United States Patent 7,468,248 (METHODS AND SYSTEMS FOR INFERRING BOVINE TRAITS) - sequence listing, part 12

SEQ ID NO: 42297 - DNA, 852 bp, Bovine  19866881210809
ctcactgtggttatcaatcgctgacagttgacagtttaattttacaccacaagtacctcattacttgtgtaggcacttgaagaacatgtgggcactggatcggatcagtgatcaatgacaaaggtgcagagggtataagcggtagcagtaaaagtgaaggtctccgtgcatgagttggcagtggtggggatacatgacagggggagtttaactgacaaacagtctgtcaggttgaaaagaatggagatttgccagggagctagctgtagattataacatatatctcttgacttgagggaaaggaagaggggaaagcccctacccgaagcagagccttcctttcttgaaaatgcttaggcaaatttaatgaatgttcaagactataaatttttattctacaagcgtttatctcacgacatagatccattcaggtgtctaggaatttaagatcaagaggatgcagtgatgctattttataaagatatatgtgtgtgtgtgtatatgtgtgtgtgtgtgtgtgtgtgtgtgtgtgtatgtgggtacatataccaaccccaccaaagcagaccattgctgttttagattgtcctgcagcagctgatggtagctattcaataataagaaagttattccatatgagcccttttattcttaccaatacaattcacgatcaacacctctaaaatagattgccttagagtggtagggaaaaaaatccattctttcaagtgtcttttatagtggtattttaataaattccttgtaatgtgcctctctcctcaaccttttattttcaagaaaaaagtttttgatagtcttttccttataaaaagttttttgttagtgttgtta

SEQ ID NO: 42298 - DNA, 1414 bp, Bovine  19866881222741
actcagacctgggatacatgcccatccctgaaccaaatcagaacccattccctggatcttggaaggatgttatgttaacataggaaagccagctgctagagcatataaattccaaattctctctggcttcataaaacaaacatttatttctcagtcatgttatagaccagtgtaaatgttcctaatcctaatgattggttcacctccaagaggttattcagagctcttagtgtcttagaattcgtgcatcttccacactgaactcccaaagttactgcttcttaactatgttagcccgaagtgacacgcatcacttctgctcacatcccattggtgagtgctagtcacatggcctctcctaggtcacgagagatgtgaaatgtggtccttggctgggcatctgctccctagcatgcactccacactgtggaagggagcatgagcctttgatggtcagctagctgactctgccacagatgttaatcctacccatgtggtacagaaggagaggaaaggagtgagtgttgggaggcaaccaaccatgtcagccacgccaggggacctggtctttgtgtcagtgaggcattgatttgtgcagaagcagatgtgtcagccctccattgcctactgaatctaatttacgtgatcagaatccttctatcacttaaaaataattgccaagaatattttaaactagtaaataaatgaattcttgtaagatgtcaggttcctctttcttgaggaacagataagatttgagactcaggtgggctttgaggcagggtgctccttctcgggatcatggtgcatgcctgcggggatgggacactgtctgttacatgcaggagggctgctggggatgaagtgaggagaatgtgtgcatgagggctttgtgcagcatgatagctaaactattaagtccacactggaggagtcgagaaataagacaaagcataagagtgagagatgacacgtacttaggtgggagaaggctttgacatttcagaaatgagtccagatgccaatagaagacttctaaatgctctgagatcataggctgtcatggaaagaaacacagttcactataattatctattacatgagagttttaactatccctcggcatagttcttttctgatccttcaggtgtcagattaaatatttcttctctggagagaacttccttgatcagagtttcctctaccctgccattgcttctttattactgaactctatgtggaaattgtaatcatttggtacttgtttaaaatctgtctttcatgtgccgtgggttatgcatgtgccagtggctatgtgtcctttgactccagttgcatacaattaccttgcactctgtaggaataatttcaaagaatcggcattgaagtattttatagaccaaaattataaaca

SEQ ID NO: 42299 - DNA, 736 bp, Bovine  19866881258624
accactacttttggtcgacattcatcatctttcccctgtattactgccgtggcctcctctctggacctgtgcctccaagctccccctactctgatcattcatttattgtggtcatgtcactgccatgtgtaaaagtctccagtgcctttaagatatagtccacattgattagcttcataatcagatcctgcctccctctcctgtcttattcttttttcattcattcatcccacaaataagcattgagcatctagtatgtatcaggcactattttagacactagaggtaaggcagaaaacactgctatgtcttcatcaagccccacacccacgtgctacaatacacagcacacacatctcacacacactctcacaaatacacacactgacacacataaacacacctgatttccagcaacttgaaatctcaacattttctacatgacccatattctttcaagctttcatataatacctccactggctgaaagaatcttttccttcctctcagacatatttgcactccctatagactcaacactcagatttaacctccaaggcctgtaggaattccccacgcagacttagacatactcccttctctccaagacacaccactttgaacacatatctttcacatggacatcttttgtacatgtgtgtctccatcattaaacactgagtcctttgagagtagggtcccatctccttcagtatatatcttcaacaattttttt

SEQ ID NO: 42300 - DNA, 803 bp, Bovine  19866881271392
acctgtaacttgcctttgggtttctttgtgtgttaactgttctgagtattgccagaatactggcaatggttttggtttttgagatgatgatactcatctgtgggatgctcaggaatcatgagagtcctcatagagatagatactcacagctttaggacagttcagggttcatgacagctcatcagtcacagagcagtgattttacctttaacttctaagatccctttaataggaaccactgttttagttgtccaagttttttctgacgacccaagatccatccattaccagtcctgattagagatcatcagacttttcccaggaggtggctcactatgaatgaggagattctccaggcaagaacactggagtgggttgccatttccttctccaatgcatgaaagtgaaaagtgaaagtgaagtcgcttagtcacgtccaactcttagcgaccccatggactgcagcctacaggctcctccatccatgggattttccaggcaagagttctggagtggggtgccattgccttctccgaacatggatctaaacatccctaaattgtgggggtagtgctgtttttgtataactttatttggttgcagaagggaatccaagattacacagagagtatttttaagagctgcctctgataattgtcgacaatgctagtcattattttctgacttgagttctctggagctaaccttgtaatgacacttagcccatttaaaattctttattttttcccgcgcctcttcagttgtgtaattgttccattcacattatggagatatgtcatgtc

SEQ ID NO: 42301 - DNA, 1226 bp, Bovine  19866881296791
ctcatgcttatcatagtcaaagttaaacctgcttaaaataaaatccatcaggatgctcgttttgtttaccctgtgctacactacaaagaggaagcaacccaggacattgttctttgctgctgagaacaattccatttccttcctgttggctgattttatttttcttgataacagcatgtaatcatggaaatttttttcaagcagatttgtactataaaactgagtctctcctgcagcaacataagatccttctgcagagcaaggcagccaagaacagtacatttagagaagggcatttgctttaatgtgtgtgacaaacttcctgttgccttttaatgttctgttgctagaacagcttaactggataattaattaaatgagcacactcacaggaaatatttttaaataaaattttggaataaagtgtgacataccgaaagaaaaatatacaaatcatgagtgtgtggcttggtgaattatcacaaagtgaacacacccgtgtgacatcaaccagacctagaagtagaacagcagcacccagaagcctccagtgcccacctagccacctgactcttccctttcccaccatgctcacctctgcctgttttcaatgtcctataaaatgaaacttacgtactcttttatgctgaacttttcaatattgagggaatccgtattctgtgtagcaacagttccttcactgtctttgcacagatgattaatcacatcctggatgggagagagaaccacgcagactagtggaggtttccctcagactaggactccaagtgctgcaccattgccttggctccctgacctaacactggatgaacagacgcaccagtatccaccatggtggatagaataattccctgagactctctgaccattaaacctcagtccctgttaagaagccttctgttgcctttcttgtgaattcaacaagtatttactgagcacatccaatgtgtgaatcactgtgctgtgtgaggactgcaggaatcacattcccaagaaggagcaatgagatgagtacaaaacaaaccatcgttcaagggctcaatctgattagaagtgataagagaatacaaagtatgttggagttttgcagtcagaggaaatcacattcagggaatagaaaaagactgcataagtctttggggtccagtgggattattaggttacatgttggagtaaaaacaagtagaaaacaaagacagataaga

SEQ ID NO: 42302 - DNA, 1360 bp, Bovine  19866881302501
ataaatactatttgctattgtcatgatcatcctcatcattttcatcatcagtattttattctcttcctctcttcttcaaccatgattttcagagccgctgatggaggaaaaaatatatttggcagccccaacagattgaattcctttatttactcaatcatccattcccatatatgaactgagagcctgccaaattcagggcttgaacgtggggaataagaaattagttagcagcaattagctcagctctcttaatcagaagtgattaagagagtgtagagaatatgttctgagggttcagaatggcacgtgatttcttcatgtgggaggagatgaaactgggatccccttttgggaaatgcagtcatcaatgcattctgggaaaatatagtagggaccaaataaatgaactgagttgaattgaataattctctatgccccctccaggcagtgccataaaggtagagaggaagtaccaaatttcagaaacagttaggctgaataggtcttcctgggttagcctgggcccctaacagataccgagaatgaaatttctatggggaaacgtactcttgaattctgaacaccacacacaagtggtcttttgacttgctgcttgtttgtgagagggggctggttggaattcatttttgatttgaaaggaaaatgagtagagcctgaaaccgcatatttacatggtttctcgtgtgtcatcttactattgccatatctcaaatatacccagacattttacagaagcttaaacaatactgtccagctctggttttgctcctttcccaccaattcgcttttagcttatctggactttggtatgtcatttggaaattggactacgttttccttgcttgcattgaaaaaagaaatgattaactgaaataacactgcacattactcagatttaattatgtttgtaatacatcacccagtgatatggggcaacttcttgccgttcgttttccatcatgcatttctcataacatatggtcctcatgaaatagttttgattcagagtccccagtagcatatggcaaaaaaaaaaaaaaaaaaaaagcccctcaagtcaaatgcaaagtaaaggccagcctcgttgccccagaggaacctccatcgactgctagccagaaagctgggaatctgaattggtgtcagggtttcactcatcatgaagattttacattttggtttgggactttggagcatgaggttctggatggtaaaagtcagaagagatatggcttttgtaatgtctgccgagattcctgtgtcgataaggtcagggagaaagttaatagatttttatcttctcatcacatgaacttaatataggggcaactgtttg

SEQ ID NO: 42303 - DNA, 1665 bp, Bovine  19866881337428
tgtgttccgtaagaaagaaaggaaagttcaagaatagcctcacagagaaaacattttaataaaattttgaaacataaaataggtgattacccagcaaataataggggagtggacatttgatcctggcagagggcatagaacatcctgagttaggaaagtatgagtagtctgtgaaaatgtcagtttatgtagttgatttgttctatacggtgtgtttaaagctaaataaattgaggcactgattttattacaatagtaagtgtcatctcattttttgaggcatatggtgaattgaagtagacattctctatcaaggaataagtcaatgattctacttattaatgaatggaatgagggtgtaatgtaatgatttataaaccaaatgtgttttctctattaaatgaaattaatgatttcactgcagcactggtaatggctaacattgagaacgtgcattccaggcaccatggtaaacaatctgtatgcttctcatttagttctagaaacccctatgaaatagataccccattttagaaatatactaaaattaagtaacttacccaatactgtgtagctaattaagtggtagaggtgatatttgaacccatctacctgaatgtgaatttctcattaccaatttgattggttaataatcttaacttttgtctcatgggctggagcagctgtgcagaagtaacagagccagatgttcctgctgattctatcctcttctgtaactgcttgtcaagggaagaattgttttttctcctaaagttctgtggtttattttttaaattatttatttctttattaagaacatttttttcactaaagcaaagaaaactttgagaacgcaaagaaacgagaagactttgaaaatgatgcagaagaaaatgcaaattactaatgatgttgcctcaggaataattacattaccatttgagactatatatttaagtatctatatgtgtacatatgtactcttaatatatggagagctataatatgaactgtagtatgaaatgctgctcttcaattaacatacagtgagtaagatgtattttcattttcatactaaattgtaatgaatgatcctgatagaaaatctggaaattatataagtgaaaaataaagaaattagaatattttcattataaatttttgtaagaaagtctgaagtagaatgaaaatgaaagattccccccctcattcagatactcaacactactcttaaatcgcactttctgctcataagtagttaattattaagggtctcatttcagatttttacttgtttacatatatgtgtgtatgtaaacagatattcatatatgtatgtgtagtagatattaatgctagattctttggggacatttcagacagttgcacaattgtatgctatatagctcttctgaacaagaaaaagctttttggcaatgttcatgggatggtcctaattgggcatcagaaagaagcccagccaagcaggtcaaaacacaggtaggcaaaacataatgatcagaaataagtggtatttggccaggaaggaagtgtctagttagcaagtgtgtgatgcgttggagcaggcaccagtggaggtagaaaggtggataggtaccagtaacaggcccagctggtggcagtagacctagcgtctaggttgtg

SEQ ID NO: 42304 - DNA, 1208 bp, Bovine  19866881347228
ctttataggcagtgaggaatttctggcaactttagaggagaaataatgatcagttgtttggaataaggggggaaattgctaggcatgaggttttggagagttaatacatccttgggcagtctagggagatgacaaatctttctgggattactggcagtgtgagtgtcaaaaacacgttgtgaatatgatcttatttactaggcttgatatttttgatatttagattttaaatgctataacatcttttatttttttccctaacattattcattaaaaaaaaacaaaactctcagtacattgggattcattccactctcaatggaaaatcttcaggatttcattactcaggtcattatataataacattaagtaggtttacacagtagaaaggaaagaagtgataaaagattttggctatgtgaaatctaccagttagctgtagaagaatggagcaaatattctctcatttgcttaagacacttaaaacttgtccagtatattagaaaaaatgtatgctggttattattagaagaatagggtgaaatgctgtatcatttgaatattttgagaaaaaattttatagtcttattgtaataaattccaactggctttaccaatatgtccatttatagaatttatattgataatatgaagttctgtgtcaggatagtaattgttttgtagaaatacaagttcttaagattcataggtaagatggaaataaggttctccttcacatgtttagaagatgttatttgattttaattttttaattcttctttccctttccagctaatatttcagctatataacatatctggtttgaatgatcttgtaatactgctgcttgctgaagaagattctgaattttacctattttcatttatttatttagaattaatttggagtagcatcaggagatggaaaaaatgaaaatatggcaatgtgtaaaactgattccttcttttttttcccccatttataaatgttattaatagggctccaagatagaattcagattccttagtcttcactagcataaattttctatttaatttattgttaattattaatgattattctgatttagcaattgtattttcaggcaaagatagtttaatattattttttctgaaattcacgaggtagtttattaatttgtcttttaaaagggtttgttcttactttctacttattttcgtagaatt

SEQ ID NO: 42305 - DNA, 1196 bp, Bovine  19866881363929
tagatacaaactttacttttataatacagaaaatagctacacaccatcttaagtagtattcaatacagaatataaaaaaagtcaaaattcaactgagctaagtaggtattatacaaaacatcagaaagcagataatgaataccaaaaacctctaattactggaagcccttttaaaaagtttaaaaacacctcataatgcagcctcaaaaatcacaccattacctttctgacttaatctgagaagtcctacaggtttgtagttcctaataatccatggctccatggccaactggttcagtagtcactacactacttaacagactcattcaatactgagaacaacaaagctcagtggatttatcaaaaaggggagaattcgagaattcacattttctcaaccaattaaaaaaatgccattaatatcaacatctgggaaacaaatctgataaggttacatgtgtggcgtatttacacttaattgattataggctgttcaaaatcagacaatactgacatggagccatttgtggtggagtcattagtttcaagccattcatgtaccttgaaacgaactcaattatttaggcgttttcaaccttgttagttcaggctggctatgaattgcccagaactgcttaattgcaaccccatatttcatggcatttgtagggctccatacctgtaggtgtttatgtcgttctggatagtaccacggtactccactcctatcttttagcatcctataccaacataaaatgccactggatttttcttttttgggacagttagtcaaagcttaattatagtcagatcttttacacatttgacaaaaataacttgttctaatttatgaaaaaaatgtaataggcaataaaatattaatttttataaaataagacaaatatgtgcaaattattttaagattttgttgactactggtacaagagtaaaactcaaaccagatgagtagcttgcaatcttctctataagttagtgtcctgtaattatgctttttaaataattctgctttttaaagccatgtcagacttctgcaagatatacatgtccatccaccacaaatggttccacatctatattgtctgattttgaacaacctattgaattaggtctgaatattccacacatgtagcctcatccagtatgtttcccaaatgtagatattaagggattgtctt

SEQ ID NO: 42306 - DNA, 1817 bp, Bovine  19866881366296
gttatttcaataataattatggaggctgccaaactctctttacgctgctaaaaaacaaacaaaaaataaacctgccatcataacacagtaaaaatcacaacaataagaggttttcatgatatcttaaaactcagtttggtgtttcttgaaggattggtggacgacttgttcagaacttacagccaaagaaactcaattaatggtcactactatcaattatttttacacatttcaacagtgtttattaagaacccacgagcttttcataaaagaatgttgtcaacttggattttaatatttcattaaaagaggccaccagttcacctttgtaagtgttgattcaataggggggctaattaaataattatgattgatgaattttatgtgtattttttaaaccaaggttataaggcagctggcagagacttttgtgagtcttttaaatgtttcccattatccaaatctcttctctatatatctatctttataattttctcatccccaaatcaatttcaggaaagatccaaaaacgagcacgtcttttttttttctttctttttttctttatttaaagggggctgaagtaaaaagcaaaaaaaaaaaaaaaaaagtgaaatcaccaagaaaaccctaaacaaataaagtgcaaacacagagtgacaagcacactcagacccagattggttatggatgagacgacaagtatatgatgaaattaatgaccctctgtcaactttttagatctcacttttaaagagaatggaccaaaaatcaatagcccccaaaccaccagtactccagtgaaccagtctttcatttatcttgctgttggcactcagatagaaatgcagccaagcacagcacagagccttcacggggagtcatcatcacaggccgtgtttgagcaccccagttaagggtcaaaggtgtgcgtcaaggcttctgtgagaaggacccacttctaaatacccatattggtattcactttattcagctggaagcccatttgggatatacatatcaagtagtttggcttttgaaatttacctcttaggctgatgggttgctagccaccagtaacaatgatggccagggatttttttctattcctgttatataccttgatttttcatggttatctctctagtgctcagatggcagcaaaatgcaacttgagattgaagtggagtagacaaacattttaaaaaatacaagtttgtacagatacatggctttatatcacatttgtatattcttaagagatgtagtttttgaagtgttagtcactcagtcatgtccgactctttgcaactccatgaactgtaacctgccaggctcctctgtccataggattttccaggcaagaatactggagtggttgccattacctagaatggaatcagataaagtgtaaagattatattcagaatactataagctcaaatcaaggtagattcaataattaagcaaaagaagaaaacaatgaaattgccagatgagttgtaatagagcttgtgattcttaatgaggattcttagcagtcatcacttacctccaagactgaattttctagaaataaaattggttagtacatcacgaggattttcctacactgagaaagccatatgaaaatgtgaaagataaattaatcccaaccaagtgttcaatagcactgttaacagctgaggccaaagtgaaatgaaatgatgtcattatgttaaaatggatgtcaatgcacacagaaaaaatcagtgtaaaaccagagagatcacattttgatgataatctaagacaagcaaagtgctagccatttatct

SEQ ID NO: 42307 - DNA, 883 bp, Bovine  19866881370179
aaatcattttcccatctgaagagcttaccccaggacatatttttttaagagtaggttacactgttcaaagcagagtgcaatcagtgttcatcatcagagtctgagggagccacaaaagtgaaggaggcagttttgtggttttgttgctggtgggagctcctagtgctgcctgaaaagggagaagcacacgccatccaggttttgtgagagattgaaacttcaattatttatttcaaagatgaggaaaataaaatgacatagtgttgcacagatatttagaatcaagtcttatgaggcatggtacttgatcaaataaatcataacttttaactgtgagctctatttttgagccccaatgctcggtaaccaggaagtgctcaaatactgtctttttaaaagaatgaatgaattgcgtggtatggttgagggcaaaggaacaatcatagaatctagtgccttaaacagatattcataaaagttttaatgcttgaactgcagaattacatgttctgactatagctctctattctatttaaataagaaaaaagagatatgtatgcttatgtttctgaatatggattaatttctgtgattactctatttactcttacttctccagcaatattattgtaggtaggtaatattatataataagagtaataaatgtatatgtcttaaataactatatttaacttgatattttatgtcattttgtgactgtgcttatcgtaagtagttattttttatttcctccttaaactgaaaatacgttaaagcagagatttttataacttattcctgggtagaaattccagactaaacttgtgtggatgacaagtcctgagactggctaagccaataggattggaattgggcacaggag

SEQ ID NO: 42308 - DNA, 1060 bp, Bovine  19866881383865
tttatgtttatcagttaagaaaatgtactcaaaatttgccttctgtttgaggaagttaactctcaaaaataaaaataaaaaagagagagagattcctgttttaaaaaaatctgtgtcttaatcactcaggcttgatgtaaattaatatagaacccctgctatcttgtttttattttactttgtgttcacttttgatgaccatcaaatcataaacacatgccttccctaaaagagatgtttgctgctattctcttttggatggtgcaaataagtctgtaaaacaaatagatgtcttctagctccttcttccttcttttatacttattaaaatgaaaatccaaagcagaatgcctagaagtatattgcaatttgacaggatttcctttgtgtgcctatgagaaaatatgactagtgaaaaaggaagtagatatagtatgtgcatgtgatgctattttattggtatctgttgcacccattgcaatgagactcttgggatgttgaacctaaattaaaataatcataaataatgtcaaacaataataaataaaactcaacttccaccctctccctgttttcccttttctcttttctttcactgggaaaatacacaagtaaataatatcaagcagattggccacttttgggaaaggaagcacctgggctcagctgggcatgcaccccctgcctgcccccacccctccttcccacgccatatgcttggagttttggtgtcctgggtagagggcaagcagaaaagggtactggatagagaatgtagacttgcaaaatttcctgtatattcacttactgggcttaaaaaattatcttagtaaattagatttattgaaattaactattttttcttaaatgtctcaaatgtggagatgcaaaattacatctaggctaaattttgtctgataaatttgtcaaaaccactgagataaggagttgtttggagcctttcctgtggaattccatctccagcaacattgaaccattgttcaaagggactgtgtaataccttatgaagccaagtatctgagttaagattaccaggata

SEQ ID NO: 42309 - DNA, 1760 bp, Bovine  19866881427945
gaaaaatccattaagagaacagggaaacttgcctggaagacgtactagagaaaactattaagatatagatgcagaggtggggcaaggaagaactattggccttagatttctcaagggaagccagaaactgattccagcaaaatagaaagttcccaagagaaaaaacattaatgttaaaggaacaccaggtcacttcagaatgagcaataggaaattaaaccaacattcaatgggctccatccagagtagagtgtaagacaggaaactcatatgaaatctaacaagcaacactgacaaagaaagaattgaggaatgagaaaccagaggaattctccttttgtccaccatgttataaacttttactaagagaaatatatacaaataaaaacgtctttaatgtctgcccatgatttgacctgacacacacatgttacttatgtttaagaactaggatggcacataccttgtgccaagtaatgtaaatgtaaatgtaaatatcaaggtaatcatgccactcccaaagacatggatttaattttctgagttttcttacatagactactatctattttattgggtatcatgtttcccaatattctgcaaactcctgacacatatcaatttcttttctttctttccattgtattatggggttttactttattcacttctacagatacccagatataattaaaggcctaagcatctagatactattgcccaaacaaacttaatattaaaagaaataaattgtgactataatttttttttctaatggatatggaaaatggaacagaaacgagattacattaaaaaaaaaggtgcaattttataatgctgaagattttgaatgttcatgattaggaggaaagtaataaacctgaaaaatggatttgaagattttgtgttcatgggctaaaggaatataaactattctttgccatgttttgattcctaccatggtatcatgaaggcccaatgggacaggaggctgaggatatcactctgtagtgtccaaactctacagctcactggcagctagctgtgacaagtcctttaacctcaccatgcatcagcttctattattggaaaaaggagagatagctgaggtctcaatgcctgtcttctttggattcatgtgaaaataaaatgcaagagagttccagaaaaatatctacttttgctttattgactacaccaaagcctttaactgtatggatcacaacaaactgtggaaaattcttaaagagatgggaataccaggccatttgacttgcccccttagaaatctgtatacagaactggacatggaacaacagactggttcccaattggtaaaggagtacatcaagcctgtatattttcaccctattatttagcttatatgcagagtacatcatgtgaaatgccgagctggatgaagcacaagctggaatcaagattgccaggagaaatatcaataacctcagatatgcagatgacaccacccttatggcagaaagtgaagaactgaagagcctcaatgaaatggaaagaggagagtgaaaaagttggcttaaaactcaacattcagaaaacttagatcatggcatccgagcccatcacttcatggcaaatagatggagaaacagtggaaacagtgacagactttatttttttgggctccaaaatcactgcagatggtgattgcagccatgaaattaaaagacgcttgctccttaagaaaagttagaccaacctagacagcatattaaaaagca

SEQ ID NO: 42310 - DNA, 1181 bp, Bovine  19866881447979
taatttgcctctagaatttggattctaatcttgtcctccagggtttattttgccccagccttttgatttttctccactcaatccccatactacctttagctagtagctatttttgaaaacttacattctgaaacaggaaaatatgcttagtccatgaagttataactttacagaatgggtttcttacattttgtagttcatatgatcagatttacttggatttaaacaaataatgtttcttgaacatttatctttcttgaaaaatcaaattttaaaattagcatgaatcctcactcatctttaaggaactttggagaggtgtgactcattccttcctgcctgtccagatttggaatgctctggcttagaagcctccacacagccatgacttaacacaggcttaatcagggacaaagcacatcttcctcccggggtttccaagaaataaattgccaatgagtaggaatttcctggagaaggaaatggcaacccactccggtgttcttgcctggagaatcccaaggacggggagcctggtgggctgccatctatggggtcgcacagagttggacacgactgaagcgacttagcagcagcagcagcagcagcagcagcaggaatttcctgctgcccttgtggggcttaggatgagcaataattctctagaagtgggtagaatgttgaagcagtaaacatgcagattgcatgctgtccccaccctgttcttcatacacgccgcctgagataatagtcctatagagaaaccgcagtgttcccaagtacttctcacaagctccgctttgcttagagaccaaccaggatgcacaaaagacatcactgatactgcctagataattattgactagttttagtattaatggtgaggattgtattcattttctcttcctggtggtgtttcactgatagaggttgcttatttctatgtagaagcatgatggttttcactctttgcgatgaaaacttcagcgacccagacaaaggtaatatagggctttaacattttgaaacattccctttaaaattcatctctgtaatttggaatgttcaggtgggggcagatggacaaaattgtatagtatagtttgtatacctctgctttttgacagatgttgtgaattgtaaaggtgccttatttgcggcaaaggggtactagggagatg

SEQ ID NO: 42311 - DNA, 1550 bp, Bovine  19866881475793
aaggcctcaagtatttctcttttaaagccttcagtgggtcagttagttttcttttctctactctgaaaggttaaaattagattttggagaagaatcagtctcacagatcaatccctgcataatcgctgacatttaaaacagctaacaataaagcaaatggtaggttgccaggaagcacactaataaaaaaataaagacatctgtttcagttcttgaagaatactcgtggcacttctaggtgctcaaagaaagaaggtcctttttaaaatggaaaaatcctattgaatgagtagtaacactaataataatgagaaggaaatgttaaaaacgaagtcatgaaatcagaggcatcgctcacaagtttgtatctttccattgctaatgtagacagaaatgctggctgatttttcaaaagcaggtgaagaaggttcactttgaaaattaaagtcattttctatcaataaggtgctcccacaaatcatcattctattttttcacatttatgaatcccagcaggagactttctaagcctactacacaccctgctagccgctgctgctgataaatagggtaggtgaaagaggggtggtcagaagaggataatgaactttttgaagataatttagaagtgtttgccattctattttttattaagcatataggaaatgacatcgtggattgaattaacttctttcaccaactgttggtgatttcattttaaaaaatattcagtaagtatacttttaaaatagtttcaaactgaaaagaagcagcttctgtgctaagtcgcttcagttgtgtccaactctttgcaaccctacggactgcggcctgccaggctcatctgtccctgggattctccagacaggaataatggagtgggttgctgtgccctccttcaggggaatcctcctgactcagggatgaaagccgggtcacctgcacctcctgcattggcagccgggctctttacctctagcgccacctgggaagcccagaagcagcttcgacttcttgaagctgcgtatatgtcaggctttacatatactctttcacttattgaaatcagtgccgttatacccattttatggatgaataaaactttcagacatgagaaagctgagatttcaacccgggtcttacactaaaactgggtttaggtcttttatgagtttggtgaaatgagatgcctaaagccacaagtgaaactgttgtaccagagagaagactgagattagagtaagcaggtggaaggctgggagatgatggagaagagtggaaggggtatgcggatgaactggaagttcattgccattgggagggtctaagttagatatgcagatgacaccacccttatggcagaaagtgaagaggaactaaaaagcctcttgatgagagtgaaagaggagagtgaaaaagttggcttaaagctcaacactcagaaaacaaagatcatggcatccggtcccatcacttcatgggaaatagatgaggaaacagtggaaacagtgtcagactttatttttgggggctccaaaatcactgcagat

SEQ ID NO: 42312 - DNA, 812 bp, Bovine  19866881621162
gctcctctcccactgggttacacaggatatgagctggatcctggcggcttctgaaacaagaatgagagaagctcttgtgaagtgaatttaaagagagagaaaaagcctttctctggcattgaagtcactgcaagtttggcttgtctaactgggagtagaccttggctcacagaactgagagatagctaaacaaagatttgttcaatttgataaactccctggctgagacagtcctgccaactttctttctaaagcaactttcacagctgaattataaaaccttgaaaatcaaggatttgtaatggaaatgctgacagatgcaactaacgtgaagttgtaccaactaagcgttgctatcatattttataactgtctgagaagcttatagaaaggaatggtacatttgcttcatgggatccatttcctttgctaaaaactaccaaatggcctcatggtatatactctgtcacacttagaattgtcttgatactgttttttcataaaaagagaaatgttgaaactaccaacttccggcaaggcttgaaagcaactgttgcctcatcctatattctggattgaagtttgttaaagaaaactcagaccctgccattggtgcctcaatattcattatttatgtgtccttggaaaactgctctagattttagcaattttacgaaaaaaagactttcataaagatgaactttctttgtaacttttgagcaaatggaaaattttattctaatatcaatgtgtccactgggtgcaagaaagttaaagaaaatttcggtgcaaagtgtcaccatcatcttaaa

SEQ ID NO: 42313 - DNA, 1443 bp, Bovine  19866881639074
ataaggaaccccagttaaaatagagactgtgtcaaagataacaagcaaattttaactagtatacataacctgattttttttcattcattatttttgtaatgcttttatgttaaagtcaagtggcagatttttttcttagattcattttacatgctagacttgtaggtgtcacatgagactttcattcaaagcaatcaaatttagttacctatgaattttaataggttatagcagtaattaatagtatagcctatctttttttcttttaaattttggccttcagtggtcatctgccaatctctatattttacaaataggaagacagtgggttgaatcatttaacaaaactagatcttacaggacactggtggcaaggccaggctggaaccaaaatctctcatacctagtctggggttctttggaagtaaacacttaatttttttaagaattcttaaggagtctggcatctaggtactagacttatttaacaactttctcattttgccttctcagccttctttcctaaagatctaaagaatttagattcttttcatcttataggtcctaacatataaatgttttcaatgttcttctttcaaatgcatttccttaagtcttgtaattcccatagtgcccacaaaagcactcagtagataatttatataactgcttgagcacaccttggttcttccccattatcaagacttctgctgtgctagctccatgtcattttcttaccgagtccagtgagctgcagtctgttcaacaggcttgcttcctatatgtacatcttgtagaagtgagttcaggtgtatctctaacaactttgacataattgggggtttttttagtcttttttcttttttttgatgtgggccacttttaaagtctttattgaatttgttacaatagttcttctgttatatgttttggttttttggctgtgaggcatatgggatcttagtccatatgcctcaaccagggatcaagattgaacctgtcttttggaagacaaaaatttaaccactggacatccaaggaagtccctatcatgtaggtttttcaggtcatcgtttcatagaaatggctctttgggtgtctagttcttccctcatcagcaacactgactgccacacctcatgctcaacacacaaagactcaccttcaggcctacagtttagctctccctcccaagaagatcccagaactctagccctacagtttcaatttcttgccaccagagggtaattctgaattttttaggcttaatcctaactcttcacttcttttcttcctcatccctgtgagagatctctatacaataagcctaagaacagatcatttccagggtccctatcccaatcctcctgtcttgaaaaaagaaacatcattctcctgatccctaatttttaaactttgagagtcctttcttatccctaccta

SEQ ID NO: 42314 - DNA, 756 bp, Bovine  19866881733567
agcatatctttccttttggttttatgacctctttttcttaatgcttaggaagaaaagagctttgccaaacatttttttttccctctggcattagtgtcttctggaaaatgaaaatggaaatggcccagtttctcttactaaagtcttcagatatttatatatgtagtttaatagtttcatcctgaaaaaataaagcacctttccacatttttttaaaggatagaaatgaaaagttaccagtttactatcaatggaaagtagaacttctttggtgacatacacatgtgtatgtgcatatattcaaatagacacagacaaaattgctaaaatgaagagaggacagcaggcaggaactatgcgtgcaattcatgtctatgatcgattcaaactaaaggagactaagcatgtcatgtttttgtttgtggcagttaagtccttttagtttttgctaataatgggaccactctgcagaaggtaaaataataaaaatgttttcactgtctatttctgtcctgagattactattctgtgagtttatggaaaacatttaaagaagcctgaaataacccaaatataatcaaaggagagcagagactgtgttttgtgagtgtgcaaagcatagcgctcgttcaatctagtctatgatgagatatttgttcagtcctaggcacaatcccacgactcaacttcctagagtgtcaaatgatgtttcttatttgtctgacacttctcttctctgacaacaaatattgctca

SEQ ID NO: 42315 - DNA, 839 bp, Bovine  19866881743193
ctcttatgaaaatatggctttattctcttttttaaactgaactactttatccctttacacttggtttgaagaaagtcctaaaaattagaaaatgcaagtgatcactttgaaagaaaaaacaaaggggcaattagatttatcatcattgaaatagtggcagaatccaaatgaaattccttggagtatttgggtgtcatggttaataattttgaaacatacaacttcaactaaaactgaaggagggaccctcaactgtccacagatccacacaagaacacgttttataaatacacactcatgccttgttgctggctcaattctgtctttcagtaaagccattctccttcaccacaagtgcacacaaatgtcttgtgtttcttcatgtagcctgttttggtgtttatcccactgagctcaacgaaacctccagaaccaccaggcaccttgagctagtgtgcactcaggtgcaactgaacatacctggaccatccaacaacatccaacatgtttatttaatacatcttcctgtataaggaagtgagtgactgatagcattgattaaaaccagccaagcataatggtcactggcattcaacatccaaactttctaaaacacagcgcaatccccgtctgaaaacctactctgcattttttacatttctggttgagacatctattttttaacaattcattttctgttttccctccatgctttctctggaatttccagcagtccctttgcatgaaaaggttggtacaagcattcatgttgagggttccagaaaaccaaaagatgaaagaaactagcaatattaaagggctctctctccaggcagctg

SEQ ID NO: 42316 - DNA, 2622 bp, Bovine  19866881994756
tttttatttttaatttttgttgaaatagagttaatttgcaatattgtattcatttcggtgtacagtaaagtgattccattttataaatatatatattcttttttttacattttttttttttttgcattataggttactacaagacattcagtatagttccctatgctatatagtaggttcttgttggttatatattttgtatatagtaatgtgtatatttcaaccccaaactcttaatttatccccctcttcctctcgcgtttggtagccataagtttgttttctgtgtctgtgagtctatttctattttttataaaagttcatttgtatccttttcttagatccatatataagtgatcccatatgatatttgtctttttctctctggtttactacacttagaatgataatctctaggttcatgcatgttgctgtagcattagttcattttttatggctgagtaatattccattgattacatgtaccacatctgctttatccacttctgtgtcaatggacatttaggttgctttcgtgccatgcttgagaccacagagcaggcagaagcagcactacagagcctgccaatggctttccttagctggatcatcctctgaatataggtcagttccaagccctgcttactttcttcagaactaaaagtttggagccttgtgaggcagtcctcagtctttcaaatcaagagtcaaatttaggggcttgttgcttctttaaactgttttatgttaaatattaagcaaaaaaaaaaaaaaagagagagccagtaatggatgcctcagatatgctgatatgcatccagttgtctctaataatgctttgctagtcttgcatcaagtgcttattttttcttaaattattgtgggttagaaggaggtcttttggagtactgaccccccaatcccattcttttctttttctttccacggctgtcattgtcctgaatttggtgtttagctatcccacgcatgttttcatactgttaccacccgccctgtatgtggccataatataccatggttttgcatgttttaaagtttatttaagtggaaccaactatttatactatcctgaactcctttccttacccactattatgcttttgtgatttatctatgatgttccagataggtcaaatccattcatttttattgctttgtaatatcctggtataggaaaatagcataatttatttactcactgatggaaatataagttctttttaatttttcactattatgaacaatgccagagtgaacattattacaatttttatatgcctgcatgtagtttaagtacataccacattttcagttttattagatgttttcaagttgctttttaaagtcattttgccaattttttacttttaccagttgtgtatgaaaattctagcattcatacatcctcacaacaaaatgtataaaacttatattttgttattcttatgacatagaattatgtttggttattttaattttatgtgattactagagaagattgaatatttttttcattttatgctatttggctttctttttctgaattatctgtacatattattttccttttcaaaaattaaagtcatttgtatttttaaaatttatttgtgtggattctttataaattatttgatgttttttctaaaaccccctttttattaaaaaaaaaaataatatacccacaccagggaatatagaaaataaagaagtcaccaataatttcactgccctaaccaaaatattgattaattttgtcctatttattgctagtctgtttttttctcttatgatatttttgtgtagttataattacaaggtatatgtaactcatattctgaattttgcagttaattatcataagcttttttggacacagctgtatggcttttatagccagcgttctaagtagatgcatgatatattaatatcattgagtaggtctttcatttcctttttgttggacattcaggttgctttttatttttccattttataaataacattatgatgaatacttatacctaaaaagcttttgatattttaaattattttcttagaacagagccacaggagtcaggttactgggtcaaagaggatatacatttttaaaaagtaaaatgcattgcaaaaatagtttaatcagtgatgacaatctaaagaaaacagggtttaagaagactcaagggagcccggcagaggtctaagtgtctgactcaccttccttggcagtgagaaaactcacaagactatggtttctccagccactttcctgacccaaagcactactcattacagacattttctatcctgcttttgcaaccatttgactctggggtaaaaaaagagaattttccagggctaaagcttaatgcttacaaggttaaaacttataaatgatttttactgatttttaaacactggtaaaggaaagcagtctgtttattttaggacctgaaattggatatgcaagaagagggagtatctaaaggcagaaatgatgctccgactagctgacaatcttatagaacatgggcatctcttcactgcttgaaagggcttttatgttcatatgatttactctttggcattgggcagaataga

SEQ ID NO: 42317 - DNA, 811 bp, Bovine  19866880427968
gtcctatattgaatagttctaatttcatgcttagtctgaaattctaatttatgtatacattttttaaaatgtgtttgggtctgcttctgaatttccgagtctatttaattaatctgtctcttttggagtcagttttcattatcagaattttcatacactgtggtaaatgctcttccatcagtctttttcattttctgtctttctttttctggttctcacacaccacagtcttcaagtaatctttgttttgacttgaattatattaaattcagcatgatttgtcagtatcaatattttaaaatattaaatctttccatcatgaaagtcagtatgttttctacaatcattcagatatccttttgtattcctgagtagaggtttatgcttattatacaggttgcaatcattttttgataagctccttttaggcattacatttttatgactgttattaagtgtggctcttctaagtagttatagacatgttattgttttccgtaaaccaagtttataactaccaacctcattgaagcctcttattggttctttttttttttttctgttttccatttttaaaaaaatttatttattttaattagaggctaattactttacaatattgtattggttttgccatacatcaacatgaatctgccacgggtgtacacatgttcccaattctgaaccccactcccacctccctccccataccatccctctgcgtcatcccagtgcaccagccccaagcatcctgtatcctgcatcaaacctggactggcaattcgtttcttatatgacattaaacatgttt

SEQ ID NO: 42318 - DNA, 826 bp, Bovine  19866880564229
tcgatccctgggtcaggaagatcccctggagaagggaatggctacccactctagtattcttgcctggaaaattccatggacagaggagcctggcaagctacagttcatgggatcacaaaagaatcagacaggacttggagaccaaccaataacaacgtgtgtattttaccttatatgttccctctctcttatctggtacagacttcttttcaccgaggaaaagaaagttgcaggagtgaggaagggcaagcatccatgggaagtgaaggggtggtttgggaagagcctgtcaacacagcatcctgcctcctcgctgtgtgcctgacgcctcctgctaaccggtgacagtgatggatggctgtggaaattgtccaagtcaaactgctaaccagcgctatcttggatctttttgtagtttaggaaacaaagctgataagatcaaggggcaacacaatcctgggtaatgtagtgtgatctgtcctgtgtagcgtaattgggcatcacagcttaaacaggccatgatatttgtaggagtggaaaggaaaacttgctgcagtttggaagttgtttcatgttgctgttgttgtccttaagtaacaatgtgacgtgccttccttccattattatgatccaccatcgtgtgatccagaggagaaatgtctactctcagtgggctgagagtaactcagaaattaagcctagcaactagagattatcatactaagtgaagtaagccagacaaagacaaatagcaaatgccattgcttatatgcaaaatctaaaagaaaaaaagatacatataactatttacaaaacagaaatagac

SEQ ID NO: 42319 - DNA, 1689 bp, Bovine  19866880567024
aatcctggcttctgtcccatcccctgtgacactccccacttctcccccccagttgaagttgttcccaactggggatcttaaaggtgattctgatgctattggaaaaaaagaggaatgtcactgtgatggctgaaccatggttctctccttgacagactcacaggctttggggtcttatcccagctacattagaaaagaccctgaggctgggaaagattgagggcaggaaaagagggtgacagaagatgagattgtcagcatcatcaactccatggacttgagtttgagcaaattccaggagatggtgaaggaccgggaagcctggtgtgctgcagtctatggagtccccaagagtcaggcaggacatagccactgaacaacaacaactcagcttcaggaggcctgctgcctcggagacctggggtcctgtcttcactgaacacacagtgacttccagacatttccttactagagaaagatcagaagggccaggagttgaagagaaatatacataacattcttcagaccttcattactccgtaatagttttgttgaaagccttaggagacagcgcagcaagatcaggagaggggagttcatctgctatttatctaatgtgttccacatgccaggaattctgctgtacctgcaggagttaaaagcacaggttctggagtcaaaatgcctgggttcaaatcttggttcagaatcactagctgtggtagcagtgagagacttacccgctctgagcttcagttttcttatctataaaatggagctaagagcactcacttcaagacctttgaagattaaacaaggtaaaacttgaaagcaaccacttgcatagaccccagcatacattaaacacttgcatgtgagcgtgctcagtcgcttcagtcgtgtccaactcttcttgaccctatggaccatagcccgccaggctcctttgtccaggagattctccaggcaagaatactggaatggattgctgtgtcttcctcctggggaatcttccccccacagggatcaaacccatgtctctcatgtctcctgcattgtcaagcaggttcttaccactagcgccacccaggaagcccagagtaaacaattactacatgcattattcttagtatattcaatatttccaaccctacgaatcatttgttcatttttcttcacttatgcagagaatatctgagtgtttattaccagatccagaagggctatgttcttttcattacccttcctcaccctcccaggccatgagccttaaactcctgggcacaggaaagtcatttattatgttgaatgaaagattcaactttttgaagtgtcaaaagctttggatttaagctagcgtaaatcagctttcagatagcgtgggactccggagaacacacacaaccaggacgccagtgcagagctgagccctgtggctgaaggccccagcatcagagcggcacactgggtttcaccgtgatggtcaagcgaaagcttggcagtgccttctgaacatgttgcaccagggctggggagacaggagtgaccttgtctttcgttcagcaaatattgatcggtttatgttgtatatgcaaacccgtgctggtgcctgggacccaaagatgaccagcaacccatggtctctgttctccgtggctttgtgttctaacaggaacacaaatatgcaaa

SEQ ID NO: 42320 - DNA, 1005 bp, Bovine  19866880600062
atcgttgctataagtagtgcaggcagaaacaggggcaggggacacaaatagttaactttgtttttttaagaagtcagattacatagtgaaaacactaaaatagttttaataatacagtggaagggcccacagaggctagaagaaaacaagaagaatctataccatttaaaacgagaggttctggagacatgggttagagtagcaggagagaaaagggagtaaattcaaaaaaacatttcaaaggaaggaaaagcaggattggtaatggattggataaagaagatgaaagagagagaagagtcaaagacaacttcaaggtttcgagcctgtgatgttaaatggctcgtccatggtgatttttatttggtttacttttatcatctgaatgcacaaatgggattttcctacatcgagctattgtagctcccaacatgcagacttaccattgaaattacctgctatctcttcacaccctgttagtgaacaggtagtattttgatggatgttacacgatcagagaaatcctaggtcttggtggcatgcggaacatagctctctctaaatccttgttttaattaattattccttaatattcgaaatcttttgagctcttaggttaacattcttcaacctaagagaatgttaggtggttatttttaccaccttgtttgttcggaaatcattagctcttggagacgtttgtattattcgtgacgttgaaatttgttttttctttttgccatctcttgactttcttttgaagtcacactattaaacctccttaaaaatatttatgtgtgtttagttaacaaaagctcctgtaagttgaatccatgctgggaaaaggttcaggtaagctctctatataagcttacagacaattgtgtaaatctttagccattaaagagaaaggagaaaaaaagccaccctcattacactgctgtcatttactcttcatctcctgtcctctttagcagcattaagatgggatgtaaatttgccagt

SEQ ID NO: 42321 - DNA, 1257 bp, Bovine  19866880631705
ctggaatattggtattccttttctaatattcaaggaaatgggttgccatttccttctctaagggaatcttcctgacccaggtattgagctcccatctcctgcactggcaggctttggtaggcagattcattaccactgagccaccagggaagccctttctacctctccttcatatgccacgatccttccattcctcttccctccactagagtctcagtttctttcttttagttcctagatgatgtcaaacaacttctgcctggaaagttgtctccttaacttgttgactggctcacttctacccatccttttgtcttggcagaaataccctttttcaggtcgagtctctttggtcaccccaagtaaaataactttctctgtgatgccctcttacagtgtctgatgttttcctttatcctgcttgtcaggctttggtttctgtggttcattgtttaaatcttgacacttcagaggaaactccatgagggacagaaacccttcctgtctgtttacacctgtagccccagcacagcgcctgagcacagagatatttgtgaatgagggagtaaaagaaataggctgacaacagggagctggtagggtaagcttttttcctatagtctccttcagcctggaatcctttccttcagccccttaattcatcagctttacagaaagaatctgcatcattatttttgttcccctgctaggatggaatccagctgaatgcagatgctaaaatgtaaaaggaacaaaatccaacatggaaagaaatatcgaatagagaatactcccccgagtggctacacatttccactgtaagcagtaatctcattgcacagctattgaggcttgagttatttacatgcctttaatcctcttaccttctaatcaagatcattccaatagctttgcctttagacttccaattgcattatgcattcacaagtcacttctttgtcaaacgctgtattggtaccattataatctcctagggagattacaagaaaagtattcattcttctttatcctaatatagtttatctctatcaaagttgtgttttcaatttttccatgctaatgccttcatgaaattaatagtgaatttaaaatgaaatagaaattaaaaacaatcatctataggtccatgtgttatctatcacaagcctatctaattcaattggttctgacttgactacttagaagcatgtacagtttgggagtttttttcatataaattttcatctcttcttttct

SEQ ID NO: 42322 - DNA, 1299 bp, Bovine  19866880645667
ggtctgtagcccgccggctcctctgtccatggggattctccaggcaagagtactggagtgggttgccatgccctcctccaggggatcttcccaactctaggatcgaaccctggtctcctgcactgcaggtggattctttactgtctgggccaccagggaagccctagtagctgagggactttaaataagttactggttatctctgaacaccacttaccccatctgtaaaatggggctgaaaatgctcatagctccctcctgaagagtcttggggattaaatgccagtgtatataacatttttcacccacggcctgacaatgctcaagttcaataattgaaagctactgattctgcccaaggccttccttccctcacccgcagccttggacgccgaggcacaaagctaataagatggagacgtctcagactaccatggaggttgtctaatctaatctgtagaggctgctctgtggctgtttattgagttaaaagaaaataggaatctaattttagcccaaagaagagaaagctatatgacaactagagtaatgggctctggctagacagcttgatagtaactgatgatgtttccagcatttactacatggtaactgctttcccttaaaggaaaaaagtcatttaaattgactacaattgtagctgctatccattttcccaataggattactagccccacttctaatacaagcccagtgtacctgtagatggggaaccgacagtcacatctctaaggggctgagttgaactgtctgcctccctggaaccaggctccttcctaacatcagcaggatgttctgagcatcagcaggaaaactcagtggcagctgacacagcaccagttcttgcagctctgtgggaaaagggacagatgatgtggccccaagcagccccccaatgtcacctgcccagggagcggacgccacagtactgccatgccaggtgccggctgagtccagctgtgggggtgtgcagtgtcaggaggggatggccctgggctaaagacgagggaacctgggtttatcaccagctggttcccctgggccgctgcctaacagaagcagctctggagccagacagccctggtccggatgatgtctgggcctcaggctgacggcaggggtacagtagcagggtgaggacacgtggcacaaagtgtgcaagtgcctgacacagtgcttggctcaaagcaaggctcactaaggaaggcttattcttaaatggcctcatttcgaaaacagacactgaggtcttcaattcaccgtccgtcctgctcagga

SEQ ID NO: 42323 - DNA, 1326 bp, Bovine  19866880739131
ttgtctaactgtgtagagaaaaactgcagatggctctaatccaaagcctttataataaagttttattaaaagccaatgtttattataactttaaaagactaaataattcttctaagacccaaaaaggtttttcatcttgcataaataagattttgtataaaatcttcatataatgtttatgcaatggcaaggcaactctctacctcagtttcctcattggcaaaataaaaagcttaaaacattgaactatttgattataaactacttctagcaggcaagaaaagtggtacaaagaaagtttgtgtgtgtgcacttttcagtgagctttgggtctcagaactgaaatcttctcttccttgtaagattattttgtataagaccatgatgtacaaaacactaatcagcatttacttattcataattcattcaaggaagctcattattatggcctttcacagtctctgcccaacatactttattttcatcttgcatttaagacagagaggcctgctcctcacatcccttgtggatacagccaggaatgagggtatgatatccatgtgctcaactataaaatctgaaacacattcagtgggctgacctcaacagatgttttggtgagagcttctaagtggagccaaagaagggtggaaaattaggtcacactgctaggaaagaagtaaagacaaaactcttgccaaagaatcattgtagagagcaagaaaaagaccctgggtttattgcttgggtgtggagtctagttctttctctgggcagtagggaacaaggttccctctggctgtatcctggagaaaacagctgatccttggcatactatgcaggggaactgtttgatctatctggaactataagatgtttcagggtcattttttagaattaatcatttctctcaggaatgcttgttcttttcataagagaataaaaccaatatccgggcactaggttaatggattgctactggggagtcattgcttctagcttctagcacctctcagctgccagttaaaatatatatgtgtgtgtgcatacatcagtgaaagtcactcagtcatgtcagattctttgtgaccccatggactgtacagtccatggaattctccaggccagaatcctggagtgggtagccattcccttctcgaggggatcttcccaatccagggatcaaacccaggtctcctgctttgcaggtggattctttaccagctgagccaccagggaagcccatattatgtgtatatacatatacctataaatatttctgtatgtacatactgcatcgtctttatccagtcatctgttgatgga

SEQ ID NO: 42324 - DNA, 1040 bp, Bovine  19866880774007
tggaaaaggtgttttagcctgaagtactcaacagtaaatatagttacattaatggcatacccatggcctgaaacatattaatctcagttaacaataactgacatttacattactaatctaattcaggcattctgatggtagtaaatgcacatgttaaagcttcaggaactgaaattattactgatccaaagagaatccttatttcactgtcaccaaacggagaggacaaatgactatacttctggggcaatctgggttttctaagaataatgtccccattttaatgctttaatgaggaaaattcaaattaaagcagattaaaaataaagtggtcccaaatgatatgccagcagggctaacccaagaaaaccagtgccttcctcttcttcaaatcctcttcccctcccactcctcttctgctggatgagcttggactcttttacaagccaggactcaaagagatcttggaccctttcacaagccaggactcgaagggaaagggacttctgcaacatggctcctcttatccagtgaatcccctgagacctgattccaccataatgccatccactcagggacaatgtcctcatccgtgggactcctgagtggaaggaatgagcaactgctggccccagggcaggtggaagaagggtttagacagctggactttgggtcaggggctcccaaaccagaccctaaaggtgaccactctggccaggcctcaccatgagaagagaggggaactatgcccagagggggtcaggaaacgtgctaaggaagtaggtcagtgggaaaaggcgagcagacaatgcagggggacgactgtcttggagccccgtacgtgagaatgttacactacctgcttgcttttcaaagagaatggtttttcatgtttcagacaaaaccaatgaatatttcccccatgatgagtctttttttgagaggaaaatctcctatattctaagtttgcattcacctaccaagagcctaaagtaagatgttacaggtaaaggctgtatgattatatctataaaactcaa

SEQ ID NO: 42325 - DNA, 1720 bp, Bovine  19866880778424
ttgcgccggcgcatctcgttgcgcttcagcgcctacgcggtcctggccatctgggcgctgtccgcggtgctagcactgccggccgccttgcacacctaccacgtggaactcaagccgcaccgcgtgcgcctctgcgaggagttctgggggtcccaggagcgccagcgccagctctacgcttgggggctgctgctcgtcacctacctgctccccctgctggtcatcctcctgtcttacgtccgggtgtcggtgaatctccggaaccgcgtggttccgggctgcgtgacccagagccaggccgactgggaccgcgcgcgacgccgccgcaccttctgcctgctggtggtggttgtggtggtgttcgccgtctgctggctgccgctgcacgtcttcaacctgctgcgggacctcgacccgcacgccatagacccctatgccttcggcttagtgcagctgctctgccactggctggccatgagctccgcctgctacaaccccttcatctacgcctggttgcacgacagcttccgcgaggagctccgcaaactgttgctggcctggccccgcaagattgctccgcacggccagagcatgacagtcagcgtggtgatctgatgccactgtgccaggccttggggaactccagtccagtggtctccggaaggtgtccacccggaggccggactggggagattattccagagctaggctaatactaaactaatgggctccaaactgccagcccacccctctcgtccctctgtctcaccttgtatttgtgtcactgtaaaatgttacgtaggctttgatgagactcatgctttgcttggaggaggccagggagaacaaaagaggttttactgttttctccttttaccactgaaggccaaacaaagctctttcccctggttcagataatatttcagaaacgtgactgttttccttgctttcccttctgcttgttccatagggagtgaaggagcaataagcatggggtttaaaatggctggttggggttggtaaagcttttcaggttgctttttaaaaaggactcacctgagatataatacagaatagtgcttagtccattcaaacccattaccttctaggattccagggaaacatgtattacaaatctgtaactagaatttcaggcatctcctgaacaagagctttatatgccaaagggattttcactttaaatccacttgcatttatagaacaaaatacttacaaatcaccttcaagaggttttgctattgttttctctcttccttatcccccaattgctgtttgaaaatgatgagataaattagttgatgaagagataggtaacacaggagtaaagtggaaaaggttcacacaaggggaaatacaactgcacaggacagactatctgtgtgtatgtttgtgtatatacacaactagtgtttgccacaaggcacacactcaaatatttggttttctgaatgctcaatgtaaactgtgagctgtaacacactcttgtattctctaattgatcttgcaacaaatcaacagctgtgaactgactgctcaacacctgctccgtggtgacacacttggagcgtgatcaactcagaatacaaggactaggagaagcttgctgaaagccagaacagaaaataacctgctgcccacaggatgtacagatcaaacatgtgattccttccagggttaagggaataggggaagactgttg

SEQ ID NO: 42326 - DNA, 656 bp, Bovine  19866880801515
caggcatgagggaatagcctgcagagcacagtgagtgggcacactgccatttttgctgctctaacttcataccttccttctttctttctttctttttggctcaggagatgacttaacatgtggctcacagctgactcttgtggggatctcggataaatgatgagaagaaaaataacacctgggtacctttatactgttccttctgtgcagattgaggatggagccagatggcctctctgctccactccctttatttatgaaaggcttcacttgcttttcaacaggacaagagagggagggggggacactggagtttcgtgttcagggacaggaaagagtgtgtatgagcaagcagccctggtaagccattgaatagggacatggtcactggggcccatgtcagtggggccctttctcttccaaaagccctcagcttgtggtccaatcaaggactgctggaggtcataagaagaagagcataataataagcccttgtatagtgcttcccttgtagctcagctggtaaagaatctgcctgcaatgtgggagacctgggttcgattcctgggttgggaagatgccctggagaaggtaaaggctacccactccagtattctggcctggagaattccatggactgtgtagtcctttggggt

SEQ ID NO: 42327 - DNA, 1714 bp, Bovine  19866880821885
ttgggggataatgatgcatcagtgtaggatcatcaattggatcaaatgtaacactgtgatctagggatgcccactacagggtgggttgtgcttgtgtggggacaggggttatctgggaactgtctgccctttctgctgaattttgctctgaatctaaaactccgaacaatgaagtctattaattttttaaaaagtattttaaaaaagaaggtttcccttaaaattattcaaaaataaaaaaatctccttgacacatccccctccaattttcccccaagatggtatttttgaagaatcaggaaaagagacagaggacaaaaagaaaataatggaacaaacctccaaacctgaggattgagctctctgtgtctttggtaccagcttttcaatcttcttcatgagtacaaagagaatagaattcattttcttttgtcctaagactcaggatcgtgaataaccattgacagatgcttgccaagacatgaaaatcatgggactgcatctgactcaaggagcaaaatatacaaaactgagaatagaacaaagatggcaagacctaaaatagaaattggagccaattccatcaccctgcacccccaccccccaccctgcctttcctgagctggctcctcacagcacttggaataaaggtcccagtcctttccaggagctgcctccacactcctgtccaatctcacttcctaccagtccctccttgcacctgatttcttattgtttctgcctcaggacctttgcacttgttctttttgcctggacgattctcctccacctgcatgacttcctgccacccattctagtctctgatcaaatgtcatttctacagagaggccacccttgactacaagactttaaatattaactcccttcaacctatttctcttccctgcttgacgtcttttcacatcataatacatattgctctgtccttctgttccacatctgtcttctccatctaaatgtgagctctggaggacagagttctgtcattgggctctcttatcttcacctcagcatccctgacagtgcccaatgcacagtagcaagtccatataaccatatttattgattgaatttgttgcaaccaatttctatatgtcaacttggcaattgcagtaaatccattgtttgattttctaacaatcaaaagaaacctcagtgactatgaacctccctgggacagctcatgtatctcctctgacggaggcgtaggtggctgacagtgctaccggtctcatttattccagatcaaactcaaacactcataatgtaaagaatatcacatgcttcctcatggaactgagacatacttttcaagaggattagcttataagagtcagataatccccctgggttgaaataaatagatcttatagaaattcctggggcacgttctacataaggcctttcgctaaaattaaattagcaacaaaatgagcttttcttgggggtaaattcaagtgggttttcctttacaagctgttttaaactatcataatctgatagacagggtcctctcccagacacacagtatttcaaatgcctcattttagaaacacatgccaccaaggccagaaagatgggaaccccccaaatttgcaaagagaggcagactggggacttgttaaaaagaacctaagaatttcagtaatttaggaaaacaataggattcccaggtcactcagtagtaaagagt

SEQ ID NO: 42328 - DNA, 1582 bp, Bovine  19866880901954
gagatcaaaatcagtccatcctaatggaaatcagtcctgaatattcattggaaggacttatgctgaagctgaaattccaatactttggccacctgatgtaaagaacttactcattggaaaagatcctgatgctgggaaggatttgaaggcaggaggagaaggggatgacagagatgagatggttggatggcatcaccgactcaatggacatgagtttgagtaaactccaggaattggtgatggaagagaggcctgctgtgctgcagtcctttggggtcacaaagagtcggacacgactgagtgactgaactgactgaactgaaattgctttagtcatgtctgactctttgctaccacgtggactgtagcctgccagtctcctctatccatgggattctccaggcaagaatactagaatgggttgccatttcctcctcctggggatcttcccaacccagcggttgaacccctgtcctttatgtctcctatattgcaagtgggtggttttaccactactgccacctgggaagacctctgaatcttctagtaagttgtttattcaagagaaaactaagctaatggtagaaatcaacaagaaagctttgtttcttttttttagatatattgctggaacacacttattttatgatgaactcatggttgttattgaaatattttacaatactcttcaaaaaaaactagaaaggatgtatgccttgaatattaagaatggccagattcctatgattctattggaaaattaaaagacttcaagtatatgaatttaatgtgaccacaatccacgtttacaactgaacacttagaaatgagaccaaattttcacctcctgtgtttcctctggctataatcttcccaactataccaagaagctcctgggaagtatgcctatcatgaaaattgctcaattttcaaaaatgatctatgaatcataatgggagtcttggtagttaagtgtctacaataacataaaaatgcctcctagcccctcaacaggtggtagaaagaagtcagatgactctaacaatggtctttttttacttcatttaaatcctagcatatcagacaatattagaagaaaaacaaaacaaaacaaaaacctagagcatgggtataacaatatatataagcttataggaaaataacatgatacaagagataggcctagtgcagtggttccaaactgcctgggttagagtcctggatccgtcacttagcctctgtgcaatcttgggcaagttatttaacctctctctgtgttagtgcctgctataaaaactcatgcaccaatgtcgtctactacccaggattattataaatgttctgagtatctttacctccccaaagtctcctccaagctgtctccattctgcttctggaccctggaggctggcccagaaaagtggcaacaatgagctcttcaccctgcagctctctatcctgtttggctgatgggagggacagtcaagagagctcgaggcagggggaattccctggtggtccagtggttaagagtctgagcttccagtgcaagggggtgcggattcgatcccggttcagggaa

SEQ ID NO: 42329 - DNA, 1513 bp, Bovine  19866880905625
cccttggagacccagcagagctatctagagacacaaagactactgatacttaggctgtagtactccgttctcacattctccctcaagagacctaagtgatagagttttagagaacctgccagatatttatattctaacaagccaaagaggaaaaaaaaaaacagaaaacaaaactcaaagcagatctattaattcaagaattttacatatttatgtgctcgattgccatctcttaggactctccaggcttttcacaggaaggagtatattgaagctgaaagaaactattcctaaaaatacagcacagaagaggtttctgatcaattcattgtgtttttatgcagcaaaatgcaacaacagacatgcaaatagatagactattggtctatcacatagagtgtgggttacaaaaatgaatcagggtttaaatgttaacaacacttaggaaagcagttagaaatgtgatgattgtatttgatctcacagacttgaagcaccttgagaacagtgactgcatcaactacattcactgctggggcccatgtgagcacagagtagggctcaatattcactgaatagagagatggtggtaccactagttaatttgagtgatgtcatatagtctttctaattgtattgtgggtaaaagatgctctccatggtgacatcagagtaatacagaaggattttagcacattggcttccctggtagctcagctggtaaagaatccgcctgtaaagcagaagaccctggttcaattcctgactcaggaagggataggctggagaaaggataggctacccactccagtattcttgcctggagaattcccatggacagaggagctttgtaaccccatggtcgcaaagagtcggacacgactgagcgactaagcaattaacacattgatgaagaaaaatgctgctttggtgcagaggtattgcatctatgaatttaaatctaaggtgaacttgaagacactttgagattgcttcttaagtttgaggttgaggtcagttagctactcatttaactgggagtggaaagaaatcggaacttacaactctcagctgtttcccaaggtggccacctctgccacctcctcctccttcacttttggggggaatctgttttcttgtacctactcaatctaacctgcaggagaatgccaatactcttaggtgtcttggcctagatgtggctagatctcttctattcttggtttgcgtgaaggaatagttcaaagctaccctcacatactccatttcagaacatgtatcctgtattcatcccctaactgtgatcacagatagctcaggtaacactgttacccaaagaggtgcatctcaaaccatcatgtgtataggcgtctctggggaacatattaaaaaatgcagattctctggagtggagcctccaggtgaagctgatgctgctggtccatggaccacatgtagagtaacagacttgattgtatgtaactcattgcttgtctctctacaagatgtgtgt

SEQ ID NO: 42330 - DNA, 3562 bp, Bovine  19866880927266
gagattccgccccctgcttttcattgtacctcatggttagttgcttagccttgaagtacctgttacctcatttgtaaaatgagcataatagtaattttgaggggaatttcctggctgtccagtggttaggactctgtgctttcactgtggagggcatgggtttgatccctggttggggaattaagattccacaagctctgtggtgcagcccaaagaaacccaatagttttgagggggtcaaatgagataaggcatgtgaagtacttagcacagtgcgtggcatgtaaaatgccctcaagaaatggtggctatttttagccattcaatcaaaaaggatatttatttggtatctgctgcgttcagacatatcgtaggtaccaaaatgcttcaagacattggcccctgcctgtaaagagtttacatcaggggtcgtggaggcaggggaggaaacacttccacaatttcaaaggtagaatgtaatagaggacagaaagatcatgaaagggagaagaccttgaagacaaggtaacctttgaattgggcattgtagcatgtgaagaatgtgagttgtgtggggatgaagcaatcggtattctacagaaagggaataaaccccaagagagatgatgaacaggaatggtgaggtcgtgtctgtgtccaacaggctagtgtggtctgaatatagggagtgagacaggtgggaagcagaccaaaaaaaaaaaaaaaagagggaagatcagaataaaagggcatgctgattggaaatgccatgctaaagctctagtctttgtttgatgggccattaaaggcttttggggaataggaggcctcccaggtggcacagtggtaaagaacccatctgccaatgcaggagactctaggagacatgggtttgatccctgggtggggaggatcccctagagaaggaaatggcaacccaccccagtattcttgcctggagaatcccatggatagaggagcctgatgggctacagtccatagggtcgcaaagagttggacatgactgaagcgacttagaatgtccaaaaaaaaaatgcacctcaaatcgtttttcaactctgttaccacaatttcctctgctaaagatattttgaagcaaaaaagtgcctcgccttttgggtacataaaaccctgttgatgaacatgatgagaaagatcgaaaggcatgttgcagttcatgaggttgccaagagttggacacgacttagtgactgaataaaaagggattagtcaggcacagattgtattttattttgaagtttgtttttcttttactatcatactttctctttagctataactagataaagtgattataactcagagcatgtgggtttagaataaattcaggtgcataaaattggattgcctttgttcccatgttgacttttctccctgtatgagtgatcacttgaatttggagagtgaaataattttacttctttccagcctcatgggaatatctgcagtcagaagacagagtacagggcttgtgaaagagggaataataaagttccatcctctggggaaaggaaagaaaaggtgaagggaggagatgtcttcaaaggagggaggctacaaagcctccttcctgcttcccccaacttcgtccagattaatttgtatttcagtgaggatgtaatactgctaaagattttatgtaacttttaagcctcctagatgtttgttacttttgttatcctcatggaaaccgtgcaattactaaaatgtggtgacgaggccttaggtgtttatttaaggatggagaggggtggggtcccagaacttatattccatactggtattgtcagggagatgaagaatagagcctggtagtcaagaaagagtgaagagtaggggagggggtggtagcggagtagtgaggagcaggtattgaagtgtgcctgctgcacaaaggctgcgttttctgacttaaggagataaaacccagtgctgtcaatggcactgtgagcagttacctatagcaggagccaagtcactccgggccatcggcctccactccaccctactgctcttggagtctgcagcccggcccaggatgtaggcagcgaggcagctctttgaactaggctagggaccaggtccctcctccaaatgcgacggacacagaagaggggctgaactccctgtttatccgctcccaggcacgcccgagccgcgcagccacggccgcgggagctgtccgcggtgctgaaccattttcttgggcttgatcggacccgtgactcggcatcgcgtcgccagcttaggcaaagggctcagtgcgtcccggggagcgcgagccccctaaggtctgcggctagttccaagcgctgcaatttaaatctctgacagaactacctatgcgactctcttaacccgagccaagactcaaggcaggatccggcttttaaggacgagtccctcatctctcccctacatcccgtagatatctcaatcccccaccccatttcctgccctgcgacttccttacggaaacggcaccaggtcgtcctgagagccagacagttcacgcctctcatctccctagtttactgcactcccctccagagcgggactctcccaggacgcagcaagctcccacaatatagattctcccctgaccctccggcccaggtttctggccccttcttccttttctgtttctactatccttctcctatttctcaaagcaccgagttgggaggtgcgagctccgcccctattttccctacaagggcacgctgttgtgggggcggggcgaaggggaggtgcttccagcccctctcaaaagccgcgagtccactgggaactcgaatcttttcagctcctcggagtagcctgcaccaccgtctgggtggaggacctccagggacagccaggattctacctctctttctccggagagctttcccatccgtcaagccccagtcaccaggtaggactgcgcttgggtctggcttgtggggactgtaggggctccaaatagagtggaaggcatttaaataacctatgcacatctaaccacccctagatttcattttacagaggtgggggtgacagcactttaaattttgttgattatttattgtggcctgtcattctaaagggaatatttgagtaattaaggtgtgtgtgtgtgttgaggggggagacggttggcgtaggaggggacggaaagagaatgggaggtgacagactctgattatctttggacaggtggctatggcctcattgcccactcagggtccagcggcccctgacttatttaatgggctgctgcctgcgtcttcaagtccggtcaaccagagctcagagacggtggtgggcaatgggtcggcggctggtccaggctcccaggccatcacgccgttccagagcctgcagctggtgcatcagctgaaggggctgattgtgctgctctacagcatcgtggtggtcgtggggcttgtgggcaactgcctgctggtgctggtgatcgcacgggtgcgtcggctgcacaacgtgaccaactttctcatcggtaaccggccctgtccga

SEQ ID NO: 42331 - DNA, 1117 bp, Bovine  19866880928921
tggtgttgccttctcctctgcaaccacaattgcctcctgctcatctgctaacatttgcacatttgcacccgtgaccttggtgatataccttgagaatgcatgtctctctccctgaaactcttgaccataaggaggccttaccttgttccctttgtaaactcctattacgctactcctgggtttcccagcgtctcagtggtaaagagtctgccagcaatgcaggggcaggagacatgggtttgagcgctgggtcaggaagatcctctggagaaggaaatggtaacccactcctattttcttgcctgggaaatcccatggacagaggagcctggtgggctactgtccatggggtctcaaatagtcagacgcgacagcacgcacacacacacacacagaatcaatcaccatcctaatcactcccagagtcccacctcctaacaccatcgccttcaagattaggtttctaatacacgattttggggacggggcacattcagatcaaagcacgcctcagtctacaggcacaaactaccagactggtgaagggactaatggaaggtcacaagttcccttcaagttgctatttaaacttttgactttgttaaacaagcctctatggagaaggaaatggcaacccactccagtgttcttgcctggtgaatcccagggacgggggagcctggtgggctgccgtctctggggtcgcacagaatcagacacaactgaagcgacttagtagcagcagcagcggtagcaagtcagtttcacacatggcaaaggagaagcttagcagagcgggaaaatgtcttgaaatattaattatgaattactgagtttcataaattttttaatttttctgaaaggcactaataacaagagcccgtaatgactccagggaaatgacacatttgcattttattagttaaagtaagtgcagtaatactctagttatctgattgttactgaaaaactggtcatttaatgtgtgtgcattttccagacaacaacatcttgttccttcaattgtaaaaactgatcattttaacttttttaaaaaaatgatgggaataatcactcaccttctaccattcagatcgtgtaggaaaatacacaaaat

SEQ ID NO: 42332 - DNA, 2743 bp, Bovine  19866880955765
caaggatgttgtttggatcatcaagagaggaattctgcagcaatacaaaaaagagaaatttctggagactggtggatgatcacaagaccagggtggaaaaaggacagtcgagcagcatggcctgggctcagagcctctgagaggctactgaatgacactctgaagctccagtccagagcgagggaaaaaccacatcgtcccccaggcctgggtggggtgaaggattgtgagaaggaacagtcttcacttaacacagatgtcatcagtgatagcctcctgggtctttgcttctgtaatctttttaggcacattgtgcgtgggcattcttaaagtcttgtttcaacaaaggctccatgggagtgaagtttctcttaaaatcaagcagtactctgatggaagagacattgcttggacttcttttattaggttaagtagggagaagtctattaaccaaaaatgaggaagatacactagataagccattgggataaacttttcttctaagaaacatatattagactatctctttaaaaaatttgtattttctttggtaattatttctacaaactaaaactcagttatttaagtctaacaagtatcttttcataggataggatatatcctacctagtctgttggtaatcccatgaacattttaattataacttcatgaagtagcttcagctaataaatagcatttccataggaaagtaaaatataactttcctcctgtgtttaatatccaacttagtacccatagagactaggcggggctggtgaatgaaagtatgggcagtagagaaaggcagaggaaaagggtggtttagaatatgggctctgggcaaatctgttaatagattcatgtgatggcttaacacttaacagactttgacttggataaattgatgagtccaagcttctgtttctttgtgttcaaaacaggataacagttttatttcatcaaattgttacatggattaaatgagctttcttatagtgagaaaggatgtgctatataataagtatgccataatttctaacttactattattaacattgttatcaagggaaagtatagtcgttagaatcacagaaatgtggatttgcatctcctccttcttaattcaattaatctgaccctggctaagtcatttaatattgctgattcactttcttatcagtaaataggagtggtggtcgttgtgagaacgcagtagtctaagtacataatgtgtttggtgtggtcctgtgacatagtctttgctagcaagggtttgcctttctttcctgcctctgagtttgagatttcttttctttctagtcgggacttgaaaagaggatagaccaagctgtggaagagtggaacattgagaaggccgaggaactcagcaaccagctagctactcgtgaggtaagtcggccccaccatgatgctctgctgcgctttcagatcttctgaaatgagtgtacgttctttgcatgatcacgagtaagtgcagtgttcaaatatttgatctaagattcttttctgtccattttcttccctcttactctcccacttattttgaaatactgggttttatttttgtctttaatgataataaattattcttatataaatcttaatgctggaaataacccacggttgatcttcagcctctagatttgatctagttcagagctctgtctgccagttgtgctgaaaaggctagctttctttttccattttcatctttaactcagtttaactctccctgagggcggctgcgtgttctggggtcacatctctctgcgtgttcctaaccctttctccccagaatgctttcttactgcatattctaaatagttccctcagctctaaagaagtctcagccttttttttaacctaaagtctgtagtataaagctaataggtatattgaatattcttttcccaagtaccaaggcatccagaagattctcacttgcaccctctgggagaaagttgcaaaatttgtaaaacagtttctgtttgcccttcactcagatacctgaaatgttaacagtcaacatttgcttgatcattcttttctgatttatgtgtgccttatttagatttgccaaatatgtcagtgatcgcctttataataaaagaaaatttttcttttttccggtcttggacgctgagttttgttgttgtctttttagtcttctttaatctggaatgtttcctccgtctgtctgtgttcctcaggaccgcagtagttttgaagagtagctgatggttttgtaggatgtctgtcaagtttgctttggcgcttcctcatgattagattcatgtcgtgcatgtattggtgggaaaatcacagaagtatcctcagtgcaggatatcagaatgcatgtggcatctatttgtctactttattgatgatgttcctttgattatttgcttaaggtggtgtctccaggtttattctaacatcattcttccctgtgtaaattaataagtatctcgcagagaggtgagagatgatttgagactctgtgaatattctttttctcactattctttacctactaattttagcagtcattgctgattgttttccagcttgagacaattactattataattaagatcttgaaaacatttgagtgtacttctcatctttacctggcaactcatatctaaaatttgtcttcagtgagatactggattctagaatctcttatgtatctatgttaagtctcccagtaaccggacag

SEQ ID NO: 42333 - DNA, 947 bp, Bovine  19866880976712
tgactgactattttgcaaccccatggactgtagcccaccaggctcctctatctgtgagatttcccaggcaagaatactggagttggttgccattccctctctaggggatcttccccacccagggattgaatcttgtgtctcctgcattggcaggtggattctttaccactgagccatcagggaagccctgtgtaacagaaatgactgctaacttgtgtgagcgcttgatctgcaccagatatgacctggggtccttacaaggcagggtttttttgtgtgtgtatgtggtaaatcacttcaatcgtatcagactctttgtgacctgatgtgagcctgccaggctcctctgtccatgggattctccaggcaagaatactggagtgggttaccatgccctcttctgggagatctgcctgaccaagggatcaaacctatgtcttctgcggctcctgcattgcaggcagattcttttcacctgagccaccagggaagccccagggatttacaatcatcctgatccttatttgcacagaagcagctttggagcctgacagaaggtgaatgcattgtctgagggagcaactggtggggtctgggtttgaacttggctctgaaagagtgagttgaaggcctcaaccactatgctaaaccatcttctgtccggaaagtctgggacatctcattctccgtggagagtctccagtaaaggctggagggaaagcgacaataccagatcagagctttggaggagaagaagccactcatctaccacgggcatccttaagaatgggggaagaaagggagccatggttttagaatgaaagtttctatttaggaggctggggcattccagataagcggcccttttttctttcccacaggctagatgccttacttcaggcacttttcagtgattgcactttgtctgcggaatgcagcactgtgag

SEQ ID NO: 42334 - DNA, 2760 bp, Bovine  19866880999044
atcccggggactggggcgattggattaccaaataatgggtcgctttagttctgccatcgtcacttatcaggtacattagtttaaaacctgcaattttgaacttagcattactgagctttccaaagattaaattacccaacttttgttggtgagtgtctctgtgaaatttcctgaaaaggatagtcctccttctttgtgcaaaagtgaagccaaatcacgtactttattgatatttagagacatacaaatgatggtgctaatgtactttaatgtctgtctgcttgactggaaaggctgtgggtttgtgctttggggcttttctttttcttaagataatgtggaacactgtagtctctttgtgagcttaatcggagtaggtagatttttttttttcttcctcttgtttttcccaaagcattatttcagatgaagttttacaccaaaagtctttttcaaaggaggctccgtgtttgtccctgctatgggtacagcctctaccttggtccagcacacaaaaaaaaaccaaaaaccatatcccatgcctgtttgtcctcttaatagctttggtggaaaatgtgagaacactgatgctttaacaaaactgagtcgatttaacactctgtactcaaaaatgcctccacataaggggaagagtcttaatctctaagccatgaagatttaatgttttcagagtaattttacagacattctgcctgccagtgcccagtagggtttagagttcttgagtcaccacgggcttaacaagcatccaggcatgaaccaactttgtagttttgagcgagaggaataagcgttgatccgtggtgactgagcagaattaagaggtaatttacctgctctctttttagggagtttgtatataccttctgcctattggagatgaattataagccaactctggcaaagataggaatggaaccagaatatcccagcaaaaatggttgatgacatcttgaatttctctcagaaagagatgaatatgcaaggatagtagtaagtgatctgctaaggtactgaagaaagaggtagggtttgcttaaatcacaagcataaaaaaaatccaggggacatcaaagtccatgtctgctctggtcatttaaacaaagctcagatttctggtagctattggtaaatggatttttggtcattcaggagtctgtgatagataggcatggttaaaatatatttttcacctatataacctctagggttcgatactgctgttactactgctgtttactcgcttcagttgtgtccgactctgtgagaccctatggactgtagcccgccaggttcctctgtccatggaattctccaggcaagaatactgggagtggggttgccatgccctctctagggaatcttccccacctaggaatcgaacccaggtctcctgcattgcaggcagagtctttaccatctgaacccaagtgcagccctaaatcccgacagggtttggcacttagataaccaacagcctcactaagggcaatccatactgagtggtgggggcccccaacagacagcagtgagcagaaagggctataaggttagtactaaaaagtggattcattctgggtgcatattagagaaggagtggttcagagccgcttagccagtatatcctcttctgatccctgtcttaagcataatgaaagtgaaatatcccttctaaatctttgaggggaggcaggatgagataaacactggtggcattacaactcaaattttctcattgtcactgagcagcttttataccctcaacacacggcagttgctctttagacgaagtgggtgtgtatgtgtgtgtgtgttttgtttaacatgcccatctcagatttccgaagcctcctcaaataggtttgtctctgctcttagcacagtggcattatccagaagcactgccaggaaagggctaagaggaaatacggattcctgtttgcaaaagcagatctttagctgccagacaaggcatttatttcaactggtacccaccctgcgtggtgcactgcggttcccagatggtaactcacgtgatgagatagcagcgacagtgctaattaaatgtcagtgagctcaggagctgcagcaaggccttcaggctcagattgctgagacagaagtaggaaggagaagtgcatcagccttcctgaggctcattagagttggggagggctcaaattcagacagttgctggattcagatcctaaatggacactgcaagagggcccacaaatgaactccaaaaggaataaacaaacattagtctacattgttttaacagaaaacacatcctttggcaggttttccttgacatcatccatcacccccatttgattgacttgtaaattgaatttagcttgttcttttttaaaaaaaacatttttttttaattgtgaaaggctatgcttcatttaataggtctttgttggttatccattttaaatatagcagtgtatacatgatcttcctaaagtccctatcccaaccccccaacaaccataagtttgttttctgtgagtctctttctattttataagtaagttcatctatatcatttctttttagattccacataaaaaggatgtcatatgatatttctccttctgtctgacttacttcactcagtatgacactgtttaggtccatccatgtggctgcaaatggcattatttcattctttttaatggctgagtaatattccattgtatatatgtgctacatgttctttattcctct

SEQ ID NO: 42335 - DNA, 1153 bp, Bovine  19866881035477
ctgggtcacctagttacatgaagagaccagcttctgttgatataagtcagatcttcaagtagaatcatgggacctcatcaccaaatcagtactgagatgagctctgagtagtttataatagaaacccaacaagtgccgtgaacgtccgaaagccgaccagatgtgtgacgtcaccagcaaacgggtgctctctgggatggtttctggggtgccccagcccatgtctgaatggtccttacgagctctgaatgggcaccactttgcttctctaagcctccatgtcctcacctgtgaaatggcagctttagttccccaagtcaaaggattgatgcatttattaaattacaaggtaaaggaaacactctgtcatgtgacaaatagcctcagaaatcggggagtttgtagtgattgtatccactgtctcatcctggtctccagccccgtcattggaacactgagcccatgccacaccatcattcaacaaacatgaatctgagcaaactctgggagatagtgaaggatagggaagactgacgtgctgcagttcaagggatcacaaagagtcggacacgacttagtgaccgaaaaacaacaacagtatgttaatttaactcattagggtctcttagcatttgaaagcgtgtttaaaaacacaaatcaacaattcatctttggggaccaaagaacaaattcaagcataatgtattacgtttcctggctccacaaacaccattttgatatgctaatggcccctagtgagggcagtaattttcagttaaataaaggaagccatgggtccaattgcaaagtctccgtagacaaaatctgccttccttgtgagtcagccaggaataaacactaatacaatatcatttgtaagtgattaacataaaattaaagtgcaatatgtatcatataaaatatattacgtgtaatataaaatgtattatcgagaaatgtgacattgacccaggaccaatgatttgagtccaacaaggatttgagtccaacctctgacagccattagctctcctgtgaattcagaacataatgtcaacactgtaaaacagcacacagaacaaccacagcggattctactctcactgatcctctagtttctcatctgtagaatgggggcaatgttacttgccac

SEQ ID NO: 42336 - DNA, 1737 bp, Bovine  19866881065695
catcacagcgctgcgggctcccacacctgttacctgctgcagccaggatgcggtgctcggtcggagctctgccctccacccagcgcctcattagtcgtagacacaccgggctatgagaaaacatcagaacttctcctgcacctctaacaatgcacagaaccagatttcccgtttcctttgttatgctatgaatattctgcagcatctccagttttattaagaagactttcccttggtttctctttgttcttctcatctaatctcttaatggaagttgctaattaaattcctatagccattttttttaacagtgttttgaatagcaaagtctgtcaactgcagaaagtgtatattcttatcaacacgcctgttgcctggaggagcgaaggcctcgctgacagatggctgctgaggagggcccagcagggcttacagctgcagcacctgtcagcgggagcgcacgcaggcggcaccgggcgccagaggagggcctggtttgggttcaataaatagaatccaggttgctagagtatttctgtgaatctcaagtggaacttggaaaatgtaagccaagtatcctgggcaggtactcgctttcaagtatcctttgacattctcctactaatggtcatgcatccctttacatttcagtgttattacatcgttaaaggaaatttaaaaatcagctgagtgcctgacatgtatgccaacatatcctttaatcagacacaagtcatccaattgagcttcattaaattgatttgctgctggctggtgagaatcttcacgaccgtcgtgaacaacccggaatcatcatcttgtacggtaaatttacgtgaaattaaataaacaaatttttcccacaaaccaaccccacctcttctcccatgtaggaaggtagtcagctgcacaataacttatagagttgtgtgtgattaattgaagggtaatcccccagcacagccaaatcaacccctggaaggaggcatgtgtccttggtcaaatgttagtacctgcctaaagcaaaaactcatttattctctcaacacagactctgccttggcaatgtcaaggcagacacctaggtcaagcacagacaacacagcctctatgtcaagtaccaggtaggggacatagggtagttttcaacctggctcgagacagcagcctaagctctgggactgtcacctctgtaagtcatcagaaaaggagtgatgtgtgtgtatgtgtggttttgtaacaatgccaaaaagagagagacatcttaaggaattactgaaaggtagaaagaagagatcaaacctatacagaaataaacctagaatctagcaaaaactaaaactcaaaaaagggaaaaactgccccagagataggatcaatctgggaaagctccaagtgcacaggcaaaggataaagggaggaagaggccttatagaaatcaccagagtgtttaaaaagggaactcagcaattgtatctatttaaaagaactacttgcacttgtgtaatggtacacatgaatgagaatgatatgaatgaggctgggccttgctgcctggctcacaacagagagaggaagttgattgtctagctgtgggtgagcgggttactatgaaattctgttgatggctatgtacagacatgaagagatctctaaaacatggccttaaaggaaaaaagcaagttacaggaaaatagagtaaaatgaaagattaaatgatagatgatagataggcta

SEQ ID NO: 42337 - DNA, 964 bp, Bovine  19866881096156
ctcttgggagaggtctggaccctcacttgggttggcttgctgagactaggcttacatcttctagtccttggttggagagtacagagcaaagaagagggaagccagtgtcctggtaccctttgtaaggaccgaaaacttccgtcctgatggccaaatccaaattggaaatgaaagccgattatcaagtagaagcagtataaggcccacaagttaggaagattcaggctcagaagaaattcctgaggcattggcccatgatcgcgaggatggagggcttcagttaaaatgtgaaggttgttcctggctaaaacgggcacaatttttataaaaaggatcttaaagttcttataatccaactccttcactgttcacctgagtttcctcacctcacagctatgtcaccatccaacctctatgaacttctgacaacattcattcattcgctcagccatttaatatttgagtgccttccacattcatctcagttcagttaagttcagtcactcagtcatgcccgactctttgcgaccccatggactgcaggatgccaggcttccctgtccatcaccatctcatgtcagaccacaatcatgcacaagactagtaggtggtagttgtttgtaatgagatgtagtaagaggaggtgagcattgccgtggagagggacacaatgcagtgtggcagcgagactggagtaaatggcctctggccggaggacacagggctggcatcctaagaggtgattttggagctgagtctcagatgtgagtaatgcactcccctgaggcagctcatttcctcttcaaaaagtccttccttacactgaagcgaaatatgtgcttcattaatttttacctaaactctgaatagtcattataacccaagccaatgactctttgaggactttgatctcaatggggtggaaagacaccagggaatgtatgaagtttgtttttcagtaagt

SEQ ID NO: 42338 - DNA, 1364 bp, Bovine  19866881129712
ctctttagttcccttagtgctctttagtcctataaaagactctgaagcttaccctattgattttgaaaggcaaaggaaaatagatgcaacaagggaaaaatgattttctgctcagttttgcttaaatctaaatcgagcatatgcttgactctttttggctttgttggctatgtcagactaatttgtctcttcagaggactagaggcaaaaaaagaagacataccagggatactgactatcacacttgcgatttccaggtggttcatagaattgcctctgccggttcacttggtgcttttgcagagagcaggctcggggtgagttcgaagtggagtgttaggagcaagtcaagtcattgcatagaaatcctcttatttgtaaaattagtattcagagaagcaaaagttaaaggttgtcagatttatttttttaagtacttatcaaccagagttggtagattttgaggaggactttcacgtgtgctcctttaatgccgtgagcatcttggattgtattgataaacactgaattactgttaagactattaacaggcccttattgtgccctgtacgatttgatttgccacatcataacattctaatgtcaaggaagaattctcttttatcatgaagttcaaattttattttactcagtggaatgcttgctgcaggcttataacacctgcaaccaaattctctcaagtagttttaataataatatttctgaaaaggaatgaagttggaatgtttcattaaatgtggatgaactcttcattatcctagtaatgtacccaaatgctttttctgggaaggaagtattcttcggccaacaatggaaccttccctataaaagcatcacattaggatatgaattggcattaaaatctttggatgctttttgcattgtttagttaatgggggaatattttgtattgtcttctttttattattatgtgtgtgttaacaaagtgggcagagtaaagtttgcagaatttagtctctctgtaaatttttgcacagtggctgcagctcgctatgggtgagggctttagtggtgcaaagctttgattggaaggcactggaggaacacctcccagtacattcagcctggttcttactcatcttagccttgtgaggtatactgcagtatgaagaatttatttctttaactcaatagtgaccttgtttatttaattgggattcttaacaaaattcttagtctgcagtgaagaagtaagaaatgcctccattttgtgttgactaacactgtctgcctaaaagtatttccttcacgtgttcacttgtgttcttgccagtacagtatgtagtttacacaccatagttaaacactggctttttatgggg

SEQ ID NO: 42339 - DNA, 1488 bp, Bovine  19866881150789
tccctggcgtggcgcttgtgaaacccaggacgttcacactgggcttgtttcggttttagtctttgcttttcttggcaaagccccttccaacagcttcagatgagaacagtcaagatgaaagtgtttcggaagcacttacacaataatcctgtcactcgtggacttaggaaaccgatccgcttttcctgaggatgtgacaagccagagtgtgacccattaaatgttgtcaaacccttcgccagagcctggagggtcctccaactcgagccaaacccctttaaaaccacccctcaaaacccttgtctcagaagtggccactactgccaccaccccacacacaaacccgcatgacaatctcttattcaccacctgcttttcagaagacagtgccaaccagcatcctttaatggatctcacttgtgagtcagtgaacacaatttcaatcagtttctgcagatgaaattgttaataactttgcactttctccctacgtggaaacacacacatatacacaccctcacctcccaccaacctagtgaacattagataatgaaaacaaacagaaaattcctaccaatatatttttgatacgttctacatcttcagtgaaactgtcattgcaagctggtacttgcctgcatacatctaaccattttcttttcgaattgcacaaggaaccctcagcaaatgatcattttttacatataggagaaagtcaaaatagattctcttttcaggctttaatcagaagcttgaagttggtctgagctaaaagcagctagcacatttttctggatgagtgtctgtagcaccctgcttcccctggcgtcatcaacattaaaaagttaggatggagaaggcaggcagaatgttcagaggtagggaagatgtgttctggggtcaaggtgtttgtttagagcgacatcatcctcccatgagagtagaacttgtgatccattcagaactagcatcccgggttattataaaaccctcagtcttcggagccaattaaacttggttatgaacacactttgagttcataatgtccagagtcagccctccacacagacattactagtatttgcctttacctcctctaaactgggcttccctgatggctcagtggtaaagaatctgcctgcaatgcaggagatacaggagacgcagtttcgatccctgggttgggaaggtcctctggaggaaggcacagcaacacactccagtattcttgcctggagaatcccacgggcagaggagcctggtaggctgtggtccatagggtcgcaagttggacatgactgaagtgacttagaatgcacgcaaattatcaccacacgttgccatttcttcctcttgcttctctctgagctgatggtggatgtattatgaaggctctcagaaataatagcgtttattttgatctgacctgtaaaatttttcctctgaccttatttgatctggacatgcctctgggataaatgtgcattt

SEQ ID NO: 42340 - DNA, 2187 bp, Bovine  19866881168894
tgtattgctggaatacaacttagcaattacaacaaggcaaaggaaaaatctgctgatatatacaataacatggatgagtttctaaaacatcacagtgagtgaaagaagccttactctgaagagtgcttagtatatgcttctacttataaatgaactcctacaacaggcaacactagcccatgattaaaaacaagaacagtgattgcctctagggaatggggcagggtgacaggagcctggattacacaggtttatgtagtttatgcacattatactctgtgatttttttaaaccgtaaacaaatattaaaatctagttaatgataagcacactgaagtgtttagggctgaaatattattgaagcctgtgagttaatctaaaacacattttttttttttggctgtgctgtgcaatgtgtgggatcttagttacccgaccagggatgaaacctgtgtgccctgagttggaagcgtacagtcttaacaactagaccatgactttttaggaaagtccctaaaatatatgtgtttttttaaaagctagattgatgaatgactgtagtgcaaggagacccaagcagtccattctgaaggagatcaaccctgggatttctttggaaggaatgatgctaaagctgaaactccagtactttggccacctcatgcgaagagttgactcagtggaaaaagactctgatgttgggagggattgggggcaggagaagcaggggatgacagaggatgagatggctggatggcatcactgactcgatggatgtgaatctgggtgaactccgcgagttgatgatggacagggaggcctggcgtgctgtgattcatggggtcgcaaggagtcggacacgactgagcgactgaactgaactgaatagatgtcataaagcaaatacagcaaaacattaactactgtagaatttacttggtggatatatggtgtgcttagtcacttcagtcatgtccgactctgtacgactccatggaccatggcccgccaggctcctctgtccatgggattctccaggcaagaatactggaggggttgccatttcctcctccaagggatcttcccccacccagggattgaacctgtgtttcttatgtctcctgcattggaaggcaggctctttaccacttgcaccacctggaaagccctataccccaacacaaaataaaaagtttaaaatttgaaaaaattatatatatatatgtgtgtgtgtatacatataccatgttaagtatttatatattactgtgtataaatgttatatatgtgacattatatataatatgtgatggtatatgtaatataatgttgttaataatgataatatcaatactgaccaaaataattgggttcctgagagtctgtaagtgctttatacctggtaaaactataatgaaattcatttagagcatttcatttaaaagatcacatctgtgcccttaatgaatagtaattaaaactcacagcagcactcccattaggtgacaaagggttattatacatactttctaagacagatagattttggaccatggagtccggccttttatgtggatgtcagcattcaggaggaaattgagacttaattctaaattttccatttctagaagactaggtactcttttagaaacaaccgttaagcctgagaatcagcattctgacttgaccccttgccactgtagcatggagtggcgggcaagtgccgtggcagtctctagtcctgactctttaactgagggtggtgggactgcccttgcttaagacatccatcctcagtttctcatctgcagaacgagaggctgcactgtatcttggtcaaactcatgtttaactatagtgagcactgaatttctctctgccccaatattcctggcaacagccactgtagccagcgacattccctatagaacccaagccatctctttttgagaatggactctatctattaaggaatgtacaaacagtccctgagcaccctacgcctccccctcagggcttcagctgcttcttgttagtgggctcatgcctcttcctccccgcttaacttgcctggtctgcggcccttgactgcttggatgatgagtcttcagctgcctcctgttgtcttctggatccaatctgctgtccctgagcacatgcacctactatttctggtgcatttcttag

SEQ ID NO: 42341 - DNA, 2292 bp, Bovine  19866881200506
tgcttggttccgccccgggttcctccttgcagactggggaatggaacaacttagctgcttttactggaaatccccatgcctccatgctatggtaatatggagccagccaaaccttgttttccactcggggctgatttctggcaaaattcccattgctggactccagtactgacagaggttaatgggtaccatttagccactctcggcagcattggtttgatcttcttggctccgatactcttccttctcttggcacgagaaaattcagcttttgccctttatcttgttatccaagagcctgaatgcccatgacagccgtggatgcagatgctgccccttctaagtccttggcagagcgggagaattcagaccaacgcaggcaacatgcactgagctcttgatttttttcctaaacagccagctggcctattgctgaaaccaagaccaatcagaaaagacacgcacgcatatgtggctgggactgctttgtttcctcctccaccaagaaagacaggagaaacagttcctcacactcagtaaggaaagatgattcagtgtgccctgaatccaaagaactcttgactaccctcaagttcttcagttcctagaggtgcctcagccctcaaaactgcacatgaacttgactttggaagaaaaatgtcaaggtcaacttgactgcctcttggcaaacaagtacaatcagtggccatcacatactatgggtcgttccatcctagagtgcccagtgctttctcagatccactcggaagggtcctgactcagaacccacagcagagaagtaggaaggagagggccactcagaggttaggacctatggtcaacatggaccatggaaataatgtaaaatcctaaaattcttgaagatacgtgaagtcccccatcagcacagcgctgtatcacacctccactgaaggcactggggctcatcagcccatttagtagaggcatttctcccccagccctggaagaaattgccttcacttcagttgagcatcagatgaagtagttggcttgccttgcatgctaagtcgcttcagtcgtgtccgaccctttgcgacccaatggaccgtagcccgccaggcccctctgtccatgagattccccaggcaagaatactggagtgggttgccatgccctcctccaggggatcttcccaacccagggatcgaacctgagtctcttacatctcctgcattggcaggtgggttctttaccacttgtgccacgaaacgcataatgcaaatcttttaacccaagacttagcctcagagaagcaagagactggaaggtgggactaggactccttgaggacacagtctccccctggcagatgcttgcaagaagagaggggtctcgaactgcagagacaggaggacacatacatgactcgatttccccaggaacaccctcctgcccgccctcctcttttctgccttttctctccaaccccagagctgaatttgctcatgtttgagaatgcatcttcatttcaaatacagatgggaagggggcttaatgatctatttagaattcctgcccctttcttcatcgtgaagattctagaattattccagaacaattctcatttctacctacacgtaagctccaaaggttcaaaaaagtatggaggaggatattctgaaatcaaaattctgttcccttattgcacagggaagaattgagagcgctaagggtgcagcctggcctcagtttaataactctgaaatgggtgtgcaacacccttcctttgtgggaagcgtgaaatcaggttaattaattggcttcctcagaggagaaaatgtgtcatcctcttcaaaaccctaggatgagaggtgtgaaatggtgtcattgtttcataaatcactacatcaaacatgggacgcctataaaccagcaacatgtaattatcataaaaatagcacacttaaaacttccagaagagtatgtggtgtattcttttggaagaacacacatggtcctgagcaaaaaacccacctccaagccacctgccaggaccagcttcctctccttgaatttcagcaatgccttccccagacatcccgattccaccctgccttcggtgttataaaaagaaataaatatttggtctttgtccccatttctgcatagagctcttaaaaacctttggaattttctgaggagatccgcaaaagtgtcttttattatgctgatgaggtaaatttgggtagtatctaaggaccaggcggtggttgcctggggaagcaaccaaggtattagaggatctagaac

SEQ ID NO: 42342 - DNA, 1850 bp, Bovine  19866881225117
ataagtagtatgccttgccttgaactgtttttatattaaacactttattttgtcttccattaaattaatttacttcacatgcattattgaatacctatcgtgtgctagtttagacttgggaatctagcactgaatgaattccttctccaaagggcttgtgtctggtttgaggaagattgataattaacacataatatgtcaagttacttggataacaaagtatgaaagttgaacataattattcttgcctggtatgaattacatatccccagtagtttctcgtttattggcaaactgactgacagtactttctgaacctccgattccagctattccatgtgtttcagattgtatttcactttattttagtaaagatcagttgtagtactttctcagtaggcaatgtgagcttgttaaccttatgaggttcaaagtttaagccttgtggcatgatgttttgaggctgtagggtttttaaattgtttgaacatgaatgtctcttagagggcatttgcgttctccacttcattgaaatgctcacaggtcttttattcttgtgccaggtctgtgttactcatctatgttactggcctgggccttgtaggcatttgagtttagagtatcttctttaggcactttgaaaaatagtgcatttttttcaagctggggaatctaacctagataaaattcagttaggttttgtttaggttccgtattttatatttcttttgattagtctgaacttttttgtgggcagagttgaaagggattgcttacctttctctaacaagaggatctgtttttagaattcaaggctgtgtgggttcaggcacacacagtgtttgaggctgtgtgtatcaagtattagataaaccaaacacatggctaatattatttggtttgttttaaatcagagattgggttgagattagcaaggaattaagtattttaaaagttgtcgggattgttgttttaagtgttgaccgcagagtgatatgaaaacccttcttgatctttggctgaaggtatgaacaccagccggtgctcacccttcaaactccctgtagctggcagatgctgatctgtgttctgccttcctttctactgtggtgaagattgggtggctcctgagaaaccacatgctagctagtgttcctgctgctgggccagactgttgtagacagggtggcttatttattgctcccatttctggagatgagaagtccaggatcaaggccctggcagactgggagtctggtgagggagcctgcttcctggttcatagaaggccaccttcttcctgggtcctcatattgtggagagggtgagggggctctctagagtcactcagttcattcatgaggatccacccccatgatctgaaaacctcccaaaggctccacctcctaataccatcaccctgggggttaggatttcaacacatgagtcttgaggggatgtgaacattcattccataataggtagcaagtaagtgaattggttttctgtggtttttcaagcaaaatatatgtggaaatagctataacttctttttagatgtggaaatagtagttaaaattttctgctgtgacttgtgcctttttcattttggtttgaaagtctgttctcaaagatatttaaaagcagagcttttttttttttttttctttagtgccacatgaaagatatccgagaggcatcagaaatctttgcttctgtactgggacttcatcctgtccttacacctgcgggacttcacatcttaggttctttttcctccatcaaatctttgccttggaggtttggtaaaagtgtgggacccgtgcttggaaagcaggcagctccagtgt

SEQ ID NO: 42343 - DNA, 2343 bp, Bovine  19866881323774
gcagaatttagaaatctgtcatactgtacttggatgtcttccaaaataaaagaaaaaaatcattcataatctagcactaaaagaaaaattcatgagttactttcaccacacttagcaaaacgaaatttaaaattctaagaaactagaaattcatcagtttattggacacaggcaatacttttaattttatataaataattattctgtaggaatatgtctaaaaattatgaagattagagcaagaacttattccaatctaagtcacattacatttgaatattctagaaatcattaattgtttaaagtagcctgagaaagaaggtgcttctggtagatcacagtctaaccctaatatcacagtttttacttggtttccaatttggtaagctaaattctgctatatcttttaaattaagtaagtaaaatattcagatatcagtccattaaaataaccactggacccaaatgaaaacagtaacaacagctaatattagcatgcttattacattatcaggtactgtgctaagttccttagatcctgttttatttcattcaatcctcaagtgacagaatttcacaaaaagataattactgtccaaaaggcatcctttaagtttctagactggcaagtatttttcttttctctttcttaagtagcagagagaaagtacactcccaagaaaatatgagaggagactctgaaaaccacaagcagtcagaaaacaattttctaccctgaatttcggcaatctctgtcctatggacattttttaattggctagaccactgggataaatttgaggtgctgggttataaacagaaatctatgtataaaagcatctggagaatcctttaaattcagtgtttttattataagacatatattaagataacttacaaaccatgccttgaacacagtgatctttgatttttggttctgctattctatctccctcctcaaaatacccttgtataattttatcagaacttctagattccttgcaagatacataacaggccttacaagatggagctgtgaatatgtatgcctgggcatatttgcagtatgaggtagaagtaaaggagaacctaacaaaaaaagagattcatgccagacacaagattcaactgtatctaaagtgtctcctacaaactatttcttgtattccctaaactatctgcttttcactagtatagaaagattttcaagtgagatcctgagtttacatttcacaataatgagtatctactcaactttcttctgtaacaaaccccaaaaaccattaagcctcagaaaacatggagaaacactatcctctcatgaatcaggctggaattgccataaacaaacaaatctaacccctaaacaaatggtgaatgtttacctggtctgagagtatacaggcctttcacaatatttgccatagttgaaggtgtgacctgaaatggtgttgactgggcttctaaaagtaaagctgaaataaagagaaaacgggttacaaaaatgatgcaactcttattgattgtcaaggtttcgttttctatcaccatttcgcccaaagactgaaggataaacaaggataagaaaagaacagcttaagagggtaaaacaagtatttatacactaaatttcttctttttaaaaattaatccaccacagtcgagttccatctaccaagtaaatatgtgcttgtctgttgaaacactgatggaaatgattcgattgatggaggttctgaaaataagcaaagctttattaaagcaacagtactcacggtacttaagtgctgctgctgctgctaagtcgcttcagtcgtgtccgactctgtgcgaccccatagacagcagcccactaggttcctctctgtccctgggattctccaggcaagaatactggagtgggttgccatttccttctccaatgcatgaaagtgaaaagtgaaagtgaagtcgctcagtcgtgtctgactcttagtgaccccatggactgcaacctaccaggctcctccatccatggcgttttccaggcaagaatactggagtgggttgccattgccttctccaggtacttaactgagtgagctttaaatacttcacattaagttcatgatttaaaacacttacatttggggaatgaaagttctctaactcccttcatctctaactccttcaatcatttccctttcccccaaatcaccatatattaactaacaaatactcatgaaacttggggtaattttagtctaagccaggcttgtcaaattattgttttttctattcacacctttttaaaaaggaaatgccatctcacttgttcaacatttctgtagtttcaaacatgca

SEQ ID NO: 42344 - DNA, 898 bp, Bovine  19866881373701
ttacccatcagcctctgcatgcccagaggcccagttccatctcctacgtcatgggcagcctgtccatgaagcaggccaacttttgtcttgttttcagtttcctggtcttatccttgggatagtgtccactcacctggaccgggcaggtgaggcttagaagaggaccgaccctgaggttgtagctgggaggtccggtactggtggagtcaggtactaggaatgcgtggacagtggtcagactaaggctcaggtgcgctgggtttgcctcaagttggggtctggcatgtggtatgtgggcagactcttggtcaggcaggccacacagggccctggactatcacgctgctctcctcttagggtacgaggaaagacccccatgggtatgctgttccagtgaccccttggtcaagtccctaccacctggttcttcttcaggcgcatctcatcaggctgttatttccatcctggtgctgctcaactttgatctgggaaaatgaaaggccaggctgccgggtccccagctgccatcttttgcagcaagagtgagacttcacgatcccgctggctcgcgtacacttcatttcccagtaattaaacaagtggagatcaaagctgacaaatctcccccatctctcagcgcggtagatgaaaggtaaatatttctagcaacagtttttttttccccctcattaaaagtgagatgtgaaatgtcttctccctactttgaagaatactgctaagttcaaggtcactccagataagatatctggtttgagtacctttattattccataccaatcatcagtcttatagaaactgggctagcttgagggggattggaagaggctaaatcatgtcaaataagtcaaagacaaagaaaagtaaagaagaaccccaa

SEQ ID NO: 42345 - DNA, 974 bp, Bovine  19866881377404
tgcaaggagattcaaccagtccattctgaaggagatcagccctgggatttctttggaaggaatgatgctaaagctgaaactccagtactttggccacctcatgcgaagagttgactcattggaaaagactctgatgctgggaggaactggggcaagaggagaaggggatgacagaggatgagatggctggatggcatcactgactagatggacgtgagtctgagtgaactctgggaattggtgatggacagggaggcctggcgtgctgtgattcatggggtcgcaaagagtcggacacgactgagcaattgatctgatctgatctaaatgtcctcatcacaaaaaagaaagggtaattatgtgacatggatggaggtgttaactaacactatagtggtaatcgttttgcaacatacaagtgtatcaaatcaactagatgtacaccttgaacttataagactatatgtcagttacatctcaatgaagctggaaaaaagattccatattaacagttatatttgggttgagaataaagcatattttcagtaatgatgttttctagtggactaacatatactgctctatatttattagttattttataaaagctcaagattcaaattcagagaaattaaagtagaataaacatgttcccatatgccttcttggagaagtttctttgaggggccattcagcaaagggaaatttataagtctcaagatatgacccaattcagactcaccagcactgaatgggactctcttctgcttcatgaattgtaacagctcgttaactacagcatgagttcttacaacggccagatgagcatggaaaggaaatgtagcatttttcatggatattaggaaaaattccttaaaaaattcttaaatcctccaacttggttttccctgcatgttcccccttcctacagccccttgacaaccagggcctcatggtggctgctggaaggacag

SEQ ID NO: 42346 - DNA, 1158 bp, Bovine  19866881421826
ctatcctgcaggtttcctgattaaggacagacctcccttcagcatggagaaggcaatggcaccccactccagtactcttgcctggaaaatcccatggcggaggagcctggtaggctgaagtccatggggtcgctaagagtcggacacgactgagcgacttcactttcacttccttgcagcaactcttcaacctcatggagacctctcgtccataaacaactctcctggctctctagccacctgccccatctgtctttattttcttatgcagcttgaagtttatgactgattcatctttttcatcactgatccaactctccttccattgcatgcatctgacaaaaccccagctttagaagaatatgatcatttacatcaatcagtggcatcattcttgaaacctttctttccctcaccttcaagctttaacccaagtcctgtccattcaagtaccaaaagagtcctgcagtctactacatttttcttcagccattaccatccccaaagtctaagtcatcgttacctctttaaaaaaaatatttattatttggctgcattgggtcttagttttggcacttgggatcttacagactctctagttctggcccaaggctctgggctctggagtgtgagggcttagtactcacagctcagaggcttagtttctctgtggcatgtggcatcttagttcccagatcagggatgaaacccatgttccctggattgcaaggcggattcttaactgctggaccaccagggaagtcccccaccatcttctcttgcctgaagtattgccataactccctaattggtctcttttcccactctttccttccctataagccatttccctcaaggtagtgagatggccctatacaatgtaaattacatcttacagcacttccttatgtcttttccattcacacagaaatatagactcctcaacaggaggtagagagcacacatgtggccatttccttttgttggtgttgttttgtcgctaagtcatatctgactcttttgcgaccccagggactgtagcctgccatgctcctctgtccatgggattttccaggcaagaatactggcatattttcttgcctggaaatttccaggcaagagaatataccaatagtatattggtattccaattcatat

SEQ ID NO: 42347 - DNA, 1670 bp, Bovine  19866881649121
ctgtaagttctggcatttgatcaagaagttaatatatcacttcattttcaggctgaatatgcctcagctataaacgttatattttttgatggatagtatacaattacaactgcccagaataaaaagtgttttcatttgtaatgtgagtgatactagaagttattatggatgtcacaaggagtagtgaaacaatgaagccttgcgttgcttcaagttcctccccacttaatatctgagagacactcactgaacacctaccctgttagacactaagctaactcatgccgatgcaaaagtgaatgcgcacagtctgctgggaaatgtttaggaagcatgttttggacaacttgattttcaggtaggctgttaatacaaagggacttcccaggtggttcaagtggtagagtccgcctgccactgcaggacacataggcgtaaaccgtggggttcaatccctgggtggggaagatcccctggaggaggaaatggctacccactccagtattcttgcctggaaaacccaagaaataacctggaagaaaagtgaaagtgaaagtcactcggttgtgtctgaccctttgcggccccatggactatacagtctatggaattctccagaccacaataccggagtgggtagtctttcccttctccggggaatcttcccaaccaagggactgaacccaggtctcccacattgcgggcagattctttactggattctttaccagctgagccacaagggaagcccaaaaatactggagtgggtagcctatcccttctccagcagatcttcctgcctcaggaatcgaactggagtctcctgcattgcaggcggattctttaactaactgagctatgagggacgttctgcttggcaggtaacaggtcctcaattaacagtaactattcatagtccaaaagcctacactattttcccccaaactgctaacatttacaaactctgtgtttaccagtcgcattttagaaattgtaatgcataaaatatggactttattttttatttttaattacattttgataattatgtataaaataacatgaagagatcttaaaactcaaatttggtcatctttcttctctgcctaatctttcaacagctccctattacagctaatataaaatccaaaattcattaccaaggcattcaaaaagtctacaggatctgcttcctgcctctctgcaacctaatcttatatcacactctaactcagtaaactctggccacataatttagtttcctgaacaagccattttctttcccgtactaaagtctttgcacttgctcttccctctgcctgaacacttgctccacaaccactcatatcacaggtctagctccttctcattcttcatgtttcaacccaactgtcacttctacagaggccttccctgacgactctctctgaaaaagtcttttaccccgccctgtatgtgctcttctcagcaattaactttgtttttaaggcctatccaaggcatcgaccaaatatttcctaacccaatctacagcttcaatattactaataatagccgttatcattaatttaatgttctcaggccaatggaccgtaataaaattattcaacccaacagcatctatacttataacaatagctctcaccataaaactaggaatagccccattc

SEQ ID NO: 42348 - DNA, 739 bp, Bovine  19866881797744
gcgagccagcgcgaccggttacctggcgaccccagaccgaacggccccagcccattggtcgagatgtcggagccaatgagaaggcgcgatgttggcaggccttaagatggctgccgggcggcaccgtccggactggtgagtacggctgattgctaggctggttcttgtgctccagggagacggacccagggaagacagggtgcctggaacaagggagcaagcgcgggaggcctcacagcctctcggccgagccgtaaaacctttggtcaggcccgcaaagcctttgaccgggcccgtgggagcgtcggctgaaccggcctccgccttgctctgacgcggcgtcgcggcggagtccccgtcctgttggtgggagaggagttctccgtcccaccccggccggagtgagacgggattaggctttcgacccgggaaatgggctcttgtttacagttgccgtacccggaaacgagctgcagttgatgggagagtcagcaaggtaaacatcctacatcagaatctgtggcgcttagttctgtgccgggatgggattcttcccatttgggcatcggagtgtggcccagctgcaggagagcctgcagagttccgggtggttcagccctgcagcgaaaggtgtacgtttctagagccacccctcttgcattcttgcaccctgtaaatattcttacggagacatccaattttaaaatgggcctcgaaatattattggctacctgtaaat

SEQ ID NO: 42349 - DNA, 842 bp, Bovine  19866881827577
actctggtttcctgcttgctctgtctcttcaaactgttttaacttttagtatgccttgtaaattgttgctgaaagccagataagatgcactgggtaaaaggaattgctataaacaaggcttcagtgatgttgccttgaagtctgtgggtaggggaagagaagcattctacagcctatgagtaggtctcactattttagtgagccaatgccctgggcgacaaacttcacaggtgtttctccagtttgggggatgggattgttagagagcgctgctgctgctaagtcgattcagtcatgtctgactctgtacaaccccatagacgacagcccaccaggctcccccgtccctgggattctccaggcaagaacactggagtgggttgccatttccttctccaatgcatgaaagtgaaaagtgaaagtgaagtccctcagtcatgtctgactcttagcgaccccatggactacagcccaccaggccctccatccatgggattttccaggcaagagtactggagtggggtgccattgccttctacagttagagagcgctaggattgggtatttcctttctcccaggtgggttaggctctggtaaaatagcttctcttgagggcagatctcattaagaagaacagaatattctgagggtgtctcaaaatggctgcttttcctctcctcctgacagaagcagatttttctctgatcttcactttaagaatctggtggagttcctggaggtaaaactcacaaagaaagggccactccatctaagcctgggccccctggagttttaaaccctggtttgtccacactgagcctccagtattcaaggccggggg

SEQ ID NO: 42350 - DNA, 760 bp, Bovine  19866881857717
cttggaagcatctctctaaagaagtgaatacatgttatatattttttatagaggaggaaactgagatgctgggagatttaggagagaactctaaagcaagcagaccctctctatagcatacaagagccagggttagggccctggccaggcctttgctctttctccctcttccagtgattcttaaagtatgatccatgaactaccagcaagcagaggaatcacttgttagaaatgtaaacttccccgtgtaggaagctgggatggaagagacgaaacaagccaatgaaacttgcacatcttatcacaagatggagcttcccttgtgactcagctggtaaaggattttcctgcaatgcgggagacctgagttccatccctggcttgggaacatcctctggagaaggaaaaggctacctactccagtattctggcctggagaattccatggactacagtccatgggtttgcaaagagttgaacacaactgagtgacttttactttcacttttctttcacttatcacaaaccatagggagagagggatacctcagtataaaaatactgagtctaattccattaatataaatgctcatatccccaaacaggctggctgtactcataagccactttcattaaaggaaaaaagaaaaaaaaaaaaggccagaaaaagaaaggttccgtgtcaaagaactcaattggaatcctcgcttggtcctcgcttccttgccagcagtgctcaaaaagaaaagagaagaaaatc

SEQ ID NO: 42351 - DNA, 2251 bp, Bovine  19866880425179
gaaaatcccatggatggagaagcctggtaggctgcagtccatggggttgctagagttggacaccactgagcgacttcactttcacttttcactttcatgcactggagaaggaaatggcaacccactccagtgttcttgccgggagaatcccagggacgggggagcctagtgggctgccgtccatggggtcgcacagagtcggacacgactgaagtgacttagcagcagcagcagacagtatgatacatcatcatcatcatcactccagtcatttttgcaaccccttcaggctcagagatcacttcctgccaagacaggaagtacaaaagaaaactcagagacagatggcttctgccgcagggtcatttagaggtatgctctgcaggcctccgctgatggcctaacccatctagcttccagccttgcacaagctgacaccctctctgctttctccacgtccaacttctgcctcatcaacaggccacagtccacagcccagaaaggcagaaccaaaccccaaactttatacacctacctttcaaggagtcttttttggtctgtacatgaacaaagaagagcattggtttgctcaatatagtttccctgtagtctttataatcgcagtagttggtcagttccacatatctgtgaaaaaagcagagatgattacaaatgctatgtagccttccactgaagtcaggacaggcatgtactggacacgcgtctgctatatccacagaccctccaagggaagtcctctaaaatgtattcttggggaggcagtcatatcttatatcaaataagtaattccccctcccctggttgacagacagatcaacatgccacccaaaggtggcctggggctgggggagcctggcaccagcattcagctctcaggggcagcctttaccaaatgatgaccactaccatctttttgggctgtaagacagcagtgtgtgtgtgtgtgtgtgtgtgtgtgtgtgcacgcgtgcccactcagtcgtgtctgaatctctgtgaccccatggattgtagcccactaggctcctctacctgtgggatttttctaggcaaaaataccagagtgggttgccatgcccttctccagtgtatcttcccgatccaaggatcaaaccctcatctcttgtgttggcaactggattctttaccactagccacctgggaagcccctaagatagtgctaccagagcactatgtatccctgaattgagaatgaattatccttcataagtggacttctcaaggtcttctccagtgcagtcatcctaactgatggatctgaaattttcctttccttctctttttctcttcctttttctaatcctgagataaacccagccccctccagagatgcaatattcacatgaactacttcacgtctcccccgattgtgagcttgtacagttttaaaaaactaatgtaggatttctgcccagggccctattcaatttagcctccttggtcttagttcattatttcaacccaggaagatctttttgctttttgactgtgtcttccagcatgtcagtttcctctccctactctacacattttccaagccgcctttctgtgtctctacctgcattgttgatttaaaagaagacagatgtaaattggcttctttcaagaagatggctaattttctagccaaacccaagttcagaagcggcgtggacacgggtgggctgagaggtacccagcgggctgggggatgcatctgccctgagccctcttcaagacagggtggcctccccactgatgggcatcgctatgaggtctgcgtggggtgaatggggggcttttgctatagggctgtgtgttggcttctagtcccaggcagagaccgctcctgcatttctggtttgtggtccttccagaacctgacctgaaaaatcaccgccttgggaccacctgcagctggggggctctggccacacagtccgaagcctccttccccatcaacctgcttagaggggctggagctggagacccagaccaaagcctgggtcaagagcagtgggagaatttatctacccccgagtcaggaaaacacagcttccgctcgtctgcctccagctctgtctcttagaaatctgtgtcatcatctttttttctgggattgtcagatctgatattgagagcttttaaaacctgacccccgatggagcacctggaatgcttcctgccttctatttcaccaggcttttaatgaagcctccacctcccaacc

SEQ ID NO: 42352 - DNA, 1498 bp, Bovine  19866880488097
tggcttcttgaggttgttttagcagtttcttttacttagtcacagcatggctgtgatctgctcccactgaacagatgttcttcatccatgtacatcacctgtgttgaggaaagaaaatgctctcattactgcagtcctcaaagctacacgctactaatattaatgtccaaacatcattacatattctcttccagaaaacctttatcgttttggctgtttaaaaggaggaaagggaaaaagaaagagaaagtggatagcaaagcaaagcagaaggaaaaaagaaatattcttgcccagagatgaagaggagaaacgaagctgggcacgttttccctacccaaagtactagaccaagcactctagacagcagtggagtcccaatctcaccgaagagatgaatcacggagacaaacatgattttgtgtagatcataagacaggaatgcctctgtagtttaaaaaaaggtttctgcttgtattacactagagctctccaaacaactgcgaacgagctacagtgaacagactgcttttgatacgacaacacaatttagatttctttagacaccagaaagtctacatttttctaattgccaagatgttataagaaacacaaactaagttttatagcagtatataccatccgagttaattcttcaaggatgatttaaacatagacccatagtttaagaaaaaccagataaaaaataaaagaccaccttgtccaattagagaaaccgagttaaatacttactaagaattaagtacttttctctgtagatgaactgaacagtttcttagtaaggaatctaatgttgttcaattaaattacctttattccaactccaccatttttcattggaaccagatcgtaacttaagttttccttctccttttgaatgaaggggtcattgaatgctcgggccatgaaacctcttaaaattagacactgtattgtttgcatgagtgatttgctggaaaagaaaaaaaaaattaaattctaatttcaacatctatcactagccatagcaattaaaaagcaagtcacttgttcaactcaaatcaccaggatataagtaacttgcccaagagccctgaatttctccaccaatgaatacactttattttctctccttttcctacagaaatgccaggagggaagcagtgagaggaatacacacacaggcttccaaatctgcaagatgaactcaaaggtaatgaaactatcaactaaaactctgaacaagccccaagaactttatgtatcactttatttcattccttttctcccactgaagcttgttttatacctaacgaataactgaaaaagggtaattagaaagccctagagtccaatcacgtttttctaaaaaggagttaactgttatagtctattaagtcgctaagtggccaggataagttattctgagccacaaaatgtatggattgctacttttcctatcaatagcaggaatattaataatctataccaaaaagca

SEQ ID NO: 42353 - DNA, 1332 bp, Bovine  19866880535414
ttaacgttctccagttcgtgggtcgcccacctggtgggtatggggtttgattttatcgtgctcgcattcttccaccatcttgctgtggcttctcctttgtccttggacatggggtgtctttttttggtgggttccagtgtcctcctgctgacggctgttcagcaactagctgtgattttggttctcttgcaggaggaaggaagcgcacagccttctactccaccatcttgaacctagtccagtttagttcttaaattcctgctgttctttttctttccaaatggggtgttttctttttaaaaaaatatttattctcatttatctggtcttagctgcagcatgtcttgttgcagcactcaggatctttagttatggcatgtgaagtcttagttgcggcatgtgggatctatttccctgaccaaccatagaacacacgtgcgtgctaactcacttcagtcgtgtccgactctttgcaaccccatggactatagcccaacaggctcctcctctgtccgtgggattctccaggcaacaatactggagtgggctgccatgacctccgccaggggatcttcccaacccagggatggagcccaagtctcttatgtccctgcattggcaggcgggttgtttaccactagcaccatctgggaagcccagttgaacttcaggcccccacattgggagggcagagtcctagccactggaccagcagggaagtctgtcctgccgttctttgtatcagcaccaagaaatacttcctgatatacatcctaagctctgcagactgcgttcatcgcatgttgaccaagtccagaccccagggctcacctcgggagccgtcttctctattcacgtggctcagccccccaactcttaagctcccacagcctggtcactggaatcaaataagacgattccatccctttgctgatacttcctgaaacccactgtgatctgccttttgcaaacactgtcacaactcaagacagactgtcattgtctctcctctaggaatgagcaataaatgggcagcacaccaaatgcctgacaataatgatgagtgtgacgggtgagaaggggcgataaagacatccatcacgggtgcggagaggacccaggcagtgttgaagcggacagaggctgcggagagcttccaagaaacagaaccggagagggctacacaggaggattaactcttctgtgcaggtaaagcaacccaaggttcttggagtctcatttctgagtatacaccataccaaacatcacattacgtgctaatctgtaatctgtctcggtcagaaagtaactagaaacatggacttccacacg

SEQ ID NO: 42354 - DNA, 2163 bp, Bovine  19866880625500
tgtcttgttggcctagcgtactaagtaatttagaaatattttcccatataaactgttcagtaagtcagctggatcgtagcagaaatcacagttcagagctgagagcgattgtgcagatagatcatcaagcctaattggttcctacagttgaagttttaactgtggtttcaatgatccaacatttataaaacccatttactttcttctgtgacctcatgctctgcttcattatgcatttgaaagtttccatatccagcagctgtcttcctctcttctcatactcctaggagggaaaaagaataattagctatgaacaagttgcattttgtttagtctgggagcaagagtccaaagaatggaacgtctaattggacctgccttgaactttgtcaatttcgaacatgctatccctttttttcacttctctgatgcattcacaatttgtttctaattccattaagaagtgacaattacagagaatttattcttcgatgctattttataggaattaaaaggattgtacttttcaccgaaaaataaaccatcaaaaagagaatcagaaagctcacctactcagttcctacctgaaacagtgcatttaagtgctgtagctcttcaggagtcacttgatgttctatctcaccaaaacaaaaagaaaataagttgaaaacatataatgcgaataggaatgcccataaaatgcaatttctggaaacccacgattcctcgctctgtgggaggccaatgggtagctgagcctgtgagtaacacataggctattccaactttcattgttccagtccctactccaattcagctgattccccagcccctagctatggggcaggcttggcccaaatgggctggaaggaagaggtggcaaggtggtggaaggaaagaagaggacaggcattgacttgggagagaaaagatcaggaactggagtaataccagaaaagaaagactgaaaatattttgccagatcatattccaaagatgctcttttccttctcaggagtccagcgcatcagaactgccttgtgtcacatcctctgctccccggcccatctcatctaggctgaaccaggaggagaccctgggggaactgacccctttttctgggggtaaattctctgaagctattgccagagactcttggtactcttggtattagagaatttcattaaccttaagtaggccatcctcagttcaataaacagactcccagagaatgcctctatctcaccctccagtcttataactattatctcaacagtttgcctggggttttcctggtggctcagacagtaaagaagctgcctgcaatgcaggagacctgggtttgatccctgggttgggaagatcctctggagaagggaatggaaacccactccaatattttgcctggagaattccatggagagaggaggctggtgggctacagtccataggttcacaaagagtttggcctttataaataaaaatggttaaacttctggcttataaagaatgaataaattgtcatagtggatagagccaaactaagctctgatgttcttgcactgtctcacgaggccagaggaagatagcaaagcagaaaatcagcatttccttgataggatcatcttctgaaatttctgtgatcacctcaagtttccagggtggtggcctttaccctaaaactcaggctgacaccaaagctacagggagacccaccatcttgtaaaattgaaacacctgccaaattctgtcttaaatgactcaataattacttttgaacttgctttcactgaggaacaaaattggaaaccctagcgctagaatgggaaaacactccagctgtagtttccacttaaaatttccctgtaaggctcttctggcaaggccggaacctggggaggtaatgtttaaaaaaactgaccaagagaaagaccctaacagtattcaaatacatgtaaaggatgattccatcaaactgaggggctatttctcctccccaataaaagatactaccctgaattaattcatcgcttgcttagactaagccttctccagcatccacaaaagcagtggagtgtaccaggctcatacacaagaccaaacaagaagatagtgccctctaagagcatgtgacttctaatcttccaccccagatgggactcc

SEQ ID NO: 42355 - DNA, 849 bp, Bovine  19866880639906
ctgacttgtttataataaaaacatttggtttgacttccacagaatccagcctatgatgcaaatgcttaagcgtgttagcccacattccttgtcgtccccagagaagttctgttcagaaagcgagaggggtggaaacaaacagttcctgggagtgtctccagtcagcgcccttgcatttagtctgagccatgcaaataatttggatgctaaaactcaagccctacgtggaccttttaaatgacaaagcaattatgtgtgtctgaggagacagacagtgtctctttaaacgttctttctgttcctcgggtgtgttgtaatcagcagatggccggccctaccttccccagggccccccttgcagcagactcttctaatagctaatatcctgcagcgaccaaggccattagaaggattaagccattaccctcctgtccagcaaacacacaacgctcacaagggccgccttttcctcttcggttgttgttttcatggatgaatcagggcctgatgattggttgaaaaatcataacagggagggcagagggttatggtcattcttttcgaggacacctccctaatagccttgggatttgaaggtcctttgttagaagaagggcaggagtcagttttgtggctcgagcaagctctgaaaatacaaacagcagtcagacctgtgccctcaactccggaatatctcatcctcaatttctcgagcatcagggtaagcctctttgctctgcctgttcacacagccagactggctgggtttgttctgctcaagacaaaccaccagcccagcccagagccacgtcgccggctcaggaatactctgaaaatattgccacccag

SEQ ID NO: 42356 - DNA, 1805 bp, Bovine  19866880658739
cattgaattcgccctttggtattatagattcctgggctgatggcttttgttttagctcatgcaatagctatgggtcttattatggaggtgaagctatgcagaccatccaaggagagcttgtcagttggcatatgatttgctgaaatgcaatcacccaaacgtcaggagtggattgctctttattcccactagcactaggggaatttgctttgacatttcaaaaatctacatcactggtggagtgaggggtagggttgtaaaatgtgccagcacctctctctgaagctgtgagtgtgttggcagctcattttattgctggtcgtctcctatttggctttggatgcaggacacaccgtgtggctttcatcacttccggaagccacagccacactggcaagatgacttggagagccctggtccactgtctaactctaaacccaaacagtggcacttgatggggatgtcattccctccagaggctcaccctgagtcctctgggcctgcccagggtggtcacagcatctcaagagcctccggtgtggtgggactcgtgattgggtccaggtagagccaggagccctgagctccaagcagctgcttctgctccacaggagggatggcctttgctgtttggggcatgaggcccaggagcaagtctgcacagctctacttgaattcagcctggagtcctattgtgcaagagtggcaggccaggacctgctggggatgactttcttcaaggaagcatccacttcctgcttctgctccagtgcaaaaccacaagcattcaccatgccatccttgggtggccagggaacctaagcaatgacgttcctgctgccccatggcttgttaggggcccagaaccagggaacgtcttataattcttattagcacttaaactgcccccaaccttctgcagcttcccagagccaaatgatctccctcaaaactgtctggattcacattgttgtagtacagcaaagatggatacaacattgtaaaacagttatcctccaatcaaaaataaatttaacaaaatgtctggatgtcaagccactaagacaagtattaagaaaggaaggtcactgtgcacaagcacttcccatcagccaaccccaccttatgccctgcaaatattccaaaagccacaagtcactagaatacaaagtcatgaagacagacctcatctgctttctccattgtattcccagggtgtagctcagtgcctagcttatattaataggctttcattcaaccaacatgtgtcaaacatgcgcccagcctgtgctggtcactgagattgcaatgatgagcaaagtggtcgtcacatggtccctgcctttatgaagtttgcaggtgaatgattattaagtgaaagaacagagtttgcataaaatgtccctaggaaagccacagccactgtaagggcagaaatcatgcaggagtcagggaagtattagttcatccaaatatttattcattcagttatcaattctttcaacccctacttatcaagcacggatatagtgccgtcctttgtgggtaggcacacaggatacaaacatgaattaagtgtgattcccagcccagggtctcacagactggaaaggagataaactaaggaagtaatcattatacgatgtgacagatgatgtaataatgtatgaaatactagagaaacccagagatgggaactaccaattttgctttaacatcatggaggatattaaaagattactaggatttttctgggaggccaagtaggaaaaggcagtacggaatgggggagaatgaggagaggc

SEQ ID NO: 42357 - DNA, 1678 bp, Bovine  19866880704585
ctttacagaattttgctgttttatgtcaaacctcacccatgaatcaaccataggtatacatatatcccctcccttttgaaccttcctcccatttcccagcccctctaggttgatacagagcccctgtttgagtttcctgagacatacagcaaattcctgttggctgtctattttacatatggtaatgtaagtttccatgttactcttcccatatatctcaccctctcctcccctctccgcatgtccataagtctattttctatatctgaaactgacacgttcttgagaaagaattgacggcctagtcatcagctggggaaactgaggatgtccgaaccccaggcagttatcagggcctctccagcctgtggcacggagcggccggctccccctcctccgaggggccagccccatcgttcgccaggtgtgcgctgcgcctctaatgggacaggatgtcacctgcaacctgaactcgatgtcttcaggttgcagttttgtttttttccatagatttgcccaccatgagcattcagaacagttgcttagtgaggaaggaatcaccggtaagttttatcatgtgaatgtttatctgatagcccaaaatatctcttcctcccacaccaccagaggtctagagctgcagtttatttattcattactcctgttgggttgcacttgactacgaaatctgccaaaaattaagatgcaaaaatgtaatggttgctgcagtcgtgcatctgcttttagctgttctcttttgctttggcaagtcgtcctctgcctgttttgcctcaagatgctaaaatgcagtcttactgaaaacacaagacgtttttcattcttctcatgtgactggaggaaccaggaacctaagcgaactttctgtctgaaacttaatactgtacttggagttgttactgcagtgggtgaagctgttcttattttctgaaacaatctgggtcattgtgggttgtcactcccatcgctaggtttgaagcttacagtgcagttcataatggttttgaagtctatagtgagacatttcttctaaagaggaaggcagcagactttaccaagtgcatcctatgtgcagagaaccactctggattgttgtggagcagtttgagaggaattaacagatactccagttccttgaattacttatagatggtggtggtggtttttcagtcgctcagtcatgtcctactctttgtgatcccgtggaataagatagacggtaacaatctcataatagaaaatgcaggagacgcaggtttgatccctgggtaaggaagatccccctggagaaggaaatggcaacaacccacttcagtattcttcaggtgcctggagaatcccatggacagaggagccttggtggactatagtccacggggtcgcaaagagttggatatgactgagccagcacacacataagtagaaattaaaaatcaagttaagtctattaacctatctatttgacaaatattaactgcacaattctagctatattaggtactttcaaacatctctagacagtccatgggacccttgaaaagacaatagtcacgaaagctgtttaggaagcagagtgatgtgtaaaaagcatgagtgaatatagtgccgacagcgcatgtgaagcttgaggagataaagagggaagacttgtgtcaggtcg

SEQ ID NO: 42358 - DNA, 1854 bp, Bovine  19866880705630
tttgactatatggaccttgttcggcaaagggatgtctctgctttaatacactgtctaggtttgtcatagcttttcctttgctctgagaactagcaaattcctcgagggtaaagaagatgaatatgaggttcccatgggtgggctcccctgctctctgggatgttaaccctcacatcctgtttgcctgttgctttctgatgccctcagtcatttgctctaagaatttctccagctgttgtacttgttcttggtgggagagcaggtctgacccaggctgttctcttgtgacacatgaaccctggtctctcttcggcttctctttcgtaccttgtttcccatatccagtatcttccagccacactggactaaatattttcatcaaatatatatcaagtttttttgttttttttttcccacctcagggactttatatcaactgccctacctgttcgtccccagatgtgtgctcagcttagtgatcttaaagctgagttcagcagttatctcctaagagggtccctctttttccaggggtggtccccgtcactctgttttattttcattgtagcacatgcagtcactatctgaactcattttattttcctgcttgctttctgtctccccactgttgtataagctctgttcccactggtatgggataaatgttaaatgtcaaagtgaagtgaagtcggtcagtcgtgtccaactctttgcgaccccatggactgtagcctatcaggctcctccatccatgggattttccaggcaagagtgctggagtggggtgccattgtcttctccaggggatcctcccaacccaggaatgaacccgggtctccctcattgcaggcagacgctttaccgtctgagccaccagccatcaatttgttaattgataacaaataataaatgttaattgaatgaatgaataaaataagcactgattctggcaggaattttctgttgtctccttcctctcatctttcaagcaccagagggtggggaccgctctgcagccatgggctccatgctggctcctgccatgtcactcatggctctttcctgacccctcatacctgggagagttatggtccctttggcaaataaacctcttgaattatcctaatttgagtgtgtcatctttcagcctactgactctgctttggtcaataaaaataattgaacccaggtctcccacattgcaggcacagcctttaccagctgagccactagggaagcccaagaatactggagtgggtagcctatcccttccctagtggatcttcccaacccaggaatcaaaccaggggctcttgcattgcaggtggactctttaccaactgagctatcagggaagccagtaaaaataaattagtatgtaaatttctacatttgattgtttttatattcaagttgtattcatagactatcactttgttcctaaattcattaaataaatgttgaactaaacaaaaaaaaaggaacagttttctttaatagtattttgataagaaatattctataaaataacatttttgtgtttataatgtaatgactaacattttgttcatcctgatggtgtgatcttaaattgctttcttcatagacaaagattctgctgtattcattatcatatgagtatcatatttttgttaaaattctttaaaaatatataatctgtgcttatgctttatcactcagaatatttaactaaaactaatggtacttacttgttttgggtcttgcctgaatggctttttaaatttttttttctatctttatttaacaggaatgggtttttaggaaaagcattacatgacgaagaatctacaataattcaccattatgcctttt

SEQ ID NO: 42359 - DNA, 756 bp, Bovine  19866880809637
ttatcatccgactgtggtgtgctggcccctgctagacactgagggaaacaggaatgaagctgatggtttccatcttccagaagcttatggtctgttacggtccaggatgcatttcatttgtatttctgagaggcacttaaccacatcctacatgggacatatgtagtataagctcatatacgtatatataatatataagtaaattgttgaagtacacttgtttttctcttcagattgtaggctaattcaaaacattttttatttcaaaaaattggaagtataaatttggccacctcaccttcagatgctttattcatcttaatttttatccattgttcctgccacatttttctttagttttctggttccccccaaacctttttatgaaaaaaagagtagtaagttgatgatcttgttctatagagtaatttatcttgattattttatgatactgtcactcataatgctgtgattgataaagtagaatcaatactccatcctgtagtattgattattctgacaagattagtatatatatcactaagtctgtctgttgctgtctgttttggaaaaatgatttcagatggaattttccttttttttttgtttatcttgctttttagactctaatactcacaaattgatgcattcttgatttgttttattttcagtctgaccttattattgcttatatttatgttctaccttatccaaaaggaatttgagatggctttcaaaaatatataccataatgta

SEQ ID NO: 42360 - DNA, 1744 bp, Bovine  19866880906367
aattcaaacaggatgggtaggttcaaattcaaaactgctcccagtgtatttatatatgtcttattcataaagtatcatccaaccactagatctaaagataaataacaggggcattcactagataaaagagaaataacacaccaaatcatccaacactggaagatccttgtgtccccacagccttattgatttattgaaaagtaactccctggtggtgtctaactgggcacaggactctgccaggatgagatcaagcagaagtggtttgaggaatgactcccagagaagatgcgaagatggtacctgcagcgcacaccctctggccactgcttcatctgcattgagcgttgtgctgacatcttttccaaagaatttggcgattttttctttcacggctggaattcgtgtagtgcctccaactatctcgacagcactcacatcctctactttgagctgagtttgttccatcaacaaataaaggggaacttctatcttctgcagtaagtcagcacagagctcttcaaattgtgcccttagcagttaagaggaaaacgttaagaaaactgatcttaaggccaatatcccgtcctactttttaaataattcttatcaacccaacaaacttttttcttctcagacaccctgaattccacatgggccaggtttagccataccataattaataacttttttccctaaaaatacacaaaatccagatgcaggagggagaaatgaaaagaaaatgagtaactacagaagaaatcacttttaagatttccatttttagtccttaatgttttatgtgatcccattttcattacaagacatttttggcccagaaataatactaaaaagacttcactatgagaacacttagcacagatcttcttaaaaaccctctttgcagaagcaattctagttctaatgatgctgacagtctttccggtagtacaatcttgaaatgtgggccaaggctcagaagacctcagttagaactgacacccggactagagtttcagcaagaagttccttctatttaatttgtcagaatttgagacacacctgttcatctttccagaaacgtctttgtcattcatgaagcactcgatgttcagtggtaggtctgtgctgttagagctcatcagctttttcaatttttcacactcctgatacagacgaaggagtgctcgaattttggattttgcatccaacttgtacttagttttaaattctgcacaaaaatgttccactaactttgcatcgaagttttttcctcctaagaaaggatcaaaagctgttcccagtacctaatttagttaaaacaacaaataatctggttattttcaatcatatttgtaaccaaaaatttaaatgttgctaactcaatcaaagactaataggctcaaaatttctatttaaactacaacatgaaacccaagtcaattaggatgtatgtcattataaaatccaaatgaaatgctacatctctatgatatttttaattctaatgattacatagaagataatcttagaaagtttttctttcctaagcaagaaaaattaagagcgtgctaagacaactgcattgtctttatggagatcaaccttaggaacaattctctgttaatagctttatcccaaactcttcattacccaagaagctcagtagcttaaagtaacaacaattgtcacacattactatctgggtcactagttccaatttagaccttaccttcaattttcc

SEQ ID NO: 42361 - DNA, 1021 bp, Bovine  19866880928500
caatactagcattttacttgggaaaagagatacaagaagatgcctgtaggtctctcacagattttcagtgtcactttgggccaaaatagatggacagtgtcaaacttctcaaagaaaaatgtacccaaaaaatgtattaaaaaaaaagattacaatacaaaggtagctttcggagatagtttcaacggtttccaagccaggttttaaactgaagtaatgttctgcaagtaacatttcactcagaggaaaggttaatactaaaagtaggtgataatcttcaagtacagattgtatcagaaaaggaaaaatactcaagtgtccacacacacacacgtcatttcatctctttaggccagtttagtcatgaataaaagaagagacttccccatcttcattattccaaattgaaaccgtcctcacattttcagttatgttccacttcacgttttcactgcattccactcaacactgctgagagcagagtgtttaagttggtacactaaatcttcaaaagcataaatacaattaattgcttacctatttttgcttctggatatggaactccttgaggatcagaatagaaagcttccagctcaaaaggcccacttcttaagaacgtgagaactttggagaaaggagcagcgtggtttctactgaacacttcatggacactaggagcaaagcaaaggtactcaggacttccagggttccagctcaccgtgctacaccaacagaacacaacctaaaagctgtatcaaccccatctcaccaggcataacccaaagtgagagaagtagtttggtaagtttgattgctaaaagacctcagttaatcaaacactctaccgtcaatgtcatacgttcatttttttaatatatattaaaaccaagtatctgaatattattttctcctacttacccttcagcatcttctgaatcgtggctccagaccagagatattgggaaaggaactgcatcagtgacagaaaattctctaactttaaatgctggggaaaggattg

SEQ ID NO: 42362 - DNA, 766 bp, Bovine  19866881080336
gaattccctgtggttgccccctctcttcctcaccttctgcttccaacactggcccttcttgtctctttctgctctcatttctataatccttgtcccagtgtgggtgggaacaattgcttacatgttcttgttgcttggctcacagcctccagtctctcctctttgtagcttggtccacaaactctgggaagatttgtttatgctctgcttacaattttgaacaaatctcaatggcattttgccaggatcccagtggatcaaggcctctttgaacattgatgcttgtcatatgatctgcattccctcccagcttctttgaaggacaaagtgatcagcatcaccattgttttctggtttacatccaagttgatgttaagacattggttggctctctcaagagatggttcatccccaaatggcatccccatggaccccagaagagacttctcacataaatgacagaatcccagccatgcctcagtgctttagtacaatcaatttgattcaggtcaagcatacactgagtaaaaacagcctgccttctttccttagccgagttacgaattgggagcattgatgatccattctcttttttcctggaaggctgatatatagagagaaagaatctagcatcaataactacagacacattcagtgatctcttatctgactgttcttcctgtcttttgctgcctgaaaaagagcactggatgggtcccttgtgaatagctgtcattggcctcagtctccccatcacctttcataa

SEQ ID NO: 42363 - DNA, 1578 bp, Bovine  19866881194555
tttctctgaggactgattttctcatctgtaaagtgcagacataccctctccaggcggctttgaggattaaatgatgtccatgaagagatcagcgctctgtaaccgacagcagctgtgttgttattcttttcctactattgttgagatggctcacagctctgaagtgactgctctaaggccatgcttggaaaggagagacccactggccctccgatgttattccctcttctccgagagtcactgctgttgatagtcaggggcctgggctctgatttccttgtatcatttacttgactgtgaaccactggcaaatcactttgcttcctggagcctcagtgtccctgttggaataatgggacaataacagcatccgttcctgacggtgctattaggagtgagcgagatgatccatctaagatcttaaccaaggtttgcctggcacaaagcaggctttcaaagctgttatttacttttcaacacctcccttctctctcctgctgtcctcggcccagccgtgggcagctgctgttgtgatattcagggttctaggggagctgtttcaggacccatttgtcctggacaatcttcactccatggaataatggcttctgaggaaggaagaccttgaatctgatttgtttgctcaagtccaagctctaattgctttgggaaaaggcccgtgttggctgaaatcatttcttgttttgttctttttaggcccctgtcgggcaaagcttaatctcagtcagacttcttgattaaccggggaagaagaatttgccaaggaaagaaaacagcaggctggtttcttcagaactcaaatgaggaaactgctatgtgatcagtacgctttctgggcagcttcacttccttctttttcttgtgtaagaaaatctaagttaaacgtatctgcgccaaggatggacaaatccagcttctctgggagcactgataggcaggggacctggtggcaccggaggctctggtagatgctgggggtccccggcgcaggtgtgccccggggaggcttgctctgctccaagggtggcctggaggaaaggaagcaggtgagtgcagattcctcaggcacctgggggctcactgctgccccctgcttccacgtaagccctgggtcgagcactgtgggccccatcatcaaagcatgttgtccacttgcaaagacatgtaaacactgattctttctacttgaccgcccatcaccaggtctttcctcctgttgatctctgaacacattgaaaagccatctacttccacttctcaaacaccttcctttcatgtccaggtctctaccaccgtcacctttgcccagttctgtgccaacccagctcagagctcccagaagctcccctttctgccttgcctggggccatgctctgcctttatttctctctctctctttaatttttaattggggtaaaatatgcttccctggtggttcagatagtaaaaaattctacctccaatgcaggagacctggatccgatccctggggtgggaagataccctgaagaagggaatggcaacccactccagtattcttgcctggagaatccatgg

SEQ ID NO: 42364 - DNA, 1540 bp, Bovine  19866881247265
tatttttattgaatgaatgaataagtgaatgaaaggcagcgtcatgtcattatacataaagttctcagaatggtacctgacctctgaatacgtgctattgagtgtttgctcaataaatggacaaaaaattgctgagcatgctttgaatcactttttcttctattgtatctgttgaagtcttatgagagctaaactaagaacatatgggaaaataaaagcccagatttgcaaagagatttactcatgcaaagcagttcaaactcgtagttattgcactgattcttgacaactttagtcatggctgagccagaatggaaaattttacctccttcactgtgtgctgacctcactgggctctgactgtgttcatctctgagctcactgtctgcccaaataaacactccctttccacggcagagttcacaggcaagcctacccaggccagttggttcatcccgttacgttctttggagctttggttaaaacctctttaattgctggtggggcactcagtgatgtgggcaatgaggcaaatgtgggttaggatgtggcagccggaagcatctagcacaggagagaggctggaggaagggagatgactggagaagagcactgtgttgatgagaaccaagtgtgagaacagagggccaattcagttctacagacgctgattgaaggcttgcctgggttaggtgcttgggaggcaaagacgcctaagacctgttccctgcttccagggatctggaaccaagccaattctgagtattcaaagcctaaaatatttacatcccgaagtgggaatataatgctgtacatatgcagcttacgtaatgttgtaaaccagaattacctcaattaaaaagaaatatttattttttagaacataataaaatatttactgcctggccctttacagagaacacatgccagtctctgcttggggtccagactggggtctggagtgagtttccctcaccagggcacctccctctcctggaggcaactctctgccccccacctctcccacaatctctccagagctacccaccacccctcagccatggaaaagactccagaccactagagaataaaagctagcccccaaacccaaaccctcaaccccccaaacacttctctcaaattaaaaaaagtgacctgacttcatggccactttcgccttctttggtagtttggtccacgcattcattcacccagtcattcattcatcccataaacacggcttgagccccttggccctggtgctttctagggttgggggagagagtgagaagtagaccttcaccctccacagagtcaatagttacctccagtcttagactctgatctgaatggtcaaggcacagacttggcacttgggtagacctgggttaagaccctgattcggacccttgtgaactctgcctgcgtgaaagtaactaaatgagccagccctgagatagtgaaagagtggagtcactttaacccattctcatttctgtgcaagcccttgcacagggcggcaggagtgggaggtggggga

SEQ ID NO: 42365 - DNA, 1286 bp, Bovine  19866881388198
acaagtccagtaagcagttagcagggggatctggagttttggagagaagacattgttaatgattgaaatctgaaagccattagctcaaggacagggataaaagccggaacagtggttaggaacatctaccaataagtgagaaggtaggaatttgaacccaagcctttagctcacttccacaaatgtgtgttgagcacctgctatgttccagggccagcggtttgctgacgattccaaggtgaataaatagaggagggccgtttcctccagtcatagagaaacgtagggatcggcacagctcattttctgccgccatgtccagacttgttgctgaagcccagttatttattttgcttgtagcaggtctctgatgcagcaacagcaataacaactccaaaagttgctttcccaattatcaggtcaatgagagcatgtctagggcagagctccatccagccccacatggaccaagttcagtactactgatcacccttcaacttttactctctacgaatggtttggctttgttgagaggcaaagtgttatgtgtcagggttgtatgcatttggttaagatgaacatagcagctctcccagcttcccaagtggctcagtggtaaagaatctgcctgcaattcaggacacctgggttcaatccctaggtcaggaacatcccctggagaaggaaatagcacccacttccagtattcttgcctgggaaatcctatggacagagaaagcctgggcaggttacagcccagggagtccatcaaaatgtgttgcagtaaaatatcaacaacttattacctgaaaagaagaattcaatgagatttttctttgtttttccatagttctctgattttccaattttttgtattttccaaatgagtatatattgttttgcacagaataatgatgtgggacacaataaaaatattttaaagagactttcctgatgtgttatctagaggcttcatttcatgcattttcaaacacctgcatttcttaatggataatttacgcactatcagaatgccagagaaagacatcaaaaagtgaacagaaaagaatagcattcattgtaataccaaacattgctaactagtggagagttagatcttttcatgtgttgtttccttttcattaaaaagtattaaccaggcaaacataatcaagtctagcaaagatatcttcagtcttttttatattgttggcttgtttacacagttgtgttcatacagtagagttttcattctgcttttcttgtttaagaccatttatatgtat

SEQ ID NO: 42366 - DNA, 850 bp, Bovine  19866881749085
agctaagaggaagcatttagagtctgctttctccattagcgttcccaagagaaaacaatgctgtggcgcaggaaggtaggaagggatggccagacaattccagggaacaacagagcagtgcaaggcgcgtgggggtgggcaggacaggattctaggtaacggagaagaccctgctcagaagcaggagacaggaccacccatcctgatgcttggaatcctcccaccccagtcccagacacccactgcctcaaatctaaaacatattcacactcggaagcaaatgactaacgtggtttaatcacttccacttccaggatgacatttcagaaggcaggtaaaatccagatgaacctctctgtgggcactgagatcccaggtagcactgtacgaggctctggagagtgcagtgtcccccgaccccggacaccccttccccacccttcactctgctttattcttctccagagcgcttaccaccactgacaccgtctatagctatttgtttattgcttgtcttctatgttagtttaatgtaagcttcatgaaggcaagaatgtggttttatgcactatttgccccctacgacaggggcagcacacggaagaaagtcaataaatatttatcgaatgaaagtcttcccgaaccatcattcaagggctgtctccttacactgacattgccaaccccggagaacaaaggactttagtgcccccactgaattcatggtcactaagatcgatgcctaattcactttttacacacacacaccccccaagacaaatgcaaagcccaaatcattcacaaagttctaagaagggaggagagatttaacatcaaacaccatttacat

SEQ ID NO: 42367 - DNA, 1026 bp, Bovine  19866881922802
ctctcaactctatctcctcatttagattaccggtcgcaaggacctaactgccttctctgtctgctctggcttcccccagaatggttttcagcaaagaggccatcaggagacttctcgccagcaagtgtcgctgctacagcaacgatgctccagatgacatggtcctagggatgtgcttcagtgggttaggaatccccgtgactcacagccctctcttccatcaggtgagaaaaagggttttattcccacctcagagcgggagatggggattttcttctcacttgaagatcctacttttttctcttcacgtattcttctggaaacagtcttaagaactgtgtagacaggctccaggcagggacatctttaactagacctgtttgtccagagggttgatgctgtacctgtacagcatgaagacggaacacagaaacatgtgcaaaatgaaacggtgtttgacctgcatccttgcatgcgggaccaggtagaagctgttccttccccccaccgccttttgtattaaaaaaaaattgatggcgtttagaaactatcagatgctatttcgaaatatcaggactgacccaatattgtcctgcttaccaccgagtgtttgcagttctccactggcctcagtctttatagcattggctgcctttttattgggctttctcctctttgggtgctattaaactaattaaatttcagtgtagtatctcaataagcatatattctgggggttatagaagagatgaggttatgttcataaggggtggttggtgctaataaggtcaccatcctgcaatgtggggtaagaaggaaatcctattacagtatttttacattttatgtaaaattctacaaaataaccgtagctcacacccattgttgagaaactcaaagctttttgaaattagaaatatctaaatgcacatgtattttaagtgtcctcccttacattgaaaatatagtcgtcatgcttattcaataaccagtagccatacagagactgggcagacagaaatagcc

SEQ ID NO: 42368 - DNA, 1372 bp, Bovine  19866880450943
aaataaactgtgtaatatttatggtgggaatgaatggctttcctgtagcattcagctgccttagctgaatatgaaataagtcatctgtatctatgtttgtgtaactttaccatctgtagcaaagtatattatctagtgtcacattatgaaagtctcagtggaacaggcttttttcttcccaataagtatagaagaattactttaatctttttcttctatgagaaaagataaatgttatctgctgtatatacctgatgaaacacttatctattctcataattaatgaatccattttaagcacatgttatattatccatcttttgtggttcaaaaatggatgacagtgtgattatgtctttgtgagataagtaaatgtgtgtattcttagatcatctggcttttaaaataccagcaaagtaaaactgtggcaaattagttgtttttcttaatctgcacttcaaatatgtggttctgtctatgttattggatgaggatatattatatcatagttgataatttcagaaagatcaaattgcactgaagttgaatatatactgatgatctactattttttaatgtttacatattttgtgaaatgtgtaacataaaacatttctctgggcaaggttgatatagatatgagcaaaagatatagtttaactatttactcatttgggagtaagtgttgagaacagaagacacatggacctcctcggagtgtcactatgctggtggttctaatgagcagtgaattagaacaatcaacgtttctaacaacctgaccttccactctaagtgtagctgaaactctaccttttgtcagcacagccacaacctcagttctgaggaggcctgaggaacatttaaaatgtgtttaaaagagaaaaatttttattcttcaacttagaaaaaagttgttaccattttatgccttacctcacttagaagggtctaggaaacctggtttttttttttatatatttaagataataaagccttcaaaagcatttttctagcctgctatctccccagtccattcattgaagcattgtcctgtctaaaatcttgaaagctcttccctaaatccatggagaaacttggcttccgcatcatgttgccctgtgcttgaagttgaaaaaatactaacttctggaaagtatcataaaaatgttgcaaaatataatgagttgatagtataagaggtgaaagcatgtcaaactaaaaagtgtaccaagaacttgagatcaaggtttgaatagattaggattaaatacattttaaaaaaatacttttcccctttctctcacattacttagtgtgcaatctggagatttctagttacctagtcacacccaggatataatacttatat

SEQ ID NO: 42369 - DNA, 1683 bp, Bovine  19866880476947
aaatatttcttatacgattacaacaaagttcttttgcaacttaaaaagtgaggtgtccattttatcacagggagctgtacagtacttaggctcctttgttgccttttttctttattgctctgtgttatacatgtcagcttctaggatgattaattatccagcctattagagtcaggatggatttggacgtgtgagatgggatgagtgataagaagacaaacacatggagaggaaaaacaatttcctggcataatcaaattaaaaataacccacccgcaaagccagacaggtgtctctggggttctgactaatggcacttttctaataagacattagacatgaaatgacttcttatattaatggtgaaagattaatattcactaaaaataaacactaaatggtattgagtgctatatgtgtgtatgtaacatatacacaagaggttatataataggatgctctctctctctctctctctctccctctctctctctctatctctctctatatatatatctccaactatatgttggagttggtgatggataaggaagcctggcatgctgcagtccatggtgtcacaaagagtcagacatgactgagcaactgaactgactaatatgtgtgtgtgtgtgtgtgtgtgtgtatcatatatatatgatagaatgctatatgttatcatacatattactctcttagctactcttttttttatttttaaagtaattcccttttttatttcgagattttactaaaagaatatttatatagtattcctgacacaaacattttagcattttgacagccaggtagctttataaaatcatcagtcaactgactgagtttatcaatttaatctttccacaacaaaacaaccagctttgaaagtagacggcaggattgaatagcaattgtatcatggtgttgactcaggatgcatatccagcttttcctgactatccaaagtagatattttaagaaatactttgattatttatttatggctgtgccagatctttgatgctgcgtgggctcctctctcactgcggtgtgcaggcttctcactgtggtgtgtaggcttctcatcgctgtggcctgtctgtttgcagagcacaggctccgagcacttgggcttcagtagttgtggcacatggactcagtagtttgagttcccaggctctacagcacaggctcaatagttgtagcacacaggcttggttgccccatggcatgtggaatcttctcagatcaggggtcaaacccatgcctcctgcattggcaggtggattcttgcaggtggattctttaccactgagccaccagggaaaccctgtatgtgtgtgctcagttgctcagtcatgtccgattctttatgactccatggactgtagcccatcagactcctctgtccatgggatttcccaggcaagaatactgaagtgggttgccatttcctcctccagggatcttagctactcttgtcctgacctgataatatgctttaatcaccacaggaaaaaaaaaatcttgaagctcttttctaatatataaaataaatgtgaagatgcaactaaattggaaaataaatttgttttaatgtgcagtagaaccacagtgagtaaacataagcaaatcattgagtggggacatagataattaaagcccttagaaattaagaattca

SEQ ID NO: 42370 - DNA, 1067 bp, Bovine  19866880484101
ccgaagagtaattaagctgccaataattatagaagacttatgcaataaactgcccttgagctctatttattttgtcaagaaacttcttacaggattttatttttatctatggctggtactgcaagttaatcttttgtttcattctataataaagtcagggcaaaaaatgatatgctgagaaaagaacaatgactggtatctataatgtacatctagtttaaaaatgcaaatctacaattaaaaaaatctagaaatatcagtgtctgtttgttatatgaacactacaccatgaaaccaattcagatcaccttcagtggacactgctgctgctgctgctgctgctgctaagtcgcttcagtcgtgtccaactctgtgcgatcccctagacggcacccaccaggctcccccatccctgggattctccaggcaagaacactgcagtgggttgccatttccttctccaatgcatgaaagtgagaagtgaaagtgaagtcgctcagtcgtgtccgactcttagtgaccccatggactaggcttcaccatccatgggattttccaggcaagagttctggagtggggtgccattgccttcttcatcagtggacactggacaatgctaaccattcacagacttgtctacttgtgttagctacagttttaaaaggcctgttttatcccccttagagttattgggagctcttagtcaaatttaaatgtttattattattattacaaagctgtttaaaatacatatttaaaatagtaattctgaattgcaggtaggtttagaggtgagtgcctgtcagggaagaatataagaatgaaaattgagaggcatttgggaatgggaggtatatatagtttggaatagcataattgacataataattttacttgattaaattaaatttattttaaaatgtcaaatagcattctagttaggtattaaggcagatatgtttgatttttcaaagtgaacatgagttaaactccttattgccaaattcagacttaaatgaagaaagtagggaaaaccactagaccattcaggtatcagatcagatcag

SEQ ID NO: 42371 - DNA, 837 bp, Bovine  19866880486165
tttccctttgccacaaaatattgatgaagtgctttattgaggtggagatctcattaattatttgatttacagaaaaagaaggcagagggaaatgagtgccctggctaataccatgatgtaccatcttgagacttaagatcttttttaatgtattcatcaggggtacatctgaaagaggaaagagtgagctgaatgggtccattaatttaattgaagcaagctcaaacaagagataaaacatcccagccggcttcttttcatacagcatgagtgctgtagtaaacaggcagagatccaaacacaccaaaaagaaataaaggtacgtggagactctagagacttcaaggccacataatatcaacagatgcagaggtgaatacacccggaagaggctctcttttcatataccaccatgtcagtgttccgcgggcactgtctaggctttattgtgaaactctgaacgactctgaggttacatgtaagtaatttagacttcctaaggcaaagttgaatttgttctttttttttttctcaaacttctgagaagtagactccgtcttctgctcttgatggaagcggggaaatggatttccactgatctcagaagcagctttaaatgatgttgctctctttcagctatatgttttggaaatgtagcagtcagaaaattcttttagtcctgaagaggttggggcctctcagcgcactcagcatttgtctttcagtggtcagcgtgattgtacacagcacgttaattcattccctggctcactcgagaacacaaaacagttgaggagagtctcccagtaacaaacacaaagcctgtctatcgtaaat

SEQ ID NO: 42372 - DNA, 1291 bp, Bovine  19866880500480
ttcacgtactgttgaagcctggcttggagaattttgaacattattttgctagcatgtgagatgagtgaaattgtgtggtagtttgaacattccttggcattgcctttctttgggattggaatgaaaactgaccttttccagtcctgtggccactgctgagttttccaaatttgctggcatattgagtgcagcactttcacagcatcatctttcaggatttggaatagctcaactggaattccatcacctcaactagcttaacatagtattagcatacctgcagtaaatttgagagaaatgaatagatttaagagacacttaggagacaaagccaagaggacttagagatggattagttttaaggagatgtttaaaaaagactcaggtttctgacttgagcagttatatttgagttctatctcctgagactgaaaacattggaaaggaaattaagtttcaggagaaacaccatgagttaggagctatcaagtgtgagttttagggcttctgagagtactagtagccctaaaataatggcttttgtgaagattaattaagcttagatttgcacaatgaattgggtaaggtaataatgaaagcaaatggaagactactataataatctatgtgccaaatagcaaacagaaagagtaaactaaataagtaaaaataatgaaaacaattattataaaccaaaatgtgaatgcatttagtagatgatttgcaaagaagagagaacagactatttagacaaagatcaattggaaattaattcttccttttcctttggaataggattatcttggagaaatgaaattctaaagtgctttattggataatagccaatttaaattttagcaaattaaatgtaaggaatattttaagcatagggtgtggtttgaaggttaagacagagaaaagttacaccaaggcagtaaagtgagttcctgttgcctctacttcctaggttatccccttgctcatctttcctgttctcttctcctaccccccttccctcattagttgcttccagaagactacttatggtttatagccaaatgcaagctcatgggaatagaaacaaacaaaatgtgtctacataatatttgctattatagaaattagcagtatgtttttaaactaaattgctttttgatttttaagaactttgtaggaaaggtattcctgtctgattaaaaaaacaaacaaacaaacaaacaaaaacacaacaccaagataaaggatctgaaaatgaagaggttatcctcatgggatcaatgttgtcaagcaa

SEQ ID NO: 42373 - DNA, 1324 bp, Bovine  19866880516391
aactacatatgtcatgttgctattgtctagactaaaaatcatgagaagagtgggtagatttggggtgttggataacccttaagttccaggtttagaacacttaggtagttctgtgcatatggtggttgaagctatgatgaaacaacacatctgaaagcttaacatgtaacagaatagataccaggatgggttatcaatttttctttcacctaaattttcactgttgagcttcattgtggtttgcaaaaagatattcctggcatcttgaaaaatgagtcaaaggaagtttaattgaagccctttggcttttgaaactgttccaccttggggataaactcattttttgcagtcatatcagaaatgagtttagcaagacatgaagcacaactgtcagtttcctggggccatgtagtcaacatatgttctaattaaaattttattttagtccatttaaattaagatcatatgtcatactgattgtctgtttcttcctatcttttgtccctcattctatggatctgaaggtcttatgtcacagggttggagtagaatgcatctgctgaagggaagggggagcacatttatcaagggattgcaaatgataaggggggctgagcagaagaactggggctctgtgtgccatttattgccagtttttgttgatttaagtattcatagcagaaggtataggctcagatcaacctccacacaggcatataagattaaattgaacttgtagcctttctaacagtaatgagctattatctcttaaatgcctgaagagtggtctagaattctgggagttgttaagacttgctttgtattgtcaatttaggggtctaagagccaaaagtcagaacagatttttccttggacttttactcataaattattcattgatccatagataatattcattgcttatttgaatatatatgaaggaaaaagcctcttttctggcgcttctggtttgcccttatgtatacaactggagacggatggaagcaagcataaatcccttcatgattgttacagttttgggttacttaacctctttcagcctcattgcctcacttgtatttaacagtgttttaacagtgtataccagccaactttaagggaaggagtgtcatataaatggattttccgagagtaaacaaaaagtttctagcttctagctgtcttgtagtcatgacaaagctcttttgcagttacctgggcaaggagtaagagatgagagagagagagaaaggaggggaaaagagagaaagctgaagaaatacctttcgtttttggaccctggagaaaaagtgttcaatgctca

SEQ ID NO: 42374 - DNA, 1163 bp, Bovine  19866880821758
agttttagaacaatgcctgataggtttttggaacagtactagcctgttactcaaattctcaatgctgcccttttttgaataaaatccttaattttgatgtgttaaatcactcattcttattttatggaatgtcttttaagttctaattccctatagttttacttttcatttttaagtttttaaattttcctgaagcatgccttttaatatggtcaacaaatttatttttcttgcacagtgagtttgctgtccctaaatcatcatattcactgctttaaattaatgttttaatagcataacaaaatataaaaatagacaattcataaatgtttaaaagcaaaagtgaagctaacatgtgaggatgattatagcaattaaaaaggggatgtagtttctaaacttctcagttattagttggataattattttcctaaggagcaaatgctaatctcttttctactttatatcattccacaaaagataatcacatcttagttttaaatgatgaaaattgatttaaaaaatgagttattttaatgacaaaagtgataaaatataaatgacaaaatgtaaggtcaagggcaaatttgaattgcatcatatatattgcatataagagatcaatttaggattttatttactgagataattactttggttcttcattttagtgtttttacatggatccagacttcacagaagaaagtttaatacatctatttgggtaaactttctaatgccttaaactccttaactgaaacttaacattttacatgtagctcaattccccagacacattttagccttgctaatggagttatttacccacatagaccaagctcaaagttggaaagtttataagaatcagaaacttaaataatacaatctcactacctatattattggcaggaaactggagtatttctatatataatcagattttttaaaaaagattttattgaaatacacagtaatgaggaaaaggtatttcacttcaattatatgaataattggctcaatttgcctcctcactgtgctagtttagacttgtactaacacaagagaataaatttatgatattagaattttgagagagagaaaaaaaaaaaacaggatttaagagatttaaagagtgtcattaattgaaatactgcaatccccaa

SEQ ID NO: 42375 - DNA, 1655 bp, Bovine  19866880881730
ttaggtccatacccattttctgtcctttatcgagcccatctttgcatgaaatgttcccttggtatctctaattttcttgaagagatctctaagtgtttcccattctattgttttcctctatttctttgcattgatcactgaggaaggctttcttatctctccttgctattctttggaactctgcattcaaatgggaatatctttctttttctcctttgcttttcgcttctcttcttttcacagctatttgtaaggcctccttagacagccattttgcttgtttgcattttttttccatggcatggtcttgatccctgtctcctgtacaatgtcacgaatttctgtccatagttcatcaggcactctatcagatctagtcccttaaatctatttctcattccactgtatagtcataagggatttgatttagttcatatctgaatggtctagtggtgttccccactttcttcaatttaagtctaaatttgttaataaggagttcatgatctgagccacagtcagctcccggtcttgtttttgctgattgtatacaatagcatatgtaacacaaaaggatttgaataaggaaaaataagttaatatgattggagaactgtgtacttacttgttttggaatggcaaaatagttaacgaggcattgtgggagggaaatttagaaacattggcaaagtcagaccatgaaagtcatttcaggtcttcctaggaagttcggattttatagtgtaggagactttgtgtcattaaaggattttaagatggaaatgatatgatcacattaggcacgctcttagagcactatggagatgatttagaagttaaaacgactatgttaagtgcaggcaagaaactgcaagtccctcacataaagtagtggaggggagtagcatggaggaaatagattagagaaataactaagtaatcacatcccctgagcttggtaaaacctacatgcaatatgtgaataaactgaaaatacaatttagtcaacagaaagtactctgctcgtgtaaactaatttgatttgaattgtatctaaaagttgaaattgattctctaatcagtaggatcaaaattatttgttctgaccctaagaaactcttcagatccacagctgatcatctctaaagtgtctctaaattatatgaaagtagtcatgcttggatgtctctgatattaaaaaaaagaaaaagtctacatagctaagtttgtacttagccgagataatttcctccacctacactttcagaactgcagcccaaatgtgaattgtgaacatatttgctttcaccaaattcagtcaacctcatttacagtagcatcatctgcagacaatgtttaattgctgcttcttttcaatacaactgaaactacccagtataacttttttgaaaaaagtcaaaagcaaggcacaggattcttaagtgcagcttttgtagtaacattttgaacaatttctaaaagttgaaaaatgccgattggttgcctagagggttatgctaaggaaaacaaggcagaaatccaagctgtagaattcatgaaaacctttgtcatggcaaacaatagtgaaacccaacattgcctggaaggggaaatttgagtctgcaatctgttagactttatgcgctgataagcga

SEQ ID NO: 42376 - DNA, 1158 bp, Bovine  19866880907112
atcagccaaatgggtagcatgtatcccaggcattcaagtcacagataataaaggtggagatgactcaaaggaaactgtgtaaccaaatggattgttggatctgaacactatttggtgtgtgtttttcagaaagtcaccattactttcactgagattcctcttctggatttttgggcttacccaatggatttacttccttcagggctcacataatcacttccatctgatgttcaggttgggtcttccagaacagagatagcagagtcttcatcttatcaaaagataggatagcagtgaacactaggatagcatcaagcactaggttgacaaagcttttatgatccatcgctgatgcctactgtaagtgttggactgtgttatgagacacaagtgtctggtgtcccaacattaaaaggggttttctttccatttggaagtattatctccagtctataaaaagcaaaattttagttttttttaggagaagtataaatgacagaaacactttaaacctcattactcttactcatttaaacctcattactcattactcttgcagggtagagctgtttatctgatcttccgtaagggcctaggggtggttttcagtggctgaaaatttctgcaaatctagaaacaacctgggaataaaccctttgggtggaaactaaagcacagacagggagagcctgggctccaaactttttcccccctgtttcaagcttacctgttgctggaagtataagaagaaacattgaatctatctctataggtctctagttttttaagattttaccagttgtgtgtagttctcttttgatatagtataaccttttatcaggaaaaatacttagaggaaaaacctttaaatttaacataaaatctaattcttttgctcctattgaagcttggaagactggatctttattagagtgcatttctacaaagagataaacattttaaaaaataagcatgaatggaatccaggataaaatgcatccatttgtgcaagaaaatagcttttactgaagaaaatggcacaaattcatcatatggagaaaaatgtcatttcaaagcctatttctgagatcaaaatgtagaactttttcatataatatattagctttttagctactctaactctacaactttttcaag

SEQ ID NO: 42377 - DNA, 1887 bp, Bovine  19866880999934
ttgtgtgttccggattatctaacccctttcttctggcaaccgtctattttagttgcttcagtgaatattcttgtacacatgcttttgtaaaagtccatgctcttacacattgtaatatatgctccaaaagtggaggaatcatcttttacgaataagtattgtatgtttagcaaaaagtaaaatatgactgagcttaaaaaataaaggtgacatatggagcaaggctgatgtttggaagattattagtaaggagctaagcatctcattaaacgctacagaaaataccgatcctgtttcagtgatgagtttccccaggccacatctatattgatctttgtggaatttataagtagtctgtgaggtctggattggtatgtctatcatctttttctacctatttaactgctatcttcctatagagattgctttctatatacttcttttttatataacagttattgttattagcctaaatttataatgctcccaattgaactctaaatattctcccttgtataaaggatagattataaaactgacaccaatgattgcattttggatttctatctccactccttttttttttaaagtttgcaactgttgtgttagtttctgccatagagcaaattaataggttatatatatatatatccactctttttagattgttttcccatatagatcattacagagtattgagatccctgtgttatacagtaggttcttattagttctaattagtcatctattttatgtgtgtatttcaatcctaacctcccaacttatccccctcccttttccccttggtaggtgtaactgttttctgtatctgtaattcgatttctgttttgtaaataagttcatttatagccacattccctcagagcttcaaaaatgactaagaagtcaatttttagataaataaaaaagacattattgcccatttggttggtcagagcagaaatggaaagaaatttatatttaattttaaaggtgattcacttaaaaataaagcagttcaatgtattttttgtctttcctttcagctaaatgtttaatagactggtgaaaaaaagtgtggtaatttaggagctgcaagaggacaaaccctttaaccttctgtagatgctacttaaaatggtttctttgttaatttttacaatttaatataaattcaaaaagatataattgccttagttatttatctttaagttacaaatataaaagcactgtggataactgtaagtccagcctcctgaaacatgtactaataatgtccaagtaaggattaaaatgaggataaatggcttttaaacatataagtctgtattaaacaagttctctccttttatgaaaatgcatcaaattttaggcagctagactggaagagttgattatattagaaatatattatgtctcctgaattttaaatgaaaagaaaaactttttttttttttttttggttctctagtgcataatacactaatgtataaatgacaagctttgttgagagaaaatctggttttataagtaggcactttaataaagtgatcatgaatgggaatataatagcttaaatggaataacacacttatttacaaataaatatttcttcaaactaagggtaggtaaaatgacatgtttcctttcttaggtttatggttaaaattatccaaaatgtcagcaatcaactcagaaaatgcctcaactgaacaaattgaaataagatagttgggttaatggatatgtgattaaaactttaagaagacgctccattccatctagcaactacacagagttctcaagggtagccacaaatttacaggctgaaatagtttccctataatcaatttatcagaatgaacagtaggggacgatatttcacca

SEQ ID NO: 42378 - DNA, 616 bp, Bovine  19866881015775
tattgggtacttactctgtgcctgatattgttttcgttttaagtgttacacacagtactaattcatttaattttcagaactgtcatatgaacaagtgctactattacctcattttacagctgaggaaactgaagcttagagacagtgtttaatgtcacacaactagtaaatggctaggttgtgaaacagacaagttgactccagaacatacacacttgaaaaacatctaaggacaaaacctaatagcatgccaagggagcagattattttcccaaaaaatgtaatccatagtttgatcataccatttatgcacaggattttcatgatcagtaaatatacccataatgaatatatcattttgaatagcctttcccaaatttactacttgagcttcagtgaccatttgctgacctggaacctaggtgtcaaaaattcttagtgctctttaaccatgcgtatttatagatttccagataagtagaggagttttattttctgctttgatggatttgtggacttatttattgtaaagtactcactagagagagacatttaattgtaaaacacccctagtatcgattcattaaaatgagggtgtcatcattaaacaatcttc

SEQ ID NO: 42379 - DNA, 963 bp, Bovine  19866881017175
tgtgaaagtaagaacagaaccttggtctccaaagagaatcttttggcccagaagcaaaaaagattacagcaatgacatctaataattctaaacatggaatgcctttaaagattgcaaaggttagattttgccttttttttttaattctaggtttttcatttttaaataataatttaataacacagttcgttggcccaggaatgacaagactttagtcgtcattagacaaagtctagctgcatataaacactatctattctcctccatgtttttttatttgtatgcagtgttggcagccatggactatgataaagtgcatttttctgcttgggtggttagccctttcatttttacaagtgacaaaataaaaatgtgctgaagagtgaacatgctgctttcactgtgtcatctcagccctgcaggtcattttattataaaaatgtaaaaatccagtcaattttatttaatcagctgaaaaggaaaagtgtttccaggtcattaatcaagtgctccttctctgtgggacttgtctcttcagaaactgccatatgaatcattaataaagctggaaagatttttttttttttaccagcatgtttttgagaaacctagatgttattaatataacagaagtaaagtaattttaggtcaacaaataaacccttcgttgccattgcctctagatctgtacctatgttattaaaatcagctaattctttactttctaaacatttaattgttggaaatgttggaaatgatcagctgttagattgtatatgattatatattccataattacatgttttcctgaatgttacctaaccttatatttacagtaaacttttattagtgtgaattgatcaaaacataatgagacagtaagaagagataattactactgtatctgtaataataataatgatagtaattaaacacagcaaactgcattcacataatgtcaag

SEQ ID NO: 42380 - DNA, 2527 bp, Bovine  19866881083825
acagaaaaatacaaaatatatacatatactcagagtagccagtgttgtcctcatgaatctaagagaatagttggcatgtaccatcaggcgcatgtatctggaaatcaccagggcagcaaaagtaattgccatccatagagaaaggaaaagcaaatcaaaaacaccagggatggtatggggaaggaggagggaggcagcttcaggatggggaacacgtgtacacctgtggcggattcatgttgatgtacggcaaaccaatacaataatgtaaagtaattaacctccaattaaaataaataaatttatattaaaaaaaaacaccaacatttgtccaccgtcaatgctagatctctcaggtaagcatatttagaccgtctttgcttattgcgatagttaatgagaaatcttcagttgccgtttttcctttgggtaattgtgtgtggtgtcttgtcctgctttttcttctcattgtcccattgtttaggttcgtgttacaaacataaaagttgttgaaggcatatcacctactacattccttctttatttttcccttcatcgtagccccttccaacatgtgtggcctttacacattacttttttccctaaaactatttttgattgtcatgtagatgtatagcatgaatatcagcacatgttccccaaagatggattttccacaaattagaatattctatttcgctctaaatatggaaactaaaaatatattacccactgtgaaatgaattactcatacattgtgtgtcacattttaaactaacaactctataaccttaaaatatagctcaatctttaagtattaattttgaaatgatgcatttgtgctaatgatttaccgggaggaaaaatcctttaatctaactcttttgcttatgaacttgaaagttgaactccatagaaatgactgactgcaacagcagggcttttcaccagctgatcaaaattaacagtttctttcaattgttctaattaagaccaaggggagttctggaatgtaccaacagtatctcaaattgctccctgcttaaaactagttctaggggagaaatgtcagcttttacctttccctacaaatagtttagtctaagttgctaatattactatctactaaaaggccttatgtatatatcccatgagaatttttttcagttttgttttattagaaaggataacaattaaagatgagaaatataatcatctagagtagaaatgtatcagaagtgagatggtatatcaatgatctgtaaaactgatgaaaactctataaatatggttaatgttttacagagtagtcattttatcttaagaactttttcacattatactagaaacatatttagagaaatcagataattgaatcaataatcattgtaaaaatacaaaaattcaatgtatttaaaccttaggaaatataagattattgctttcaagtgtacatttttcctgctagctgaacatctctcaaggaacattttctgcccctcaaaatcaattcatttctgctaagttgtagtcttttgtcattcatcatctaaagttctgatctaggttattaatgaaacgtgttttcttgcagtaatttctttcaaacttattcattttcttcaagattcgtttttcttactatttatataaaacatctactttaaaagttatataaatggtgaagagacataaaagcaaacaccaatattgtcattatagaagcaaaaacagagtaaagtttaaaatcttgacctacatgtaactcaatagtaagttatttaaatggaacttttaggtgataattaaatgaagactggaaggtcaactattgaacaagtatcttgtatactatgataacaatttcagaatcctagaagtcaatcaaacacccgtttgcttataaagtatgattgtgttatgagtgatgaaaatacattgccttgcttcatcataattttaagccatctcttctttgaattggcaattctcagtttaaaggcctttgagaggtcatactctttaaccccatacacaatccctaaataagtaattgactctttcaactctcaccactgtgttaagatataagcaatctcttgttgtaattagcattctttcctaggagaaggatgatgtttgggtggctaaatgggctagcagtctttagagaagcattctcttccctagggctgaacacagactatttaaaactgctgtgaaagagtcaacaggattaacatggagtcaacttccttgggaaatggagccaaagagattctaaggagacaaaatacttcaaggcaatcacagtagtagtgaaaatgtccaggcttactggccctgtcacatctaatttaactgatgacatgaacattaagcagggccacaaagactttttttatgagtctaaattctgttttcttttttttaacctcctgtaaacttaggatatttccattttttttaaacagaaatcgaaaaaaatgtatcataaaaccttggaaaataccttctatttatttaa

SEQ ID NO: 42381 - DNA, 1935 bp, Bovine  19866881240789
accccctggagtaggaaatggcaatccagtccagtattcttgcctggaaaatttcatggacagagaagcctggcaggctacagtcccatggggtcacgaaagagtcaggcatgactgagcgactgagcacaagcataacatctaccccagaggctgcattgggtccattggattctctctcagagaacactacaattggtacaatcagatcaatcaaattcagttactagacttgtaaaatgaatgatctcaaatatagaggtcactttgaggggtaagtcaagatgagtctgtctctgcaaataagcagagtatattctctaaagacaaagcagaaaacatgcagggagagagaaggtgtatacacacacagccccagagaaaaacagatggagagggtgattgcctttattatagatgacttctcaggtcctgtttccaattccacataaggcatggctacagtttctgttcttggctttcgacagatggccattcttatttgcttagattagttgtagtggatttcagtttcttgcaaccaaacaattgctggaaaagacagccacctagggataaacttcagtcatagaggatggttagcatagtgcagaggctgagtttggagttcaccccagagagtgcatatccataaagagtgaggtcagaaggaggacttggaaacaatggatttgtgtgtgggtgaggtagaagtgaactgggaaaatcaaaagggaagattcactctcatggaaagaaaatttgggaaaagaaaggtgcaggttatgcaagtaacgagagcaatgacaaattttacctacttcagttttaacatatgctatccctgagcctatgaaacacatttccttttgaattcaaaaaatgtggaccattcatttctgccaaaagtataaaatattttttcaaagccatcaaaaggtgcaagatttctatccactaattctatccactaattctatcaggttctctaactaaatagaccattgagaaggctgtgtttatttatttagttgtttctcaaacactatcaaaaatacttttatagtttgatatttcagggattccctggtggctcagacagtaaagagtctgcctgcaatgtgggagaaccaggttccatccctgagtaaggaagatgccctcgagaaggaaatggcaacctactccaatattcttgcctggaaaatcccatgatggaggagtctggcaggctacagtcagatatgaagaactttgaagtacaatctgaagtataaacaagcttattcagaagccactgaagtcctgtgtgtgactgaaccatgctgcaaccacattagatctcatgaagctctcagtaagcaatgtaagatgagactggattacttgccattctttttaactcaagctgttgtggttgttcagttgctcagttgtgtccaactctttgtggccccatggactgcaggacaccaggctttcatgtcctttgctatttcctggagcttgttcaaactcacgtctagtgagtcagtgatgtcatccaaccaacttgtcctctgtcgtccccttctcctcctgccttcaatctttcccagcagcagggtcttttccagtgagttggctcttcgcatcaggtggccaaagtattggaaagtcagcttcagtatcagtccttccaatgaatattcagggttgatttcctttaggattgactggtttgatctccttgctgtccaagggactctcaagagtcctcttcagcactacagtttgaaggcatcaattcttcggcactcagccttttttattgtctagctctcacatcagtacataactactggaaaaacattgctttgactgtgtggaccttggtcagcaaagtaatgcctcagctttttaatacgctatactaggtttgacataggttttctt

SEQ ID NO: 42382 - DNA, 910 bp, Bovine  19866881253684
aaatgaaattactaagaagtcagtaaaaatgagggctttaccttctctatcaccctttctatgtataatacatttgttaatacatctttaaaagtttagaagctctaagtgcatcacttgattcccttaggttcctgtatttaggaaatataaagggtagaaatcatccagagaaagttaccatataatagattaagaatcatagttaagtccttgggtaataaccttataattcctgaaatattaatgctaaatttaaactaatattttatatgatgataatacttaatatagtgactttatcctactttgttggaaaccttttagtcattttacagtttcatgtgtgtggtttgtttggaggagatgctcactctagtgtgctccatcccaagagaaaaaggaaatgtgaacacagggactcgacttgtcagattgtcacttgtctaaaaacgcctttagaaaagaagataaagccaactctaagcaatgtaaacaagtggaaatataatagctttgaccttctatgttcctcttttcatcaattgttttaattcttagaaatttagatttttttttagaatacaaggaaaacagcctctcccaagaatttaacatcttaaagatgcccatatttgcttttattcaaagtgttggacagacttcccagactttaagaattgccacatggcaaaaaaaaatttcaaacagagactatagtttagaatgaaaaccagactatttgatcttcctttcctttttaccactcatcctctttctttcatttgttgtttgaaagcccaatgtaatccttttttatagtagattcttggtttacagaggactttcagatgctattaagagtcagaggttaaaaagaagtcttaaatcattagacacacaaggctag

SEQ ID NO: 42383 - DNA, 1737 bp, Bovine  19866881367515
aattctaaaaattctgctatttaattggcctacatctgtgatctcaaagaaaatcttaacaagggtgttacctttgaacaggcaactgagtgtgggatattaatcagacatatagaaactatctcttggtgtcatctagtggttgtatttcatcactgcataaaagaaatggcttactgatttttctgagtaaagattgttttattacatttatttctgactgactggagtgaaagaagctgccatttttaagagacaagagaaggttagtagcaatcaagcctttctgggctcttcaccctggccctttgctatgccttcttataaggtcaagacacatcgatgggaagctcagttatcgtacactggtgtgaaggtgctgtctgctgccccatttaggctgcatgactgagtgactgggtgttgttaagggacatccacagccaatacacaaggtattttctctttgctggctgagcagcactcgagggattctgacagcctgagctgacatgctaacaatctgattgcagatggcaatggtaggaggctttgagtgagagagaagagtcccctgaccctcctgtcatctactctctcaatctccatcctaggatcggagcgctgcacaactatcacagggagaggtgacatagtgaaaataacttatccacaaatgtgctgaaatgtcatctctaatgttatagttcctttaagacgaactataatttctaatataacttttcagttttgaaaggaaagggcaccaaggctgagttgacagaaataaattatccagataattaaggctaactactccactttctcctactccctggcccacgcacagacaataatagagctcaattatttataattcaggaatattttttcttttaaaaaaaggattttctataaagctggtgtttgaatggctcaaaattataatcattaagggaagcaaattattaacaaattataatcagaaaatttacaaattttaaattattataattctgttaccttaacaaagataaggcatgataaaaaaatgaaaaaaaaaagattatgacacttcattctcaattttccacaattacctgatgtttttaggcaaatctgtgagtttttaaaaatgatcttaatggatttaacaatatcaaccaagatatttctccacatatttactttatattacaaggtgaacattttttgttgttgaactatttttcaatgatgtttgctttttcttgtatatatctctaatgtttatatgtcttactgctaagtcacttcagtcgtatctgactctgtgcgaccccatagacggcagcccaccaggctcccccgcccctgggattctccaggcaagaacactggagtgggttgccatttccttctccaatgcatgaaagtgaaaagtgaaagtgaagtcgctcagtcatgtccaactcttcgctaccccatggactgcagcccaccaggctcctccgtccatgggattttccaggcaagagtactggagtggggtgccattgccttatatgtcttatacaagcgtaaattgggaaaataattaataagaacataggactttcctggtggtccagtggttaagaatccacctgccaatgcaagggacacaagtttgatccctggtccgggaagatcccacatgctgtgagcaactcagcctgggcaccacaaccactgaagcctgtgtgcctagagcctgtc

SEQ ID NO: 42384 - DNA, 1219 bp, Bovine  19866881428311
tttgcacaaatggagtttgagctgtcattgagatgcccaaaaagaagatgtagggtaggcatctaaatatgtaagtctggaaattggagaacaggtcatattaaaaaatataaatgtcatatatcaacattctatagatagtaatcaatttttatagcatagctaagattgcctggggagagactgtggggtgagacatgaagcttgtaaggagttccaaggatctctgatacttaatttttaggtagtgttcaaaacagactgaaaagcagatgccagcaagacagagaaaaccagaaaaggtataaacacagcagccgaaggaagagaatgcctctagaaagattaatgtccagttctgctgaagagacacagtaacagctaaaggctccaccactgaatacttcctttgtaaacttgggaagttacttaaaattgccccctccatatgatctagatagaattacagacatcacaggaatattgtcaggattaaatgagatagtgtttgcctagggcttagcaaaaacagtctcaatttatagaaacttcagcaaggaagaggaggacccttgttaggtttataatgtccctgtaacctgctttgcactcactgtagccatgcgaaattgaatttctgtttcctagcttaaaaggagggtggcaaatccagacagtataaagtaatccctaaagcaattccagtagctaaaaattcagagagccatagttgttacagaacctaattacagctaaaccacatttattcaccaccatcaggaaatgatggaatctacatcagggcatttttcaggtgctgtacagtatcatgttactcaagttattgtgtctgctttttaaagtgtttctcctcaccttctctctgttgtagtccatggtgacttcaagttgtggttaggatgcccgtgagtaacagtcattcctttctgtcccacacaatcactgatttattgcctttaattatgaggctaccatcttttctttttaccatggtatgactttagtttggggtaatgtgtaggttctttatgtaaatatctaatgcaggtatgtattaaattatcacactagacaaatttactggtggtcatctctagttggtatgaagaatcttcacttctgccttcaaaagaacaacttactctagtttatctctgtaccttttgtgtccatatgaatcatccaaggagctttataa

SEQ ID NO: 42385 - DNA, 1169 bp, Bovine  19866881431267
tatattttttggaagcttttaatctgtggtttcttctttaaaggaaattaatctccatttatatttgtggaaatcctaattctaaaagttacctcctgtgttcataaaggtctaacattaggatataaattggcttttccacattattgtctcagagctggccatgagcatgctctgtcactctgctgctcccagctgtaattaaataatagtgaaaggcaagtccccataatcctgaatttccctgaagtaatcaaattctgtatttttatcacataatgaacaaccttttccatgtattcagtttttctctgggaaatgttttgctctgccgaaacatttgctctgccaaactgtcgaagcacagattacaggaacactgagaaaccacttctcttacgtccaaaagcagttcctgatggctgaatgggttctgtgaacaaatgacttgtgatcaaatatgtacgtttaccaacactttttttaaccccttgaatattccctatgcatcgtaaactgagtttcttttcagtaaaatgatccagaaaccgatccaagttaatggcagacctcacatggactttgtgctggtgtgcaacctgcatcagaggccaccttgaagctgtccagctagtccttgctgctcctccctgactcaagaaagatgtgttcttggtcttttctgccaaattccttgtgaaggtgtaactggttctgggatccaggcttaggcatccttctaactgccactgcagagtggagagaagaccaatctggtttttgaaaacaagaaatgtggcttccttatactaagtaatatagcataagcaacatgagatgttgcacagacaatttcaaggagtaaattttagttttatggattattctttggaaattttaattctcctactggaattttagaaactagtattctttatagggggcgttgtgacagacactagaaaagcaaaaatacaaatttttgagttaggagagacttacctttgagatttattttcaaaaatatcttcttctgatggatctttcaaattttatgaaatacagtgcatgcacctgagtcagtatggacactccaggtcagcaaacatgacacaagcaatgttacagagatcctacatatcagaggagaaagattatgctctatcaat

SEQ ID NO: 42386 - DNA, 1540 bp, Bovine  19866881538703
ttccagcatgtcatacacacaattgaattcttaacagctgccattcaaaagaactgtggaggaccatttgaaagtaatattttgctctgtgtgacatctcatttttttcccctcagaaatcataatttttttacacacctcatagtcttcctaacaggaaaccagctctgcctgtcattttgattggggaggaaccttgttttccaggtcacttgcttgaatcctggagacaagatattcatgagggacctggatggggcatttacatctcagagcagagttttcctctccatttgccagcatgccaggtcagtgagccgctctgtcggagggaagataatggctgctgtagtgccccctgcttattacacactgagtgctctgaccttcttgggagaaccccccaagcattgtgactcagggcattcccctactctgtaagaccctgtcaccaggatccttccatctgaaacacaatgttagtgacaactttggaaggggctacttccaaatgccatatttcaaacttcttccctctgctgacaacgtcttgactatgcagaacaaaataaaaaattgttcattttttaaaatgtaaatttgacttaaaaaacaccacaaatcaatgaatttgattcattgaatataaataaactaaaataagatcataagtacaattgaaaaaaaacttatattttcaatctgtatttacaaattgaactagtccttcttaaaacaaataaaactttatagatataaaaatagcaaaacaattattgaaaaaaattaaattcattatatatttttagtagatagcagtaccattttaggacctggaaaaattggaagtgacttctcttcctatcttataccttaatttgattctttcctttctaacaaaatggattttttgagacgtgaaatacaagtgagggttaactatgtcttcattttctatcccagacgttcagatgttacctgaaatactctctacctgaattttattttatttctctagacaacgaagcagtctagcacccctctgccatttggattggtagctagtaaagaatttacctggtaagtggaaacaaagctggatgactgcctcaatacggggagaggagtaccactgtctttggctcagaggtggtttccaatcacagctttcttacttcatttatgataggcacaattgtgacaataataagcaagcataatttctgggcaagaggaacacagaagaaatttttgaacatccaatacctccttctccttatttttcagttacaaagtatattgataaaaagagtacacatgttccaatacaacttgtaaaaatcacagagatagaatatttttttctctaaaaggggaaatacactgatgctggagaagcccccacaaagacttcccctaattaatgtcttttgtagatttcttaatttaacattttaaaactgaatcttcatgatgtgcaagaatgttcagacagctatataaggataacaaccaaaaagtactgagtcattacaatatt

SEQ ID NO: 42387 - DNA, 765 bp, Bovine  19866881709870
aatggatgaatggcttttttcccctccctttgtctggtcatcattgttactgtggatttctttaacaaaagatagcaaaataaacagaaatgtctccgatgaactgtgagcctgcagttaagtggcatatctatgggagtgtgctctgggatgtatttagtatagctatgatttttttttaacagtacattattgaatttttagcaaagtcacactagaaaaaagaaattactacttcagaatgaacaaagatctagaaaagcaccacatgtagctttttttcttacaaaaagctggattacttatttcattagacatcttaaataaaatttgtgatgattttggttaaattctgttgattatagacaaattcatattgaaattatatatactcatttgagtgattttttaatcacagtcactattaattttcagccttttttagtgtggaaacaatattttaaaataattgttagtatgtaatatttgctagtaactctcagtactcattagtgatatttgaaacatttcaaatgccaacatcctaaaactgtagaggtaattttattaattataagctgtaatttattacccatactgtttttgctagataactcttgtggataaatgattaaccatttaaaatgaagttttttgcttccatgtttataaagaacttaattattctataaggtgttccctattttggtctattttccatttagtaggatatctggattaaattatagattctgcatgtagtag

SEQ ID NO: 42388 - DNA, 852 bp, Bovine  19866880356150
cccagctctgccagctcaatgacagactcatcaaggagggaaaattgaaactctagggcgcccccactgcctcttctctagaggtcagacgggggtgggggtccctggttgtgatgtcacaggctgccatgtttaggaaacacagtgtaccctgctcccagcatcaccaggcacttgcccacacgtctgtcccagcacggccctgggccgcttttaccctggggagcatataaagaagtttgctgaggagggcgtcctgctccctggcgtgtcctgcacctgcagtttatgacgtcctcaccctgaggtgggggcccagagcgggaaggcctgtgacaggtgtgcttctcctggacgacccagggcaagaggtctgtggaagtgcaaggcctgagatgctcacgggggccctcctgacctcccccgccccctattccgagcccccacccctgagccctttcctgaatggggctctgtaaaggaactatgcaaatgtgggcccctctccccccactgtgtctgtctcccctgaatcctcacagccgtccacgccctgctcacagagacacgtcatgaggtctgaagctggctggggtcagttatccgtgggtggaaatgctcatcaagtaactgcatttgacgatttccttaggattaacgatactgaaacaaagaggcccttgtgtgggcagacacatcccccttcttgaaggactctcctagatcaatagtttgaaaaatgtgactccttagaaggcttgagttcagaatccgccttttagggatactcggctctcagtcccttggtcgttagaagagtagttccttaggcagggttttatttttcttttt

SEQ ID NO: 42389 - DNA, 795 bp, Bovine  19866880377823
tttggccacagacatggccgctactcttctaggctgggtacatccaatcttgcccctggaagtgtagcccgcctccgccagggtactgggtgatctgcgtggtcttcccagacccagtctctccaataacaatcaggatctggttgtcatggacagcctgaaagcaaccaaatgtaaggtcattaaaatctgccacacattactcaggagtaaaataattaagttctaacattaaaggagaaaagggggaaacagtggtgcacatatgtaagatgacaaccagggtttaaatttttaagtacgcatagaaaaaaatattaatggtgattttctatgggtgatgttctttttcaacttagtaggtaaaagaatctgcctgcaatgcaggagttgtgggtcaggaagatcccctggagaagggaatggctgcccactccagtattcttgcctggaaaattccatggacagaggagcctggtaggctacagtccatggggtcacaaagtgtcggatacgactgagtaactaacactttcactttcaactcttccccagatggctcagtggtatagaatctgcctgccaatgcaggagatgcggtttgatccctgggtcaggaagatcccctgcagaaaggaatggcacccacttcagtattcttgcctgggaaatctgacagaccgtggagcctagaaggctgcactccatgaggtcacaaaaagagtcggacatgacttagcaaccgagcatacatgcacgcataacaaattaaaactttaacttttaaattattta

SEQ ID NO: 42390 - DNA, 1703 bp, Bovine  19866880452092
aaaaaaaaaaggaagttcaaaaacaaactaaccaatacagtgtttagggacagacaggtggtaagatgctaaaaaaccaggaaataaggtaaaattcaggatggtgattacccagaagaggaaggagaaaggtctaattagagcgagcatgtaagggcttcaaaggtgctgataaagttctactcctatggcagaaagtgaagaactgaagagcttcttgatcaaagtgaaagaggagagtgaaaaagttggcttaaagctcaacacacagaaaactaagatcatggcatccggtcccatcacttcatggcaaatagatggggaaacagtggaaacagtgtcagactttattttggggggctccaaaatcactgcagatggtgtttgcagccatgaaattaaaacacacttactccttggaaggaaagttatgaccaacctagatagcgtattgaaaagcagacattactttgccaacaaaggtccatctaggcaaggctatggtttttccaatagtcacgtaaggatgtaagagttggactatagagaaagctgagcgcaaaagaattgatgcttttgaactgtggtgctggagaagactcttcagagtccctcggagtctcaaggagatccaaccaatccatcctaaaggagatcagtcctgggtgttcattggaaggactgatgctgaagctgaaactccaatactttggccacctgaagcgaagagctgactcatttgaaaagaccgtgatgctgggaaagactgaaggcgggaggaagaaggggacgacagaggatgagatggttggatggcatcactgactcaatgaacatgagtttcagtaaattccaggagttggtgatggacagggaggcctggcgtgctgcagttcatggggtcgcaaagagtcggacacgactgagcgactgaactgaactgaattgggtggtgggtacacaggttttcatttgttattgttatataaaccatatacactttattaaggaatttatttcacaatttaaaaaaaacctgccaatgggctaaggttaaaatttgtttccatggcaactcagaggtaatctaggtggatccaaggtttagaggacaattactaaaaatatgagatcaaattcactccccaaaatactagaacttcttgtatcttaaaaactgattgtaagcaccttatatcctaaaaacaaacatttatcagaaaaataagggttttttgcctctatcatgaaaggaccctttttctttgagagaagagccatgagacccatgaaacagatgagtttaaccactggtttgtataaactacaaataaaccctatccacggctgaacttgccaacagtcctcccaatccatcatcctggcccatccgagtgcccggttaccttcttcatcatccactttagggagaatgccagtctcttcatcgaagtctgggaactcttccttggaaaggacattggcagcaatcatctagccaaaggataaaaggaaacatttgtcgcctactagatcaacactcttcttttgactttatacaaagacttcatgtaggaaaccaaggtttttttcctctgctgacccaagactgcagggcctcaaacaccatatatcctacccgtgggggcacaacatcatgcccaaaagcacagctcaagagtcgcattcccaggacatgttat

SEQ ID NO: 42391 - DNA, 1590 bp, Bovine  19866880467373
gctgagttcatggactgatggtcactgaaaaaaaggatgtggatttagcagacaccaatgaggtggagtggagaaggcaatggcaccccactccagtactcttgcctggaaaatccatggatggaggagcctggtaggctgcagtccatggggtcgctaagagtcggacacgactgagcgacttcactttcactttttactttcatgcattggagaaggaaatggcaacccactccagtattcttgcctggagaatcccagggacagaggagcctaatgggctgctgtctatggggtcacacagagtcggacacaactgaagcgacttagcagcagcagcagcagcagcagcaatgaggtggagtgaccatgcccccggagctgatggagacagatactaaaggccatggctcagcaccctctgtcctccaactccctgtcccaggccacagaagcccttggaactaaggagcagccctggtgagacagatgagaaaatcctgaataggtaaacttaaatctgaaatttctgagttcagctgaaattgattacaagtaaattaaatttgctgctaccaggtgggatgggctctcaaagagagatataggaaaataaagttgtgttttttagaagcatcctcccccccagttatagctagttcatttcttctttcttttcaatcaggagctggttgaggtctcgggcctttccaactatcacatttgctatgggtctgacctcccagacttcttgactttgtagctgccactgctgctacagctcaaggaactacccagagaaacacagggcatgtctagcaggcttttgccggaccagatctggaatgtgagtctttttttattctttctaatagtcctccacccgagtcggcatggcggggcccgcgcaggacgcctacaggccgtatcgtctcctcggagctgcagccaccgacccgcagacctccagccccggggactggaatgtgagtctttcagccaacagatcctgttaagaaaccactgtgtgtcactatgaaaatgatatggaggttcctcaaaaaacaagaaagaccaagaccatatgatagcacttgtatgggaactttaaatgtggactcaaacatatttgcaaaacaaaaacagacttacagatatagagaacaggcttgtggctgccaaggggtaggggatatgggggagggaaggactgggagtttgcgattagcagatacgagctattatatataggatggataaacaaggtcccactatatagcacagggaactatctttaatatcctgtgataaaccataatggaaaagaatatgaaaaagaatatataaaactgagtcactttgctgtatggcagaaattaaacacagtgttgtaaaccagctatacttcaatacaattgaaaaaaagaaagaagcaactgcatgcaagtcctgggccgggcatcatgcctcgttctggggacagccaggtgaataagacataggcctcatcttctacatgtttataatcttgtggcttcaaacacagaagccaccggctctaggaccttcattatgaattgctcctgattg

SEQ ID NO: 42392 - DNA, 1027 bp, Bovine  19866880522305
tgatgggggcagggttgccattaagtgtcacaaacccctcattttgtaccagctgatgggagaccataattgcccagatggtgggagagcatgattagtccctcttttatgcccagccccatgagagatgaaattaatcatggagccaggtgggaggggctctcctgtctcatcctctctcaaactggcaagaaggtccctgataaatatgcagtagagtaagctggtcagtcttcctgcttttccaatccagtctagctgtagttgaggattctggcagattctgggttcaaaacaattttccttccaagtcctctcacagtggctgcgtgttttgcttcttcccttttcctgaacactttacttcttcacctcccactcaccccttttaatatgcttttatgttcttggcaacattcttatcaaagtcaacagtaaactcctactaaccaagaaaaatggccttcaggactgttttttatctatttgacttccctataatgtttggagtggttgggctcgtgttccttctggaaacactcttttcttttcttctgggatttctgctcctccttttctgatcatttcttttccatctctaccttccttttctgtcctgaaaatgttgacaagttcccagttctctgtcttaggcctttgtctaatctcttggctccctcagtgagtggcagatactgctggtcgctcatgcaagaattattctttttccttcttgttcaggaaaggtgacctctcctctgagccaggggacaaatcatgattggtccaagaagtcacagtaaataattcatctttgcctgtgatttgtttaagggtggacatgtgacatagccctggccagtggggcacaagcagtttaggtgggagggacttcaggggacaattgtacaagcagactttggtaccctttaaacaaaatgtgagaatatggggtctgaagccctggcatctatcttgtaagcccgggggagaagaccaacaggttcaatcataagatgctgccctg

SEQ ID NO: 42393 - DNA, 4702 bp, Bovine  19866880564250
acctttgcaaggggaggggcagaaagggtcatgtggcagagataaaaccattcctagagattagggaattgattgtgagcctgacagctaacttttttttacagttacttcatttctctgagtcttagttttctgacatgtaagtgcgactaataatactgtccaatatcacagtgaggtatacaactctcacattttgacactttcatcttgttcttagatttagctagtagtggaggctgaaaaataatgagacaaactgggaaacctttaatgtattgaaacaaaaaatttggtgacatgcaatatttactttcacatatcaaaagtatgtgtccacccagtccattctgaaggagatcagccctgggatttctttggaaggaatgatgctgaagctgaaactccaatactttggccacctcatgcgaagagttgactcactggaaaagactctgatgctgggagggattgggggcaggaggagaagaggacgacagaggatgagatggctggatggcatcactgactcgatggacgtgagtctgagtgaactccgggagttggtgatggacagggaggcctggcgtgctgcgattcatggggtcgcaaagagttggacacaactgagcgactgatctgatctgatcaaaagtatgtaaagcagttactttaaaaattaaattaattaattaatttatttttggctgctctggttcttcattgctgcttaccctgggctttatctagttgcatcgagagagggctactctctagttgctgtgtttgggcttctcattgcagtggcttctcttattgaagaacacaggctctagagtgcataggcttcagtagttatggcacatgggctcaatatctgcagctcttgagttcaagagcatgagctcagtaattgtggcacatgggcttagttgccctgcagtatgtgggatcttcctggaccaggaattgaaccaatgtcccctgcaatggcaggcggattctttcccactgagtcaccagggaagcccaaaccagttacttttaaactcaaatttgtttcctaggcaagatctaaattctggaattcagtgtctaattaaatcatatgggggggaatcaggaggagtaacatatacacattactgaatataaaataggtaaccaacaaggaattactgtacagcacaggaaactatactcaatatttcataataacctataagggaaaataacctgaaaaagaatatacatacatacatatatatatatatgaatcattatgctgtacacctgaaactaacacgatattggaaatcaactatacttcaattaaaaatataaataaacaatatctttaaaacaggtctttcctggcagctcagatagtaaaagaatctgcctgcaattcaggagggttcgatccctgggttggacagatcacctggagaagggaatggcaactcactccagtattcttgtatagaaaattccacggacagaagagtctggtgggctacagtccatggggtcgcaaagagttggacatgactaagagactaacactactggtaaatgaaactgtgtgaatattaaaaaatataaattgatctgaagagtattataaatattacataactaacaaaaagacaaaaaacactagtgtaggcataaaagaacataattcaatgggaaagttttctgttttatgcaaaccaggtttacaactaataaagggaaaggtaaaatgtagaaaattaaatggatagttttttaaatcaagaattcaaattataataaatatattgataatatatcattctacatatacaacttttaatatacaaaatatgcaatgtatgtctgtcttttatatttacagaaatagctgaatgacacccaaagagtatgtttctgtgtgctctggagaaagaaagatctcctttgagaagggatgttaataacctgagcatcatttccaaagtggccagagagtcagtgtcttgatcacaaacctgcttgaaatttacaggtagctgtgaatgattgcaccaagccaaggcaattggggacaatatggctcttagacggagttgaaggatacagttccaggcttaaatcatccctgctcaaatttactcctgaaaagcagtagaaattggaggccctatcatttgagacctggccaaatggcctggctgaccatctccccactcccctgtatcttgcagatcctacctacctcctggggttgtgatgataatgactaaagtattattatactcctatcacactatcatatgcctaccatatcatttagtaggtactcaaaacctactgaatctctttctttttcctatggctcaataaaaaaaaaactttggaaaatcacgggcacataaacaaagatggctatagacattcattctgagagcaggccacatggctcaaatattgaccacggtatccactgatttgtttaaaagtgatttcctgatggctcagacggtaaagtgtctgcctgcaatgcaggagacccgggttcgatccctgggttggaagatcccctggagaaggaaatggcaacccactccagtactcttgcccagaaaattccatggatggaggagcctggtaaggtacagtccatggggtcacaaagagttggacatgactgaacgacttcactttctcttttaactttcagaggatcccacagtgattctcaatttgattcaagcaagctcaatttgaaaaatatcttagtattctaagtgcttcttggcccctaaggaatcaggcaagctaaagcatgtttggatgaagattcacatttagcccatgaaactatatattgcaataaaatgcttatattttatcttgtatgacacagccacatgatataattatactgcatggtatgccaaaggctcagaatagcagaacacttatttaaattgcagtttagaatttctcaaatcactaccttttcctaagaagtccgtgtcctcatgacattgtcagtccaattaaacaaaaaaagcaggaaatatagtttatcatttgaaaatgctgtctccatcttatagcagaacatctagccatgtggctttgggcaaaccatttgatctcttcaacttgaaaaacattttcatgcctaccacgtgcaaggtttggggatggacttctgtgggatgattcagacatgcctttgatgagaaaggcatgctgggtagggatcttcagtagcagtaagtagagaatctgcaatagttctggaagcagagtattaacgagggggaattagcaagtggtttggtttggtggaagcatatggacatgtagatgcgcaggggcgctaacgaaggttgttgggaagctattaataggatagagggctcctaagtgaggcaggcatcccagatttggagcctggatgacttggagcattggatgtcttttaagaagcattagggaaaatggcaggaagtgttagcgtgagggaaaagaatgatgcttttggttttaaacatgctaagcttaagatcctacttggatatccagctggagcttccaataggtaactgatatagaagattagagtttgagagttgcaggggctggaaatagaggtctgcgagttgccagaagtgatagccgaatttgattggatccatgttgattaggacatgggttcagcttatataatagcaacaccctaatgtggtgatttcaaacagacagaagtgtatttcttcctcacataataattcactatagaggagcctagggctggtatggtggttctgagaggtcagagattaggatgcttctatctctttgctctaggaaccttagggtcctgacctggtgtacactgtctgagaagactcgacattatcacctctgtacttccagggaaggggggataatgaggaaaagacaggacctgaaagtaataggactagaatcaggggagtcacctgtggtttagtggttaggacctgacatttgcactgccacagcccaggttcaatccctggtctgggaactaagatcctgcaagttatgtagccatggccaaacagacataaactataggaccagaatcccagtcttagctagatgtgtggctgctcacaacaaaggttacattgcttgtccttcttgtagataagcagccaataagaggtgagcaaaagacatatgaaccactttaaggtctgctctataaacatgttttaaatatcaatatatccttgcataatgaatcagagagtgcactgtggtggcagctgaattaaagaggagtttcacaagggcttcccttgtggctcagctcgtaaagaatccacctgcaatgcaggagacctgggttcgatccctcggttgggaagatcccctggagaagggaaagactacccactccagtattctggtctggagaattccatggagtgtatagtccatggggttgtaaagagttggacacaactgagtgaccttcactcactcactcacttcacaagggcttccctgataactcagttggtaaagaatctgcctacaattcaggagaccctggttcaattcctgggttgggaagaccactggagaagggatagactacccactccaatattcttgggcttcccttgtggctcagctggtaaaaaatccacctgcaatgagggaaacctgg

SEQ ID NO: 42394 - DNA, 821 bp, Bovine  19866880598638
tatgtgtacatagagatccctgttttggtttaatatcactgttggatttaaattttgatagtacatgccaataaagtgaaccattaagtatgtgatgttttcatgccactaaacagtggtgatataacctgtgaatataacctgtgaactgcctgtgacacctttctaggaaaatggggcagagtttccattattaagtctttatgggtgcttacattcttgttctatgaatcaggaagtcaaaaacagtctaggtgtgaaaggtagttctaaaccatgggaaataaaatagttgaagggaactaagttgcatgcctgcaaagagtcataaatatcagttttctctgaggtatgttactaggttcaggccacatcaggttgacgctctgctttatttgtcccagttagttaaattcaggtgcattaccactctttctaaaggacagcccttttcttagtatttttaagcactgatccaggagctgacaatctttgttctgtttcttttcaaaggattcactcattagtaacttgctgcgtctcatacaaaccatgcggcctccagcaaagccttctaccagcaaaggtgagcagggcttctagccaagctttgtctccagtacggtttaggttgtgagcatcctgtaaattgcatttgtttaccttgctgcagctgctgaacaagtagattaaagtaataagacataaccagtcaaatgcatactgaatcacactccccatcccagtgccagtattgttgttgagggttttgtaatcagtattttcttttttaggaagttgaattatgtttatagtaatgt

SEQ ID NO: 42395 - DNA, 1347 bp, Bovine  19866880615462
gaattaatttctagactcttacttccccttcagatctccatcccctgatccagggtctcagaataaacatgtatgcttctacacacatgtatatgtctgggttagagccacagcaggaaagaataatcaacatttacacgcctgcattttcccaagccgagctagtccttgcttccaatcccagctgaattttgtggccatccactaaaagaaagctgaggactttcttatatgtgaatttcataacatatgtgtgtcctagaaagaaggcatctgtccagtgcccacaactttaatcaaacctatctcgtgctttaagaataaaggcttgaatagttaattaattaatagttaattttaaaagatttttttgtggaccatcttaaaaatctttattgaatttgttacaatattggttctgttctcggttttgactttttggccactaggcatgtgggatcttagccttcctgaccaggaattgaacccataacccctgcgttgaaaggtgaagtctacctgctggactgccagggaggtcccatatgtgtatgtgctcagtcactcagtcatgtccaactctttgtgactccatggactctagccagccaggcttctctgtccttggaattttccaggcaagaataccggagtgggttgccttttcctactccagaggaatctttccggcccagggatcgagcccgcatctcttgcatctcttgtatcggcaggcagattctttaccactgctctacctgggaagctcaaaccgctggaccaccagagaattctctacataattaataatatgcaaattattcttgactgggagtcacttggtctttaacatacagagacaggagaacatacaaggagagagtccctcttttttatacacacacaaacacacacacacacatacacccctctccctaccataattataattaccgtgctggcgtccagatcaggggttagcagccttggcacggagacgcctgaaaggcacccaaggcaattagtggtgtcgctcctccaccccctccataccttcagggcctttgcacttgccgttcccctccaggcacacacatcccctccgccccactccatccttgtgtggctcactcccccactgcatttgggtttcatctcaaataccacctcttcagggaggcctggcctggccacctccacggtgctctgtctactcaccagctttatttttctttacagaacttttcactcctgggcatcatgctgtgtatttccttgttctctaacatctacctccctgccagtagggagctttgagaggctccgtgatggcgaccatgtgcccag

SEQ ID NO: 42396 - DNA, 1990 bp, Bovine  19866880625902
ttcctgtgacttctttgagtcttctgctctacttcctcgtgcaaaggtggtctggtctgtacttataggtacagcaagaaatgtgtgtgtctgagagacaaagacagagagacctattagtatttccctctgtccctctgtctgtctgactctcagactattaatacaagccccatgtctggctgcacccctagaacatagcactcccacagcacaacgctgccctcccaactgagcctgttgtctgttccgtttctgatcggcgccaggctcgtagaccccatgtaggtagaatataactttccataaataacccttaacccgacctacaatttagcctttgggttttttttcccctcgtggtaatgggattatagcctgggtcatccctcctaaatcttcaggtcccagaagcagaccctaggtgttaaatcgggattagggggggttggtttgaattctctgttcccccacactgcctcgcacatgacaaggactcagtacacattaaggaattgagtctcctctgcccgtgaaccttcagcctcagtgtcttggctggggccgtgccttctgcctagaatgtccatgctcccttctttacctgctgctgctgctaagttgcttcagtcgtgtccaactctgtgcgaccccatagacggcagcccaccaggctcccctgtccctgggattctccaggcaagaacactggagtgggttgccattgccttctccaatgcatgaaagtgaaaagtgaaagtgaagtcgctcagtcgtgtccgactcttctcgaccacatggactgcagctcaccagggtcctccgtccataggattttccaggcaagagtactggagtggggtgccattgccttctctcccttctctacctggtgaactgctaacccacctctctgaaaccctccctaagcttgatccctttcccacccaccacagagcaaattcctgccatccttggtccctgtaacattttgtacagaacagtgtgacctgattatttgcccacgtgcccaccaggctctgagcagctcgagtgggtgtcagggtaaggatctgagcccacggctggctatgagcaaaccatttaaccccttggtgcctctgtgtcctcatattcaaacaccaacctggctccagagcccattgcccacccaactgtgccacatcacctttgggggctgaacgatgtatccatctcccacctgagcccgtgttctgggccctgggactctcttcactatgcatggattctctgcagggtctcattgaggtctccttggggcctggaggcagcagcatccactgacacctatcaaaggcttgcggatgatgataatgggtttaggagggcttattgggagttaaagggtaaaattacagggaagatcttggggtggggttaccccaagatgggctggattcaatcctttgcaaagggtcatcttatggcaaagggagagtatttcttgagcctctgttagtgcctagcactatgaagtgagacaagagttttgaaaaaagcccaagtcatggtccttgcttgtgaagagtttacattttcatcacagaggcattagatttacatttgagaaaaagcttgactgagctcctgtgagctggtcctgacacttgactttgtgtctattctggtactaaacatggcttggctgggtgggacaggtgacccatgaaggaatgctaaatggaagacatagattcagaagtcaaaggagtaacagggacaaaggggacggacatctggggagaggggatcagcgggagttggaatatttctggaaggttcagggaagaggtgacaaggaacatgaaccccaaagaaagagcaggagttgttgggggtggtaaacgagggcagtaaactacaggttgggacagtctggggccacttgggagtcattaagggagtttgggagagtgggggatggggatcaagcagtcttccatgtcag

SEQ ID NO: 42397 - DNA, 1470 bp, Bovine  19866880645794
aacaagatcccacatgttgcaactacagaccccacatagaagactgaagatcctacatgctgcaactatgacccggcgaagacaaataaggtagtaaatatttaaaaaaaaaagaagaagaacagagagaaacatgaggaagagatggtggcctcatccatcactgcactttatcctgttgggaggtggtaaccagatctaccacaggcgtcttcggaccatcaggggagtccccaacactgagggtggcagaagagtcctgaagccaccagagagctactgcatcaaccagccctggagctggtcacctcgggatttcttatcacagaaaataataaattttcactattgcagctatctgaataggggagcagggctggcaatcaaccctcagccaaagtcaatgcaaacacaagggtgccgaggccttgtgtcacgtgtggtcacttaacaggcagccaggtgagcagagagagacccaaagctctcagcctttcacacaagagccagaaaacatcaggttttccaagaaaaggcctgtcatgtgcttgttttctaaaaaaatcaagttcaacctgcctcccagtaaagcaactctactccaataaaaattgattttaaaaaaagctgcctcccaccgtttcctgggtggcaggtcccttaccgttcttctgagccagagcctggtcgatgaagtctgccgccttttcaaagtaggcgctgaggttgaactcctgtgtgtcattggccttgatgcccaggtaggtgatcccggagtccttgtagaagttggcattggtgtttgacgtgcatgaaggacctgccctcagctgcattcaggacatgggtgatgcccagcttctgcagcttgggggatgtcttgagccacagacctggacaggaaacagcagcaggggaggatcaactgactacctggcagccctcaggggaggaagatgggagaagaccctaagcctcttggctcagaaaggaaccttccgtgctctggcccctgctggcttctccagcctcagcttatgaccctctgccctcactccagccagctccaactacctgccacaaatagccctgcgtgctttcatgcccacactattcccgctacctggaatgtccttctccaccttcttcataaaggtgcaccctctcatatctcacctcccttggcagcatttcctgatctccccttcatccagcatcgtgctctcgatcctgtgggtgggtgatatcaccaagaagctaaaaatggagccagactccagacagccctgtcacttactaagcttgaacaagtcacttaacctttccatgcctcagtttccctatctgtaaaatgaggatgataacagtatctactcctggggctgttgttagtgttaaatgagctgttctataagacagagcctgacaccgtgatcagggccactatcctaatgcttgattgtgcttatt

SEQ ID NO: 42398 - DNA, 986 bp, Bovine  19866880829366
cccctcccccgcccacacacagcaggcttttccacaatcccatgccttgtcatttgcctttccactccgccaaatgtttcctgttttctctgccaggtgaactcttgcacattcttcaagatccagctcataggtcacctcctccaggaagttttccatgccctccaggcagagtcagcccctttcccatgctagctgtgtagaagtatacgctacttctcccagcctgtaattatctgcttgctggcctgggctccaccgtcctgttgttcacagatattccctcctcctctctggagaaggaaactacttccctgactcactggcctcactcaggcttgaccatgtgacttgccctgggctgtgaagtggaactcatgagtcagtgaggaacagaagcttccaaggctaagtatggttcaccatgctctcttttccctttgctgcaaaggatggcaatgccccatccagaaaccgcgctgccagcctggcactggagtaaaggaaagtggaactgactcatgacatacatgaagcgtgagagagaaatgaacttgactgtgatgcatgaggcctctgggaccatggaatcatgtgttactgcagcataaccagctgatcttggcttctccaacctttgcctctctgccccagctttaccagcacaaaatcaggaatctcatcttactcacattacagggcagaccttcagcccatgttctttgagtggctgataatattaataggtaaggtttgctgaatactgatcaggtgctcggcactgtgctgtcctcttgccaaatgtcaccccatttcatcctttcaatagcactaggtaactactcttacatagaatttgcaaaagagaaaaggggtgggacttcccttggaggtcttgtggttaagagtcagtactttcagatgtggatgaacctagagtctgtcacacagagtgaagtaagtcagaaagagaaaaacaaatatcg

SEQ ID NO: 42399 - DNA, 2431 bp, Bovine  19866880874739
tgtcctgacatctgtacaccaagccggtaacatatccactgctatcaagagccataccaccccccaggcactggtgaggagggacttccaggcagctctttatgaaaagcaaaggcatttttgtccacggggttgccacgtgcttccccacagaagctattcaaatgtatactgtactttctggaaaaatcaggtttctctggcgttgatgaagacttttctcaaagaccagagcaagagcccagagaaaaggccacagaagaaacagaatccttctcttggaagttcaaagtcttgttctacccacgagcacacaacgggcttctgaagtggaggagtttcaggaagctactggaggtcaagagaagggcaacggttttctttgcagcactcttgtgtttttcattcaaaataaatagaacagaagctgaacaaaaagaaccctcaaactcaaaacccaatttcaggggacacccggggctccccaaagccagactcactctgtggccaccatctgggggatgggctcatccaggagttccaggctatgcaggatccagtagcagagccatgggcggctggcatccagacactgcgaaaggaatagggcagaaaacacaccccttattcagaatcgttccaagaccctgctgacaaggcgacatctgtctccctcccggccgcctggcaaggaggagaagggccacctcagagggatgaaggacactttgcctggaggccttagcccggagctgaagtgaccatatgtgagcaaaggacaacgggacaaaggcgtttaacctgaacccaatgagtccttccctgacaggcactgaaagaagccaagcagaggactcctcacacagcagaaactcaagtgctactgttttctcagtgtagacccaaggagagccacaattacagggaaggatttcctgcattcactcgtttattgatttaacaaatatttaataagtatctcctcaggcccagcactaggggcacaagcatgaataaaattcagttccttctcttgaggtgcttgggttagaatgtgtgtggttatctgtagaggaggagggcattagacagacacggaagtactagtgcatttctggaataaggcagaacaagacaagtgcatacacagagctggataaatgctataacgggcacatggaagaaactggctaattctgcctgagcagctggaaaatgtttccaaaggtgacctgtgaacaggtcttgatcctagttcaagccataaacactcaagcattcaagcctaggcaggctggtagtattattgccccagttttacgaatctaaagtgtataaacggtgtataaatgagatccagagagatgaactttttccagatgacaaagagagtaaatgtaagaaacaagaacccaggtttctagactctcgatccagtgctcttttcattggcctaagctgccgtcttcataaacatgcacataaatacgcttgctcaccacctaggggcagctggtgtgctgacagaagacgttgctatgggtttcagtgccagctccttctctcattagctacgtggtggtggtggtttagtcactaagtcatgtccagctctttgtgacccccatggactgtagcctgccaggcgcctctgtccacgggattccccaggcaagaacaacggaatgggttgccatttcttctccaagggatcttcctgacccaggcaacaaacccaggtctcctgcttgggaggtggattctttaccactgagctacctgggaagccccctgtgtttctggagatgtagaaaatagacaatattccagcccaccagcccccaaactgagcacataacccaggcctggcccaatccacttaagggaccccatccccaaggtgactgagctggttcaagtaggcctgggcttctggggccattttcccaactctatggaagaggcttctctataggcaagagaatgaagccaagaccaaaagatgccttgccaagagagacagggggacaagaagggaggtgtcctttgaggccctggattcacttgagcggccacaacatgaacagtgcccccttgaagttagcattcagtggggccatggctccacccgtcaacttcccagctagggaaccaacacatttcatttttcctgttttttttccttaagaaatttgagttgaggtttaatcacttgctaccaaaagtctgaatatagaaagggtttccatctaccttaccttgctggtcctcaaaactgtggccaagtctgtaatgcattttttcatattgaagtcatggggagggactgatttccagtctgggtcaacccagagcagtacctgcagggcggtgagactctccgaagtcattcctttgttaagggcacccttttcatgccccgctctggtat

SEQ ID NO: 42400 - DNA, 931 bp, Bovine  19866880907128
aggtgtctttccgtgctgaagtttctaaggaagccagcccagattccaccctttccttccgagaatgtatcctgtgatgtttaagtaggagtcaagccttgagaatgaatttctcctaaagtgtccttgttccaagagaggaggtggggatggatacacctaggaaaggaagcacgcaacaaaaggggtttgagtcaaatgttccctgggatcccaaagttttctaagggaacagtgcggttcaactgacccactgacaaggaaagaggtcaacgtgggcaacccagtaccccacttcctggaggctttcaaagaaactcagcatttcatgctgagtttcagaagagaaagggcagctcagaggcaggaaccaaggatgttgagggtagggaggaaccaagaaacagacaaaggaagaaacaaggtgggaagagggcagataagggctgaggttgagacccagagggagagcagaaagaggacaggattgccaaacacaggcagcaatcagggctctggcgtgcccaggtcagcgacttcttctcctttcagtccacaccctgagtggatgccttgatgccccgcccaggcccctctactggctgtaagtgttggttccagtgactccaacaatttgtggtggcctcttctctggagacctgagcaaccagcagcctattaactgactgatgggataggggaagggtaccaaagaccagcttccctgtctcagggggctcctctctgtggttccaggctccatccagagcttccctactgagtgaagtccaaatcagaatccagctgtgagaaggggcttttgctgagcccctctcctgccctatcctgcttccctctctcctcttctcctgagactttgccctcaataaaccttgtgcctctaatccctgtctcaggctcgcatcgagga

SEQ ID NO: 42401 - DNA, 1330 bp, Bovine  19866880979073
ctaaccctgaggttctgcatcccgagagagcctccttatttcactggctgtcacgctgtagaagcaaatagctagtgtgactcagagatggtgtggtttaataaattcaactgtgaagtcagctttggaaggttatagatgttgaggttcaaatgtaggtcctcagcaattccactgcgaagtgtccaccctagagaaactctaactcatgtgtagaagcagagggatgtaaggatgttcactgccgcactgtgcttaacagcaacaagtcagcaacagtgtacctgtctctcagtaggggaaccagaaaatgaatacactgggctctgttcacatattggagtataacacaacagtccaaatgaatctatgtctctatgcatgtcagtaactatatcacttatatgaactagaaatctcaaaaaccatcgctgcttccactatcattccattatgtaaagtttaaaaacacatataacaggggcacgtagtttacatctaaatacatatgtagtcaagatgggcaaatattcaggggcatggtatcatcaactccagccacgggtcacccgtgggcagggacagcagtggaaatgaggaaaaggggagaggcatttactggacacactttttatttcttaaaaagaaagagccagaactaaagcaaatgtgatcagcattcacatcctggagggtgggtactacgtgctttttctgcacactttcttgtattcattcattcaacaaacattcagtgaggacctgttatgtgccaggcaccgttttaggctctgggaacacagtagtaaacaaagccaacatcgctgtcctcaaggagctcatattctctctgtttgaaacatgcataactcctcgttttgatttttaatacataagtccagtccttaaccactgactaagaggcaacctacctttttccaatctcctccaatctgcttggttttctcttccccagaacctcccactagcatctggtccccttccaagccccatgtcagaaaaggccacagctgtcctgtgacagagtccccacctcaccctgtggaagacccaccacctagctgtactgccccaccccccactatcatccaacttcctggtcacacccaccaccatttaccggagaccctggggctgcctccagtgtctccccaccctcatgcctgtgtagacacgccatcccacacccaatccatccattcctagaattctttaacactgatggcctctttgcccccccatagccacattcaaaatgttatccctagaactgtcctcctggaaacctttcacttcccacctccctctc

SEQ ID NO: 42402 - DNA, 1657 bp, Bovine  19866881078066
acacacacactttctttaatgtgcctcctataacactatgaagttattttattgcactgttaacaaaattccccaagtcttggatttgaaaaaagccttaagtcagatccagaaaccatcaagtgccaaattccagggagtgaagcggggaataagtgcaagagacaagtttgctgattgcatttgatttaaaggcccttctactgctgcttgcaaaaaggaaggtggattaaaagcaatttttttttgcaagtctcagtggcccactacggtctgtagtagaaagagagacacgctccagaaaaaaaagtatttctctcggcccacagtgacattctcactttctcagtaacttaaaaaaacaatcagattcttccttccgctctttaacctccaacttacatgccaattagccacactcttgtctagtggggtttcaagtcatttttctccaaggcaaaggaaagacacttaggtaggtgccttgaagtttctcctggcttcccccacctgctctctggccctgtaaccttcgcccacctgctttgtcttccccacccccaggggccaagttttccatggagtctgtgcatggaaataggaatcaggagcttcttgttccccaaagagttctctctctctctttttaaaactatttatttacttggctgcaccgaatcttagctgcggcacggggggtcttcgatttttattgcagcacatgggatctagttccttgaccagggattgaaccccgggccccctgcattgggagcatggagtcttagccactggaccaccagggaagtccccaaagagttctctttgacaaacagtctcatggtctaagagcttccctggtggctcagagggtaaagaatcgcctgcaatgaatgcagaagaccagggttcaatccctgggttggggaagatactctggaagaaggaaatggcaactcactccagttttcttgcctggagaattccatgaacagaggagcctggtgggctacagtccatgcggtcacaaagagacagacacactgagcgactttcactttctcatggtcttataggctggtgcccatcacaggaggatccattgccatttcaactggccagtgagtctactcagtcaccatggcttgctggtatctctggagggttaatacaatttcttggagaatgacattccaagcatatagggtcagagctccttgcccactgaattatttacatagtctagtgcagcaggattggggctgaaatgggaatggacgataagaatagtgtatatgctggctggttccaaagatgcccaaggttccccgaggaggggccatgggtctcagccctgaggcctggaggcagcacacatgatgttaattaaacaggcatctcatcttccagaacaggcagccagggtgttgcaggctggtggaggagctggggtcaaagccacaaaccagactcccctctctgctttgtccaggacttacccattgagcgtacatctctcctctgaaccttacaaccctcctattttgagtaaagaaagaattacactctacatttatgcacatgaagaaatagaggctcagacagataatgtgagctgctcggaatcacataattaagaaacggcaaaagcaggcat

SEQ ID NO: 42403 - DNA, 1595 bp, Bovine  19866881129043
catacgttctgagcctctgggcaaaatttctgcgtgtttgtctttctgggtctgacaccaagaaatctatctattttataccttccaatatgtcccttttctcccacttgggccctcaatggctggtaaggtttctgcttgtgtctccaaccagagagaatatggtgagctctggagggcttttttctaggtcaaggatgttagacgggtagggccaataagctgccaccacccactcttacacccacggcagacatcactaattgatcatagcactctcttgctgaatgtagatattgcttttggatatttcaggatatagtatctggtctcaattgagcagaactggcaagtgaattaatcttgtttgccatccttgatgcagcaattttaaccttctctgtcatccactccactccctgcaggaagtggatttttaaaaattacaaccatctgtccttcacagacaatgcttagctatgttaaacactggccgattgtgcttttaccattgaatacatacatgctttaaggcatgtgactcatcacagttttacatccacttatgcagagttacaccatttataccaccagtcacaggatcacgtgtgaaaaaaaaagaaagcatttgttgacttttttattaactaccgaccagcatatacacaaagccctcttgaatcatatagtttagaaacaataagcagcatttttctatctggtggagtcaatatgaatctattttttttccctgtcctctgaatacagtctccaaccattgcttcctttaaaagtcaggcttatggtttcagagcaagatgatgtagaatcattttttccctccttctcaattctaaatctggcttccctggtagctcagttggtaaagaatccatctgcaatgcaggagaccctggttcgattcctgggttgggaagatctgctgaagaagggataggctacccactccagtattcttgggcttccctgtgactcagctggtaaagaatctgcctgcaatgcaggagacctggtttcagtttctgggttgggaagatcccctggagaagggaatgtctacccactccagtatttaagcctggagaattccatggactgtatggtccatggggtcgcaaagagttggacatgactgagtgactttcactttcagtttcaactctaaatggcttcccaggtggcacagtggtaaagaacccacttgccaatgcaggagacacaagagacttgggtctgatccctgggttgggaagatcccttgaaggaggaaatggcaacccactccagcattcttgactggaaaattccatggacagaggagtctggcatgctacattccatggggttgcaaagagttggatactacagagcgcacacgtgtgtacataccaccaccacaactccaaatacaacttaaaatcttaggaatttattgataaaaggactctgaaagatggaaagaaaatgggttaagtagggaaactcaagatttgaggaacaaacaatgtagtgactttcctgggctttcttttcatttcccacacccaactgagataggaaaggcctacaaccca

SEQ ID NO: 42404 - DNA, 829 bp, Bovine  19866881155533
tggcatgggcgcatgggggtaactgcactgtggagaaactgacaaagcctcaaccactagctggtcaaggtcaatgtcaactgggatatgtcatgtagacagtacgtacctttttttggtgggggaaggggaggagagaagcagggtccttcataagggtctagtagatatagtggagatggaggtgaagtcctaggcctaggcctaggaaaaggcagaggtgaggcagaggcctccggagcagaggccaggcctccctgactccccccagcaagccctctgctacctcagattcctcactccagcctccccctgcctctgggaacacagagcagcaagaactgccatgcaggaccctccagggtccccacttagagcagagcacaggatccaggatgctccctccccactgtgggagatcagggggaactcggtgtcccactctccaccaggatgaagtggggaagctctctgtcctccagaagagaataaactcttgttctctgtgatggggggagagagagtggggcttggcctctaagcagaacctagaaagaggccagaggtggtgcccccagaggagattctcagatgccactttcacacttgcagtgtctccactttcccttcccattgactctagggagcagctcagagtctgggccagagtgactgatgggaagaggggatctgctccaaagacatctgtggatttcagagtgggagtttccccgacaccaaattcacctctgtatacacagggcagtagtcatgtatggatgtgagaactggatcataaagaaggctgagcactgaagaattgatgttt

SEQ ID NO: 42405 - DNA, 1822 bp, Bovine  19866881232791
ctccatcaatgttattatttctttttgtagtaacatggttttgtggcaatcagtgaaagctccttggaggaagtgccctttgagctgagcctcaagaaccggaaggacttccagaagctgagatggtggtggtgaggaggctgaagaaccacagattttgtctgaaagcttgttatttcttctctcttgctcgtttcatccttccctctttagctggtactctcttctcccagagtctctctctttcctttcccgacctcctcctttttccttctcacccactggaggcctccctctggtgtccttggccctacaaggtcgctgactgctgggttatgaggtgctgctctggggctgcagggtcaccttgcagtcccctgatggggactctgtaccggttccaaaaggaggtgggatgctgtatccaggattcttcccttgcagttcagggagagatggatttagtgtgggtcactttcactacaaattatcaagcggtcttccatgtggatgtcagcctgtgttagggctacagctgtaccagctcgaccttgttcagttaataatttactgccgggaaatgggagttaaatgggccagaaggcatattttgtgtgaaccttgggacacctctgacagcaatttgtgtaatttgtccgggaagagcctaaagctatctgaattctaatgttctgcctgtcgcactgaaacttagaccccttttattaacatggttggctttgatttatatttattttattcctttggtttcacttctgatctcatgactggagcagtggtgagtgtggaaaatggctgtgtgaggaattatgttcccagtgtccttattcgaagaaatccaccagcacctgtggtgtgggttttctctgttttgtgtaaaaggaactcatacttgatttaaagctctgctattaccatttttggaattcttaataatttatgaacaaggggttaccatgttgtattaggtcctgaaaattaggtacctggtcctacaggtatgccttggtttttgatgttgaacttgagtgaccctccaaggtccttgtgtcctttctcctgcctcctggaccatcctggaattgtgtcgaagacctcagggagcctctggtaactctttccaagaatcgtacaaccctgccagtcgaaatatcttaaaacacacacacaggtaaaagaagttgtttggtggtttagatgctaagtcatgtctgacccttgcaaccccagggactgtggcctgccaggctcctctggccatgggattctccaggcaagaatactagagtaggttgccatttccttccccaggggatctgcctgacccagggatcaaacccaggtctcctgcattgcaggcagattctttacctactgggtaccttccctcataagggaagcccaaaagaagttgttttaaaataagtaatacatggatttatgtcaaaattcaaagttctgaggggtactgttgtttccccccagttttcttgttctccttccgcagaagcaagcagttatccatctctgggcacctatccaagagagtctgtgctttgatgaacacatatgtacatgtctccatatttctttttcttcaccagatggtgagataacttgtatactattttgaactttcctctttttacctaactctgcattgtagaaataattctaaatcaccatacagatctactttattatttttggggtaatgatttcccattgtttggattttctataatttacttaacaagttccctgtgacgacacttaaggtgtttctaactataaacaatgt

SEQ ID NO: 42406 - DNA, 483 bp, Bovine  19866881304083
cctgactgctgccctgccctgccacagcccagcctgcctggtgcacgagagcttgttagtgcccttctcatcctagacatcatgtctgccgtgttttgggggccaagtcctggtccaaagctccgcctggggcatagttggttccccttggcaacaacagaaggcctggtaaccctgtgattggctcaaggcaggttgagaatttgctggcacgtattctcctcatgattaaatgtctttgcaagaggcaagggctgtgatgtgatagagaaaacactgcatttggcatcccagaaagctgggtgaccttgaaggtgcttaccttctctttgcccctgtcgcttacctgtcacatgaggctgtgacagcattacagtcgtgctttgtttaaagtgctgtgctatactaatttgagatgttggttttattttgtcctcagcatggcaaggtgcctgctgggctgtcccccctggggtggcagag

SEQ ID NO: 42407 - DNA, 1680 bp, Bovine  19866881319452
caatgccctcttccagaatgtttacatcctaatgataactatgccttggttgagaaaccatccctacccctattgtacagggaaggaaatcaaaacttgatgatttgatgacttgtccatcaaggttacacaagacacccctggtggctcagttagtaaagaatctgcctgccaatgcaggagacctgggtttaatccctgggtcgggaagatcctctggagaaggaaatggcaactcactctagtattcttgcctgggaaatcccatggacagaggagcctggtgggctacagtccatggggtcacgaaagaatcagacacaacttagtgactaaaccaccaccaccaccaaggttgcacaattgtaacgtgatggagacaagattctaacccaggaccagctgaccccaaagcccttgctctcctgcactacagccttttactccatattcctcagctctttggaagaggggaccctttcaagagggtcttctagaaggatcctcaggaaacaaggctgggggtagggaggatggctgtgctgaagacagggtctgagagaggcagatggtctgggcactcccttcctcctgtccccgacaccctccacccccgccccagtgcagggcacactgtaaggtcaccaggcttgcagtctccccatgaaaacagggagactgggctagatcagccctggctccaggaagtgccctgctctgggtctctgaagaaccaccgcacccccggctcacgcacggcacagaccagaatctggctaatctcgtcgggccgcttgtgcaggactgtgatcccgttcacttcccggagctcgtctccaacgtggaccaggcctaggagacacaggggctgaccgtcagcacagcaaggggtccaaggttcccagagcgcgaagttttaggcacctctggcacctgcctacagaacccaagcaggggagattcaaggcttaaaggtagtggatgggactggaatgaacttatccccaggtgtgctgggtggctcacctcgaatcacagcctcacagcagcctggcaaaaccctccagtttacaaacagtcagctgagattcagaaaagtgatgcagcttgcccaaggccacactgctaagaaataatggagccagtgcacagatgcagttacttggctatagaaagcccatgttctttctgctgtcacctctgcttctttaaaaatatcattaactcttccccttcctgggtgtacagacataactccaaggacatccttctccaattttacatgaaaactgaagggcgccagagaagatggagtcaggagtgttagacacacctgtctgttggcttctgctttaatgataagcaactctgcatatggggccctatttgccactcaacatggacaccagtccagaagcagcagcatcacccaggacgcaggaagggctgcagaagtcttgggcccatccaagacctgctgagtcagaatctgcattttaacaagacactggggccatttccgtgcttgttaatgggaggcactggtcttagggctcccaccacaatggtctccagacttttgggggcaacactcccctacaccaggagatctgcctcccaacttagttcctccacacaccaaagattctttttcttttaattttttattttatattggtg

SEQ ID NO: 42408 - DNA, 1046 bp, Bovine  19866881346459
actcttgtcttttattagtaagctacgtcaaatcctgtttagaagagatggggtacaaacaaatgaatcacttggtgactgaattgcaggtctctaccgagcacttgctccgaggaccagatggatgatctcttcccaagtgactgtttcaaagacaggactggagtcccaccacccccaccacccgccttgcccactcccttgccttcagctccgccataccttgctgtcctttaggcggtcttcctcctgggtggctgggatgattttcagggtgatggatccctgggattgtgcctgaaaggagacagcacatgaccatatcatctcccaggtctaaccctccaggacatcacatgttacctcccagatctggaaactcacatgcagaaggaaagttggacgtgcagcctcccctatgacctgcccttcagtggtggcacccagatgaattaactgaagcatttttatgggacaaagggatagaacacttttctctttttttttcggccacaccacgcagcttgcaatatcttagttccctgaccagggattgaaccttggccctggagaattgaaggcgtggagtcctaaccactggagcactaggaaagtccccagaagattttaaatgagaacttgagaacaatgcatacaacagatacagctcgctctctcccttctgacctctagtgcccccaagcactgcccttcttttctcttgggttattttcatatcatcgttcaatttcattttcctctttcctgcctgatttggggctggttcccaaccagcacttccctgttgacctgcatcttccccagtctcaggccactccatcttccccaatcttcgggtccccctcccttctaccagagacagatgctgcaccccacgtgggggcccatggggaagcacgtgtcggcccattaaagcacatctcacccaatgctgtccctgatcccgcctcactctgggaaaatggaggctggtgcccagaaccagggggaaaaggagagggggcagaaagactgaaggggtctgc

SEQ ID NO: 42409 - DNA, 1567 bp, Bovine  19866881584986
agaagcccagggacaccggcatgctccactgctcctctttcttccccggggacctgtccctgatgtcataactgagtaactatgacaacccatcatggacagctaagtacctcacagaggagcctgggtgcctcatttcagaagtgagactaggaagagaagatgaacaattccctggattatctggcctaccctgtaattgtctctaatcatagacagagcacatccttcaggaagaagctggactttggccactatgcatttcataagaatagaatacaaataggtatgtggggcaatttaaactggacactatgactagaattctgaaagggctcaccttaagagatattgatggtgaaccagagcagtacacagctttgcaatgatatggccttatctgctgagtctggtcaagagggtattagcatcagtgacaaaatttatcttccaccagggagttcctttgatggaaacactcatttatgctctttaaagccaaaaagctagacagaggatgagactgcagcatccagtagccaggctagtcatattgggaaagggtgggagaaaggctctttcattagcttcaaggaacatttatgtctgtaaattttatttttctcagccctcatcatgctttcatgtctgctcaaaactcttcaaatgatgtcagtttgggaaagtcaactaaaccagaatccctgaactgaattggttcagaattcaaacttccaatgttttaatcagtgtcattgtgtagaatgtgagcagagtctctaaggctactaagaggatacctgtgatgtaacattgctctccttccttcctctccagtgaagcctactgttgataccaaacctccagcagcgcacacacatcacatcttaaaattgagcaaactgcaggtatttgttcttgccatctgcaaatgtaccttatctatgtcccaaagaggtccagtttcccagagccttctaaatacccaccacttcctcctcctctccatacaccacccctggattcctcagccctgctcccagtctccactgtagcccccagtttgcccctttcccataatcccacaggagggggatactcaccattgtgagagggagcatcatgtagtgatgatgtcaccatggtggggtgggggtttctcaccagggtgaacaaaagagaatcgacaaaattgaatacgaaaacaagcaactgtgtcaaaaaatcgccaatgcccaccgaggccccgccaaggtggattgctggaacgaatatttttccaagaggtagtattatttctcttcattttctgaaagtcaaaactgacttcccccttgctgggctttagtactagaggcacacttaaggaaagttatcctgagggataaccaaagagaccatgttaaggagaaagaaaaccaccccaaacaagaacctttctctaacgttaaagagctaacttttgttccctaagagactctttggagtcctatttagagttcgtcacagaaaagcacttttgtaaaatggtgatgataactgggattttaatatagcattcttaaaa

SEQ ID NO: 42410 - DNA, 1303 bp, Bovine  19866880907254
tttcagacagtacagagatgggcatctgctctgtgtttattttcatgtgtgtgttctcatgcgtatgtgtgtttgtgtgtgcttagcacatcagacccctgatttcacaaatattgcttaagagaaggcagtgagccagtttaaagaaaaatgttcagtaaatgagaagaaaacctggcatctgagtacgacaaagtcctaatggaagttgacaagtgcctgtggtcccaggccagagggtctctgaggcccttccctctccaagaagtggtgggttcagaccccccggccccctagaatgagaaacacacagaccaggccctggtttccaccttgtcctcatcagcaccaagatataccatcaccaggagcggcaggagaagttgctatgaagtaagtggggtggtccttcctggccacaggcccccatatgacctcagaggacacagacagtgtccacacacatgacccctggtgtgattcaggccagatgaggccagggcacaggactgacccagactgaaggcagatgtggccggagtcttaacagagatggctcaggctgggcctggcgtgtccggggggtcagcagccacacctcccttagaggctagggggaggttctgagctcccctgggcaggcgaataagctcttccacctgtgctgcccaggggagagccgcctgtcccacagccccaatgtctctgtcctccaagtggccgggtatgaatcacagggatttacagcccagcctcgagtgggatttatgggtctgtctcaagcccggccagcggggagtggccgcccgtcagtcccccattgcagctgattgatgaggatgtttcctgccaagaaaaatcccctctgtggcaggcagccgagagaaaggcttccaggcccaggggccagcccctcaccccatacctgtccccagtctggtcccctctcctgcgcttacagctcacaccttcccacgatccccccagccccacacgctgacagcctaacagtaggtgcacccaagggccccagcttccagggagcattccaccttcccagacctgccacttgctcatccctgggaacagtgtgctttgaacaaatccatcccagggctcgaggctggacatgccaaattccagaatgaatttctgaaggaatccagaacacacacacacacacacacacttcacagatgaagaaccagaagtccagagagggacgggccttgcccagagtcacacagcagcacaatggtgtagctgagacctgagcccacaagaccctggactagtcaagtca

SEQ ID NO: 42411 - DNA, 1599 bp, Bovine  19866880353522
ttaactcaaccatttggcatagtggcatggcttttttagacaattgataatttcagggttttattcacaggcacaatcataagaaaaacaaggagaagacggtcccccagttgtgttcaaatgcacagactttaccttttgagaacataattgaggatgggagtcacagagaaaagatcattaagacttacaaagaaagaaagaagggaaaacagcccttcctggtttgtgccagtgcaagccaggaggaaggtagacttcctggagctggagaccatgcccaacccaagagggtggaaacaggagggtcctcagaggcagcagacatctgggcaaggaaataaaaacaacaagggggcacagagaagttgggagaaagctgcaaggaaagtctcttccactgaaacattaggcaaacatagcaaatacagctgctggcaggggtccctgtatcttcccactcaccccagaaatagaatgtccccatccaggatctcgaagaatctacaaatccacccccttagtgaagcatgggttagcatcccagtcaattcctgcctgcgttctctgaagccaagcaggggtgaaactgggcggaggtgcgatttgggtgcgcctcggccactaattccagaaacaatcagagtgtgaagggatggagggcatcaggatgtttgcaaaagcaaagacatgtcagcgccacgttgccagcagaatctgagcatcgatttagcaaaatctttcttcagagaagcaaacagctcggtgggtttagctaaacataaatagacaattagagatatcaaaggtgaacatcgatcaatcttcaacaaaaataaatagatatttttaagaacttcctaggaagtagagcaaagagggagtaaaatcattgtcttagggggttctgatacaaggacagatggagagctgatctttctatcttgagtcttgatctttatctgtttatcatgtatgtatgcatgtatctatcatctatctggccatccatctatcttgcaaaaatttttttaaatttattttcagttgaaggatcattgctttacaatgctggtttctgccgtacaacaatgtgaatcagtcttaagtatacatgtatgtccttgctcttgagcctcctcctcactctgccatcctacccctctaggttgtcacagagcaccaggttgaattccatacagcagcctcccattagctattttatatatagaaatgtgtatgtttcaatgctactctttcaatacagggtaaagtaaggtaaataaaaagaggaaaacgcatattgtatgttagtgcatatatatggaatctagaaaatagtacagatgaaccgatttgcagggcgggaatagagacccaaacatagagatcagacctgtggacacagcggaggaaggagagggtgagacaaacgagagcagcatccatcttgctaattttctagtttttcctaagatatcagccatacacctttacaggcagactctattccatcctggattttcttatagaacctaccttagtacaggggagcatgtattggaattaatacataagtaaaagcattcctgataaggc

SEQ ID NO: 42412 - DNA, 1748 bp, Bovine  19866880647364
ctatagcttaattgtggccttatttatgacattactacataacacacatgtgtacatacacacacacacataccatgtatatttcttctcactaaaaaagactttttcacaagtttaggagttgttacatccaaaaggaagcctggaaagatggtattgatgatcccatttgcagggtagctttggagaggccgacacagagaacagacttacggatacagttggggaaggagaaggtgggatgaatggagaaagtaggatggaaacaggtacactaacatatgtgaaatagacagtcagtaggaatttgccatatgacccagggaactcaaactggggccttgtgacaacctagaggtgtgggatgggatgggaggagggaggaaagttcaagagggaggggacatatgtgtacccatggcagattcatgttgatgtatggcagaaaccaatgcaatattgtgaagcaattgtctttcaattaaaaataaaataaagtaagcctaactcataattttaattagatctggataatttagaaaaaggattggggaaaaagagtttggcctaaattactcatattagccaataagtttgtaaatattcaccagctaacacaaaatactacctccctaactgactcaagaaatacctagctggaccttgtagggagccttctcccaaggaatctgctcagtttataatcacccagtttatcctccttccttatcaggctacgtttccaactctacttgaggtataagagtacttcggtgggtattttgcttctgtacttttgctgtcatagaagttagttcaggatagacccagtgaaggtctctcatggtttgaaacacttcctggcaatttagaaagataatgccaccctctttggtgacaataatctcatgtaaataaagctttttctttttttaattaaattttttcatcataatttgtccagcaaaatatttccaactttcttatttccaatgccaagcaagagctttagttgggattcccacaggctgcagagagagagatgtgaccaaaagacacatttcttagtataaaaaaaaaagatccgaccttactgaaggtatacaataaaatttaaaatattttttatctactattattttactattaatttcttttgaaagctaattttagaataaagcagatacccatgtacagaagacttttttaaaaaagaaaaatctctaaacagaacaattttcagtttaaaataaggaaaataaaattgctcacaaaactttaacataccagctggccccaatacaattacccaagtagaatacatttaaaaattatgtatcacaatttgaagcgattttacatttttatacttttagagttggcaaatgaataaatgtcatagtttttctactgtttaaaattaaataaatgcttcattttgcaggtaagttctgcaatctgacgccaaaccgtaattgccaagtgcatttcagatagtgccaggatgtcatttacttttattggattatgaaatgactagagaagatgtctttccaattcttcctggttattcccttagggttctcattgcccatgtccagccttcactgccaaggacacaggttcaatccctggtcagggaactaagaatctgaagccttgcagcagggccaaaaaaaataaaagaatagaatgaatacgaaaagttaccttttgcttctcaacaaccaagtaagcgtatagcctta

SEQ ID NO: 42413 - DNA, 768 bp, Bovine  19866880708172
ctaaataagtgatcttgcagtgggtaccttttaccttttggttgagaggtcaacatgagttgagtaatcataaataaatgtttcctgagaactctttttaaacatataaagactaggagtcaaactgattgaaatgcttataaggcactatcctggctcatgaatttcaggctgatgttttatgtttttcgatattctgttctgtcttagaaattcccctgtgtgcagggaatgactcacatagttccaggcaataataagttacttaaaggggacttccctggtgctccagaggccaagactctacactcccaattcagggagcccagagcctggttcgattcccagtcagggaactagataccacatgtcacaactaaagagcagcacagccaaataaataagtaaatatttaaaaaattgagatacctaaggtatcagtgagatggatggatggcatcatcacctcaactgacatgagtttgagccaactctgggaaggacaggggaatctggcatactgcagtccatggggttgcaaagaatcagacacgactgagtgactaaacaaaaaggtatcatagagaatgtgtgaggtttggtgggtagaaagccactctatacttgaagaatcgcctctgagctaaacatcactcttttcaggcaaagcctggacaacctcttccaacttccctcacctccaaaatggaaatcacatgaaacaaatctcacaggatacatacattgctgagtaaacaagaaagtgta

SEQ ID NO: 42414 - DNA, 1419 bp, Bovine  19866880761222
ctaggcagtcttaaacctctttgacctggattctatctcaatattccaaatgcataagcaattactctaggaagtaagcattactgtaggaagtaagcaagtgaatgaatcctatttttacgagcaaaggctcaatgatccaattgtttcattccacatattaaatatttcacaaagtagtttatcaaatattatagtaaggaatcactagaaatgaaatatttagaaacagatactggaggaagtaaagcattgctattcatgcaagtatatcagcatgaaataaaatgacacaaaatactgaacagctccatatgccctgtcataatttagtattcttattttcaatataaatttctggttttggtctggtcgctgcttatttatggactatattttttaaaaactatcaactcactatttaattcccgcttctacttacccaacgatgctccagctcctcagccaagattttaattgatttttgtagtagccagttgttaataggataatttgtcaatacaataataaaacaattgtctcaatggctctcattgctcagttcaccagataacaaagttgagttttgtttcattaattgaatgcaggtgtaggatttgtgggatgaaagatataaatccctgtggaatggtggaaatctgggtcagagatcacggaaaaattagttaagcatgctgggtcaagagaggcccagacaggtgtcccagctctgtttctctgtgtcacttcctgtgttctccattgaacactggtctgttgatctccagcacacaggtcaacacatgtatttctgaatctgtagtaaattagaaaccagactaggattccttacactcacgaacatgtgactccaaacacccagacagtattaacctctcaggataaaaatatttcactgtacatttagtgttttcaaagacagtagtgagatactatttttctccttcaagatgcgtgataactgtaaaagggatgcaaataatttttctttctcaaaaaaataacgaaaaattaaacagaagacatccgtttatacccaaaaggaccctagaagggaaccttggctccaaccgttcaatatagcctctccagatctcttggatgaagttacataaacttcattcttaatgtttctctcatttctttagtttttagacctgattcaggccagagccacaccaggactgtctctttactcttgaatgtctccctcctggttaaggagatggccttatggagcagttaggaaatcacccatctctactctaactcagcagctcgaaggccaagcaaaaggaatcccaggccaacctcccctcactccctgaaaatctgctttggctcagctgcaagactggaggactgagtcatgtaattaccccatgggagacagaatat

SEQ ID NO: 42415 - DNA, 2220 bp, Bovine  19866880833123
atggagcagacgctattagccagaacttggggctctggggcttggtaaacagggcagaacatgacacagctgtgcacatacgcttctgcagctgcaggctggtgtctacagaggggactaaacatcgcatctatgcccctctccagtggctactctcagagaagagatctgttaccagcactttgcccagtggtcattctacagctactcaatgtaaacttcttatccagtctacattttcatctcagacacagctgttgagatcctgaagagcaaggctgcagatgtggcatgattcactcctaaagtatataacgtgatcacctgcaggaaaccatcccaaaaggccaggtcctggcttgagaccgtgacacatagaaccatctggtgtacacactgtgggagaagatgtggacctgtctcttgctgactggcaggccctcctctccaggtctgaccactgctctctctggtgatccagctcccactgccctctccacctctcatattttgctacttttactcgcttttgcttctactctatttaggcattctcacctttcaacatttccaaagagatcaagcccttccccgcagctatctgccaccgctgtattccactgattgaaagagcgagtcactatgtacagtggaaagaacactgattgaccttgaggagaactaggctagccctagttgttaggtgtgcgaccttgggcaagaaatagcctctctgggtttctgggtttttaatctttgaaatagaaaatagaattagatgatttgaaaaaatactttcagttctaaaataccgtaagtgaaaacgtggtcttctaaactctaaacaatggggctcttaaccttggatccttgattgaggacccaggatggctgctatggtttctaggaaccacgtgaacttgggtccagatttctgttgttttgttacctgctgtggaagagattactaattgatgtgtgctcagttgttaaatcatgtgactctttgtgaccccatacactgtagtctgccaggctcctctgtccatgggatttcccaggcaataatactgaagtgggtttccatttcctcatccaggggatcttcccgatccagggtctcccatgtctcctgccttggcaggtggattctttaccactgagccacacgggaaacccttattaattgataattgatgtgtattatctcctttattaatagaatataccaaattttatttgatcacatgaccatttagatgaacatacttgctagtctttcttgcagctggaggtgacaaagtgactaggttccacatgaccaaaggactcaaagagtgtgagcaaaagtgatctgggcagcttctggctagtcactctgtgcctgtcctccactctttcctcaggatggtgcgtaaatacattgatgctgagccagttttggccaagagctttatctcagagttgtgtgcatgcgtgctaagtcatttcagtcatgtccgactttaataccccatggactgtagcccgccaggcttctctgtccatggaattcttcaggcaagaatactggagtggattgccatgccctctccaggggatcttctgacccagacactgagccccaggtctcctgcttttcagacagattctttaccttcccctagccagggaagcctagtctttatatatttcatttccattcaatggacatccattggggccaacactaaacttttaaaatgttttatggtgatgtggccagctgcttatcctacacaagaaagcatggagaaatgcatctttgctaacagttcccaagtcctgatcgttttttttccccctatttcttttcctaagtatgtatacttggaagtatattgatatttgccttgctttttgcaacttgcacaagttattcttaatttcttagagctgtgtgcctgacagtcaaattcttaagtttccactggctttccacacaagagtccacctgttccttctctgctcgtgtctcctaacgttctgttggaacattcccagttaatgcctgaacaggaccctttgtgtggattcacgcacgtttgtgtgcacagccaatctgccagcctggaccgacagccccacaccaaagcctccacttctcagcaggaatccagcaaaccagatgtcaagtgcatatttcttgggtattttatgggatccacagagaggttctca

SEQ ID NO: 42416 - DNA, 1276 bp, Bovine  19866880839881
agagttagaccttaaagaaggctgagcaccgcagaaattgctaaagttccaaaattttggcccctgatgcaaagagctgactcactggaattggaaaagcatcatgctggggaagattgaaggcaggaggagaagacaggggcaacagagaatgagatggttggatggcctcaccaactcaatggacatgaatttgagcaaactctaggagatggtaaagcatggggaagcctggcatgcagcaattcatgaacacacagagagtgggaacaacaatttggtttcagtggaaagtataatgttcatattttcttcttccctgaaatgaataccatgttggaccattaaatgaggaaagtgatagaaatactgccacaggagagtacttttttttccctatttacatgaaactggctaatagccagacagtctggtgtttcacttaaaacacagaggcatttactacacatagcataagccagttgcctacctgagataacccgcctccttcaagagctgtacttggaaagaagtgtatttcaagcttatttgtaaccagcctcccagggtcattcgtagagtaatgtaaggcaaggagcagcccagtgattaattatcaatccatcaaaacactattagtaatccccacctaaaaagagcaatggcttgtttaatgtgctgaatgaaaaatgttaaagcagtaaaaatgctttacaggagacttttaaagcagagatgatcacgtaaccagggtttaattctatagttcagatactaaggcaagacaaaaccaaaaacaattaaaggattaaagaagaaaaactcaaagttttcttacagaaaaacacgaagagtaaatttcctatcaagaagtgccctctcttcttttcaaatgtatgggtctagggagctcaaagaaatttgatttaaaatgacggtgacatgaatgagggaaatatttggcatctttggaatttcggcaacttaagaaagtattttgtgagatgtaagggttgttactaatcaaggcagcccaggggccactttgaccatttattcctcttgccctggtggatatgtgtttttttgttttttgttttttttttagtttttggaagctgtaatttgagaagtttcaaagcaaaaaaaagtaaaggttagtcttaaaagggatgcatttagcctaaaaataaacgagctttcataactcagcctaagtttccctctctctctttcccctgcccccttccttctctccccccacccccgactcccc

SEQ ID NO: 42417 - DNA, 1728 bp, Bovine  19866880887758
gatctgggttctaccctggtagggcaagtagatgccacatactgcaactaagaccaggcacagacaaataaatcataaaaaataaaatatttaaataaataggtggcccttagaaccaattatttcttccatggactctgatataagcttcaacacatcttataagtgagggctttcaggaacatataaggattagaagcaagaccatgagaaagtgaaagtgttagttgctcagtcatgtctgactctttacgaccccacagactgcagcccaccaggctcctctgtccatgggattctccaggcaagaatactggagtgggtagccatttccttctgcagaggatcttcctgacccaggtagtgaacctgggtctcctacattgcaggcatattctttaccatctgagctaccaaggaagcctaagaccatgaaagtgaaagttgtgtacaactctttgtgaccccatggactatatagtccatggaattctccaggccagaatactggagtgggtagcctatcccttctccagtggatctccccaacccaggaacctaactggggtctcctgcattgcaggcagattctttaccatctgagcccccagggaagcctaagacagtgagaagaaggcaataaattattgccattggtcaagggtatctggcacctttctaacgaattcatttttactcactggaggcttcaaagctctcctgaagtttctccattgcctgtgataaggttgactcagatataaacaccttgaacatgtggcatctgagtatccacacagctctgttacacaggacggttccctctgatcacatccttcataccagggggctcaataattcccgcccagcctgcagggccgtgggctctcatgctctccacctgagagcagggaggtggagagagtgatctgaggagagcccggtgtcgaaaaatccatatcgacattttgatcataggcagcgtgggactgaaagtttttgaacaacaaaccatttgagagtgtgtaatacgcttgtgaaaatattcaaggcataattagataaataacagatcccagtgtctatttttactttgccttgatgagaagctttgcaggagagactgttggtagttaattctccttaacaacaatctgtgtaatcacaaaccccaattagccgtgcctgttctctgcgatacaaactatttccttagcgcttcacatcactactttgtaattagctttcatctacacgagctttgactaaaaaaatataaaagagtgtaagtgattgtactgccactcagtattctgagaaataatcgcctgcgatttcaatcagattaattttatcacccgtattaaggaaaattacctccctcttcactctctacagctgagggctatttcatttcctgagatgttcataaaagcataatataaagcaatctgtaattgtaaatatccttccctaataactttgagatatttccttaatacatctctacatttggagtttccgttccataaaatacagtaacaagtgctctattatgttttaagtgtgcgctgttaagccggacaactcggcgctgtccttcctgtttttacatagggttatatttaacttgcagataatgggaacaaggtttaaaagtgatggagcggaataatggcgttacagcaataatatattcttgcctttggaggaatagaactttacagc

SEQ ID NO: 42418 - DNA, 1253 bp, Bovine  19866880897377
tttttctggttttaaattttgtgactaggagacatattggtgacatgtctcctaaaatatcaactttttcccaatgaaccatcactgcagagaagtaatccaccaggtcctgagaagtggacacagatttccagactatcttcccagtttcctgaaggagctagtaaccctctgattggctgagcatctcttctctcacatttaccttatatgattgtcttaaaaccaaatgaaacaacgtatatgaaaatggctgtgttgactctgagatgcttttcaaaagcatgttactaccaccaaggatagtaacacaggatagtaacacattagtagtaaaaggactaggacttattttttttttaagactttctgatatggattattttcaaagtctttactgaatctgttacaatactgtttctgttttacgttttggattgggggccacgaggcatgtgtgatcttagctccaagaccaaggacagatactgcaacccctgcactcaaaggcgaagtcctaactactggatcaccatggaaggatcgaggaccagtgcttaaaatgtttattagaaaaggaaaatttgacctcaggggaggtgtgctttcctgccgttcttccttagttgtatgcagtttggcccgtgtccaaaaggcgctgcagtttcagatggcacccaggacaaccaagggccaggggatgttgctggtacatgacaccggagggagggtgcgctccgctgtgtccccaccctcgggccccccaccccccagtgggctcggctcccctgccagcaccacagtgacaatatgagacagcgcatctgaagcagcagagccaaatatttgatttggatggctccgctgaagatgcctcatcacaactgtgggtgcccagattaccagcttcttgctcttggcttccgcgtgctctgcagcgagtacaaactgcacagagagctccttgcaacagggacgggaggaagcccaaatggctgatgtggagtgtcttgtttggggaagagttcactgatgaggaataagctgaggaggcaagatgctgttgtttttcctgtcaaggcacatggtaataagcacatggcaagtgtgtgtgtgtgtgtgtgtgtttttcctttctaacttagattcagaaatttctggcgatgagaaagcaattccttttcagggaagagtcaccatgacttttacccttctctccctgacacacatgggctccacatcagttagcatca

SEQ ID NO: 42419 - DNA, 1417 bp, Bovine  19866880907728
aaatgtcaatgattttcaaaaatgtcacctttcctatgtagagaatggcattttgttttctaaaaaaaaaaaagaaccaaaaataaagcatttgtattaaaatattctctgtgaagatgcctaggaatctctgttacacatggctagaaactaattgatcttcaagtgggctcattggccttacccaaatgagcaggaatatgctggaccctcaaaacatttggggtggttgtttttgacttgagtctggcagcatgaataaaaccctcccagaaggacctcattatatttagaaatctccctttttagctaagggacaaaagctggagtttattgaaggccactgaatcttcccatttctaaagggacagagaaaataagctaattttgaactcaaaacagagaccattttggtgcatcccactgaattctgttgttatgagacaggattcataaagagcataaatgcctctctctgtgcaaatacatttgagattcaggaaagtaaaagccccagatcaaatacaaagcccccatcaaatcagccctaactgcactaagaacatcaaaagcaacgtctggtcgacacatcaaaacaaaacaaaaatcaaataaaatcgtccatacccagtgagtttctgttttaatgaagtagatcatatacaccattgtgaattacacaaattctggggtaagtgcatttaaaatttgcatttaactgcaattttgatatccatacgctaatggagaagaagaaaggatggcccggtacccatctgcaaaagggaacctggagataaaaagtcaaaaccaaaaaataatacaggatgtgttttctaggtgatttacaacattacacttggtccttccaactatctcaagtgttaggtattatgatgcacccccttttttcaggtttatagaaatggggtcaactggatggaccaggaactgaaatccaggtccattaagccggagtttatgcactgaatcttgattccacaaagaaagaaagatgttcctgggagcacttgtgctaacactttacatatcgtctctcatttaatctccacattaatctttctccacgtgggtggaagttaagtatatgttgaaagaataaatataggcatgaaaagtgactgccttcaatgctgggaggacagagggaaacagcaacaaaagcagaagccaaaggtcagagccaaggtcaccaggataaacataacactatcaccacccacaggagaacatcattcctaccaaacatgggacacgtgtgagaacattcgcacctaatacttaaagggaaagatcaccccagcaggcatgaagactcaggaaacatctgggttttaaaaagatttttaaaaagctgatgaaagtttgacacaggaacctctgtccctcaaaggca

SEQ ID NO: 42420 - DNA, 2739 bp, Bovine  19866880923945
ctacccactcctgggcatccacctggagaacatcataattaaaagagacacatgcactcaaatatttattgccgatctatttacaatagtcaggacatggaagcaatctacatgtccatcaacagaggagtggatagagatgtggtacctatatacagtggaataatactcagccataaagagaatgaaattgagtcatttgtagagatgtcaatggacctagagatattatacagactgaagtaaatcagaaagaaaaaaacaaatatcatatattaatgcatatgtgtgaaatctagaaaaagggtatagctgattttatttgcaaagcagaatagagatacagatgtacagaacaaatgtatggatatgaagggggaaaggagggagggtgtgttgaattgggagattgagattgacacatatatgctgttgacactatgtataaattaggtaactaatgagaacctactgtgtagcacagggaactctactcagtgctctgctgtgacttgaaggggaaagaagacctaaagggagaggatttatgtatattgattcattttgctatacagtagaaactggcataacattttaaagcaactatactccagtagaaactaatttaaaaaaataaaataaagttcattctccatttcaatggaaatttactgagaccctactatgtgcagggcatttttatataacaagaatacagaagaaaaatccctactatcatacagtatctatctgagtgaaaaagatatatacataaacattcataattttttttgtttttttttttccagtgattatcactttaaggtgaaaaacaaagtgtaaagaaatataagaaacaaaataatgtaacacttcaagtgatgcactgaaatgttagcacgtgcagcttgggcaggcctggctgaggagatgacttttgagaacagacctgaacaaagtgaagattttactccatgggcatttgggctgtggagcttccaacagggatggcggtgcctaaggcagcagtgggcctggtgtttcagaaacaaccaagatgctggagcagccgtgcaagaggaaagcgggggagagaaggaggaactggagtgtctgcagtctgaagctgtggggtgagctcggcgttcctgtatggctgatcatttagctccgttccttggatgtgtgcacccaagttcacaccagtacagactgcaatagcttcaagtgtgccccagaacagtaagatgcacagcgtgatgaccagaggacctgcgtggacagcagtcttcaccctgaagcaggaaagagacagtcacgtgctctgaatctagagtgtcgtctcaattcctcgaacagcaacattcaaggaaatgtttgaaaatgaagaccagaatcggattttggtatctgcagacgttcacacacacagatgctcttaaataaccctcaggagaaggccagcccaactctagatgctgatacatattttctcttttagtaactgattcggttctaggaggaactgcccatgtcggtggactctgtatggatctgtgcctgggttctccgtcctgcttgactgatctgcatgtccattccttcaccaatacagtgctgccttttaaaaaaattattttatattggagtattgctgactaacaatgctgtgatagtttcaggtagacagcaaagggactcagcaatacgtatacatggatccattctcccccaaaccctcctcccatccaggctgccacataacattgagcagagttccttgtgctctacagtaggtcccttttggttatccattttaaatatagcagaatgtacattttggtcccaaactccctaactatcccttacccccacccttctccctggattctgtaagtctgtgagtctgtcttgtaaataagtttgtttatatcgtgtcttttcggattcccaatataaaggatgtcatatgatatctctcctgtgtctgacttacttcactcagtatgacaatctctaggttcctccatttgctgcaaatggcattatttcattctttgtaaagatggacacacctttttatatggagaaagactggccgggggtgaggtgtggtggcagagagagagcaaaattcagccaaggtggtctggcttctcgggagtaaaatcaggagacttgagcccacattgtctgtatctcttgcttctgatatgagcctcactacaaagaaactgcccatttattaagagatatcatataactaacagtaatatgcagaatccttgtgtttttgtgggtcccaaagggttacctccttttaattgaacattccaccttcttagtaatagactattgagaatatacgagtagacatttgaactctgcaggactatctgcaagaagccctgtcagtcgtcacgtaggtcacattttgatccaaatgttaattgacagtgtcctttaatgtgcattttggggctcaggtatagcagcgaggaaaactcattataagctcggcaagaaggcagtgtgcagacttgtgacatagcatctgatgttcgaaaggggttttcactgactccgtgcagctctgcctgaggataaaaccctgcctctgccagtgacagggaagaaggctgcagtggcctgtggaagtgccctcaggcagcggggtccctgtcacccgcaggatcacccaggcttgaaaagcacttctttctcttttctttaaggatc

SEQ ID NO: 42421 - DNA, 1248 bp, Bovine  19866880931960
ctcaaaagcatgtcaaagcccccacagctgggaaccctgggggagggggggtctccttgaaaccttgctgatcatattaaaatataatttgtatcctgggccaccgatcccatattttcatgcataagaagtctaccagcactgaagactaggcatacctagcccataccgcacaactatctatatctgtcctggtgggctcgggtcatttgaatttgataaagactgcggggggcaggctggtgcagaagggaagtcgcatcgctctgtgcagtggaccttgaattgctctcatacaggcaggccccatagggaaatgaagtgctcagatgcctttaatctgctcccctgcagcaaacacagtggcgtctgccagctcaactcaaaagtgctctcccttgcttaatattcttcaggcctctctgtctcctggcaggtttgcaaaggtttttttccctgcaaaataatgtagtgtgaaccaaaactttgggattcgaaacgggaagggaaagacaaggaaccatgtgttctcttccgggtcttctgatgcaagagagggcatgacagaggcaggcgctcagatgcgggagcatgcctgatgagaaacatccacagcgcccatttcccatgttgcgacttttttctgaccccaactcctggcacagggatgatttggagcagcagctgtgatgtgaggcaacctatgacctgccactacgtctgaagacatagcctcccaggatgtgagcagtgacacaaaactgagaccctgcaaattagccttcctcggtttatccccttgctgtctgcgaagtcaaaacagggtttaacacatgctcttgccttgtatgttttaacccttccatcaagacagaagaccttttaggacatgaagatgtcatctgttgttatgaagaaggcttgcacgtgtgctaagttgcttcagtcgtgtccaactctttgtgaccccatggatcaccgtagcctgccaggttcctctgtccatgagattctccaggcaagaatactggagtgggttgccctgcccccctccaggggatcttcccaacacagggatcgaacctgtgtctcctgcattggcaggcgggttctttaccattgagctacctgggaagcctttacaccacattagggtctacagttaacatctgaccctgacaaaggaagctctgatttatgatatctaaagatgtaagttatagtcgctgggggaaggatgaggggaag

SEQ ID NO: 42422 - DNA, 1578 bp, Bovine  19866881068310
aaaatagaagctgtctgcgcctgtctgagtaaagaagagcagtgggtattgtctcccaaacatgatgtgtcttctgaatccaatggactggagagctttgagagcagcctcgggctaaagctgagcagctcccattccagaataagcagactgttttttacaaacctgagttaggatagattcagaggttaatttgtcttcaaaatcattgcattaaggtcctgtctatggggtgctgaaaatactggaagtgggtagattttatcagtaaaatatgaaatgagtgttcgatgtcctatagacaacctatcttggggattctctggtggtaccaatggtaaagagtacacctgccaaggcaggagacacaagagacgggttagatccctgggtcaaaaagatttccaggagaagggtatggcaactaactccagttttcttgcttggaaaatcctgtggacagaggaacctggggggctacagtccatagctgggctacagtccatagggtcattggagatgactgaggggacttggcacaagcacccacataggatctcagtgaccatgaagagccccaacgctgtgtcactgatcagctcccagcatccagagttcagccctgactccctgtaactgtgagaccagccaagtccctggtcctcttgagagcttacctctttttcctctagaaagatagcaaattaagtcattagtaagaccacttcctcgcctaaaattctgtgattcttctgtcaaatcgcaaattacagtgagtgaagactcaagatatcatttctggaaggttgctgacctctagtgtcagcacagatctggaaaggaaattcagacctcagtgttaatttcctgttccccggtggctcagaggtaaagaatctgcctgccaatgcaggggacctgtgtttgatccctgggtcaggaagatcccctggagaaggaaatggcaacccactccagtaatcttgcctgggaaatcccatggaccaaggatcctggagggctacagtcctcggggttgcaaagagtcagacgcgacttagtgacggagcatgctgcatgtgttaatttcacattcctatcaagacttccccaccccttttccagtttccttatggaggagaagaaaatgtaaaatacttcaaattaaagttctattaactaaagcttcatttacagaataaatatttctgctgacatttgacagattatatcaattttgaacctcaaattttaataaggtattaccaagcccaagaataaacaagctaatcaggcccactttcctatttcctcctttgtattaaatgataagtgaatttaaagctatgctttgtcttattaatatctgctaaatatggatgatatactgaatatatatttattcttaaactcatttggaggcaaatatttacaaggcttttctattataatctgattttaatatctcaactgaaactgatttatggcatgtgacttcaaatgtggtgttagttaaagaggccaagaattaattagctgattctatcaaggggttttttgaaactgatttttaaaggg

SEQ ID NO: 42423 - DNA, 1396 bp, Bovine  19866881092417
gcctcagatgctgctgctggtaacacttctcttgccatggcagaatatccaagcacctagatgccgccccaataaattaatgctaaacctgagaagattgaaagtcctaagcagtgtggatggacctagagactgtcacacagagtgaagtcagaaagagaaaaataaatactgtatgttaatgctctacgtggaatctggaaaaaatggtatagatcttatttgcaaagcagaattagagatacagacagagaacaaacgtatggacaacaaagggttggggaaagggtggtggtgagatgaactgggagactgggattgacatatgcacactcttgatactatcaaatagatgactaatgagaacctaccgtacagcagagggaactccattggatgctctgtggtggcctaaatgggaaggaaatccaaaatggaggggatatatgtatagctgattcgctttgctgtacagcaataactaacacaacattgtaaagcaactatattccaataaaaattaattttagaaaaggaaataaatcatgaacaacaacagcaacaaaaagccctaagcaggaatgtataaatacaccagcatgagtcagctgactgtactttaccttccaaatgtggggagagaacgcccctctccgcacctcccactgcagagtactcttctaatctggaaggtggttggattctaggcaaccaaagggcaattcatttcctgcagcaattatacataagcaaatatccaattaggaatatccacaaggtattttctgacaaaaactgacacactgagagaacttcttccagattagcaaaaaagcattaaaatattttgagtgaaatacaataaactccaacagcaaaatggtgtctatgaaaattggatggagacgatgaatagttattaataaagggtatcttacactgaaatattgaagcatatagtctcagatgaggtgactttatatttgtggatttagatgaaatgtgtaagtaggtcactctagttaaagtaataaaacttttttttgaagctttggatggaataagagagacagaaaagtattgtgctgaacccagactattctggtctttttgatgctcacatggggtcttgagaatgaataaccaagatattacaaaatattctgatgttgaattattgtttgattttcttttgagggacaaaggaacagagcatagctctgtaggtgatggcagagttttccttgaagaaaatcaaatttcccctgtcagtcattctgggaggccaaggggaggggggcccttgacttcagggagggaaacccttttatctctaagggtttggggtaattggcccagaaactctagtatgggaatcacccatagttctttttta

SEQ ID NO: 42424 - DNA, 1098 bp, Bovine  19866881277796
cccaccaggctcccgtgtccctgggattctccaggcaagaacactggagtgggttgccattgccttctctgcttctttccatgacaaaaaagtaaaaaactggtacagtttcaaatagacacaatttgtcatagattaaaatgtatttatattattgccaaatggattatcattgatgcagaagtgattgagtaaagtaatttagaaatagtctgcctattaaaataaatctgagaactttgtgacctattgttttattcatcaaaaaaaatcacatgtaacgtgaactaaataaatcaggaattttaaaaggaagtaaatattcccagctaagtccaccactctttaagtatcaatcaccaaaatatttcttactacattcactgctaggattatatttattttctaagtgaatagggttatagggcacatggtcagttttaggatctgaaataccaggaccaatagcatgtgcagcgtgtttctttgagtcctaagattttctgcattctttgctaaccaccccctacagccttttcacaaacgcatggtctgtagctattctacagcgttttcactgatgtcaagaatttgggggggaaggatattcacttttatttagtaactatcataagcaaacagttttctgtggtaagcagacatgataatgatctagttggactagtttttcaatagtaaagaaactcatgcatccttactatctcaaccaactccttaccaaagaatttaaggtaatattttaaaaacagttgtgtcttttttatatgcactgtgccctttctcaatgttataaaatatccccatgttgactcactgtacattgattttaataggcattctccacagagcaatatgaatatcattggaaactgtataatacaattttctacccctgaaatgctatagaaaactgcacattttatactgacacgtgccccatcaataatagagtttttatatcttatttgtagttattgatctcaacagcgtaatgaaaaattgattgcgacggagtgcacaatttcttaagtataaattttaatgtcaaattatttttatctatgcttcccaattata

SEQ ID NO: 42425 - DNA, 1170 bp, Bovine  19866881372146
ccctggtgacccagtggttaagactctgcacttccaaagcagagggctcaggtttgatctctggtcagggaactaatattcaagtagtgtggccagaaaaagaaaatttaagaaaaaaaaattttaagtaagaaataaatgtaaggttatgctaatatcaccctacagcagttgggaattaatggtgagatggaaagcaatgcctcagatgtacgtctgacttttgtgttttaattaatttccccctggtccctaaatcctggccactaaaaacatctcccacttttcttcatggattcatttgcacagtaattaaaaatttttgagtgtgttgaaaatttcaggagaaaatatttcataaaatgtaaatatctcttgctatgaaatggccttgagctgttgcgtaagtcactcagttgtgtccaactctttgtgacctcaaggaccatagcctgccaggctcctctgtccgtggcgatttcccaggcaagaatactggagtggccttttttcaggagatcttcctggcccagggatcaaacctgagtctcctgccttgcaggcagattctttacccactgagcccctgactaccaccatttactatgttcctatcttgatgttctccctggaagcattatcattctcatgattgccatggagcaaggaattcatgtgtatgtgaacttccccagccctgatgggagagttccttaacttcaagagaaagtgaagtatttaaatgggatcctggcaggtggaagagccatgctctctgaggagtagggttacacgggcaacttcaacgaaatctatgaggtattctttctctgaaagagattcagagaattggagagggagaaaatgggagtgagcgattaaatgaatttgaggagcatttttatctgagagacaagtgtgaaaggaggaataataaatgactccctgcctttcccgaaaaccactggctatccattgtcttctctggaagccatctgatagcccatgctctccaccaatgggcatagaaaagtggacaaaaaaaaaaaaaaaaaaaactggggtcagctaagtagagagaagaggcttagccaaaacaaaccgaaaggcttcgcttcactgaggtttgattaatggcatattagacagcgtcctccgtggaagacaaga

SEQ ID NO: 42426 - DNA, 876 bp, Bovine  19866881374935
attattattattatttgaatcctctcaataatacattttgttgaagaagaaaaaataacatggatcattattatttcaaacctggaaattaaccctttcttatagccacctattcctaatgtgataggaatgttccctggtaccccaaagtttactaattatccccagaaggctctctggtgagggaattcagccagactacaccagaggaatgtgaaccatcttcttcaggattgtggagaatgtaatttgatttctccatactccaatgttttctataatttgtattttatccttttgcttaaggtttcaaagccttacaaacccaataacttagggataagagaagacagaaaaataaatgatattgtttctagggtattaaatataagcctggctatcggagctgcatggcacttgcgaatcgtaatcaggtactttgatttaacactgttttgttttataataaggtggttgccatatgttggaaaaccgatctgcctatatcggagaggctccatacctctgtaacaaatcccaaaactcattttataatacctcaaatctacccattgtaatgtagctccacaagtgtaaatccacagcaatcttggctcatgaatgtggctgcaagattacctatattatcattgaaagcaaaggggaagcagtgaattagaatgcagtggatctcacaaaaataactttcagtaaatcttcttttaatgcatagtttacaattttcttttgctcagcatgaaactgattaaggtccccctcctaaagaatactttccccttcacatagatgcattgtttaatatagttacaaccccaatacctgacaaatcagaatttcaacaccacaaatgtgatg

SEQ ID NO: 42427 - DNA, 1046 bp, Bovine  19866881544824
cacatcattccttggactccaggtttccctgtcggccttcttcttctctcccgtctttctgcctcttctgtttgtttcatagatgatcaccagggattttcgtggtgactaaaagaagcaataggggaaggtacgtgtgcttcatcttcctggaagcagaagttcactttatctagttacattccaaaggcacagctgaccggattcactgatggcctggtgtgaggtgtgagggaaagagcagagtgaatgaggacactttcttagcaactggagggatgaagctgttatttttagtgatggggaagggtgagatagattgctaagaggaagcttgggtagtgtttggacatgttgaattcaggacacctagtggagatattatgtaggctttggggttccagagtttggagttaaaagtggccctttgggcagaaagtgtgcatttgggagacattgcttgggggtgtatttaaaccatgaagaaaaataagaccatttggagagtgagagtgatacgcttggccaagtgctgcctgaaagtagagtgaggtgtggatggaggtctgacccttgaattgagcaggctgtccacaacaacttgacctcgtgttttgcaatctagatttatttcttctcaggctcacaacccttatatcccctttaacacatacatcacattttgtgtaatctctcttttctttcttttacctttaaatgaaagcatatgaatgatacatgtaagtcttgcttgataaattgcagtgctgacatgagggattaattagattcagtgagtttatcaattattgcagctgttaattgctcaaagacaccatcatcattgcttcaaagttgttcactgatatccatatgttttgtttctgcgtattaatacctactaatctactgacaaatatataagaagaaaaatataaaaatctttactatcacaacaaaatgacttgttccatttcctgtgacaagctcctattacgtgcagtcattgaacaaacccacctactttattttacaaatactgcctt

SEQ ID NO: 42428 - DNA, 935 bp, Bovine  19866881572258
acaaacgtagcagttttctgaaattaaaaacacgcacatgtgaatgagctggctcaaggattaagttggagtgggggcggaaatccattcaggattttcccagtgagtttacgcttccaaccaatcaagccacgagagtgcacaatcccctttgctactgcagtgtggggggagacgggcatgaaaaggatgctccatggctcatcctgcagacctgccagagagaaggggctcagcccagccttgcctttggggactggagggaaagatgaatgctttcttcagactcttaggtaaaacccagcccagataacctgctgcatgatgtcctgctctgttatttgcaacttacattgagttaaggctgaagaataataacaaactgtgatttctgacggctgattagcctgatcttatctgagtctagccacgatgtcctttctgctcacggctttctcagacttctggtgctatcgaatgaaagtaatgtgtttctaaattagaccagcttccttagtagtaacaccgcttaatggctaactcattaccaaggtcgaaaactaattatcttaccagtgtgcttttttttttttaaggatctcaaactctaaattgtttattttggctttggttttagtttttccctcctctttaagtctctccctgatagccatcatgactcagaggctactggcaaaatgtggagactactcccccctgccttttaattgaggattatgataaaagggggggtctgatagacatgcagtttctaaatcgaaagagacactttctgattgatgccctcaataaataccacatgaaattctatgaagctgagggctctcaagttataaaaacaagttggctttggtcttgggagaatgagatgtttttgcatagcttaagaataaaagcatgttactctgacaggc

SEQ ID NO: 42429 - DNA, 2789 bp, Bovine  19866881612474
aaatagaatagctccttagaaatacagttgcattctttcaactgtatttgctatattgttgttaatctttgaaaatcaattcactgaaaaagctagcctttatcttatttcatccaacaatgaaagaactgtttataccttctgacttactgtgggttgaaattattagtcttatcaaaattactcctgtgataaatcaaagtatggcacttaaacaagtcaagattatggagtatatcataaaaatttgagatcacagaagacaggccaatagtaaattggcatatgttaaaggaacaaaggtatgatgaaatggcattttgagagaaatatttcatagagtttctgattgtcatttgggggaggaaaataagcatgcgatctgcggatgaaaatgatctaggctttggtaaagtgaagtaagtcagactttgcaagaggaagagtttgccaagacttagagaaggaaaaaatattttactccttaaagggtatatgatgaaatcatcaagatttcaaacaacattaaagttatttcttgtggtttcttcaaatgctaaaaataaactttaatcattaacttgtatggtctatcatctacatcttttccctgaaagtagaatatagaagaaattttgcattagttagaaccaatcatagttagatctaaatttattagatttttaaacaacaactttgtgtgtgtgtgtgtgtgtgccggtcattatgttaggaactagagaatactgttgtgaaaatgaatgaaatccaatgatttcaactgtaggtggtgttaagggcattctctccactggattaggtcatgagttagatgttttagatgaatccactttccaggtctcctgtgctattattccatatgagacttttaaggaggttcctccctattcaataattctctgagtttgttgatctgtagttttattttgcttgtgtaccccccacagcctgtatttctcttctactgggaacaagtcttcaggcagcctctcaataacaaatagctctgtcttgccttccttcccagccaatcagcccctgtggaagaactgcacccacgcttacctgtcgccataccccttcctgagaggcgagcacaactccacctcctacgactctgcagtcagtaagtactcagtcctcagggcgcctccagaagggtggtctttctgaaacactccccccacagcagctttgtgggcaatcaaaagataatttataatttcaatgtgtgtttttttaatatcagtcatgtataaaataataaataagatgtcatttttatttatttatctttgatgtggactttttttgtttgttttacaagctttattgaatttgttgcattagtgcttctgttgtatgtttgtttggccatggggcgtgtgtgatcttagttccccgaccagggattgaacctgcaccccctgcattgaaaggtgaagtattctccactggactgccagggaattcctaagatgtcatttttaaaataccatttataatcttaataaaatgcaactgtggtccaaaatcaaagcccatttgcttgttgcttatcatgataattttttacaagtgtgtttgttttctgatatgaaaataatggtattcatcaggaggatgggcttcccgggtagctcaaatggtaaagaatctgcctgcaatgcaggagacccagggttccagtccctgggttgggaagatctgctggagaaggaaatggctacccactccagtattcttgcctggagaaatccataaatagaggatacagtccatgggatcccaaagagtcacacatgactcagtgactaccactttcactttgggtagtttttaaaatttcaaaataaatttcctgaccctgggatcagctgttttccagttggttaataacccactgtaatattaatatgaaagatcaaggcagcattaaggcttcacagtacattcagtggaaatggcataagaatatcctagagactggagtgccaatagaaaggaaggtactttagaactgaacagtcctggcctgcatcttgtccttgctacatactagctgtggcaagtcatttaacctctgaacttagctatcctcatgtatagaatggatagaataaaaaaatagaataattagttatcctcaatattctgccttaaggaatttctgtgagaaggaaaatgtagcatttagccctatatccagcaatatagtaggcactcaataaattgtggtgagcattattattattaatagtaatatcaccctcattctttaaaactcttgattaccagaaataggggcaagtcctccatatatgccagttcttacctgttagcttctcggccagcatgttgagctgatctgagttcaggccacgaccaacgtatgatgaaaactgccagctcatcacttccaggagttgactcaaagtggcagatggaggattattaaagaaaaccaagttctgaaacagagttgtattgatgattgtatgtattaatcacactgaatacattgcagctcaatatataggattcctgattaaactcttcaggttaaccctaagttaacaatacagatctattgtctcatctctgttgtgcttttaaattaagattgattttgtcttttcctaaagagttcctggttctttgagtctaatgtaatatatggttctatcttatacctgaagaatcattgggcagctctttaactttccctggactatagactatcagtcaactcatacaagtacttaaca

SEQ ID NO: 42430 - DNA, 3020 bp, Bovine  19866880457728
ctctgcttttcatatgctatctaggttggtcatcactttctttccaggagtaagcgtcttttaatttcatggctgcagtcaccatctgcagtgattttggagcccaaaaaaataaagtctgacactgtttccactgtttccccatctatttcccatgaagtgatgggaccggatgccatgatattcgttttctgaatgttgagctttaatccaactttttcactctccactttcactttcatcaagaggctttttagttcctcttcactttctgccataagggtggtgtcatctgtatatctgaggttattgatatttctcctggcaatcttgattccagcttgtgtttcttccagtccagcatttctcatgatgtactctgcatataagttaaataagttaatctccttacttgtgcttgaaactcacctcgatcagagcagactgggtatgattgtaagtctcagctgcctttatgattcttgtgcatgggcaggataaacgctaacaaaatgtgggcagagagcaaacagaaggagggagaaacagcattctgatcatgtccaaagagaataagaccgcttagccctgagcgatgtcgggttgttcaggtagactcacttcagggcacctgacgtctgtcctgacagagacagctttgaatggctcctgcctctctggattgtccctgagaccctctcaaagctggggtgttggcgtaccaagcttgtgcagaattgaggccatgccgtgtggtgttgagcatgagataatccccagtgtaaaggcagtttgcacagcaagggaatttcttgctactcatcttctctgtgccaggcactggctaaaacgcttcagacaaatcacctcatttgattcttactgtatcattgccaggtggcgctagtggtaaagaacccgcttgctaatgcaggagacataagagacttggattcaatccctgggtcaggaaaatcgcctggagaaggaaatggcaacccactccagtattcttgcctggagaatcccatggacagaggagcctgacgggctgcagtccatggggtcatgaagagtgggacacgactgaagcgacttagcacgcacgcgtgtgtcattgccagtaggacgtcctttcagtcatccttgtgttattattcccattttcctaatgagaaaaccaaaacgcagagaagtggagaaacgtgccccgtgagataagatttgaatcatggaccgtccaacttcaagtccataccttttctaccgtatcgttctttttacaaaagatgacacattttttgaaataaaatgaatagttgctcttgttgatctctaagcccatcttgttgaatagctgaaaaggctcccattcccataatttggaatttttccccagagactccccgtgggagttaattcatttgatggatggccctctgcacccctgtgtactcatgtgtgcctgctgctaaatgctgctgtcatttagtaggaaaaatacaatcctgtgtcctaaatgtccttgtcagtagccaagacagagcctgacattagatcaccctctttgattttccacttgtgggctgaaccatcgttacccaggacattgctgtgatctgaacaggaagactgctccattggggccactcaggatggtgaaatgaggttggtgatcataatttgcttcctaaatttgcagcctacttggctgcccatacagtgctcttcagaggatgttaaagagcctgtatcaaagaacaggaatgcattctattaaagtcgtatgtgagtcctggcagttaaaagacagaaaggttaatgggggtaggatggggggcctggggtgcaaggacagggcttggctgcagcccgccagccttcacggtggagcgtgagcagttctgataggattctcacggggtcagcactggagtgctcagctagagagtttttcctctccgacatggtggcagaggtcagccactcccagaggactgtcagcatatccatacacagctcgcagaagtgcaagcacagccttcccagggtgagggagaggtcagagaaatccatttatatgcctcagaaatgtcaccgaggatggcagaggctctgaagagcatttctttatgaggaaatgcggtcatgtcaggcaggcgggactagaggcagattccagtccagaacccaagggtttggacccaatccactgcccttctctctgttccaaagagtaagtcacaggtgtaggtgaagaaagggctctgaaatgggaaaaaaaaaaagcaaacagggggggtctgtggtcaaattaatttgagaaacagcagattaaatgaggtaccacaggacagcccagagcctctacagttcacttcgttctgttgtaacataacgagtgcattggtctatattctggtgcttctgaatgtgcagtaaatgttcgaatcagtgtcagcaacagggtgaggtaagtgacgtgtttaaggtgcagggtttaagaagacgctcattctcaggctcctacaggtgagccccgggagcaagcatgcccagagcctccctcgcctcaccctcctccacccaccacccagcacccagtgggggtgtggatgtgctgaggctcccccgcccacacgaaatgctgggactcagtcttcccagaggtctgctcatctcatgacaacttgagtgagtgcttaaaatagcccaccaaggttaagtgttaacttagaccctttcattgactctttttttcattatttattttatttatttattttggattgagctgggtctttgttgctccacacaggctttctctagcagcgagcagggggctcctctccgtggtggtgcacgggctctagagcgtaggatcagtagtgaggcacaggcttagttgcctctcagcatgtagagtcttcccagaccaaggattgaatccatgtcccctgcactgacaggcagattcctatccactgtatcaccagggaggtccctttctttgactctta

SEQ ID NO: 42431 - DNA, 1699 bp, Bovine  19866880470177
ttttttgtttaaatttaaaattatttagagccctctcagttttttataaacttcaaaattctcagttaatctaagacattattctgtagcctggattcctattttccttaaattttctgttcagatgagaaagcaatgaaattcattcagctcgaacgactgtatcacgagcaattgctcgcaaatctttctgccattcaagaacagtggggtgagtacaaactagagtgcagaattatcaataatctaacaagttgctatctagaaagttaacatatttgacctggttttctaggtcaggaagtagatgtttctagtcaagttagtgttgcaaagaaagtagcatttttaccgcaagtttacctcattttaagaaagtttttgtctttgtattttgtttttcatacaagtgccaagaaaagaacacttgcaactttttcatttcttctgatgtccttggctgatttagtctctgggatatatgcttagatttaaaaacaatcacttagctatttctgtgttaactttgggctgaaaagataattttgcatgataatctttatcagtagagccagttaagtattttcccttctaaacgtgttttgtaatagctagtgactaacaaatattttaaatttagaaacaaaatggaaaactgtacaaccacatacagttacacctttgaggaattcagaaaaaggatttaatggtgaagattttgaacggcttgctaaattttgtgcaacacatcaagagtaagtacttgactgtttacaatgaattggaatagaatattggagaagcattgtaatactgaatatttaaaatgcagaattcacttatttgttttgttaatgctaactggagaaattaaaattaataaaatgatttggttcctttctcagattttatctgtttcttacacaaaacttagcaaaaggtctgttttacaaaattcaaagcaccttctaatcagaaattttttaatgtaacttctaatttcagttaatttttgcttaagagggtaggtgattccgatggaaaaatttgtgttaggatttttattacaattgttttccagtgtttctatgtctgtctctgtatgttgtagtaaaaacacacttttaagagtagcctgatactggaatgcaaatgcatttaatcagaataccagataattttaaattatttgatttgtatcaaagagttggatttttaaaactgaacatagtaataataaagcacttaagtatatatattttaattattatttgaagactcagaattataaaggtgaggggatatgataattattttaaactagtgcagatttctggggatgtacaattttcttgtgttagtttgaacttttaaaacagtctttttatggattctgcattatgacctaattttaatatgttaaataggttaacttttggctttgtaaaacttttaaataatggaatattaaagatagataaggggagaattgttttcttactttcaaaacattcaatatagatacttttctgctcttcccagggaactaataattgtttaatctgttacaaatgttttaattatttaaaaataaagaattattgaatctaatatagacgtgactctttttcttttttttcctctttttaaatataaggcaacttgccaacacataatggttttttaatttttatcacag

SEQ ID NO: 42432 - DNA, 1068 bp, Bovine  19866880547777
tgcatttctaagtctgtgcatggatgtcattcttctcatcttgggggtttgattgaagagaggtaatggattggagaagttgaggaaaaggggacatctttggaaatgcctctgaggaaagggggaacaagctgacttggttctcgtagaacctgcaggcagggttgagacccagcttgagatttgcagtaagaggagtcttctgactgggcggaaagaagaatgtagcatcagcttcatccacaagttggggagatcagatacgaaaaatgtaaaggtcacttaaatgtaaatgacaaaatgcaatttttttagtttataggagaaaaaatggatttataaggcagggtttcaagaactttggaatttataaaaagacttgtacaaatcagtggtttttttttaaattaaaattcttcaaataattaaagtacattgttgaagatactaataaaaagaaaaaaaatcacccataagctcaccatctaaaaatagcaatcacaaatactttgaagtgcctatttccagaatttctcgtatgtatcaatagaaatcactaaaaaataatttttaataaatctaaaaggcctgaaggtgaatgatgtgagagagattactgtacttgggctgacatgtcttggcttgcaatgtggcagtgttagagcaactgttactttcataaacaggctccatttctgggtttcctctgaacattgtcatcatcagtttgctggtatctccttctttaccaaggtcagcaggccacaacagctggtaccaccacattcctgattgtctaattaaatatttcacataaagcgcatataccatctgcttcggttacagatatagtgatccaaataataaactgaattgcttgtgtgtgcttcagctgatctggagatgaacccgcatttttgacatagtgggaaaatgctgggcttgcactggtttaaaaaatgctcccgcttctgaccccctttagcagggctgactgtttgtcattagggattagtgattagtgatttttgcttatgtgttcatgttctcacctggtgtccctcatta

SEQ ID NO: 42433 - DNA, 1734 bp, Bovine  19866880641462
aagctcaagcccgtccccatcaagctgattttcattttcatctgatgcagaaggcaagcatgttactttactttccacgccgtcaccaggatgacatccatcttgtggttctatctgcagattatatgcaggagtttcgctgtcatccattagagcatcttttgttgaaccgtttaagtttcattaaagtccttcaatgtctacaatgacaaaaagaaaaatctagtttatttttttgaactctggattttcagtgatctttgattttcctcttctcctggactgttttactgcaaatatggaagagacagaaatgacaaaggctcactcctactatatctacttttctcacaaccctaccccacctcacctggttcctgcttgaatacaatggctctaaatcctgggtgcatgtttattacctgtggagcctgtcaaatttctattgtagacctatgaaatcaaaatttctgaggactaagcctaactattgatgtattttttgaagttctcaagatattctaatggtgcaacatgctggaaccacctccttgatgaaagaaattattggttaagtaaggttgtctgctaaaaccaatcattcatcttatccctgcacacttaagagacaagtgaaagttaagtgtaagtccttgtgtaagtccttatatggccaagcagcagcaatatttacaaatgaaaacatttaagaacagttttaaaataaaatttttaaaaagtatatgggggaaaattcaggtagcatatattctcattacatactttactttctaaaaataagcgctgaaaagttctttagaattgtcagcaaatttcttttattcagtttaaaaaaagagagaaccatgattaactctaggctacttagtttagacttggaaaaaatgtaaatctaccccaagaatccttgtaacattttaaagacatacaaaacagactttaagccctgtatcagtcatgtttttttcccttcttctcatccaaaagtatatcatattttaagaaaaattatgccagccagatttaggtattttatgcttgccaagttttgctttgggtttgaatcaaatataattcagcaattttgagaaaaacattgtggtaagaattttgtaaattcttcaaattaataaacagaaaagctatttgctctttagaaacagtaaatatacacagtaaataaacatcatatttaattttttttgaaaaacagaaaaacaaagtataaaacaaaacatgagctctacactgactgtatcacatgctttcaattatcttacaactggaatattttatctgattcagaataaatgtactgcttaccaaatataaaaaatatctaaatctggctggtatcattttccttaaaatatatactatatttcttcattaacagatacataatataaaaagtaaaatgatttaacttgactaagaataacttagtttagacctaaaatgaattcaaactagagtataatttttaattgaaaagtgattaataaagtattttcagatctctatcatgagaaaatccaaattctaataagagcttaaaagtgcatgtggctaatatggtgtcctatgatggatgaagagataagcaaaatgcgatgtatttatacagtagaatgttattcaaccataaaaaggaataaaattctgatacatgccacatcaggagaaccttaaaaatagtaagccgagcaaaag

SEQ ID NO: 42434 - DNA, 2142 bp, Bovine  19866880657223
gaagaggactggtctgggaacagagcaccccaccgtgacagcgatccactaagcatcagttctgcagtttggctcttcaaccatttaatgagacgtctggtcactctagcatctagcataaatctcttggttacttttttttaaatcaaatctctttctgaagtccacatacaaactttaccaaagaaagccatgactctgcggactcacccgctcttaaggaacccctgcagcatcctggtgatcacagcttcctttccattcctttggtcaccagcttaaggtcaccagtaaactgctaacaacaaacaaaaacccactggactatagattttatgaattacttatttcacctttaaaaaataggaacatttgtctaactgcctctcctgctcttttacaactttttaaagaacactgtactttggaaacctcatttatagattttcttagtgcctgggatataatttatctaatgatgttttgcaatcttttttttttaatctaccttagtctctttctccttaccttgtggtttccttttgtcacatttttgctcaagctaattccactactggaagtggctccctctcagcctctgcctatataaaccttgtccctgatttgggctacttttcacacagtataacatcggtggagctttcccagaggacctccatcataaacggtctctccttactctaaaatgtgacccactcacagtccttactacttatgccaagaaaatgtactgtgcagcatggctgactaccactgtagtcatggctgactacagtcattaaattataaggatttaaagttatacattatagagatggaggtcatgggaggaagggaatccagaaatctgttaccgtgtacataagtaaagagagtactccatactatcctactaatcctagctataaattttgattttcaaaaattgaccttaccacaatcttccctcaccatcactgaaattgttggctggggacagggatgcagcctgtgattgtggaacagagtgaagctctctggctcacggagaggtcaaaccctggacttgaattcattaatgccaggctccaaccagtaaggaagcaatcctataaacagctcagtccgtaggtaaaaggatactccaatgtgccttcaggtcttcaatttttttcagggattcctggacttccttccatacctgctcatcaccagtcagcatatcagcatcctgttcaggccacatgaaaagaacagaggaagacaaattcctcgattaaaaaaatgggcaagaatagacatttctccaaagatgatattcaaatgaccaatgagcacatgaaaagatgctcgacattattagccaatggggaaatgcaaatcaaaaccataaggagatatcactttgtacctactaggatggttataataaaaaagataataaaatgttggtaaggttgtggagaaattggaatcctcatacattactggtaggaaagtaaaatagtgtagccactttggaaaacagtctggcagttactctaaaagttaaacagagttattatataacaattccactccttccatatatgtccaagagaaatgaaaatatatgttcatacaaaacttatgcataaatgttcaccactacatcattcatagtaacaaacaaagtggaaacaatccaaataccattaaccgatgaatgggtaaatcaaatgtggcctagttacacaatgcaatgctggttgacaataaaaagaactgacgtacaacatgtacagcatagataaacatgaagaacatgatgctaagtgaaagaattcactgacaaccacatattatatgatttcaccaatatgaaatgctcagaacagataaatccatacagttaagtagatcagcaaaaggctagggcaggagggtggtaagtacacagaactgaggagggactgctaatgattttttaggggtgatgaaaatgtttaaaagcaatcctggcaatagttttaatcattttctgatgtgatgaaaagctacaaatcgctacacaaaaagctatcaaattgtacactgtaactgaattgtatcctacatgaattatgtctcagtaaagtctacatacattcataaatgtatgta

SEQ ID NO: 42435 - DNA, 1821 bp, Bovine  19866880675499
tgaaattcccttgaaaagttacaatagtgtaaatctcagtgatttattgtacaactgattatactagtcatattaggacccaggatatggggctccagaaatactatagatttttctgtggcatcaggcatgagttctgggaagcaacatagggtgagggcaaagcacacactttggttcagatctcggccagaattcagaccccaccacttactgagtgaccttcagttcagttcagttgctcagtcgtgtctgactctgcgaccccatgaattgcagcacgccaggcctccctgtccatccccgactcctggagttcactcaaactcacatccatcgagtcggtgatgccatccagccatctcatcctctgtcatccccttttcctcccgcccccaatccctcccaggatcagagttttttccaatgagtcaactctttgcatgagatggccaaagtattggagtttcagcctcagcatcattctctccaaagaacacccaggaccgatctcctccagaacttattcaatttcacaagtcggtatcattcctgtctgtaaaatgggaatgctaacatccacttcactggattgctgtgaggcttcagtaaaaaacaagcgtgtaaaatggccagcacagtgctgacatttagaaagtgctaagtatatactaatttttttcagctgccctttctgaagagccccaacagagaaagaacaattttcattttcagtcgagtatccatagtaagtgtcctctgtcttgtttgataaaaacacaaaggtgagagagaagaaaagccctttcaggatcctgatacctgccctccagttttcaactgagagtcaacctattaatgagcactagggtgaaaatggaattttgccaggcaaggtacctgggagagttcataacacacttgactttaattcatgtgcactataatcctgtgggttaaagggccataaaagttgttctggttttgcttacacttcaaaggaagcaatttaatggccatgaattacagtttcccgattacactgtaactatgaaacgcaactgttctggtatgatttccagtctggctcctttaccaaaggaacttcaaggaaagaatttaaacagaataacctttccaggcgttcatccagcttcctcatgtaggagactctatcttgggagcccaagaatacatgtgcacacaaagcattatgtggggtttaggactagagtatggtcagccatagagttgagttggggacaacccaggaggagaaggggatgacaggggatgagatggttgcatggcatcactgactcaatagacatgagttggagtgaactccgggagatggtgaaagccagggaagcctggcatgcttcagtccatggggtcacaaagagtcagacacaacttagttactgaacaatatgaaatgaggagcccctagacactgttccctagggagacccatgtgatgacagatgttatcagatataaacaaatggagtaacaatgacaacattttaaagggaggagggtcctattaagaatgtaagcaaagaaagatttcacaaacgggggctcttcctttcttttcaatcattcaccagtaaggttaaggcaagcctaagagatccccactgtcctgagactcagcagacaaactataaatctttgccacagcagcaaacaaatgcttacagcaggaaagtgatcacatgtgggggattgaagactacacttggaaatggatttaaaccctggtttatcaactgactagctgtctgaccttggacaacgtccctgtacactggt

SEQ ID NO: 42436 - DNA, 910 bp, Bovine  19866880782383
gatccttaactcctgatattcctcatgcctggcctagggattcctttaacctttttatggtcaagtcatatacattgaacctgacgttcagaaccacatcttgcccgtgctttttcttccctcgtccacagtgattaatattgttcccccaggcagactacctttggttattctaggtgggcagcatgctgagtctggcctaccctcgagaccctcatcttttgcccaggctcccatctaggataccctcctcttccatatctgtgggcctgcatcctcagagtcaaccaaccacagatcaaaaatattcagggggaaaaaaaaaaacaattccagaaagttccaaaaagcaaaacttatttactgtgggccagcgactgcttacatagcctttacattgtattaggtattacagatactctagaggtgcttctaagtatacaggagggtgtgtatagattatgcacaaatactatcctgttgtatttaagggacttgagcagacagattttggtatctttgaggggtcctagaactaatcctcgacagatactggggggctacttactgtgcattgatgctctttgaattcctagttggctaagattatatctatgaaatttttttgtgtattggaccagacttacctgtctagagactattgtggggctggagcttgttggtgatctccttaattgaataacaatataaaaattctagactatgagtctagtgttggcttatactaaacttctgatctttcattttgaagtgaaaagaacattggcttgtagtttatggccctaatctctatatactttggtgaaagactgcccatgggctgtattaacacagtcattgcttgctctctaacatgtattccttattgatatttcatatagatcttatt

SEQ ID NO: 42437 - DNA, 644 bp, Bovine  19866880794069
caatgatgatctaaggctgtggttgctgcagtgggtgattagttgttcaccatcttctttaaccatctttgatctggccactgtatttaggttgttaggctatccaaaaggcagaaaaaaactcttaaacttttgcaattgggaagctgagtgatactttaaaaacttaatgaaccttgaaagttgttacttaccatgtgaaaataaaaatggcacatcagggagattaaaaaaaaaaaaaagaacaaagtggttggaaaagtgtaaatgagaaagtaagagtggaagataaaatagataaaatgaaaatatcttgttttacacaatattattcaatgacttggaagatttcacttggccatagattgaagttgttcggaagagatcatttagctttttaaataaaaacagcattacaaatgacagccaactttcttatacttttgtgtttacaacaactaaaattaaaaggacatagcccaattccctcatcctaccttcacaccttcatttatccttcttcatctagttaatctgggttaaagggttttttttttgttttctctattttttaagttgatgcaggtagttgaatatggtcactactgaaaaatggagtctgaatatctctcttatgcacattt

SEQ ID NO: 42438 - DNA, 1444 bp, Bovine  19866880832494
actgtatcctcctggggtcgcaaagagtcggacacaactgagcgactttcacttcacttccttcacataattaaaacatatcttgagatagaaccacataaccaaaatatatgattattttaacatgagggatgacccaaaacataggaaataactcaaggggacaggggggtagctcccagcctttgcacaggtaatggcacaaaagatagacacatgtcccgtgcagagcacaggtttgtggtaaagaattgatgctgtcttaaagtggataccaacttgaaaatctgataaatgctgtttacttttaaaacatgattaaatagcattgataatgaacatgcttagaaactgatgaataatgtattacatgtggagtaaaaggaaaatacaaaataattgtctgaaggggtagtttttccccggcaacgtcccaaaactatgacagtatgttcttttctcagaaacactgggatgaggactctgcaaaaggcaaaaatcctcaacacagaaaggaaaccaaataatgattctcaccaaggaaaaccaaaggaaaacctgtcagagcactagatttaggaagattcagcgtttactacaactgctgcagtgtctgtaggtacattctggtgagaaactgtagcttctcaggtatgtttcatttttctcccagatctcagtgaagttcccttgcaggctcttttggctaagacttgtatttaaaaatgaaaaaaaaaaaaaaaatcattccacaaaataacatactccaattttcctctaattcaacagttttataaataattaaacacagatctaactttaattgatacacagtatatttttttaagttagggggtactcattgtgcaataaaaagtcaatatttggattcagttcttagtgtaaattataatggcatcaccgacttgatgaacatgagtttgagcaagctccaggagttggtgatggacagggaagcctggtgtgctgcagtccatggtgttgcaaagagttggacacgactgagcgagtgaactgaactgataatgattcatggttcaatttatgggaaatggcttaaataagtccatgtctacacacaccaaaataacatgttctagatgaacacatagcagaaaaatgaagatatcacgtgatgttcattttactttcagggaaatgaatataaacttgttaatgtttatgccagagtaaagactctcatgtaaatggatggcttgggaaataaattatgtaagtacataaagaaagaactaatttaaagatgacacacgctaactcatattttgcagagaggctagaggtcagatcactgagaaaaaaaattcatcaagtaaactgatttccagcccccttcacttggcacaaaaatcttatgatgaattgtttatttgaattaaggctgcagaacaggtaaagaggc

SEQ ID NO: 42439 - DNA, 1047 bp, Bovine  19866880861389
caccggaacataatctgatcctcctggcagacttgacatctactttcttccaccccgcacgggaagagaatgtggagtccaataaaacgtacctagaggctaacggtgaaacaaaaacctatgctgtctcccttttctccagtacaataccttgaaaaaagtaccactggtaaaacagtagtctcagaaactgtgatttccagtgagaaagtgttaaactcattagaggggcttcttgtggtcttgattccctaatgagctgtgggaacttacataacgaggagaactctcagtctacataattcaaaagcctacaaactctgtaaattctgtttcctctcttacatgcactaaactagcttttgttcaaatttttaaccactctatttaaaatacttttgtctgtttcctgacttgttacaaaaaaaaaaaagcctgtgaaaatgacaaaataataattattttataataacaacaatcaaaatagtagctaacatttattgaattgggggctttctgtggtgttacttactagtctaaatgctttacatgagtttacgtgtgttaatcccatggcaacctatgaagtagatactattattataattatttttcccattttacagataaggaacctgaagcccaggggtttgaataactttttctaggtctgaaccaggattgcaatcagaaagcctcattataaaacccttggtaccaaccactattctgcctctctcatttccaccctccttatagtattatgggcttccctggtggctcagcttgtaaagaatctgccttcgatgcaggagacctgggttcaatccctgggttgggaagatcctctggagaaaaggaaaggctacccaatccaatattttggcctggagaattccatggactgtatagtccatggggttgcaaagagtcagacacgactgagccactttgactcactcgcagcattatggtttttctcttaggttctttaagttgtatgctaaaaggaatgttactctgtaaggaaaataaaactttcttcat

SEQ ID NO: 42440 - DNA, 1422 bp, Bovine  19866880908479
catttccaataaaaagtaaatctctccctgtaaaaagaatttactcagaatgaaactgaatgtaaactttaagtatcataatacaaaaaaaaaaaccttctaaaattctcactttcagatctatgcaatcacagtatatattgcaaaaccagtggccactaatagcatgagtctggaaggcaagatcaggaggtcatagatgtacccttaagaataaaaagaacgttctaccaggaaaactattattttgtttaaaagaaaaaaaaaaccatcttctcaaacagatgtggaattgctaatcaaaaaattctgttgcagttgtatattatcgagttaaaaagtactttgtagagctctggcagcaataacaatgacatgttttgtggtcagaaaggtcacttttattcttgttgcttccaatttaatatctggctttgaaacattttacgcaactagtccattttctattttattgttcagagcttatcacattctcatcagtctaccaaaggcatttttagaaaaggaagttctaagtccaggaaaaaataagtatatatttttaaaactctgtacaataatttctaaaaaatatactctatgcattggaaataagcttaaaactaagtctactgacactaaatttagaaagaccattaccaataattaccagtgtacgtttgaggggatagaatagaggaaatactatacatgtcatttcagtaaactatgccatggcaactaacaaaactctcataatttcatttcatccttttaagattcatgtataagaaacatttcattcatcatagaaagcctgcttttatatttcctccatgaaatcccaagaactactctgaaatcatgacgttgtgatgaacgtaggacacagtaaatgatttttgaccatgaaagctacgggctgaaacgaagccagttaccaggggaaaggtactactctctgtttgcaaaattttcttctcaacaacagaggtaatgctgagtgtgggataccagcaccggacacatctgtatgcaagtatctgtgactctgatttacagtcagctgcagattacactcctgtttcatactggaacacaaataaaggtggaaaatggggcagtattagcagaaattaataacatgcatcagacactctaagtactttatggttaatcctcactttaatctgtatttattattattttttgtgttttctgtttgtgcactcagtcacttagctgtgtctgactctttgtgaccccatgggctgtagcccgccaggctcctctgtccatgggattttccaggcaagaatactggagtgggttgccatttcctcctccagaggatcttgccaacccagggactgaacttgtatctcttgtgtctacctgcataggcagagagattcttaacca

SEQ ID NO: 42441 - DNA, 801 bp, Bovine  19866881110490
aataccctgacattttaatgtcagaatgcaaactcctcttacccagcaaccatagtaatgctaaccacatcattgacttgctttgttctggaacctgggaggattgcattatcgtctctttaaactctttagctgttcctaacatcagaaccttaggaggaaatatgctatacaagttcaaggaggcatcaggaaccagcctcatactgctattgataataaaagtccactcagcccatagtaggctgctacatatgtggagaagagggagttgttttgttttctaaataagtatcacatcaagtattggataaatttttacaaaagttaatctattcacattgaaaataatcatagtatgtaattcagagatccctttatgagcagattttggcaacatgatatgccatatgaaagtaaaccattcatttttcatttaacatatgtatgtgtaatctgttggcagagatgtcatatgttcagaaaactaaaggcttcagattcaagcaatttttgtttttagaaataatatcataatttctttactcctttactactgcttgggtctttaaaaaaacttttaatctgaaagagggcaacacatgttccttgtcctgtgtctatatcggcagcattacttagctttaggtctacctgtctcacgggaaccaaaatagggaaggacataacctagaactttctgatgggggaggaaggtaacaacccagaattggtgttgagtttgtctccagagaaactaatctaagtgacttctgtgcagtagtcatctctgtctcttgg

SEQ ID NO: 42442 - DNA, 2618 bp, Bovine  19866881135702
ccgtatgtgactactgggaagaccatagccttgactatacggacctttgccagcagagtagtgtctctgcttctcaacacgctgtctaggtttatcatcgctcttctgccaagaagcaactgtcttctgacttcatggctgcagttaccatctgcagtgattttagagtccaagaagaggaaatctgtcactacttccaccttttccctttctatttgccatgaagtaatggggccggatgcatgatcttagcttttttaatatttagttttaagccagctctttgactctcctccttgaccctcatcaagaggctctttagtttctctttgttttctgccattagagtgtatcatctgtatatctgaagttgttgatgtttctcccacctatctttttgccggtacataatactaataaataccatagtgacacacaaagctggagaaagagtttagtcccagaagaatgccctcctggccaactgcaatagcaatctctagcaaaagagcctaccaaactgacaaatcaaagcaacaacagcatatgagccttcagaggaagaatggctcacatttaaaatttatgattgcacaaaggcactctagaattttatgttcaatgtactgaataaaaagcagctgttaggcaaagaacaattaaatggcttcaatgtgaaagaattaatcacattttcttatacttgggattctgctgtcagtgaaaataaagatgaaaaggactacaatgtcaatattctaaaaaccaacatcaaaacaagcatccaatctaggattcatccacaaaaatgtaaaactacttccttgcgttaaaattttaaaagcttaatcacactaaaaattttttacagcactcattctatatttatataacagaacaaagttatttctaacatcagtgtatatttttaattgttcaaaaacactgaatgttgagaattccctggcagtccagtggttaagactcgatactttcactgttatgtgcctgggtttgattcctggttgggtaactaagatcttataagccaggcaacgggccaaaacaaaacagacaaacaaaaatatttgcaagtataggcctacacgctcttcatgggctttccatttcacagaatggactcatattctagtaaacatatgaaatgatgacataagtggaaacgtcgaagtataaaatatatgcagataaaaacatcagaacaggcacttggattattatacgactccagtcaagcatgtggagaaggaaatggcaacccactccagtattcttgcctggacactcccagggacggaggagcctggtgggctgccgtctatggggtcacacagagtcggacaaaactgaagcgactcagcagcagcagcagtcaagcgtcagttcagtgattggccagtttatcacaagagggaatagaatagccaaaacgagcactatgttaaatacatcagaagtgaattgaatggctgcatgaggataaatggcagtgtgactgctacccttatttcctctacttaccaggaaggaagtttcagaatgctattttttctctcgtgctctgtgtctactgtaatctgaacacctgctgaagttactgggctttgaaattccatttagaagacagcaaacagaactgtggaataggtattttgcatagaaatgctcccagggacactaattaggttttggaaaagaggaagtcagtcacttgctaaatggcctcatggccaaaagataaatttcacagcactcttcctatgaatcacaatttagccaagtagattcaaccaattctagaaacagaagggcaaatgggcccccacaaacttggtaaagcccattaaggaaacagttggctcctgcaagagggggggaaaaaaaggcaaacttaaccacaaatgtgctctgactcagggaaaactagacacatatggaaatccaggttttaaaaatagagcagtaagtttaccaaaataaatcttcctccacaaaaagattcagaacctccttaatcttcaaattttcctacttcacataatttgatatgtatggaagttattcataagcaatattttcaaaaaatacacagtatactatttaatacctattttatcacttaatgcctaatgcttatcgttttgttataaatacgacaatgacagtgttagtcactcagtcatgtccgattcttcgcgaccccatggactgtagcctgcaaggcccctctgtccattgaattcttcaggcaagaatacacgagtggattgccattccattctccaggtgatcttcccgatccagggttcaaaccctggtctcctgcattccccacagattcttcactgtctgtgccaccaaggaagcccctagtaaattggtaattttttaagatctgctttttaaaaaatcatgaatcctttgattcttcacagaggaccagaatgataagagataaaaactatcaaaaaggagaaaatgacatgattagaatgggaggaaagacttccaagtgtctggatgtgagataccgcagtcatcttgggcagccgttcaaccctgatggactggaacctctgactatgcccttttgtgat

SEQ ID NO: 42443 - DNA, 1183 bp, Bovine  19866881195712
tttgctttatatttaaatagaaatattatgtatttctaccaattttagttaaagtctgtaatttggggattcatacagtatgtttgtctgttctttatttttctccttttttaaaaaattgaaggtgtgaaagtgttagtcgcttagttgtgttcgactcttgtgaccccatagacaataagtagcccgctaggctcctctgtccatgggattctccgggcaagaatactggaatggattgccattttctattccaggggatattctggacccagggatcgaacccaggtcccctgccttgcaggcagattctttgccaactgatccaatagggaatagtttatttacaatgtcatatcagtttcaaatgtacgccaaagtgatttcattatgcacacacacatacacatatattctttttcagattctttgccatataggttattacaagatattgagtgtgtcagtagttgttccctgtgctgtgtgacaagtccatgtatgtgttatttgaactcaggagtggctaacctcaccacctaagggaagagccagcattgaccagcatcattgacaaaagcccaatataagtgtattctcattgctttgaaaatgttttcctgttgctgattttaggccatgtatgtcatttctgttttaaataacaaaaaattactttttggtcacggtatcagttcagttttaaatgctgtcttttttttttctttttttatgttttctctatctgccaaggtccgaaaagccagatatggccccaaattttggttccctttttggatttggatggcaatgggaggatttaggaatgacatttaggaatgacccatgagctggaactcatcagtgtggttgagggaggctaattttgtttactgatttccaattttgcaactctgcacttgtttctgagactaagtgttgtgtaaaaagataaggattattttgtggtcactggtaatggagtttttgctggggcctggaggaggcaactgaaaggaaaggaggatgttggaatggaataaaaaacgagctccttagcgactttgtgtaacattagcttagactagaagacttgttccccattctcttgctgctcttgagtaaataaatacctattctaaaagaaccatggaagatgtagtaacttgggtcaatgtaaatt

SEQ ID NO: 42444 - DNA, 939 bp, Bovine  19866881228415
tcttttttaaacataagataatccgtcttattgctaggctggatttttctttctgaattcagtaagccttttatttttaaaaaatttaattcccttatattaactggaggttaattactttacaatattgtggtggtttttgccacacatcaacattttgcattctattaacctggcttcaggttatttttgtcatctggggaacctgcttcctgtgccctgtttaagcagaagggggcagtagagaaatcagttggaaagtcagcagcctggtttgcttcctcctgatagaagtggttgtgccatataaatatgctgaaaggaaatgagagttgaaattaatcccttttatttatttaagcctaaaattattagaaaaaaattaaaatagcatgatttagatttcttgtcagttttagcttatatagttgctgcagaatagctataatatttgtggggttttttgttctgaaatctgatcagcaaatgtagagtgtgttatttcgtacagttctgatttcagtgagacttgttttctgcaagatatcttgtgtgtttacagaaaagcagatgctccaatgcgtttttgtggtttattttgtttatccattggagttagagtttctaaggaaaaccatttcatttcttgctgaaacaaaggggaacttaatgtcacttgactaaattttggttttggagtcagagatctaattttttgttgttgttctttttaatttgcctgcataaattttttccccctatttgttacaggaaatgaggtctaagctagctgacttgttttcatgcccttgatctttgaaaatgtgttactacattaattgaagcaatactgtttttctgtaaagaatgacttaagtcttgcagatgggcctggctaactagttttatttactgtgtatgaaagctattctgtttctc

SEQ ID NO: 42445 - DNA, 2393 bp, Bovine  19866881334829
cactttaaagcttttgttccactgcctttccccctctacagtttctgggaagaactcaaaataatgtccctgtaatatgattttctctggctacttcaagattttctcattttgtttgtttgtttttttaccaccagattgagtatgataaatatgaggtttttagaaaatgcatcctacttgtggtttgtggaacttcttgaatatttttttttcttttgccaaatttaatcaagttttggtcattgtgttttcaaataactttttctactctgcatccctttctcttcctgttctttctctggactccagtaacacacattagaccttctgatattttctcacagatctttgaagcttttaaaagtttttccaatcttattctctttgttctatagattagaggctttcactgactttttctttgctattgctacccactattaagttatgcaataattttttttattacatatattgaaggttttagaatttccattgtactctctctagtttttaaaacattaactttctgatactatttcctatttgttcatttattgcaagcatgttaacctttattccattgggcatagttataaaacctaaataaaaatattcttatctagctattgcaacctttatatcatcttgggttggtctccactgattgcattttcccctggaaaatggatcacctgttcctctctctttgtctagtaattttgacttgtatcctgattattttgaatattttctaggatttgggactctgttatatttctctgaagaatactggattttgtttgtttttgtaagcaattaacttggctcaactcatgatccaaacttggttaactctgtgaagggctacttttcagtccctttggccttagctgggcttcttggcatctgcttgatccaagtggatttcagaagttaaccagagattcaagtggattttatgcagtagatttagggtttcccctttgtgctgttgttgacatttcttctcactttcttctttttcttcaagtttcagttgcccagctgatacagacttaccttcagccacaaaaccttaaaaacaaggaactcaccagatgatgttcatttttttttcaaatgttaattcccctatagtttctgcctacttttcattactctccagtgccttcagatagttggtttttatattttatccagagtctctagttgttatatttgggaaggttgctatggtagaagctatgaccagaagccttattataacttttaataactgttgtttctagtgtatatttacagcttttttggcaagccaacaaaaaggaagataatttttttctcctgtttttatttgcaaaatgtgttttaccagaatttgtctgactcttagaagtatcaaagtatattctttggaggtgcaggccacttcttaatttagcaggatcctatctagacattcctctagtattaaagacctagaccacaatcaacttgctggttactacatttaaatttttctttggaaatcgtgcctgagtcatggatctcttaagttggaatattaatggagttgtatgctttaggaactgctgcagcacctacatagtgctttctttccgagtatctttaggtgctaggcttcttcagtactacgcagtcatgacgtgattaattacagtgagctatagttaatctgaaatcttaaaatatataatcacttaattttgaaagatacatacaaagctaaaacctgccctggtcactgttctcagtccccatttcctctcctcctacctgcccatcttccctcaggtaaccattgctaacattttggtgtatgatctttaagaccacacacacacacacacacacacacacacagaaaaatggagaattattccgtgctgttttgataggtaggattatattgtgtgtgtgtgtgtgtatagcatccttatttttactcactaataggccttagatatcttttcatatttaccacatacagatctactacatttgattttgtatacttctgtttttctcagagttaatttatcctgttgtaatctccttaggaaacccttcaactagtattcttaattgaaccagtaaagcctcattgttgtggaacctacttactttgaaatttgtgataattagaccaagaatagaattaaaatttatggctgccaattaatgactttaaaagaatatttttttctaactaagagataaatagcttataaaccctagtttaaaatgtaccaattacatataaatttttatctgtgtttcattatctaatgaaatagtagcttgttctgctaactgtatgcattgaaagcaataaaaggtacatgccgttaaaatattccacaatc

SEQ ID NO: 42446 - DNA, 1914 bp, Bovine  19866881384575
atagccgagttaaatatgtaatccctctccagagtaattacaacgaaagaatggatgtaattaggaattgtgtctattttttgtagcccatcccataactgacagttctgctttgtccatgcagttgataataagtggctctgatagtttcctttgagcaagtgctaaaggagctggcactttcacacttatggtccaatctgactttgacataactttttcatcacgactctggtgtggcatctgtagtcatacagggaggtcaaaaacgtacacatactgtgtgatgtctcttttttttctcctgcagtgtagctggaaatgtggctttttaggaactgactgatttttctaaatttcaataaagataaaggacattttgaggttttttttttttttttttaatggctccttcttaagaaaaggagaactgagtaaaaatgaagatttaagattgaagtttcactgcctaggttgagcttgaacagactgtggcagaattggagagtaattaatgtagcagatacgtatagatttgttccttttagaaattggtcatacaaagggtgtgacctcgttcatacaccttttcataaaattttgctaagcagtgtatttatgagagttttgattagtttctttttcctcaaaaagttaacattgtgattaatattattttgctcaaaataacaagttcttgttatgcttgctgaatttgaaaatattttaatgtgtgctttacagctctttttgtttaggataaacatcttgaaattgcatccaactcatcctttgcagatgctattttcctctccttccacctgatgacttaccctgttcatctgggtcactttgactcagcttggatggatgctcagttgctcagtcatgtctcactctttgcaaccgcatgtactatagcctgccaggttcttctatccatggaattctccaggcaaaaatactagagtgggtcgccacttcctcttccagggtatcttccccctccagaaattgaacctgcttctcctgtattggcaggcagattctttaccactgaaccacctttggctcagctcaaggggagtctgttctgacctccccagtgtgcactccaactcccattccggccactccacttaaactgcttttagtcaggccatcaacagcctaaatccctgggaatgtgttttggttcttactccatcttgctgtgaaatttgtcggtattgatgtctctttttcttacatgctgttttcctgctctcctgattttctttccacttacggtggttgctgcttcttattctttgtgagctcttctgctcatcccactaatggtgatgttcctcagattatttctctgagttccttttttttttccccttatgtgtcacatcctttcagtgaaacatcttatttcataacttcagctattatttggtccaaatggtgatggtttagtcgctaagtcatgtctgactcttctgaccccatgggctgtagcccgccaggctcctcttgccataggattttccaggcaagaatactggagtgaattgccattcccttctccaggggatcttcctgacccaggggttgaacctgggtcttctgcactgcaggcagattctttaccgattgagccacctgggaagccctagtgagtcttagaggagtccagatgagtcctaaataaaattcccagttcacatctttcttttgctttcctgactcatatctaactggattctgggcccttgcaataggtgagaaagatcaccaagatgtcccagaagccctttaaattcagtgtatccaagcattctttaggggatgccccctgctttctggtcatgtcgttttctctactggaaaacatttagtgcctctccttgcctgccagtactctat

SEQ ID NO: 42447 - DNA, 990 bp, Bovine  19866881426513
atctcctgcttggtttatggaggatactttaaaagaaattgctgagatatacttttattgaacactggcaatatagatttttatttgaactacttttgaaacttgaaagaagggaaaatattagttttcgttttcatttgacaaaccattatttccctttttaaaatgagagtatcaccagaacaggaaaggcattccagagcatgtgtaaaaagttctgcaatagtttttgcctcaaaaagaaatctctttcttctctgaggtttgtggtgttattttgcactcttttatgaccttttactcaatgatgggtattctgattatagaagaagtttattcttctagtctctcctttcttttttagtattttaaattctttactcttctgtgtatacgtttcatgtcacctagagggcatgaattggataaggcagccccgatcttggcatggtttctgggcagcaccatagtacaatctgttctccatgctgctgctttggaaattattaagctttacacatttagctcccatgccaggctatcgtcttcttgagggactttgtagaattcagtttggtaccgttactttttagcacagtttctggcactgtatagtctctcaaagaatatttgttgtaaatggagaagcatggtaattcatagttcaattatttataatatagtttaattatttacaataattgtttataatttacaataataatttacaatagctagcactatttacagtagctagaacatggaaataacctagatgtccattgacagatgaatggataaagaacctgtggtacatatatgcaatggaatactactcagccataaaaaggaacatatttgagtcagttataattaagtggacttccctggtggctcagacagtaaagcgcctgtctacaatgcaggagaccagggtttgagccctgggttgggacgatccccggagaaggaaaggcaacccactccagt

SEQ ID NO: 42448 - DNA, 1358 bp, Bovine  19866880234963
tccgtcccatcacttctggcaaatagatggggaaacagtggaaacggtggctgactttgtctttctgggctccaaaatcactgcagatggtgattgcagccatgaaattaaaagacgctttctccttggaaggaaagttatgaccaacctagacaacatattaaaaagcagagacactactttgtcaacaaaggtccatctagtcaaggctatggtttttccagtggtcgtgtgtggatgtgagagttggactataaggaaagctgagcacagaagaattgatgcttttgaactgtggtgttggagaagactcttgagagtcccttggactgcaaggagatccaaccagtccatcctaaaggaaatcagtcctgggtgttccttggaaggactgatgttgaagcttaaactccaatactttggccacctgatgtgaagcactgactcattggaaaagaccctgatgctgggaaagattgagggcaggaggagaagggaatgacagaggatgagatggttggatggcatcactgactcaatggacatgggtttgggtggactccgaaagttggtgatgaacagggaggcctggcgtgctgcggttcatggggtcgcagagagtcagacacaactgagcaactaaactgaactggagcaactgagcccgtgcaccacaactactgagcctgtgctctggagcctgggagccgcaactattgagccccacaaccaccctcgcgccccagagcccgtgctctgcagcaagagaagaaaccacaaccagaagcagaacacggcaacgacagcagccttgctcgctgcaaccagagaaagccctcacagcaacgaagacccagcacagccaaaaacaaagaaataaattaaattattaagaaaggtcccttccaggcaaaaatggaacatacagttgtctgttttctaaaatgctctgtccgtgcagatgccaaatacattctacattcttgaccgactcattagctgtatttaacactatacctattgcccagagacacctggtacatcaacagaaagtgaataattgtgaggattgaatgaaattaagcaccctggatcagagatggttttgtgcaaggaaaaggcacagctgttgcccttttaaaagataaaatgtgactaactggatcatctggaaatcaattagactgaagtaggccaaagatattaggtgtttggctaaaagagatatagtctctggcagaggggagacagagctttgtgtgcacaaaatgtgacatcaggagttggaattctgtggatataaactttaagatttcctttcccttgtgatgacaagggggacattttgagggcagatg

SEQ ID NO: 42449 - DNA, 758 bp, Bovine  19866880387977
cctgtgtcagcgtctgttttcagggcaggtatttataaaggttacagaaattgtgacttacctgcatatatttatccttaatttgttcacaggtagaaatgcaattggatatataaaggtgaataaattcaggaggtagatcaacagctgtggttagtctgtttcataaaaataaaggcaggcctgttaatttcggtcacttagtgaaaattctaatattaatggtttatgcaggtaaacatcggagccaccccaccccactcacccccgttaataagtgacacttcgtttctcaggtctgcacatcatatgtaataagcgctgagcaccatgtccctgggtggtcttggctgaatcatagttctagttaccatccaggctctgacgatgtgggcagttactccgtctacctaagtaataccaacctgattacacatgagtgctatgcaaggagtacttgtgaaggaaggcgtggtaggaactgaacagcacaatgcatgactgagtacttacatgaggcaaatgtttgctcaaggagcagtgtaagtgggaaggattcacagggcatatgacttaaatggaaacccaaggagagaagtgttcttcaaatcagtaaataatctaagtgaagtgtagaatcgggggtgggcgtggcacattacccgagtacagaatttttttcccacaaggccccaaggaaacgcagccataggctgctggtgacgcgtggatggggtatgcacaatgagggggggggt

SEQ ID NO: 42450 - DNA, 1693 bp, Bovine  19866880572042
acagctgggagatagggccaagaaaggagggtgctgttcccgctgcaaaagggaaccagacaaagcatggggcagtcctgccccatctcagcccctcaggggatacgatggagcacagggtgatcagcagagacggccacttctgcagcgcacccaatccctagctgggggcaacctgggatcattcattcaccaagtatttagtcagcagctatgtaccaaatgttatatattcaagggggaccagcagaaaagaatgggtttctttttttcctttgctctctgcaattctactctgctgctaagtcacttcagtcgtgtctgactctgtgcaaccccacagacggcagcccaccaggctcccccatccctgggattctccaggcaagaacactggagtgggttgccatttccttctccaatgcatgaaagtgaaaagtgaaagtgaagtcgctcagtcgtgtctgagtcttcgcaaccccagactgcagcccaccaggctcctccgtccatgggattttccaggcaagagtattggagtgggggtgccatcgccttcttcgattctactctattcctcattaaaaatcaatttcacgaaagttgtcactgatttaatccaaagcagaagcaaaatttcacaggtaataccaataaaaaataaataaattccatgggtgaaaggttgtgcctctatttttaaagttaaaacataagtaaaatggaaatttcctgtgttaggaccagtttcactgaatactaagttcaaactgtaaaaagaaaaattatcacctattactggtgtctgtgtgcatgcttagtcctgtccaacttttgcaaccccatgggactgagtccaccaggctcctctgtccatgggattctccaggcaaaaatactggagtgggctgtcattatctgatgtcagaacaaatccaggtcatacatctaattacaacttaaaaggtaatgcggcccatgaacctcagggagaccttcagaaggactgatgtgtgccaagaactcctttcacatctaaaactccactgtatttatgattccttcatctgaacgccccaccaggaacaactccattcatgaagccactgtttctgaagccaagagaccaggtttacgttgcatagaactgggctaacaaggaaggcaggctacttacggggagcgccttcagccatctcaatggcagtgatgccacaggaccagaggtcactctgcagaacaaagcagatgttagggcaccatcctcactgtgaggcctggtactcgccaccactgggcactcacacaaaccacataaatccattcttgggggtacgaaccaaaaggaagtttgccaagaaattacgagcacaaacacatctggaagaacaccttccaagtaaataaatgatcagctcataaagttcagtcaactcatgaagagggtgatggaaaagctatacaatctgccttgtattgtacagctttgtaaaaagttatgcaataatgataataatgatcgttaattagaaccacttgccgtacctatgatccaactctcagccagagtctgatgatcaaacaagacttttcatcaggaccaagaactgcattattgatacacgtctctagaggtcactctcagagtttaaacacatttggaccaaagcaaaggtgcacagctctttagcaa

SEQ ID NO: 42451 - DNA, 1895 bp, Bovine  19866880908970
ttttttcgtagaaaatggtagctgatcatccacaggtaggttagtcatcgctttaccgattttgctgattcagtgactacctgtgtatttcagtaactctttgtcttgttctcagaactggaagttgtctgggcaccactctgtccatggcgtgcagtgcatgctgggagaaccggaggccatctgggtgcccgtctgtccactgtgagcagcgcgtgctggagtcagaccctgggatgctgacctcagcgctctgagcctcagtgttcttgtctgaaagcggcaacgatgatgcgtctccttggttgtcagactccagtgagacgatcctgtcgagggcctggcccaaggatgggcaggaagcatgccttcagctactgacttccttcctcccttttcctgtatgtggcctcttcttcctttccagcccctccctctctcctcttctctctacaccacagactgagtaccactccctgtgtctaagagaagggggcgctttgtcacagcaccaggagagggggtctggggagcctgatggtgaagctgccctcccctaatgcactatcatgacctagaacagggctgcgcaccaaactcagggttctcacgtggtttgtcacggtacagtggggaaaaagcttcatgagtgaccagtacattttagcagatgagactcaagaatgcacccaccattcagcagagggatggtagggaaaaagtgaaagtgttagtcgctcagtcacgtccagctctttatgatcccacggactgtagcccgccaggctcctctgtccatggaattttccagacaacaatactggagtgggttgccatttctttctccaggggatcttcttgacccagggattgaacctgggtctcctgcattgcaggtgggattctttaccactgagccatcagggaagcccagcaggatagtaacccatagacaaagattcctgcaccctcagcctgaacacaagatgacagctatatgatgcgtatttagttcttctgtggttgcaatgagcttagaaccaagacacggctttgggcacaacaagcaacaaacatattcttataatacaaaacaatcacgttgtacatacaggcatactttttgtttgaatggaacagcagctgtctcaacatgtcactatgacaaccaacaatgctcccacgcaggtgagtctggtttgaaagcatgtgaacagacttctccaggtggagtccctgtgtgatctgggtatttgcaaagggccacttcactctcctgccagcacaggggtccctggtgacctgctctcgtcctgcttgctgtcagggagacaggcctgctgtgaacccttcccaaaaagagacagcagtcaaccactgtctggcagcgctgtataaaaggtttccatttcacgcaagcatcacggactttcttctccctccatcaggcctttcttggaacggctctgaagtactcctccctggagatgtcggctactcctccataccatttctgaagccagatgtgttctaccttcatcttcatgaagaaccattcatatggccgaggccactttctcatcactgggtgtctgcagaaataaagaagtcaccatagagcagttttcattagaggctgtgcctctggagcacagggccagatgtagccttggccaggtcacagggccagacgccaggtctcttgggcttgtgctcagttgctcagtcgtgtctgactctttgcgaccccatggactagaccctgccaggctcctctgtccctgggattctccaggcaagagtactagagtggggtgccactcccttctccaggggatcttcctgacccggggatggaaactgcatctcctgcattgcattctttactcactggg

SEQ ID NO: 42452 - DNA, 2420 bp, Bovine  19866880947316
tccttttatgctttggaaaaaaaagaatctaaatgacaactttattctgatgatggagatgatcttaacatctctcgaagccttcaaatagttttccacagcaatatcttatgctcctaagacacaccttcagaggatatgaagctgatcttggtttaaaacatagatccctcccaacaattaaaagtctaatgccaaagtattcaaagatattatgactttcaacatcccttttcttagccttgttagtagttcccttttccactattgacatttacagcaagtccaataaattcagagaactttcactgcatgcctggcatgtgtgcccagcatgaccagccagtgtgtgaatcaagttcagttcagtcgctcaggcgtatccgactctttgcaaccccatcacaaagtttgtgaatgaccagctgaaaacaggatctggtaatgacatgttaccattttgtaggatttcttcaaaggttaaagccaccccttatcataattctacatactgttgttaagtgatacttcaaagacagcccccgagtgctgagctaagtaacgatgagaatcacactctataaagggtaaaggtcgtgatgctggacccagcagggcttgggaaaaacctgagaaatatttgtgtgtatgtctgagaatctcacctgctgtactgaatgatcgtgaacagaaattgcttttgcatgcttctgtgtcttccttgaagctaatagggtaagaaacaaattcccttaagttactgaattatatgactgaaatattacttactacaataaaatatatgagtgataagtgaggaagtagtagaaccctaaaggaaactataacagaaagttcctgaattccaaagaccaggtaagatgtgaggtttaaattctatccccagagttgccaaaaatttggggcaggtggtgaaggcagtgggattcccagggcagcttgtgagaaaggtctttagtaaccctccaaccctccatgaatttcaatgcctttcccccaaataactttcaatttaatagagtggttttttaattagttttttattttgtcccttaattttttggtttgttttgggccacaccacatggcatgtgagctcttagttcccggaccagggatcgaacctgggcccccatgtggaagcatggagtcctaaccactagaccacgagggaagtcacaatacagtgtgtttgctgtttttctgaagcttcaagaataattccctcaccactccccatccacaggcgccactgctaagctcctctgtagaaatcatgaagccatcaacgggtaaaggggatagattgggaaccactctgcctgggtttatgacctgtcaaaaccgtggtgatgtcatgctgctgttgcatccccaatgctctgttttctggtcagagacacagacttagctcccagctcaagtcagtccacagccctgtattgaaaaggccctttttttccccttgatgtttgttagatcccaggcctgccatttgggacctgcctgcccatcagtgatggccccttcgacaacagtactgggattcctttcttctatgtgacacccaaggacctcctggtggccgatctgatgaagaaccccatggcctcgctcctgctgccagaatctgaaggagagttctgcaggtaggcaagggcctggcctccgtcacccagctcctctacacaaggcagggaggttgtggcgttcatggggccctgagatgcaaagccattcctcaccactcggccagggctgttcctggtcccggctctgggtctcaccaggttccaagactggccgaggccctggggtctccatgctgctttcatcatctacggaattaagcgatgaactaggtagttttgaaggttcttttttgttttgaaaaaaattatcaaagcaacagctttattccgaggatggcaattattgtaaccacttaggcagctcccaaatggtttttcatgtttctgttttatgtccctaagacacacctttggaagacatgaaactgaaatgtgaagctgatcttggtttaaaatacagatcatttcaagcaattaaacgtctagtgctggggggatttccctggtagtccacaggctaagactctgaattcccaatgcagggggcctgggtttgatccctggtcggggaactacatcccgcatgccacagctaagacccagcgcaggcaaataaataaaatattttaaaatatatatttttaaagtctaatgctagggacttccctcgtggttcagcggttaagactctgtgcttctaacacagcgggtacagtttgatccccagttagggaactaagatcccaccatgccaaggtgcacggccaaaaaaacctataaaagtccagtgccagtgtgttccagata

SEQ ID NO: 42453 - DNA, 1078 bp, Bovine  19866880959977
acaggaactgaggggaacagtgtctgtagagactccttcatggagcaagcatgggaggccagcggtgtgggcaaggagcaggttggcgcaggtttcaggcggtgccaggaagcaccactgatggagaaagcagaaaggcagaggtgaaggaggacccgcaggaggagagaggaagccacagggaaaatgacatggcagctcctccaaggtaacctgagggcagcccttcttctctagttgtcttgagaagaggtagcacccacttgggtgggggccctgtgaggccccttcatgggctttactttggcctgagtgctcagatcctgtgtccccaggggtgggcatcctttttggtggctggtgggagctgagagcatgtctgcttccatcctgcagtagctccctgccacccaagaagctccccaagatgcccacccccatttccacagacattggaaataaccaagagacaagctcactgttattcaaggccaactcgtggtcctagtgtgtcattgctgattatgtaacactggcatatttactgagccccagcaagcaccaagcactgagacaccctggaaatacagtaggataccaggattcttcggttgactgttggtctctctgctgtttaccgcatcaaatatgagatgctgcaaagtgtgcacattacctcattttgctccagagctattgaggtctgatggtgagaggacattgctaatgaggcctttgggtcaatttcacaccctccacccaaaggacgggttaatttcacccaccaccgctgatgtctctagttcaaccagtcccttaagatgaagcatttgaatagatacatgttagcactgtaacagtcagggtttgtttgtttttttttcacagttttctgccttccttatgtgctggatgtagaaaggacacttacctctgtacatgatccttccactagcagcataattacagctttcatttgagttgagcttatagccacatagactgctaaatagaattaggtataaaatccattttcttttcaaagaatgtggccttgcaacagacataacaaaaattt

SEQ ID NO: 42454 - DNA, 1841 bp, Bovine  19866880993241
ttctcataaagggaaggatttataaatatatcagcttcaaaaggacccaagctggcctaacaggtatgccttcagaagtctaaatatggacgtaacgcacttctttccacacctaacttttctttgcccagggctgaggttcgggcatcaccattttgcacattagcactgggcaaagaaagcttattagccagtaccgtctgtgatgggtgaagtttcgcccataccactgctggaagcgcccaacctcgggtcaggccctgccgattctcggtaagcgagagctccgggccggcagcctggatgcacacacagagcttgcctggcacacgttttctctgtgaggccctcagtcatgcggcagccctatgcctgggcactgtcccaagctacggaatcaccaacttaagcggcacagaatgtcagaaatgtggcaccacacttcccacgaaaggacacctgttgtcagtctgacgctagaagaccatgtcctttccagcctcacctgggaacgtgtgtgccagcagctaggcacttctctgccctggggcatccacaagttgccacccatgcaaacactgatttggggccacaaacaggcttttgtgggcagatttgcaaacgtggcctggactaaagacagaccattgttcatcatttccaggttacagtcctggtgtttacttgacagaggaaagggtttcaggtgtatttcaaataaacagcttacaaagaatagtagttatatttagagaacattttatgggaggaaaaaaaaatccagaaacatttacaacaccagcaaaaagttcttcgttaaacatgtttaaaagtagaagaaagtttacctgaaataaaaggaactataatcctgggatttgataactgcatcaacttttaagtttaatcagatgagttcatgttttctaaaaaccacatcttgaattctctggactttcagttccaatttctagctttaatatcttcaaatcacctgcttaaaagaagacagcaagacgacctgttaaaatgacatcttagggtagaaagatgtttgaaaaagtatttgtgagcctaaaatataactatttcaaatacctttctttagcaatattgtttgtttatgcaactctaagaaaatggtatcattcagacaaatgataccatgataaatggtatcagaatagacaaactttcataaattttaatggactcaatggacatgagtttgtgcaaacgcttatgtggaaaatccttaagaaaaggacttccaaaatcctgagattcaataactaatcagcctaacaggaaacataagtgttttcccaggtttctttttatctgttgataaataagcctccaacgcgtcaaaaagaatgggttgacttttcttgtactaatcttaaactaatgtaatgcaaatacttttttgatttacaacttgttttgtacttttcctgttagaatgagggcacacttctagatacatggctgatgatattgttttactactgtaactagtaatcgatgtgccagtacttttgaaaatgaaatgcttttaaaagtgttttaaacttcaaaaatgaaaattaactgggaaaagcattggtggcttttctaattggtgatcttgtgacagaagcacagcgtgcagaaaaataagatgaactctggttcaggccaaagttctgtgctctgtaagctgcaaattagagtttacaccgagcctggagaaatgcttttgactaaaacatgtaagtacctcaggttctagttagccacatatatgtgctgactttacctcagccctcattggatcatacgagtgtgctccaaaacag

SEQ ID NO: 42455 - DNA, 1106 bp, Bovine  19866881018159
ttcagtgtatgtcactcctcttagctgtagtgatctgctgctcagtgagtctgttcatgccaggcaggctctgggagggccaggggagagcagtccccatattgcacagctctcatcagaccaggcatgttttggagttaagcagtggtcaacagacacactggcaaaatcgcttatagcagagatgaatctagaatcctgtgtccttgtttggacaatgtataaccccctctatgggtttcttagggcttccctggtggctcagatggtaaagaatctgcgtgcaatgtgggagacctgggttcaatccctgggttgggaagatcccctggagtagggaatgacaacccactccaggattcttgcctgaagaatcccatggacaggggagcctgatgggctacagtccatgggattgcaaagagtcagacacaactgagcgactacgcccagcacgtgggtctcctagccctctgggttctcacttcctgagaacaccggtggatggaaggctgggccacggtgtacataccttgttgcccgtgacggtgtctacgaggaagccaggcaccctgaccaccacactgctccccgccgtggcaccggggctctggcccttgcatctgagcatcacccgggggggatccgcactcaggctttcatgctcctgagctggggggcagtctggagggtggtggggctcatggtctggctggacaggagactggtcatctggcagtatctccttgagacttcccacgttgtcttcctcctcttcctcctcaatgcacgactgaagtatgtgaatcacatattccgaaagcagcaagtgaaacaggtgccaggagcctacatgaaataacaacccccagtgaataagcacacagacagatggacaggtaaacggatccccgtggaaccaacagcttttccagggctctcagctcctgtgcactagagcctcactcctcctggcaaagcctgagtccctgcagcgtccatcaccctcgcagcatcccacacccagaggaccccagaaggtggctttagcacaaggtgctcagtgagctgagtcatgacagggaacatcaacacagctgctgtga

SEQ ID NO: 42456 - DNA, 728 bp, Bovine  19866881042921
aaatttctgagcctgagagtgacccctcccaccttgaaagcagcacctgacttagaacagagctgatgcagaaatggaccacacacacacacaaagcctcaaaatactgtcctggcagatgtgccctacagcaggagtccatgcggtcctcgctggagcagggagggggacgtgggggcagaacccgtgcccaggaccggcagagcccacaaggcagggctggcgacaccttaccctgtaatcgtaggtggcgtcggggttctcgtcacaggcaatgacctcaggggccatccagtacggggtgcctatgaacgtgttcctcctccccacggtcctgtccagctgggcactcaccccaaagtccactgcggccagaggaaggaaggaaaggggaccagagtgagcaaaccagtacacaacaggacgcagacacggagcgcaacagggtcttcagagtaaaccacacaccagcacggcgtggatgcgtgaccctccagcaacacgggtacggagcgcccctccagagccaagtcaccatagggccaagacgcccgaccagcctgggggtttccccaggggcctgtacccacaggtccctgagtttaccacagggaccaccagagggactgctgggggagtctggggcttggatgaagtgggcctggagccacgctaagaggcaagcctggctcccacttctccaacaggacggaaggggaaacgggagt

SEQ ID NO: 42457 - DNA, 1539 bp, Bovine  19866881162869
gactcaatggacatgaatttatctgagcaaatttcaggagatggtgaaggacagggaagcctggcgtgctgcagtccatggggttgtagagagtcagacaggacttagcgactgaacaacaacagggctgattaacagtgttgtgatagtttcaggtggacatcaacaggactccgccatatgtatattaacacaattatttccccattctttccccaaactcccctcccatccaggctaccacctaacgttgagcagagttccatgccgatgaacatctttttaagtaagttcgctaggaatggaggcaagaagggaagtgtagagataagaagtagaattttgcatttatagccctccagtaaatttaaaaaagaaaagctggtggggagggaggacaggatttttacagaacagtgcccacgtttaaaaaatagcaatttatgtgattgaaaaattggtgggtgtttttttctttcaattgaactatttattttccttagataaatgctttcgattcacgaagtgacaaggtagccgtatccgcctggagatggttcatcaacaattacaaagggctccctttcacggcaagttttattttaccaggagctcaagaatagctccttctggagcataattaatctttctattccaccctacctctgagaagagcctgcattaaaagactaagtgttcagtaattgtttaaatgaatgaattagtgcaagtgcatgaacagcatttaaaggcacaagaacaaaagcccagaagccatggctgacacactccctttccagtcccactgcacctgaccaaaatcaagagcactttttcttacttccattaagaatggatgataatagtttccttttccgattttttttttctaacccatgcagcaacagaaataatacgtatgcaaataagcgctgtttccattgttataaaagggaatatatatgtatttgccaacactcaaaaaatgcttttggaaattctcttttaaagttggcaggacattgcagcaaaatagaaggtgagcaccacccatgtgaaggactccgtgctaggcctggacaggcgaggagaaccctttaacagtcagcttcccacagcatttatagctcaggacggaataacattaagcatggaacgaacatgaagaagctgctccctaggtacccatcgaaacagtacgaggagagaactcacaggcgggactgaagtggtcgccaaggcccagaccgtgtgactataccggggcacagacgcttcctgaggcaggaggcagatggcgcaggacgcctgcagagcccagagagcagctgcttgggcgggcaggcggctgtgtcggaaggctttcagcagaagcaacaagtgatgttattttattaactttaacgaggagaagggaacaaagaagccaccatttacacgcagaacctgcatgctggccactgtgcatctattatgttattttcattctgatgagagcctgtgaagtaggaattattattccattttacagatgaggaa

SEQ ID NO: 42458 - DNA, 1173 bp, Bovine  19866881278180
atacctgggtgttcggctgtttagaaaagcaagatgagattatataaaagtcatatagggattctgtttgtgagagcaattatgattaagaagggctgagacaggcaatatttcatttcttaacttggttgatggttacaggaatgattacatattagtataagtgactgtagagtcaacaaactatgacctgtgggctaaatcctgtctgccacctgttcttgtaaataaagttttactggaacacagccttactcctttgcttacatacgtaaacaagaacacagacagagtctctatttcaccatttacacaaccatgtggggctccatggcccctattttctctaacacatttgaagattcatggtgtgtttttaaacatgtgtattgtccaaagatgctcagttcagttcggttcagttgctcagtcatgtcctactctttgcgaccccatgaaccgcagcacgccaggcctcgctgtccatcaccaactcccggagtttacccaactcatgtccattgagtctgtgatgccatccagccatctcatcctcttgtccccttctcctcctgcccccaatccctcccagcatcagccaaagatgctacaattcattaattcgtatttatagtccatcccattcttaaagctaagtgactccacgctccagtggggatctgatagcccctcctcccttgacctgcctgtggatttgcaaagtgacttgactgtcaactgtgttgtgagtgttcctcttattctcagcaaagctgctttatccaggaagaagagtcacttttctcgggtttgaggaactctcttctttgtgtaagacaaatagtttttcagctacacaagagctgagtttgggcgccattgtttaagctttcctgtgctgcatttcgtgataaattgagacttttgttttgttttgtttttcttccttgcagaggaaatcaagtacaggagacgtctttatggtgggctatatctgatgcagcaaaggcaacaaactcaggaagttcaaatgttgtctccttggatgggcccaaacacaaaaataccacctccatctaataaagtagaaaacactatgctggagcaaaagatgcaagaaatggtcttcttaagaaacacaaaactcaaggtttttttttatcacttcttctt

SEQ ID NO: 42459 - DNA, 1040 bp, Bovine  19866881665772
tataccaaccttgaaaacatggcttgcttggcaaattcgatttcttctggagacactgcgaccatccgaccagtgagcgttaaccgggcacagcgaaggatcttctgggtccacgatgttttttctgcatttgaaggacagtttccagatattaaaatgatgatagaacatcagctggacatatgaaggattttactaaaaagagaaaataagagttacattgatagttatatcattcaggcttttacatttttctggaattacttgaaaatactttgacacatctgatccagaaattccactgctaggcatatatccagagaaaaccataatccaaaaagatgcacacaccccactgtctactgcagcactacacacaatagccaagacaagcgaacaacctcggtgtccatcgacagatggtcggatgaagatagggtcaggtgagtggcgcccccagagctgtacagagcagcgagctgactgaacaggggctcccactgagggtcttgcagagccctggcctggcctgggtgctcttgcctagcacttcccaagttgtctcctgccccaagggtgcagactgacagctagtgtacacacaaacacacctgtcacaccgcctgtgtgaaaatagtttaactttttaattttattggaacacagttgatgtactgtgttccaacaaaattaagggaaggttgtgttaattcctgctgtgccgcaaagtgcttcagttttatacatatatatatatatataaaatactaaaatatttaatatattttattatttattcttttacatgatggtttatcataggatagtgaatacagttccctgtgatacagtagggccttgttgtttatccattctaaatgtgatagttcacatctaccaaccccaggctcccagcccatccctcccctaataccctcccctttggcaatcacaagtctgttctctatgtatgtgagtctatttctgttttgtaggtaagttcattgtgtcaagttagattccacaatcagatcagatca

SEQ ID NO: 42460 - DNA, 1291 bp, Bovine  19866880501520
aaatagatatgacttgagccaaatacataaggaaaattcttctcttttatttctatctcaagtttcttagtacaaaatgacatatggaaagtgtgtgtttcctatcttccagccaaaattactttaattccaaaacaaaggtaaatagatgcaaaatgaaaaaaaaaaaatcatcttggaaaatccaggagtttgttgtatattgtgttagtcactcagtcatgtctgactctttgcgatcccatggactataactcactaggatcctctgtccatggaattctccaggcaagaatactggggtgggttgctattcctgtctccaggggatcttccccacccaggaatcaaatcctgatctggccgcatcacaggcagattttttactgagtcagcagataattttttttttttaattgctcaagtaatgacttgactttattcttgaaacatgttcctgaaaagcttagtatattgaaaacctttagatggatcatagcaattttgatattaaagtacttgtatggtgaaaacttttgtaaagtaagcgatcatctcccgatttatcagttttgcaaacccaaattttcaatactgtgttggcttaagtttttaaaattataatgtactataataaagtaagaatcattatttgggctttgatttcaatttcctaaacatagtacatccaattaaaaataaattagaaactgtgaataatgaattaaattgtattcattgtatttctttgccccctctatattttctttttatattaagcaatttactttcattaaaatattctctaaaattcaaatatttacccatgaattgattattctctgggtaaattacaatttaaactatattaattggaaattgtatttgtaggtttgaatgaaaaaataaaaatgaatctaatacatattagcttgcattgcttcttcagaaaagaggtcatagctaaaatgatcaaatcaaaagccatttttatcaataagcaaaattagaatgcaaaattctaaataccaatgacatcctttttgcctattttatttttctgaatttttgatgaatcaatttcagccataaattatgaatactttagcgaactgaaaatgccttttgaatgttaattattttgaatattaatccttattaatctcagctttgctaatatcaaaaagaaattataccatgtgaaaatttttgttgcataatgcaccacacttaagtgtattttttaatcagtctggaaggttctgcatgttactaagatctcctgaataag

SEQ ID NO: 42461 - DNA, 2393 bp, Bovine  19866880652315
cctttcttcctccccaatgtgggccatctgtacagataaaccaagtactggagcacttcataagatttccaaaaatatctagaatagcttctgctctaatctttattcctcccattttccaagcagtgccatcaaatcaaaatttgaggaaatgtaaatattctcacagctgtcaaagtgtttatgtttttaaatggatattttaaatcccattcaaccacaaaacattgtaagacagtttccatggttacttctattaattccagcagccataaaacatttagcaggcttcttaaaaaaattagtgtcatcaagcatttaaaaaaataaaaaacttttggaagtgtttatcttgactactaatcatctctgttgtatgatgataataattctgaaaactcagcagatgtgttaaattcaatgaacactgtacagaattcaataagaaaatgaatatctaaatttatttcacttttattgcaatttattatattcatgacttcaatttgtatatggaatgctgaacacacatataagtgcctgacacagtatattacaaatcagatctatataaattttaaaggtcttcaatttaatggcagattacaattattttttacatacattcagacttgatatttcaagaaattaattccttgaagtgaaaatacatcttaaaaacatatctcatatccttacaatttaaatataattgttatattaattgccaaaaaaattaagatgcaaaataataatatgtaaattattttctgtaaatctttattcccaatgacacaattatcttttccaaataatatttttaaaaatttcaaaaagagtacttgagacagtttctcatcccttcctttgtctgtctcacataggtcaattgcttttgactatttttacctttcttaattacactgatttacctgccacactttctaataattatataactatacaaaaattgcaataattttggttgagcctgtatttagtgtttcaattaatgtgcctttgaagagtacatgctcagagtcctttgtcgtttgtttgtttggtctctcctgcattttcactcttcacgtaagtacttgtgaaagaaattagttttttgactgcgctgtcttcgttgctccgcatgggctttctctagctgcagtgagccgggctcctctcccaggtgcggcgtgcaggcttctcatcgcgatggcgtctcttactgcggagcacgagctccgggacacacaggagttagcagctgcagcacgtggcctgaatagctgtggctcacaggcttagttgccctgtggcgtgtgggatctcaaaaccacgtctcctgtattgtcaggcagattgttaaccgctgggccacaagggaagcccctgaaagagtatttttaaatgaaacatatgcagatttcaaaatgaaaggggaaacgaggaagagattgagaaagagagataagaacaattctcttcttcatgaaaaattttgcaggacaaacatatcctttttttttccaccttccatttaaaataaaatattttgcttatgtttcaaattagagtaaagagatattacaaaagaaatcttttgtgtcttctcattcagatatagaatagtcattttgatgagatttattttaatattccagtattactcttctgctccctgattttttttctttaaatcaggaaatattttaaacataaatttattatctgaagattagccatgttttagaatagaatttttatgtacatatattttaaaaatggaaaagatcacattttccctgcaggtagaggtaccctatactcttagcaagaaaggtaggaagaaagggaaaggaaaggaaaagatgagaaggaggagaagggaagagaagagaaaaagaaaaagagaaaagtaaagaaaactctctcaaatatagctctctagctctattaaatgcaagaatatcatcactgtaaagacaaaatttgattctcccagtgtttgtaggtcttactgatttgtgggcattaaaaagacatgtctcaaaaggaatgctttgataacatcagtttattttaatttaaaacaaaagcaaagcatttgaaattaaataaaagatgatttatagaaaaaaattaacacttcataaatctatttaaaatataataatgttcctctcagaaagcttagaaaagtcctcttgtaaaagaaatcaatcatataatttgggatcatagattttaactcctttcccacttttttcatctgccaattctccgtaccctgctcttccacccaaaagttactcccaaaacacaaaatgatgttaattcatattttttaaatttcttagtcactttctatgcattcaagaaaatttttcatattt

SEQ ID NO: 42462 - DNA, 1400 bp, Bovine  19866880836103
cccctattttcctctacagaatataaccttttaaaatgacatttaaacaacacatttctgaaatacaaatagattatttcagtcctataaggaaatatctaggaatgaataaatcaatttgcattgtattttaagtgtcatttaaacagttaattctcaaaccaaaatatcataggtaattcagatttgtaaatagtcattaaatcaaaaattgcaaattcacatttgtccaaactctctctcatactccagagtaaggcattattcacataaatttatatttatgtacacacaaaactatgatgaaaatgttaatgaataatatgacgtaaaagtacttgattgaagtcagaaggctttgtcactatttcataatctatccagagatccattttctaggcagttaatcaattccttattcaataatataagaatggtaatagctgccttgcctaacacgtatgttgttacaaggctgaaattaaatcatctaattcatttgcttttcagtttaaaatgtgtctgatatacagtgtctaaaagtaatgtcaagattcatatcaaggcttataagactctcaagaccccttccttcttcattggcctcatagcctcacatgtttccctttctgagcacttccgtggtctcccttcacctatacacaccttaggcttttgctaaacatgcatcctctgtctggagtattttccatgctttgtccatctggaaaacaaaaatctcatcttgatttgtaaattcaagagtcactttctctctaacagtgtccatcctttcccttccactccagtagaactgaccgctccacctttagccccacctctagggtccacaaatattttctcatcatctataacatttcttgtcagttacatttgtgtgtgtttattccccctgcaagactgagagcagcttgggagccagtttttctgtgctttaaccttatctcttgattcactctgtccccataggaaaatcttcaggtatacactggccacatccagcgagatatacttacatttcaaggaaagcttaagtgttcagataaatgaggaggcagaggcaaatgaaatcgtggagggaataaagaagagagctgtgagtaaagacaccaaagtgctttcttctctccatcactttaccttctatcaccaaagacttagctcagaaccaatgttcaggttacgggaagtgagaaccagaattgtgagaagcatgtgtcacggagaagcagcaaccacaccagaaaaaacagactgtggccaacaaactggttgatgttgaagctgattatccaatagtagagtcaggaatatccatctaagtgcaagaactatcacttttagtatatcataaacaaatgatcagttttgatgatagg

SEQ ID NO: 42463 - DNA, 2054 bp, Bovine  19866880850947
cctaactcaactgtaaatgtaagagagccaatgtgagatttgggactggtactatctgagaggtttgattaaaatttttagaaatattaattggacaaaattgtataaaatagatgatgccatcctacaaaaagataggctagttcttttaaaaactgtcaaagtcatgaaagtcaggaaaagacagaggactcattccagatttaaggagactgaggagttatagcaattaattgcaacacatgatcctgaacggactctggaccaggaagaaaaggagaaatggttgagacagttttgcaaaatttaaacagactgtggattggacaacagtgctctaccaatgtcatattgatatggagtccctgatttggaggtttgaactgtggtcatgtaggagagaatcttttttggagaaacacacattgaatacttaagagtgatgaggtatcatgtttgcagcttgcactcaaatgattcaagaaaatactatggtaattagtatgtatacagagaaacagtgagacagagaaggaacaaatatagtaaaatgtattccagttggggaatcttaatgaagcagatactgatttatgtgccatgtccttgtaactttcctctaaattttaaattatttcagaagaagtttatttttaaatttctaatgagtgcatcgcaagagtcaacatgagagatatttatagatcaatgttagaactcatacttaatgaaaccagtgatttctttgaaattacagaagaatatgagcaacactgctccaacaactgctctgtgggactcctcattacatttcagggctgggcgtctccagccttcacatacacaagctaaccagctggcctcagaacattatgcatggcttctgctagccaaccagacattataacagcagtaaagcatctccaagtgcttagagacgatgttgaaaatgggaatggataagagaagaaactgtaaaggaagaatcaaagcaacaggtacataattcatatcactagggcaagggaggaaattaaaggaatgataatgcctttaactaaacaagaaatcagaagaagctactagtttgatggtaaggaagataaattttctttttaagtgggttgatcataaagtgcacaagacatttcaaattaaacatccggcagactgtaagaaccaggagactaaaactcaaacatgaaatcgattctggcttctaaataaagaactgatcgtcttcctcaaaaatttttcaaattgctatatattatattcatcctttaaacctaagaaatcaataaagttttcactattggtaaattttgaaaactagtaccatcctcatgttgggtcaaggatatatctgcttttattattgagataaccagcagtattagtcataaaccaactccaactttcactagtgctggatatattattaggactaagaacatcctaacataactcaaaaatttctaaaacattaggtttagatcaccgataaatttagaatatagaaaaccaaaaaatccagtggaaagcagcttagttagggagctaattgtatatagacaatcttctttacgaaatgcactattaatcttcttacataacagtagatcatgatgttcaattaactgaagtgctttcagttagctcacttgatgataataaataaataaatatgcaatgatagtccataattggactcaaatactgaaacaggctaatcaactttgtaaaagactaagggaacttcacacagttaccctatccatattctacataacaaatccatcatgacctgattactgtttataaaatactaacataaggattttttcaaaacatttattctattagtcacagtctaaaccaatatagaattcattagtcacagatgccactagttattaacaatttcctgaaggcatttttacccttaatatctgctacatttgctgctcatgcattttaattataaattaaaagcaatgcaaatattataatcagagagagtatttctactcactaaatactatatttaaaat

SEQ ID NO: 42464 - DNA, 2376 bp, Bovine  19866880867458
agtcagagatgtttaatatcttgactgctactgctaagtcgcttcagccgtgtccgactctgtgcgaccccatagatggcagcccgtcaggctccgccgtccctgggattctccaggcaagaacactggagtggattgccatttccttctccaatgcatgaaagtgaaaagtgaatgtgaagttgctcagtcatgtccgactcttcacgaccccatggactgtagcctaccaggctcctccgtgcgtgggattttccaggcaagagttctggagtggggtgccattgccttctccaatatcttgactaaggtcacagaaaaactagtaagtagtagaattataatttgaattcaggagtgtcaaactctaaaatcaatgccctttctagtataaaacactgcctttagtattaattgcatgattgtctggacagaaaaaaatgtttttaattgtgacttttaaaagtatggagtgttttgaagccatatacgtcagttttctattgctatagcaaattaccacaaatgtagtggctttaaacaacagaaattttgtaagtcagaagttttaagacagactgtgttctttctggaggttttaggagagaatctgcttcctcatctttcccagcttgtagaggctgcctgtataccttggctcagggtcccttcccccgttttccagaatacatcaatgcaacctctacttcccttatcccatccccttcttcagcctttggccctcttgctttctgcttgtaaagaccctctggctacactgtggtccccttgataacccagactaatattaccattctcaagatccttaacgtaattacatcagcattttttttccatgtaaggtaagaaattcataggttttgggggttggggtgtggacatgtttgaggcgggcattattcaacctaccacattgtactggcgatgggcacctaactttgatacacttcccacacaacagagtcactttacagcatcatgaatcactaggtaagtatttacatattccctcctggtaccaaaacatttatttaaagaaccattcaatgtaacataaatgaagtgtaatcctaagaaagatgattgtaatcaaaagaggactttagtaagttatctttatttgaatccaaaatatattgcattcttcatttccatgcagatataaattaaaccatgctcagcagaagataagagttctataatcagaaatcaacatctgcagatattatgacattgcacctgcatgttttgaagtgaagaacacaaaaataccaaccatgtgtaagatgctatctttaagcagtaataattttgcttttactttttcaaaacaaagtatctgttattcctattaaaatttttgaagacatgcttagtttgcaaatttaaatgatgctgtttttctccttcctactcaaatagctcctctgttaaatgaagcttccacaaagagtttttattaccaatcatgaaaattaagcttacaaatacactttgaataaaatataataagaatttccttataatcctgaagatgtgatccttggtttcatgccattaagcttatatttttagtgtgagaaccacagatttgagaccattactattataaaataactcatactattaaaatctcatcaaaaaacaaagtacttagaaatgaacctgacctaggaggtgaaaaacttatatgctgaaaactataaaacaatgataaaggaaacagaatgatttaaagaaatggaaagatatctcatactgtttgatttgaagaattagcattattaaaatggccatgctacccaaagcaatctataaatttaatgtgattcctattaaattgcccgtgattttttcacataattagaatgaataatcctaaaatttatatggaatcatataaatataagagatgcagaattgccaaagcaatcacgagggaaaaaacaaagcaagaggcataactctcccaggttttagacaatattacaaaactacagcaatcaaaatagcatgatcttggcagaaaaacagtcatgcagatcaacagaacagaagagagcccagaaataaacccacatacctgtggtcaattaatccttccacgaaggaggcaagaatatacaatgaaaaaaggcagtctctttggcaagcggtgctgggaaagttggacagctgtgtgtaaatcaatgaagtacatcatactcaaaactaaactcaaagtggcttaaagactcaaacatacaccatgacaatataaaactcctagaagaggacctaggcaaaacattctctgacataaatcatgccagtgttttcttaggtcaggctcccaaggaaagcaaaaagaaacaa

SEQ ID NO: 42465 - DNA, 1157 bp, Bovine  19866880891824
tcgcttttctataacagtttcctcatccataaaatgagaaatacttttgtcatggggatttctgtgaggattagataaagactgcatttgagaaaaatgcaatataaatacaaagtgttccaccagccagactacgataaattaaaattatcttttaaaaaagtatctatattaactccttcatgtctgcacagcattaatgtgtgtggggtatacaggaacttttgtttacttgaaaggattccagggatttggaaagcagaatgtgatttcctatattttttttagtagaaagaagcctaaaaacagagtttggtgtaactgaattatgcaaatatatttaaatcattcaagctacaaaaaatggcattttgtccaaaaaataataaatgagcaaaaatacccatccaattcacattggttacagtctcaagcttttagttaaaaaaaagatggaaacggaggtatttgatcctagtctgctcttctgtttgatatttaaaacagagtatggtttctctgcctaacgtatttttttagccgacacagccccccacttccgctacgtcacaagcaggaacagtgcctgagggcgcccagagcggggcaagcaagagaaggcggccgtccgcagctgccgggagagcgccacgctgtaacggaggctgcgcactgggaacaaaggctgttatctgagtcaggcagaccactctctctggactatggaccaggaagtgaatagatggcgggagagcagtccagaggagatacgcagacaggaacatagccatcttgagaactgaagccacgttgaccgtgaaacaagagtcagagaaggcaattagcccctaggacagcttctgtccccagactgctttttcagttccagttatccgcacgttttcctacagcgagccgttgtcacccaaggtgccctgatcactcctctgtcccttgccaacccagcatggtttggacttttcttcctcatttcaaaccataaaagacacggtatagatatatatatttttttctagactaaattttcagaaatttcacatgccaagtttattcatttctcatttcttttgtccatcactacattaggtatcatttttgaaagaatattccttagtgagctctataattctagttat

SEQ ID NO: 42466 - DNA, 1360 bp, Bovine  19866881220457
cgatttcacataccaattacctacttaatatctccactatggtgtctattagacatgtccaaaaccaactcttaatttccctgtcttcctgcaaatcttttcctcttacagtcttccccttctcggtacaaggcaccttcattcttcccttttctcaagccaaaaaatcaccctattttttctctcataaagtccagccgaggcaataacaacttctgttgcctattcctttgggacctggtcagaatcttgccacatctcagcatcccacctatagctgttgcaatatcatcctaaccatcacctgacttgcactattcgtctctgtagtctatgttcaacagaaagcctgaccgatcgagttgaaatgcaaatcacccctttctcctccaggctctcaagcagcttctcgtttcattcagagtgaaagccgtcctcacgacgggccagagggccctccattccctgtcccccaacctcacccccgcttctctgccctcagcccccagcatgttcactgtcttactctgacccagccatgctggaacaggcttctctcacatctctataattcctccctcactgttttccaagtctccgctcaaatgtcacctcattccttgaagggaccttccctggccacctgatgggacacggcagtccctgtcactcctcctgtgcccttaccctgacttgctttgctctgtagcatttaccatcacctcacatagtctgtattttttaaatgtctatattgtcagtctctcccttctagaaagtaggatacctgacggaaggatttcattaagcttatttccaaattcctgtattctcaatgtccagaagactcctggcatatagtaggcctacaataaaccaatgaatgactaattgaatgattgaatgagatccccaaattatatgattctggagggataataatgttttccccataaatatttacttcattctgaaatttaaaccattgccaagttaatttctcttaagcgactgaacattttcctccattaatatatttgatcaagctccatgtctgatttcacaacatttttatcacaaaataccaccaagtcttttccaatggctcagagcaaattcacagtttaatgtgcttttaagctatttggggtcaaaaacaaaattggactcatgctttaactgcttccacaagtataagcaggagctatgcatttgatttcctctctacaattgctggtttcaactacaatcgttataatgactcgtgtgactcagatttggagagagcactgtaatcaggaggggactgctttcaatattcacctccagagtctaggatatgagttaagactccagtgaa

SEQ ID NO: 42467 - DNA, 748 bp, Bovine  19866881279343
atagtaatcatagccaagaagcaaactaattgtcattccccttcagtgccagaaagaactgacatctttcaaaggagatgaaaaggaagatagaatattgacgacaaccatcattacaaagatgggcactcacataacagggcctctccatatcccgggagaatgcatactgttggaaatgttgtagaatggaaagcagtaacaaacactgaggtgcacattactccttcccttagtgaacaggtactgagaaaatcagtggcctaaggcttttctaaccctttgtcaaaatgtattcattgaccgcatttcaataaatatatccactttaatgccagattacggaatcataaaatttcaaaaatggtttaagccttttgtgatctaaaaatgaatcaacagcagataaccactttctaaatgcaaaattgagattagtaaaatttaaacaaaaaactggctgctacctaccacataaatcatcaccatttaatacacttgaaaattctaattatacattttaggcatcttcttacttaaattactcagttaaaacttaaggaaaaattagctaattgcattttagcattatatggaattattattttaaatgaatcaagtgacaattaaattatatcaaaatacttttagtatagtaatatttctattataggatattatataaaattttatagtagatttatatacatgagttaagaaaagacttaacactaagtattgatttagt

SEQ ID NO: 42468 - DNA, 712 bp, Bovine  19866882184731
ttttgatattgatatgctattaaaaaattctctttccactgggctaagatctggaaagggttgctgttcttatgtctagtgatgtgtttgtggatatctgtgcatattagtatacatatgggacttacaaattttaaatctctgtggcaatatttctgtaacacttttgtgacttcagtcttaactagtcacttaagttctaacaaagttaggcaccaccgtatttatagactattagaacatgattcactaaaaataaaagttagtgctatgtacacagtctctagcacttacaggtaaacagaagaatagatctagagagcagactgttggaataggtttgcaaacaagatttggagccacaaatgcatcataggctgttctacacagatcaaaaataatttaggttaggaagttgtggatcataatatccatatgtacactaccatatgtacaaattaatgtgtacaaacaataccatatgtagacgtgaaatgtgacaagcaactcaaacttttctcagtatgtagaggtaaatgtgagaagacagcaaagtgagaattggttaagctttattttaatgacccaactttgcttacaacttgtttttaggatagagcaaaagatacatggcttaaaatcagaattgtgtgtaaatttcaaatatttttatttagaaatttaatcctacaaaaatgttcacttattcaaa

SEQ ID NO: 42469 - DNA, 1169 bp, Bovine  19866880426079
aaaaaacttttgaggttgggtggggtaagaagaaggactcatttttacacagagtcaagctggaaatccagtctccaaatctgcggaaggggatcctttagaatccctccggagctcactccctgacttcagaatggcccccttattggttctctcagccccgccccctgctggagagggccgggcttgagggcggggccaggctgggggcgggtcctcacctgctgtgccgcccgtcgccttgacgaccgcgacaagatggcgaacctgacgggcacgattaaggggctgtaccccgaaacactgagcccagagcagctggagaagctgcgcggcttcaaggtgggtgcggtcccaactcccgcctccatcggagtgcagctcctccccgggtgagggccgggccccagagagaagggactcgggagcctgtgcccagataaaggggcggaaggctgcgggatggggacatctccggcgtacccctggcttctgggtccttgaacagatccccgcaggctcttgaaagtgcaaaaagaactaaaataggaatgtaccagaaaaatggaccgaattgactgccggatactttaacttagatacaaacaagaacttcccaacggtagacacccgactttagttaaggcgcctaagcctgagcctgagacagcactggagatgttaataatctgtaagaagagagatggcttaactgttcaaacatcctgggaagagacccgggttaagggagccccttgtttccccaagccctctgcacctccgcctggaaccctgaaatctttctcttcatggagggtgaccttttgctcttgacccccagattcaaactcggattactaatgaaaagtaccttaggacccacaaagaagtggagttgctcataagtggtttcttcaggtaggtggttttccagactggccttgagtaaatagtgtaaatttttaccaaatctcgttggggatagatgagtgtgagtcacgtcctctttgtttaaacacagcttgttgcttcctttagggtctgaagattagaaaatatcttaagatggaatgttttctaatgctggggcctgtgacacccaggattttcttgttatttctagaggcttccttcagttatctcagaaatattaatatgcattcatttta

SEQ ID NO: 42470 - DNA, 2035 bp, Bovine  19866880489262
ctgatatttgctgtgcaccagtaggatcctcatcaggcagaaactccctgatgtacttttgtagtgcttgtctgtcaataaaaaagacaagaccatctgagctgtcattggtgagggatgcactcgactggtttctgcgggatctctgggcttgctacactggctgtctgagcttgattttgatgcttcccttgggttacgtttgtttgctgcagcatcttctcctgcagggcctcgtacaggggactagagtgttctgcacctctctccaccaaacagagttcttggtctctctgcatcctctcttcaaggcctgactcagagactgaaggatcatgttcttttgtagagagactttgttctcctgccagctgttgggggctttcagtctcctcctccagtgttgcagggcatgtcttttgggagactgcattgttctcatccagactttttactaaatcctcctgggcttctagggctccatcttcctcttttttggtacttgggctctggtcctttagctcttttctactgtctttctttgtagggagttgccttacggaaagctgtttggtgatgcctgcatttggggcacctgggatccctggctccagggactttgtgttttcatctctcactatgaacacctgcgtgtcggagtgtcccctgggctccacagctgggcctcggcctgttgtcgctgagccctgaccctcgtgctcctgtgcatgttcctctgtgacctgctcatcctctcctctgactgccagcactgctgcctcctgaactctcttttcctcactcagtgctaagtgtttctgagtttctgggttattactgtcacttccttgcacagaccctctgaatgggtttgtttgactttgggaatccccttgcacaaacagatcacttgtctctgagttgctgtcaccatcctctgcagtcaggctgttgggggtttcaggagacctctcatcattctgtgtggccactggctcagaaccttccccctggtagccgtcatcttccttgaccaacttgtcatgaattttggtgatcatcttatttttttctccagattggttctcaagtgttgtcaactcccatattctttctcttgttcctggtgtcccttctgcttcaggggcatttttactgttcacaagtgcttctgctgtgccttcctcagcatgtcttgcctcttctcctgggctgatggctccttcactttcggaatctttctgttctcctccttctgagtttaactcatgtgtctcagaatcttctccagcattcttttcttttgatgattcctggagttcatgatacttcttatcttctgttggctcttccagagctggtggctgagttttttcctcaatttgtttctgccctactgtttgatggacctctggacctcttacacccttcctttcaactctaaccatgggtgtttctgaaacatttctgttctcaccttggactgacaagtcccttgtttcatattctttttcttgtatgggtggttctggagtctcagctgttctactctcatccttggcagcagctgatttctgtgtctgagatggtttccgagcagcagcttgttttggcaggtcgacatgttctgaactgggctcatcttttccctgtactgatggttcttgtgatttagggtgtcccttaacacccttctctcctgcaacttcctgatcctcagatgatccaccaggcctctgtgtggtttcttccagtggagaatgcaggattcccaagctcccttcctgttctccaaaccgtcctcctgtctcagtgccactttgtttcctggctagtatatctcccttctggagaatctccttattctgtccctccccctttgtgtgactgctgatctgttctgatcctgccattggcttacttgtctcacgttgggttctactgtcacctgttgctgatacatcttggtccactttctggctctgttcatctcctttcagatgttggttcttagagtcactgtgttcagacgttt

SEQ ID NO: 42471 - DNA, 1310 bp, Bovine  19866880490391
atgcaagataaagcaggaggaatgagaagaggatgaatttaagaggtatcaagggatccccatgctgcctgctcttccctgactgtccctttcctagatacctaacctggggagaaagggatggtggctggtgagaggtgcttttaagcctcacttggtgatacaggaaattgcagaagagaaatggttttctcagtctttctccagtgaggtctctctgcctctgtctcctcacaggtctctgggcctttttcattcccctccactggctgagtgctggcaatgttgatttactatttgcagtgttgggtatctgtttggaaaatgcttagtccaaagaaacagttattgagcatttgccatgtgcaagcagtaagataggtacagaggatacagagagagtagggaggagagggagggagagagactcgaggagcttaaatctaggctggagaggtagacaaattggatcattttcctaaaatgggatttaagtgctacacagagggaagcccaaaggaagggacccttaatccagggaaatagtcctagaggaggtaacactgaaggtgctagaattagccaagcacagaagaattgaaaaggcattccaggtaaggggaacagcatcaacgaaggcaaacaggcgcctaacagtgtgtaagagagtcacagactttcactattataaaagcatggggacttccctgatggtccagcgattaagatgtcatgcttccagtgcagagggcatgggttcaatccctggtcagggaattaagatcccacatgccacatggcgtggcaaaaagatttttttaaaaagcataagagagtgagagagtcctgaacagggctcatttaaggagtagcaggaacaccatttgggggttcagccagaaaacatgttcctgtcccactgcggttcttgcgtgcttccagttctttgaatacagaccctacccctaccaatgggatctggctgacccccaagtgctgagtgtgcagggagggagtacagagggttatcccagcccaggaaggatgggaggacttctctgacctggggacagagctgcagtactcacccttcttcccatgaacccacctccagctgccacccaaggggaagctgcggagcctgtgtagccagcacgtggaaaagctgcaaaccttccagcatctccaccctatcgtggtccaagctgctttccctccactctacaaggaactcttcagcactgaaatcgagtcacccgagggcctgtccaagtgatctggaggagggactccgttctcttccctagagc

SEQ ID NO: 42472 - DNA, 983 bp, Bovine  19866880512733
acggagaagcctggtaggctgcagtccatggggtcgctaagagtcgaacacgactgagcaacttcactttcacttttcacttttatgcattggagaaggaaatggcaacccactccagtgttcttgcctggagaatcccagggatggggcagcctggtgggctgccgtctgtggggtcgcacagagttggacacgactgaagcgacttagcagcagaagtgctttaaatcacatcgttgaaaggaaatttcaatatttgtaaaatttgtaagaaggtcaagatactgggctcttgtgtgctgactcatccagtatggggtagggcagaacagagtcctccctgcagagaccaaagctgaatcatctccctcttccttctagaaaaacaggcttgaggctaagtgctattaatgctcatcagagccttgatggatgtgcctagaagagcttgaaaggaacaggctgaacctttgcaggaagaacccacaatgcaagggctagtcattgattagctgctgtgcataatgtgacaaataggatttttacattgagcagtccaagttctgtgtccggagagttaattgatattatttttccacttttggtcaatcttattgaaaggatgatgtaaaaacattaaaactttaataacaggctatttttacttttatataacctcttccagactttgccctaaaaaaatattggatagctgcagtcagagtgaacataccgtttttcagataaatgggaattttggtgggaaacaaggtgacttcatgttctatggaggtacctttctcacccagaccttatgattccatcatcttgatcatctccctgtcttagttttggcttcccaggtggctcagtagtaaacaaacaaacaaacaaacaaaccaaacctaataatacacctgccagtgcaggagacataggaaatgtaggttgatctctgggtgggaagattcccgcagaaggaa

SEQ ID NO: 42473 - DNA, 2512 bp, Bovine  19866880566584
ttccctacctcctttcgaagacttgggttgcttttctgggtgcctgatgtcctctgccggctttcagaagttgttttgtggaatttactcggcgtttaaatgttcttttgatgaatttgtgggggagaaagtgttctccccgtcctactcctccgccatcttagctcctcccccatttgtgcatcttgtcctctaagtgtctgttcaaacttttgctcatttttaaattgaattgtttgactcattatttggtttaaaaatttctttatatattctgacttgtttgtgaaggattggaccttggaaaataactatttgagttagttccttgtctgactacttgtgagtgagaatggaatgaaacagaaatgagacaaatctcagtatttgatcaccattatttattgttagttttaatacagttcaattatttgaacccaaagggttgaaacaaatatgttacaatcaaagcaagaaattacatagccatggcacatagtcttcctttccatatgagtataaatgatattttcctatgtggaaaagccagtgaaatatagcaatactttgaaaccattgtatttccttgctattgcttttccagaatttttaaacctgaaacaaattcttttgagttggtgggggtggaggagggaggtctttcttgatgaaaccatgtcagagcccacatttggatcctttcatcttgaactgactcttccctgctctttaagaaatatgctctaagacactggctgtgaagaagcaccatctgttttaatgtctcttgttagcttactgattaaagatgcacctaagaataaaggcgtggtggtttgataagcaaagaaacctccagggcttatctttacttttagggccttctcctttctgccaccatccagtatggggcacaccaagaattgtggttcatattgctataagggaagctttggttccagaattggtaatgtaaattttttactctttagagatgaaagcttagctttggcatcctgtaatgagtaaggagctgtcaaaaagacagctaagcctcaagttcctaaaatgttttgcattattcttccaaatttattcccacaccttatttatttcctaaaacagtggtccccatagccttacattctttgaaaggaaccgtaaacaaggaattgagtataaggtattggtagtattggatttagactgtccatagaagggtgtaaactgtctaaagccacaacttgaggagctttctacttgtctgtaactgcttcctggttgcccgtcattataatttttcctttgcccatcattataatttgatggttacaaccagattccctttgaccttggctgcatccttggctttgttgcctacatgtccctgattatctatgaatactctcatatccatcaaacttgctgcttgatgagctacaacttctacttttttttaactttctactctgaccattcctggctgtttcttcttgatcagttggtgtgtgtgtgctaagttgcttcagtcatgtccagctttttgtgaccctatgaaccgtagcctgccaggctcctctgtccatggaattctccaagcatgaatactggagtaggtttccatgtctgccctcctccaggggatcctcctgacccagggctcaaacccacatcttttaggactcctgcattggcaggcaagttctttatcactagcgccactggggtttgagtctatttggggtttactatgcccatcataagttccacttgagcctggcctacctctcctttgcatttcaagttgttcatggcttgaatactgaccagatctagaaccaccttattcagagcaagatgagtgacacaaaccagacccatattgttcagaactagaacattgacccaagccagatccatgttgactctgagtagaacactgacttgaaatcccagagtacgtatattaaaaaggagcctggtacccagagcctgtttgccttagagcacattctcataattgatagcctttgggagtatttctactcccgctcacttacgtggttcaccagaggaataagtaggatagagactgaagcagcttacaggttgctgctagttggggatagtggcctttttatagaaggaataatggtctatcttagggaggaactgccttctctgagatgtcctaattcattcccagacaagcccaactccacctccatctctacctctcaggtgtttaccttctcacttccttgcctgtccacctgagattgtgttagcagttcccaaatctgggttagtctcaaccccacttgccagagtctctggacactgcaaagaaagacctctttgctgttcaataaagagtaaagcattatgcattgataatgaattttgtgggcttttaatcgaagttgagttgacatcagggacaaaatgtcaatgaatcatggaatctgatcttcagaaagaaccctgaagtcatctagtcaaacttttttaa

SEQ ID NO: 42474 - DNA, 1270 bp, Bovine  19866880686776
atggcatttatagtgatgatgatgacacaaactctgttcatgatagatatagaatcttcagatgagaatatttacttttacatcagcaattcaaagcatacgccctagatttgctttcaagggcacatcaattgtttccttctttcttttccattcattctataattgatctgctgccaggaagggggtctatggcctatttatcttgctttaacaatctgtaccctttcttcctctagttacattctagcctctggaagctccttcctggttgtatatacttcctagctacctcatcctcagtaggaacacttactcttcccaaactttgaaaccatggattcttcaggagttttatagatagaaaaatccttctgtcccttttctttcataaagaagccagagtcctagcagtctttaatggcttatggatttatgggcttctctactgcctcttaccctcctaccacatagaattctggtgaacagatagttctaagtgtttcgaattggcctaaacgtcagggagacatcagctgactgaggtgtattttgcagttttgacttcttctacctacaagtaaagctaagctaccaagttcagctgcttctttctcctgcaagctgctcaaggctgttagtggctgaaatagcaaaactcaacccatttcagggctttatgtaaagccagaggcaagttgagtcaggtgcatactagcccagttcagatcctgccagccgtaggactggttccctcccctgttggttccacgacccagcaatctggggccttggctaagctatttgtcaagcagcaacgtgaggtgataagacaggctggatctctattttgagaatgattgtgaagggagggacctttatattaatttaaatatagattctgtggcccccaccctaagaaactctgaggctggctgctctaacccacttctgcatcaaccctatagcagaggactgtacttcagctcttcgtcagtttgaaaagagagtcccatatgccttaattcttataaccaataaatattcacaggagctgatatgtactgggccattagaaaagaaatgggaaaaaaaagtatgaggtagaaagtcagtgcccattctctagacacaacttcaaccataggagaactaacctttaaaccttttgtgaaaatataaaagataaatacaatacagtataatacagagaacactggttcattattaacttcttgtttctctcatactcaaaggcaaacgtcagcaa

SEQ ID NO: 42475 - DNA, 1127 bp, Bovine  19866880804697
tgattctttcactgaatcaacatttattgataacctactgtgcatcagacactgttctagaaatgagggttacatcagtgagttcctgtcctcatacagctagtacattctaggatgggaagaaatataataaacacataaataacatatgtagtatgttggttggtgccaagtactacggcaagtacaactctgggagacgttgggggacagggaggcctgacgtgctgcagtccacggggtggcaaagagttggacatgacttggcgactgaaccacaacaacactatggacagaaataaaaaaagggaagggatgggacgtgctggggtggtggagtgggggcagggacaggttatggtttgtaatcaggtggctggggaaggctgcatttgacggtggcctgaagtttttggtctggccccagccagaggccagacatttagccccatacttcacagtctcttttctctgtgcatcagtcactagtgtttcctttcccatccaagtccttccagtttattcagtaaagcttaggcactggggacacaccgtgaatgagatggatgccttggtggacctttcagtcccaacaacgtgagggatgctgtgttaggacactcagggccctgaggcagcatggagcagggaaccatcctctctggagggtgtcagagaagcctttccagatgagatgggaggctgagtcagcgtgccctctcttcacttccagtcctctatcctggccttctgccagttcctttctttgttgaatgtctccccagatttcaagttcctccccatctcacctttcttgttgtcttaggcttcatgactgattctttcttggcctctatttcccagttaaatgaggataatagctgttgccacccttatgctcccaagaatgcaaaggtgtttcagaagattaagagcatttggggattaaagacactagatgatagtttaaaagcttttagctcctgaattagggcatctacctgacacaatgcattgttaagcctcacagatttccctatggtcatacttctgtttctctgtaggctcaagctgggcatatttgggaaatctgggcataattgcttggggtggtgaagtccctgtcc

SEQ ID NO: 42476 - DNA, 974 bp, Bovine  19866880812930
accccatggactgtagcctagcaggctcccccacccatgggattctccaggcaagagtactggtgtgggttgccatttctttctccaggggaatcttcccgacccagggatcaaacccgggtctctctcattccaggcagacgctttaaccgctgagccaccagggaagccctgaacctctataaagaccatatttccaaataaggtcacattataagatattctgagggttaggactttgccatacctttttaggggcaggggacacaattcaaaccataacagaactttagacaagaataaaagtaaattgagaaaccaatatcgtagaaaatatattctcttccagtagattgagttgaatctattgcaggcaatggattctttgggcttcaggttcttgcttgttttctccttattgaaagtttaggctgaactgagatcaccatttcgaaggtcaaactggtttagtattgacaatttcctatggctcaacctaataaattagaaatatctttgtgggggcttccccagtggcttccctggtggctcagtcatgaagaatctgcctgccaatgcaggagatatgggtttgatcccacattcctcagagtagttaaggccatgtgccacaaccattgagcctgtgctctagagcccaggagctgcaattattgagtcaacgcactgcaactactgaagcccacataatctagagcccatgttccacaagagaagccaacacattgaaatgaaaagtggctcctgcccaccacaactagagaaagtcctcacaccaatgaagacccagcataaccaaaaataaataatacaatttttgaaaaaagaaatatccttgtggtaccctagccagtcatccttccacaggcacaagatcagctggactcctctacttccagggccaactgatcctgggatggccaagtctcctgtcctaaaagctctgtctgtag

SEQ ID NO: 42477 - DNA, 2989 bp, Bovine  19866880850138
gcagatacagggaaagcagaggtacgtgaatccatggctgtacataccgaaatggttagactatgttctggcattgttaacttgaaacttctttcaagttatcacttgttgggatgtaattggctctctgtgagggacctttgaaacaaagtttttcttttctaccttaatgtgaagctagtctgtgaaataaagagttcattttataattctgttgatttgttcccttcagcaacaccagcactgtaagggattctgctaactgttgggtccagtttccccactgcctggacctagagaggaggacttagaaaatgatttgtgtataaacgagggaagttctgagcctaacggactcctcaggcaacttctggccttcattcttctccaggagtcatgtcttgggagaagtagtttgcccagaatctaatggctttcccattttagcatttgaaaacggtatcccagaaagaatgcccatcttctggtctttcaggaccttttagttcccactcagatgctgcttctccttctctttatgattgaaatcctcagtttatcttttacatcaatgtctctttgacagctttgattcaggggaggggaagtaatagctttgggtactgtctaagtctgatctgatgatctgtgcagaagaacggctgacatttgttggggaagatgacatcgagatagagatgcgagtcccccaagaggctgtaaagctcatcattggtcggcaaggagccaatattaaacaagtaagtgtgtgagcaggcaacagctttcccgggattgatttctgctgtccatcctctgcccccattctgtaaaacccacttacactatgtatattttaaacaaaacaaaacaaaaataggaagtttctggctgctattttccttccagagatgagtacctctactccttatagaatgggtgacttagcttgaaatggggatttttaattggatggttctcatcctggtatagtttgaatcattcctgtctgctatggaattatgaactcttattaattggcagtaattaattgctccctaattctttttaccatcttccattattcatttggaatgtcaagaaaactaaataattgattgtttaatccaaatttggggaaataccagtctaaacacagagaaactgttttggattaactgctgttcagggttatctttgtctctccttccgtaagtacatgtaattgaggactgcttacaaaacccgatttcactgattactgtgtccggttccatccacctccagggttaggtttagagtatccttagctgacccaggtgagagctcttccagaacatactgccacatatccttttctctgcagctaagaaagaagacaggtgctcggatcgatgtggacacggaggatataggagatgagcgggtgctgcttatcagtgggtttcctgttcaggtgtgcaaggccaaagcagcgattcatcagatcctgacagagaatacgccagtgtctgagcagctctcagtcccccagagatccgtgggcagaatcataggtaccactggacaactttctctgctgtttccttttttgttccctttgccttcctttctttcacaccttccagagggcttttcctggccttcttccccttcatcttgctgagggaaattgagagaagagctttactttttttataaagccagtggtaaagcaaaactcattacctcaagaagttgtaagagaacttccctggtggttcagtggttaagaatttgccttccaatgcagggaacatgggttcgatccctaggcggggagctaagatcccacaagcctcagggaagctaagcctgtgtgccacactggagagatgcctgcatgctacagctaagacccaacacagccaaaaataaataataaaaaatttttaaagtatgatctgaaccttacaaataggttccacaagggttcaggtaaatgtatttacctcatattaagacttttaaagggaagctaaggatgctcattttatcctaaatctctcaagaccgtgccatagaaagcactttttatgccttctcctagagcattcctcatgctgctgtgagaggcagagaagcgtcctgtgcttggtccagtggtttcatgtgggatgtctgctaatgaagtgaggacgtgaagtctgcttagtggccagaagatgaaagtgacatgaccacattaacttagccagtgtgtagaatttaaataaaatgggtagagcaaataatctagtacccccctgattacagtaaggatttcagtagctcctgttttccattcactatcctacattctgtttagtttgaaaatgagccctgactctcacctcatagtgtatacaagatagtggcatcactaggagtagtagaggaaaggacagggtcttatgtattattcaatacagggagaggcggcgagacaattcgttctatctgtaaggcctcaggagccaaaataacctgtgacaaagaatcagaaggaacattgctactatcaagacttataaaaatctcaggaacgcagaaggaagtggcagcagctaaggcaagtagctaacctgaattgtatctgagagtgagaagaaccctttactccatcctgggtcagtatctgaccatgtagatatcatcccttctcttattttccacagcatttgatactggagaaagtttcagaagatgaagaacttaggaagagaattgctcattctgcagaaaccagagttccacggaagcagccaatcagcgtaagaagagaggaagtgacagagccaggtggagccagagagccaactttatggaaaaacactggcactagcttaaaacaggctgcacctctggcagttcctccccacaaaggagatggtgacgtggctgctgtgggaccagaagagggttcctgggagaaacctaatgatgacagctttcagaggtctgctgtcca

SEQ ID NO: 42478 - DNA, 1700 bp, Bovine  19866880898094
ttactacttggtactaccttgtgggcaggtgggcacagagcctgggtgtccaggaaagttgcttatatccaggagggaattaaaggctagcggaggagtggccacaggagctgctttttcatttatttatttattatttaggctgtgctgggtcttcattgctgtacacaggctttctctagttgtggtgtgtggacttctcactgtgacttctccggttacagagtgtgggttctagggcgtgtgggctcagtagttgtgacacacaggtttatttgcccagaggcaagtagaatcttcccagaccttctgtgtggaactgttgttgagtatcttgccctgtgggtagtaacttgcatcctagttttgattaaaatccaagtgtggggtaggcagcctgcctctggccacctaggacctttggacctggtgacccatttggtggctatggctggaaatggagcaagactcatctgttaaagaccgattactatgaggttggtggtagttaaagagagaataaacttctcaaccttccaattcttagaaaggatcaattaccacaggtagcaggtggggagaagttgtcaggggaactcagagcagtgtgtccttgctcagaagacgaggaagacaaagaaagccccatggagacttgaagtgggttttttttctgacatgattaaaggactccatgcattctcctgttctgaggccctctcttcttttgcaggcctgggtccactgtgctcaaatacagaagcctggggactgccctggtggtccagtgcaaggggcatgggtttgatccctgttcagggaaataagatcccacatgctgtgtggtacaaccaaaaaaaaaaaaaaaaaaaaaacccactaagggctcaggtaaagcatttatgagtcctgttgactgcatacctgagtaagggaactgacacacactgtctcaagtgtgtgggatgtttatataaactgcgctcaaaaacccttttaggcaagcagcagcatttccaacatgccctaagcagtcaactataacctgtctatgcagctacctccctcttttggtgggtttcagttaattctggcctcaaccccagcttcctggctgtggtcacaagcagtgcaatttggatgacataagggatcaggtttagaaacaaaacgctctgtcagtgtagccagtgtgggtgtgcctggaattatgaccccatgcttagaataaattgtactgccatgttccgaactgtgttgaacactttatcgaaccacaaagcctttaggaagggtctttgtctcatgtgatagtcatcttggcttctaacttacgtaacaacacaattaacgagtgtttagaagcagactgagagcttctttgtgtgatgggcaggtttacaatgagaacattttgtccttgaattttatgcttgcctagaaggatcacagaaagtgaaagtggtcttggagataatcatgtccagcctctcattttacagagcgcctgaactgaggcacagaaagctgaagcaaccttcccagtgttagttagggtcctggtctgggtttgtatcgcagaactgtaagaaagcagagcaccagtgtcctctaactcattctaggatagcactgtggtatctgcagctctaagatacaaagttaaatgatttctatctgtttatttgactgatactgat

SEQ ID NO: 42479 - DNA, 1522 bp, Bovine  19866880898553
cctcacttcctgcattggaagccgaagcctcaacccctggagcaccagggaggtccctaactgttgctttcttagtgaagctttccctgactaaagtgcttactgtgtgttagacactgtgctaaatgctttacgtacaacgccttacttaatctgaatgtggtcctcattaagttctcccataatagctggaactttaaagtacttattatagtttacaggtaaatgtatatttctatgcctccttcaaatgactgtaagctttctctgtgtctctttggctcatccctgcatccctagtgcctaactcagtaattaaccgatcttgggcactcagaaaatagttgctgaatgaacaaatgaatgggaaacatttggaaagtaggctggggctttttatttttctctctcaactcactctttcttttctcatcaattgtcaatttaaacaccttattctgatgctcccaacttatctccagtgagttctctttacttaatcatctgaataattgtgtgaaataaccattgttatctctgttttatagttagaacacctggagaaaattatatcttccagtactatcatcaaatgtagggttttggtgggatgttataatgcgttcctaagacggatttactatatcactctcattacagagtgctgggatcagtctttttcaacatgacttgcattgaattcagagttaaagactcctgtaaaatttgttatgtagacacctggattgatctaagtattagataaagattctggtagtgagttggggtctgttgaactggataaacagcattctttacagaattaagatttaagaaagtttatttttgccttggtatgccatgagtaataaaaggtaccatttataaatactatacaaattttaaagcacccacatgttactaaagaaacaaatccacttctgtagttgtagctttcctataggccacactttctttcctgttgtataaaaccctttaggattagatattaactcaaatgccttaagagtcttgaaaagcaaagctgcaagagattaacattcatactgtccctgtgtgagttactgaatctctgagcaagtgaagtctgagttaagtcacgaggggcaggagttgtcccaggaatgaggcgggagaggacattgcaactgcagtgtgtccaggtgtcatcctccatgccggaggacagcactgggccactcactcaaggaactgctaccagtttctgtggggttgggacagggaggtagagagagatgaggctgcagaagcaggcagagccttcaagatcctgaaggaccattaccactcatactattaataatatgccagggggttactctgggactctgggcagcaggagccaaggaggactgctagcagagcagtgacattgtttaattgacatttcagaaagatcatgatggagaccatcaaaattgtattggaattgggacttcctttagcagtccagtggttgagacttcaccttctaatgttg

SEQ ID NO: 42480 - DNA, 1516 bp, Bovine  19866880909701
ggttctatccctgggttgggaagatcccctggaggagggcatagcaacccactccagtattcttgcctggagaatcctatggatagagaagcctctcaggctgccgtccatagaatagcaaagagttggacacaactgagtgactgagtccatgcacacacactcccagtaagcagacaaactgaccttccaaacaaagcatatttcaggggtcagactgagctcagatggaaataagcaagctcaactgaacaacaaagttcttaaatctaagattgaaacatgtggcagggtgtccaggaagcacctggtatgagttagtgtccttgatcctcagaaccatctaaaaaggtaggagctattactatccccctattttgagtaatgaaactgaaggacagagaataaagtaacttacccagcctcagaggcagtcaactgcagaggtgggtaatgagctcggacagtcctgctgtagggtgtgcactgtaatggcgagatgaatttttggcaatcacaggttgctgacctctccaggacaggtctcacagtaataggttagtgcccttgcttctgtggcttagccattttgcattatgacacagcataaagcattaagcccatagttacttcatgttacctttaatgacctgaattaggtctaagaaaactgctagccaacaatgacagaatgcttaaattacttcaatgcctaaaaaaagtgactccatttaatcctcagtcggcatttgaatttaggttcaacctaaatgctcttggggtctgccctggtggctcagaggttaaagtgtctgcctgcaatgcgggaggcctgggttggatccctgggtgtggaagatcccctggagaaggaaatggcaacccacttcagtattcttgcctggagaatcccatggatggaggagcctggtgggctatagtccacggggtcgacctgcaaaaagtcggacacgactgagtgacttcacttcacttaaatgctcttagctgagcattaaatgaatgtggtcattgcctccctttttatcttctcaaataatggctctggacccaaagctagtagccctttcttgagttcaagcaattcaagcagcgagaggggtgtcctggcaagtgaggacgttacttcagggcattaggttcttatgggtgtccctgatggcctctgttggtaggataggttctgcggattgtgtttccagtcatggcagtggagttgtgctgatccgtccccagcagaagcccctttgtgatgtgggctggggtttgtaccatgcctggccaaattgggtggaatccttggttgtggaacagtaacactggcaagcataaggaggaatttaggtcgattggcagcaaacagaactttctccatgcatctgtgagtggaacatgtccatcctaccagctgggtctctaccacttcctcagtttttgcttgtttatcagttaactgacaaattagaaatccatcctgttttagtcttcaaagcct

SEQ ID NO: 42481 - DNA, 1941 bp, Bovine  19866880932333
ctagtggggcgctctttttgagcgcggggaggaaaatgagtgagtgcttagccgctcccttgtgttatgtaatcccgcctatagtacatccgaagccttagtgcgctgcagttagtttacaaagtctcctcccctggctctaaaatttcttcgggatggcgccgtgatttataaaatgggatggggcggaaaaagcttattttcgtatggttatatcctgccgcggtgggcgccatgtttatcccagggactattttctccagattcttagcaccttctgaaaaggagggatattgttgatccacctgctttttctgttttcgcaagttgtcctgctttctttcccgtcagacgcgggattccttcaaactgttaataatactgagcgtttctttgcttgtctaggacattttcagctcagaaaaaggtagagctggaaggagtcttgttagacatttagtccaaatttctttttcgagatggaaactgagatacaggtgttctgtctcggaatagccgtcattctattgcagactgtggcccagccctctgcactcctttagacacctcccacctccgcgcaaaaccccacagacgtgcagtttgactttcaaaggaatttttccatctagatgaagggaaacggcgggggcggagggctgcttcttggcaaacggcgttaaattttgagatccgttgcttttggctctgggatttggattctgagtttgaactacttagcacagtcggtctcaacttcaagatgcataaaaagtaccttgcaggtcgctagaagtgctgtttgctggatacctcagctccaagcttatttggatgggatgctgaggggggtatatcgtctctacatttttaatctgcagtccttcagctgagatagattaaggtaaccaccatattaagagttatggttctagcataaaggtgctcaaactatcatcttcgaacaattaagtggcaatctatgctcttgatttcctcccctttctatattatggttgtaatgtaccagctatgctgaagtatctaaagctaaaggaactgacagaatagagtctcttgggatgaacatgattttgtgttcaccccaccttgaaccagtggtaaaatctggaaaagcagttcgcaaaatgtggcctgctaattcctggggttcccctcaggccctctcaggagagctacgaggtggtaactgttttcaaaataatactaagaccctggttagctttttcactggcatttgcactgatggtccaaaggcaacacttgataaaactactgtgggaaacaactaccatacttacttgagaatgtctttgatgaagcaataaattacatttcaacccttcggtacatgtatttttaacttgtaagaatccgtgaccaaatgggagatgtacataaaccactgatactgcctgcttaggtaaatctttgtcataaggaaaggcacttatgagatttagctgcgagttgctcgtttcctggaccagcatttttacttggaaagaacgactgacaaactacagtttttcacacatgagttttcttgaaagcaaatgaagtgagcttgtcacttcagggaaaacaattgacagtatttgttctcagtgataaaaatttgagagtgaaaattagaatttttaaaaatttgatatcaggtttaacaacttctggtacttaaaagactttccttgcaagtcattgttaatgactggttttttaaaatatattttatggtggaatgtgtcaagatttgggacaggcataactcagtaaatctgtattttcaaatgacttttgcataactcaagtcactgtgagtaatcttcaaaattcaacatacactgatggaatttaacataactttcatcagtagggtttcagattccaatatccaactattgtttaagagactgttat

SEQ ID NO: 42482 - DNA, 1911 bp, Bovine  19866881095024
cagtgctgcttctctgtcctgcccctggctcttgggtggctgcaggggcaccacggccagactcctgagatccacatactccctcaggaccctcactcagtgtctcgaaacaggcctgggcgactttgaacactaagaccaagaattccttgaattccactgtccctgtgtcatcttcgtccagcaggcgcaggacttcatccacagtggccggatcatggggtttctgtggagaagatgaggctacgtcagtacccctcctttgaggaggacaaggtcaggccagtcagctaagcttccaggcatcctacctctgggcctaagggcccaactgcttggcaccccccacaccacacacacacgcacacacacacacacacacacacaccctgctaccacagaagcactaacataaaatcactgtcattgagtccagctccctcaagggcaggaagcatgctttgtgttgtatcctgtgtgttgggcccagtttccggtctacaggagaactggataaagatgtcatgaagaatggctaaatgactgagcttgtagattcttcaggctgccctcaggccctggaccctggcatggaggtgttttttttctccagcgagcacaccaccaagaaaagctcagcaggaagatggccccgtgggaattctgtgaggtcctcactgaggagctcaggtgttttcccaagttggggcatctggtgggttgccctcagtgtgcagaagcagcaccctgctgtgcccacaccttcctgcccccaggactttcaccatcccggttgctttagctgtacaccaaaggcagggagagtgagggaagtgcatcagggctctggggctgtcttgcaggaaggggctcccagagtctcccctagctgctacacctcacttctgatgcgacctctcagctaatgtattggagcaactgcttccagccaagcacaaagccgtacttcttgtgaatgctcgttactgatgatcacacttccggtagacgtagacgtggccgccatatcagatttaagaagcagcagaaagtaacgattgccatttctagaatagtcaaaggctccgttcctttctgagctgtccctttagtgtcctcttactctgtctccaaattagaattaattgaagtcaaggtatttctttaaggaccaggcccgtgaccatccctgctccctctcctgctctttctctgctgcgcagcctccattaggactggcgggcctgggtgtagcggcttagaatcccaagcaaatatggccattctctcttccctcctgctccccacaccccgacccgtgcgtctcttaccacgatgacatcagcgaactctttctccaggagccttttgagctcccctctttccagcactgcgcaatcgccctccatcctggcatagcgcctgaaggcttcgatgatcccattaatgtttcgaagtaactgcggcatctttgagtcctgctgaggaaagaggaaaagccccagcttgggggatccataatcaacctagctgtttcctagagagcacttttgcttctaagtcctttctttgcctattcagctctgctttgggcccctctgctgtgtcttccttggtattgcctacgtaacgcgttttaccaacgggcaggaggagcaggtgtggttgcaggcagggtctagatgcggccccaccgcctccctgtcaggtgaactggggtgggctgctttgcctctccatgcctcagtttactcactgcgaaatgaaggcagtattattatttattttatacgattattatgaagatttaaagagatttttcatataaaacacttggcagatgctggtaagactaagtgctagctattaaatatcactagcaggttattatacccacatataatttgtgca

SEQ ID NO: 42483 - DNA, 3637 bp, Bovine  19866881133331
gaatgtctctccctggcctttaaggccctcctatcaggccttccttcactttcctctatttcctgcacgtgcccccactctagccagactggacccctctggttgtttcactgagcgctcttctaggcagtgcagaaacaaaagtggagatgacgcggttcctaccctggaggagttcactctcaatagaatgtgagctgttcccttgactttccagacctttgctcctgctgcttccttgttctggaaggctcttgtccctcagcctttgtcccatgtgtacctcaaggtacacatctcaaatgccagatgctgtgtgatgacctggggggtcttgtttgaagaggctgccctctctctgatctctcagcacactattctgaaccctcctgtagcactacctggaggttacttggcattttggaaacttacccgtttccttgtgcttgactgtcctttttttgaggtggggctgtatttatctttttaaaatcaatccctcatatcttatatagtgacttacacctaatttgtgctcagcagttgtcaagttgaattgaaggaaaagaagggaagcaaaattgtcgaaacttggaaggcaggggcctcctgggcaggcagggcagctgtagccacgaggctatgttgcagaaccctggccttggagccacacgacctggggctcctctcctttatttactcacttcatgaacttgggcaaatggtcaaccttttgaaagctcggtttcttcctgtgtaaaacggggcacagtcattgctgtttcacggggttggagagtgaggtaatatctgtggacctgctttatgagccataaaactccgtgggatgtgaaggcagtctcagctgcccagtgggccggccctgcgggtgtcgtcacagcgtccacgggcctgccgggccaacagctgcctcacgtctgtctgctcagctttgtttcctgtgctctcttgccccacccgtggcaatttctggttgctcttcctcagaaggttgtgggtgccacacctgtcccccacacgtgagaccctcagggacgaggcagcgagctcttcaaccctggcctggccttggttttgtgaaatgattgtcgagtgaatgacaagcttcacttggctacagcactcgctgtctcgtgagctgatcattccctaggctccttgcttctggccccggatcctgacttgaaggagaatcacaccggaaagggtccttggcaggaggcctctggctctctgcccgctacgacaggtgtgtctcaggtcatcggccgacagacagctcaggacctgctttacctccaccccgtgccccttgttgttttccagagaaatgtttttgaaaagaccagacaacattccagaatttgccgcaggtgagtaaggcagcatccctttggggtgagtgatcaacgcgcaccaggagtgttcctgtgaactgcgacttggacaaggcagagcctgggctaccacttcacccgatgtctcccaagggagctttcttcaaaacgctctttcctccatgttatttcctcagaatgaggacagataagaaatgaggcagaacttcctcgtggtaaagatggttaagaatgttgagattcccaaagggacagacaggcagctcttttcccgggaatcttaaagcagggttctcagcccaggctgtgcattaaagtcacctggggagcttttaaaaaataccgatgcccgggcccaccccagggttttatttaattagtctggggtggggcctggcatccactgttttaaaggctccccaggtgattctaatgggctccgctgccctgagagggcttgaggtcaatggtatttaaagggaaggggctaggccgactgatttcttaggtccttttagccctgggagtccgttacagcctcacaaggttcctgattgaatctaagtacgtctttgctgccacagcagatgctgcctctgattcacattatgccgggtgtataaaaatcctcctttgtcgtcatcctgcgagagcctggccctccttggagaggatattctcagagagggcgtgatgtctcagacaggagccggcaggccgagtggagacaagaataacacttggtatttatttgggccccaagatgggcctggagcagaaagccagagactcgtcaaccctctgacggcttcctgtgcgtcagcaagctgataagccagtggcagggtggtgtggtggggaccggggccaccccgtgtcccccttcccgggaacactggagctggaggctcagaagtgctgggggtcggggcagtgcagatggtgaccctggaatttgctgtgacatctcatattacatcgtaaaactggtctgcaggaacagtcctgccaagacagagctgtccctaactttttagcagagtgagctgtctctcccctcgtctacttccccttagatttagatgatttcttctttttgattctcatcccagactatttcacggatccaagacttcccaacaagattcacatgcagctaattaaggagaagaaagcggcttaattagcaaaatcacgatgctcagctgttgagagagaccagaaagaatccagcctttggtgggtgttaacctcacttacagacagaggcttcttcactcctgtgaaataagcactggctcatcggcctggggtgtgaaagaaaccaaacagtctgcagagaagtttctgcaagtgttgagttttcctgacaccaccttggggaattaggggctgtgaagagaggcccagggtttgtctggcgtatctgtggcagagacatccgtcttcttaatctagtgacgtggttgagagtggaagttggagtagttctggaggaaagagaggcagggaagcgggggtgggatctgttgccacaggcttcctgcgagctcctgtagtggccttttccttgtgtccttggtggtgggagtggaagggcttccccgctgcttctggaaggggtggaggccgcttccctcgcagcatttggattgggcatgcccccacccccatcgtcaaaccaggctaccctgtgagggccagcacacattttccaggcaggcttctgaaatgatgtggaaggttgggagttttaaatgtgaggtgggaagaagccacactcctgatttagcagcaccatttcttttttttgcagggtcatctgaaagccagagagctgtgttgccctcagtgtgggtttccaggctgccctgggctgcgcctgctgttgcaaaggcttttaaagatactcattaaaagcagaccttcctgtgctctctgctttatttcaatcaggaggaggaagacatccttcacgggaggctgctctacccctcctctgacctgggaggtagcagggcctgtctctgtgtccatggcagaggcctctcagttcagccagtgggctggctgcccgcatgtgctccctgcccctccagaccctccctcccagggccaagactagacagaagaacagtggcgagtatctggagaggaccacagctggccgtggtggtactcaaatgaacggagtccccgcttccgaggtggcttttgttttttatcttacctccggggttactgtaccgagagtacag

SEQ ID NO: 42484 - DNA, 1275 bp, Bovine  19866881152257
aatgaaacaagataataccctttccccttccttcgatgagtctaaaaccattacttaactgaaggtgcttaaagaagaaaataaaaataaaacaatccgagagtagagaaggagggaagactgggtttggtggtgatgaatcagggctttagacccagaggctgtctccttcctaactgtgcaattagagactcaataaaaggtttgagcacctcctgtcagctcacagccgctgccccacattccacttgctctcactcgagaacaaggtaagtctcagagactatctgcttgaccatatttagaatctcggctgctattcttgtgtgagattgtatgagaatgtataagaattttagaaaaaaatacactcttaactctaggttgatgattattaataataataattaaattattaataataataataaaatttcattttaaaaacctataaactatttgtatgacataggtatgaatacaatttaataagacacaggactcagacctatattaaaatatagggtcatttaaatgatggataatgactaaggggttgagactctgttttaccagtgaattcatggagccacatttcttggtaaaaacatgttgcttggcctgcataaatggaggctgattttctgtgttacttctctttcctctggaagtttttcctaacttaaaagttatactttcctacaatgaggagctagattgagccaagggcggaggaaaacaggtggccagactcagatgatgctgaaatgattagtaccactctgttggcttcatttgtacattttagtacttacatttgagttctttttctactctccttttacaataaagctttccctgaacacatgagtgtctctattttctgcagggtagggagaagtatctcttctaatatttatctatgcaaaaatcctatctcaccacattatctggcacaaattttaagataaagaatagaataaatgatgtcagtggagctgggggagggacagaaggaagggagatctggtatctccttcctgagagatctatcctaggaagtgagctttgtttgttctttctcacagtctcctgagtttgtaaagatgcctcagctcctgagagacatcctctgtgtaattgagacattccacaagtacgccagggaggatgcagcgacgctgacctgcacagagctgaaacagctcatccagagcgaatttgaggacatttttcaggtgaagtgctcatggagctatggaaattcttctccat

SEQ ID NO: 42485 - DNA, 981 bp, Bovine  19866881194726
acagagtcggacacgactgaagcgacttagcagcagcagcagcagggtatcattagtttttatacgactcacaagctaaaaatgctttccacattttaagttgaaaaaaacttgtgacatgaaatcatgaaatttaagggtcaggtcaatcagtaggttttattgaaacacggcagtgctcatctgtttatacagtcctttaatgctgtaagagcagaggtgagtagcccatctggtctacaagcctataatatttaacacctgatcctttacagaaaagcttgccaactcctcctgcaggagagcactggccccaaaaacatgtttcacccacaatgctttcttccctctgtggtgacagccagctcctgcaggaaattagccctcaacaaattccacctcccctgcaattccatagtctcagtcacacctctgatgaagcgagataacctggcccaaatcaggcatccagaggaagcatggccacagaatggatactgactctgctagccctctgagtaacacctagaacaaagcatgcagcataataacggttgaatttggaatcatataatttatcatttcccaatagttgctaccactccttcccaattcctgatgatcatattgtataagttgtaagcctatgtgacttcacccagcttcagtgagacttgtgctatacatttacaacagatggtgtgtagagcaaggtcctcaaggacgacccctaacatatgattcagtttatatccatgtgaaatcacgtcctctgaggtaaacacgggaagagaaaggacagatcctaatcctgtgaaaaaatagaagtggtcaatgcagatcactgcagtcatgagccttactcctctttcaattcaatttggcaaacacttagggggaccttaatgtgacagccaatgtgctgtgtctataagcaacatagggatcatatgagtgaaactgttagtcactcagttgtgt

SEQ ID NO: 42486 - DNA, 2453 bp, Bovine  19866881268468
tagagctttcgtcttttccggatacatgcccaggagtggaattgctggatcatatggtaaatctatttttagtttttttaaggaatctccatactcttttccatagtggctgcataacttgcggaatcttgcacagtgttttctcaaccagatattctacaagggtagggaccacgtccagttcatcaccaaagtcctgtcatcaaggctctgtagtctttagcccatcacgttaatagtgattgaatggaacatgaagcccagttgcttaggaagcttttattgatgtgttaggatagacgaggcaatggacagacagcagaatctataaaagtaactgaaacccccccacaagctaaggaaaacgtggcacaaagggatgagttgttgcatgtcttcttgcccctgctcagcaaaggaggtaagagagaaaaattaaggatagcaatcaccttgcagaaatggcctcactgagaaagagctaagagcgaagtaccaccatgaagagctaatgttcagggacttgctaaccggactggccagggcacagcaagccaactgccctctgctcttctctgtgctgggcactggagtccagggctggggcactcatggcttgctgcttttgaagtaagaatacagtcccctggctgtgagtcctcgcttcccgtctggcggggctgcctcccggccttgtgctgaagggacactagcgtgtaggctgccctggtcctgccttcggatcactgtctccctcgtgtggtcatcaacccactcctgatgaaccacagtgggatctctttctccctggcctcctgtcgcactggacggtgggtgagtactgcttctgtcctgcctgcccgtcacagtgctcgccccagtctgggcctgccctcccagcactgtctctcctgcctcgcagttgctcacctgtgtctgtctttgactactgcctgactgcctctggggctggccctgttctcctgccccggtgtgccttgtaatctggcccctgtcctgttccatggcctggggggcacctccctgtgtctgaatgtgtcctcctgtcacaacctgccttgtctgatacctgtcttgactgtgagtctcagtccctctggtggactcctgtggttgcgtgctgacacttcctgtctgatggctcctgtcctgctccgtggtatgagtgtgtatctgggtttgtggccttgtctctgctgtctgactgtgggtctcagtccctctggtggactcccgtggctgggtgctggcgcttcctgtctgatggctcctgtcctgctccgtggtacgaatgtgtgtctgggtttgtggccttgtctctgcctgaatgtgtcctcctgtcaccacttggcttgtctggttcctgtcttgactgtgggtctcagtccctctggtggactcccgtggctgggtgctggtgcttccagtctgctggctcctattttgttccactgtctgggtttgtgaccttgtctgtgtctgaatgtgtcctgtcaccacttggcttgtctgcctcccactctgactgtgggcctcagtccctctggtggactcctgtggctgggtgctggtgcttcctgtctgatggctcctgtcctgctccaaggtatgagtgtgtatctgggtttgtgaccttgtctctgcctgaatatgtcttcctgtcaccacttggcttgtctgtctcccatcttgactgtgggcctcagtccctctggtggactcccgtggctgggtgctggcacttcctgtctgatgactcctgtcctgctccgtggtatgagtgtgtgtctgggtttgtgaccttgtctctgcctgaatgtgtcctcctgtcaccacttggcttgtctgcctcccatcttgactgtgggtctcagtccctctggtggactcctgtggctgggtgctggtgcttcctgtctgatggctcctgtcctgctccgtggtatgagtgtgtatctgggtttgtggccttgtctctgcctgaacgtgtcctcctgtcaccacttggcttgtctggttcccgtcttgactgtgggtctcagtccctctggtggactcccgtggctgggtgctagtgcttcctgtctgatggctcctgtcctgctccgtggtatgagtgtgtatctgggtttgtggccttgtctctgcctgaacgtgtcctcctgtcaccacttggcttgtctgactgtgggtctcagtccctctggtggactcccgtggctgggtgctggtgcttcctgtctgatggctcctgtcctgctccgtagtatgagtgtgtatctgggtttgtggccttgtctctgctgtctgactgtgggtctcagtccctctggtggactcccgtggctgggtgctggcgcttcctgtctgatggctcctgtcctgctccactgcctgagtggcacttgtccgggtctgagttatggttccag

SEQ ID NO: 42487 - DNA, 1810 bp, Bovine  19866881343043
ttctcctcggtaaaatatagcatttagggatctgtgttgagtacgcatatgtcagcaacaggaaccagaatgaatgcatgtctccagttcctattgagactcttcaggagaagatgccagcctccccttcaaccactgctctaaaccaagggtccctatcttctgggactgtggaccagtacctcctgtcagatcagtgatggcattcaattagaaataaagtacacaataaatgtaatgctcttgaatcatcctgaaaccatcccccatacccattccccatctgtggaaaaactgtcttccacaaaaccagcccctggtgccaaaatgtttggggactgctgctgctgccgctaagtcggttcagtcgtgtccgactctgttcgaccccatagacggcagcccaccaggttcccctgtctctgggattctccaggcgagaacactggagtgggttgccattgccttctactctaaaccaattcctaacctttttttttgagtggtatattagtctcgattcaatttcatctgtttcctatccagtagtgattttagttagtgtaagccaaagctactctgttcttgctgaagcatgccttccaattaagcaaaattcactgggctcctcttcagtaccaggcattgggccttgatgagacaaatgcccccagattattatacctgaatataatgatctgacaaatcctttcctttcttttaagctattcacaatgaaaagctcttcctttcccactgcacctcagactgtgagagtagctcttctgtctagtgctgccaaaaatatatcagatccccaaagtgattagtatatactgttacttgttatatatacctcaaggctttgggtagcttgtatttgggtagggcaactgatgttgctaccaaagatgcaaatgactttgttatgatcaataacaagttcagaactttagtaaagaatactaggaattccctggagatccagtggttagtgttcctcactttcactgaagcggcctgggttcaatccctggccggggagcacagatcccacaagccatgctgtgtggccaaaaaaaaaaaaaaaagtgctcagaagatgaaattcattaagcagatttctaaaccctagaatgagaccaagcaaggtctagtgaagcttggagggttgaagttcttttattaatgacgcttgactgtggctgttggtattcagccatgtccacatggaagagtcccatttaccagcgcccgccaccaccgccaccaagagaagtggtgagacatctgttctctcagtaggtgctttgtcagttaaacgaaggggcactgatcttgcttttccaaatgatcagagtttttattcttcattatgcaaacttagcaggcaactagataaaacccctcattcagagcaccagtacctgaagtgcctgtttccatcagcaggaggaaggccccaaacctggggtgaattggaaaaggattgaatggctgagctcttccagtcattctcaaaagactggtaattcatgtccctgaatgtagccttggggcaactaagccgtgtgggttacagctactgagcttttgtgctctagagcctgcctgcagcaactaagacccaatacaaccaaataaataaatgaataaaattttttagagttaatgtgtattgtttctttccatcctttaataggtttcaacagacttcaccaaaatgccgtctcaaatggagcacgccatggaaaccatgatgttcacatttcacaaatttgcaggtataaaggtacttaacaaaggaaga

SEQ ID NO: 42488 - DNA, 851 bp, Bovine  19866881497021
gcgtagtgcagttggccttccttatccgaagatgtggaacctgtgaataccagatggccaactatattcattttttccataaaaagttctttaataaaaccccccccccctatttacatctggttctaattattaaaaaaaataaaaaagttaaactttaaattcatcttcatccacagaaagctgttgagactggacactagacttttctgttgtgctgatgtctcattggacaggaaccccctcctgcttgctgttccactctgggtgtctgagtttgttttgcatgtttggtttaaatttatgaatttgtacaaaaagcttagcgaaaatgagaaaatattgttttgacttcccagctgaatctgaaatcagaatgaaattgttcatgcagctagtccacaagctttattaaaattagaggccccagaggcatagttatgggcttggaaataatatcttcatctgttggcttctataaacagcaaaagaatgtcatccctcaagattcactctgcatgacttgtgattccttcacatgtgtatacgtgcattaatacattcgtcaaacatttatggagctcctggtacatattgaatattttgtaggctctgaaaacacatggaaagacttgggccctgaagttaagaagttcacagtctagtaggtaggatagatgtttaaagcaagtagttgcagtgtgctgctgctgctgctgctaagtcacttcagtcgtgtctgactctgtgcgaccccagagacggcagcccaccaggccccaccgtcccttggattctccaggcaagaatactgggagtggggttgccatttcctcctccaatgcatgaaa

SEQ ID NO: 42489 - DNA, 819 bp, Bovine  19866881791023
tacttatatcttttggtcttgggcctcccaaagttcaggacagacataggcaccctcagagtgtcatttagcaagtgagacaaaattcatattttatggcaagacaagaaaaatataaacataaaattcctctctgccctttggcttcccctctccccacactatggtgtatttgcattgtgtattgaccaaaccctcccccatgagcaggtataaatggcaacattctcctagcaccaacaaggcaactccttaagagataacattacttcttgatcttttaaggggtcatatgacccaccaggatgttgcttagagctgaattatataaacagtcaataatacatcatttgggaggtgccaaacctgcatacagcccctgacccactccaggggcagcagtgagcaggggaagctgctgtagtggaaaaaaaaaaaaagataaaaaaaaataatacatcatttgatgttcaggcaactgtctcaaaaatttttacataaccgtgccttgatttctaactggcagaaccgttctcagaactttctgatatgctcttctcaggttataatcctcaaatttgccttgaataaaattttctaattatttcttagattgactgattaatttcatgagcaatcgccacctcacaccaatattcatcccactctgtggtgggctcttctggtaacttcagtgcatgtggggggtgatcacaacaccaggatttctgggggaagtggcaacaactatttcagaatttatctctcattcgacattgttcttcacctccatctccaggtgacttctttttaaaaatt

SEQ ID NO: 42490 - DNA, 1249 bp, Bovine  19866880350507
gcttgaagtggttttttgaataattcaagggagtattttctgtattttgcttccctttggagttcgtatgtcctaaagggaaaaattcaaggagtaaaataaaggaaaagtctgggcttgctttatcccttatgaaataaaggaatcaataaatgttggttgaatgttgaatatatttgctatactcagaagttagatgtgtgctacaacactttaacttgggagatagaaaagaaatgcaaaggtcctcttggtttttcagatatagaaatagggctagcctatgggtgccttaaaggaacatatttttgtgctttcaaaaagaaaggatcaagtaattaaaatgtcttatgcaattaacagtattttaggagtatatcaatagttctatgaattacagtaatcttctttctcagttccagtaagtttacccaatgataagtggagccacataaccaaagagacagataatttacctatggctcagaggagagctacaagaattgtctaataaccagaaattgttttgcagaggaagggataaaatagcaggctttttatcctgaggaaggacttttaaaaagcatttttgaaaactgcacagagaataaatacaattgaaaaaaattctgatctaattcttttatgcgtcatatggaatcctaggaagaatcattgcaataattatccaaagtaatgttcaatgtaacaaaagagatgtttggtcttaaatgtatatgcatttaagtgtagaatgtccaaattaacaggtcaaagggaaagtattaatatatgtgcagtttctaacagcaaaaaaataggctagtttgtaaataccgtattcttcaatgaagaaaacaaaaatcaagaataaaatgttggatagtcttatcaaccaggtcatctttaaagacagcttttcaagatagcaaaaatgtgcaacaattaagcttgactcatgtaactaaaacattcgttgctatactagcagcagtactttttttaatagagttcacaattcagaacacaaccaataattatatattagtatcagtaggaacaccaaatattatctcacaaccgccactaggtatttcttcttgtctgacacagtctgcacagatccaggcttgctgcgtttgatacaattcagttcgtcaacgagcttctttcatgatgtgctgctcctgaatctggctggagacagattttggtagatattggtgatgagagatacgttttatgtgag

SEQ ID NO: 42491 - DNA, 1380 bp, Bovine  19866880398573
taggttgtggttaccagggccaggggggataggagacaggggagtgactactaatgggtttggggtttcattttggggggatgaaaatgttctaaaactggattgtggtgacggtctgtgaatagagtaaaaaccactgaactgtacactttcaatgggtgaattacatgctatgtgtattatatctcaatagagctgtttaaaaaaaatagagctctaaagccagactgcctgccttccagtgtcagcacagcaatagctgtgcaacacagggcaagttatttcacgtctactaaatttttcctcatttcccctatctgtacaaaggggacaatcatgcaaataaaatcactggattgttgtgaatattacaaaagagcacatgtcaagtcctttccgcagcgtccagcgtatactgtgtgctctgtaagtgtaaacaattggcaaggcctagaggcacagatgagcagcagctgttaaagatgaaccagatgtcaagggagcaggtctacaggcagggaagtcacagaaacggcagctgggccccaggaatgtgcactggatactgaggtggaggttgcctgaatgtgtgctccttgcatgccagaggcccgcccctggggtgcggagaatacaagatgctgggctctggcccccaagtccatgggctccacaggtgtgttctgaggcccagatatgcacactttttgaaagttcccttagtgactctaatcatcagctgggtttaagaataccttgtatgtttctcagagaggcagccaagctcagaccaagcaggcccactgggtacccctagaacccagaacaatggcaggtgggagctggggcagggctgatgatgactgtaggagaggttcctgtgcccactgaggaatgaggtagacatgggagagaatgcacttcaacagggtccctacaccctaaagacatccttagaaggcctttgaggttgtcagtagaaaacatgcaatcagcaggttcatcctgcctaaggagaagtgacagctttgggaaagaccagatgacaaactagaaaacagagctgcagtggcatagctcttgaatgtgattgattgggtctgaattgtccaagaggaacaagagccacgcagtatggctagacatccagacttatatttttattaagggtgtgttcttccgtatgaaacatcttctcacaaatttcctactgaagaatcaccaggtactagttcatcggggtctggtttctaaggagatcattacacaaactattccacccgaagaattcggctaccattggcactcctaacacctgttatcatatgagggtggttggcaataagaagtgagccttttatttgtaacaaactgaacata

SEQ ID NO: 42492 - DNA, 1259 bp, Bovine  19866880514933
ctgtgctttcctgccagggcctaggttcgtccctggttagggaactgagatcccacaagctgcatgggaaggccaaaaaaagtaaactttttcttctgttatgtctatatgaagcaagaaacaagtttctagaaggctgtgattagcaatgagaagtctgaaacagggggaaagactggctatggtgttagtagctataagtgttagtagcatagactatttgtagtgaggaaggctgattattaggagactagttaaccactgagagactatattaatagtaattttgtaccttaagtgtgaaatatttttacctttcttccctggattatgtgttttttgaaaccacaattttatatagtcaaaacagcacaatataaggaaaaaactgtttagaagacatctgcactcctaggtgaagacgctggggagtgggttcataggcctcagaggctctaaggtagaatcctaaaccagggccccagaaagctgctgaggccgagagaaccaccttctcctctgtccagggtgctgcacgggaccggggaggggcccccaaactgctttagagtattacatggcaggacgatgctctatatctgcagactgccgttatataatacagctaccgatctgtgcttttaaaagacttaggtctattcggagaccttatcctactgaaaatattcatagtaagcattttttatttgtttgtttttagtgcctcagcataattcatttcccggacacttccagcatcactatcttctcgagactgattttaatgcttgccaggaactataagcagatatgtttgctttcatgatattcagtttatttgttttcagacagcttagacgcctcatttctagtggtgctgtatgtgcatatacataaatatgtgtctgtcaactcaattttctccttggaactttggactgggttgtaacagctttgattgcctccagaaagttttgctacagctggagagtttgatgtggctatgagaactcttattctccaatttctctctttggccttaggtttaatgttctctagttctttcacacatacaaagagggcaggggcaatctcttgtgattcatgaaaaaaaattttttttttttttgaggagcaaccaatgtagaaaaagaagtatatgttgactaaaaagagtgtgtgtgtgccctagcactccttcctactgcaaaatggggactccagggtgttttccaaagcgaataacctgttctctgatt

SEQ ID NO: 42493 - DNA, 673 bp, Bovine  19866880552458
tccagagcaagaagaaaccccacaggtaaacattctctgctacctctgctggccccttccagggctggcatcacctccttggagtggcagccatggggctgcccagcctggcttctccagcacaggccctgggctctcccaggccaagcagcaccaccactggacagtctcccttctgcctgaatgttaattccatttctgccccatggaggtcaccctgaactggtccagtttcccttccatggacactttgccaaatgctttgttccctgaaatatccttctccaggctaaatactctcagacatcttctaaaatcattcctctcaaaaggtcattttcactcttctcctgatctctgggtgctctttggctcccacggccttcctaaactgtgacactcagaagggagaccattataggtgggcagctcccatctgtctgttgtggatattgttctcctgttaagtccaccaggcactcaagctatattttttatttctaacagccacatcacccttaagtcttatttcacactcttcactgccaagctgcttatccacaggtgtcctttaaaaatgtcatcttgttggagtcagtccgctgctctgacctctggagatctttctggactctgactcattaatgtaattgttcttcctcctaaatctctc

SEQ ID NO: 42494 - DNA, 1328 bp, Bovine  19866880692890
atggcttattttgtttttatatttaagtatcctgctgtataccatctttaattctgtcagcagatttaaatcttgaaattactcagtatatgtatgtgcacctatgtatttcactttctctctcttaagaaaattttccttctgatatctctcatattttctggtatcattttatactaaacaatctaaaaaatttttaacaatattgacatcaagtagtctgcatcattaactccctttgtccttacccccaacaaatcatgggatggcccgggggggaaggcaagcacatcacctttgcagtagtctgcggggtcctcctgctcctcatcgtctgagcccagaatctcctcctctggctctggtggggcagggtccggcagaggcggtggtggtggcggaggcggcggtggaggcaccaagggagctttctgctgaggctccggcctgaaacaagaggagggagaattcctattgactcagaaggaaatcctgcgtcatgaacacactttagagtttcttaatatggaaaacaatataacttttcacacactaagaggagatgctgattaatgttatttcattttaggtgaattcaagtaaagtttcaaatcacaagagggctacccttggctgtcctattagccgacgaatatttttgcaggcacattttcactcagagtttcaatacttcaattagatatatactaatatcatgaattgtaagtgaaataagacaatcagccccccatgacatgtaatcttgttagttagaacacattcccagagattagaaaaaagaggacaataatcctggacattaaaaaaaaaaaaaaagtttattatccatcatttttaaatcaaaattcatttacccattgaaaccatagaaatgtggttaggattcttggataactcataaaagccaactaatgtttactgtaactgatacatagatattttcattaaacaattcagttatctatcaaccttacttatcaagacaagaacattgttccaaactggaaattaaacaaagaaaacatgtgaatgtagtctaatacaaatacaattcatacatcaatgcaaagtttccatgggtcatttctgattgtcacataaagctaaatatttagtatactctttacagaagataggaaaacctataacactaaaaagaagcaaaaaacttaagaggttacagatgtaaacctttcaagtatctagaatacctcaagaatatattaaatttgctcaaaaataaggcattcataatgcaactctataaaatgaagtttccacttataaaatttaactgcaatttctag

SEQ ID NO: 42495 - DNA, 2961 bp, Bovine  19866880719476
tcttaaggccctgcagagccctgcctactgccctggcccagagttctttcaggcccgtgttaagtccgccttaactccatccctctggaggtcagcacagcacatgctctcaggcttgtcactgtgtcatttaggtgtgactctgtgagtcagtgccctgaggaagagcctgcctggggccaggggcaggcttcctggtaatttatgtctaagacaagcttttaatagagatacacttttaaacagtaaccaggaaaaagattctctctttttaactggtatccatttataggactcagctgttgaagctcaagggtagcattaggcttaagtttaatcttctgtatgccgtaatttacagcactgagtaaagcattgtacgtacaactatttcagtcatttgctgtgataaatagctattgctcttggcggaacagaaacgccatctctgctttccacttatgaatattgaatggtctcaggcaggcttctgctgtaagtttttaaaggggaaatccccactggtcacatctcctcagtggccccaaatgccatttccctgctgtgtgcactagtcagtgctcgattcggaccgcagttctgcggcacccatgttgttcctggtgaatgtcacacagggcacgcccagcagctacgggccccagtcctgctgaaggctgcagttttgcactgaatgcctcgagctgttaggtagaagatttagctagtggcaggaagccaccaacagggatcagggagatatcttagaggcgataatctggcacagggaaaatagaaggggtgtgattctgttggattcctgatggtgagaagatggtgttagctagggaaattgaaactaataggagcaaaaggagacggggaatgcccaggttataaatctctggggataaactctttaggaacacagagacacatatgccttcctccagacctcccttagttcggatgctgtgttccctgccagctgggaggaagcaaaatgtatattcaaatacgatgctcaggtccactgaccagcttgacccagaagttcaagtccaagtcaactggttaccctagacttgggctcccagaaatccccccaatttctttcctgtggacaaactttctgcattggaggaactgaaatctttagattggcatcctttggtgtgtctcatgtgtgtgagtctgcactgggtccttacaagtactccaagtatcgcactggatggtgagataaggactcaagggcgaacgtgagcagagatggtgaacgagtgaaatgctgcgctcttgcctgcttctgaatcctgtgatggagactgtcttccgcagtcacattcccaaatgccacttctcagcagtatctctagaaggtgattcctttgaaaacagagatgagaggcttctgttctcactaccgccttttgagggtgatcatgtatctttagaaacagctacagcatcttgccatttacgaagcaccctctcctagcgtgttcattttgatttgagtaacagctcagtaaggtggactggtaggggctggtttcccaggtttggaagctcaaagaagtttagcaactttcctaacatcacatatctcacctcagtgcatttgccatgaacagagaccccagtgagaaaatacacagaggccaccaaatagtatgtccacaattggagacaaattcaccttttatgaacctgacagtctttgtatttctaattcccagctccaggcagtgaacacatcttctgactctcttatatctctttcacttgagatctgagctttctctaataattatttgaaaaacaatcttaacagtgttgactccgaagaaatgttattcagcctgcctataggttatgatatgccttttcatttcttggcctgaagattccttcagaataaagtcacggtcatttcagcagacattgaaggcagttagttagttgtgatctgcatgcgaataaatccactcagcattctgattagttataatgggtgataagagaattgtacagaccaaaaactccacatacttgtttcatgcatgtaaacctactaatgagaatgggttttggcaaaaatctgagcattgatgttcctgccactggacctcagaattgcttgttagtattctgggaaccagagtgcagacacagatacagtacaacttgatcttgagggcctctctcatctcctggccttcgataagtttgttaaacagggagatgagaggaagcagtctggagagaggatgatacgtaagtggcttaagagacctggcagtttaggactccttggcaaccttgctgtgacctcccacctcttcttgcccatctgtgaaatgggctatgcaccaggattattattcaagatgataatcttgagaacatcttggcatgtgactcatgctataaatacaccttgctgccatgtggaaaatatgagtttttagctgaaatgtataatggggtgaggcagagggtatcagtcactggtagcaggaggattgccagaggcaggaggtgtgcgggaatgaggcagatgcttgcctaaagaaggagaacagagagaagcgtgaagcatctggggcaatgtggtggaatgttcaaacaaacaaacgcaatatagatgtttggatgtctggcctggattttgaaagcagtcagggggttggagatgagcctctgtcttttcaccttgcaggctctgtgctcctgctttggcacacactgaactccagaggccttatctaaccagtccccatgtggggttcagctgctatgtttgaaggctggttgtgttgcagatgcagggaggggttagaaacagccagaccctgcagccaggctgtatgggcatgactgtggctctaccactgaccagctaggtgaccttcagctgacgcctcagtctcaccgtgtcttagtttccccatctac

SEQ ID NO: 42496 - DNA, 1089 bp, Bovine  19866880732585
tattatttttatacagaaggtgacttttgctagagagctgttcctacctcttcatctactgggacagacaagtcactcaaatggctgattcgtccatctcttcctatttcgtgaacgacaaagtcagagtatctgaggaaaagaaaatcagagcattattattttgctgcctattaattttaggagaaagtttgtcaacagtaagccttattgttgtgcaaacaggtattaaaaataaaaactctcagtgcaaagtcatgtagttattttttctggtttcgtgatgaagtctaatccacaccttggcctggtaccaggtacagaaaagaccttctgagcttctagaatactcttccagaaaaatgcctaggtcaaagcttattaatgttgccctatgattacatagttcattctaaagtgaatcatgaaacacagcaaatttaactaaattggaagctagtgtatctaccttgagccaccctgaagcttacctttatgctaaatactttacatacattatttaaagtcctattaactattcccaggtagcattatgacccatttttcggacaaggattctgaggctcaaagaagttaagtaactatgaagtggctgaactacattcacacccagatccacctggctacaaagactaccttctctctcctgtcgatgtggcccattcaggtaaaagagtttaagattttaagaccaattcaagggaaaactcgaaaccatttaattaccattgaaagtaatatattttaaggaaatacccattcacatactaacaaagcaggccacagggaaattgctattttttactcattttatattcaaatggtttcatttacttatttgggcagctttcctattcctgaccgaccactggtgtgaaaaatccttggggacagaacactaaaaatggaaaaatagactgatttctttttaaagaaaagaattaataaaacaaaaataacttgatacaaaaacaaaacgaacctttcttttaagattcctgagaatccctggtgagaacttacgaacttggtgatgcccacatccagctctgtgagcccatgcttcat

SEQ ID NO: 42497 - DNA, 1518 bp, Bovine  19866880760103
tgactttaagaagagtttggagggggacacacagtaatcacgcagccatgagagcaaaggagaaaagttctccccgcctcacactttctatttgacataagtgattaaaatgcagctgaaaagtctactagcagagagaaaagacacattaataaaaactggataatgagcatattaagattaatgggagaaaggaaggcatttaggaccagcttctcccaccatgaaaggtacttctcctgagtggcatctctgtctaaatgtgaatccacttggaggcagccatgtgtgtccttgaatcacagttgccgttcttcccgataatctcccctgtcctgagtttatgtaattggaagcccacaaatcaaaaccactgccagccgagttcatctttttggtagctttccgagggagtccagtggcactggctctccagccatcatcacacggttgtcacatccagagttcccatcacagtctgtggatccattccgttacccaccacgggcagaggctcacacttaccttcctgcaaaagattcagtgtggtgaaatcacataatctgttttttccattatgttgtgtttttttagagtcagttcaaaagggaaactcaattttaaaagtatatgaaactattgttatactagagtcatatgctaccttgacattttcatgatttctatagcaaccggggtggtttcagaaccctgaaaaagactttgggggaacctgaggccattttctggggctttttttgttttttttttttcaagaaattaaaattcaatattgtctactttgctgtcttccttttccctactgtgggatcttctgagcgagtgcaggcatcactgctgaagctgcccaccccccagcccccggccttcaaaggcagtctgcttccagctgcttctgtgtgcagcctttgcttaacttggccttcccacttgcaaaaggaaggaatccctctttcttaagcgttttgtcttttgaactctcaccagttgttgcttggtaatacccaggtcttgagctttggaaggttccaggggcaaattcaaaagtgcacagaatctagtgtgatcctgcagccacaaaaccagttgtcttcccatcatagaaacaaatcctgtacaaatagctaattggacatgtcaccctgccttttcctttacctcagccattttcactaagtgaatattgggtataaaggaaaatttatacacaactttgcttgtctgaagtgttccctcagaaggccatttataaaatgctgctcctcctagtctgccaatttctttctttctttttttaaatgtatttgtttatttatttggctgtaccaggtctttgttgcgacatgcaggatctttagctgtggcatgcaaacccttagtggctgtgtgtgggatctaattttctgaccagggatgtaacctgggcctcctgcattgggagcacggagttcttaggcactggaccaccaggcaagtcctgccaatttctttttcagt

SEQ ID NO: 42498 - DNA, 2305 bp, Bovine  19866880772210
actctgcataacactctatagtgaaatgaagttgcccagtcgtgtctgactctttgccccccatggactgtagcctgccaggcttctcaatccatgggattttccaggctagagtactggagtgggttgctatctccaggggatcttcctgatccagggattgaacctgggtctcccgcattgtaggcagacgcgttaccctctgagccaccagggaagccctgtaacactctataggtggatccatatctctgcaaataacccaatttcattgctttttctggctaagtactattccactgtaccacatctcctttatcctttgtgttatactttgttgatggatgtttaggttgcttccacatcctggctattggaaacagtgctgcagcgaacacggaggtgcaagtgtctgtttgaattatggttttctctgggtataggcctagtagagggattgctgggtcatacggtggttcttgctccctctgttttaaagttttaaagcatatggttgcacattgtttggacctgcactgcccaatagagctggactgtgagtcagaaatgagtgctatgtgtttaaatgctctagtagcccaatgaaaaaggtgaaataatacaagtgaaattcattttagcatagttgacctcaatatatccaaactgttatcctttcaacatataaccaacataaaaatgattcatgagatatttcacacccttctttcatagtatgtcttcagactcgtgtattttacatgtacagctcattttctttggaccagccacagtgcaaatgttgtgtgatcacaggtccccgtggttggtggctgagacccagtacttgcttccctgcccatgcaccttctgtgttgtgacgggtgcaggtggagcaggctcagaggcaagcatcaggacacaaagacatgcagaatggtccctatgtggataattatattcattggcatttcctcctgccctttctccacctcctgaaggaggctctatgggccccactccctcccacccaactcccacactccccgccccctgctgcttggaaatggccaccgtgactgcagcaaagcctcctcagagactcaaagaacgttaatcagtttcacagctggaggcaaagtgatctagtgcagcaattcctccattaaggggctttctcttggcctttccattagggaaggacttctgcataaagtgaaatgtgctttgtcttcaccagggcagacaaaggatgaaatcaaaagagccataaccttgctaccagctgggctaccgggagaggcaacagggaaggcagttctctctctgcttccatctggctcatggctctgaaaagtggtagcaacttctgtcagatgcctgccggtcccactggatgggacttttaagatgccttgagcagcattctatttcctgacgagggaaggaactgaggcccttgccagggccaggtaatgccggtcagaatgaagggatcctgctcatccccttctacccctttctggcaaattgtccttggtgtcctgctcctttctttcctgagtgatagcacccttcctgttccccagggacgtccatccccacaacaggtgccctcacacatacatcccattcactgccccccaggcatctgcctaactcagaagtcaccaccagaagtgtttgcaaaatgctttacaccccaggttcttgtgagactgctcaagaaaggaaaaagcagtgctattggataattccttggagaaggcaatggcacccactccagtactcttgcctggaaaatcccacggaggagcctggtaggctgcagtccatggggtcgagaagagtcggacacgactgagcgacttccctttcacttttcactttcatgcattggagaaggaaatggcaccccactccagtgttcttgcctggagaatcccagggacgggggagcctggtgggctgccgtctatggggtcgcacagagtcagtcacaactgaagagacgtagcagcagcagcagcgctcagctagcagttgaaacacaagcagtctttctctagaggtgtcgtcttaaatccttatattgcagccaccgattaaaggcaggttcaaagggtatacatgagagtggctggtattgtctccgtgtctctgtgaatcattctatcttgaaactaaaggggaatgcaacatattcagtgtttggatatttagaatttgtagtgcttttttttttttaaattgagcataatttacatacattaaaatgcacagctctttacagtagagtttatat

SEQ ID NO: 42499 - DNA, 1029 bp, Bovine  19866880868184
ttcataatcccaccacatagtcacaaacaacctcaatcattttagagcacacctctccaagatttcagtggaagtggacatcttgaccccggagaagaaagcacagacacactgaccacactggagattcgttaaagtcattaagccagggcagggcaaccacatatttcatcatccaattcactcagagtgaaagggcttctttccctccttctattaataagttagccaaaaaaacatacataaattggggttatccctggccaatccaagtgtacactgccccttcatatcagaatagttgcgcgtacagtttaggaatccttacttaagaaacagtcccaaagaggctatgaattacaatttcttactcagcacagcttatttttataatttgtcaaaaagagaaaactaaaacaaaaacaacaaaaaagatgatgatgatgatgatgatgatgataaacccaagttctaacaagttgaaaattttaatgaaaaaaaatttttaaacaaaaacctacaatatacttagcatcaaacagtacaaaatatagatctcttgcctaagttagcaaaaacaatgaaacaatttatctttgcataagaagtcacccaataaaaaacacatacagaataagacttcttttctgattatcaaggcaccactaaagcagtacatccagtttttcacacccaaaataaaataacacatctttctggttttccctcctataactgggtcagaggccttaagaaagctagagggaggaaagagcctgaacatcaaaatacactgtttcaaacagactcctaggagatgataagaagtaatgggatgagagcagaaaataaaaccatgattaacaaaatctagttagaaccagatatagaaatagtactattctatacataaagcaagagaaaaatataaagtatctgaatacagatttaaatacagataagttaaacgacacttactcctggaaggtaagttatgaccaacctacataacatattcaaaagcagaga

SEQ ID NO: 42500 - DNA, 1872 bp, Bovine  19866880892661
ctgaatgtatgaaacgccctgaactgtatatttattttttggcccactgcacaaaatgtgttatcttagttccttaaccagagatcaaatccatggccccctgcagtggaagcatagagtcttaacaaagagactgtatactttaaatgaatgaattatatatgagttagatctcaagctgttaaaaaaaaaagtatcttaaacatgttaacatatttttttgctttcagttcttcttacagcttcaacaggcagcactggaagtctttgcagagaataacactctgagtaaactccagctaggacagctagcctctatggaaagctctgtctttgatgacatgattaacctgttagagcgtttaaagcatgacatgctgacccggcaagtagaccatgtttttagagaagttaaagatgctgcaaaactgtataaaaaagagaggtaagtcctctgtattttcttataagtcaactctcaactccagtttatgaaagttaacagataacatgcagtcagatttccaaagtgtctatagacagcgtggagtttggccttttgcactcccaacttttaaccatttttgatggaaatctttctaaaatatgttttgacagtcttaatcagaataaatggataacttaaccttcagatgtggctgtaaatccagacggctggtgtctgatagggggttaaatggcctagcctgtcacccactgacaaagccaggtgttgctgcagtacctgtgcatgcctgcactgtagtgtagtcactgcccacgattccttgtgatgtctgttacctcccccagacggtggcttccttgagcacaggcagtgtctgtcctagcacagccgtgtcacacagaggacttatccgtttagaagtgtcaatagtccctgttgttttgctgaaaattaacagtgtaaaattaactaatgtcttaaatgttaatgcattttacattttaactgttttatatcagtaagtcatgttaaatttggaggtttacagattttatcatcctgcttaagtaaagagtgtttcattgagaactaaagtataaacatgaaagaaagtgtaagttgctcagttgtatctgactctttgctactgtatcgtccacggaagtctccaggccagaatactggagtgggtagcctttcccttctccaggggatcttcccaacccagggatcaaacccaggtctcccgcattgcaggaagattcttaatcagctgagccaccaggaatcccaagaatactggagtgagtagcctatcccttctccagtggatcttcctgacccaggatttgaaccggggtctcctgcattgcaggcagattctttaccagatgaaccacaagggaagcaaaaagtataaacataggtacagggaactccctggccatccagtggttaggacttggggctttcactgctgaggcctgggttcagtccctggtcagggagttaagatcctgcaagctgtgaggcatggccaaaaataaaataacataacataaaataaacaaacaggtatatttattttctgagagcacttctaatgttgggctgtatagtttttcttatccagaatgccccagaaaagtgtatttccccagatttaaaataagtaaaaaatcttaaacatatagaatgatgaaaaatttcataataaaaatgaatatgctgcagacagtgctgtttctgctttttccaggtggttgtccttgccatcgcagtctgaacaggcggtgatgtccctgtccagttcagcttgccccttgctgcttactttacgagaccgtttacttcagttagagcagcagctttgcttctctctatttaaagttttctggcaaatg

SEQ ID NO: 42501 - DNA, 1816 bp, Bovine  19866880904495
acagataggaaaccaacagaaaatgaggacaggaagcagaagatgagtatcttcaaatgccaagagcccttatggaccggcttagtacagagcctccagccttatcttgctggccctgtgaaggcagatgagggataagtatggagattgttcatctatatacttaaagaggaagaagtcttctgttaattcatgctagttaattacacttacgttcatagctgggaaagctgtggatgaaagtcatcatcaattggtttgtcactgcacgtgggaaattatgatgactttgtaaagagctaattgtgccagatcaactgaggagcctctcacgacagagaggaagggttcagacgtggctctcaagaaggggatcacctgtcatgcagccggggttcatggccaggctttgctgtcttccaagtgttaggatctccatactgtaggacatgactgtaactggttaggaaagacctagcctatgagtgatactggtggcctctgggcctgcctgctggtcgcgtgagtgttcctcttttggtgacctcggagagcacctgaaaggttgtttgccaaggcatcatctcgtgtcctgatgtaagtgcttcctgaatcactgcctctatacagatctcagctggtgaccttgggcaagtgactcgatcttggtgtgcctgttttcctcatgtgtaaatgaagaatgcggttaacaatatctctgccccacgggattttgtctatccccgtgagtatggcttcccttgcagctcagctggtaaagaatccacctgcaatgcaggagacctgggctcgatccctggagtgggaagatcccctggagagtggagaaaggaaaggctacccactccagtattcttgcctggagaattccatggactgtatagtccatggggtcgcaaagagtcggacatgattaagtgactttcactttcatgaggatgtagtagtctaagttttttaaaagcagcaagtgtgatgtctggagcagagcgcatcagtaaatatttgatgatcatgttatcattatcactattgtcacatgtgccaaaggacagaattcctataactcctcaaccagatttagaagcaaaatctcctggtaaaagtagagaagtggttcttcaaactcagactgaagttcaaaatggaaaaagataacctttgattcagagtctagaaatgagctctagagcaaccaaatgagggaaactgggacaaggctcatggggagtgagttgggaggagactcaggggtcacagatcacagtgtgaatgctataaatgataaacatggtcccgaagggcaagacacagcaccaagaattctcctaggaaacaaggcttcagggggaccgctggggttagatcagccaccatgtttgggtcacaccagctagcctgcacttcctaagccctgctctgggcaaggccccttcagctagagacagaaggtggttttgagagaatctgaaaatactagacagggtccaaagaacggcaatcaaaaggattgcaaggagagaaatagccattctgagaaaaggactccaaaaactacagcactgaccttgtgtgaagagcagaaaggtcctggggtgatctacctgactgcaagtaggtggatattctagacagatcaagggatgcaggaccagtgaggcttgagcgttgattgcagcagcctctctctcatctctggtcagtccatcccctgcccgccaacaccagcgaggtgtatcggagggctgggaatagttgatttggtggcttccagggcctacctcagttcaggaag

SEQ ID NO: 42502 - DNA, 1578 bp, Bovine  19866880904725
cagatggagaatacacgttcttcctccaggatctggtaggtgatccttggcttgaatgatagaagcaggagagtgagtgggggctggtggtgtctttgacttcaggcaccctcttcatgttgggtggctgagtgttcattctgctctttgttcttgctctaaatatctgatatctgtgtgctcatcattctagctgctttaacccatcaccttatttatagtcttgccatacatcatccaaggaaatggcaacccacttcagtattcttgcctggaaaatcctatgtacagaggagcctggagggctacagtccatggggtcgctggagtcaaacatgacttagcaactaaaccaccaaacatcatccattagaccaaagcccagcaaatgtagggaactgggaagcaactctaggcttaatttcattcactctcttcccctttcccaaagataaaaattccattggcatttttttccctcccaaataatggcataatctagggactaatatagccattgtctttcactggaaaggcatgagccatgaaagttgtttttttgtttttttttaaatactttgtaggcttctcagtgttcactcactaccagctgcattgccagctgagcaggctgttatcacagtgagacctcaagttcagtgtttgcttcccagagagggagacagataacaaacaagttatagagatttccagatgggggatgtcacaactgggttgtgtaataagtcccagaaagatggcggctccttattcagaggcaccaactggctcctaccatcactgaaagcccttgaggacacctaatgcctccattcattggaaggagaggagaggaatgttgagcagctcttggtaagacttggagaagcagaatttgaacacctatcataggttgctttctgaggttctgattccttctgtgtactccaattgtggggctgcttgccaggggcacaacttttactaggagcaggaggaaaggggacaaaagagtctgtatgaatagaagccagttgatcaaggagtcaggggtgataatcctcttgtcagattctaagactctcccctcctttattacactgattctattgtggcacctgcttattttcttcctactgtttaggacaatttgtaattagtttattaatttgcatccctgcttgtaatctgtctccccctctaaatcagaggtgctcaaactttggtgcaatctaaaggcttattgaaaacacagatttctggactccatctgcagagtttctcatccagtatacctggggatgtgaaattccaggtttcagcattcttccctggaggtcatagtgatgatcatggtcaggagaggtataactttaatgttctggggtgggctgaagaatctggtcttctaataaattttcaggtgatggtgatattgctagtctggggactacactcagaaccactgacctctactcgtaatataagctccacgaaagcagagatcattttttacttatttacctaagtgcttgcttgataatatagggattatcgtatctacagattgaatgaatg

SEQ ID NO: 42503 - DNA, 1149 bp, Bovine  19866880909864
atggttttctgtcccttctctccccacttccccagattcctggacacaatgcccaggaataaagacaatgggtaagcactgctttcctgtggttacagggacaagcagcgagaacagtcagccagccgccagcacccacccgacactcaccatggtttgtcccttgatcccttcgctgaaaagattgtgtgctgtttgctgctggaggtaagtagattgtctttgggcgttttgaatggctttgaggagctgctggcagagttatggccgctgagacaggttttcgttttcacctgtactagggatgtcctggaattggagggtggagacgccggagatggagaaggtctacacattgaaccgtgtcttctctctacagggggagaaagaatagaactcagcacgtcatctgtagcaagtgagtcacatgcatgctagtatacacaacaggcagagagcagagtgctgatcttgcagtgctggcccctggagcctctgttctgactacagtttgcttgacatcctgtcccgccaactagcagtgattaccttctgaatctctgtatcaaatggcacactgcactcgcgccagagttctcaccggaggcgtttaccaggcaatcctccaaaatcattgccacagacgggaacagagaggggatgccaggtgttacctgggcgcagtgagagaaccacacaaccacacatcctcagacagccactcagaggccacagggtccctgagggcagtgaggagggtacgacttttaagaaagccaacagaaatttctcaaacctgaccccctagcgcatgttaagtcacttcagtcatgtccaactttttgcaaccccgtggactgtagcccgcctgactcccctgtccatgggattctccaggcaagaatactggagtgggctgccattcccttctccaggggatcttcccaacccagggatcgaacctgcatctctcatgtctcctgcattggcaggcaggttctttaccactagtgccacttgggaagacccctagtgggagcactgaaatcacaaggacctgcagggctgaatgaaagcgtcctctagatctgggaggtggccaagcttctgtccacatgtccctgggcctttccaggactcactgaggcc

SEQ ID NO: 42504 - DNA, 1338 bp, Bovine  19866880920186
ccccatacttcccaggcattcagaatcccttttgcatcttcttggcagccaggaactttttcctttagttaagactgtcctcctgggatggtgccccagattccaagattattccttattgcctacattccaattaaaactcccacttttctcactgccaggagggaaaagaataagataattttttgttgaagtattatgctgtaatagaccttttaatgcagtaattctccaaggttgggtggttagggttgtcctcgttctcttaggattatacctggataacaaaatcaaagtcaataaactcctaggcttctcatcatttggtcattccaggaaaagaaaaaaaagaagaagacaaacaagaaaccagaagagtttatctaaaaacaaacagaaaccttgcttttacagcaaggaaaataacaacaatcgaattgtttcagaaagcaaagaccaatttatctagcttgtgagaaaattacaagtgatacttgctttaaagaaaaaaactagggagcataaaatatacaaactgatgaagcataaagaatgatcacaaggaggttctccaaaagaatcctttgaatggccaactcttaaagtgtgtttaaagtaaaattccatttacaaaaattatctttacagttaactttttaggaaacaagctactggataaaacactttcttttgcctcttagagaaattataaacaaacttacattgccatcattccatcagcatcagatttttcaaggtcagctcctactcaggtctttattttcccttttgtatcacttaagaagattggtttttgttgttgataagaggacagacttcctgggcatgtcttggtcaacactgacagtggtcattcgggtgatctgttctctcttaataaatgccacagcgtcactcagaagatcatggtggtcctgatacaaaatcgacagggccagaatcaggagggaaatgcttccatgcatttctttttttttttttttttttttatgttaggtacaggaagttcagatcctgaggcaaacctgtccagcttgctaaagaaaaagcacttcatctgctcactttactgtcccatatctatcacaccccgttctctccctggcaggaaggcagttctctgtacttgcaaatagaataaacaaactatccatagagaactagtagacattttgatttttattttccacctgatttcaagagagtaaaatattaggttggtccaaaattaattgcagtttcagaccgtgaattttaaattgctataactaggctcaaacatatcttattatcaaaagaggaggcatacaatcaaca

SEQ ID NO: 42505 - DNA, 1033 bp, Bovine  19866880920721
tttagttgcaggagataagattattcttttttttttttaacaaacatataaattattttatttacaaagccatgttacaaaaaaaaaaaaaaaaaagcaaaagcaaaaaaaaaaaaatacaatcgctcactggagaatgtctccaggcctggtgccgcaccacgtcagtatcaatagatacatgtttgttctttcctttttaaaactgtaagccatagaatttactatttacacctactttagaacatttattctgcttacaatatcacaggcatggaatgaattctatctgatagtgctaatacataaaggtgcgggacaaagaaggaaaatacttagtgttacaaaatatggatcgtagaaaagaaacccactccacaagtgtggtatttgtttagaatatttggacatgctttcttcaaaatttctggaaaaggttctaaaattggtagtaggaaaggacaaatgagcaggtgcaaattctcttctgtgcaacaacagttattgaatataccccatgactgaccagctacataaaacccacagagttttgttaaagtgccatgggctgacagcataacaaaatagaaggtgtaaatagaaaatttctttttttccttttttaaaacaagagttcactgagaatcagcaataatagaatatgctgtataaactattctttacaaaggttggtcagcattatttacaattggtacattgatacaaaagaaggcatacaagttatccaggtcgctttttttttatggctgacaggtctatgcattgcgttacgctttaacaaccagagctttcgagcctctgtggctggcgacaagtcacaagatcttcaggcagatgggggggtgtgtgcagtcaaggggctaggagagagggctgagtgggggtgtgcaaaacagaagtacccaaaggatattcccccaataatgctttataggctggtccagttgaactccatccaaacaaactgaaagaaaaccttttatttgcattccatttttcaagctgtgagttt

SEQ ID NO: 42506 - DNA, 1209 bp, Bovine  19866880929879
ttttaaaggtattttgaagattaactagtactgtcaaataattttaagtctatggatgaaagactggataaaagtataaggtattagcataaagatgtgcattgcattttgccatatttattggggatattcgttgctattggcaaccttgacttcaaggtaagaaatccctgagcatctgctgaaattaaaaaaggcatttttatttggactgtactcacaaattgatttgagaaaaaaaaaaaaactggctccaaaagagtgatgcttaagcttgtaagaatggtggtgctctgcaatgggatttgggcagaagttcttaaaggaggtaatcccgtagacactgcaactcacatgcaatttatggttaaatgtgcaccttgaacctggttgctttcatttacatttgaaatattgttttcaacaaggttgacttaaaaaaaggaaaaactagctggtgattcagattcagacctggcctctctggcaatttgttgtatcataaggcaaccaacatttgtccagtaacaaagaataaaattaaggtcacagaactacagaattcaagattgttacggaagggtattaacatcaagcgtccagctcttcatgttacagaaagccaaaatttaactcctagtcgctgaaccttcccagggtgagccaccccttctggtcagatggctgctggggaagaagcccagccaggaagaatggcccggccgtctgatgggggtggtcatggccctccctcagtgtgtcagaggaaatagagtccctgaagttctagaaagcagtagttttcaagctcatcaagttctcagaacctccttagtcccaacccaatagtgatgaagcagggctgggagtccagtcttcactttagtccccagccctggtccttctcttaatcagactctgaatcctgggggacatagttgcccaaaggcttccatgttgtcaagtgtaaaccagggcagaatgctctcgggttaattcttgtccaccctttctcccctcacagggtgaagaaagtaggtacgtatgatgttagttacctttgtttgctgctcttgttgtttttttgctggctctgttgtactcttgggttggccaaaaagttcaatcaggttctttctctaacatcttgtggaaaaaaccaaacgaacttttcagccaatctaatatataaaagcactccaacttagt

SEQ ID NO: 42507 - DNA, 1029 bp, Bovine  19866880939023
gtcttagaagtgcctatgtgtcagatacaaaattacagtgtttttctgtactttggcctttggtctttccccacaaaccttgggtggagtgtgggtgaaggttaatagggaacagttttgtatcctcagatcagggagtgcatctccaccagtttgagtcacttgtggtggggtttgcactgagcacctgcagcccatcctttgtgctagggtgaaggaagggccccaggaatctgcctgttgatagcaggcctcctgaacgggttgcaaggtgtgcctggagactccactttgacccttcgcaggcacctgtgccttcaccagctccaggcacaccagctggaaacccacagctgggtttaacagacagcctaactgaatgtagcaataacaccaacacctctcttttgttgagctcttcctctgtagatgccgtgctctgcccctcacatacgttacatacgtttcaaccttctaacaaactggtcatgttggggacaaaatgtcattttgcagatgaaggtgaaggaacttgaaccaaacctgtatattcaaagcctttatgcctaacccagcactatacttcttccttgggtaattctccatgctctctgggggttagttaggaaaagatggacagaaaaacaaaacaaaaatgaagacagatcagctatcctggtcctccctcctggagaggagccccgttaatctccaggatttgttcctgtgctttcctccgcagctgggatctttgtggctaccttccatttaccgagtcctttacttcagtcacctcatttgctcatcacagctggcttttgctgaatgcaggaagtggcatggtgtcctttttattatagatgaggaaatgaggctatctttttgaactcttgtaggtaaccccaaatgtatgtttttgaaacaagctttttcttttttcttttctttcctagaagaacacaaacagaacgggcaggataaggactcttccataacaagactctgaagccaattccaaaccaatgcctg

SEQ ID NO: 42508 - DNA, 840 bp, Bovine  19866880985394
agccctggctctgccccggaagtttacactaggaagcctctagaacagcaggcacaaaccccatggaaacaggctgtgcatctagatcgaaagcagcatttaagccaggaagacagagctctgtgagccctagacatcctgggaggggcaggctgtgctgggcgctggagggagcctcatttcgccaggaattgaggacccagagccgcaggccctttgagaaagcatcctcttaaaactgctctccctggcatttgtgacagggaggctggtcacaggcctgcgggggctggaggagaaggccgcgcggccacgctggggccggtagtgttccaggaaggcaggatctatttttttctgggaagtgagaagcagtttaatggtactatgaaaaagcttccccaggcatgcaggccttaagtaaataaaagcacaaaaatagattttttcagaccgtgtccttccagagcatagtaggatttcctgagaaattggattgagttctccctgactcacctgactgctgagtagaggaattcagagggaaaatgtgtgtttcctgtagccatatctgctgaaatagggccgatggcagggcttacggctctcaactggtgatcttttgaaagacagctgggagtgtctgaatagcaggctggggattggggctgaagcttagttgagccacccctatacctgaacccctactctcaagaatgagaagtagctttatcatagaacttctgccctgcctgcgtgttgtagattggtttcctgcaggtatgcagagcactgggcagccctcaggagaacagggtgtttttccagcggtgatgaggg

SEQ ID NO: 42509 - DNA, 1296 bp, Bovine  19866881012503
ttattttaggactagaaggccatgttcactcaagccagtggcttataggggcctactgtttccactccagaagtggtttaagaaagttagacaaatttgggttttgcctggttttctgtgtatattgtgtttatatccttcaggctaacctttcattcatgacgttttgttccattcatgacatcctttggaagtagacataaaatgatagcagcagacacaccaagaccctgtcctcatcaacatctttttacccaaggaccacaacccctgaggtagcccagtgttcacatctggaaactcggatcatttagtgactgccccagaagtgacatcgccaaggtggtgatgtaggtcgttcccaactttaccccttctctcaagaacagctaccagctgtttgtggacacagaaccactgagaaaatcctaagacgtggaagtgaggctggagcacacccctgtgccagagagcaagacagatgacttcagaaaggtcagaggagtagctgcccacaactgtatgcccctcccccaggccggcagcaccttgaggagaagctgcccctcttcttgcagagggctggaggggcatctaccttctccagtgttgttggtcacttcttgggagcccctacacctgtcttgcctcatggggaccatgggagaatctccagggcttgaccactgggaatctaatcacgcctgcagtaattgaaggtagccataatggaaagggagagggttgacctttttccaaactgcagaaactgaatgtcaagggctgacttccttgcgtgtctctctctcctaaaattcttggaacgatgttgtgccgaggatgggctcccagctaatgctggttggctggctctcttactctttcccatggcagagctcagattggctgcatcagccaaatggacctgggtttggacccagaggcacttgaactaatgatgggcatctagggaagtgcttcctgcaagggagctgaggccgagcaccgttactgttccggtgttagtcttggctgtgcagttgccgctgagtcaagctggaattcactgtggggaaagcttttgtttgtgtatggatgctttatccttgtacctgtggtttcataacataattctgcttgccaattttagggatcgggtgcttaaagaaaaaagtaaaccaagtaaatactctctagggcaggacagagtaacaccaggaaaagataaaagtgactcactgacaggctctttgaacatagaagcagttatcagcaaacctgctctgtgaagctgat

SEQ ID NO: 42510 - DNA, 662 bp, Bovine  19866881047802
ggacccccagggttacctggcccaggtgtccacgtctgtgctactctgatagagcacttaagatgaactagaggggaggggcttaagatgtggctgaggatctgatgttaacttttatttaactttaattcacaacttaaaaataggtacttgattcagttattagaaaatgttttaattaattatatgttggaacaacttgggtacgcaaatctactttataatcactatttattaaaatgcaatctaaatacggatcaagtatttccaatgaaattttagtgtacaaattgagatatgctctaagtgtaaaacacacagggtttttaagattttggggaaaaaaatgaactctctcactgattattgataataatcacagtatattgataatactgtggttatattaggtttaataaaacattgttcaaaattaatttcacttatttcttatcacttttttcagcatggatactagaaaatttcaaattacatgtgtggtacacattatacatgattggatagtgccagtctagacaattctagataaagggttaactgtctccaggaatggaaatcttatgatcctttccaatggtcagatccatttcattcagttcaacaaatatttactgacaagggtactgtgtttgctgagtgtg

SEQ ID NO: 42511 - DNA, 1549 bp, Bovine  19866881052228
tgagctgtgcagtgtccagttcatctcgctctgttcctccacggtcatgtgcccccaaggagcttctgctgctgttgctgccctgaggtcagctatgttccctgtggcaatgtggcccctatttcacggtctccctgacgttaaacagttattatcccttgtttctcagagttactataaagtatttaatgactgatggcaaaggtggaaccgattttcatagtagtaaaacttccctgctgttcacccacctgattgtttaatggaatcacagatttttgtggagaacattaaaggctttctgattcttaggactagatgctatgaagtatctgtagaaatattttcaggtgaatgcaaatcaagtgttttccaagaaattcttcaaatttaatgttttaaaaggggatccacagaagttgactttttctaaagatgaggctcgctctagttacctgatgtgatttggtgctttttgtaattctaaacttttaaattcccatggcatcattcagtagcattgctccttatatgcatgtaacttaaaacctctatatctacaaatgtgaaattgtagagtgactgacatcatgtcccccagtaagcctaacacagcccatagcagtctttttctagtcatacagcacatcagtgtttcttttcttgcactttttgcatttaagtgcatgttgtacagaataatgtatttcaatttaaacactagaaaaacatttagctcaatgatagcctcatgctttgagaagcacatagacaacaagagctcatatgaagagcttgaagatctactgtcatgtctcattttattccaagtcatagataggcttattgaaaggaatgtttggagcaatcatcacattatcaaaagtattattttctctctaactttaatgtatcatagttgagatgataaaggtagaacgtgtacttatgaatgatgtggctcagttataagaatttgtttttattaactaatcaaaagcatttaactcatttttttgaccaggcttatatggctgaatgtaatgatgaaaattatcatagcaagaagggaaattagagatccagtttatcctccaccattattttctgcatgagaaaagccagtgcctgaaatagtgaagtgatttatctaagagtccagataggattcttgtaaactttcagtgtttataaagttaagaaatttggagtcttggaacattgcacaaggcaattggtttgcctagttatcttctcttaagaaaaccaagaatgattattttaaattatactagtactcttctttaatatctgctcaagccagagcatggaagaagtaatattaaatgccttttgttttatagcacattttcatattcactattaattcttcaagaaatccttacagatgtatactatagatggttctattcccacttcatatataagaaaccagtatgttatggtttaacagtgtcatacctcagttaagtcaaagaggtcctctcaaagccatattttgcagctccatcaactgtgctcatgtatt

SEQ ID NO: 42512 - DNA, 1732 bp, Bovine  19866881113715
tactgcacagattaagagaacaaaactttagtgttgaatgtataagagtcttacctaaggtggaacagaaattcaaaatataagatggtgctgagccgagcacccattaaaccaaatgttacaaataactctcccttgtattcacacggcacagtaccatcccagttcaagtttatctcacaactgaggactgcttgaaaaacatcaaactggtatctcatcagactgatgtggcaggaactaaggtactccaccagtctaagcatcccaccaactcaaagagaactcagggactgtgatattctcttcttccccgtgtcataaattttctgattctaccctctagttccaaattctgcttgactacccaattacagagaaaatacctcacatctgttcaagaagtatttatcaaactttttttttcttgctaaaatgagtagaatgtgtcttcatgcatggaaccaggtgtttaccagattagagcatacaaataacaacacaaaacaaggcagacactggttcagaaaccctgctaaccttaattacctcaacacagtcatggctcaggaatacagtgacagaagaaaatatccagaaaggcagagacgctctctctggctagtttagtcccaaggaatttggaaagaagtggcctctgaggctgacctatgagggctttggaggcaagggggactctcaggaaggagacccaggcatggcaacaggaaagtctgcttctgctgatacacaaggtccccagagcagaatatgggcagaagtgctagaaagaaaggttgggaccagattttaacacccttgaattaagaatatggagtttatttctagtaggatataaaatgccatgcaaaactaaatctatttttactttagatatatagtagttcttagaactatataccatgatcacgtagaagctttttcaaaagacaaaagcctaggaacaggagattctgactccgcaggtctcaaatgtggcctcggcccatgtcactaggagactgacacacacccatggttaagaatttctgctataagcagtcattaccatatctaacagatgtctactggcaacacatccaagtgtgcttatgactcaaatacaagtgaggaaagcagatacaaacagacacaggcaaagaaaggcagatagaaataagaattcctgatgctccaaaagatttcaggaataggatgctccattctagtaaatgtatgtctctttaaaagtcattacactaatcacagtctgttttaatcatctacttcattcaagtaaaaccaaattttagttaattccatcaaaatataaataaataattaagagttcaaacagaaaagcacagctaacagacttttaacatgactgattattaacatcgtatttttctcccctccttcccttagtaaaaaacaaaaaaacaagaaagtcgaaaataacagacaacaaaacagtaaaaatcaagaaacaagaaagacaacaaactgaatggaagaggtaacaactaggaagaacaaaagctacaacaaaaagtgacagacatcgatcagaaacctccttagaaccagagcatgaaaaccaagggctggggaagcaccaggttgtgggaggtatgctactgaatccgcagagcagctggacacagcaacagctccctctccgctcaccctaaccccagggcgggcaaagactgtaatctggctacagaat

SEQ ID NO: 42513 - DNA, 918 bp, Bovine  19866881324579
tggcaaacctttgcagcaagttacgtttggcccactttgcgtttggtcacagattgtaatgtggtgagcaggggtatctgtgtatataacctccagccagtcacccatctctgtttccccagcgtggaaatacagtacctaaaatggaacacagtgagtagctaggtcatcccagacagaggcaggtgagtgaagccacagcctgctggaactgggcatcaaacacacatggtcatcataaataaatcatggcctattcatgtttgcgagcctgccataagtaactgtggcctatgggcttcacacggagcaactccagagaccactttctgttgaacgaatgatgggttcaattgagttgtgatttactaactgatatcttataaatgtgtttgactgaaactggaggtgggaggaagtgcaggggtgcagaagaggttggtgggaagtgtggaaagcgttcagccataactaggccatgggagcctggcttatccaaaatgaatggaggaaaaggccattagatgccaaaggatggtttccctcataaaacgcgatgtcaccctggtaggcagctgaaacctgcttggaaagatggaacttgttttgtggatcacacctcagacagttggttttctgtgcctaattgtttcctgaccatctagtgagaggagaatttgtgtttcagaaaaaaaatgacatggaggttaaaaatgcatgcatattcaaggacagctctctagcataatgtttctgctaattaagcactttgattggaaacgaaaccatattctaaagatgtttgcctctaaataccttagtgtgatcttgacatgtgtctttaggatgcacaagggaatgatgtcaagtggccctcttacaagtggcagcttatttgtgcttcagtgtccatgtgtg

SEQ ID NO: 42514 - DNA, 5759 bp, Bovine  19866881324878
tttaaaaaactgcacacttacattatttttctataattacagctgccttaagtctttatattttttgtaatgcagaccagccaaatttttcttaatttagcttctgaaaaaaagaaaaaacagaagaaagtcatgtttaaaaattattttggaaagttatttccaaaaaaattatataaaggccatcattctttgtgatacttatcttttacatatttctaaagtgctaggttttaaatatttatggtattgtaaattcattagttgacttaagccacattattgaaatttattgggagtacattgggaaacatttgattgttaagccttccatgaatgtaaagtgcagagtcaaaattgtgctcttatgtatacaaacatttaactaactgtaactttctagttggaatgacttaagaattcaaactgttcatcttcttccttagcctgaatggtacttggctcaggttcttctgtggatcgggaaccacactcagtttctggatgagaagattcagccaatattggacaaagtgggctcttcagtaaatgcaagggtaagagattcagtccaaagcatttcagtttcagagttgcaggtgtccatgaataagctgtctttttcattaccttatgcttctgtctttttttagcttgaattttctcggggccttatgatgctgattcttgagaagttagctgctgatattccttgtctgctctatgacgacaatctcttctgtcatttggtggatgaggtgcttttgtttgaaaaagaactacacagcgttcatggctatcctagcacttttgctaattgtatgcatattctatcagaggagacctgttttcagagatggttgactgtggagagaaaatgtaagtgctcatatggccataggctgggggagaggtatctcttattgtgaatacaaaattttaggtgttattcttctccagttctgggtagaaactagagccatctaaatttttcttggttgaggtttattaagttgccttcagagattatcttcttttctccccatcaagcttcagttgttcccacaattgtactctacgtatttctagggtagaatatttaagccagggacttctctggtgctccagtggctaagacttgcgctcccaatacagggggactaggtttgttcctcagggagccagatcccatatgctgcaatgaagagtttgcttgctgcagctcaagatgctgcatgccacaactaaaaagatactgagtgccgcaactaagactggcacagccaaataaataaaaatactaaaaaaaaaaatttaagccagtagagttaactgttttatggattctacatatagtatttctgctcttatggaatcattctggatgtggcttttctagtcagtgaagatatttggaagattctgggtaggtgtggcgggcagaggtaaaagatcttacttaaccttaaaatagagcatgttatatatagtgcaactagtaggagggtgtacatttacttttttacagaaaaatgatcattcctaagaaattatgagttgaaagattaggaattacaatctgtagctacttgtttgacatagtctttctcgtgtgccagttgcgcttcaaaaaatggactcaatgctctcatcagaagctgcctggatatcccaatataaggatatcactgatgtggatgagatgaaagttccagactgtgcagaaacttttatgacactactcttggttataactggcaagtatagtcttaaagatataactttgttttttttagaactactgactcttagcagacctgtggttatcaagggggaaggggaatggtggagggatggagtccattaggtgataaaccataatgggaaagaatatgaaaaagaatgtatatatgtgtaactgagtcactttgctatatagcagaaattaaatacaaattgtgaatcaactctacttcaataaaattttaaaaagtaagtaaaagtactgactcttcactcagtacttttgaagtagtttgacaaaataccatatagtgattattgtaatatcttcaaattcaatttctattttggtcaaaactctagcacagtattttagcttttggattttttgtaatttaagaccttaaacattagtttacatgagggaaaattcctcatttgttacataaaaacacataagaatttaattttattacctgaattcccttgtctttcagcttttcaagtatcttcagtaaatggtgattgacccaaattttaaatattattttcttcactttgatttatcactgtttatagaacaatataaagtaactttaaggagaagaatgggggcttccctggtggttcaaatggtaaaaagtctgcctgcaatgcaggagacctgggttcagtccctgggtcgggaagatcccctggagaaggcacagtcggaatagtaacaggaacgtctatagtccaagaatgttctggctggagggtggcccagctgtctctagccctggttggcctgttcctgtccatgttgcccctggggcactgcagacctgctggttctccaggcgctactgagctgtcactgccgtggtccttctgtgccttgtccatttcttgggcctgtgcggtaaccagaagaggtgtcattccagcccagtcagtaaataattcataagaaaaatatgaaaaacactacaatacaaaaatatttagcaaaactgatttaaaaatcttttattatggaaattttctcatatatatatataaaagcagcataacgaaccctcaggttatctgttcctaaagtttaaaactattgcttttctattatgtattttcccccaccccccaaaatacagatttttttcctgaagtattttaaagagcattttagacatcttatcttttcacctgtaaatctttaattatgtgtttcttttaacctatcctacttcctccttccttttttaaaaaatgtcatttgttgaagaagtggaataatttttgtatatgattttctcatatacctttaaaaaaaattgagtcataacttttaaactgaagcacagttgatttacaacattgtgttagaggcataacttatatacagtgaaacgcataggtcatcagtatatagatcaatgagttttgacaaataccagtacttgtgaaacacatatccttagggagtttagaaatggatccatacttgaatggttggttgatttttgacaaaggcaccaaagctgctgctgctactgctgctaagtcgcttcagtcgtgtccgactctgtgcgaccccatagacggcagcccaccaggctcccccattcctgggattctccaggcaagaacactggagtgcgttgccattcccttctccaaggcatgaaagggaaaagtgaaagtgaagtcgctcggtcgtgtccgactcctagcgaccccatggactgcagccctccaggctcctccgtccatgggattttccaggcaagagtactggagtgggggtgccgttgccttctccaggcaccaaagctagccaataggaaaaccctataccataaactttgacatgctgtgtgtgctaagtcacttcagtcatgtccaactctttgcgaccctatggactgtagccggccaggctcctctgtcttggaattctccgggcaagctggagtgggtttctatgccctcctcaagaggatcttcccaacccagggattgaacccgtgtctcttacatctcctgcattggcaggtaagttctttaccactagcgccacctgggaaggcaataaaccttcatatgtcttgttaattttctccacagacaggtataaaaatcttcccacagcttccagaaagttgcagttcctggagttacagaaggacttagtggatgattttaggatacgattaactcaggtgatgaaagaagagactagagcttcccttggctttcggtactgtgcaattcttaatgccgtgaactatatctcagcagtgctagcagactgggctgacaatgttgtaagttaatcttttatgttaagtaatatattagtaatttgaacagttttaccttttgaaatgttgaatctgtagcaagcagaaataacacacgttagacagaatcaaaactgggccaaacttaggaggtatgattacagtacatgtttttctcatctaagtctcgtatagttaaatcatgctgatattttaatcattggaaaagaaagccatcctttcatgaaattgtagtttataaagtaaatcttccctctgtagattttaaacttgggaaatacattaaatggtaattgccatctcagaaaaagctaagcttgtataatgacgtcaaaatcaataaaattcagaactttaaggaaaatcaaagaataacatttggtacctcttaaaagtgaaagtgttagtcactcagtcatgcccgactctttgtgaccctgtagactgcagcccgccaggctcctctaatccatggaattctccaggcaagaatactggagtgggttgccattcccttctccaggggatcttcctgacctggggatcaaacccagtctcctgcattgtaggtggattctttattgtctgagccaccaggaaagtccctattgagtgccttcaaacatgacagattatgaagagtcataaaaatagaaacatttttaacctaaatatttcatacattaaaatattgtttaatattttgtttttttgaaacatactcaagagtaaatagaatggtaaaatgaactcctaatatgcctctcacccatcttctagtaccaattttgtttcatttaagcctttcttctaccgcttatacagaattattttgaagtagacctcagatatatttcatggtaaatatttccatatgtacctctaaaagataagaatccctttttaaaaaagcagcgtggtatctggggatcctagttcctcaaccagggattgaccctacactttctgcattggaagtatggcatttcaaccactagaccatcgaggaagtccccaatatactatgaatttataacaaaatattatactatactgctagcatatcatatagaaaaaaatgtattcctttactgtgagagaaaaaaaaaatgaaagtctttatcttaaatccaggataatcagccaaaaaacaggaaacaaatatactaataatagatgtaaacaaatagctgataaacacaatcataatttattttaatctgggccttttggctgggacttagtaattatttaaagacttttttacagaaatgttaactgaaatacatgtgtatgatatcattctgctgagcaaggaaaataattatttcctaaaatgaatattagtggaatgtaatgatcaatgcatttgtctttataaagtcacctagtcagaatacattcattcattatgtacttttatgtgtcatgttcctaattttagtaggtgctttattcactcacccccaccaacccccacagtgctccattttctgcttagctttttcataaaacagtcattcttgcttcttgtgccaatgctttaataagagactcattcaggggcacatttttagcttcagtgaaatatttgtggaacatcattaactactttactcagtgctgtagtcgattaacggagatgaactggccatcatccctgtccttagaaaattaataatcgatatgaattaacggttccttcgtcaa

SEQ ID NO: 42515 - DNA, 678 bp, Bovine  19866881327362
gaaagaacaaacatgtatctgttgatactgccgtggtgcagcaccaggcctggagacattctccagtgagcgattgtattttttttttttttgcttttgctttttttttttttgtaacatggctttgtaaataaaataatttatatgtttgtaaatcaatgtctttgggttttcataaaatgtaaatttagggtattgctttttattcttctgggtgtatgtgtcctcaccagacgagccttcctgctagaacccacatttaaggtgtagaagagagttcattcaacagatatttatggagcatcccttttgtggctgcctctgagctaggcactctgctcagtgatgagaaacagatacagacccagatgctttctgaaggcacccaggtagggcagacggtacataaatacatgatggaatgcctaattactgattgtggcaaatggtagaaagattcgagttctatgatagagaataacaggagaaaccaatgtaaaatggattgaggggggggggtttgcaatcagggagttgcctgtgagaaagtgagctgaaagacggtgtcagggagataatcccaggcagagctgggccacagtgggaaaagtctggtagattcttgaagactaaggaagacagaacagggaaaggggtgggcagagcaaggaaaggatg

SEQ ID NO: 42516 - DNA, 2328 bp, Bovine  19866881359383
tttattttcaaacttaccattggagtcagggttgaacgatttacaaaaaacgttatacctaacagaaaaagacttggtccgataggctcttcttaacccacctacccccctctcctaccctgtcagtcaagttttctacgtggggcgctcttggagtctctgctgctgctgcggctaagtcgcttcagtcgtgtccgactctgtgcgactccatagacggcagtccaccaaggctcccccgtccctgggattctccaggcaagaacactggagtgggttgccattgccttctccaatgcatgaaagtgaaaagtgaaagggaagtcgctcagtcgggtccgaccctcagcgaccccatggactgcagcctaccaggctcctccgtccatgggattttccaggcgagagtactggagtggggtaccattgccttctccgcttggagtctctacagaaggctaattgctactacccatttgagagtcgcctaggtaacacctaccttctggcatccagttatcggagccccgaagaaatgatctttttggcttccctagtatcttggaagttcttggagatgaaatgctggcctttggagtgtatggtaaggggacttacatcatgtacccctaatacggaagaaaggaatctagcacaatggaatctcaatataccagcttccaagtatttacctatgtatactgattttccaagcacttatctatgagtcagcaggttcctcgccattgaagttactcaagtgttactgaccttctttctaagaagctaacgctttctcatttgagacctatttacctccttgtttgtttcccagagaatgcagagagcatatttcaatttcccggaccacagagacaatcttattcttttgattgtgacttccattcttcaatccctgcacagtgccttgtatcagtggatacctagtgaatgagtgcagattcctcttaccaaacaagaaggcttcagagatgctccttagagcagaatcagtggaaggtgaccatacattagtacccagtactcctgagaccactgtaaggaatacctcaggtcctcctgctccccacccccttttaaaaaattttctggcacccagttatgggattcccatggtagtgatctccgtactggcttccttgctactcttctcgttgtattctctttagtttggtttctaaacttttacttccactctgttgaggtttgggggcttgccctggagttgggttgtggctagtagtgctatctggcttgggcttcatattcataaagattcagattagactctcatgttatttccaaatcagatacacactgacaagtcagaatgatgctcactttgcagctttatttgttcatgtaaataaaaaatatactgtaatgtagtaagccagtttggcttttctgtattcccctccccaatttttggaaggtttcagcaactggaattgacatggccctgtctcagcctctgagaagtttaactttctatttcctctcttctgccttttttttttttttgctttctcttctgcttatggttcatgcccactaatggaaggcatggttgtttctcttcaggaagccattgctgctaagagaatgtgccttgagtattaagttctctcttgcttggccatgtgccactaacttttaaaagagagatcacagaagaatagtatctggtcacttatcagaactcatttatatactctgactgggcaaaaccaagggggagtgagctactgctgttaccctcggtgatgcatagtccagcactgcttctgccagtcacctgagttcacaggagctcctgcttccctaaggaggagctgggagtggctggcagagcaagtccaatctgattaggcaaccagagagttgtgaattttttgaatgctcaagaaacaagagtgtttaaacagcatctcactgaaggtacaactgttcaaaatctgagaagaatgttcagataactgtttaacattgactataacattggtcatattctgatttgttcttggagtctgaggaaagacccagaagttctgggcacaacacactctactctctaccaggttcattaaggaaaataacacttgtaaagcaaaacttccccgtctgaggtactattgttgagatttacctatggtagtatatgacattgggatttaaggatgtacaagaggtcaggaggaagctgtgtttagggaaatcttatcattggctaactgtaacattggcagttagagtcaatggcagtacagagtcctgatcattttattggtaagatgagacttataa

SEQ ID NO: 42517 - DNA, 1292 bp, Bovine  19866881412706
tgctggagatcaagaaagaggctttaatagaatttgacttacaccatgcatcttaattaagaagcaaattagaattgctggatgggtacactttgaaaaagaaaaggcacacaaaatgattatcagtcactgagcccactgaaaacatctagcctatggctgagagcttcgatggatgatgggtttgcttgtttccaaataagcaaaatcactgccttgcagaaagggtccaaggaggccccctcactggagcccacgttgggataaggaaggcctccgtagcctccgttccaggggaggaagctggccacctgggtcgctgacaccaaaggtgatgaggtggctcaggaagtgtggggacattccttcttctccctcaggggatgcagctgctctctgacactactctgttttagtacacagggcagtactcatctgaggctgtcgctcaatacatgcctcttccttctagtaactaatcaaaatcgtagtgaaagaatccagaggaatgttgtgaaaggggcaagagaattggagtcagagccaatctgagttttgctgctacttgactgtgtggccttgggctggtccctcaagttctttggtccgtatgtccactctgtctctcagggatgtggggctacactgcagtggccattaaacatttccagttgttcaattgttcaaggagatgcacaggacccaaacgagaatgcttccacatccacagttgattacagaaaatggagaaggtattagcagttacattaaagtaaggatgtgtgtcccagctgaatgctacctcatagcaagaggacgggagaggcccagagccagcaggctcctgctatcttctttccctaaggccatagctaagtgtacttgctcagaccagaaaccaccaactacatcactgataccttggaaacagtgaatccaaattagagtctctgctggaactgtttgtattgaatatttcactggtcctgtaggcaccatcctgttacataactagccccaacagcagagccctctgatgggctcaccaagaccagggggcaaatcgtcaatctcaccctcatcaatgaacattgcttttaggcttggggcagactatccccaacctctagggacccatggttacaatgcagtgctattagtcagcaggctccatgccttgaacgagagttagttgtgtgcaggaactttggcaaagccactcagactaattccagtcctactggaattcactctcatgggtaccatataagaacatgcatatgctcagtata

SEQ ID NO: 42518 - DNA, 678 bp, Bovine  19866881555622
gggggtggtggaggactcctctccgggtctgaaaggatgagacgagatgagtaagctttgctttggttcttgaactagattccctttcctccttgcaggagggtggaatgcaaacatttcagcaccctcaagtcatccctgagctgagagtgcagccgacttagctctctgaatgccaaatgggctaaactagggctcagacatgcctgcagacaatgaagggcatgaaagacacgctggttttgcaggggaggagttttatctgtcctcacggctggctggttctcccttctccaagattcattcacagatcatttctttgatcaatttgttcatgaaattatttcagcaaccccctcagcccttgttgttgttgctagcccttgcccctttcctgactttgaaacaggatcccggatgttatttataggcctttgccagtgagaagggcactcagtggtggagcacacagctcccaaacctcagacttcaccccaagaccacgtgctttctaggcatggggtgggacctcaagccccacgtaaggggaaactgcaacagcaattttaagtaagataccaagttactgacagttctgtctttgatcagtgtctcaatcactgagataaagctacactgccaccactttctagttaaggtattctcaaagcactcatc

SEQ ID NO: 42519 - DNA, 1030 bp, Bovine  19866880717999
caggtggattctttacaactgagccccctagaaagctctgagtttatggtacattattataaagagcttgaaagcaaagttcccataattagacctttatctgcatatcaaaatgcagttgttgtcatttacagtgttttatgggcttcaaactaaattgcaaaaatcagtacattctttcaatgccatcattattactcatgtactcttggaatcttctgtttaaatttctccagtagtcttagctgttcagctagtcaatgctacactctaatgttcatatgatgctgtatgcatgaaggataattagatcagatttctgaggttatttttagccttttcaaagaagttgggaatgcaataaatttactccatgctgttatttacggggaaacgacttgtatttgatgatagtttactcggatggtatttggagaaaattggcaacgttttaacattttttaaaaaaatcaatgggcttctgtttctggcacttgcttccaaaaaaaacaccatgactgctgctgcacataataaattcatcacaccatgatccagcgccaagtcaacttagggaaaaaaatagcctgggctctgggtcagagccatgcattctggaaatgatggacttctgaatcttaaacttgaagtctctttataggaatggtgaacaccatatggcctaaagtccaaggaaaatggatagagaagtacatctggctcttttggcatctgctaccatattgtagccatgattttaaaagacgcttactccttggaaggaaagttgtgaccaatctatatagcatattaaaaagcagagacattactttgccaacaaaggtccatctagtcaaggctatggttttccctgtggtcatgtatggctgtgagagttggactgtgaagaaagctgagtgcagaagaattgatgcttttgaactgtggtattggagaagactcttgagagtcccttggactgcaaggagatccaaccagttcattctaaaggagatcagtcctgggtgtt

SEQ ID NO: 42520 - DNA, 1300 bp, Bovine  19866880975589
cagccccagttaatcccagaagtagaactagctggggcccagatgttctttcctttacacccattaactatccagtgtatgtatgctttatcctattgtgttccatgggcctgtttcataagtctttctatggggcagtgactgggataccaatatggagatgacttacttctttgaaacaagacagaagattttgctattccaatcagccaagacacactgctccagggggaatgaatagcaagtgcaaacagtatgcagcagaaagatttaaggcaagtaagggttgtagccaggtaaaaccaccacagacatggagttcaatacagagttcccttcattgcatgaagaaatagcaagtctttcaaagagatttgcagtggttggcaatccttggcctgtccaacatttctctttgcagtgccattcattcattgaaagaaacaaggggtttcagcctgtgactgcataactaaaccctcttctttgccaagtgattagagagcagtgtggaactgcttactttaaacgccttaatagagtgaaatcagggatgtcattcctctttgtaaaatgctgatatccatagagagatgtaaatctaatattttgacatattgaaattaacagctacaatggttattcactggttatttgcatatgactatttcatgtcctgggacctttttaaaagcttaaagtatctcctggggaaaattggaagctcaaggaagtggaattcaggaaatagatgagttctcccctgtatttcagtgatttttactatagaatgagataatttacttatagaaaatgtttttggatttactattaattaatttgtgctttcatttattttcatttcacagtttttctccaaaggaatttaagcagcttccaggatcaaattcattagaagataacaaataaaatagttgaggaattagggtctaaagaaaaatgaagctgacaaaataaaataaagcatgcctgggggcaaaggggcttccatggtggttcagacagtaaggaatcgcctgcaatgtaggagacctgggttcaattcctgggttaggaagatcccctggagaagtgaatggctacccactccagtattcttgcctgaagaatgcaagcctggtggttacagtccatagggctgcaaagagttggacacgactgagtgactaacacatggggcaatcccccaattgcttactattatacattaaatcaaattgaaatgcaaatgtttttcagctccttataatcatgacaaaataatatatagtcagtacga

SEQ ID NO: 42521 - DNA, 812 bp, Bovine  19866881148275
ctaattagctatgaggaggtactgatatggggctcacagtctatataaggagaaaagatatattgaagatacacatggcaatgagaaaaacaagtaaaaaagcaatgcatcagactagctacctaagcaatgtgaacacattctttagggcacttagggtgacatgcagccattaattggctagttggctttcacatggtgtcaattaatctttaaaaccattaaagcctagcatggcactagaggaaagcaatcacagaaatctttcaaactgggaaacaaagattattctactaattagtatcttctctttgctgaaagcaactgaaatctatgttggcataagtgtgcaatttttagcaatcctgcaagggtcttctttcaattgtttctatattttattttaatatttttctctcatttgatctcttcttaaacatgttttgctttgtttagttttgtttctagtacaacatgtggcatttttttttttgtctgctaataagaaatgtaatgattgctgggggatcttattgaaaagtatatagatactagaaatgcaagatcaatccagtcaatcctaaaggaaatcaaccctgaatattcaatgaaagaactgatgctgaagctccaatactttggccacctgatgtgaagagccaactcattggaaaagaccctgatactggaaaaaactgaaggccaaaggagaaggcagaagatgagatggttagagagcatcactaactcaatggacaggattgaccaaactacgggagatggtgagggacaaggaagccggaatgctacag

SEQ ID NO: 42522 - DNA, 925 bp, Bovine  19866881607276
tggacatgaagaatgaactagtaactaacaaagctatatgttgattaaaacagcatgtggttaatttttaaagattgctgatctttattaaggatggtgaggctaaaaaatcaaatatttttggctaacatatctattgaccagagaggcagtgataaatactctggtcattaaaatgctatttcagtcttgttaccacaaaccttgactgcatgaaacatagttatagaagtaaaattcaaaaatctattaggtctctgaagctctctgtgtcttgtatctacagaggggagctgagaagtcacattataatttgggaataataacatacaaagatgtatgttatttgaatattgtttctatgttcagaatcatttcagtcaactcagtgcctcccattgcccttcatccatcctaaagtcacattgtgtacttctctgagctctccaaataggcaccctcttgttgccaagcaaccacagattttctacaagtgcctgtgccatgtgtacttaaaccgcagttggccttttttctccttcaacttttcaaagtttagaaaaataaatatatgacagtcaggtagagctgtggatattgtaaaggactgtactgggaagtcaaacaattaaaaacagatacacacacatatatacacatatccccttttaaaaagcttttataaatatattagcaattatatatgtaataatgtatatgtctgcctttttaaaaagcctttataaataatttaaaaatcaattcaaacaggtgaagaaaaactatttctttttcctaagatagtaggtattttgtattttatacaaaatatttttttggatagatattttgtattttatatccaatagcaagtaagtcgatagctattcctgtgattttctataaagcattatagagcttcatt

SEQ ID NO: 42523 - DNA, 1565 bp, Bovine  19866880389647
ctgccctgctttggcttcaccgacgtcccctcaaacatgaagtacctggcaagtacttgctgaatgactaaatcctttcagtatttctatcgctaaagtagaacgttctttcatctgactctcaggttcaaaagtacactggaaaaaattatatatcaaagcattcattcctggtaacacagatttatcttttctaaaacttgcaatcactgaaccaaacttcagtggcttcaccaacaagaaaaaaaggtgtaagcgcacaaagaagggtctgttacataaccacccgaacactgctagctccattcaactttaggcacaggatttatcattttatggcaatttagtagtataaatactgccaacacatttcttccccaagaaagagatattgaaagtggcccaacttaccctaaaacttgccagattacatttaacaagttgaagtgaaactgaatttttcaagttcctgcagcagatactcaaataccatttgttaatttgaattttatttagaataactctatgcaagtcacagtaaatctaaaaactattcatgctgaaaagcttagaaccctaacagagtatgtgattaacaggatctcttacggaaacaatactggtttccgtaagagaaaagaagtggatcttaaatttttacactagagtttaagaaatgataaactgaactattgcataaaagtaatagatcaattattattctgctctctatttcacctgggttctcattagaaccaacatgctctaacttgtgaaagacttacattcaaattagaggaaaaaagaagaaatcaacctcatatctaagggagacagcaaaagacactttaactggttaactctgcaggcttttcagtgattctaagaaatcagtttcctctgagaaaggtaactgtgaaaaacatttcaaaattgctttaaaactatgggctgtaaaactaagtggaaacattccatttcagctgcctaagacattgacattgttgggctcctgttcttggcatcccccaaacccactgacccaatattggctaagtctgctttctaacacctttagcagcatcagtatgaacatgcttttaaaatgattacatcttaagtcctgcctaattttattactgtgaaaaaacacgaccactggcctgcaaccacaaattaattctactagagtctattttcctgaacaaaaatgaaacaaagctcacgttctgtttctatacatgccattctttttaaccaaaaatactgctgttaagaagtctggagtataagcgaagtttccgagctctttctgacatgggcagcctctatgttttgaccacatggcgtaatgaatgccccatacactcatgtgaccactgttgccagtctcactctcccataaaaatggggtagagaaatgtaaaagatattactgaaagtccaaatgcaacaccacatctgctgccaagccctttttaaaaaagattttctaaaataaaaaagaaatgtagaggaaaagtgatccgtttgaggagaaaatagattagacatagggggagaag

SEQ ID NO: 42524 - DNA, 649 bp, Bovine  19866880420507
ctctaagagtccattgactagctgatttgaaatcaacattaacttaaatacactcaaatatctgagttctaaacttagaatcttttacttaaagtaatatagaaaactagaaaagatatgctttcaacaaacatattcagcagttttgtgcatgtgaatggaaactgtgttaagtttatattttaacgttgtaacaaaaacaaatgttgtttcacattttgctataaagtgattctaattatgtaaaaccctagtgtgtgcatgctaagtgaggtcagtcctgtcccacattctgtgtgaccctatagactatagcctgccaggctcctctgtccatgggattctccaggcaagaatactggagtgggtcgccatgtcctcctccagggatcttcctgacccaggaatcgaacctgtgtctctgacatctcctgctttggcaggcgggttctttaccaccagcaccaccggggaagcataaaaccctagaagtccatatataatgttcgagtgcagaatggccaataccagtaataaatcagtcgtgaatgtcatcattattcagaaatcagtgaccatacttatctgtgaaataatcaatactattacaatacttaatgactgaaaaatcataagaaaaaactccaat

SEQ ID NO: 42525 - DNA, 1262 bp, Bovine  19866880545104
actgagtctgtatgtttgggttcctgagacgtagctgaggtctatcactaccgtatcatttacaccagctttaactgatggtgccacactaacggtaacttttacttatcttttgagttctctgcagagcctagtagatcctggactgctatatgcttatggtctggtaaagattatcatttatttaatccagtacattgtgaattttcagtatgttctggtgacagaatatactttgtacaatttttaagggataaaagtgataccaaaatttctaactgaagataagaaactcttctcaaagaacattatttatctctccttttatttcctggcctgaccaacagcaatgtttcatgaataaagaaaggaatttagttactaccagctatctaaaaattaagttaataaaattaaatgttattttaaaatatttcagagttagcatccaaataaataggttgtctcgataattataaaccagtagtaacttcaggaggctgaaggtataagccaagccaagatatgagaaaagtctatagctatagatatttagtctatagctaccacttcataaaactatgggaaattgtggcaattgatattgtttctatagcgaatgcaatatacaatatctagaaaatattttatatagtgaattttatatcatttcatccattttcccaacaagaagagagaaatataccaactgtgtaggtggtatacttctttttcattaccataagtaaatgaaataaacagactctcttagactagactatataatatatagaattcatgcttgctatcttacaaggagttatttgtatgtgaaatcttgtggacttgagattgaaaatgtgtgatttacaagcaaagaaaaaacagctttaaatcttagtgccctgcatttcaaatttctggctgatttataagccttttaaatcccatgctattaagaaattcaaaatttatatggctatatatatttaactaatattaactcctcagccagccagcctgtggcattttgcatgcttttcttcattttttccgtctgtattttttctcatctagctttttcagaaatgttattcctatttctgtcacactgtcgccttttagtctgtcttgcaggaatgtaacatcagccgccaaatgaacctaggaaagaaaaaaaaaaaaacaggcttatatcattcagctttttaagaaaactcaaatttttctatttttcagttgataaccccataaagagctca

SEQ ID NO: 42526 - DNA, 1129 bp, Bovine  19866880721901
caagggattttccaggcaagaatactggagtgggttgccatttccttctgcaggggatcttcccaacctatggattgaaccttagtcttttgcatcttctgccttctttaccccaggagtgggttattgcgtttgcaaactctccctctttttttttttcctgaccaattctcattcatccctcaggtcttaccttgcttgttcctctctccctgaaggctttcctgactttctagaagacatcaggtcttcctgctcagagcctttagtatcagctttcattattctcgttattttctctaaggctctaaactctgtttgtgggaggtgggaagatgagctattgccttgggctctgaaacttcgtgtagtgcctgtgcataataaacactcataaatgttggttgagtaaatgaataattaaatagtgattgcttatctataaatctcaggtcttttattgaaataagaagcacctcttttctttgactttttctctctgagttacttttttttcaacctaccaagaaaatctactgagtttcctcattttagggataggctattttgcattttttttttttcaatgaattgtgcatgcctcaatttctggttatactcatagtcataataacataatttccaggctcctagaaattagtggcttcattcggtccctaagggaaaaatatttagggagttatagactgatttgaatattctttgtaaggtagaatgaatacctaaagggtatgtatatatgttatttttagatatcacttcagtgagattcacaatcagttcctggcttggtattcattgcgactgaactgaactgaactgaactgaaactatactgtggttaatttaaagtaaaggaatcactggcctgagcttttaatggatggaaaccaaaacccaatttacaaaattaatgttgtgggaccagagttataatttcagtttttatgttgaacatatacaacttcaaattattatgtgtatgaaatatttttcagtttgcgcatgctaaaagtttgactttttttactgaatattaggattgtcactattaccttctaaaacattaccaaacaaaataattgtcttttttttactagctttctta

SEQ ID NO: 42527 - DNA, 1957 bp, Bovine  19866880760569
actggaacccgaaggcctggggatttccacgggctcccttactgggcgacgtctggctctacggactccttcacgcagcaggtagtattgcagtggatctggccacaggtcctctttgataatttcagcaatcctgtcagactctggaaggctgtggtctgaaaaccaggtgaagaaattgcacacgacctcttggttcctgcgaatgaaggactggggttcatggccccggcgccatatgattggagtggaaagagaccctactcggccagaggctctgacctcatattctttgacaatcagctggtttcgaaaatacgggtttctccgaaagaagaacttgaacttgcagcctgttcgcgggtgtctgagctccttcacctccaaattagttatgcatcttaacatctctgcatcttggcctctaatcatgggagacaactggggggtggttccgaaaggcagtgacccagaagcccgggatattctgaatgatgtagttcctccgctccaggtagtgtcgacgcatccacccgaatttatgctctagttgttgaaaggcccggtcagcctgagcgttcacagcatccagttccagctggattgcctccagcgggttcatgcggagatccatacgcaggggccggtgccccgcctcctccaccactctgttctccacaatttctatttcttcaccgactggcctctcctccacctccattccctgctccactccctcctcctccttcgctccttccttccccaccacctcctcatccactgcgaccgagaagacggggccctcttcagtcttcacttcctcagccttcgcctccgccatcaagtcagaccccaacttctccgcgccacaagtttctagcggcttctcccgactcaagccctgcggctctccgggctgacggccatttcccaggctgtcgtctgttgccagggacacagacgccgtttccaggctctccgtaggaggcggagccggctctagcctcgcttcgggcactacgtatccgccatccccaccggctcggatctggaacgtaccggcacagcctggatctgagggagcagttgagggcgcgctttcctcctctggaagctggggtggtgggagcgcgacggcctcgaaatacccctcacccgtctccgccatcacctgtgacgcctctgttttcaggcaccgggaagggtcaggagctccggcggcacagtcggatgtggtgaggctgtgggcttcaaggagaggggtcctctcgcccccgtctcggccgctcatgtcggcagcacccagataaaccgaaggccagtgtctgttttcctctcagaagccgcgctcgacgaaaaccggtcgctctcaccactcactctctgatctcgcgagtgactccgtgaggatgacgtcagggcagtagatctcgaagtgacgcgagaactcgcggctcctgggatggctttaccaggcttcctacggcccgagtgtttctgttagctttatttttacgaatttaatccggtggattggtaatttgatttacgtaaatatgtggctcgcaagcagaggctgaagcagggagaccccccgcccccctcccttcctggcagtgcatctggaagtacctccagattgttcgctggggtaattgtaaggatcccagtactacactgccttctgttgtctgaaaacatgtttttatggttttgtaggcaagcgggtaaatctactccctgttattccatgatgggcaggagcaaaattctctttaatttttaactaaattaatagcaaattgtttcccttttctcgggtagtgagtgaaaatattctggcctgtaacatctctgggagaaaaagctactgaacgactttttaccacaaaagtcatgcatactgttccttgctagccttacttcggagaaggcaatggcaccccactccagtact

SEQ ID NO: 42528 - DNA, 2021 bp, Bovine  19866880792139
tgcgctcttcctgcttctctgatctcctactgctgcctgcaactggatgcaacgcccacccccttaggctgccccctgctggatgaacattttctagaccttgttaggtccactttctagtttttggtaaacaagaatcttcagaattggtggtagacccaggtttcctgccagcatgtaaaagacctttctatttctcctctgggctttgctggtggctcagatggtaaagaatccgcctacaatgcgggagacctgggtttgatccctggatttggaagatcccctggagaagggaacggttacccactccagtatttctcctctaaaagaactcaattcctcaccatcactcaggaaccctacttttaccgtcaggcaagtggttgaggggataagttagactcatttacatggcaaggataatgatggtgtccttgacaagtatcaggttttctcagcctcaaccagtaaaaccatacaaaggttagatactttcatttgtctcccttcttcatcctgaacatgatgaagagccagcagtgccagggcaaacagtttctcttctctttctccctctctttcttatatctgtcctatctctttttttaaaaatggtagctcagaaacatctgcagaagcaggcttttgcggtttaacttgtgcgcgtgcttagtcgcttcagtcgtgtctgactctctgcgaccccatggaccatggcctgccaggttcctctgtccatgggattctccaggcaagaatactggagtgggctgccatttccctctccaaatctgacctgagacaagccaaaatgaccaccacaaggaggcagtttaacttgggtctttactatttcaagaggcagagagatggtcctgtaaggagactaccagagcccttactcctctctgccgtcttcccagccatcacccatcctagcaatacccagacagttggaagaaaggtagatgtatatggaataaatggatgggagaactgaagagactggggcgactgcccgccctaagaaagaaaactgaacagacgcccagaggcagaaatgacccagggaaaatatgggcctagaatgaaaactggattgactgagagcctgcaaggaagggtatcttctcttgtcagtggtgatggaaggagaaatatttttctcaggattgggatgggagaactgaaggtagttgaaatactaactatgttgctgaaagatgggttctttaaagaaattcaaacaatgcaattatgtggaagattaatactatgtccttaatttcactagtatttagtaaaacctattactttctctgtttctgtttactgggaagatgcggctgtataggttttctttggctttcagttgagaacatttgaaaggatgctaatctctttcttgtacaatatggaaatttttgtgaatattcatgatgattttcaacttgtttctgttaaaactgtatcttttagaagtaaaattgaataacttggtcttgccagactctgaagactttggaaatgattgtctttatggaaaaataacacacaaaaatttgtggctctgactgtcttcacaatttatcctggtaacaacttaattattgatatatctctctctctgaatggcagaaatacttgggaggtttctctgtaaaattggaagtgtaccactggcatatttttctttccttatttgcatgttggtaaaataaaagcatgtcagtataaaaaaaataaactaaaaagaaaatagcaagggtggaaaaatacacagaaaaatcagaatgcatgaacactactcttggaagagtagcttggtacaaatactttagaaaattgattggcagcatctatgcacaccctctgatccagctctgggaacacacccaacagaaatacatacatatatattcacaaagacatgcatggaagtgtttataacagcacagttctaatagagggaactgcccccagaatccatcaacagcagaaaaagtaagttttaaaat

SEQ ID NO: 42529 - DNA, 1832 bp, Bovine  19866880903020
acaattacagcactgaatatggatttgaagcatttgacttctgctgcttctgcacatgttatttttctttaacagacactgatcacctgataagttaaatttaaaacaaggttttagacacgtaagcagtgaggttacgtagctcatgttaggtaacaagatactataaaattaagaagtccctgctctctgagagccagtgatcccaatgaggcaggcaggatatacagataataatagcaaaagttctagttcttatgcttagagccataattcttaatcctaattgtacattgaaattacttggggagctttaaaaaaatatatcagtgtcacggctccagcctggaccaattaaatcagaatctttggggtaagacacagatacagagatagaagtcaaacactgttcatgtaaattttatagattatggttttaaatacctttacccttcatttctcaattctcgttgtccttttccaagcattatgtttagtacatagatactcaatctagatattctagatttatttacaaatattaaaagcaaaccatttagggcccatatagggtccataaacagaaaatctgttttaacgttaaatttcagtctcatcttttgccttctataaacaaacaaaaaaattagaacattttttaatctattgtttatctcattcatccttcaaaaactatttcagtatctcttggccaaaagaaatttatatagtatatgtgtatttcagaaaattgtatcatcccttactgcaaatacatttaaacagttcatggctgaacattttagctgttcactggcctgctcttctataacctacaaaggttgtaaatatttcagtctctcctaaattatgttctgcagtggaaatgataacagaccttaattggaggctgatggtggagctgatagcattccagaatctctgatcctcccgcacggcagcttagagaacacgacccacacgtcacaccaacactggcgatatagttaacaaggaaaatgcttacttattccatgatgatagaaatcgtgatgtggcacaattgtctattaagctaaaaaagcatttttaatattcaagttgtacttatttttttttaccacgagaggtccctcaatcctgaattacagtggttgcgtgcaggccattttctctgcccgaaggactgtcgcagcacttcgctgttcttcccgtaactgcattaataccgaatttttaatataggagagtgaaacctttattctttagaactagctttttaaattttttacttttaatcccctctggatacagaaaatatcagcatctaaggatagaagaggagtgtaaaggccaggaaaatgagttacataaaatggcaatgaaatcgaattcttttgaggttaagtgaaaacacaggctgctttgtgagtggagaacaaacaggaccattcctttctttccaccttaggtctcagtctcagttccctgtcttgtctagtcagtgtcaatctctcagtataaaaatagaataaacatgattatttttatcaataggggtatagaaaggaaggtactttagataggatgacattaataggacatgaataatagaatttttgtcataggttatatgttacaaatcattactttgactttaaataaacataaatgttcctgtgtctgcctctccacttatttaagtattcattcattgaatgattgctcaatgtcaaacagaaaatcagactccctgcctttagggaaataatttaataagcagttattattccagcataatatgtttaacataaattcctctggtttaatag

SEQ ID NO: 42530 - DNA, 2674 bp, Bovine  19866880917391
tttgcctgtgtatcgtgtgtgtgtgtgtgtgtgtgtgtatgtgtatacagacataaacatagatatatgtactacataataaaatgttcattttactttatagagtaaaacatctgaaatataatttatcagtagtaatgttaagaaaaggcaggcataatatgattacttaccaaaaaacaccacttgctattatgggcagtgatatttgcaattaagttgaacacaactaaattatgactttaattaaaaggcattttctaagatggcaccaacatgtttaaaatttaatacattttatgtgagatactggaattgttaacatagaattttctttctgcaccgtttgcactttttaaaaagcaaaacatctctaaccaatatcaaaatgctccctaatccatagacatttcattgcataataaattgaaggagcacttttttcccaaccaactattacttgcccttccttgggatatacgattgtatttatatccatggctaatagtaatagaattcctgacattctcttgtggccactatgtccacattaattttaaatgaaaactaaatggaggctggggggactgataatgaaacacacagcctttggccattggtcagcatccgattagaatgagtcagcaggtcttagaaagtttgggagcgatagtggtatctcagcggttagtgaaaggtgggtttgggtctgaattctgggccaggcagagagatacagggccacagtgccaatgacatccttctccaattctgtctcccctacaagtcttattacctgcaaacaactaatttgttaaggtgagaagctgtcttttttctaaaagaagtctgaaacacagcacacaggattatttgtgatcttacattgtccagacctctgaggtttaacaaagcgacaatggccttgcttatctttgctgctggtagacgacagggtaaatacgtgagtgtttgagcatctaccatctttacaaactgttctagaaaccatggagatagagaagaagcatgaaacagaagcaataaaagtatgttgcttcggctcaaggagtgtatcacctagtttgaaaagcacgtttttacctacactgaaagagtaactcataaatgtaaatgagtctttgaatatgtaagttcaacatgaaggatacacacaaggtcaacatgaaagggtacacttcttccctgacgaagctgctgctgttcgcattgttttttgaattgccttcagaatgaatttagaaggcatgcagaaatatttaccaagttataagtccatggtataactcaggttaatcagccatatgattcagaaatttcttccagtgattctggccacttccaagtattgaagctgcccttaatgaacatattaacatattaaattgccccagctatggcctttcacataaagtgatatcctttctgtaaaggcagttctgctatttgtgtgatacttcagttctaaaaattctagtatatttattttaaaaattaaattatgttgctgcagagacctaccttatattctcaagagtagatagcaggcttcaaagcaatcacaaagtactattataaaagtgttgcacattccatgggacctatgtgttcaatgtaatggagatgtatcacagtgagttctcagttcagcagacacaagttaaaaaatagatatgccctcctgcaattgcttcaaacacctctgaactaatttcctttggttccctctcctctctccaagcaatgtcttcgcatggacttcatcatggctcaggtgactagtttcccccaatcacagttaccatagattatccattctcccttattttatctcatttctgatcagccaccaattcctgtcggctttatcttttaaatatttctcacctccatgccctatcctctatttgctaaacctctgccctgattcaagccatcactgacagagacaaacaggactctctagcaaaaagccccaggagctccttctaaactgcatgatactgggcccactgggcctgtccccccacaacccgctttgagcagtaagaagggctgcacctgaattctattatacttctgacaggtcctatggtttccttttccacaaaagaggagctacaatttcccacagtgccaaagcccagaggagctgggctttccaaaccgccctgcaaacagctgatatccaaaatcaggctaagaggcttgtgcaagtttcctgatgagagggactggctgtggggaaaactgggtcttgctctagtgggcagggtcatgctcagtaaacctttaatccaatttgctgatgggtgggcctgtgctccctccctgttaggtgtttggcttgaggcgacccattcccagaaaggcaaaccagtcctggagcccatgggctgtatggcagagctaaagaggacttatgccaacatgcgcctcccaggactgctcctgctgccggtgcccatgtctgcacagcagaccacggccaacgcacccctccgaaggagaccctcaagcactggcaggcaggtctggctcagtctcctttccccaggctcctggtgcacacaaggtttcatctgtgccctccacgagtctctgtttccccaagtcccatggaagttctgtaatcaaatcccactgtccttca

SEQ ID NO: 42531 - DNA, 1347 bp, Bovine  19866880921206
ttaaaagcgtttatatatcccatcttacttcccataggctgatccaggtgaaggtaccatggtatatagtctaggtcctctcaatctaggcagatacacttggtcaacatcatgatgaggagagtggctagaaagctggtgtaagtgagtaaagtgagctgattgcaactcagatttctgcatctcatttttttctcagagtgaactgcatcgatttcaaggatcgtcaaccacttttttagggaagtctaaaagctaatctgtgaagtattaaaattgtccttttctaggaaggaaaaagacatgtctgcttgacttgctatgtaattctgcaaaattgggttggcaaaaaaaaaacctgaataaacttttttggccaacccaatacattaatagcatgtggcctacaggaaacaggaagctaaaaaggatctttcacaatcacggttctatggaatgatccaggaaaccctccctatctgttcaggatgtatttgagtgatctctcaaagagggaaacaaatgaagggtgtactgtacttgtgggaggtggaagacagctctcaactagggattaaacgaaagcttaacatttctatgccagagcctctttttggcaaactagtaaagcctcagcttctttctcaatatgttttaaaactcctaacatataatacataggggtaccaggaaatgtattattttgaaatataatgatcagtacagatatttttaaaaactgtgatatatgtgctcctttattaagatattaaaattcaaaatgtaatggctaggatagtaactatggtaatttgtaagtagtgatgaatatatataatattttgagatgtatacagtaactgtatgataggaaaatatctgtgacaaagacacaggttctcagattgctatagttggttatccagatacatgatttagaagagacgctaaaatttcaggcacagtgaaaatttagatgtaatacttctctcatacaaaccccacagacatagattaagaaaacttaagttctgagagactactttttctagattgtgtttctcttctaggactttatatcaggttggccaataggatcatttccatttccataacggaaaaccccgaacgaacctttcagcccacccaatactaaagacctgatcatgttagagaggcctcctctgcccactctgtcagtgttactcctcagcccacagcatttcattcaccttcttcatgtctttgtcctcctggcatttaagtacgtctgtctgtgtgtgggtttctcaggtggcgcagtggtaaagaacacacctgtcagtgcaggagaagccagagacgtag

SEQ ID NO: 42532 - DNA, 1256 bp, Bovine  19866880963735
acccagcaatctgtgtttaattatagtatgactcacaccaaagtttaagaaccactggctagactataacctccagacattggtttaattgatctggggatacagatgaacattgacatctttaatatgtcccaggaaaatgcagccaaaattgagaataactgatctatacctgttgtttgaatttacagtcaaaaacaccaagtctagtaagattaaattattattccaaactatcagattttatgctattttcctaatttcccaaacaaggagatagacatgatgtcttctgagacctcgcagccataatgggacctggatgatagaagaagccaactgtttgagcctccagtgttaatcattagggtttagttttttttttccctccctaatgttttcttcattttcctccctaatgtctacttcacttttcattcactttaagtcgtgtattctcagtggggcaaaaattggttcttggtgtaaaaaaaatcttaatgcagtggattatggttctccatatctttattctacacaataaaatcttattccttagtatttctctcattagggagaaatgtaatttaaagctaaatttattaattaaatatattttttcttctagggcaaggggcagtggtaatgaaaaaagaggttgaaaaaagttatttttaaaaggttttatagatgtattgcagtccaggattattgtgttctatgtgctatgtgtagtcatattaatagcggtttgttgcaagatgtttggacccagataatgtttacagtataaattcctggctactctttatgctgtaatttcactctgtccatcatggacagaatcagaaaacactggtcaccatcattttacttggtttgtagccaagagtttaacatgttgatagatgcaatgaaaagataaatattttgttaaatttttaaatgctcaaataatccccaatatattgtgggattgagtatctcagggtaggtaaacagttactgaatttttttctctcaaagttagtagctttcttcagtatctgttaataaatgttaatgtctttgaaatttatttccaaaatctcattggaatataataaagagcatgcacaatcaagcttagggctcaaggaaagatgctgttttcatgtatactttcatggatacctttgatttcttttaaaaataaagctatttttccttatgcatgtttattttgtcaatggcaaagaataatatatctttaaata

SEQ ID NO: 42533 - DNA, 756 bp, Bovine  19866881007827
aaactggaaatttgcccttgaataatgtttcctgtaaatcatcgaggtttgtgggggtttgttgttgctggtaactgctgggtctgattgggagttggtttaggagccagggtggctgcaatagaggaaaagctggtgtttcccccagttaactcaagtaaaaagtattctttccataaagggatcattaagggaaaggaaagtccctggttccttgtcagtgtggaggaaacaaaagctacagtggaacaggccctatcttccctcagtcagagttcctcaattgagggataaaggtcaccaatgcgcctgcttctggaaaggggtgggcatggggaggtcggcggcctgtgtgcttggatctgccacaattagttgggttgaaataagaaagcgaaagctcaagacaccctgagaaaccctcttcccttttttggaaggtgctacttggcggggcacgggcaaacgccagatctcccaaatcatttcaggagctgggcggcgaagaggcagaagcagccgagccttgtccacggctccctagggtaggagacccatggagaagtttcgggaggtgttgaatttgcacctcaaacaccgtaacgctctgggctactgcctggtgagcctgctgacggcgggcggggagcgcatcttctccaccacggtgttccagtgcccgtgcagcgtcgcctggaacctgccctacggtctggtcttcctgctggtgccggcgctggcgctcttcctcctggg

SEQ ID NO: 42534 - DNA, 1164 bp, Bovine  19866881021721
ggaggggttactgccacttctttctctaagggaataagacctaactgttgcttgttcatcatcttaactctgagtagttcaaattttacctgttgattaaaaaaaatttttttaagtgactaaatcactgttttgttgtgtttacctaaggtgttaggctgggtcctgatagcagttgttatcatcctcctcctgatttgtacatcaatcactcgatgcctgtctccagttagttacctgcagctgaaattttggaaaatctatttgcaacaggagcaacagattcttaaaagtcaagccacagaacatgcaacgcaactggcgaaagaaaatatcaaatgtttctttgagtgctcacatccacaggaatacaacactccaagcattaaagactggcagcagatttcatcactatatactttcaatccaaaggagcagtactacagcactttgcacaaatacgtgaacaaaaaacagaagaatcaaagtagcacatcttctgaagaagatgcaatggttcctgttcttggctttgtagattcatctgatatgaacagcactacagacttatgaccttgttaatgaatgagaaaagaaagctcttctgaattattgattcctttaaaaaaaataaatgtgggtattgtttatgactcctctgtttggtcttccaagttatggaaacatagaatattaaataaaatagaaatttagaattttatctttttattattttatttaaaaagtaagcaaggttaaatggttcactcagtgtgacagttcagttcagatcagtctctcagtggtgtccaactctttgcaaccccatgaaccacagcatgccagacctccctgtccatcaccaactccgagaggttacccagactcatgtccattgagttggtgatgccatccaaccatctcatcttctgttgtccccttctcctcttgccctcagtctttcccagcatcagggtcttttcgaatgagtcagctctttgcatcagctggccaaagtactggagtttcagcttcagcatcagtccttccagatcactcaggactgatcttctttaggatggactggttggatctccttgcagtccaagggactctcaagagtcttctccaacatcacagttcaaaagcatcaattcttcggcg

SEQ ID NO: 42535 - DNA, 4554 bp, Bovine  19866881218579
ttcagttcagttcagtcgtgtctgaacctcagatatgcagatgacaccacccttatggaagaaagtgaagaggatctaaaaagcctcttgatgaaagtgagagtggagagtgaaaaagttggcttaaatttccctgtggtccaggtaattttcacgtcctttccccttccctccccttcccttccctttggctcagcatccctcttggcttgtagtaattaaccctgtcacttttccccgctcccctattatggtaaggacaaaaagataataataatgctgatcaatgtattctcttagttttccctcctttccatttcccccaccacaacctttgtcccatgcatcatcaccatttggactatggaaatgttttactgctacctttaatcttaatagcttctgcttccacatcacacacaaggagccaggcactgtggctacaagctttatgtgcatcacctcagtctctctcccacttgctcaccaccaccgctagattaatcatcagaaaacatgacctggtacatctcaccagtacatacacataaaaaagttttaagggttccctttgctcatggagtaaaaccttttttaactcacctccatgtggccactagtcatttcttcagccttattttccctatattaattctgctccagctagacacatcctcttcccactattggtggtagcatcacttaaaatctgcctccctagcattccttcagtgctcagccactactcctctggtttggcaagacgcacacaaaagctagtgctgcacagtattactttttattttgagattagtccctgtgttcacctgaggctgcagacctccctggcataaagactgagtctgataacaccagatatgcttttgagagcagttcaaataaatacttgctgatgaagcagttaacacattgtatttcagtgtgggcattttatatagtcttttgatttatactgaatgttggacttaatgcctgtgtttcacgtaatctttcatttgttcttgccaaagagtgtggagggcaaagcatttaaggaagaagccttatctgctctgggccagttgcagcacagattcgcatgttaattggcctcagaccacagatttcaatctaaccactcttctgccaaagggaacagttctgcgtgaatgtagagaccaaaaatgagactgacttttctgtcctccaaaacacagggatatcagggctgcacacaggaaaagcgtgtgtgttaaagtgacaatgtcacatccagtatctgaagtagaacttgcagtcacagaaaaaccaggaaattccttgtatgggtcatttgataaagctttgttgttgctattgttcacctttgtagtcatcatgaaaggggacttttgaaagaattttctcagggaggaagtaaggttaactaactggtactttccccactgaggagggtacagcaccacgtgtttatgagagcatctgattgtaacctgaatccacttccctgagtctagtcatcaaaagtacacaattcctcacaaaaagtttaggaagaatacaaccaagtttagacaagcattcagtctcaaggcactgtttttgcatcccaaccatttcaacagtgtaaaaggaaataaaagtcaatattgttaaaataaaaaacaaaatgtgtacatatatgatggtatttccaatcatcaagcctgaaatgaaagtgtaaaatttaacctatgtactctgtttttgtacatttgtgataatgcttgtcctagaaactagcagaatatggattagagttgaaagcgttaaacattaaatagtttctatctttgtcacatccaaagaaagtaaactgattttgtaattcctggggaaatgctttacttcacaaatcaccacacatgttcattcacatttctttcttacatgaataagctttgaggtactaaggtttctttttaatggttatatgggtcactaatttcagagtgacttagtttcctacccttcaaaaatagttaccttccttcatgaatcattttctttctcactccaagacagaaagctaaaaggaactttttaattcactttatagaattttaatttccagtgtcatgaatgatatttatctcaacccactttgtttaaagcattgagtattctttaaaaagctacaaaataactttttctttgagaaccatcttcatgagaaaaaacaagaccaaaggtttgggtcgaatcagtgggtggtcgctgtgtgtgcctgctctggatgggttcataaagccatgttttggatttggcaggccagtctggattttctggataaaagtttctcatacaaagaggaaaaaagaaggagcatttatatcctttttataaatatcagagattatattcaaaatattttgtgattgatacagcacaggtacccattattagaatagacaccagcaaaaccagaggctgatgtttaactttcaaacatggtatttatcattttaacactaaatgatgcactgtgtcatccctcactttcattgaattctttatcccatataaaagataggaaacatctttaaagtatctttaccttctcattaccatacagggtaatactgatataattttctacatgctgaaatatatcagttatatttgcttcataagtatatgaagaacagatgacaaagcaaaagaggaaaagaagagtacatttcttttcctttgagaatcttagagtatcaagggagggacaaaagatcattttaactgagtaataactcaaagagaaaatgatcaaacaaaaagaacatttcatcaccgaggtgtactgtcagagatgtgaacaactaacagtgagtcaatgatggaaaccttcttaaagaaaacacactttgagtacaggttggaaaagatgagaaatccaaagaaatgaagggcaaggacatgtgcacagctgaagaaccagcaaggtgtctgtgagcagggtggtttggctggccacagtgagcgggggagggaccattaaaggaagaaacaagaaaaccagttctctgatgtttacaggtaattgcaggtggaaaccactaactcaatgggagaagcagatcatcagcaaaattttaaaagttcattgggagggtaagatattccacttaagattttaaatgggagatagtattaagtttgaggcacaccagcaaaaatgacagaaaatttcgatttgtactttaaaaatgatttaacgaacaaatttaagagatgacaatatggagtgtgggaacaagaaagagttcttctgtgggaggaatacaggagagttgatcagaaatttagaggcgcaaagaaatttttatgtgggtccacgagtaaatctttgaaattcactgtaaatgtgttttaatgagtatatgcatttttctgggacatgaatccatcatttctttaaattatcaatgatgcctatgacagaaaatactcatcttcctcagtaagtttaagtggtttttttcaggttcacacaagaactggtgacaaagttataactacagtctaccagcataaaatttatccactcattcatttttcactcaacagcgacaaggattcatgcaaacacctactctgtgcatgcacagttcaggctggtagaattacagctgagaatgcaaggaacacgaaatcctgcctctgtggatcttgcatactaatggggaaggacagcaacaaacaaatacaggagtaattatacattgtgttcaaaggcgatatgtgcaaaagagaaagagaaagaagcaaaggaaggaagagggagattgcatttttagaatcactcttagtaggcagcagtatgtggcaggtggaattccagagggttttgtcttgtgttcctaaactcaaagtaatcaaaataaatagagatgtggagaaaaactgaactgcatctttgagaggagtaaacgagtaaggatcataatctactctaggactgaagccaatatccagatttttcaactgcaatttggccaagatctgttagaagattttttttctaattaaagaacaaacaatgcccatccacttcacacatgtttttcagtgacgtttatgaaaatgcaaaacaccaggagctacaagtatcctccaagggtttcctgggaagcaatggctctttagccaaagaaaagtgagcaaactgtttaatgggaagagtattgttttatgaaaaataactgtacataggatagaaatcctatttctgattatagtagaataaataaagtaggattcgttcatagatatctcttaaagccatataaaattaaactatttaaataaaattatctttcacatttggcaaatatacaatgaagaacaaaatctctgtctaatcttaacccatacatggcacaaagacacacacatatgtgtggaaatggatgtgtaaatacgtgtgtgggtgggggggcatgcatctgcagctagcattaatcaggtgtgcactaattgcactgccattttagggattaaataaacagggttcccagg

SEQ ID NO: 42536 - DNA, 1627 bp, Bovine  19866881260440
actgatttttaaattgtgataattatctcccattagaggctcagcaagatctatttctctgttctttttcattgatttgtcttttttactgtttagctgtattttacgggttttttttttttaatgtttgcttatttttttatgtttagctctgtttcagcaatgtaagccaacttgaaagcttttgtagaagtaaacacattcacaaatgaaatgatatacaatcaaataaaatggcatatctgccaaacataagaaagaatttctaattaaatgaattgcccaacactgggacaggctggttctctggggtttctgggaggtttaatgctccacttagaaagttaaaattgtaagggatttcttgggaaaagcaatattactctagacagcttttgcaaattctactagtctatcaaaaaaaggaaaacatgatacgtgaatggcaagaaactttacatatgactgagtctaaatccctcttttactgatgaacctagagtttcaaaatcaactgctagtagtttgcagggctggaatccacgtctagtcatctagggtgccctgttaatgacagtagaaataggagaaacctttaacaattatttcctgtttcctgttttgtttctctttttttcaagaaattgactgatttcttaggagaatgtttgaggacttttagaataccacctttatcttccctatcaaactcaccccaaactctcaggaagccttctctgtgatggagaactcaagccctgaatccctcttctccttctttgcaccccgtctcagtaaatagtagacatgttaaacagaatgaacatgaaagtcatggagaaatgtaatgaaagataattgaaatactttgaaatgaatttttacctccttgggaaaatacaaaggaccttctcatgtattaactaattgattttcatagcagaatactgtctctttccatttttcattgttttcacatatgcaagacaacttttggtcatttgctcattattccttcacatttccaaaagcagagagctctcattctccatacccaatgaggacccttgatataagatgtgttcctgctgtttagttcagacaagtattaggtgaagtgtacacaggtctgttcagatttggcttcatttgtcatagctggtggcaaacacagctctggtcatgttcaagtaaacacgtcacataaagacaagccatctcctagtcataggctgcttttggaaggctggccaaccatcttcctaatgcctgtgactagttcaggtatgaatcaggtgaacaaccatggatactcaccatgattcatcactatccccagaaaaagagttcaaagtacatgtttcagtgcaaggggggcgtcaacacctccatcttcctgtgcaaaagggagtactctttacgcacaaacataaaaccaattggatttttattgagcacccgccttaagcaagcactgtgctaagtgcctttttatgtcgtattttatttaattttcataccaaccctaagggatgtggatatttcttcattgttttacagagcagaaaacaaagtagagggagattaagtaaatttcccctggatacaaagcaggtaaattttcatt

SEQ ID NO: 42537 - DNA, 953 bp, Bovine  19866881312962
ctttttattctcctgtaggatctttcgaagatggtttggctgccttggagatttggagatctgatgccacgatgaggactcacacacggggggctcccagtgtgtttttcatatgtttgttttgcttcgtgtcagcctgcgtcactgacgagaatccagaagtcatgatccccttcaccaatgccaactatgacagccacccaatgctgtacttctctagagcggaggtggccgagctccagctgagggccgccagctcccacgagcacattgccgcccggctcactgaggcggtgaacaccatgctgtccagccccttggagtacctccctccttgggatcccaaggaatacagcgcccgctggaatgagatttacggcaacaacctgggggccttagcaatgttctgtgtgctgtatcctgagaacatggaagcccgagatatggccaaagactacatggagaggatggcagctcagcctagttggtagatttttgtctttttcttcttactgtattaactctgtgatttaaggaatgaattcatagggacatgaaatctcagaagccagattttcatatactgtgtatgtgtgtgtgattgagggggaaagattgcttgttatttatgttgtcagtggcttctgaatggtctctagtttcaaagacctagtaacttccaagtttaaagttagaagaaaaatatttatagatacaatctaaccaaagaaaaagtaatttgctgccttgagtaaacagtatcatcttgattgttgagatttctttcccccttgtttaacacacttgtattactatcatcaggtcttaggttctcaccgacccccaagtgattaaaaccttttgccagcaagagatttcctccaattaagatttctttccattttaggacacttaggagcttgaagagctaaaagtaaatgtgataggattaa

SEQ ID NO: 42538 - DNA, 1181 bp, Bovine  19866881588734
tctctgcttctatggataagactaaatttttctacagtaaatctaaaagccacatgaacaaaaacaacaaaatttatgtatctaatactaacaagctggtaatagaacactgatatcagactgctaagtcgcttcagtagtgtccgactctgtgtgaccccatagacggcagcccaccaggctccaccgtccctgggattctccaggcaagaacactggagtgggttgccatttccttctgcaatgcatgaaagtgaaaagtgaaagtgaagtcgctcagtcgtgtccaactcttagcgaccccatggactgcagcctatcaggctcctccgtccatgggattttccaggcaagagtactggagtggggtgccattgccttctccggatatcagactaagacattctaacttaggagcgcacctgaggagctttttcaaaatacagttgctgaaccaccattatcttaatgaatcccaaatacagaaggaacggtgttgtgtccctcaggactgtgggagtgtggaaagaaggttgagaaccacctacagtgtttatacaccataagggtgggggctgtacatcattcatccagctcttttaccaccatacttgacatgtagaaggtactcaagaaatacttggtgaattaatgataacctgggaagtgaaaatgaacatgtaagcttaatagcagctaaatgctagtgtgcaaaaaacatcttcatatttgatactgaaaaaaccattttggttgctgagtttaaagagcatgactttctgttctttaagtagaataggttttcattataaagccacagtctagtcactttcaacagctacaggtaaactcctagaataaaaatagttttaaatacacaattgggtggggtgaagctagaaaatattctgattctacaatctgttttggacaagacagtgctttttatgtgactaacaaagcaaacagtagtcagattccctgtactgaaataaacacactatttgccaaaagggttgaacgtacaaggcttattcaataaagacacatttcccaaaattaaatgggaatatagaatgacaaatacccacatatatttacatatcccccaaagaagacatatgaccacttggtatgggattttgtctctaataattacaaaatggagccaagcccactgt

SEQ ID NO: 42539 - DNA, 914 bp, Bovine  19866881787212
actactacagtactgaattttgcccgcaaaaatgctcaaagagaaaatgaaatggttttatactttctaagacaagctataagtaaattctagtttatctagcagtgtaacagttggatatcttctgatcggtacttgttacagttttaatggattttcttaatgatgacattggacgacaaaaatcctattttcagaattttttattcttacattattttcagaacaatctaatgctgagtatgaaagtgaaagtcgctcagtcatgtccaactctttgtgactccatggactatacagtccatggaattctccaggccagaatactggagtaggtagcctttcccttctccaggggatcttcccaactcaggaatcgaacccaggtctcctgcactgcaggtggattctttaccagatgagtcaccagggaagcccaagaatactgaagtgggtagcctatcccttcttcagcagatccttagtataattaagtgtatttcttttttggcattctgaatcttttaaaaagtggtagcttatgtattttaagttttccactgtattgttttccagaattggaataccaattccctacctatactgggagtaagactttcttgtatgtattcattaattcagctatgtattgagcagctataaacctagaaactatattaggcatgaggctacaaggtaaaatttctcccttagtccaaagcaatttatttaacttattgtacctggccccaaagaaaattagcaatcttttttgttttcaaaatttttcgtaatcaaagatttttctagaagagtttcaaaaactagctgtgactttctcagcaatagctttaaacatgaaaacactattttctggcataactgactaaaagcataaagcatgtaaagaaaat

SEQ ID NO: 42540 - DNA, 831 bp, Bovine  19866880403446
tactaaattcaaagggtagagtatgggattaatttaacttttgtgagagagaccttttctgtaaagcaagattctgccagtggcaagtttgaaaatgcagcccaaaggggcttaaccattatagggaattgattaactcaagtaattgaaaaggctgggggtggtataccttcaagcttggctgggtgccagaggatggagcaatgaaatggctacactcttcagtctcttctcagtcctgctttctcctcaggtgattgccgttgtcaggcaagctgtgctacataagagcgaattgggtcaacagcagtttcacaggcttttcaacccaagtggaaacccagggaaaacagcagcttatctttcccaacagttttatgcaagtccccagaatactgttggtccacaggcattccccactgtggtcagtatgacgtgacctctgttagccaggactgggccaccagtgagtggatccaggagtcagtagtttcagccttgtctgatccctaggctgaatgggaaagtgctctctgcccaaaggaaaagtaggtgctgctaccagtggatgagactaaaggcaaaatcagcaaaggaccaacttttcttttcgttttaaaaaattttagtcatttatttatttttggcttgtgctgggtctttgttgctgcagcgagtggagctgctcttcattgaggcgcacaggcttcactgcactggcttctcttattgccgagcactgactcagtaattgtggcgcacaggctttgccccaggcatgggagtcttctgtgaccagagatcaaacctgtgtaccctacagtggcaggt

SEQ ID NO: 42541 - DNA, 1748 bp, Bovine  19866880516676
tggaaatggcatcttagagaaatccagaacttgttatcaaggagttcatgattttcaggggtctagttttccactgtggcatttgcacaggtttaaggaaaggctgagaatctcattttctattctcttctcggtcccgtggtaaggcgagttttcattattgggagtggattgactgctaaactaaattagcaattatgatgggtacaattaactgataaagaatttattatcacttaaagtaccttaagaattaaatctgatatttatttaaccttactcggtatagcacagtgggctgaaagggatacaaagaaataatgaaagtcgcatccaacacttggctcatctgtatctgtcactccacaagacacttcatggacattataatttttaaactgtgacccaggtctctcaggttgcaaagtctattttctttcctctacactacgctctggtgcttgcccttagcaaagttataaatccagtgggagagacaaggctactacatacacataaagcaataagagaataaatagaatttagttctgtggccttgattttaataccaaaacaaacaaacaagcatcaataacaaaaataatacaactggtttgggctaagtggcagaacagaagtataggtctccatgtcttcagcatcatgaaggccagattagcctacaccctttcttactgtgtgaccttgaactctgatgctcagtttcttcatctgcctcatgacattaacatctactgcacttgagaattaaagctacatgtaaaacaccttgcataatgtttgccccaaagtagaacctctgtgttattcaattcaatgggcattttctgcctcatgttaaacaaccctcacaatttttgacagtaatactggtgccagctctcttgaaacatcctcattccttgtgacctgagatttcagtcttatagttttcctcctatctctgtggatacttcttgattttttttcaggacccagtgctggatcttagcctgcttctttgatcactgtaccttctttgtatagactctcatggatatacacgtgtatattctgacaacttcaaaggtatttcagacttcaaactgtcttttgagtcccaaactggattatgtaacaccctattcaatacctccactgactatctacttgaccagttcccaagaggaccatgtccatacccgaacgtcctatatcataccaacttccccatgcaactgataaacctactcatatcatacttctaaatacgtcagtgattttcattgctcttagaataaaaatcttgccttttcctgcatagccacattgtaatttgccttggatttctccagcttcatttcatgccattctctatcacattcaataatcttcagatagactatcctttgttaagatcttcaaatacccaagctccttcctgagtcagatgttttgcacctactgtctatctctttgcctggtaaattctttgtgaaatttcaaattacagcttaaatttttcagagaaacctccaggaactccaggctatgcagattaaacttggttcttttgctacatgctattatagaataatgtgtttctccttcctagaacttacagcattcattatatgtatatatacgagagatctcttcctctccttacaaagtcccaatcctattggattacggcccactcttacgtcctcatttaatcttgattacttaatcttgacttccctggt

SEQ ID NO: 42542 - DNA, 1187 bp, Bovine  19866880536921
ggagataactccccagacatgttccatttctctagagttgaaacacaccccatttgcctaaagcagtgtaactactctggctttgccatggactctgcattgccctccttcctctcaagggttgacaaggcatgatttaaaaatcaacaaagtaagtgttttaagtttaaaatacaattatatcacactaacctttcttcttgccaacatctagcaaatagtattaagatggtgtgatcagttagggagactaaaaaaatccacttgacatttgaccctgactatgtatataccagaaactgtctgaatactgatgtttttcattactcaattgcaacactacaatatattttctcttccactgtactcattactttctcaaatacacacaatcggttttatctactcaagtcttttctgcaacttctttgtttctaaataatcttgtaggtacacatgaccttgaaatctcacttattcttcataacctattatgtagccaagaactcaatttaatcctatctaagctttaattgaatagtttaaaatactattctcctgtgaggcaagcaattcatttaaaaataaatacagcctttcttatatcataatcctggccctgcagttgttgaatatttgaggaatctaacgacaacctttagtttatcactgtgattatcataatttcactactaataattacctaccgactttaaaaaatgatctgaagaagaatgatatggtagatgaaatgagcttgaattacatgtactttatgcttttccccagatttatcagaatgattttataaccttgggaaagtcactgaacctctcaatgtttctattctgatctctttaaaataaagataataacttcatcttatcatctacttcagtgatgaaggtgtaaagactcataatcataaaaagcacatcaggctttacgaaagccagactcagtgtaagtataaagtatttttgagaaagagcacatgaagagtttgcaaacacaaagtttttataacgtgttttggaaaaaaaaaatacataaagggaataaatcatacctcgatactcattttctgaggtgaactcctgtatccactgtatcccctgcattattagttcaagtgaaggacctgacaaaattttaatgtcactgcagttagcattcagctatggctt

SEQ ID NO: 42543 - DNA, 935 bp, Bovine  19866880640990
ttatactttcttttcagaaataatcatagctacttctgatataaaggcaatttaatgttctgctaaagttctgagattattaacccattttcctaatgtctttattataatagctatcattctgatcatcccacttgtaacattattgtttcttaagatttctaatgcatcttaattagacatatggtttcctaagttaaccacttttgaggcaatttcatgaagattatattactcagaacccttattttaaatcatatattaggtaaatatctgaaaatactgagtaagtgaacagggttacaatttttatttgtattttgttttacaaataaaattgtgagtagttagctagaacatgccggagaaggcaattgcaccccactccaatactcttgcctggaaaatcccatggatggaggagcctggtaggctgcagtccatggggtcacaaagagttggacacaactgagcgactttactatcaggcattggagaaggaaatggcagcccactccagtgttcttacctggagaatctcagggacagtagagcctggtgggctgccgtctatggggtcacacagagtcagacacgactgaagtgacttagcaggagcagcagcagctagaacacgcagtaggtttgttttctgttatatcctaatggcaagcagatgacaggaaggtgtaacattttttcagggtaaatagcattgaatatgcttggagagggggttagttgcttagagagtacatagttgaaatcaaatatttttctaacttctgaaggtttcagtgattcctattaataatccaaatatatttttgaaatagaaagctctattattgtttactctagttctaggtaaatgggcttaaagttttaacagtttttacttttaaaagtatattctgtcatctccagatctttca

SEQ ID NO: 42544 - DNA, 1489 bp, Bovine  19866880677724
tagggaagtagacaggaaaaagaaggcaggcaatagagagtaagttatcaagcaagttacaactgtgagctgctggaaggtaattccattgaggaaatctgggagtctgtgccgaccataccttagaattacctgaagagaaggttgagtattcttcattggttgaagcttgcttctagagaatttaactcctatcacttttgcctagccttaataagcaagcctattgggttatcaagcctggagtgggtgggggtggggatcaaatctccattaagaagcaacacattcacagcatgcagccttcatcttagaggtgagcactgagaagctgtggatgggattcgacaagcactgcttcctgatcagctggggcccttcacttatgcacatgtgagaggtacttaatctattactaagaaatagatgtttctgatcaagggaagaaaccacctgaggctatctcctgtcaccaataactttccattgagagttcaaagcagggcctcctgagagaccccgaggcatcatttaaaatggatgagaccttgctattcagataaaagctctcttctttatcctcagtcacctaactatctgggcttcccaggtggcactagtggtaaagaacctgcccaccggtgcaggagacatgaaagacatgggtctgatccctgggtcgggaagatcccctggaggagggcatggcaacccacttcagtattcttgcctggagaatcccacggacagaggagcctggcgggctgcagtccacggggttgcaaagagtcagacacgaccgaagtgactttgcacgcacgcctatctggtaatatccattccacaaatctgacgaggtgaactctacactttctttacaagcagtctattgatcattcttggttcaacagttaacagtatgagaattcacagtctcaccattttttccagactcctttctcactaccatgactggagaggcatatgggctctgaagcagtaatgatcatgttaaccaacagctcttttaaatgatccctcaggtcattaatctcccacaaagcagtcctcctagattgttcccaaaatgcccttgagtcatttaacaagatgctgtgttgctccccttgggcacatcccacgatccaggcctgtagggattggcttcaattttcacctcaacctctcctgctcagatgctgaggatacctcagagcgcaagaagactgggctcaggctatgggtgcttctaagacaaggccaaggaggtgggaacaaggagttgcaagggttttggggaaagaacatctggccactcatgcttacagaaacctccatgccacagacttgatcctgaggacatagagctatatctgcaacagtatgtaccaccaaagcctaggttaggccacagctactagttttacacttagtcccataagcttctgaaagttgttgcatttgccttctcctttgggaaaaaatcgtt

SEQ ID NO: 42545 - DNA, 2730 bp, Bovine  19866880688055
ggtaaagagttgtaaaagaaaaagcggcaccttgaggagtgagaatctaatgaagagcaaatctcagatgtaaagaaaacacaagtagaatgccactgacataactgaaagcctggaggaagagtctgggaacctggctgaaacagaggctgaataaaagaggagaaggaggtcatactagttgagcagactaggtgctgggtctgaaagctgagtttgagaaattaacattctttacttctgatcacaagtaatttaagaggagctgtggagaaggccatggcaacccactccagtactcttgcctggagaatcccagggatggtggagcgtggtgggctgccgtctatggggtcactaagagtcggacacaactgagcgacttcattttcactttcactttgatgcattggagaaggaaatggcaacccactccaatgttcttgcctggagaatcccagggacagtggagcctgatgggctgcctctgggctgccagagtcggacacgactgaagcgtcttagcagcagcagcagcagtggcccagctcaggaaaggagcagctgtgacctaggatctatataatcaaatatcgatcactccttcttagcctccgagccctacttgttcctctgagtgaagtttctctgggcagaatctgacatgctgtttttaataaggaaagagatttttttgttttaccactgggtacagtatgaccataccagctcagcttagtaggaaatccaggtttgctctattggcaaacttgtgcctataactggggctgactgcttttgttgagtcagcccctcacgtgcactttggtggactttttcctcttcggtgctagcaatattccagtttcaatgttaagaaacaaaaggcaaccaagtataaaatacaaaacttctatttttataattctaagatatttacagaaatgattaagaactaatgaaagctttacaaataatgtgtatttaattacagcgtaccatttattatttattttctttgtaagaatggtgagatggggaaagagtctaagcctgtttacacacaaatataatcctaaacaattggaggaagcgtgttggttaccccttgggccagctaccctgaattctgcgaaacacagaatgcaccgctgtgtaaattagaaaaaggctccctctacaggccgactcctttgtgctgcagcaatttcctcactcaggtggctctgttaatgagcatctttacctcatggaggtagagctggtcaaatgcaatatgcaagctgcctttcctcttagagaagatcaaaaaaattcttagcatgctgcataatgattttcctcttggcatggataataggtgaaaagcctaaagagcacgctattttctgtagaatcacattgcttttgctataattaactttattcaaataaattgcaaattgaactactataacttggctctgatcaacaaatattcatctatattatgtatttatccatttatataagagatgggaaatagattcatacaatggaggggggaaaaaaactggattgttttgcctgagagtataaagatttttcttgaatatcttgccagaagctgccagaggttttctatcttctctgagtacagaacaaaagaaaactagcttgcactatataggtatttcaactctgaaaagaatttcctaccaaaaagaataataaaaaattagttgacaagagaattttcattccaagctagctagagctttacaagtaagagtaaagattttatttccctgcatttaaaattcagttttccctttcctttggaaacataaggataatttatagataataatcagcatttttcactgcaagaaaagttaataaaggtacatagaatagacttcatatattcattttttgttgtgggagaattgatttttacatgagtaaatacccctgtttttctagaagagttaagggcaaatataaggtagtctggaaaagaagtcaacagggtaaataacttcatatagctaatttttgccatcataatcctataacccaaaacactattacatgggaatagttggttagttgagcaaaaagaagagtgaacgtggacaacgtagctaccttttgcaagcatagggcttagaagataggaaaactggactcctaaacagctgtgtgacatcaggcaatttatgttcagtctctgatactagtttctcatccatacaattacatgatgacattagttactaaagttacttccagccctaatattttgggtaggaaattcttgcactctttacctttaagacatcagaattctcaagttttagtgcacgtggaactcatctgggaacttgctgaaagtgcatattccacccacaggcattctggaccccttgtccagacattctgattcagtaggtagattcctaagaatctttttcatatactttctccgtggtaagactgcaggaagaccaagaaatacgttcaggaaacatttggataaaattaactttctgaataacaggagacatgtctgactagactttgtacattgcataactagcagtgcatacatgctaagttgcttcagtcatgtccaattctttgtgacactatggactgtagcccaccaggctcctctgtccatgggattctccaggcaagaatactggagagggttgccatttccttctccaggggatcttgcagagt

SEQ ID NO: 42546 - DNA, 1008 bp, Bovine  19866880752663
tgagtttctgtctacatgatctccagcccaaactagaaagtgaacaatccagttaatgagccaatttttgtgtatgggatgcaaaacattggtttgattcatattacttttaaattaaccagctgtttaggtaacgtggtgcaaaacaactggcatcccaaaccatccattacttcttccaattaaattgtattgccttataactgttagcaaaagatcgttcactcatttgttcatgctttgtttactggttaaacacttagtgagcaccagttgtttctcagagcagggtactgcgcttagtaataaaggaaatgcagagatgagagagactctacctctgcctttgaagagcttccgatttcaaaggggactaatacaacaaaacaaatattgataaataaaagacagaatgtgatgttttgtgcactgatttaaaaaattattgggtgcttacaacccacagggattctctttttgaggaaagagctcttgatacaaccctgatgtagcagattcaggtctgagccctgtcactaactggctttggcatttgcttagtcacagcttttctggaacataatatccccatctaggaaaggatatgttgtgttcaatgtttgttagtgctttttcccatgaatactattctaagtttcaatattttaagttggaaaagaacatgaatcagggtacatttcaaagggtagaggaaactttgattaaaaatgtagaaatacggatgttcttgaaaacacaagaatggatcttaattgatgcagatgagttaggcacactctctttaaaaaaaaaaaaaaagatttatttatttatttttggctgcactgggcttcctctagttgtggtgactgggggctactctttgttaagggtcttgggcttcattaattacagcacacaggctcagtagttgtggtttgagggctttagtgccccagcttagtagttttggtgcatgggcttagctgctccacagcatgtgtggga

SEQ ID NO: 42547 - DNA, 1718 bp, Bovine  19866880853348
cttttcactttcatgcattggagaaggaaatggcaacccactccagtgttcttgcctggagaatcccagggacgggggagcctgatgggctgccatctatggggttgcacagagtcagacacgactgaagtgacttagcatagcatagcatagatatatgtagtgttttgcttacagagaaaattacactgaagacaacacatagtctggctggagatcttatcttttttctttatttctaatgtcagttctacaacttaataattatattcacccatccatccatgcttatgctcagtcatgttcaactctttgtgaccctttggactgtagcctgccaaggctcctctgtctttgggattttctaggcaagaatacttgagtggattgccatttcctcttccaggggatcttccccacccagggatggaacccatggtcctgcattgcaggtggattctttacccctgagccattagggaagcctaattacattcatatttatgcttaatttttcatgatttaacaatagtaaacatcttgaaatgcttataatttcattaaatataaactgagttgaagatggtatatcacatttacaaaataaaactataatatgttgtagaatatgtttttttaaaaataaactgaactttgaaacttaaggatttaaattttttgagtgctatttatatttttatgtttatatgtttttgtggagtagcattttcaattaccaaatttcagttgccaaatggttatttttaagttttttattcctttagcaatactagattatagtagctttaagtatttggacacagtcaaattatcagtataatttggataagaaataatggatgaatataaatttaatcacttcatttaaaaatgcagataacatgagtgaattcatctaaatttattcccataaaagcatcactatttttccaaatgccatctaattcaacatggttatcttttgtcatttacagaaaagtgaactacaacatagccaaaataaaatataactgtgattcatttccatatgtggttagtggctaatggcaaaattttgaaggtaactcatcttcaatgcattatattagttattagaaaattaagaaggatctaaaactatcattattctttaagatggcatatttttcttctcaaagcagaaattagcagaaagatcccaggcaaaacatggttcatagaagagagagtttatgcttctgagaaagtcaatattaaactgattttaaataaatttctttaaagagtggtagtataatatactttaggattctacaatggaaaaatgagattgcatttctgtggaataagtggtgatttttccaacttaatctagggctctctgtcctcaaataaattgttccacggatgacataaagtaagtcgtttgggcctttctacacagggtttttcaaatcaagcttttgtgaaagaatattactacaaggaattttactgaaccagaaagtgtaaatgaaggatcattgatgaaatgtgttgagaggagggaaaaatgggaaatgctgccgaactaaaatgaactttgttttgtctccagggcagtcctgacttaatgaaatgcagctatgagtagaataaatcagcctttgcatagagagttgacagtgaaagcacttaaaaagaaaccacaatgtccccaagatagaatctggatgtgt

SEQ ID NO: 42548 - DNA, 1073 bp, Bovine  19866880871477
cctccctgcagagggaattggtttgggcatgaacccatgagcagtttaatgtcattcagctgatgccttgtgttatccttgagctaactaaactctgccatcagaagcagtgttgctgcttgggggctgaggattgggggtttcaagagatagtattctattaaacttgacattaactcctcctctgcttatctgcaaaccaaatgatttctcaggactccctcccttcctcttttcttccctctcttctttcctgccgttctctctcttttccttctttacttgctcatgtagtctgtaaatttttatcccactgttgctgggccctgtgctagatgataaaggtgtagggataaaaagtatggtcttttttcttgtaaagctcatacaggaagaacatacaaacagtcgtaattcagcttgataactgttcagatagtattgtgcaatgaagagaaagaggagtgatacatctaaagaggaaagaaggcatggatgatggtgaggggagacattttgaatggagtcttgaagcatagccatgtgtgcatttgttttgaggggagatactattgcatcttcagaagttctgaaaaaaaaaaaaaagttctgaggcaagaaagggtcacgagtaggagagtttgatcgaagtctgaacattttgtttctgttccaaatggcggaagagaagtagaaccttaaccctacttgtgccacttacctgctaaactagagtatatccatccttctctcctattctttcacatcttctcttcaattgaaatttcatcaaggaacacctcctacacacacacacacacacacatacacacacaagtcacaggaccttgtcttaatctatttgcactactcagaaaaaaaaaaagtaactttcttgttgttgtagagtgtctatgtgctattatccatttttactagtcaggctgctgctaagaacaggacagagtcattagggtaagttccagtggtttggaagggctatagggtacacagaaaagagtgcatagtatgaggttgcgaaggtggacagaggtcatatctcctcgtactta

SEQ ID NO: 42549 - DNA, 2619 bp, Bovine  19866881031892
tcagatcccataactattttgtaaccaaaatttaatatcttccacatttgtccttaagaatttatctctagcccgacttagaggtccactttattcctcactttgtatcccatgcttacctgtactgttttcaaaacatcacataatgctgtacctgtctattttcttgactgattgccactgatctgtaagtccctgagaaaaagatacttattcttcaccattatgtcctcagtgtaagtagcttacgcttagtaggtgctcaataaatatctgttgcatgaatgagtgaattgcttcaacttctgttttacaagagaaacagaatattgctaaatgattcattccattatctttcaagtagaaagctacaagcgtgcatgtatatgtgctcagtcatgtctgactctttgcaaccccatggacagtagctcaccaggctccttgttcatgggcattttccaggcaagactactagaataagttgctatttcctcctccagaggtagaaagctaaataatcccaaatgatccatgatgtataactaaatatactgattaaaatctcttaaagtataattatatatttacttttctttaatatacacaatgaaaataacaactgctagcaatttctaattagtttctcttttttcaaatccatattaacttaggattcaaaaatcagtgtgatacatttatataagctaaacatataattgtacagcatagtgttcagctatacacagtgtacagcatggctctgaataagtcctcactagtgtcagcatgacagtagtaataccaatggaccagtttatggtgatggcgataaagaatgtgtatcaacaatgttatatataagtcatttgaaagacatgtatccaagataatactataaagaaagagagataaaaatttggacatctatctatttcaagatataggaaaagcataatcacatgtcttttttccaagtaattgttgttggcattattcttacactaagcatgataatagcaaattattgcattaggaaagagaatgtgaattacagtcgcataattttacgatactccatagggcatagaataattctctcttaacgtccaaaaatgcaagcaaacaatattgacatcgaaatgctttttgacaaaaacagccattacagagaaaaagagattaaaaaaggtttttatactctcaactcctcaaaccattttacaaatatttataaaatgtcaccaatagagggcttacctgaggtcaagtgaaagaggccctaaaccatcaaaagctatttccaatgtccagctgggagatctaaaacagagagtaacaaagacagtttatgacaaagctgacacacagtattctggaaggagtgaaatcaattgtgacatttttcatttatttgtaaatgcttctttggcagtacactccctcaaaacgacagttgcttcttacagaagaggggaggtgatggtaaaatacaggaatcctgacagttgctttaatgagattctgctttagggctattctaacacttttcccaacaaggagcctgcccttcattttcaatatcataactcagtaatttggaaaatgttatctctgtgaaaactaaacccagtcagtccttattagctattggttcagttgattttcctcttgtctttcaattagaagaaaacattctaaagcaagtatctaaataaatatcagccatacagaccaattatgtcttttattaaaaaagtactcttttatcaaaaacagtaatatggtgtgtgattgaacaactcaagacacactttccagtaactcaatatttgtttgaaaatatcacagagtacaatataagatatattttaaagactttactttctatgttttaacaagttcctctggaaaaggaaattattgcaaaggtagtttcactagtcttaaaaatttgagcaactccaaattaagcagtctaaagattccacttcatgtattcattcaattttcctttgatcatatattaactgtttggtgcaaagtaactgtcctcaacccatttctttaaaaaatgtaaattatactgtgcaaggaaaatacaatctaacacagggtagcccagtatctatcacctattagtcaaccaatagatatttactgaactgataagctgcacaaaatcaaatctttgtgcatagcaaaacacattttggcatttcactgcattatgggttcaaattctagatcacagagaaatgaactaaataagaaacctcagagacataacaaactttctgggttccaatttgcttttctatgaaatagagttggtactatttactgcatgtgatttctgtaatgattaaataaatgttggggcaggaataaagcacctagcacaagttcttggctcataatatgttgttaataaacaatagttattataattacaaggttttactttgaccagaacaaataacatctttctcaaatataacaacaaaagtagcaacaataaataagtggaaggagggaaccatggctgtaagaattctaagataaaacctttagttctatctcttccctctgtgaaactcaactctctcatcacaaaaa

SEQ ID NO: 42550 - DNA, 819 bp, Bovine  19866881064358
caagagtactggagtggggtgccattgccttctccgaagccctgaattcctctcttaagaaaactaagttattgaaaataaagcccttgaagatttaacattgattctgtcatattctcctttcagaatacagttagcctgaggttaaagctaaatattatatctttacaattttcagaaagaaaatggagatgtttagaattctgttgctactacttcagcacttctttataattagtcagttgttgttgttgtttggtcaaccagtggtgtccaactctggaccccatggactgcaagtgccaggcctccctgtccctaaccatcccctggagtctgcccaagttcatgttcattattttacatgtacaccatgtacaatgagtctgcacaactctccaaatacaataataaattaaaattttaactttcagttcagttcagtcgctcagtcatgtctgactctttgcgaccccatgaatcgcagcatgccaggcctttagttaacattaaaaaagccaagtaactgtatttttgttactgcaaataatattgtaatgtttatattagttgccatttttttcctcttccattatggtttatttataggatactgaagatagttccctgtgctatgcagtaggaccttgttgtctgttcatcctatatataatagtctcatctgctgatcctgaactcccactccatcccccctccccaacccttggcaactacacgtctgttctctatgagtctgtttctgtttcatagataaattcatttatgtcacttttagagtccacattaagtgatatcata

SEQ ID NO: 42551 - DNA, 1675 bp, Bovine  19866881187440
tgggctggcttatcacctgtcaccgctgggggagccctatgtccttcaattggtctctctctctcactggttccatggagcctttttaaactcagaatgcaaatccctttgctgatgacaggatgtgtagagggaggtacagggaatcaaagggaggagtctagagtctgccctcagctcaactactaaccagatccccaaacgtggacaaggcacaatttaacaggaattactaaagaacactgcaatgcaattgaaagtgaattgaaaatctagtacaattggatttctaatctctgtactgccaaaacttcacctctgggattttcatgaatctcctctgtgtcacagttttctcctctgaaaattaagaagatttgaatatttaagaggaaggcataaaaccactaggttctgtggggtaaaggtctgcaagagtgaaaggaatggaaggagaagggttgtcacattgggaagctggagtaggaaagataaaagcaccattttatttggagccagtgatgagcgtagaaatacttttcttttactgtcctcgagtatattcattggcaaacactgcccttctgttagatttccacggttttctgtgacctacatttgctgtgatgttttactgactccttcatttgaattagctgcttttttacaggcctccaaatgccattatgaatcaccgaagctcacgccatctatcacagttataaggcatataaaagatgacaatcatcagtcaaatagcttcactcctcctgaaacaaaattttctcagtgcaaaataaatactttccctcctgctaggttagctaaaatttatactcctggtatgcaaatagtcctcaaagtttcagagtaaagaaagtgttcagtatgttggttcagtcacaggcaggagatatcattttaaatgggagtttttgttttgagacttatgcacaggcttctgaaagtatcacacttttattagtgggacaacaaggcgtgttcatatgcttaactatatctcaaaaaaacctgcttttagtttatgtcttgagcattccagaaccttacatgataacattaaatccaaccataatttgtttcttaggccaagaaagaaacattataacaatctctttagttgctcagtcatgtctgactctttgtgatcccatggactgtggcctgccaggctctttttttcatgggattctccaggcaagaatagtggaatgggttggtattccctcctccaggagatcttcccaacccaaggatcaaatcccagtctcctgcattgcaggcagattctttaaataggaaaatataaattttatgttttattataaataaatacatgatagtataaaatcagtgaatttttacctagaagaaatccaagatatgttcactgttaagtcaaatgatgatttgagattcaaggttcaggtcatttagccagggaaaactcctaattaataatagctggacctgaaatcagagaaggcaatggcaccccactccagtactcttgcctggaaaatcccatggacggaggagcctggtaggctgcagtccacagggttgctgagtcggacacgactgaagtgacttagcagcagcagactttgatttgagctccctgtcaattccatcagattctaacactttaaac

SEQ ID NO: 42552 - DNA, 671 bp, Bovine  19866881235704
ctgctgagtattaattatatgttactgaaaataaatttaaaggaatataggcaaaagaataggaagtaggaaagaatgtaaatgtagctattggatcatggcaatttgttatatattttcaaactagctggggacagtgttgtaagattgtatttatttatttatgcatctgtaagtaatggggaagtacctatcatttagaaataattactctcaccctgaaacttctataggcaatgtatggcttctgtaaaattgtccaggatatattatgtcacttttgattggaatctatatgactgaaactgaatagaaaaacagtgcattcataaatgatgcattttcctaaggtctatttttaaaaaattagaaaaacagtgcaaacgtgggaagacacccatactccttaaacaaattggagaatagctgatgtttgtcactgacaaaattaaaaattcattgttcagtttagtagcttgaaagcctgttatgtcacgttcttcactgaatgacacacattcttctgtagaagtgttcttctgctaaatgcacaccagaatgttggtaattggggcatgcaaatttgttctgcaactaagaacaagaggaggatttagaagctattttaatgtggtagtacatttatgtttaaagtacaataatattcatct

SEQ ID NO: 42553 - DNA, 2351 bp, Bovine  19866880450438
ccaatccctcccagcatcagagttttttccaatgagtcaactcttcacatgaggtggccaaagtactggagtttcagctttagcatcattccttccaatgaaatcccagggctgatctccttcagaatggactggttggatctctttgcagtccaagggactctcaagagtcttctccaacaccacagttcaaaagcatcaattctttcacactcagccttcttcacagtccaactctcacatccatacatgaccactggaaaaaccatagccttgactagacgaacctttgttggcaaagtaatgtctccgcttttgaaattagcttgcactatttcaagcaaatgacaatattatatgataataaagtagtgaactccttaatttagacatgtgcattaagacaattcctgttggagacccaagtgattgtcattagccaccttagcatcacagcaggttacacaaattattattatacttaattagcattctgacaagctgaggaattctttacctgcatttagagattacatgcagaaggatgatctgaaggcatttcctgccttaaaaacaccaaagcaaatcaaagaaatcagatccaatcatatttttattatcaagtacttgcagatcattaaaccaaatgacagaggaagaaataccaattataaatgttgtttttaggtgacatttgatttttcatgtaaggaaattattataatcagaatgatataattcaacaaaactattttactgtgatataatgctaatactatcattgttcacctccttttcttaataaaggaaatggtataaaatataacatcatttaatatttagagaatcatttaaatactatttaattctactcccattgcaatacatgttaaaaattagttttgaattattgactatcatattaaaatttctaacaaaaataagtttcagtggcagaagaatgtatagatttatgtacctgaaaatgtttctgtgctaaaatagaatgctttcagacagaaagactaaataagaaatggttgttattgttcaatcactaagtcttgtctgactctttgtgatgcctgtcctccattatttcccagagtttgctcaaattcacgtctattgagttggtgatgctaacaaaccatctcatcctatgttgcaccctgctccttttgccttcaatccttccagcatcagggtctgttccaatcagtcggctcttcgcatcagatggccaaagtaatggagcttccaccttggcatcagctgttctcatgaatattcaaggttgatttcctttaggattgactggtttgatctccttgactctcaagagtcttctccagcaccacaattcaaaatcatcaattcttctacactcagccttctttatggtccaactctcacatccatacatgactactagaaaaaccatagttttgtttatatgaaactttgctgacaaattgatatctctgctttttaatacactctctaggtttgtcatagcttttcttccagggaggaaatgtcttctaatttcatggctgcagtccacagtggtttttggagcctgagaacagaaaatctgtcagtgtttccactttttccccttctattttccctgaaatgatgggaccagatgccatgatcttattctttttttaaggttaagctttaagccatcctttgaactctcctctttcaccctcatcaagaggctctttagttcctcttcactttctgccgtaaggatggtatcatttgcatgtctgaggttgttgatatttctcctggcaatcttgattccagtttgtgattctttcagcctggcatttcacatgatgtactctgcaaataaattaaataaaaatggtaagaatatgaaaacaaatttaatgtaacactaaataaaattaatttcattatttgaaatattcaaaaaatgaggctatttgttagtgatgatttactaatgatatttaggagaactttatcacacttagctagtttcttggtagaaaatctctaatgtaatgaaaagagtaaaactgcatgagaatatattcatttcaaaagtttctcattatgtgtccatacagtaagtatagttttagttcccataaaaatatcatttcaaatatgaatggttcccagataaactacaggaataataaatagataagcctataaaaggccttcccttttgtttcagcagtaaagaatctgcctgcaatgcaggagacctgggttcgatccctgggtaaggaagatcctctggaagacggtatggcaatccactcatagtactcttgcctagaggatctcaaggtcaatggagc

SEQ ID NO: 42554 - DNA, 1686 bp, Bovine  19866880635458
aactgaagcgacttagcacgcatgcaagcactcatgcataaatatgcttgtatgtgtttttgagtaatgtgttacatgaaaaatattttaaggtaattaacagtaaaacaagagttcaagttatagttctactaaaattaatttttcttaatattggaaatataaattattgccttattttttattcactactactgtttaactgtttcctggtggttccactgaaagaatccacataccaatgcaggagacacaagagatgctggttcaatccctgggtcagggagatcactgaaggaggaaatggcaacccactccagaattcttgcctgggaaatctcatgtagcctagtgggctacagtccagagggtcacaagcagtcaacatgacagagcaacggaacatgcacatgggcactgtttagctacttgtgtacatgtgcttttacagacaacctaatactcttaattaaaagtgggagagaaggcaagatagagggacagatacacacaggacctattttccttttgactttacagtgcggcaatggagaaaatgaacagattaaaaattgtttgagattaatattaacagcatatacgcacacatgccaaataaacttactgcaggagggcagatagctgaagctagggcactgacggtgtctgtgaagtcccctgcaaagaaaggcatgcagacagcaggaagaagccaatttctcttagaagaaagtatttggatttagttgaagccaggaaaacacttgctttagtattttcctcaaccagtaattaggggacaggataaggcagtaagtttaaggaaaagagatgaaaagggcctttgtaagtttagatgaaaagaatgaggattaaaataagagagggagacttgagtaaatgaatatattgaaagcgtttttttgagaaaaaaagtttaaccttatttatgtgtaaggtgcattgagtatgaattcactagtgtctggaaagagcaagaaaatgactgcagtaaacaaagtgtgaggatgagagctctgaaaaaggagagagagtgtggatataaaacttttcagagaagcaaatagcaaagcttgagatataaaatggagatagttttaggggatcagtgagtctaggaactgaaagcaaaatgttgtatgtatgtgcatatattcccatatacatatttctatgggatgaagatcaatggatttttatcaggctctcagagggattcaaccctttactattgaatataaagagcagaagtcaaaaaaggaaacactagagaaagctgttaacattgaaagtaaagtatggaaaagtatgaattaggggtgaagttaattgagtttatctttgacatcttatatgtcattaaatcctttggtaaactaactaaggaaaagaagtgggggcaactctgagaatatatgaaaatttcataatataatagatacattattttagctattgttatatattaaaagcttcactatttcaatttaatcatattcacagtagcatcataaatatccttttttttatcataagcttttatattcaccccacctatttaaatgacctttttaaacaaggctttgcatatggaatttatttttataaatacatagtatttgagtaactagcaaattttggtgtaaatgggggagataatggagt

SEQ ID NO: 42555 - DNA, 1645 bp, Bovine  19866880675159
taaatggtcccaactagaattcaagttaacgtttcattaacctcacttataatacctaaaggaggcatccacatttaaattcagggggaaattagtctaactaagctctcctgaatatactaatcttgaagcagccacagtcacactgagcactgatacagcattccaagttcctttatgacatatacacactttatacatgcacacttagcaggaatgaaaaaactaaattacattactctctcaaaggaaatctttagtgatatcttaagatattgtcttctaatattgaatcaagtattttctaaaaaaagaaaaaaaaaacatttccttcatttattcattcaattatttggcaatttatttcatctttagtccttaatttactcattctttacttaacaagtgccttaaaaagcacttacttcaggtaaagcacaattctgaacccagtaggagacccaaagaaaaataagacttgtgatcccacctttatggggtctgctgtctagcagagaatataagactacagaccacaacaaggtcaaaagaatatgatgagacaggttatcagtgaggagaaggaagtgggagggagaatataggggtaagggattaagaggtacacactatcaggtataaaataagctgtgaagatattttgtacaacacatggaatatagccaatattttataataatgacaagtggagtgtaacctttaaaaattgagaatcactatatagtacatccggagaaggcaatggcaccccactccagtactcttgcctggaaaatcccatggacggaggagcctgataaggctgcagtccatggggtcgctaagagtcagacacgactgagcgacttcactttgacttttcactttcatgcactggagaaggaaatggcaacccactccagtattcttgcctggagaatcccagggatgggggagcctggttggctgccgtctatggggtagcacagagtcagacaccactgaagcgacttagcagcagcagcagcagcatatagtacatctctaacttatatatcaaccatactttaaaaaaaaaaaggaaaacaaattaaaaaatagaaagtaatgagttttaaaaactgagttcctactatgcaactagcactgttatgcatactgtgatgccataaaacagaattttatcaaacacatagttcaaagagatttctaccatccaaaaggcagagttaagaacaaggtcactcaaatcacactgcttaggtttacatcttggcttggtcattacttccactatttccttaggcaaaccatttggcatctcattgcttcacccttatgtataaaaggggaatgataagaaggatgcctaccttacaggtttgttgtgagaattaaattacttaagaaatgccaggcactaagaattgtgtctgatatgtcgtcaatgttgtaagtaagtattatcttctttaattttgatatatcacagaagttttccaaaaggacagacagtagagctaaaaggcagcaaagctgtagtttttttttttcttttaagtgaactcttatttctattagcgagactaattcagcgcttcacaaacattaaatgtttagtgccaactagtgaggatatctgtag

SEQ ID NO: 42556 - DNA, 737 bp, Bovine  19866880867202
attatttaatatgtcctttatatttatatttggcataatggttggaaataagtctataaatatttgtgaagaaggaacacagtaattaaaccatcacagtttattctctgaaagcacaggcataatggcacgaaagaccagattccatgttccttcaagtcatgtaatttggaactaaatgaaaattggagctttagtttcttgattgcctaactagagaaatggatgcttcatatatcttttagatcctatctttcaaatatcagatgtctgaagcaagtttttggcatcacagttaatttatgattgacatttttaatgagtgtctgaatgccaatattttgtgttgttgataaaacgatccatatgctttacatttcagacactcaggcagctgaattgacattctgttgtgaaatgttaagttcctaatatgattccaaatccaggcagtaggctaacccatttccataaggaacttagaatatgctcaaggttttcttgttttcatctgagactagggattttgaaggacctagaatgtgcaaagacaaatgttgctatagattaatcttaattaagaatgacaaatgctctgtagaagaattaacaacattatttgtaagcataagaggttgaggcagtagtgttatattggaagagctcaggaaaccctcaccagcacttcaacaaaaacttattgcttaggtgtcaactgtccatatcaggacttcagg

SEQ ID NO: 42557 - DNA, 1764 bp, Bovine  19866880934916
catcaatatttcagcactcagctttctttatagttcaattctcacatccaaggcatgactatttgtaaaaccatagctttgactagatggacctttgttggtaaagtaatgtctctgctttttaatgtgctatctaggttggtcatagcttttcttccaaggagcaaccatcttttaatttcatggctgcagttaccatctgcagtgcttttggagcccccaaaaataaagtcttttcctatttcccttgtttccccatctatggggaccagatgccatgatcctagttttctgcatgttgagttttaagtcaaaattttcactctcttctttcactttcatcaagaggctctttagttcttcttcaatttctgccataagggtgatgtcatctgcatatctgaggttactgatattactcccggcaatctcgattccagcttgagttcatccatcctggagttttgcatgatgtactttgcatataagttaaatagcagggtgacaatatacaaccttgtacaacaatatacaacatatacaatatacaacctctatgcactaccgagttttaaaatatactaccaagttttaaaatgtggattatatatcttcacatctgcatttaattttgtttgcttttcttagatcacagtccgtttcttttttgccttgtattaaaaaatgtattttttatttttaaatctttactatgctttaaattattttaacatcttttcaataggatttgaagtaaagtacatcaatttgcatttttatttattctagataagttatgctcctgttagataagtagtttccaagatgtgcttttcctaccatctgttccaataactgggggggaaatgtttaatggctaatgatgtacatgtgctagtatctctttaagatactctatcattttgatgggctcagtggtgctaacataatcatctagcaaatgaaatttaattttgaaatctaagagtgatagggacaaaatctgcaaagcttgaagaaatattttgggcttgaattgcacacattattccaaattttctttgtctattttttaaaaatttcatttgataccagttgtataatctagtagactaaaattgagattatcttcttgaaaagtgagttatgttaatgcatttgtaggtcatatattattttcagagtatttgagcaacttcagtaagtctataacacctcttgtggaagaaatcagaacatattacatatgttgtttacattgcagttctcaaacattttgaccccctaaaccaataaaaaatgttggatagtttattattaccattagagtgtagaataatttttattaaaaatcagatcatctagttaaaatgaatattccaaggtaaatttgaaaaataagatttcaaattcatataattagtaacaccaacttaaaactataaatatgaaggataaaatactatttttctttgtttttggtctatatgtttaaaattttaaaatgatattagaaacaaaaacctaataagattgttgttgttcggttgctcagttatgtcccgactctatgctaccccatggactgcagcacgtcaggcttccctgtctctcactatctctctgagttttctgaaactcatgttcattgagtcagtgatgccatccaaccatctcatcctccatctcccccttctcctcctgccctcaatttttcccagcatcaaggtcttttcctggaatcagctcttcgcatcaggggcc

SEQ ID NO: 42558 - DNA, 1470 bp, Bovine  19866880935743
tgctttatgtttgctctactgcaaaaacaatgattaaacaacagatgttcataccccagaaatataaactatcaatgtttgcagaatatttatttttagaaaaagaatagtaagcagttacctgctactatgacatatagatattctattcaccttatatttcatttgttttggagaaaaaagctggcgttacttttattttccttttctgaagtattgggcttcgccttttgatatctttgagtttaactgaaaaacttatttaaatgtccattgtattagtcctataagaatttattggaatgaaaaagctttacagtgtttatagtattgtaaacatattttatattcagttgtgtcttcatattaactatatttcctctgtaaaataaattgtgaatgttgaatacttcctgctacaaagaaacggatcaattaaacacatttccatctccctctctttctttccttctccagcagaattctgtgtattaagattctattaaaacaaaaacccagaatcagtaggaaatgtgtatatgcatatagttgtgtgtgtgtgtgagagagagagagagagagaagattaaggaggttcatacatccaaaatctacagggcaggccaatagactgaatagactgactatccaggcaaaagttcatgttgtaatctatagtccaaaaagtagtctggaggtagaattcctttttcttttaagtatttgtcttttctcttaaggcctgctgattgaatgaggtctatccatattatggaaggtaatctactttaaagtctactgattaaacacatctaaaaaatttttgtacagcaacatctagtctggtatttgatcaaaacgctaatgtactatgacctaagccaggtttcacatgaaatttaccatcttcctgagaaattttataataattttacataatttgactgctctaaataaactgaaacaaagcaaagcaatgaaaatatgaacacaaacacacacacacaattatatgatgattggtgatgttttcagcttactagtagtataaattctatctagtcacaggaaactatttctcatatggaagtgagaaactcagtaaatatctttcagttaaagtttgttgcgccctgatgctcaagctatcttaatgaagatattccttatcattgttttcattaaaaagataaatcaagctttaacattctattatttttacaactcacattcaagtgctagtttcttataaaaacataatttttattaatcaacatttttctcatgaaatgttgattgagacatatttcctttatgtttcaaataaaaacaaaaatactgaatgcaaaatatattacttattattgaactggtaaaatgaggacaataaatttgataatactctttttgtttctctcctaagtaaaataactagtattttgtcctatatgacactaaagatggtatcct

SEQ ID NO: 42559 - DNA, 1748 bp, Bovine  19866880954524
tttgagttaatcctggagttggttatggacagggaagccttacgtgttgtggttcatggggtggcaaagagtcggacatgactgcgactgaactgaatggaactgaatttacacacatgcataaacacacatatgagtgcttgtaaagtagatgaaatctaaataacacctgtgtactatttgcaatttactggatttaatttgtaattaaagttaagcaagctatcatcactgaggaaactgtgggaggagtactcaagactactctgtgctattcttttcaatgtcttgtgaatctatcactacttttatatacaaaggtaaagagaaaaagaccatatttgattttacataaagtcaaaagaaaataaaatctttccatgaatgtttcaaacactataaaatatactaattataatcacaaatggtttcaaccaattaatggttttaactggactttttagcagagatagcttatttaaattctgtcttaaaattacataaacatcctacatataattagcatcacatcctttctttttactttctaaagtaacaagttgttcttgttcacacatgattaatatattttcctttttcagctgaacgttatcttcatggatagtcaatcatgcattctagcccaatgagcatgaagtttatgacaatataataaacctttagaaactaagttactttcatgtaagtaattatatatatacagatagaaaaatgaaagtgaaggtcattcagtcatgttggactctttgcgaccccatgaactttacagaccatggaattctccaggccacaatactggagtgggtagcctttcccttctccaggggatcttcccaactcagggatcaaacccaggtctccctcattgcagctggattctttaccagctgagccacaagggaagcccaaattcttttggccaggctgtgctgcacctgggatcttagtttcccaaccagggattgaactggcaccccctgcagtggaagtaaagagtcttaaccactggaccaccaatatagacaggaagaggaaagaaaaacactacaatgctgaaaatagccatgtttcattgcttaagggtaagtacgttctatacttgaataaaatgttcctcagagaaatgactgatgagtatacttaattcatatgataaatgttttcaataaacacatctaagaaaggaaaataaaacaataaatgaatgatatatgtatctgtttcatttctacgagactagtatcatttcattttttcttttacaaattaatattatttgaaattcaacatgggaaatgcattataatactgaataaattttaatgtattataattaaaatatattataatattgtttaaacttaaaatgtattatactattgaataaaatcagcagaaaataactgagcagtcatgcgtgccttcctttattcccttttccttttcactctaaatacatacataatatgcacacataattatacacatattaataacttgcaaaataggattatctcatttctctctgatgttccaaaactatagacattatatcttaaaatgtgtataaaacagttctccgtatgatacatttacagataaaaataagaataaagttaataaaacagaaaaagaaaaccagtgtctttctcaagcccaagaaaggttgaagtttcctcaattctaaaacgttactgaaaaaaacgagtaaagaaaccattgtccag

SEQ ID NO: 42560 - DNA, 1342 bp, Bovine  19866881055947
aagtcgcttcagttgtgtccattctgtgtgaccccatagacggcagcccatcaggcacctctgtccctgggattctctaggcaagaatactggagtgggttgccatttccttcttcatattatagtatattactaattaaatatattcaatattaactgccttatttaacatttattaacacatttatttttcatgtaaattcctttcatataaacaccaaatcattattatgaagaacacagctcttactttggttttgagctatgtagttgtagatgacatattcagaagtgaaaattttaaaaatcttttgcctgcagagagaaatggacagcaacatattttatttcctttttttgttacttttactacacacacacacacacacacacacaaatagaaatactatttctatttgcagagatagaaatgccagaatgagtagaaagtagagtcctgctgtcactgagagtacttgaatctctaattctgaatgagttatctgagggttgctggtaaataaaggaaaattcttgtcaatctttacttaatttgatgcacttacttatttatatctctggagagaaactctctcaaaacagtgggccaataacatctataattaaaatactacacttaaagttttgctttcatttaagtcagacagatttattcttttaagtttcatatgaacacattaacatgaaatatatgcaacaaaatctgtgtaaggtgaatatatatatgagtttgagttttaaaaaaaatttgtcttggatctctatcatttctcaataattttttccatttttatgtggaaataaatcattgttcgttcacatttgagtatggtgaagtgtagtgacattccatctaaatgtaattctgatactagtaagaatcaaacttgtgatatgaaatatgtgagaatacattctaaagatgcccataacccagattcatcttcaaacaattaaatggctatgaaacaggaaaaagaattgcagtggaaaccaggaaaaaaaaaacaacaacaaaacttgtatatatgtgtcaaaatataaagacatttctgccatcaaagtaaaggtaaaaatggatgaatgaaaggaaaaatgatgaacgatgaacatgacccaccacgctacgctaagtcacttcagtcgtgtccgactctgtgtgaccccatagacagtagcctaccaggctcccccgtccctgggattctccaggcaagaacactggagtgggttgccatttcctcctccaatgcatgaaagtgaaaagtgaaagtaaaatcactcagtcgtgtccgactcttagcgaccccatggactgaag

SEQ ID NO: 42561 - DNA, 1307 bp, Bovine  19866881194337
aattatagtacaagccaattctgtcagaggatgttatagagataatgagataatgtcttttaagtgctttccggatgaaagaagataacttttcccatcctcagtaaagaggagacccatgatcactaacacttcacattgctaaatgtaacttctttagaaaagtgatgctattaaaataatgacacataaagctcctcctttacctactgtaacgaaggcatggatctgcggctgaaatcggtgagcttctctaaaaatatcaactattttctctaagtttaacaggcacattcaagggcatttacttcaaagctggctgtagacatgaagcattccaaaacataacaaattttatatcagtaagaagttcctctagatagtatacaaatgtgaataatgaaagtcatactcttcaatgttaattaaaacaagacctggtataaaacctagacggttttttaaattgtcatttccttccactgtccaattagaagttaatacctataacatatttaactcatctatcctctgagtgaccacattacagtgacacaaatatttttaattgattcaaccaaagtgaaacattatggtattaaactggactgtgaccctctatctgccatgcttttctttaaatctgataaataatttattagccatattgtcaatgagagatattagagggacgtttccttttcttttttctttcctctggactcagttatctctaaaggcagcacagtttctggaaatttacctaaatatggagaagttaaattcttaaaaaattataaatgcccaagaaattataaatgcccctagcaattatgaaaaatttaaaactccagaagaataaattgtaaatagtaataataaacatagcagaaattgtgaatgacaaaacagacaacttcttggttgattacaaaaggttcttgaaagtttcatgcaaatgaaattactattttcagtaataaattttgtctcagtcacaaaatattgatggccatatgccagagtccagctccagcagccagggaatcagcctgaaggggtgggcagtgtcggcgggcgatgatgcagtctctgactcttagtatggaactatatcggtggacgatgatgtagtctctgactcatagtatggaactacatgtttatttcaagcttcaggttctcttttacactttgacaaaagcattaggtgagaggtttcacggttttagttccccccatccagattcactgtacctaaatagtgatgcttttgaactgtggtgtggagaagattcttgagagtc

SEQ ID NO: 42562 - DNA, 1120 bp, Bovine  19866881370909
atagcatattggacatctatggtgccttcttttgggtccttatattccaactattccctttttaaaacaggacagtgaatctacttcttgcccattatataatttgtgacaaaaatttttaatgcactactagtttgaagctgagcttgatgctataatttaaaaggcacatggtttaaagagaaacaaaattgaattcaaatcctggtgcattcttttgctaggtacatggctgggcaaataacttacaagtttcaaactcctcactctaaaaagtagatagtgagcacagatgttcagagtttgtggaaaggattagaatttggtgtatatggtgcacttaatgcagtgcctgacaaaaactgaatgtgtactaatatatcttattgttgttattattattagaactctccttctgttagggtgtttcaaattatctgatcacttctacattaagagtcctacaaagccatggaaatttattatgtcgtgctatagtattattttatatttggggacataatagataattaatgtctcctggatatttccaacgttgcagcttcagagttatccagaatattttgtcgaaagttgttttctgtaaatcaggctatgctaaagagcatagtttaatcgtaagcacatggtgaacgtgggcacatggaaaactgtctcatttgcgtctttccatctgccaaatcatacagaatctactaaaacagtgaagtggagaatgagccaactctgagatatattggagaaatgcaaaaacagaaataaccagtagtatagcacaatctcttgcaaagagtgacatttccaagtctgggctaaatttcatcagttccttaagatgcaagccaggaagtaattagtatgtgactctttatttggcctacttagggtttctctcaactttcagctatgaaagttagacttcccttaaacctcaaagggtttggttttctggtaaattagggtacatatgaaagtgtatgagcaatagaatttgaaagaataatattagtgatcttagaagttttcctaggccatgaggtgagtagagtaatagaagctgaggtcaccaaaacaagttccccagactgcacacttggga

SEQ ID NO: 42563 - DNA, 1625 bp, Bovine  19866881511198
cctgtgcctgagtcttacttccctactgttctccccactggggcataaattctcaaatgtatctagagtccttgctattataaagtcctcctccctcctgtaggtcagcgaagagggaaaggttacaagttcagaaaatactgctgaaccaagcagcttatgcattcacctgtaaacttacaggcacacagatatattttctcaatatcccgtagtagtttcaggtcatgcgtctgtgctgagatgataacactaaggcccagtgaatgccacattactgtgatgtacaggtttctttttaagccaacaacaagattacacttaattatggcctcattgaagccaagttagatgtgcaataggcaaaaatagaagtaggtagaagagttagaggaggtgggatgtatcataaagaaaatgcatatctgtgcctttcctgcacatttcctgtacaatatgtgaaaacaatttggaattttgattccatgaatacatcccacattcttttcatttctttgaccaatatgtactatgtttcttaggcaagatgtgtattgctaaaatggcatcaggaatttcattattgagtttagatttaaggaattgaaatatgatgtcatagaactaagtgataattcaatgcaaccaggataacttaatagcttctctgagcatgtggtgaacactttaggcaacagcagtctcttttcacatatatgaacttggtttttgaaaaaaataagggtgtaaagtaggcaaacagaataaaaccaaatgtatccaagttgcctaccaaatccacccagctgaaggttgaagttacatgtaaactttaaagttctttgcattgttgcttacccagtgaggcacttgtaaaactaacagtgcaaatgattgcaatattcagtacaatttctgacacaattatttggagcttcagacccaggacagttttgagcttctcaaactaacaactctgcgatcagtgtaatatttgtcaccttctagaattctgataggtaccataattttgtagtactgataaatatgctatgctttatatcaatataaaaaacaaatatcaattacagttacttgggaaagtttatgagaactcatgaaagcttttcatccattttaacagtctccactgaaggactcagcaaatcttatcctttctttatgagcatatagctttgcctaggaaaatcaagtaatcaggtactattcaagcgaaatcatctagttagaaaaatgccaatgtaaaggttttgttgatgtttgctttccagtttcttggctgatcagggtatatttataacggaaaatcttttgagcaaactataattgtattattcaaaatgtagatctagagcagatttatcagctgtttttcagtgtacaccctgcgtagtacaatggaattataggttttaaaaaggagtgcttcaaaatacagtgttgattttctccccttgcagtgcaggtccacacttttcttggagtgtgtggggtgtgttcagctggttctccacaccttggtcacagtctcactgaccttcgttgcttggttacaaaatcctctttgtgatttgtgagatgcttgtcttgatggagagcaatgg

SEQ ID NO: 42564 - DNA, 866 bp, Bovine  19866881814720
tggagaatcccagggacaggggagcctggtgggctgccgtctacggggtcgcacagagttggacacgactgaagcgacttagcagcagcagcagcaagaaccaagttagaagatcacagggaaaggcattttgtctttcaaatttttttttaaaaagctattgttaacaacattttgtggtatcatctctgcatgccttgcagaacactgacaagccctaggacatcctcgaagtcagtttatgcctcagccagatctgatagcctcttatttttcctaagtgaaaatacaaattgtaactataaataattgctttttaaataaacatgcctaaatctactccatcaaagcacagctgttctttaaaatggataacttgggaaagggtatatttattctattaccaaaaaatttggaaaaccttctttcattgtttttccctgaaaatatgtaagtcatgcaaaaacaaaaatcaatcttagaaatattaatagcacagactatttgggggctaaaaacagcacagcccaattccatcacttacatttttcatgagtctgggttccaaataagatccatcttttttctcaaatgaaatctaaatttaaagtataaaagtccaacactactggatgactcaataaaatataccacaaactataaagctacttcccaagagtctttccagaatgcctaataagttgggactatcactggattgggcctataaactctagagcgactactaggaacaggcttggaagtcagccatccctattttttcagttgcactttataaattataagtgtacattaaatgttagaattccttacttttttcttgtgttaaaatgcatgcgtgccaa

SEQ ID NO: 42565 - DNA, 1173 bp, Bovine  19866880151132
ctaatgaggtggatgaaactggagcctattatacagagtgaagtaatccataaggaaaaacaccaatacagtatactaacgcatatatatggaatttagaaagatggtaacgataaccctgtatacgagacagcaaaagagacagtgatgtatagaacagtcttatggactctgtgggagagggagagggtgggaagatttgggagaatggcattgaaacatgtgaaacgtcatgtatgaaacgagatgccagtccaggttcaatgcacgatgctggatgcttggggctggtgcactgggacgacccatagggatggtgtggggaggcaggagggaggagggttcatgatggggaacacatgtatactaattaaataattttctattaaagaaaaaaaaaaaaagaatgtagtgtcccagaaaccaagtgaaaaaagtatttctagaagaaaaacacagagcagtccaataaaatgtgggctgaaaactgtcaatgagatttggtaacaccatacttattacctgtctcttccaactagaacatagttggaagagacttccgagaggtcagggacttgtttgctttgattattgctgtaacctcagtttttagaactgcacctggcaatgtagtatgtgctcgataaataactgttgaagagtgaataataaaccaaataaaccaaagtattaataattattaaaacatgttaaattcttaagagtagaattgctaagtaaaagcaaaattgaaagtctttcaatgtgaaaggctattattaattttttcagtccatcaaaaaagactgcattaatcccatttaaagcccatcaaatactcctttgttatcagtgggaaacctcaaaggatagcttgagccagcttctaagatgaactaatcagtttatttttagttccctcctacttctatcactacacttgaaacacactttatttccctttcaacacccatctcaagcttcagcttagataggattgtgtacactgaactgtcaattagtttcctcctctccaccctaaggatgtagctaaatatcaagatattagttcagtatgacttaggcctcatggagaagtatccacattaaagaaagaaatcatcaagatgaaaactttaaagacctagaaaaacaaagtataatagaatgaca

SEQ ID NO: 42566 - DNA, 1664 bp, Bovine  19866880354902
ctgtaaggattggaaatcatgtgaataatttaaagtactggatgatagatggcaggtagagacttactgctttcctggtcactgaaaaccataacgggagagttatatccttctccactgagaaccacgccccctccccagggaatcacaggattgctgtaaaatgtttggaggaatttcaaatactagattataggtaacctcatggagattagagggaggtttgaagggaagttaagaactgctattaaaaaaaaaaaaaaatactatagccttttgcacagagtatacagaggacaacaaatcaggagcaaggatggcagagagaagaagccaggaaaggctctacaggggtgtgttagtcttggaggaggaacagaagttgaataagaggctgagaccaagaagcattccagacgtgaagaacagtgctcccaaaccacagaggtctgttactcacagcattcctattagaagttgtgagatatggctgagggcatggatcttagaagaacacaagattatttactccttagacaaggttaggccaacatgttccaaaaaggtagcatgtgttcatcaaggtaaacaactgatcagaggtcaagtgagaacaatacaagccctgactaacaagatagtactgtctgtgatacacgtccaataagcttcctcctgcggggatgggctcctgagaaggcaatggcaccccactccagtactcttgcctggaaaatcccatggatggaggagcctggtaggctgcagtccatgaggtcactaagagtcggacgcgactgagcgactttacttcgacttttcactttcacgcattggagaaggaaatggcaacccactccagtattcttgcctggagaatcccagggacaggggagcctggtgggctgctgtctatggggtcgcatagagtcggacacgactgaagcgacttagcagcagcagcagcagcagcagggatgggcaagagccccagatgggaaggaggctcttcttgatctagccaaagcacctctcttaactcatccatcaaaattagataagaaaaccaaagggaacatgtatctaagtcaagcagaaggaagccagtttctaatttcaaatgcacactaagtaaatatacttcacaaggaattctgccttgtgtttgagcctggcacagtatgcacggctgaggctgttggaacgaaagaaaacaagttctgtggccaaggtatttatcatactgaacaacagtgtttccctctaatgcctcaaaactctcatagtcatcatgatgccccatgaatcacgcagttcttgctgtcacatcgcagacaacagaccactccagaggcaaaggatgttttgagtttcgttgctttaactcattggaaaacataatggtaaatgatttctttcttaagaaggtattctaggcttgctaaattctttaatttattttccaaaatgttaatctgaaaacagcatattatgtggagccagtgtctcccttacttttgctgtaatctagggttggcctggagaaggcaatggcaccccactccagtactcttgcctggaaaatcccgtggatggaaaagcctggtaggctgccgtccatggggtcgctaagagtgggacacaactgagcgacttcactttca

SEQ ID NO: 42567 - DNA, 1432 bp, Bovine  19866880503266
ttaactaagaaagtgctattcagcagcctttaaagaagcccctggaagatttctaccaaagaccacaaaacatgttcatgggtcttttctgcctggatgccacccaacacacacctcatctcaaagagcaacatccttggtgtccactgtccctcttctctctcaccctgcccataaggaagctctcttctccccagattctttgcctctgtctagggagtctttcctcctgaggaaagtgtggccttgagactggagtatcaaggggaagacaaccagagtgtatggaggattaccactggccaggcactgaactagatgatttctctactttttgtactaaatctgttaaattatcctgcagtgtaaatcctgttttagaaatgagaagtctaaaattcagagagactaagggatctgtttgctgccatacagctggtaaaaccctcagctaacttcctctgtactccagtcagtttttccactcagggtagagtccccagaacaacaggaccttgctaatcctcacagctattcatgacaatctcatggctcaagcatggaaaccaaaggaaatggagagtggcagctggtgtttcaagcctaggtgctaacacttgccattagctgccaaacaaaacagaactgatcagagagtccagaataaccagagggtttaggaaagccatcaggaatgaggaggtttcaaacctctttcgttccttggatgtccttgaaagagtttagaaatattgctgtgaagacctggctgtgttttctgaacaggcagatctggaagctaagtggaggttaaggtgtgcttaagaacatgatcatttccttttcaaggagagctgtggtctgaagaagaagaactcacctgctgcattctgtgatccaacaggagaagcagacttgaactgccatctgtccgttgctatgggaacaatttcctacacatttacagaaacactcaggtctgggtaaatgctgccattgtcaacgcatgtccttcagctggctcatttggagaaagaatggcaaagtgatcgcgtgacacaaagatagagcctgaagctttctttcaccacttgaaaactaattgatagcctcatttttctaatcataggggtccctgcagggtctgccctgcagtacattcaaactttccccttgggcttgtttcctcggtgagcactggttggtgagggaggtgctgctggttcaagtcaaggaatgcatactggtgactctcatcctaggagccttggttcagtacaagcacaaaggagctatggatgaggagtggtgtatgcccatacttagtcacaccacacacacccacacacacacacacacacagcccagtataattattttatgctctaccatgttcccttcccagaggtcacatcacattggtcagcagaat

SEQ ID NO: 42568 - DNA, 1917 bp, Bovine  19866880659791
cttggaggctcgaagtccaaggtgaagatgcaggcaggtttgctttccctgagacccgagacctctccttttcttgcaggagactgtcttcactcctcacataatctttcctctgtgtgggtgcacgtgtgagtctgaatttcctcatcttctaaagatgcccatcctattggattaggacacatcttaacatctcatgttaattactgctttaaaaaccctgtctccaaatacagtccaaacatggttctgaagtatgggggttagggcttcagcatgtgaattttaggggtatgcaatccagcccataacatctacatatctttctgtaaaaatacacactttccccaaattaggaaccacaacaaaattactatttaataatctgctttttaaagcctttaataatatgtgctatctctacggcaatagttactgattaggttctgattcaggattcatggtctgagtagatgcattagcctcccactccctcctaagactgaattaataaaaatagtcatggttactgggtgcttattatgtgccaggcactgttctgactactttgtgtgtattcaattattcaactctcacaactctgggagatgggcattattatctccatttttcagatgctgaggggtgaagagtcagtgctgtctcgattgaggaatcgagaggatttttctttcctgcagggagagcctggagtcagttaatagaagcaaggaaggaccagagaggagaaggcgccaaggtggctcccctatgtttaggacatctggcgtccacaccctccagcgtgagtggtcccgtccccctgcaggtatgtgcacatcctgattcccactccagtccctgggtgcctttatttccagcacccagcaatgcacctcatgcacaataagcctgtataaatatttgttcaaataaatatccactaagatgagcatcctgaaaggctctcttatagaatcattcttatgtttttaaaggttttaaaaacattttaagacttcctagagatagagggcaagggttctcacttcagagagacccatttctggccacagttgaatatatcacatttttcttagtaggagaaagaaagtaaagaagggcagaaaattcccctgtcctgtctggaaaaaaaaaaaaaaaaaagctttggctaaaggtaagaacatgagtctgatttcactttaccatctgcaaagcatgttcaagcagtggaggttccaggcctgaaatggagatatttcctcagctggtatgaatgacggtgctttcgctttctctcatcaccatctaactccattccagacaccacaagatcatcatcagcctggatctctccttccagcccagataatttcataaactcctcccatcacagagcatcccgggatgcatgtccagcctgagcacaagctgagacgccttctcctcttctctgtcccagctctctgcactaagtgggaagtgaagtccctcagtcgtgtccaactctttgcgactccatggactgtagcctaccaggctcctccctccatgggattctctgggcaagagtactggagtgggtggccatttccttctccaggggatcttcccgacccagggatcgaatctgggactcctgcatttcaggcagaagctttaacctctgagccaccagggaaatcctacagaaaggtcacgtccaccaggaagccctctcagacccactctcccagcttctctcactcagtcctttctttgccccctgagtccacagatgtctggatccctggatgaaggagttgattgttagcattcctgctcccctgagcacaggcacacagaagtcccgcatctgtcaccagccctgaggaacctatattgtcaaaaacttgaagctcactgctcctgagt

SEQ ID NO: 42569 - DNA, 2292 bp, Bovine  19866880675265
ttttaattaacaaaagacttgtttgtccctatatttttattatttaagcacaaatccttgcatatagaagatgcttaatatttattagatagacagatggaggaatggataaatggatggatggactggacagatgggaatgtgaagagaagtgtaacatataaaccaataattactatgccatgtaaatattgagaaatgggccctggatatatgaagtggaaagttcttgctatgactggttttgacataacatttttcacatagaattattttgttttatcaaccaacaccacaaaatagattcacttctattcagttgattaattcttattttttcttttatttctcttcactacagtataatctgtcttctgacctacatgatattataatagaaaaatccattttctgtcacctttgctttttatagctcctctcttaatccaaaagggtaatatgaaataaagcttacactcaacactgcagaagaggaaagcaggtgataagttgcttgcctctaggttattaatcagctgtcctctagggcataatgttatgaagctgcgccatgtaataaacagaggcaaaaagaataatctccattttctgactctgaagtgcaggcatgtgctataaaactaaattgacatctgttagcaggcttgtcacatgaatggttttttcctgcagaatctggaataaattagatcttaaaataaaacttggaacagagaggctgctttacataattccttctaatgttgtgctgtgaacctatcgcactgattttaaagagaagttcttataagaaatgtttcattatcattttaattgcaaaaatgttgaatgccactccatgctaggaaatttgtgttttttaaaaaggtccttatgtttttaactaaaaagtggcaaatgaaaatttccttttctaatatttcacagctgaaaaagaaatcagctaacctccaactaaaagtgtgaccacctttccccaagcacttggagccggcttcatgggtggtttattatgcatgggcacctcagaggctgacatagctgtgctcctgaggcagaaatcaccaacctgggtgtgacctcacagatttgttcaggaatctctccctcagaggattcattaatatgatagcaacttcttggggctctcttactgtcaaaaggcattaagcattttttaacacacataaagtaacttgccaagctgcctgacctagtgaatctgagctgcatagtgccaaatgtagtaacattcctctgtcgacctactgttaggaaaggagtcatgaaaaaggaaacttttaatgggcacctggagcttagagcctccctcgcctccctcaggattcacttagctctcattccccaaaggttgtcaaaatggcaagattctcagacaaatgtgccaaccttggtacacagcaacaaagaaaaacaaatgccggctctctggaggctaatttcctccatatgtgaaatcttcctctttggtaataataacaggtccctcggaaagtcttgaaggagcgagagtcagtcacaatgctctataaaataaagtcccaaagctggctccaagaatacccctcattcatctctatcaccagcatcagtttatttgctggacagtcttctcaaatggcagagatctgtaccactcaccctacaataaggaagactaaggcacagaggccacagagacttagtgaggagccagggagtggccccaaaagctgacggccaggatctggacccccttcctgtttaaagcatcctatgcatagcaggggatgagcgatttgcaaatggaagctgagcttctgaagtcctctctatccatggaggcttctcaaatggtgatcttcataccacctggggaagaatggggtggggttggttaaaaatacagatttcctgagctccatgccagactagctaaatcagaatctctgagcttggtcctgggtctgacatctgagtcaaggtcccttaagaagactggattctctgtggcatgttactgttacttttggtttgttttctggtgttctgaaatctgagaacctgtaattacacaggtgagagtgggtctccagattccagagcactgttcacacacaatctttccagtcatggcttttggccaagggaaaccaaaggagagaacatctaaggaaacaaaaactgtagctcaatccggattcactgagtggtttgaaaatcattaagaagagtcaagacttttgtttcacagcaaatctcaccattata

SEQ ID NO: 42570 - DNA, 1621 bp, Bovine  19866880693103
agaaaagcttggaaaagattatatactgtttgtttccatttatatgaaattctagaaaaggcaaaatttgtctgtatatgatggtaaacaaagtggttgctaagggccaggcactgactataaagggtgatgaggagactttagagggtgataaaaatgttctatatttttattgtagtggtttttatgtacatatttataaaaactcatcaaactctgtacttaaaatgggtgccttttattgtattagactataaataaaatgttgatgtttaaaatatgtatgtaatttgaatacatattacatgatcatacatatataatatatatatgtataaaaatacatatataatatatatatgtattaaaaatcggtgaattctgaaaataacatacctcaagcagcattaagatttttgagatacataggtatagctgtagaaatagatgttgatgaacaatgtgcttagttttcagagtaacttgtgcttatattggttttctcaaatattctttgcaggtagttgactatgataaagtgattcaaccacgttttgataaagcccttgaaatgttaaccagaaacactatagctgaggccactgaagcagccattaaagttgtcaaagaacggcttctcttagaactacaagctaaaaatggtgaactatttttttaatgtgtgttttaacagtagttaagcctggctccctgagggcacagtcttggtttgtcttgatatccctggcatcttgcacactgcagcctcagaataagtggttggagaaatgaatacacataaacccaaatcatacactgagaaaaagattccaactctgtggatttctaaggaaaggaatcataaagagttttcaaacttaaatttcttttcttttatggatctgcttcctgggcagaatttacccctttatttacaccaggggcaatgacaacaacgacactttgtctgactcatggagtttgtgttattgctgctgctgttgttgttctaggcctctgcgtcagccttgattgtaagtcagtgtttttatttggggaatattattttcagattcaaaatgttataaatgaaaaagtcatcgatgaggagacagaagcacaagaggttaaatggcttcctgaaattcatccagatggtggcatagctaagacttgaacatcctctatttgtccgaatctgctattaggatttcactaactttttacatacactggaaagctccccatcatttcctatgctggaaactatttaaagatcaaggaaattacttcttacatggcaatattgagcttttgctaggaaagaacacaggttttgcctaataaatctgcctctcttctttctcattaacctataatcaagtaagaaagtacaacctggtgcctgagagattacaaaaagcaaccacaaaaagaccagcattgaaataatatgccatccaaatgatcatggatcagtggtaaagaatccgcctggaatgcaggaaacacaggtgacacagcttcagtccctgcgtttggaagatcccctgggataggaaacggcaacaaactccagtattcttgcctgggtaatcccatggacagaggaaactagtgg

SEQ ID NO: 42571 - DNA, 1299 bp, Bovine  19866880736126
atacatttcctaaatttatctaattttactttttattctccctttgcaatgtcatgtatttaattacttgtcagaggatttcttctcattttttttaacttctgtctgcaaggatgggtaggctacaattttgcatgatctacctgaaagataaaatattttttagaaacggaagaaacaactgttggttatttgattattatgctaaaaactgtttacatctcattatttaaaaataaatgattcgttaccaaaaataagtgttttatttttcttttttgtaatcctccctttctagcttttcttattttagattgttggcataaccctcttggtaaaacgaatttgcacataggcattgcagaggcagttgttttaaggtacagtaattgttttatggcacttggaagtggcccacgtataacttgatgatgtagaatcagttgcttgttaggaaatgaccatgcagtttataaaatggacaccttgccttggtttccttatatgtaaatggaaaagtccatttatgccaccagctggtatgcataaattaagtaaatatgttttcatgatgcttttaaatattttaaaatacttattcacatattttagctggtgaatggtgaaaatacttcagtgtaaaatacagtgaaaaatgtcattaggattttctgtggcatgttagaatggctgatttacattgaattttgctttgaaacatggctctaaattgaatgtttctcatccatcatatttttaataattgcaaatttaaaaagtaatagttaatacatatatgtagttttcagtataggtttagttaatattgatgaaaagttacatgatttggtaataaaaagtagagtattgaataaagtttgtgaaaaagaaaatctccggaaaacatttagacctttttcattgaaaaacttgcagaagacacaattcaaaatacgttttcaatttgtaatacattgatgtttgtagtgtaatgtaatacattgactttgtaatacattgaaaatacattgatcatttgtaaggtatgatatggagctactttattcaggtttgtaaataaccatatatatgttcagagagtgtatcaatataataccatatttaattacacatatctctttattgtcagaataaggtattgccaagtacttgattttcattattacaatatctagtagcttttgatttcctttttggaggggtaattcaattaattttcatagcaaaaactgctattaaagtatattattacttttaccaaaacaatacttttaatta

SEQ ID NO: 42572 - DNA, 1734 bp, Bovine  19866880740692
ctgcccacccctgcagcttccacctccctctggggttctgtgaggtgtaaatttctgagacttatggggacacgtcttgacttcataccttaaacatcagcagcagcagtagacacccaaccattttcataccccatcagtaaaacatctgtgcacttgtgccccccaatatatacacatttaactatatgtaagtcacagtactatagcagtatattgtatacttcataaagcacaaaatatggaaagtgttaaattataaattgtaggattctgtaatatatgtttaatatttagtacatattatatagggttccctggtggctcagatggtaaagaatccgcctgcaatgcaggagacccagatttgatccctggttgggaaggatcccctggagaacggaatggcaacccactctagttttcttgcctggagaatgctaaggccagaggagcctggtgggctgcagtccatggggtcgcagagtcagacatgactgagaaactttcacttcactttacttcacatattatataatatatgttgttatatgttctacattaagaattccaccttaaggatacattttgtgtgtgtgtgtgagagagagagagagatagagttttacctcactctttaacagtttttatattttgtgtgtataatctatatttacacactaatatattctatgccagggatttttttgtggttcacgtgaaggtacacccctcctctggagacctcttaaccacaggatccaggccaagccccttgggagccgtcctggctctccacagacggacttgtcaccttctccatgctttcccaggtctcatcctcactcagacaggtctccctgctactccctttgatcccaacacatgctttggagtcagaacacctgaggttaactacagatggctgcttaccagctgtgtgaccatggacagtgaatgtaatctctctgggcctcagttcttacctataaaatcaggacaaaagcacaaacttctctggcgattgtgaggacagaaagaggtaatacctagaagggggcctggcccagacacagaggtcaatgactgatgactatcaccatcattttgccaagggactcactaccgcctccagttactatttattctgatccatcctgcccttctgagagctccttcccttcaagggctacctttcctgaccactccagccctccatactctctctgctctgggatccaccccccccccccaaccactttctgccctcagaatgcgcatctgcagattgccaattaactatttctgactactctcacttccccacccagctcccacactctgggagggcaggggccacaggctcctgtttctgggtgctcaccacaggtggcactcaggcaaagcagatgaagtggacacgtgccctcacactgcttggctctgaaggcttcctgtgccaccccctcctggcattttaccaccctttgtcccttcactgaaatcacaagtttgcatctgttggcctgtgaaatcccacaggctcctgcagaagaggccactctaaccagacactccagcagattctgccaagctaggatcagcatctcatcacgtttccatcacaacacagtgagaaacatgtgactggcccttagcaacggtctctcaagaaagctacccctatagagagctcattaagttaactgaacacacgtgaggcagaaatctaaa

SEQ ID NO: 42573 - DNA, 3465 bp, Bovine  19866880742764
tggtaggcgggttcttcactagtgctaccattagatgcacataaatttaaaattgttatatacccctttgtgaattcagccttgaatcattatgaagtgatcctttttccatttaagtctattttattgaccctaatacaaccaataccattttcttttgcttggaatttgcctgatataccattatgaaagtagtaagtcaaaaaattaaataatggaaaaaaaaaacctccacaatttattattatactagcataaaactaagatgcacctagaaatgtctgtggggattcctaggtggtgcagtggtaaagaatccacctgccaatgcaagagatgcatgcagtacaggttcaatccctgggtcaggaagatcccctggagtaggaaacagcaacccactgttccacagaggagcctgatgggctacagtccacggggtcaccaagagttggacaccactgagtgactgagcacacacacagaaatctctgcaacaaaactgttcaagatattgatgcaggaaattatacactttcaaagaaattaaaaatctaaagaagacctaaatgaatgaatagatagaacactgtcttcaaactgatctatcattcaattcaatctcaaacaatatcccactttggatgttagcagaacttacaagttaattataaatcatatgtagaattacaggggacaagaaaagccaagacattcttgaataacaaaaaatggatagaggtgagagggtagaacaacctaccaagatcaaagccatattattaaaaatattcataccatacacaaaacttaattccgtggatttatggcttaaatgtaaaagcaaaaatatagtgctttcgaaagacaaaataggagcatatttttatggctttggtaaaagaatttatccaacaaggaaaatctgtggcttattatttctccataacaagacacaaatttgcaacatacataattaacacaggataatatccagaatatataaagatctcctacacattagaaggaaaagacaacccaatagtaacttcaaaaataaaaacactaataagatatatgaactctcattagtgttcagtgatatggattaaaaaacattgcataagttcatactttgccaaaatgtttactattagtcacaacttgacaattacagatgaatgtatttgtatgcgtcacatctttcccctggatatttttccaccattaaatttactaggtataagcttttcaaaataaagcttattaacaaacaagtgatcatcaatatcccttactctcagacactagagcactggggcggtttagccccagccctatctctgatggacctctgatactttattcaatcttttctcctggattattttacttgtaacatgaagtgattgaactgagttctacagatgtccccacactcccacccgttcggtatacattgaatctcaatgttcgtactttttcaagactttgttttccacttattctttcattcctttactcaccttctctctctctcataattttgtatatgaggcattgaaaacatgaaaacaaatatacacaacaacctcaggtctctagggtctggtccagaggaaaaaaaaaattaacaaatcacagcaatgtggcaaatgctgtatatacaactgaagtgtgggaagggggtttgaggtagacggaggaggaaacatgcgctgagactgaacaacagcagagttttggggggtgggaaagaagggaggcatgaggcaagggatttccaggcacagaggctgctgctgctgctaagtcgcttcagttgtgtccgactctgtgcgaccccagagacggcagcccacccagggctcccgtccctgggattctccaggcaaggcacagaagctagtgtgagcaaaatcttgagggggataaaagacaataggtttgagggctttgtggagaggtcatcatgggagaatggcaggcctcatatgttattaatacataaggaacttagaaattactgggcaggcaatagagtgtctttggcaaggaagtgatatgataacactggaatttagaaactcattctgagcgcattgtgaagtgaaactcgggatatggagctgggagacaagaaagaaggaagtagaaagtccagttagaaagttattataattgtcttgaagaaaaattataaaattataagaatctgaacagtggtagcagaaaaggaaaaagagatgtgataaataacataggcactattgagtaatggttcctattcattaccaggacctattacccaatagtaggaattcagagagaaagaaaagtcaagaatgacacttgagagaagtgaggaagatataaagtaggctgcatcagtaaaaatagagaagtagaaattgatttgagagacattaatgaaacagacatgttagaaccatttgattgataagcttcaggggctgaggaagaaggaaaaggaagacctctctgttctaatatgtaggttatagaatcattaattcaaatgggaaaaacaggtaaagcagatcctgaggcaaagaaaatgcttatattttaacacattggattggaggtgactgtgagccatcctgggagagaggttaatagttctgaagctagcaaggagtttagaatggataaagatagtgtgcctggcacatgacttatgagataattactaatgttatctcctactttacagatgagaaaaaagttagacatggaacacttaaataatttatccaaggtcacaattcgggtaactcatggaggtaagatttgaattctggcagtcttgataccagagtctgtacgaaccatttcagtattcacctgtgagtcatcagaagtactgcaggttgaaggcctggagagtatgagggatgcaaaacggactaagagtctcaggaaacatcaatattgaaagggagggcaaaagaacaggaaagagaaggctgagaatagacccatggaagccagagggagagaaagtttccaagaactatttaatactgtcacttgatgcacataatcaagacaacagaacttgacaactggaagcccagtgacattactcagagagagtaagtttcccaagaggctagggcaaggctgcattgagttgaggagaaagtgagataaagtgggagagctccaaaaagctgagtttcgagaagaatgaagactcaggaggctgttggaggactctaagtttgaggtgtttgttttgttataaaaatagaaggattctaagtattctttcatacttgatgtctctttaaaaagtaaaatccacaaatagctcactaaaaacctgtaagagacttaagttatagcacctgacttgggaacatcataattagaaagaagtttttgcacactgcctcccctcaccacatcctgagcttcctgatccacccccattaggct

SEQ ID NO: 42574 - DNA, 2032 bp, Bovine  19866880803899
gggaatttgggctttaagcatcccgctgcattcatggctttaattagagcagttgcaataccctgcaggtagggaacgaattatgtgtaatttgagtctgttttcttttcttgtggcaaatagatagaggctattctttgcttcaaatagcctcctcaggattgaggatggagcttaaaaagatagttaaatgagcacttgctgctgctgctaagtcacttcaagttgtatccgactctgtgcgaccccatagactacaagcccaccaggctccctcatccctgggattctccaggcaagaacactggagtgggttgccatttccttctccaatgcatgaaagtgaaaagtgaaagtgaagttgctcagtcgtgtccaactcttagcaaccccatggactgcagcctaccaggctcccccatccctgggattctccaggcaagaacactggagtgggttgccatttccttctccaatgcatgaaagtgaaaagtgaaagtgaagttgctcagtcgtgtccaactcttagcaaccccatgggctgcagcctaccaggctcccctgtccatgggattttccaggcaagagtactagagtgggcacttagctctacagaaaagaaacacaaaatacatttgaataggaaaaatttaaaactattgattggtttagtgccaggtaggtgatggatacatgggtttcattatgcaattctatttttatatgcttgacattttctgtttaaaaatagttgaaagaaggagacacctagttgttcttggtccatctctgcttccgttgctcagaattggccaaattctactcaggaccctgggccacctacccggggaactccagagaccacagttaccactatagtcaagattctggggccccgagtaggcaaagaggaggacactcttctctgggtgagtgtcctcttccctttttgatattaaacttgatcaaaacctaaccatctaggggagatgaggaaaaaaaaaactggttaagaatttgtaagaaatatatgaaattgtgccctgggcatctgttttatagaatttttttaaaaggccttttaaatagtggttggtgactgatatatctgactgtatttagaaagtgttagagaaataagagtgacttgagtagatagcttcatccagattttgggcaaaatatgtatttggtggttcagttgtggtgacatcttaactctttcaagccggtggtgggggggaacctctcagagactgaatttgcatatttcacattacagaaaagttctacagacactgaaatttcaaaataagaaacaaactatatgtcaaatgtaaataattttctacaatcctactctttcttcactttagtgcagttatttgggaattagctatgaaaaggggggctttccttacattttattttcataactactcaaaaccaaaataggttaaaagtggatttgcagcttaaactcaggacactctgcctttaatttcattgttaccaaaataaaaatgatttttgaaggagagatagctgtcgtcttctaatatctaaacagagaaacccatgtgagcgaacctgttccagatatccaggcaaaggcaggctggtgagagacattggttccttcaatggggggaagtttgtaaggaagcttctgattccagtatttctgtggtgacctacgaataccaaatccgttaaatggatgatcacaaatgtcttcattgtgtctacacaggaagataggtacacaaggcaactaaaagataatgttcattactcatttttcttgagtggagaaaatgatacagaagcaggaagactgaggctcctagaaattcatgaccaccaacttcacctggggccctagccctgctcaccgcttctcagtgttcttgcttttaacagcacctatatgaaactttctttatatacttttatcctcacacttttattttgaattgacaagatacttcaattccgcacataacttcttcgtgaaaagtgaaagtgaaag

SEQ ID NO: 42575 - DNA, 2291 bp, Bovine  19866880807113
atgaatcttaatagtaattcagatatcagttctgctccagaaaacaaaatcttgaattcaaaattgttgggcctcttaatcagagaaaattcacagtgaagactgctaacattgaagttaccgagtgccgttaattcatggggtcttatggcccagatcacctgaactcccctgagtatttcacttagaatatatatacctctgaaggctaagaaggaacagtataagaatgtgaatagagagggaagccgataccatctggatggacagtgattcacatggaattttttcccctttcttcagtgacttcatgcctaagaccgttggtattgatccaagtccatttactgtacgtaagccagatgaaaccggaaaatcggtattggggtaagatttacatgtagaataaaattttaaagattcacataaaaataatatagcactttcacccaaaactaataacttcaagtcatatagtttacagcatagtatgtacactgcatccacgggtgtgctaagtcacttcagtcatgtctgactctttgtgatcccatggactgtagcccgccaggctcctccatccatgggattctccaggcacgaatactggagtgggttgccatttcctcctctagggaatctttctgacccagggatagaacctgcatctcttacgtctcctgcattggtaggtggattctttaccactagcacgacctgggaagcccactgcatctatacagatagcttatttataaaactgggattattaaagcatggttgacacttaagtagaatttatgggaatttcagcaacacagtacattttacttaaattagatgttccgtagatggcataaagttaggtagcagatgttatgtatgtcctttaataactccatatcctctgtttcccgcaacataaaagacttaggtaaaaatgtgtatttgttgtgtttatttttgctggcacccggagaaaacattaaagcaaatgctcagacagaggacttaatagatcttctgtgtactccgttaacattgtgtgggggatggctgttattttattgtatacagcagtatgaggaagagaacaaaccacgtttaaatctttatgctttgagactgaaatgaaatgtgtcctagtctgcgcatctctgttactgccgctgacctgagtgatcccagtgatgagaattctcctaggccctggccagaccgtggattttgagtcctaattgtatttgggagtgtgtacagggtcttaattggattctaactacatgtgtgatttatacaatgagatatatactgatattactatttcccagatacaccacttatgtggcttaaatatgtgtcctggaccaggtgctatgaggaatttaaaagaaggaacggcctcaggacatttagaatttaaagtgttcctgggacaaatacataaatgaccatttatattagtgtatagttctgaaatgtatcaactttaatttttagtttcatgaagtcagaaatgaatttattttctctaatatctaacccatggttagatagtattacatatttcttttctagaaaatgtagaatatttcaagtcccttgcagataattttttcaagtaagaatattaaatatattaaatatttttcataaaatccaaaaatattaccatacatttttttaattaagaaaaaaacagtattctgactactgtcaaatttggcaatgaaataaaagcaaataatgtatatttttttctgtttcccctcatccactctctattattagaagacatcatcagcaaacatagttatttactaataaattgttttaaaacagtttaaaatcttagtttatgttcatcagttgctcattacttcggtacaagtaatcagctgccactgtgattgataaaaattcataggaaggccagaaacacacatggatttggctattgaccctttcttgatgcttctacaagttataggtaatttcactaatatctcagatataacagtcttctactgtactataaattttgaaaatcctgatttcagttaccaaaagggaagacacagtagccaagtggtagaaaggcttttctgcacactgcaagcacatacttgcttattttctgaattcatagcaaagcttaaattcatagaagggtcagtacatgtacatgataaactattaaacttttcccttcagcacaacttgaatccagacgctagcttctcacagtcattttcttaacacttctccaggactaaggctttgggacagag

SEQ ID NO: 42576 - DNA, 1332 bp, Bovine  19866880816252
ttgcctcagacgtcttgattctgtctaccatggtacatttttagatgagttcattacttagagaacttataataacagattacttttttaacactaaagggaaaagttaaaatcaaatagcagtagaaaactaaatcactgacacttgtaattatcatggaaagtcatttgtataagtaaaagctttataataatagaatgtcgtttcgtggttttccttcctccaggaagtttcatgaaagtttaaatatataatttcaagaacatcgcttttgtttcagagattattcttctaaaagtacttttaaaagttactattctgatatgttatttttaatttttagggatatccctgtggatttcaagtatatagcagaacccagtatgcactcaatgcctgcagtgactttgtctccaaatggtgagttagtagttacagtgtttttaaatgagcttctaagacactgtgtgatttttgttttcaaaagagccttggccattccctcctgggggaggtctgtcacagtgccatacttgtatattagaaataatcactgattttcatgtatgagtcacctcacccattctcttgtttttttttaaaaaggtaaaaataaaagaaacaatgatttgcaacattgcccaagcatctaaggatttccatctgagaatcagggttttgggtttgtttttttttaataattcttccaacagaatcatgttcagcaactcatttagtgatttactgtgagctctttttcttttggggaataggtaattttgttctggttccttatatgagaacaccttagcaattcaccataaaagattttctcagacaaaaattaaaaagataagtctgcttaatactgttttctattcagtaactcatggccttttaagtacgagtactccagatatactgatataattttatatgaggatattaaagtggaggacctgatgtttgggcagcatggtcatcaaagccactgttagctcatgtagcttgctgtgagaatagagcaaggaagagggagcaagagtttgctcttccagtcgaagcatctaccataggcaaatcggtggacaattgtcaagtgtcctgtgatttttatgagaagagcaacctcacagggtgctgttctgataatcaccatattgtatacagtcacatttgtgcacctacatttcatacagtgtatttttaaaccatctgtcatcaatactgtgcccatcttgaacaaggccacttacttagtctgactatgaacattgttagggtcatcctttataatgtctataacatataggatacaaagatacttcagt

SEQ ID NO: 42577 - DNA, 1722 bp, Bovine  19866880830777
cctctccccttgctttacaggggccatttattaaaaatacataaacacagacaaaaaataaatatatacaggtatttatattgatatatgattatatgatatgaccatataatgataacagatgatgtacagtgatagatgcaaatacatgagtctatttatagactttattctcttctactggtctatccttataccaatatcatggcttttctaatggttattataaaaagtgttgatatccaagaaatcaagcccttctgccttattgtttttatttaagataatctttactattcttggccttttgtatttctatataaattttagaattagattggctgctcacacatcggacattcaagaggcagaaatggctttattggccttggtaagtggaagcctatttcatgggattcatttctgccaccacagccactctgttcacacgccctcatgcaaattttcttaaccttagtatagcagacctccatctgagcatttaaatgtctttagaactctgtgactctaataaacagatcttcagtcagctactcagttgtatctgctcttccacagttagaaataagggcctttttgtaaactaccaaactaatatcttacccatagactttaatggcttattaacagccctcagtttctcatccttcctgtgtagagcatcatagcagcttgacagtaaccaaccaatcccactgtctttttagatgttgttctccccagttcattgagatgcctgaatcatcacacaggcaagggcaatcacctctccagcaaaacccaccaaatggttttttcaggtcaccactggtaaaatctttagcagtttggccactgccctgtgccagggactatccatgccccacgtaccactagaatgacattcctctttgcctaccaggtaatgaataagccagtcaacaactccatcctgtcacttgtgttcttagttcagtcccgtcacctatgttagtttagagtcctctgagatctgtatgccaagaaaggagtagatgtactagatacttgttgaggagaatgcctgtgaaggagaaaggggagagaggccagagaaaggatgtgaagagcctttggttggtaaaaggaaaggagggaaaaggatgattggctgaaaagtatcttgaactgcagtgctattctaagcaagttttggccaggcctatggggactccttacaccaaagttaccttgttagaggaatgggccagtattactaaccacactgtgctgaatcgttggcgaaaggtaagtgaaagatcgttagtgaaaggtaagcttggactttgcaagaacatggtagtagatctagaagggtagcagctggggccatagccaactatgcacagattgctttcttgcctttgtcaaataaattgaatgagtgtatggtgggcgggggctctgtttctaggctctgtactatttcattggtttaattgtgtgtcctctgccagtgccacacagctttgattactggtactttttgtaattcttggagtcaggtactgtaaaccctccaacttgttctttttcaggattgttttatatattctaggtcctttctattcccatgtgaatttaagcataaacttgtcagtttgcataaaatgtttttcctgaaaattctgattagaattgctttgaatctctagctcagaattgacaacagtattgattcct

SEQ ID NO: 42578 - DNA, 1788 bp, Bovine  19866880919726
actgttgttgtgggtttgtttgttatttggctgtaccactgggcatgcaggatcttagttccccgaccagagattgaactcgtgccccctgaattgggagcacagagtcttaatcactggggaagttggaacttcacccgggaaagtttccaagaaagcattttgaaagaaagaaaacaagcattgttgagaatttaagatatttcattcaaaattaacatttgttttggtacatatatacaatgaaatattagttagccactaagaaaatgaaataatgccatttgtagcaacatggacggacctagagattatcacagctaagtgaagtcagagaaagacaaataaataatatcacttatatgtggaatccaaaaaaatatgataacaatgaacttatttacaaaacagaaaaagagtcacagatgtaaaaaaaaaaccacggttaccaagggaaaaagcggggaagggataaattgggagattaggattgacatatacacactactatatataaaataaataactaataaggacctactgtaaacccaggaaactctactcgatactctgtaatgacctatatgggaaaagaatctaaaaaagagtggaaatacatatatatatatatatatacacatatatatatatatgtaactgattcactttgctgtacagcaggaattaatacaatattgtaaatcaactatattccaataaaaatatttagagattatgcaggtaaaaaattaacatctgttttaatatattaaaaggctaataaagatctacatattggttataaaatttaagttaaatctgcatatattctatatcttgaaatcataaagttaggttttatccaaatctatttgttaaaaagagcacagattttttctataaaatagaaagtttgttttcataattctaaagattgttggcgtgcagccttgaaactataaatatttgttactataaattttgttaaatgcagaaaaattaatgcttcggtaaaggtgaaaacaggcttccctggtgacttagacagtaaagaatctaccttcaatgcaggagaactgggtgcaatctctgggttgggaagatcccctggaggagggcatggcagcccactccagtatgcttgctggagaatccccatggacagaggagccgggcgggctacagtccatggggttgcagagtcagacaccactgagcaactaagcacagcacaaaggtgaaaactatgtttgccatggggtttgatcccacaaagccttgcagagactgaccttctgctcataattgacctgatctagttttactcattcagtctatacagcaatgctgtgtagatcctcttaaaagtaacagaattcctcatcataggaattcactttataaatacactccaacatactttagaatgtagtacacagttttcgtcttcagcatatattacagcagaagcactcttaatctgtctgtgcaacaccagcttgtcagatgaactgacagtattttctctacctgtgcactcctgctgctaccactttagtcatatttttaccaggagtcattgatttgttcccaaaccagtttatgtcagttgtacaagctactgaaattacatcatttcgttaaaatttaggtaaaatgatgaaatctgtacacagaaagaaaacgggttctcttttctatagaaaccaagttgagaaaaagctaggtgctatttttaaatactgttgcgttaagcatgggtgaagtaactgtaaaaaagaataacag

SEQ ID NO: 42579 - DNA, 4212 bp, Bovine  19866880936415
tagaaggagtctgtttaccttttaaagaaaccaccaaacttttccccagagtgtttgtactattttacactcctgccatcaatacaagaacattccaatggttctgcatccttgcaatacttgatatgctctgacctttaattttgattaaatgattacactattccaagttcacagctttgttcccaatgccatcaacttaagttcttgatacttcttgcagtagtcacttacctggcactcctccttcagataaattgagagtgtcagatgggaactttgtgaacttcctcccaccatctataaacttagctctatcagttccacttattcccaccttgactcctgtcagagcagaggagtcatgtctccacctcctcccatctaaatccctctctctctctcacaccacattttggaccccattctcctgtgaagacttattctgggagctttctctgctagcttccatctttccagttacaggatatcagtcttatattcagttcttgcccatctttaaaaaacaaaacaaagattatctcgtgaccttatcttccctcaagctaccaccctatttttcacctttgatttaaagttaaatatactgaaaaaaattagaaaattcccattgcctccacaacttactgcagtctagcttttaacctgctttctgtttaagttgctctcacttagatcaccaatgaccaccatgttcctaaatctagcacattccaaactttctcttacttgaactgtgggcagcctttccatagctgatcacttcctttttttttttttttctggttatgcccgtcctctggcttgtgtgatcttagttccccagccagggattgaaccccaggcactgcatagtacaaggacagggtcctaacttctggactgccggggagttcccagtcgcttccttcttaaaacatttttcctcttggttttcccagggtatcccctcaattctcctccttagtcttcttttctcctttgctttccttcactgtacccccatatgttattgtgtcaagactgtaactttggccttttctcaatccctcccgtggctttattctgatgtctgactagcttagttggtaaagaatctgcctgcaatgcaggagacttggtttgattcctgggtcagcaagatctgctgaagaagggaatggctacccactccagtattcttgggcttccctggtgacttagttggtaaagaatctgcctgcaatgcaggagacctggtttgatccctgggttggcccctgaagaaaggaatggctacccactccagtattctggcctggagaaatccatggactttgtagtccatggggtccatgaagtcggacatgactgagtggctttcactttcattttcctgtggcttcacttacaccttaaggtcaatgattatcgaaattctgtctccattcatgccattcttgccagctccaaatccacagggctgcctgcctccacttggatatttccacaaatcccaacatttaatatgtagaaaacttgattcagtgccctctttctcaaatctgcctttcctgctatgttcccatcatagtgtatccaccctttgagcatccttgactccaaactgttgcttaattcttacaatcactcacttagtcagagacactcttctttgagacctcttggatccatccccttctatgtacctcctttgccttcttagctgatgttaacatcacctctcacctggattgctataactgatctccaaaatagtctcttggccaccagcctttcccacctgcagtccattcccaacactgctctttgtaatctggctcttgcctacttctccagacttatctcctattacttcctctctagattctagatcttaaacactccagctgtgctgaatggcctgcattgctctgaatgggccatacttttgtgcttcctgttgtcctcttggtctggaacattccccttcaatgtcctttgccttgaaaatgctttttgttcttcttgactctgcccagtattgcctttctagtggatttccatagcatttccctgaccttcatatgggatccctactctctatgtatgcctttattattgcgcttttcattagtactgttctcagagctgtggctgttaccttacatggcaaaagagactttgcagatgtgattaaatcaagaatcttgagatggggaggttattctggattatctgggtgagtcctaaatataatcacaaatgtccttataaaagggaggtagaaggagatttgaccataaaaggaggcagtgtaaccactaaagcaagataatacactgatggttttgaggataaaagaaggggccacaggccaaaaaagcaactctaaaagctgaaaaagttaaggaaacagactcttcccctagaagctctaaagaaagtgtagtcctacttaaatcttggtttcagaccagtgaaatatagtgcagacttctggtcttcataactgtaagagaataaatatgcattgttttaagctaccaaggttgtggtcatttgctacaacatcaataagaaactaataccttgggccaagtgaggccctgccctgggcctcatgctgcagagacctctgctctatgcccattccagctgtgggggtgaagagtctgtgtcctcacttctaggccaggcgccatgtaccccaagactcccaaattccttactaaagaaattcttcctcaagacctatttattgagcctaaatgcctcttcccaaagttggttcttttgagacagactatactgccagtgggctcatgctctgatttgaaggatagtcaaaggagcaattatttgtgggatgaaccactgtatagacaatagactgaagggcacaagaactgaggctaggagaccaaagagaaggctgccacagtaattcaggtaagagatgacgatagagatggtagagatggtgaaaagtggctagagtctagatatattttaaacataaaggcaacaggcatccgtgttggatgggcggtatgaaaaatagggaagggtgtgattccaaggtttctgctctgaacaactagaaggatgacgttgtcattaatttagatggtaaagaagggagaaacagtgcttcttgagatcaagattagtggctttatttaaatgtattaaatttagatgcctattacttattcaaagtgggtaaaggtgttgggatgttgaatcttgctttttgcaaagactatatgcttccagaaattagcttaaagtcttaaaatagagattattaatagatgcatcaaataaacatatgacattccttcatagaaatgtttcaagacatactcacagttttgtatccttacatcgtcagataggtgaagatgcagcccattgacaatacacagcctgacaagctgtgtaagccaggaatattaacagcctgggtgtttagtgtcttcttgttcttagctctttcaaacatttagggcagatattgaatattaataccaagtggattgaagtcagatccatggtctgtcttactatcttagtcttgaactttcttaatctgctgattgcaaaaatgtttttctgagattttaacatgtataataatttgactttgttccaccttgaaattatgttgttttccctaccacatgtttggaaagtttatagccagagcttttgttatttcagtccgcttaaatgcatcctggatactaatagggcctgagagagtgtctgatgttgctgaatagtctataaaggttgttcattagaaaatgttaatttgatgaatgagcaataatgctgatcttcctggatctcaattcatagacactataaaacaataaacctataaatcttagtgtgttttgtagtgttaaaaaggtcacagctctgttgcaagatattggagactagattgtttatacattttctcttgtgcattctataatcaatacccattcccctcattctcctgaagtttttcttgtcaagttcaccaatgatagtcacattacaaaatcaatagccattgtttttaatcctcattttacttactctctcagcagggtttgaccaattgactactccctcctgaaacaccttttctcctttattttgggtcactgtgttctgctagtgtgatggttaattttatgtgtcaatttgactgga

SEQ ID NO: 42580 - DNA, 3486 bp, Bovine  19866880950930
cttgaggagtcaagaaaggctaacctggaggggacatttgactcaggacttggtattgcttaggagttcacgttcttttgtccctctggatgttctcaaatgttccatcctgggcacccctaacgcaaccttgcacttggcatttcacatctgctctcagcctccattgcttctcttttacctgttgaagaatctttcttaaatcttagcttccacttcagacaatagaattgataactggagcctcaaatggaaaggtttggaatgcatagactcaaagggcctctggagggcaagttcacatctgcttcctttaggaggctgctgtagtgattcctgctggagacagtggtgacttagagtggtttaagtggaggtgtgggaagtggtccaacattggatatattttgcaggaagatgagaaaggagtagtttttgttgttttgtgttttcgggggagtagatggaaatcaggagttttgttttaaacatcttgagtttgagttatcctttggatatccatatggaaatgtcacataggcagttggacataggagtctgaaactggaggaaatgtccaggctgaaaataaagacgtgggaatcctccgtgtacaagtggctctttcaaagctgtgagactacaggagatcatctgggcagtgagggttgctcacaaagacagagatgcaagtctgagccctgggactcagttttaaaagtaaattttaaagtaatttaaattaaatttagtaaattaaatttaatttaaattttaattaaatttaatttaagttttaattaaattaagttttaaaagtaatttaaaagtaaattaaaagaaaaaaaagtacattaaaaaaaaaggaaatatttgcatagaaccttacatgttgtaagcattcaatagtggtcgctttaattttcactaatctgtcccaagtctttagcctcagccgttccctaaatatcatttgttataacttctttccactcctttggtttatgctgattcttttacccccatcctatgattcatgccctttccatcactgaacattcaggtcaaggacggtggcccagaaaccttttttcatcattcctacttccttgctaatctttgaccagtttgggagacaacataaatgcgttctgatttgcgagttgctttgtatgtgttgtgacctaataatctattttagattgaatgttttgtctgtgcagttgttcatgatggaaaggatcacatttcctagtgacccttagtaaatgtttattcccaagacatcaataagtaaaaaataagaatcttattatttcaacctattatgtgtaattgtaaatgtctttggttaaaaatatataagaaataattgagtgaacatagaaattaaaataactattttttaagtattgttttaggttttatttagcctcttaaagaaaaaaatttccctggattttctcccccctagctagttagttattttcatattttcagggtatacagtattactttcccaaattcctagatagtgggaatcttgaatttgtttcatttttccattatttcacagtcaaattaaaatgttcctccaaagtggaaagagcagctatctagtctgttctcccagtttagggaacagagtggaatgtcccctatctctccagggataagtcttgttcctttttagcctcgcattgagataaggtgaaatataaactgaatgcacagttaattaatataataaatttagaagtaatgtgttaaattccttgaatcctattttatttaaattttgtttgttggggataatgataaacaatattattttaggttcttggatactttgccgtaggcatctaccagattggtgaaggagaaaaagttccattctattttgaggatggctttctgggtgaatgaaaacctgtatgaaataattgggttgccaagtgtttcttgtcaatgtgcttcctttgcaggtgttagaggcacaaaaattcagcaattatattgccactttaatcatagcttatgcttctcttaaagcaaataatctgttataaaaaagagaaatgtgtagtccccatgtaattcttttcctcttttcttatcctcttctttcaccaagctatacaagaaatagttctaaatattaaaccctctttcacatcagaggttccaatcttacagcattatgaaatgagggcagatgatacatggtggataaacactgccctgtgggattaggactcccctagaatccatacatttttctatattacagaaactttaagcatacaaatatcactatgattcttttttattcttttactttctctctgttttctgtgtttctttctggtttctctttcttagatatttactatgattacatggcttaagttcttctggaggacataaatagaggactaatgatggtctccttgattatacttttttctacaatcttgggtagatgtttcttttacaagtagggaatctacctgaaaagcagcaaaatatatggctcatatgcccaggagaagtactgttgacaaaaaaattaatcagtagtcaatctgagaaagaaatggaaaattttacttgaaccaaactgagtattataactcaggagacaatctctcagagacctttgagaactgctccaaagaggtaaagggggaggccagtataagcgattctctagaaatggtagtgcagtcaagcacacagcttgatggagagttactgtgattcataagtaacagatatctttaaaggttttagcacttttctaagtatgggttcatgaattttctcctgaaaatatctatctgaaggcctatcttttcttagagcacagaatgccttatcctgattttgtcctgagttccagggtattgtaggtcagtgaatgtagtggctaatgacttgattcttatagaactggatagtagacaacagtctctgttttacagtcccctcccttttggtcttaattttgaccaaggtttgagaggcatttcacgaccaacttgtcccaaggcgctaggaatgctcattcctaggtcaatcagggatttcattgataggctgctcagtgccctgttactgcacttggccctgttaacaatagtcaaaagcctctggaccatctgttttactagtcagttatggtctaggatgtctcttgttgcgtcttcttatatctaaagttacactgttataatctttgatcttataggacaatatatttggtcaattgtttaagcttgcctaatcatcattaattttattggaggctccatcacacatttggtagtataagaaataataatcttgtgaaataggtagaatacaaataatatagctagtaacattaataaagtcctaagtgagtatttaaggtaagaatttccattaagggaggcccagttctctccaggtcaccgacccagtctgttctgtagcagtgctctc

SEQ ID NO: 42581 - DNA, 1115 bp, Bovine  19866881046201
tgaatttgagtgaactccaggagttggtgatggacagggaggcctggcgtgctgcgattcatggggtcacaaagagtcagacacgactgagcgactgaactgaactgaagcaaacaagtcacctgagaagattctcaatcctgagtaataatacaatcaacataaacacccataatccaaagcattcttttttagggcataagaaatattttcttccagttttcaattaaagcattgttaggttttgaatcaaatgttggcccttaaaaccaatccatttcttttcccagtagaattgaactgttcctatctgctctttacaaagttgattttgaatagtgaatatttaaatgaaaataagaaactaccttttatatgtaataatctgaaattttacaccagaacgactttatctaatggctttgaaatataagaaaagcaaaaaggaacttgaagaatttcccccaaaacagctttcccagttttgttttactcagttatatgctttaaatgaaattattccagggtgtaaaatattaagcaaaacatacaggcagtttggagcaagaaaataggaccaagctgagatctttaatttgcatgtagaactatacaattatttttatgacctactttcatgcatttttaatatgatgtaaaataaactctactgtcacaacttcccattctttctccaatcttgcaacatagctggtgggctccaagaaaaaaagagctctgttctaatcaactggctaaacaattcatttcctaatctttagcctcctagtttaattcatggcagaaccagcttccctcttgagtcttcttacctcaggcaatgtttatgtagcaaatatatatattgtgcctactgtgtaccaccaaaaatattctggaaataactccagaaagaatgaagggaaggagccaaagcaaaaacaacacccagttgtggatgtgactggtgatagaagcaaggtccgatgctgtaaagagcaatattgcataggaacctggaacgttaggtccctgagtcaaggcaaatgtggaagtggtcaaacaggagatggcaagagtgaacatcgacattctaggaatcagcgaactaaaat

SEQ ID NO: 42582 - DNA, 847 bp, Bovine  19866881169585
ttttcccctcaaatgggaaatactaagtagataaagatagcagaactaaattttaatttctgtcactgtgtataaagctatagtaataaaaaattatggcactaccagaaaaaaatgacatagaccaatcaaacagaacaaagagcccagagataaactcacacatatacagtcaactaatatttgataagggagccaaaaatattgttattttgcatcttaaggaaatatatttgaaaagagaatttccagggggagactgtgttatactactttttatgttttagttacttatagtataatatatacctttttagaaggatttaagatggtctgaaaaaatctgggctctatttagataaatacttaaaggaaagtatatttggatatagacagaaataatttttcatttctaatttccaaaataaatctcactatattttatagagctttaaaattaatattactgtttatctgtatttcaggaaaatatttatataatagactgtatttagagaataaacaagaaattgactctaagattttagaaagattattagatgaactactaaaggaaagaaaagaggaagaagcagcaaggtaatctgcctggcacaataaatgatattaattaaccttttacaactgttaaaaatctacttatgatttatatttataaaatgcctttaacatcaaaacaggcctactaacaagatccaattctaattctaagaaaaatagtaatttcataaatattcccagaatctctaaagtatatagctgtgggatattttcacagtcccaaatcagacattctaaaccaaatgtttactttcaaaagacattg

SEQ ID NO: 42583 - DNA, 2765 bp, Bovine  19866881230927
atttaacccttagatttatcttaaagattgtagatcaagtgtgtaaagcaattagcagattaattcacattccttataatagaatgcctggcatgggaagaattacccaactctgatcttaatattgtagttttgtagcaaattgtgtaaaattttttgtacagaaaggtcagtgtaagataagatgtcttgtaaatcaagattttaagtacattaaagtgttttaaaatttaaaaaaagccctgcataattgatagtattttagcaagagattaagcaaatatgggaaacattgtgttctaaacttgattttctagtaaaattctataaggaggctgggtgtggaaggggagatgaagagctggtgagagagccctgtggtctctggagagaaccattccatcaggacccatcaatcctctaggcagaaataatagagaatttgttagtccaacagactaagctaaagagtgtcatcagcaaactgacaggatgaatgaaggctatctgcaaatttctaagtcaggaaactgactctgtggggccaagttgggcatactggctgctggtcaccaggaagggctggttcatcttaccttggtgctctccagacttaggcactacctagtcctacatcccatggcagagaggactattaattaacagagcccaaaagccaactagagaatgtatgcagctgccattgttggttttttaatggctcaacttctttgtcctgtgaagaatcacttgagaggccctcgggattagggaaattcagggtgactgggcagtcactgtcctggtattaaagtgaaataaaacttttgtgagtccacagtagccctcagtaagatctcttgtatgcaaagttgaatttcaggaaggaggtaactcaatttgctagaaagtcccaggactttctctgcaggggggatgggggggtttggtgggatggggttgtgggtgggggtggaatacccgacactccagaatctgctccccaccataacaggaattaggagaactgatacggacttgattaaggaccagtggtagggaagggcaaggaggttcctgatagaaaacaactttgcgtgactcagcaagattttaagtcaatgacctgagctcaagagcagggctttaggttttatgggcttttactactgggtggtttccctgagggcttctctggtggctcagaatctgcctgcaatgcaggagacccgggttaaatccctgggtcaggaagattccctggagaaaggaatggcaatccactccagtattcttgcctgggaaatcccatggacagaggagcctggcgggttacagcccatggggtcgcaaaaaactctgacacgactgagagactaacacacttactttctactggatgtgagctggggaagtcatggttgagtagaggagtgtaaactgaagaccagctcaagcacagggctctcctgtccaaacgcagcattaagggaggggcgctgctacctgtgcagagactggaccggtgagagactgtctccattggaccagtaccatctggggaaggggaaggccacaccttcatcactccatcgggcagtgagaagttctcctgggctgtagaagtcacatgggtctcctatagactgtgtaaacctggagactttgggacaactcaggagttgctgcagggagtgaagttggcctgtgagtgtttaagctgaattttagcctgaccgaaaattaaattattaatatgcaaccatatcggtgcccagactttgagaagcagatcacacaccctttacaagagctttaaactctgtttaaggtattttaattaattccaatgagtaatttcttaaagatttaactccctcccactctctcccatccctatggcccccacttaccctgcggtattacatacacttcccatcagagataattctaaggcctgaatagccagttcatcaggtgccgtcattcctttatgaagatgccaatttagcataagtgccagctctgtgtctggttggttgtttaatacataacgcaaagcatctcctatcgacaaacgctttaagccatattcacttgaaatctttttggcaactgaaaaacattaaaattttaaacttattctgtttcacaaaccccatctgttaaccttggtttcagattctagttaactgacaacaacagcaaggttaatcttcacatttctcaaagaaatttcaaaaattaaaatagctacattttattgaattaatgggcttctctggtggtggctcagacggtaaagaatctgcctgcaatgttggagacccgagttcaatccctgggtcgcgaagatcccctggagaagggaacggttacccactccagtattcttgactagagaattccatgaacagaagagcctggtgggctacagtccatggagttgcaaagagtcggacatggctgagcaaacaacactttcacttcacttcattgaattaatactattcaaaggtcagtcattattagcacttcaggtatgtggctgacagatctggttaatgagccaactgtgttaggtttttccataaccaaaccatttaagtgttttttccttctgtacaaggtagcaaaaaatttgagagctttataaggcatcctgtgtgtactattaatatttggtctttttatatccaaaataacaattcaatgttcttgtgtcattgggttaacccatttccctatctatacacttatgactt

SEQ ID NO: 42584 - DNA, 2183 bp, Bovine  19866881247538
catggctgtcttgagaggctaactaactccactttcagttaagggtctgggtctgtgttttccttgagagttgggtaaagggaaaggctctataatggtcatataatcttcatcacccaccacattagttttctgaatttctacttagaacatttgtgccagaaaagacaggcgctcaattaggctacaaatgtcacaatttctagtaattaccatcgtgcacaaataatggaaaacgctcaacaatgggtctgatttgaaacattaactttcaaaaatgctcacaaatgaatcatttaatctacaatcaactttcattatttttttctcctagagatagaaaatagataattactgagaagagaattggggaaactttccacgcacataatttgtgttcagaaacatagaaacaaacatttctctggaatgtacgaaatgatttcatatacaatatgctatcatcgtagaaagccttccaaaatggattcagtgcaagaaatcctggttgaaaacatctgtgatttaaggcatgtcaaacttgaaatatgcatgtatgggcatgtgggtgtaccgtgtgtgctccccataatagagtccctgtgcatctcactctgtgcgtggcccacgtgttaagtgggcatgaaatgattattaacaaaaccccaagctgctgtaccacggagagtgtctgatagagcaatgcaaaaaaaaaaaaaaaaaggagcacagagtcagcaactgctatgcactggggaagacttggtaactatagcaacttgctttagaagttgctcttcccctgccagaaatcaggtgggccctgtcagccctcccactgtcacactgcagggagagagcagccattcaggagaggtggcaggctagcccacaaagggcacacagaggaaagcagacctccttaagttccggcaccacatgggtctgtgaagcagcagattaggaacaagaataagtgcaactgaggaaggtggacataaagagagggttttgaactcctgcaaacagaatgggaattctctgtcatgaatacatccacccagctgtgactattctgatgaaaactggcacatgattacagaaaagatcagcacacactcaagaactggacccaggcagggtcagggtatttctgtcagtctcttggataaaatctcacaattccacagagaggagggactagagttaacaccagaaccccaccacgtatcagatttttgtagttgcgataattttttgggggggattaactttggaaggaatgatgctaaagctgaaactccagtactttggccacctcatgcgaagaattgactcattggaaaagactctgatgctgggagggattgggggcaggaggagaaggggacgacagaggatgagatggctggatggcatcactgactcgatggacgtgagtctcagtgaactctgggagttggtgatggacagggaggcctggcgtgctgcgattcatggggtcacaaagagtcggacacgactgagcgactgaaatgaacttttagtaaactgcagatagttgaacacacagcggggtgagctcatttcttctcatcaattacagttgtcattaaaaagcctggagccaaagaagctccttggacatggtgagacaaaggtttccccactgggagccccagtgaccttttgtaatctggtctctgaagtgggtagaagggaggcctctctcacatggaatgggcttggtgagcttaatgttacagggattcaggcttggtttaccctcctcaccacagcactggacacaggtgatccctgcctgtcctgaaccatggcctccatttgactggagaactcactcctgttctcctgccacctcactggttgcttgctcccactccctcctctctgcaggatcttccttctctctcccaactctaggtgatctaagccttggaaggtccccctcctcttaattttttatgtgatcttatttagtgtcagggttctcactgtatctgcaactcaagactgacatagtcaccaccatctcaatgtgaccatgttggatgtcgatctaacaggcaccacactcatgccatgccccagaccatcttctcgtagcagatggctggttctcccatcaaagtacatcccaaaaggaatgctcctcagcccat

SEQ ID NO: 42585 - DNA, 1928 bp, Bovine  19866881283587
accaacatgcctgctaggactgtggcctcctcagtggcctgagttctctgcttttgcccttgatctttcctagtcttttctccacatgacagccagaatcttttaaaaacacacatcagatcctactactaccttgctcaagaccctccagtgtcttctggccactgaatagaagctggagctcctgccagtggcttttgggcccacgtgatcgggtgcatccctcggctccaactgcctcttgaccaccttcccctttgctcactctgcttctaacacactggttttctttgctgcttcactcattacctcagcgcctcacacttgctgccactactgtctagatcactgtaatagcgcattccctctctccaagtttccactctctccttagagacaacttccctgcctattttacttaataacattagcccccacatccattctatccctttatcctgctttacttttctttgccacactaatcattacctatattatcatagaaatccatcttcctcaggaagatgtgagatttataaaaacagggactttttgttcactgcttttcccccaggactcaaaacagtgcccagcacatggtgggcggtcagtaaatatttgtaaatgagtgaataaacacacacatgaagaaaataaccatactttgtgtaacacgctggctgtgacatgtagtggttcaacagtttttaaactgcttttgactttgttgctaaataatttggttcctgtaacaaatcaggttgtaaagtaagtccttctgttggaaaattaaccacctctggggtcaaaaacatagtgttctcccatgtctcagatttaaaatggatttcagaaatctagttaacagaagagcctggacagaattagaatataggattctggatctagaagggacttctctctccaaaggagatatatactctcctcctctaagagcaaatatcaacagttctcaccctggtcctgtgagctcccttgctccaagcttgttcaccaagtcatcttccaaatacaggtgcctgtcctagaagaacccctcttctagcttctaaaaagtttcctccatgtcattacagaagttttagtagtacccacaatgtactgggtattagctatttgccacacacttggcattcacttgtttactcctcaaagcaatctggtgacttggtgttgttagtagtctcatttcataaatgaggaaaccatagcacaacaaggctaaaggacatgtccaaggttacaaagctggtgagacatggagccaggattcaaccctgaggttcttacctcagcgtccatgctcttgatcacctgcaggctctcttcttagcaggctactcacctggttcaaattgggtgacttggctaaggtcactcacagcaggcaatggacaaatggggaggggggagggtccaagtctttgttccttgttctctccagttggcttgaaagatttcagtgagatgtaactgcctctgcagagtgggtagcaaggaagtttcatggtggaactagtctcaactactagctgctaatttaaggccaattgtctcacacgccccataaaagagggtcagatttaaagcgtctgtaactttattcagtttaagtgacaaagtacaccttttgtatttgaaatgtattttcctttttaatcctttctcttcaagatattcagtactggcaacttaaaaagtacctttaacacgttttttttctgttgttcctactgaattttgcttattttaaacctggtacagactgtacctgctatgttccttaattctgccacattcaaagactgactactgtgtgcacccctgatgggagtcttggtgcttaaatactattgctaggactcaccctcatgtcccaatccctaagcacataaggtaaattt

SEQ ID NO: 42586 - DNA, 1412 bp, Bovine  19866881287455
gctaggactgtgagaatgagtaggatgtagcctgggaatgcagtgggttctagggggctatttgttgttgttgagttactaagttgtgtccaacttttgtgaccccatggactgtagccggctcagtccatggctcttctgttcctgtgatttcccagacaagaatactggagtggattgccatttccttctttagaggatcttcctgatccagggattgaagccatgtgtcttgcgcctcctgcattggcaggcagattccttaccactgaaccaccagggaagctctaaggggctgaggttcctgcagtttcaggttgacataaagacagtggaatgttttactccaaggttgatatgatccaggaccataggatcactgcaaactgtctttggatgttttaccaatgtcacaaagttcttatacaggtcacatttctaagtccacatttattgtttggatcatctccaagcccaaaatgaacatccatagagcaactcactgagtacatgtttcatggagacttaggcttagtccatggtcaggggaagaatttgaaatgcatagaaatctcctctctagcaaaaaggatacaaattggcagacttcctagggtggtagttagcccaggctcttctctgagaacttctcagggatattagcaaaggactagtgtctctatccccgattaccaccagctacaatgagcaccaggcttccgttgaaggagcaggatgaggctgggcgaggaccccatggggccattgattccctcatcattatggtcaaggcaattgttaactatgagagccaaagacccattagtgataatgcagtcaaaatggaaactcaaaatggctcaaatccaagacaagagcagaatctgtgaattaagagattgagtcatcctttataagcctaggaaaaatatatcaatttatagattgtcacctcagtacctgagagggagttcagagaaacagaaaaaggaagaatttgaagaagttggaagttggcttgtattctgctaggtcattattattattactaactgttgcttttattatattactatgagccaggcattgtccaagcattttataagcattaactcattttatctgaccactctatgagcacctcattgatatggccaggatgggactgcccattccttcaaatctctccttgatttctcccctttataatataattctttcaggaccagtaactacaggcatcatgtgatgtaaggagtaacttagtcattagcttctagtgaatgcctgaaaatctatcatgagacactagataaagatattgacataggttatgtgcaaatccatctgtaagggataactttgcatttttttaaagtgctgttaaatatcaattatgtataaggcactat

SEQ ID NO: 42587 - DNA, 624 bp, Bovine  19866881777696
atctttgtaatttttttggctccaaagcttctgaatatgtccatactcattcaaaggtaggagtctaagtgccaattaccaggctaaacatacaaggttacaggaatttatgaattagtgacacccatatattttagctaacaacagtggaatgaatacagagtttcactcttagaaaggctctaggcttcaaaaatctagtgtgactgagaaacattcagaggctggatttgaggttttagcacagaaaagctgtagtgaagttgttaacttcaaccccataatacaggattaattcctctggggctcattgaatcatagcaatatagtgattatagtcctctcagccttgcttagaaaagtagaaagaaagaaagatattgcctatatggacagggactcattatgtgcttaaagggcacagaactaacaatgtagagaaatatactgaagaacttaaaaaaaaaagcgccaaatataactgtcttaatttgttcttgtcttttatctggcatttagacaatctgaacaattctcatacaattacatatataaaagtgatttgtacagtcagtgttgctatttgttagtagtagtttatatcatcatatatgaatacgggaa

SEQ ID NO: 42588 - DNA, 952 bp, Bovine  19866882240291
aaattaatgcatttttagtcctgaatacatattgaccaattttttttatactggcttagaagtgacgatgttagtcccattacaagtattttctgacttgatggttattactgttatcagtggaaagatttagagttaccaactgtggcagccattagtgctgttcaccaagtgcttctgtctgtctgccttctaggagccttatagaattgtacttcctggcttccttctgaagagtgggagcatgtgactagcactggccaatgagctgtcatcataagtgatgaatgttgcttcctgatcagagcctttaattgctaaggcaggagccccaaagctctcacccacccagctacaggcttgatcaccttcaagactgtggctgcttcatcagcttaggcccctgggtactgaacagaacccttgctgatattcaatccacatatagtatgagagaaaaataaacctttgctttttaagctgctaagatttggaggttctttctatcctgcaacataactgaatctttcctaacagatgaaccaacaagatgtcaaaggcacacgttacacttacacaaatgtccagctgtctttgtaaacggcagtcaaccaacatcaacaccattctatctcacatctatcatatctgacagaggagcaaaaatccctctctcacctggataagtaggaggaataagcattccagctgccacatcactcgtggtctcaggagtgaatttgtctgaaatgactgtaatggagcatcctgggaccattttggaaatgcacacagcagtagaaagccccatcacgccagcccccacaactgcaatccgtactgtatccatgggcctgtgaggaggcaaagtatgagctgcaaaaccttgttttaagaattagtccatccttgggaattccctgattgtccagtggttagaacttcatatttt

SEQ ID NO: 42589 - DNA, 3357 bp, Bovine  19866880498039
aacaactcttggggtactgggtgagtaaccatgataagaccctcggcttaatgaaccaaggaacaacaatcttgaaaagggccctgcccttcctccctaactgaccatttagtagactctcaatgtttttctctactttcttttttcaatagaccctcaatcttttaatttctttcatttctaaagctgtcttgccattatgacctattcataatgatatagatttgacagaaaatgataatttttaaaaaaagactcttttttttgccattattatggtttctacatttattgatatatataacaactgtttattaagcccctacttttatgccagcctgtcctttgcaaactaggagtatagaggtgaacaaggcaaagatcccactcacgtggggcctgtgtctaatggggaagataggaaataaaatgcaaattagatacagcgccagacagggtcaggcatatgaaggaaatacaaccatctctgtggaggaggtatctgagcagactacatgttggatcatgaataggatcatatagagagctggggaaatgtgttcaaggcagaaggcatattgtgggtataactcagggcacaaaagaacttgatgagttctctgtagaacaagatcatggtaattgtcacatcatatcatgattatttgcttacttactatctgcctaagtaggatgttaggacatacttattcatttttattgtcagtagctagcaagagtttggaatctggttggcacccaacacccaacatctactaacaaatgaatgagtcaccacaaagttttctggctataaaaaggtgaataatcttacctagcactgtgtgtttactgatgtacactgcatttccaacatttatttttttttagtaatttttgttgaacatggttaaagtgatgatgaatgtgtccatgttcatcagcattctgatgatgattttgttatatattttcatttattggagaaacttgatattaaattcactttatttagagatattattaagaaccatattatgatcatttaagttttctaattaaaaattgtccagagtttacattctaggagtactttaatattcaaatgatcctgtgaaaatgaatcttaatgtctgatcaattttttattgtggtattcaaaactgaaatattaaagtactttggtattaaatatcataaaatgaactataacattaaatatggatattctgaaatcgtgtattttaaaatttcagtactcaattttgacttcattagtgtatttgtaagtgccagtacgctctagaacaatgataaaagaaatttagagaatctgaaaacttaccatgttttactgtactgtttgggattttggaattaattgagtttggcctattttctgtgctgatagcttccatgtggaaacaccaaatatcagtatttctggagcatcatcactaaaaagcaaaaataaaaatctatcagaagtggacagatctccatgagataaaatttattgattagtaacagacttaaatctttgtttcattctgcttttgtcttcgtgatactaagacaggcggccttgtcaaatagctaacgatacacacaagtctatggttttggttttaagtcaatttaattattttccttctgttttctaagctgttttggcaaacgcacagtgaagtcgttgctgtacaagcctcccatattttcacaaagcctgacagcatagacatctgtaaccatccttcccatggaaagctttttcttctagaacaaggaccccccaaaaaagagtctgcttcaaattcccatcctcatgtctttttactcccttagctgagactgacaataaggagaggacaaactgcaaggatgacgtttctatctaaacagatttacatcttaaaggagagagcctcatttaaaatagtaattctattgtctattttttccttaagctttctctttcctattaaaaaaaaaaaaaatgaatagccatcaataagactgagtttcagggaaaaactgttactatagaaggccagccagatgaccaagactcaaatggtttttagaaaccctttatatagatcttgtggtaacaggctccttagggagcatctcaattagagataagttctgttactgtacttaagtccaacattgtttccacgcatctacatgaagagccttatgctcccgaattcctctgggccttggactttatttttatctattctacatggaagacttattgttattatttttttttacaagcttccactgctagtaattattttagtggttttatagataaagatgcaggaacacaattctctttatagattaaaaattaccttttcatattccgaaatcactggagagattgatttgtataccttggttttttttttttttggtatttaactgtggtctagctgctcaggattcatgaaaacaaaacaaaatgttgtcatccttgatagtaatttgaaaggaaaatttcacattcatgttacattcttacagaaccaaataagccaataagcaaaaagtcataaaataagcttaataaaccttcatattaaggcaaagttaacatttgtcacttggcaactggataaaaattcaactcacaagacagaatttgggctgcaatcaatgcttatgaaaaccacgtgcagtttgtgcaagccctgctggatttggcagctctgggagtcagctgtgattcctgagcataataaatgcattggtttgaattctcctgtctgttgtatggggagggttgtctagagctcattcagattcaagatgcactttaagatagaattacaagggggaactgaaggaaagaaaaaaaaacctctcatttgaaatgcttttattggaggatggccctacgaggtgattgttcctctggacatatgtcattttcagaaatgaaaataacattgcctactttggttaagattccacccacagaaactgctccatccttatcagactcagcttcagcagcggatgaaatcttagtcctttatggaacgggaatcatctggtgtcctattgctaaaatagtctagagattactcacttacttctctgcaattatagccatctgatcctttgatattgtggaagggtgagataatgacatgactgtaacacaaatccatattgaagagcccagtgtttaaaattccctgggttcacacaccggaggtttacttgtgagctgatgatacttgtgagctgatggcacatcacagataatcatcaaatatggttatcaacttagtatctggacaaagaataaaacaggaaataacattctattactaactc

SEQ ID NO: 42590 - DNA, 1520 bp, Bovine  19866881145207
gacccccatggactgcagcctaccggctcctctgtcctgggattttccggcaagagtactggagtggggtgccattgccttcttcatttactcactagaggccagtatcttttctcccgctttgtgactgccagacatgtctccagaatctgccaaatgtctcctgatcactcccagtttagaaccactcatctgaaatgatagtgtttgtcatccaagaaatttaaaactttgaaattttggtagactgaattcacacattggaattccccattttttaaaaaacccactgaatctaaatatgaagctatccataagattatttttgctcttaggtaacagattaaaaattgtatagaagcaggttaattcaaacaattttaaatgctgctgtaaaaggtaagggatctttgtcaaaaattaattcttaagctgacagcatctgggacagtttcactaaggacattgacatataataggtagagataaatgaggaaaggatattcctcacggaatagaggtacagatgagaaagtctcaaggtttctttataaagcactaattagtttaacaggaagataggactttttctttggggaggtgatttctgattggctgtgaaaactagcatagacctgccagcaagttctccctctcagtgttaaaactaggataagactttaagaccagatgatagcagattgagttggccttgagttaaggtaagaccatatttttattcatatgaaaaatattttagagaaccctaagtaagaaatttctgcctgttctctggctcaggattctataataactgtaattgtgctgatactgttttttcagttgttcttgattcttttcattgttttctgtctgtatctctctaggagactgaggatggcattattgcttatgatgattgtggggtgaaattgactattgcttttcaagccaaggatgtggaaggatctacttctcctcaaataggagacaaggcaagataattcttcttactagagaaaggagagggagggagagttaaaggttatcatcttaatcttaaatcctgaaaacatggtttctttaaattttatcaagttgtgctccaattcttttgtgcttacaagtttaatatatatatgaacatcttcctatttaaaagcagtttattcaattagaatagggtctagcaagcttttgttaaaagctttttgaagagttagtgtttaagcattagatatgtcaaaagaattaccttatttaaaataaataatattggtaagaaagttaaaacatcaaagtaaaatcataccaaaggtttttacattgtggttaatttttattgtacttggttggaatgtctggttttctaattgacttcctttaaagaaagtgagatctgtaaggaatacacactggagagcaacaacttgatccttgtgaaaaatggaatgagaaatagaagtaatagttctgggggaaatctgttccatcaaattatttatacagactatttaagt

SEQ ID NO: 42591 - DNA, 1916 bp, Bovine  19866880395207
ccagccacagtggtccccgccagccatgcaggatacagacagcggaggtggtggcaatggccaggatagtgccagtgggaatcgacttctgggcatcccgcaggtccccagagcggttagaaccagccatgatccctgtgaacagaggagcagttaggacaggagccatgggagagcagacggagataggacaccagcctcagagtcatgaacccaggagtctagtcctggcccactgactcgtgtgagagcttgggcgtgttacttggctactccgggatttaattccctcacctgtccagtgggaggtgaactggatcctgcttatgtaatggggctattggactaagaaattccccacatcatgattgactttctccctacccatccactcccaggcagagtcttccctctctgagctcccctttacctgtgactgaggggaagtagatgccaaccagcagggtgaagtaggaggtcatatcgctgaagacatagggatggtccatgtcgatgggggtaccatctgccaggcccaccgagggcatcccacgcctttccacaatcacccccttggtcaggtaggagctccatagattctctgtgggggaaacatgactctcagatatcagggtgccagagctctggggccaggaggcagggtggacaaaaagaagggtcaaaatcaaccagctcttatttccaccaacatttcctaagctcctgctttggaccagggactttgcacatgaatcagatcgagtccttgccctaaaatggtccaatctactgaaggacatatacaacaaagacctatctcagactgattcaatatgtcccaaactggtctcgccacccactcacggcaaacggctcctttcctctaccccttatcttggtaaaaggcaccaccatcaatacagatcagcttgacattgctcacaaccattccctttccccgtctctgtttcaaaaccatctccaactcctatccattattcctcctaaatatttctcaaatacaccccttctcatctttctagtgtttctccactctggcgctattaacttgtagttataactatgataagaacaggcaattctttgtatgtatgtgggggagggggagctgtcccctcacattgtagggtatttagccacatcccagcctctacacaccagaaaccagtaataatccttcagttttgacaaccaaaaatgtctctagatgttgccacctgtctcctgggaggggggcgggggcagcgcaaaacaggcctgatggagaacgagtttgctggcatccaccactctcagtaagaaaaccatcatatctcaccaggactcagcatcagccgccccctaaactccctgactcagtcctctccctgctatgagcccatccacattagcagccggagtgaaccttcagaaacaacaaactgaccatgtccgcctcttactcagaaccctttggcagctcctcatcaccctcagagcactgtccaaactcttcagcatggcttccagggctgaccacagtctggctcatgtcagtctctccatcatttcttgcccctccttcccttgcactttatgccctagtcataccaaattactcgtggttggaagggcacaatatgctcttctgtgtctgcctgcttttaggcaagctgttcttctgcctgtgattcccttattccccttgtatagctgaaagtctcttatttgctcttcaaaacccttctcagatgaagccaggaagcctagtcttaccaccttatacacatgaccactccctcccttgagagaacactgttcattgaaggcacgtctacacatgtcataatttatttgctattacatctgcctctgctattagactccttgaggccaagaactgtgacttatttatg

SEQ ID NO: 42592 - DNA, 1421 bp, Bovine  19866880417829
ccccgatcggctgatcccccgagtccgccagtcagaatgaatgactgtacctttgtgttaattgtggagcccaagccgcacgcggaatgctaatagggccaagtgggagggggcaggtgccagtctcgcctggatgctgggcaggaaaggaccctacctctggctgtcctcctcaacagccagcagcaggatctggctaacatattcatctgagctccaccctcctctgctcgaggaagccccatggttcccatggaccagggccaggtctggactcctgtggctgccacacaggacctttcacatctcgtcctgtccatcactccagcctccttggttgcattcccacaccatgaaccttgtaccgctcaaactcctattcacttattcattcattccttcaacatttactgagccctctgaagggtgcagggggatgaagctgtgaacaagacagacatggtccctcatctcatggctttaccatcaagcagaaaaaacagacattggcaggctctggagccaggctgcctgggtccatatcccagtttggcactttactatctgtttgatcttttaaaaaaatgttttttattggagtatagttgatttacaatgttgtgttcgtttctgctatgcagcaaaatgaaccagttatacgtacatctatacccccttttttaaagatatctgtgtgatcttacagcacaaataacctcttctgggcctcagtttcctcctctgtagaatgggaacaagaagagtagctacctcagagggttgtttgagcaattagttgactaaaaacatgtgaaaacatgtaatacagcatcatttactactgagcatgaagttctcaataattgttagctattattatcatttcaactcaggatagcattacaacaaatgacaatgggacttccctagtggtccagcggttgagactctgctcttccccttcagggggtgggagttcgatccctgattgaggccaaaaaaaccccaccaaaaaatgatgatgatgatgaaataaagttatgggggagcaagcagggcatcaaacgaggggactggtccagtcaggggctggggaagggttccctgaggatgtctgattttctcagacaggagagctgagtgggtgttaactgaagcagtggaggtggggagggagagggcagagaagtggagggaacagcaggggtaaaggccctgaggctggatggaacgcggagtcgaaaaatcggaaaggcagcaggaggctggcatcaggagtgatggggaagcagggctgaaaggggcctggagaagcgggcagggggccacaccatgcggggcctcgtgggtcttgttaaattgtaaattctgtcctgagagtaaggaagggggaagttgttgaaagcttctgaaacagagga

SEQ ID NO: 42593 - DNA, 1451 bp, Bovine  19866880429526
cggccgggtgcccagcaggcatggaacgcacacagcagtgggataactgtggtttggagaactgagtgggaggtgacagtcgtgtcagaggctgtgagcagccgcggctgctcaccaccgagctggagctaattatacacgcacccagggctgaccgtgggcgcggagtagaggcagaggggtacagctcagccgtactgctggtagggacccgtgggaggtggtatttgtcactgcacctgcagatcggagccgggccctgcgccagggcctcactcgtgctgcctcccttttacacgcacagcaactccgatgtaggttttaaatgggttccctgaccgtgcagctagtgatgggcagagcaaaactccggcctgtgcctgattgattctaaagtcaatgctttaaccgtcttgtctcagggatccttacaaccccctgagggatgggtattttgttgtcccgtttacagatgctcaacgaagagaggaaataatgaaactgatactcagcaaagagactaaataaggactctcatttatatggcacttcacactctgcaaagcatctgaaaggcagttttacatatgttgtttcatttgatcctcaaaacatcttggaattgaagatgacctttattagtccccttttactggtgaatacaatgatgctcatggaggttgtggcttagtaatagctaacgtagctacagcccttgcagaagtcatcagcaaactttccataaacatccagatagtaaatgcttttggctatacagcctctgtcaaaactattcaactgtgctgttggactgtgaaagcagccacagacgatatgtaaaccagtgagggtggctgtgttccaatgcaactttatttacaaaaaataggtgttgacctgtggctgtacttcgcccacgccttgcctaccaaagcttttagtagaccatcgctttgtgaggtcttcacagaagactgttattattcaggctgtcctttttaattattaatgaattactgtagacgttatcatcctcatcgttttacaaaggagaaactgaaggtgtagcaaggttaaggattatatttgaggtcaactcaggaactagaatgcagagttccaaagaatagcaagaagagataagaaagccttcctcagcaatcaatgcaaagaaatagaggaaaacaacagaatgggaaagactagagatctcttcaagaaaattagagataccaagggaacatttcatgcaaagatgggctcgataaaggacagaaatggtatggacctaacagaagcagaagatattaagaagagatggcaagaatacacagaagaactgtacaaaaaagatcttcacgacccagataatcacaatgggtgtgatcactcacctagggccagacatcttggaatgccgatgtcaagtgggccttaggaagcatcactat

SEQ ID NO: 42594 - DNA, 1141 bp, Bovine  19866880430726
tttagaatcttagacttaaaaggcaccattacacgtgctttagttccacagtctcgcctcgcaggtgagaggaaaatcgagacttgggtgaaagggacacgtcatcacccagacactcggcgacggagctgtgaccaggtcccgagtcctctggctctgaacccaggtgctttcttcagcagggaccggcatcccagcccagcactcttcctcttgcacctacacggtctgctgattttaaaaagaagaaaccaggggcttccctggaggtccagtggttaagactctgtgcttcactgaaggtgacgtgagttcgatccctggtccgggaactaagatcccatatgcctcactctggccaaaaagttaaaacaaagaagaagaaactaaattaaataacaaatggtcttagaggccatgttgtgcatttccacatgtatgaagtatttatattaatacaaaaggctgcaggacaatccatggtgatacaagtcagaaagaagttgcctcttggagggctggtgggtgaggggctgaccagaaagaggtaggagggaaatttggggggtgtgaaatgtttggtgtcttattttaggtaggtggttacaggaaggtgtgtgtgtgtgtttctgttttttgtgtatgtatatatatgtgtgtatttacatatgtatacacacatatatacataagctctgcattgtattttatgtaatttgtatctaaattaaaatggtatgacaaggatacccttagagaaggataagggtgtcctggggatccagagattcatggtaccatgcctgctttgctctgtcacctgagcagagcatctccaccaggacttgggcccgtttcttttcagaggtttgttgtgtgtctaggcacatagaaatcacatgtgagaagttccgcctggagctgcagaagctgtgaaagctctcagagccatgaggccagcccacttcacctttaggcctaattcagttgcagcgagcagaaattcaagccagctcagtggggggtgggggcgcagggggcgcgctggccaaagtcagctccacgtctgtccccttcaccgcttttatgctgggtgagctcgggtagcttagcgcactgagctgcacttctgtcaccttca

SEQ ID NO: 42595 - DNA, 1624 bp, Bovine  19866880444089
cctggagtaactgtgtgaggggtaggtgctcggctttttacgccctttaagatacataaaaaggctgtgagtactgcctggcagacagtgcctagtgcctattttttgttgttcgggtgttgctgatgctacgtagacacccttatgtggactaccgctaccttacaggtgagagaacccgagtgcagagaggttggtcaataagcccaaagtcacagagcagcagttactggagctgggacccctcccagaacacaggcgcagcccctgggttccacggtgccactccctgagccccactggccaagccccagctccagctcatggtgagcgcacacaaggcaggtgggcccgggaggcagtaccctctcgctgctggcacagctcccggtagtgctgccggagcttcaggatgagctgggagcggagcagctccacctcggggtgtggaggcagcacctccgaaggcccccggtgcttgatgaccgcgttggtctgaatgtccagatcccagtacaccctgggggcacagacagagcaatgaggaggcggacgccctgcctgcttccctctccgctccccacacacacacagtcctgggcaggccagccatccaggatgcgcagcagcaaggactcactctgtgggtcggaggagagctgcctgctgtttatcttcaggggacgtgccccagatcttcagcgttggggttcctgggatgctgggggagctggggactgacgggcccgtgggcgtcatggggatttcaatctggagtaagaatcaaaggtctgaggtcaggggagctggccgggctgcaccagtgcgagccccacctcctgactgactgccgaagcccagcgcacaggggccctgccagctgcctgcccgccccagtccgctgacactcaccttgggcttcttcacgccgttgccgctgggctgctcttccgagagctgccgctttcggggcttgttctcagccaggggggtttccaccaagcttgagtcttggggcaggggggtcgcattcagccctaaagggtccgactggtggagggagaccagcagagttgcaaccagggccggcggcttaagagcccccgtactcgagtcctggccccctcccgcccctactcctactgcttggagaagagcacaggggctggggtgcaggacgaacactgggctccgctcctgcaactgtgcaccccaggccagggccttctcctccctggtgggccgtgctgagccctacctcgcctctgaaagcatgatttaaggggtcaacgcaggtgaccagtttaaaacgccgcctggcatgagaaccagaatggggggattccctggcggcccagtggctagaactctgtgctttcactgctgagggcgaggctttgatctccagtcagggaactaaagatcctgcatgctgaacagcacggccagaaaaaaccagaacgacaggaataaaggggaaacttaagaaacacttggaactcctgtggtgatactgagagtatgagtgtgacggcggacagggtgcaagtcctgctctgcctcttactgctttgaggtcttgggccagtcccttcccctctctgagcctcagtgtgttcatctg

SEQ ID NO: 42596 - DNA, 1485 bp, Bovine  19866880452222
aggcacagtaaaccttaatttgccccaaacgtataccaagtggcagagtcaggattcaaactcaggcagactggctctagagtccaggtttctagtagttacactctaaagcctcttgtcatccattccactcagcaccatttacccgtccctctaatggtatattcattaatccacccatatattcattaatgtatttattcactcactcattcatgcctatgtgcatgtattcattcatctctatgttccttttttaacttcttccccctctctattcacccaggtaattaattaatcaacttattcattaattcacccattcattcacccagtcccgggcttgaggagggaatgagttgcctcaccttcaaagagcatcaccctctgctttgtccttcctcccacaactgttgattaaactaggtcattggacagggaagccctaggctggcagcaggaagagggcctgcctctcttttcttggccttgcacctgagctcagagctcatactttcctcccttgcccctctcccccattccacccctgcctgcccacagcatgagagcgacatctccgcttacacctacgagaagaccttggtgatggagcagcgttcccagatcctcaaacaaatgcatttaaccaagaatgagcgggagcgggaggtgaggttgccctagctgggctcggagtgtctcaagctgctgccagctctggggctgcacagatttgggatggcccactcctggtcactggcattgctgcctcctggcactggttccccagcagcaagggtgcacgctgcagctgcctgtctccagcctcccagctgagatgcagaggggctttggcgagggtgacagatctactctcgacgtgacttctggggcccaagggagaagagtggaagttaaatgtgtatggatgatgattcctcaggggtgtgggctgccagtgtgggggacaaggtatcatgtgatagacccttagagagtgagtaatgagtggatatttcaggatacagctgatgatgagaactggggcaaacctcctagggtgtggatggtgggttctcaggggtaatggtgctgagttctcatggggtaaggctggctgtaaggtctctcccgtgtgggtaacgtgggcccaccagccctctggtatttggatgaaagccccaccccagtgagtggggtccttagggctggggacagaagagctctcagaagtgggtgacagtacaattgtaagaagtggcatgtgcactgaccagtcagaactggccctgaggtagagctcagctgggccaggtgtcaaccctttggtcgctggagagtgggaaggccaggggtactggagaggagttggagtggccatatcagtggggcaatagctatttggtgtggaagcatcgcagtattttaacaactggtacaggtcccgaaagtgcacatccggctttgggggtagctctttgcagg

SEQ ID NO: 42597 - DNA, 1411 bp, Bovine  19866880473247
cagctgcctgcaaggagaggccataaatcctgagccctgggtggtaggagggagggaacccgtgtgtggggtggtaaagggggcagctaagtggaattgaatcgtgtttaaggaggaggcccacgccttcccccgggcctgtaatttactgcgaggttgacaagatgaaagcggaattttcagtggcataatcgctgggacctcagggagccgcgggagatgagccgcgaggcaggcagtggcagccaaggctttaagcgagatctggggcgctgatcccgctgtgatcacagtgcggggcggcagaccggggggcacagggctctgagcagggccggccgcgccggctaagcccggggctcaggccacgtcttgtccgctgtcatctccagagccgaggtcaggccccgatttttcagccaattttatgtagcggaacgtaccgcccaggacagctgtgacagtggctgccaacagcactcagctgagcaccttctccagcattgccctcagccaaagggagctgtccagctcaaggtcatgcccactggaggggagcacaactcatgtccaatatctgataggtgcatggattcaaaggtgggaccccttggctcaacttggagcatcccaactctggagcgcccatggaagcagctgtggcctctgttgagacagcctcacaattcaagctctccctctgctcagccttgcctctctcacccctttcctgtgttcccttcagctctccccagtaaacctcccgcaggcacatctctaccctggagcctatttccagggaaccagacttaaggctttccctcatcagtgggcttgttgtaaaacagcttttgcgtgtagtgttggaagagcatcacagagcctccttttcctgatggggagactgaggcccaaagaagcaggaaacttactcaagaacatttggtgttaggggcaaaagctgggacaccagactcccagcccagtagcccaactcctccattttatagatgggaagactgaggcccagggagttacaaggtacaggggagagtgggggcatggaggcagtgtgctagggtgaaagctcacagctttgtagctggatcctagccacacggttttgagcagaaccaccccttcttaagtgcttctatttttcatcagtaactagaaagaccagttcccgtctcaggaggatagggtgaggctcgcttaagtaacaataagagctggcactggctgtgtttggatgagtccttcacacacattttgatgaaccactgtgaaaacatgtcgctcacagtaggtacatgatgcttagttacacaacaccctgaccacctggtccaggggctccaagatcagcttcagaatctgagagtgggctgtgccagacctaggacagact

SEQ ID NO: 42598 - DNA, 1215 bp, Bovine  19866880477133
cgcgctcgggcccaggtgtttgatcctggctctcaggagtagatggtgatgacctcgcggccgccgccgcggaccagcatcacccggtccaggcgctcggtgagaacctcgaggaattccatgtctgagcgcccgtcaaggagaaagaccgtcccctttcctccccccatggaatcaggctcccgttaggcgccagcggaacgccgggctcgcgtccctgtccgaggtgctgattctgaagccgacccggctcagcccttcctccccagggctaggaactaagacccctgacgtccgcctccctccttcctcccaattttaagcccaggatacagttttcgtcaccgttgcggttgcggggaggcccaggcatgttgagcaaaacaagcttggcatcctgggatttcttgacaatgacctcgttcagccgcacggcggtgtgcatgcgccgcacgttggactggttcctgcgggaggaagccagggaggaggagggcagtaaggctaggagagaggggggacttggatccagtcgccccttccagcacctcccccgcccccagcaccgggctgctgggatctgctccttacaagccagggaccaccaaccctagaccactccaagctgggctaccccagaggtcaggggcgcgagttgagggttcatagcagagtgagaaaagtagggaacctggccaacctaggagagagtttaaaaattctgaagcacttacaagttctcccactcccttcaggaaacataagagaagcaaggagaggaagaaaaaggagaagggtcagaaaaagcaggagaagctgaggacttgagccaccatcaacaccttgcgtgcagacgactcctgttctcccagccccccagccttcacctttccactgcctgcacctgcgcgttctgacccttagcaatcaagcccaacctgagtcctcagacagagcaaccaaggagaggtctgggctgggccttctgactaccaggccaggaccccttccactcatttgctctccacggggagcaaagaccctgtaggctcaccccagaccttagcccttagcccccagacccgtacggcttcatgctggaagaagtccttgatgccctcagaggagacaggactggggcccttgttcttctctgccaccgacttgtccttggtccaggtgagatgcactttttctgggatctgcctcgccctt

SEQ ID NO: 42599 - DNA, 1068 bp, Bovine  19866880490988
cgcagtcaaccacaagccactcaccttttctccctgagcctgctcaccggtcgcctggatcccccaagggggcaagagctggcccaggaaaggctgcctgcagaggacagatgtgctgggcgtgttgagagcctcaagtgacccgggcctgtgtctcagatctaagtggaagcctcggcctttgctcagtagatgccttgcccttgcttttgccgtcttcatgagggctcacgcggccttgcctggggccgatctgctgctgctgctgctctgacacctctggtctccaaggccactaggtcctcttgcccacgcatttgcctgggcagagggtcgtggctccctgcaagctcacagtctctcatcctggcaagtcagagacacgcaggccgagtcccaccctctgccgagaggaggcctgggcccagactgtggtgcggtcactagagtccgctgctctcccctccacatttatatcacgtccttgcttggagagaaaactcccacctaacctgaacagccgcccttcccgtttgtgctccttcagccttccagacctcgggaggtttgccttccctgccccgcctccgccagcgctgtggtctctgccattggccatgatttcagggagctggccggggccctcggaggcccccgctgtgcccatgaggcttccctggtgctgcagcactcgtaaaccacacgcacgggcaccgtggcattcagtattggtagcctagcatggtggggactgcccaatgaagagtgtactgtatattttctttactataggccatacttctacagacatgtatatatatttatataagatctacctatcctagggtggaatgttggagggaaaataaaatgggaggccaaaaaaacaaaacaaaccaaaagtcaacacttgcagttgcaagccacgattgtaacctgagagtggccaggagcttcctgtcagtaaccatgttttcaataaatactctttcatgtacacaccggttcccattaacagctgtttctctgtacttgctccctgccccggggaactttcaccttgacaag

SEQ ID NO: 42600 - DNA, 555 bp, Bovine  19866880528862
ctcccccttgagccctttcttgtgtccctccttcagtcggatgggactgcggactcggagcactccagctaccctcctttccatgctttttaaggaaagtacctgttgagtccccccaaggtcaacaacgaggtccaatcctccaccatgttgtctggggacagtgaattatatgcctcgagacatctgggtgccggaccagtctgcctggccctgaccccgatcctccaaaaccagggggccttctatcccctgactgaggccaactggagtctgtccaaccgggcggtggagccccagctgcaggaggaagagcggatggtgtacgtggccttctctgagttcttctttgactctgccatggagagctacttccgggcaggagccctgaagctctcgctggtgggggacaaggtaagcccgggatctgtttgtgaggtgggggcctgtgatgggccttctgccttacccccaattcccctgtgcaggtgcctcatgacctggatatggtgttgagggcctcctactttgggagcatcgtcctcatggtgagtg

SEQ ID NO: 42601 - DNA, 2479 bp, Bovine  19866880544411
ccttcctgtggctcctggaagatgtaccgagactttgttatactcacagggcctgtgctgagaaggtgggactgggctcccagaatccattgtggccaaagtgggattggattgtcagtgagacctgcggtagcgccagccaggcccgccaagccccatccctaagtctcttgactgcttcttgagccctccctcttcttgggatttaaaaaaaaaaatgttcatttcatttgccttatattctcttacatttactagtgtgccttctgtttacaaatctgcaggcgagcctatttgtcagatgaactcagtgtggagaggagagacttctagttttgtccttctagaagaagaggcagtgtcacttccagaaactgaactgaaaaaccaataaatgatatctcagctgatctagattgtacctgtcattggcttgggacattgagaacttcctgatggctggagacacttaggcaggagtgcagtgaccatgtgtcaaggatattctcatggggactgagcagagagattaaattacgagacttggaggtcctttccgtgtccctgagtctctgcgtgtgtacagggacaaagtgtacgtcaggggaacagcacatggcgagcacacgaggtcccaggatcaggaagaccctctgctcctcacactcagcccttccatgccgaaacccttgtttctaaaaacaagggattaagttcttaggtttaaggaaacacaattgagtggatgctgtcatttgaaatcgagttatgcattatccatgcccgggactccctggcaccctggccaacacagcagacaccactgtcacctgggggcggctgtccagaagtgggcagcacacctaagcagggagagtcctgggcgggggccgggcatctgaaacctaagccttcagccctcgcgggcttcctcaccgcctcgccctctctggctctagatcgcggggtacgtgagccagcccatggtggacgtgtccatcctgcagaggtccctggccatcctggagagcatggtcttgaacagtcagagcctgtaccagaagatcgcggaggagatcaccgtggggcagctcatctcgcacctccaggtgtaagtgtggccctgccacgccttctgcccggcccgccccccagccctctgccctcctcccgccgcacctgtattcccaggtgctgggccgcttgtcactcgtcacctcttccctgctactcactgccagaattcctcccataattcagagctggtcacgtcacgctcctgcctgacaccctctgtaactctcttcacctcttaggatagcatgaaactgtcccagtccctctctgtatcactatggtgccagacagaattagatgctttctcttctatgagcgcaggagtccctgtttgtatctatgacgatcatatttacatgaaatactgtattttttattatctgtctcccgttttaaacgttgagttgggaacagggaccagttttgtatcccttgttttaagtagaagctctgttagtatttgtcgaatgaactcttgctgaactagcagcgtgcagttgagggtagccagaagtgtcttgcagagcatgtgttccaattcaggctctactgcagacgaggtctctgccctcggcaagctaactcttctggcttcagtttccgcacctctgcgctggggttaatccctcccacctctcaggcttgggaggatcaaaggagagaaaaagtctagtgtagagacctcacaggataggtattcattcaggagaggtttttttgttgttggtcattgtttttttggttttgtttgttttttaagtttatcccatcctaagacatttaacggatagtaaacaagatctaaagacagatgaacccttaggaggctgttctcccttcccccttcttttttcttccctttctgccattccacataatttaaggggcctggacttgccaaaagcaaggatgctgatactgctgacaccttcctacctgctgcccccttccagcatgtgggttgttgactgaatacccttccggttcccggggaagcgagaattcccagactcggttgtttttagcagccttttcttcactcagctatgctctcagcccaaaccttcccacgagcccaagtgaaaaaaaaaagcacaagaaaatttgcaactctgatttctttctccttgtcacttctctaggggattcttcagcctctgttttcatgccccaaaagccaaaaaggttgattgaagtgaggggacatgatcaaccccagatgggagagttctgattttcctgacctcagagttacctctgtttctttgtttctgaattggaatgacccaatcacctccttagggaggagagaggagctaggcgtttcttagggggtcagtctgtgaatattttcaacccattgctgtccctggaagtcatgtccgctgctgctgggctgagg

SEQ ID NO: 42602 - DNA, 1978 bp, Bovine  19866880552354
tgtccgtgtgtctttaaattcaccttctcgcttgtttctcttgttctctgtcactctgcacatctctctccggacatctctggctctttcccgtctctccatctgtcgccgtgtcccttgctttcctcctgtctccacctcgcatgtggtttctctctttctctgtttcggtctcgcccctgactgccgggcccaggccatccgtctgcgggtgcaccccctgtacttgatgatccccggtaccgtcggctgctcctacgccttcatgctcccagtctcaacgccccccaactcaatcgccttcgcctctggacacttgctggtcaaagatatggtgagtgcaggcgtattccagcagaggccccgaggagtgggcggatcaggggcgggcaaggaaccggggcaggactcccaccttcccctccccccaattcctgaacaggtcattctgagtgggaccagcaaacccctgggagggcccagcccccgactagcaaacactctgggatgattgcttaggtgatttcaggaagcgctgacttggccactgctttccaaagtttgccttggagatgagggccttcccctctctctgccccccaccttgtcttctgacttgtttggccaagcgctctgggccgggcagcatctctaggggagacggagcagcggaccacaccagagacataggggtgcacgtcagtgcccggtcacctggagaggagacagaagccgaggacggtggtgtgggatcccagcttttagcaaggctctcctccaagctgagcctcttcctccgcctgcttcctactgcccttccccctccactggccgcctcggatgatcgcaccgagcagttcaggggctgcagaccctaaactggttctatagagaagagggatctgcccgactagttcttagctgatggtagggtctccagggacggagaccccagcaggacaaagggagagaaaacaacagtgagcggcaggaagacagagcagagaggcagcagggacccggggagacagacattcattcattcgctggttcattcactgtacaagtgtgctgagcacgtccgtgttccaggcgcggaggtggtgccgggtaggggagacacacacctgcctccaaggagacaggaaatgcaaagcaggggggatgtttaacgatcaaagcaggttgttttcaagttgtgtgatgctgggtcagccaactgctctgagcctcattttccccttctataaaatgggaataataataagaacaaccctaaaagggttgctttcagggtaaatgacatagctctgtgacaactgcatggcacaaggcctggctcctagaaaccactgaacgaaaggggatgttatcagctcctcgagggtcagcctaggtgtgtaaagatggaagcatcttgggtatcaaccgtcctgggtttgcgctccccctccacctctccccagatgtgccatctggcgtgaaagactttctgactctcagtttccccatctgtataatgggcctcgagtagaaccctgcctcactctgggctcccttgcaggtgcggacgggactcctgatgaacctgatgggcgtcctgctgctcagcttggccatgaatacttgggcacagaccatcttccagctgggcaccttcccagagtgggccgacctccacttagccaacgtcacagcactgccatccagcttggctaacggcacatataggaccctctgagcccctctcaggaactctctttgggctgggccctcccaggggtttcacccatcctctgctgctgggaccccacaggctgatcaagcaattcttctctgtgatccagtacacagcaagcaagggtgacttccagcggtccactcgggtccacagtctcgttatctaggataccttctcgtttcccacacagttcagggagccacttcctcccagttctgctgcctgagaaacaagctc

SEQ ID NO: 42603 - DNA, 794 bp, Bovine  19866880553123
attagctgctggttgctatggccaacgttgtcatcttactaccgtgaagtggaagcgaggtgtctgaggccccattccttagggagaccatgcagaggtcctgcactgaccccagttaggtttgacacagtccagcaggccagggtcctggccaagtggccacagaggagggaatgacgtaggccaccctccctgagctcgtacagccccgtggggtggggggctagggcgtccctttcagcaccaggttggatgcagggaccaacctacagcataaagcttccggagactaattctcttcatttttcagttcctgttgcagacattaaggccattgtcactgggaaggattgtccccacatgaaagagaaaagtgctctaaaacagaacaaggtgagtggagaggcggccctgagtccgagctgctgttccagtgatcctgggcgtagtcagtggtggctgctttctggatgcatggcctcccattctctgtctctttaaactgaccctgaatgtttcattaagaacaatctgaacagacaccaaagtagatagaaccctcatataggccttgcccagcctcatccaccatggcagtgtccacatccacttgtccctcttcacttactactttgaagaaaatctcaagtgttatttcatcttacctgtaaacatttagattgtatctctgaattataaggactctatttaacataattataataccgttttcacatctaaaaggaaataaaaagttgttatttagaatcaaatattccactgatagttgattt

SEQ ID NO: 42604 - DNA, 2458 bp, Bovine  19866880572554
aaaaaaggaggctcttgtgaagcactttgtgcaaggcctcccagtaaggacttggttgagctgagattcaaacccaagttggtctgaatctagaacctgagctttttaaaaattatatttatttggctgtgccagcatttgggtgcagcatgcgagatcttcactcttctttgcagcatgcaggatctttagtcacagcatgtgggatctttagcagcagcatgcaaacttgtagttgtggcttgtggcatctagttccctgaccagggatcgaacccggcccccctgcattgggagcgtgaagtcctagccacagaaccaccagggaagtcccagaccctgaactcttaatagcaggctttcccagccaggggaacgtcaggacacagaaattccagtgaaggaggccctggaaccagtcactggaaccagtggaaggagccctgggctgggaaccaggggacctgggctgacatctccacttggccccagattcactgtgcgatactttacttctctgagttcaatggcaaaatggagataataatagagcctacctttaataagcgagtgtattgcagagctatttagaaaagcagtgcccggcacatagtgctgagcaaaggcagccatccttgtggatgaacacacaccagcctcccaaaactattggggtagcatatgcctgctccacggtctcaagactgtcagttctgaaagcatcatgtgcaaggccctcatgtttcaggtggggaaactgagacccgggaggcagggccgggacacagccccggggctcctggaggcctccctgctctggccagggggacggttctctttccggtctcctttcgccctgtgtgtctgcttctgtccatccaggcctccttccaggaggaggccagctggaaggctgaccctggcagccctcttttttccagcagctggcaggaacctgcctaaataaatgcaaagagaccccccctctggaagctgctcttgccgcgtccccatccaaatgttaattttgccagggccttgataaatcttcctgtcgcctccacccacctgagacatagatttcatcttattgagaggtgacacttctgccctttggtaccagctatcaatttcaggcggcgcccagagtggagagagatgaagaaccaggttctgctaaaccgccttcagccaccccatcctttccttaaacccccatggggccagcccacctgagacattgtcacctacccttccagaagaagtactgggaccccaccactattgcgtggctgtcagcaattccatgctcacctgcctgactttcaactgccaacacctgaacctcttttttttttttttaaagatatgtgttttgttcatatttttaatatttatttatctggctgcaccaagtcttggggcatgtgagatatttgtctgtgggctgcgaactcttggttgcagaatgtgggacctagttccctgaacagggatcaaatccgggccccctgcattgagagggaggagtcttagccactggaccaccagggaaatccccttttttcaggccttcagagctagtttgctgcccagatggcagactggaagagctatgggataacgtccacagagtagctctgaattactgactctttggagctggagtttaggtacctcagctctctcgctctttgtggggatggatactcaagtgtccacctgctggctcccagaattccctaatggaggtaagctccagttgcccgcagtggtaaaaggcttggtcatcaccccctcattggctctttcccttctcccctgtcacttcccaccctcctgctcctgcttcctgggatgacctaccccagtcaactacttgaccttgaatccttttcttcgggtctctttccacaggaacccaaactaagatgctcatgaaacctttcttagcagctcaagatgtgaagcactgtagttagcaatggagatataggagaagtctgacatttattgaatgcctactatgtgcagggactgtgtgtttcttactcctggatcaatctttgatgctaactgaatgacatctctggaaagctctgtctcaattttacagatgaggaaacagatgctcagagaggtgaagtcacttgcctaaggtcacagagccagcaaatgagagtcagtatccaaactcaggcagcccactctcttactcactagagagagacatgaaaaggagccagggtctgtgtgatcaacaactcagttgggagaaattctcccaggggtggggcaggcagcctcctgcaaggtgctgaagacatcataatcagtcagttcagttcagtcgctcagtcgtgtccgactctttgtgaccccatgaatcgcagcacgccaggcctccctgtccatcaccaactcccagagttcactcaaactcacgtccatcaagtca

SEQ ID NO: 42605 - DNA, 3954 bp, Bovine  19866880645803
ctggggacctttctgaggcccacaagccccaacagtccgccacccctcgggccacgagcacccacagaaacccacttgcacaggtcccagcggggcagctgctcaggaatgtggagcgccttccgcacgtgagggtcgttgaggtagttggaggcggccgtggtgttggtgcagggggggtccaggtgcaccttctccccagaacgcagcagcgtctgggaggggggcacagagggtcaggatcttggcttccctgtcccgctgtccctccccgtccctgctgggaggaagcctgggcccttgcacacctgatgccacacccgcttgagtggcaggcgggtgaagatgttgcccagatcctggaccacgacagtgtccttctcatgcctgcaagtgcaatggggggaaatgggtgcctgggcccccagatagggctggggttggcaaacaggatgcctggcagggcctaccttacgtggctgggcacccccccagcacatggagcatagaggttgtagatgttgaggccggagctggccacgatgtgggacacttcctgaagctgcaatgacaccccccaagctgccatgctttacagaatcctggcctcccaccacctccccaccagcgccccaagactttttttttctttctttgggcctgttatgtgacacgtgggatcttagttccccgacggaccagggatcaaacccgcacgctctgtcttgggagtaaggagtcttaaccattggaccaccagggaagtcccacatcccaagatttattgctcttctacttggcctggtcattatccttcccccacctcccccagggaaactgagcctcagtggaaggaatctgctagtcctgggtccaaatccttgtgcctctccttcctagcactgtgacttccacatgcttggcctcagtttccttatctggaaaatgtggataatacgatctccctcgaaagggacttctggaggaggaacaatctgcatggccatcactgagcacagccatggcacatcagacgctggatgagggaaacgccctttcccctcacagggagaccacaggcagtggtgtgggaccgcacccacactccaaagcatctgccttcaggcgggagaaacaggctaatcccttagtcaggaagatctcctggagaaggaaacggcacccccccccccccattcttgcctggagaatcccatggacagaggaggctggtgggctacagtccatggggtcacagagtcggacacaaccgactaaccaacaccaagcaggctataaaatgaagggggtgggggatggcaggatgggggctgtcgggggtggcgcagggcgggggcagaaccgcacattggccacgcattctggctctttgttgtcgtggaagttacatttgttttgagagcaacagtgcgtctgcagggaagaccagagcctgtaagagatgaatgataattgcttaggcccatggtgggccagagaaggcaagtatcccaccttctcaacttccccatcagggcttggacccaaaggacctgtttcctggggacaaagatatttatcagagagcgtggtatgtagctcccaaacctggctgccctggggccatcctgccagccgtccttcatttctttacgttctgatctttacatgaaagatcctttcatctttccacaccaaaatccttctagcaaccccatctcacccacctcccccgccccccaacttctgctcataaaccagggcaggacccgagatagcatgcgcctggaggacagacctgagacccccatgacccgccacgcccagggattgcccagtggtcctctcccatacctgttccccagaaggccatggtagtaggcgaaatagaccagggagttgtcattctgctcataggaagagagtccattgcccaccgccagcccctgtgaaacacccagggccttcagctcatctggacgtgggccagaagagcctcctttgacctccacccaaaccttcagcagtctggaagctgaaacccagggtggtttgagggagtggttgggcgggggaggccactcagtgtaaagaatggagctggcagcttgatgagtgagcttccggtcaggggaggcacgtagcccagaggggccagcgagtgcaaggggtgtcatgaaggaagagttggacggaggagctgatcttctgctcgtagagcaggggaggcaggacctgggatatcacatgcctggaggagacctgccgcaggggaatgcccaagaagtgggtggagagcggacctatttgaccttgctaatcacaagtctaggcctccctcctctcctgcagcctccctgcacctgaagattcatgctggggtcctgcatgaccagcactgccagagttgggatgtagatgccggcatagctctcgcccgtcaggaaaagctcattgcccttgtattctgggaacaggcagaagaaatctttaagggcttcaaaattgctctgggcgacctggagatggcaggatagagggaatcagaaagtggtggtgcttgagctacaatctcagagataatgacacccacccaccctgtttgtgcaagagcctgtgacttgtccgagaccacaccccagagctggtgacagagccacaaatggactccaagaccatgctctttttctccttgcatcatgccaaccagggagactgagacacgtgggtggacactggactcacctccgtgtcattggtggcataagacttgtcatcggagtaagagaagcccactccagctggggactcgaggtataacacgttggcaatctagaggggaagtggaaatgggttgagggggctgttcccttccccatccaactgctgagacacccacccaggacccaaaggggcggcgataccaggttccaggagtaggggttgtactccagtgtgacaccatctggctggatctgtggaggaaagagatggctaaattcccagagtcagctgggtggtgggtggagtgggggaaggtcatcctgctgggtattgcacaaccaggcaaaaccccctgaggtatgaaactgtcaagtcaggggtatggatgaagaaaccgaggctcaggaaagggacacattttttggaagaccacaaagtccttttctccctcttcccgggccttttcctttgggaactgtcccctccctgcccctgaccagggggtgaccccgctgctctccactcaccaggaaggggccgtgctctgtcaggaggccgtcaagggagctacagcctggccctccattgagccacagaaccacaggactgctcttcggatccttctgggactccacaaacctgggggccagtcaggctagggtgggtgctggtgcgggggactgggtgcagctcagtcttccagccttccctactcctggatttcctcagggatttttttttttcttcttcttcttcttaatctcagtttgacggcagagcatgcgagttcttagtcccccaaccagggatggaaacccagtcccctgcagctggaagcactggagccttaaccagagaacccccaggtaagtccgatccctcaggggtcttaaagacacccccccccacacacacaccatcatctcccctcacggtgggcattgcagtgcccccctcccaaccccgtccgggaagaaaaggctgcagaccagtagtggaggcgcttggagccggagcctttgaggtagcccggagtactggcggaaagaaggctgcttggccagcccgggcaggaagcagatctcgtcctggtcgggggccccttcgcccccgggcgcgcaggcgagcagcagcagctgcagcaggaggagaaccggcggccacagcgcggctcggaacatctgcggcaggaagcgggtgccggctgttgcctcgcccgctcggtgctcg

SEQ ID NO: 42606 - DNA, 3342 bp, Bovine  19866880662739
catttagaacccagcaggagatttccatctctggctccttaggctcttgctttgggcccagagtttttctgggcagagccgaggctattgtagaggcactcacacaactaaagaaaataaatgtccacgaatttcttcttcaagaaataaagattttatttgtggacactgaaatttgaatttcatgtcatgttcacgagtcagaatatatatatatatatatatatatatatatatatatatttatttatttattcttttcaaccatttaaaaaatgtgaaagccattattctgagttcagggactgtacagaaatagccagccagctgggtttgacccagagactctaattgctaacctttgccctggactgtcacttctggcagctgtgtacccagacgtggtaaaagctcagacagggagagggaagcagcaggatcctgtggtttgtacaatggggctgtcagtctcaggagggccccgccttcaggccactgatcaccaggctccagaccaccgatgccccggccttgcccgccttacctttaaagtcaaaccaccacttgagggacggcttttgtgacgggaagaagaacaagatggtgacaaccgacacgccggtgacagcatcagaaatgaacctacaaggacaaggccccaaagcatgagaccccggcatgtcagcaggccaaggtttggcagctttgcaaatgaggatttgtggaagggaattaggccctctgggaaggggacgttgttggaggccaacgattgtgttctgcactgtgcttggcagggacgcgaaccgcccgtggatgcgaaagctctttatccacagctccctggggtgtttagacttggctggagccaaacaatgtttatcctcccacttcaaggaccctaggaagagggatttgaccaaggaggggagaatctgagagccgcagaaggctggagtctgtggaacccctacgcatcactataaccggggctcctgtgaagccctgagtgtatttgttcagctcctgtttgcactcctcctggggtgggcagcttagcacacaaagatgcaacccagagatgcagctcacaccagcagagcccagatggagcccacctcacagccccttgagacctccctgccaccttccaagaatccacaacgtgtcctgtggggatatcaagcccaccaaagtctcagagacagtcctcaggggcaggtatcttccctttcagataaggaatctgagtctcagagaacagcagcaacttgctcagggccagaccatggtctgtagaagagatgattttgaactcagctatttctggctctgagttcaataaagcacagagccaaatgccaacaaagacgctttcagcccacacatttgggaagaagagtattcaaatggccaagaaactgggaaagatggtcagtatcaatgtaatagagaaacacagatgaaaacacgcgctaatagacaagtaaaccgtgaaaagggtgacaatatctaatggggatgttgagaaacacaggctgttggtgggaaaataaactttctgaagggggagctggcagtacgtttcaaaactttacgtgtgaataccccttgatccagttgttgtacgtctaggaatttatcttcagggaataactaggctcttgtacacagattatgtactgggatgttcattactgataagaacaaaaaaaagaatgggggatttttagtagggacatgtttaaataaattgtgtattatcatatgtataatgaagtactccttgcttatttaaaaaaaagataaaaaataacatcaactgttatgtttgatatggaaatacaacagataccttgtaaactaaaaaaaaaaaaaaaaaggcaagtttttgggacttccctggtggtccagtggttaagaatcacctgcaggggacacgtgttccatcccagtccagaaatatcccacatgccgcggggcaactgagcatccaataggtgctcaataaaagttgattgattgactgaataatagaatgaatgaatgaaccacgtgctcagggttgcacactttgtagtggggggactggcattcgaacccagttttgtctgattccaaaggcagagctcttaccacatgagaacccagatattttatcacccaaacctaagctcttttgagagcaaaagaaggaactggtaacaaccacacaggacgagaggcggaaacctagcctagctctccccagcggcactgcctgcttagctccgggcggcccagccccgaggctcccctgttggactccatcccacaggtcccgagtctcacccaggggtgaagaggctggcccagccagggatgaacttcgggtcccgggagaagaggaggatggcaaacacgcagaaaaggatgaacacggcctgttcggcaaacctgcgacacagagatgagaacaccaaggtgaccctgggctttggcctgacagcagcaagggaaggcctggggcaggggcccactgggtgtggtgggtgtgagtgggcccaggccctgcctctgagagccagaagtagtagttcggtgcctcggcggtcccgagagtgagggcggggtagtgccgggtgtcactggttcctttcctggggcttccatgttcccccagcatccttcctgagcatcaggcctgcctccctgcaaacacttcatatcattcccagggtcctagggacaatccagagggagaaagaaagcgagacacagacagagtcagaaaaacagagagaaaggcaactgacgggaacagagaggtaggcgaaagagaggaacagtcagatatccagaatggggcagctacgcagagcgacaaacatggagagaggggcagacagaggcaaaagagaaaaccccccacatgttggggtaaatatctacccaatgtgcccacttcacagatcaggaagcagggcccagagagggttaatgctttgcccaaggccacacgggaagttagtagcagagtcagaccttgtgtgtgggcctgctgactcctggttattttcactttaacatgcactgaacgaggtcctgggagccactgaggcagggccaggtatcccatgaacaaggagggaaagtgggcaataggcaggaaggtgacacgtccctactccaagtacagcctgaggggtttgctggtcctcagggtatcgaccccagtgccagggcaagaggctgactgtgttagtcatctccctaccttccatctccaggctcccaggcttttggtcctgaaattccctctggactcagtccccgagaggtagctctcctgaaagtctagtg

SEQ ID NO: 42607 - DNA, 1474 bp, Bovine  19866880692134
ccctatcaactccctctttgctcatcacttacaatgccggctcactgcactggcctcaactccgcttccagctgcccaatcagggcagcctaatatagatgaatgatacacaggagacgcaggaaagtggttgcatggaaaggggggtcagaagatagaggggcaggaagcaggtcaagagacaagggacagagaaggcggcatacagagatggggtaagaaagtgggtcagaggctgagaaacaagacacagagatgcagacagatggacagagagaaagtgacaaaaacagaggtacccagatacatagggagaaatgagaatagagctagagagacgagggtcaaagaggcagatatacatacgtatatatatatatcgagagagagacagagacggggacagaaagaggttgccaaggactcacccaggcaggcaacacttgagtgtgtgtgtgtatctcatctatccccctaagaaaggggattcttcttttgtttcaaatcgagtcccattgactcttccatcctctccccacttaaatgggaccctccgtgaagtagtctggtcacctcgtttactcggggcagcaacattctaagtttctgcagtagcatccctcggccagttgcagaaagcaaacatttttggcttatgattccgttctatttggtcacccaagatatacagagcacctactatgtgctagaccccagagggtaggatgccacatttgttacctttgtactcactgacacgtgggcaccgggcctggcagagaggggctgcttgtgtttgctgagggatttgttgatggaaaagacagagaacaaagtgaagccagggcctgtgctcctctctgccacctctctccaccagaaacctcctgccccttttctccccatcctgggtggtgagagccagtgccgttgctaggcaaggagatattgcacatatagatcttcctggactttaattaaaaacatctttagaatgtgtctctgaagaggccagcaattgattcctggcttgggcctgagggctgttgagccacactctctccagcagcaggtgggacagtcagaggctaccagcctgccctgccctccccaaacaggacctctgggagcacactgccccctgccttcctcctgtcctctctgccaccgtcctctcaagcacgggccctggcaatcagatagtatgtcctcccgattttatttctccctcccctctcgggcctcagtttcctcagctgtaaaatgaaggtatctacacttaacccaagagagttcctgggaggatgaaatgagattaggggtgtgaaagggctttgtaagctctaaagtcctgtgcacactaaaactgtttctcatgcccactgaggcaagtagcttaggttctggatccaggatctgggtccagttctggctccagctcttactatggaacctcaggtaagttactttatct

SEQ ID NO: 42608 - DNA, 1227 bp, Bovine  19866880710747
aatcaaatagcccgtgaatgctaactctgtgctgggcactatgccttcttcccgccctcacaacgaccgtgagatgcaaattattagcccggttacccagctgaggaagctgaggctcagaaaggttgaaccttgcccatggtcacacgggaggagcccagtgcagctgagatgcaaactcagatccattttcaatcctcctctgtcggaaagggtctctctgcttcctgtgtctcccaggcaggtgtttcctctttaggggaagggtggagggacatgggcactggctccatcggcgccaggacaccttcaatcagccctgacctgcccctcttaggtacgccatcgaccgcgactcagatttggaccaggtgtttgatatcgatgcggacacgggtgccatcgtcaccggcaaggggctggaccgagagacggccggctggcacaacatcacagtgctggccatggaggcgggtgagccagggggcggggcgaatatggaagggaggggcgatggccaaagggtggggctgtgggcggggcaaagcccagggaggacgggccgaaggctgggggcagggcaaaaagagacggcagagctgaggtgggggcgtggtaggcaaaggctgacccacaggatcacagatgtgggaaggatcccaagccaaaaaggcagggcccaggcttgagtttgactttgttccttcagcttttattgagcacctactatacaccagtcctttttacagaggttggagatatagcccctaacaaggttaaaaaaaaactcctgtctgcatgggctagagctagaccctcaggaaacttcgagaaagggtgttcgcatgtcagctaagtgctaacaagaaactggaaaagaagaaagcagaggaaagggattgggggggaattgtttctcttagggtaggcctctctgcgaaggagacttttcaaaagagagctcgataaagtgagggagtcatgctgccactggagggaagagagttccgaggagagaggacagccagtgcaaaggccctgaggtcatagttggagaaatagcaggaggccagtgtggttggcgaggggcagagtgtctaccctgcaatgggtctttggacttgactccagatgagccgggagtcattgagggtttgagcagaggagggaggttgcccgacatgatacctacggctgctgcattgaaaataggttgtttgggggctg

SEQ ID NO: 42609 - DNA, 1501 bp, Bovine  19866880730115
atacaacagagttgagtgattcctactgactcctggggttgccctggagacagacgttgcaaggcctgactccctcgatgcatgctttgaccctctcaaacacacagcctctcagagcagtgctgtggagggaggggacggactgtggatctggtgacaggaatggattcctcctgtaaccgaccactgacacagaacacagaaagttaacttgcagaattaatgaagacctcagggaaaagcaagagttgggatgaaatgccagcctcacgctgtgttgagtgtgattggtgaactagaatctgtggctggtgtgatctgaccacgctcccatcgcagctgcccagagcttccacctaccagcacaagcgctcaggaaagtcctgctgccggtcacttcattgctggtgcaagtggcagctgtgtggctctcctccttcaggtgtctggtctcccgaggcagagtggaaggtgttggcccagggtgagggatgctcagttcctgactagcagctcagagagggtttttaggggcatgagatctccctggcgtcccagcagttcctcactttctctgtattggagtcaggctgaccttggagaaccctgagatctgggccatgacatgtctcggggatgatcttcaactttcagataaaagaagcaagtctggggaggagctgcactctgatccaaatggggcgctcgaggctcatttgaaagctccaagcacagccacttgaagctcagctggtttgctcagctgcatgtaaaaagaggcacttttatgagactagaggctcctcaaggtcaaaggcctttgggggaggggatccgaggggtccagacactggagagagccttgagtaagtgtgatttcaggtgctgggaaggatgcctcccctccccaccacctcctttttttaaaaaaaaaaaaaaagattgtaatctgatccttgtgctgcagctcaactgcagatgcccaggggagggtcacagtgccttagtaatttaccctcccctgtgaatgagctccagacctatccttggaatctttaccagaacaaagcaggtgggccctggaggatatcaaaggcccagagttagcagttatgaagtgagtgctgaaaagcaggcaatgttagatactgagtttgttctctcatgttggatgtgtgctaagtcgcgtcagtcgtgtccaactctttgcaaccccatggactgtagcccaccaggctcctctgtccatgggattttccaggcaagaatactggagtcggttgccatttcctattccagcggtcttcccaacccagggatagaaaccgcatttcttatgtctcctgcattggcatgcgggttctttaccactagtgccacctgggaaaccctctctcgtgttggtctcacaataattaagcaggatgggtcttatccccattgtacagatgaggaaactgaggcccagcaagccatttgtctaaggtcagtcggcctaggg

SEQ ID NO: 42610 - DNA, 3267 bp, Bovine  19866880810824
ttccgatgttagcactgggcttctctaggagcgaaatagccccaccctatctctctgttgtcactgtggtgcttgctgagaaaggtgccaggggtggggaggtggactctgtgtgtgtgtgtgatgggcagagtgacaggtaccaggcaggcagggagacaaggtggaggggcccgggcaggctgatggatgagcagctgaggcagatggatccaggtcagtgggcagacaagatgatgggcagtgatgggctggacagatccaggggaccacagacataggactgcggcctcacagtggagcccacaggagctaggagctgaaatcctgtattcagggacaacaaggagttcctgggagatgcagccagggtccgagaacaagaggctcctaggaattcttctagcatccaagcggctgctcaggatttagcacatcagagttgaaaggatctttaggtgtggatgggtccaggcctcctctacagatggggaactgagacccaggggaggagggaacgtgctgagggtcctacagggtcttggcagcagactggttcctctgcctctaatttagtccttttttgttttttgtttccattctttgaaatgagcctctcacctgggcttgaaaggaaaagggccaggttggcagagggggaggttgtgacccagaaggggaggggaactgggaggtcagagtgagcctggccgtgaatctgtccttctatccccctcccacgattctctttccgccaccctcctgcgtacttctgaaagcacagacgcaggagccagacggaaagttcctgccgtggctctgtcactagctcgatgacctctgagtcagctcacctgtgcctcagtttcccacctgtacctacctcagagatttgttgaaaggattacacgagtgaatagacgtgcagccctgggacgtccctggtggtcccggtggttaagagtctgccttgcaatgcagagtgcgcaggttcgatccctggtcagggaactaaaattgcacatcagagagaggggggcaactaagcctgcaccccgcagctaccaagctcaggcactcgggagcctgtgctccgcgacgagagaggcccatgcaccacgactggagaggggggaaaaaaactaaagaagcccttcaggagtgcctggcccttaggaagtgctccatgatgttaactgctcatatgccactatctcgcctttaattttcctttgccttctgtatggggtgggtgcacactcacaggcgccccccaagcacgctgtatcctccttgacagcaaagactgtctttctcatcctgtctctcatcttcgcttctcaccaccagggccctcttagccagttgggcacgtacacagtaggtgctgactaaaggtgtctttcaaaagctgattatttatttttggttgcactggatctccgctgctgcccttgggctttctctggttgcagtgcacgggtttctcagtgcggtggcttcgcttctcttctcctggttgcagagctccacggctgcagtagtcaggcctagttgtccggtggcatgtgggatcctcccagacaaggggtctaaccggtgtcccctgcactggcagacagatgcttcactactgggccaccagggcagtcctcagtgaatgcgtcttgacgtggctcgtggactatgtgctgttgaagggattcgggaggcagccttggagctgtgtgttgaggtccaagaaggcagtgtcacaggatggggcagggaggtggtggtgggacagcatgaaggaagcggggaagcttgggggaatgtttgggtgacagctcctcttctgctgtgaccagagcaccaagccaataaagggaggcgtgagagaggctgagaaagggggcgggagtttagcagaattcagaagggtgtgcctctaggcgggggaacgcaggccatagggagctgttgactagagctttaaggatgatcaggctgatggcgttgttttaggatcgacttgaatgaaagagaaaggaagcggtgggcagctggaattgtcccagtgacaagggggtttggggcttgaatgatgctgaggggaacaggggccagggggccaaggtaccagggaaacaggatcaacagggctgttggttatggaagatgagggagacggaagaatgaaaatgtcgaggtctcaggcctgggtgtctgggagaactggggtgccgtcaaccacgttaggggactatacttgggagatatggggaaaggggagatgccagctaagattattcatccatccagcctcccatctaaaccgtccatccatccaccatcccatccatcttcctcctgcccacctgcctccatttaaacattcaactgccaggtccaccccttccttctccttcctccaccctccatccattcgcccgtcatccatcacacaggtacctccactgccattctttccatcttctgctgcccatttgtccacactcgtccatctataatcctccaacttatccattcatccgagctacatttcttgtgagcctacaatgtgccaggctctggtaaaatattttcttaacttgataattaagatagtgattagaaaagccaatgaaagggaccagaattcttttacctgaaaaaaagaaatttgagaggcctccatctgttgctaaagttataggggataccctgaaagaaggtgtgttctattcccaggatagaatagaggacattggctgcacttgcagctggagggattgcggttagcttgcagggaggactaccttagtgatcattacaggtatctgaagtccctccctgatcatgtgtttgggctaaaaggggaaatgaaatctataggggtgacttagagggcgtgagcgtagactgggccattgatggagccgtgggtggagaaggactcaggacttgccttgaagaacggtgtgggagcggaagagaggaggaccaaggtgaagggaacttgcggggaggcagacaaacctgtggctgggatgagccaggacgcagtagggccctttagttctgaaaacagcccctgactcagcctccttcccttcacaagccaacttttctctttgaccccccagctcttacacagccctgtccccttcccaaagcccctgctccccatttagtccttgatcccatccctgagcccctgttccctcttcaagcctttgttcccccaagacccccaatctccacacaaaacccccactctcagag

SEQ ID NO: 42611 - DNA, 2636 bp, Bovine  19866880845890
ctctctctctctgtttccttcctctgctcttgcatcccctctctctaagcagaacgagtgtccccagaaggatggcacagtctgggacggcttccctggcagggcagaggaggtcggagctgcacctggagatgcaggggagtggatgggcgggacggacatctgcagaaccgatgagcaagccctgctcgcagaaaagtctctgaaagtcactgccttttggtggctggaatatttgggtctttcctatgcgacagctgcattgagccagggcttggatgggggagactggcctggggtggtccagccctttctgaggttgtgcccagactgggatccaggcaacaaggccatctgagtaaacgaacagcagccagagatgtgcctacttctcccctaaagaggagccagcaggagcccctgctgaagtgacctgggcagtcatggtgaacgtacaggcagagtggtgggcaaaagatattttgaaggagggttaaaaatgacatggtcccaactagcctaaaaagagaaataagaagtaggaagactgtctggtcctctgatgagctgattaatctccttaaataacttgcagtccaacttcccaaaaggcaaaagaaagttaggttaatctactctaaatgatccgtgagcttctcaggggtggtaatcaatacacacacattcactcctctctctctttctctcctcataagtaattctcagtaattgcaagaaagaggtgtttggggtggaaaatgacattctaaccacagagagaattcccagcaaggggatcaataggccaccagttgggaggcgggttttgcagctcagtaaaggccaggagagggccaccatcacatcacactgggagccgcagggtcatcccgaggtctttctgcctgcaggagctttaattgattggggaaaaggagactgaacgcggagggtgagtgagatctgcaggagaaggaaagatcggctcctcccagagcccgtcactgatgtctttgagagcatgactactgctcagcgccagtgcccaccatggatgccaaaggagcaccatcagtgtccgttaccaatatcctcgggagcacgtcatcagtgcttatcaccaacaccctgcagacaccagcagggcttgcctgcgatgacttggtggcattgcttatcaccaacaccctgcagacgccagcagggctcacctgcgatgacttggtggcgttatcaacgttcgccagcagcactcttgcagatccatcacctgtattctcaggagtacccatccgtatccatccgcgaagcccttgcttggtaccctcgttgatgccctcgagcattaggaatgtgtcgtttttgttcatcactctgtctccactgggcttcccaggtggtgctcgttcgtggcaaagaatccgcctgccagtgcaggaggcataagagatatgggtttgatccctaggtggagaagctcccctggaggagggcatggcaacccactccagtattcttgcctggagaatcccatggacagaggagcctggcgggctgctgtccacagggtcgcaaagagtcggacagggctgaagcgactcagcaggcatgcatgcacgtatctccactaaccacagaacctggcacatcataggaactcaatatcatcatctgaatagatgaataagtgagtgactattcttaggaaggagagcaatgtctttttcctcttcacctccttactgccctatccttaggaccttacccactgcctagccaaggagagagctctgtaactacctgttggatagatgactcagggggttgatgaatggatagatggatgaatgggtgggtgggtagatagtagatgggtggatggatgatgggtgcatggatggaataaagaaaggatgaccctgggagcacagtcattgccatttgtaattccagacatacagccaccaagatcagagttcagcataaagtcatcccaagagagaaggaattactgcctgctgccccacccctggtgggtctgggccctccctgatggcttcacctgattccctccttggctgtggggatgcagatggcaaaggcaggaagaatctctcacctcctgcccctcgtctcccctcttcctctctccaacctgaatacaattttctagactgtccccaggtcctggagggagagctcattacctgcaatctgcccataaaaacatcaatagctgcccgccggctggggagcaaatgaccatctactcagcctgacggcagggtgggcaggaaggctcaggagtgtgcaggctgcggtaggctcagctcagcctctctgaggacaccagctttgtgtagactcagccacgacctctggcaaggcagaccgccccgcacctcccagagggccatgctgggataggaaacgctcagtccacctaccatttattccacacacattcatcccaagccctcaacgggctgctcattattattacgaataacaacatcgacaaccaaggtggggacagcctaggtcctgggcatctcctggcccacctcctgccttgcagccccacccactgtccagcagggctggccaaagctcatctgctgcacaaaccactgcca

SEQ ID NO: 42612 - DNA, 2298 bp, Bovine  19866880886414
tctctctggaaagtagacacccttcccctgcccctcacccaacccagggtctctgtgcccatcactgccagcaggaccatctgcctctggaggcctctcctgagcccccagcgccccaccctgcaggacagactggtgcagggggcacacctaggcgacattccaaactccctgtcatttcccttctaaggacatcggctgggtcactgctcaggcctgagggagggcgtcccacggctcagatgagggaagtgacattctcatagtcacacaattgggatgagacacctgcagccctcagagggcataacacccttcctggatcacaacctaggaagctgggccactgtcaagtctgccaagagctggggacccagagtagatcaagagcaggaaatgcaggcacctgccaggtaaggagcagggtgagccaggtggaacgagtggtgagctgccacgtggagacccttcgaaaagcgtagcttctactctgctccctgaacagagggttgaagccccttgaaaatgaggcccaacattaccagagtggctagtttttccaaagatgccactcattcccatttttatgtgacagtcccccgatttaaaagctagcattttttaaaaaatgaaagaccatgtgcaggccaatcttggtaggtctgtgggcccgcatgagggccactggatcacaggctctgcaggaaaccccagtggaccggtgcagggagctgtctctctgtttctctgctgcaggggccctgggctggaggccgtagacctgccctgagatgccagctgtgccacttaatgtgctgtgtgaccttgggaaagactctgtccctctctgaactctagtatattctgctatgaagagaatactggttcctacttcttagggttgagaattcaatgtgataatgtatgtacagggtccagtaaacaacatataaactttccaggcctgttcctttcaacctgggctaacagcttggcctgagtgagccccaggcttctcatatcagattgtacaggcctctgcggtgcccactggaccagagccctggcctgggcctcatcacaaaggaaacttcagatccttgtggtggctggaagggagagtcttgggaagacatcatcatttgcttagttctcacactggcatcaaagagctgattggttaaaaaccatgttggtcatctctccagggcctctagtggatgcataaaatctgggaggatgggagcaaaggtagggaaggggcagaagatatttttggctttttttcagcaaacataggcagtcaattctgcctatataagtgctagtctgagttcggagaaggcaatggcaccccactccagtactcttgcctgaaaaatcccacggacagaggagcctggtaggctgcagtccacggggtcgcaaagagtcagacacaactgagcgacttccctttcacttttcactttcatgcattggagaaggaaatggcaacccactctagtgttcttgcctggagaatcacagggacgggggaatctggtgggcttctgtctatggggtcgcacagagtcagacacgactgaagcaatttagcagcagcagcagcagcagtctgagttcaggcccacaatatccggaaggagtctctgaatcatcaaaaatagaatgaactttgttgaggggaatttctgggtagaggattcagagccataagacagaacagaaagaggaagtggtaagtcttcaggtctagaatcataatcagaagtccgtagaatatcagagtcattgagttttacagcttgcgggtatagtatgttgccaccatccatcccgttggcttgagaaggtagagaggtggctagattcttatcaagtcggccatgctagccaagagaaatgatgtgagtcacacacataattaaaagatttctaatagtcatacaaaactgaaattaataaaatattttatccaacctattacatccaaagtattatcctttcaacatgcagtcaatataaaaatgtattgaggacctggatgagatccaccaaaggatccccttgcgttctggcttctgttggtgtgatagtaaattttatgtgtcaatttggttgggccacagtatccagatatttggttaaatattattccaggtctttctgtgaaagtgtttccagatgagattctacatttaaaccaatggagtttgaatagagcagattgctctaccttgtgtggtgggcctcatctaatcagttgaaggcctgcatagaacaaaggactgacat

SEQ ID NO: 42613 - DNA, 1052 bp, Bovine  19866880902101
aaaccttattaaacatgcagcagttttcactggcgagaagacccatcagtgtaatgagtgtggaaaagctttcagacacagctcaaagctcattaggcatcagagaatccacactggagagagaccctatgaatgtaatgagtgtggaaaaggctttggggggagctcagatcttattagacaccagaggattcacactggagagagaccctttgaatgcaaagaatgtgggagagcattcagcctgaactcacatcttaacctgcatcagagaattcataccagggagaaaccctatgaatgtagtgaatgtgggaaaaccttcagagtgagctcacaccttattcgacacttgagaacccacactggagagaaaccctatgaatgcagtgagtgtggaagagccttcagtcagagctcacaccttagtcaacatcagagaattcacaagagggaaaacctattcatgtaaagaacttaaattcataaggaaatagaacaggaaaaatattgagtaaataataaatatcagttgagatgaatgactgaaagaccagtatctctttattttctctctcattttcagcttgctgttctgcatataatctttactgccatgtgtctgcttgctaaagtcaaaccagaagagcaaaatttgggggaggctaataaataagtcaggcttccctggtggctcagtaataaagaacctttctgccagtgcaggagacacaggttcaatctctgggtcaggaagatcccctggagaaggaaatggcaacccattccagtattcttacctgggaaatcccatggatagcggagtgtggtgggcctagtgtacatggggtcgcaaaagggtcaaatacaacttagagacaaaacaataacaaataaattagtttgtctatggcaatgaaaatagaaaaagaggactcttgggaaataaccagaattacagtgtggggggaaagaagattcaggtaaagagagcctgatcattattattaactctagttaatgattctccatgagaaagaggtaggccaagc

SEQ ID NO: 42614 - DNA, 1065 bp, Bovine  19866880917663
caatactttggccacctgatgcaaagagctgtctcattggaaaagaccctgatgctgggaaagactaaaggcagaaggagaaggggatgacagaggatgagattgttggatggcatcactgatgtgatggatatgagtttgagtaggctccaggagttggtgatggacagggaagcctgatgtgcagcagcccatgggattacaaagcgtcagacacgactgagcgactgaactgactgactgcacaccctagagcctgtgctctgcaaccagagaagccgtcgcagtgagaagcctgcgcaccgcaactggagagcagcccccactccccgcacctagagaaagcctgcacacggcagcaaagacccagcacagccaaataagtaactaaaattatttttttaaaaaaaccacactggtgcattctcatcccctcatcaccatgtcccccttcccttcattttttgctcgttgggattcatcaatcatggggtcaggacagacacttgaaaatcatcctgctattacattatttcagggaaggctgggggcagaggaagtttattaaatttggaaggtttgcttctctggggaaactctgaaaaagaagggggggaaaaaagaaccctcgactgatgatggaaagctgagctcagagcaggggattacggggatcagcctagatcatctcgctgctttcattaaccccagagtttattttttccctctccgtcttgacaagttcacgggagactgacagccacagccgccggctgccaacccagcctctcttagccgagctgctggtgaagcccctagggaacatggttggggggagacccaggtccttgtcagctctaccagtgtaagtggttgaacagcatcctcccaaattcatgtccacccgcaacttcagaatgtgaccctatttggaataggctctttgcagatttgtaattgttaagggtcttcgaggtgagctcatcccagagctggtgggggggaaccctaaatccaatgactggtgtccttaccagaaggaagagatggacccagagacccagg

SEQ ID NO: 42615 - DNA, 1605 bp, Bovine  19866880938123
acttacctgttcagcatctccacttggaagtctaaaatgcatttcaaactcatcatgttcaatgagagctcctgacttctatctacccatcacccccctccacacacaaataataataaaagaaaataaatgtaaagctgctcctcttccagcgtttccatttcagtaactgacaactcccatgatcccagccacttctgccaaaagccttcgagtccttcttgacatcactctatctcacaccctacagccaatccatcagcaaatcccgccagctctaccttaaaatagatccagaatctgactattctcatcaccttcactgtttacagcctggtccaagtcaccagcatttctcacctgggttattgcaacagcctcctctctggtctccctgtttctgccagtaaccccctacagactgctctcggttttggtgttaaaacataaatcagatcataacactccttctctccaaattcctttctctgggtaaaatggttcataagacccaacaggatacagccgctggtttcttctgaacgcctcctcccatcaccgtccctcccctacattccagccacacagttctctgaatggaacgggcacattcccacctcagggcctttgcattagctggtcctcttgccggaacacctttgcccctattatctgcagtggttactctctcccttccttcagatgtctgtttaagtgtgagactttccctgacaacctgagagggaacagcccctccactctcaggagcccgaatcctctcgccccgtttgctccttgccccagcccccacagaactcagcactgtctgatacagcgctgatttatcatctgcctccttgccctttaatggaagctcgctaggagctttgtcttttgtgctcaaggctgtatcgccagcacttagaaaggcacttgccatataataggtgctcggtggccatttctccaatgactctggaaatcactgttttgaactagctatctgcttgtttgtctatttctttctctcccccagtagacagtaggcagcaatggattcaattctccactgttttgctagtgtccaatacaaagcctggagagtggatattcattaaatgtttgaataaacagatgaataaataatagaatttccagatgggttgccaggagtggtgcgagggaggggttatgagacagttgcctcctgaagcctctaactctggtagcccttcctgcctctccttggagacctgaggctaccttggaggggaggaggctagagtttgacctaaaaatctccagaggccaaaagggacagagattagtattaggagctggtgcttgaaggatctggaaatgtagatttcctattggagctaacctgggattgactgactgatttctctttcttttgaaatcaaagtatagctgatttacaatgttgtgttagtttctggtgtacagcaaagtgattcagttgtatatgtgtgtgtgtgggggtgtgcacacgcgtgtgcacgcgtgcacttgagtgctaagtcacttcagtagtgtctgactctttgggactctatgtactatagctcaccaggcttcctctgt

SEQ ID NO: 42616 - DNA, 1839 bp, Bovine  19866880950105
taggtggggtcagagagagctgggggaagagaagggacttgggatgaacagaaagtaaagtggaaggaaacgcaggtgttggttctgaggcttgaggggttaggcgggtactcaggtccccctgaaaaatcccccaggctgctctgcttcagtctagacctcacctcccctttcaggctattactcctccttccctccctgcattccctgcccagtttttcctcctctatttcattctttatccgcattaaattgaccatgtcaccctctcatccataggcttggatgattcccctttgcccatggaagtgattctccaagtgcgccaggagaacccagggagggggggataaccttaggttatctggagtcccttacacgacccttacaggatctggggtcccttaggaaatttccagttctctactaattccaaggaggacatctccatttaatggtattttgtcctctacttctttatcaaaaggaggtgaggctcagattcagagctatcagcaagaacttaatatcactgatgagttccagccatttccttcttctcaaagcaccaatcctcttgccccccccagctacacgctttcttctttgtatcctcttccctggctgctcctccccagtctctgggattgtcctctgggtctgaccctctaaagctggtgtgccatcgggccccctcttgtctggactctgtccagtcccatggatttcagcactaccagtgagtccccagcacatctctccagactcatagaggaatgtccagctgccttcgtgacatcaccacttgatgtccatctcaacctgaaagtccaaaatggagcttgagttaccccacacctctgccttccttccctcttgctcaccctgttgcgggagatgcttaaccacataggggtttccttggttcctctctctcacccgccccatccaatccatcagctgtacacgatcactttacccgcaaaacatatcctgcagctacagacacttccctctagtcacttcgtgctctggcccaagccatcctcacccctcacctgcatgttacagtcccctctgccctggtcctgttgctcccaccctgcacccctcagtccaccacgcagcagcggaaaggcttttaaaaatggtgatcagatcatctccctccgctgcttaaaagtttcaaagggaattcccttgtgcttacaaaaattcaagccctttgcgctggtttacaaggacccgctttggcctgtttctccctcttcatccccacatgactcacccccttgtccactctgttctggccccaggaagctcagtaccaccttattctgtctgggacactctcatgcttgatctttgcatggtcagtatcttctcttccttttgctgtctgcatgagggtcacctccacagagaggacttccctggccatccaataaccaagtcacttccagacatgaccaaatgggcctcttcaggcacagcagagcatgacacttgtacttgtttcctttctttgctttttttcttttccccatatagctataaatgtcttccctggtggtgcagtggtaaagaatccacctggcaacgcaggagacgcaagagacgtgggttcaatctctaggtcgggaagatcccctggagaaggaaatggcaacccacttcagtattcttgcctggggaatctcatggacagaggagcttggtgggctacagcccatggggttggaaagagtcggacacgactgagcaactcatgcatgcatgcacgcacgtgtataattataaccaagaacttagttagtaaaatgtccaggaggcatcatt

SEQ ID NO: 42617 - DNA, 945 bp, Bovine  19866880959304
tggcccccagtctccaggcgtgatgaacccaagttgattgcagttgctcccccgccctctgctttcagcgcgcggcgctagtcttggtggtcctgctcatcgccgggggcctcttcatgttcacctacaagtcgacgcagttcaacatcgagggcttcgccttggtgctgggtgcctctttcatcggcggcattcgctggaccctcacccagatgctcctgcagaaggcggaacttggtgagcgagagcccggggcactgggcaggtggaggcaggcagggtgcaggcgggcgggccgggtgggacggctcacacgagtcaactttgtgcaggactccagaatcccatcgacaccatgttccacctgcagccactcatgttcctggggctcttccctctctttgctgtgtttgaaggtatgtggggtcatccaccgaggggggacctcagcacagagctctgatctctgctcggagcccagcgctatggtagctgcagaggttccagagattagtgatggtggtcccgaccctggcagtgcctggtttgggggctggacagacacttaaaccaaggggctagaatctcgcaggataaatgctactgagaaatcccatgtaaaacacaccaggcggtaatgatggtaaatgcacacagccctcaaggtataccagggctgttctgattgttccaaacatatagactcctttaatactcccccaaaaccccacgtgccagtactaggactgcctcatcttgcagataaactgcggcagagagaagtcaagatagccttgctcaaggtcccataggtcatatacaagccagcccctggctctggagtccctctcttaaccgcgatgccccctcttacttggagtagagtcatgaatgactccaggttggggccagaaaggcaagctgaggcttcccaaacagtgcatt

SEQ ID NO: 42618 - DNA, 927 bp, Bovine  19866880987011
cagggacaagcactgagacagctcccgctttctattcttagcatcggtgggggctggcgggactcgaggaaagctggggcctcaccagctcctccagcttgaagatcagagagaagatgaggatgaagaggacggctgaggacttggtcatcgtgtacctgcaagggaaacgtccccatgatgcactgctggagccagcgacgcggacttactgccaggaaaggagcccactcggtgcccccagggggcgggaaggaggccaggggagacccctgacctccctgtgggccgcaggccccgcgggacacaaaagaccaaagaagggaagccgagtcgtctgggttgacacgcgacctttaatcggaaggaatctctgactcagaggcctctgattatcaccagaaaataaaaaaaaactgagcttcctgagtcctgtgatttacctgctctttagcggagatcaggattaaggagggaagagagaaatggagaaagagggggcagccacacatggctcgctgaagcccagaatctgagataagcaatagctgctccctctgccctccatgcccccttccctgctgcctggcagggacctggcaggaaggtgcagcccccccgccccagcctgctggacagacggccaaagggctcagtactcacagcgagacggtgatgtagaggaagctccagttggacaagcccacatccagcgctgtggccagtgctgtggagacacagggcacccgtgggacaccccgcccgggtaggagccctcctggagctttcttttccacccagcaactgaagggttaactcctggccccacgcccctaaagcggagggggctgctccagcattagggcaacagtccactgtctaaccgcttcccacttgtggatattaggaatgccacgcccccacccc

SEQ ID NO: 42619 - DNA, 655 bp, Bovine  19866881003504
ttggactgtcggggattccctcttataggtttttctttaaaaatataaataaaaaggaaggaggagtcctttgtccgcatgatattagggataacaggttgaacaagcacttggttcagcagctctctactgctgcataatttctcagagtttttaaaacacaaatgtgttttgtgacagagaatggcttgtttctaaagctaagttgcagaacttaccacacacctcttcacattttctccagcgagctccagtgggggaatgcccttctcacagaagggggctaggatcagggctgagactgggtctggtcaatgggagagggtgggtgggcttgggcacgtgatggtctgactcctgcgtctttctcccctaggaaaaagaggccagacccggtgagtctggggctcaggcctgggaagggcgcctgcttgcgggctgcctgcggggtggaggggcgggggcgggaggctcaggcactggctcaccctccctgcttgccttctatgtccacccgtccccttctgccccttcccagaccccaaagctgagctccttcccctgccccgtgtgtggccgtgtctaccccatgcaaaagagactcactcagcacatgaagacacacagcaccgagaagccccacatgtgcgacaag

SEQ ID NO: 42620 - DNA, 1204 bp, Bovine  19866881084065
caggaaagcgtagaggatgtggccctgagcgttctccacccggtgcagcaagagattctctgggaagcggacaaacagatcgctcatcttgctgctctggaaactgagccggtccaggtcttggctgctgcccacactgaaggaggccatggaacccacatctaccttaagaaagttcttcatcactttggctatcttggccaggtcagaaggagcgatgtcctcctgctctggcttggcgggtatctggacctcgtctaagcaaaacaatggttcaactggggactttgcagctgtgccaaggtctttgttgaccgcgggctgtgcagacaggagtttcttctgagatttgccggtggcgtctcctctaggaccagtggttttggggtcaatgtgtatatgctgtgtgttgagttcactgatgaacagtctatccagtttctcattgtaccgcaggagcaagtatgctgggcacatgtctgcttctgctgctctcttcctgtttgactgggtccgaatacagacaaatttcacctgcacatatctagggaaggcagaagcaacagtgaaacaggtgctgaccacccagttttctcttacaagtctaggccctgtagggactcacagtgcctgatacatttcctggagaccacagtgtggtataggatatgggaaagaaagattcacgttcacgctccagtcccaaagtagtcaggtctttcttcaagaccccatccaattaaaacacccttcatttgcatctacagaagttctaagctccaactccttttacttactctcattttcccatctgcagttgtcaatctgaggcaaagatatacggggaaatagatgaacagcaacagcagaactagttacctgctgtctaaagtgtctttcattcctgccctcagggagccattgccttctctgtttcctcctccaggcagcaaaaataaaagaggtctcagggttagggtagatctgggcttcctctctaacaggaaagatctgggttcatctttgacttaaagaaaaatgtctacatcctgagagagtgagaaccctgaggctagatgatccccgggattctgctagctttgccgttctaggctgaacgtgcccactcaaaggagactggtaattaaactgaatatctgttctctccctcctttctatactttgaggcccaaattaggtccta

SEQ ID NO: 42621 - DNA, 1527 bp, Bovine  19866881126587
cctggtggctagacggtaaagaatcgcctgcaatgcgggagatctgggttcgatacctgggttgtaaagatccccgggttgtaaagataccctggcggagggcatggcaacccacttcagtgtccttgcctggagaatccccatggactgaggagcctgtcgggctacaggttgcaaagagtcagaacgactaagcacagccccaaatccttaaaacagtgcctgtccctaccctgtcacactgtaagtggtaactattatttttatctactaggtgtgctagtcgtttcgcaaatctcattgactatctcattcccctgatgtcctcctgccccaacacacacacacacacacacacacacacacacacacacacacacacacacacacacacacacgcgcccacccacccacagagctgtagatgttggtagatgatttcctgggccagcagagggcgctagtctcacacaagcggctggagtcggtccctggccggggctgaccgctgactgctcaccagggtcttcacctcccaccccaggctccgcttccactcacacaaatacaagataagccccagttcctggaagagcgatcttcgcaaatgaagttatcgtgagttatgtgaacccctaacctgcaagagctgaggctagactggctgtctgcctcctgccctttgcttcccacttaaaaaccaagtcaccatgaattttcttaatgatgctttattcgcctgttttagtcatttttctcctctttctgaggcagagagatgtcttaagggaaacggtacaatattgcagaagagatccaggccttgaaattcgacctgtatttgaagactggcttcaccactccaccaattaaccccagacaaatgtctgaacctctcgtacctcagtttcgtcatttgtctaataaaggtaatgagtctgcacctcatgggaacgtgaggatcaagtgagataaatcatgtaaagaccttggcacaaaatctcttttctatccaagcctaacaagtgtttgacaaagagtgaaatgcccaggtgtactgttttcagtgatgagtataaagagaaggtcatgtactttgatgtcagactgacttgggtaccaaacaagctgcatggcaagtttctttgcatcgctaaacctcagtcttccttatctgtaaaatgggcaccctagtgcttcattggcgaaggcaatggcaacccactccagtactcttgcctgaaaagtcacatggacggaggagcctggtaggctgcagtccatgggggtcactgagagtcggacatgactgaacgacttcactttcacttttcactttcatgcattgggagaaggaaatggcaacccactccagtgttcttgcctggagaatcccagggaccggggagcctggtgggccgccatctatggggttgcacagagtcggacacaactgaagagacttagcagcagcatcagtgcttcatagaaagttagccattttagatgagattgtatgcataacag

SEQ ID NO: 42622 - DNA, 544 bp, Bovine  19866881132179
ggcacctgggctctgttggcctcggtgccggtacctggctgtgcgcggaggaccttgaggcgtggggccagtgcgcccctggggctggggaggaagcagcacctgaaggtgctgtccactttcctcagcttggccgtctctcggtaccaggctgttgccccacgagtctgccctcctgggccactgtacttacagaggcggggcagggtgcacctctggccgggcagctcccacctcagtcccaccctcgtgggctctaacaggctcctcttcctgcttcctaaggccttgcctggttccagctgtagcagcacatggacaaagggagtgggccgtggctagactctggtccctttattgagcttgagagaccagtgggtacataccaacaaaaataaatttctctcccgaagcctgcctgcaggctggggcccccagcgtgtcctggctggtgcccatggctgtccgcaaccccagcagcacaggtctggctccccaggagtgacaggatgctggctgctcagtatctggagatcctaggtgg

SEQ ID NO: 42623 - DNA, 1681 bp, Bovine  19866881283214
ttgctcaaactcatgtccattgagtcggtgatgccatccagccatttcatcttcttcaccccttctcctcctgccttcaatctttcccagcatcaaggatcttttccaaggattcagttctttgcatcaggtggccaaagtattggagcttcagcatcagtccttccaatgaatattcaggactgatctcctttagcatggactggttggacctccttgcagtccaagggactctcaagagtcttctccaacaccacagttcgaaagcatcaattcttcggcacttagctttctttgtagtcaaactctcacatccatacatgactactggaaaaattctatcctctgaattcaatcctcaaactcctctatttcacagatgagaaaactgaaacagagagggcaagccagttgcccaaggtcacacagtgaggattccaacccaggggctgtgattcaagaccatattacagtgatggaagaaaatggaacccaacctcctatccctcaaggaagcccttcatcagtgggccactccttgcatacctccagtgatgagtgtctcatcacctaccaagtcagtctgctttgatgatcaagaaagtgatagtcactcagtcatgtccaactctcagtgaccccatggagttagtccatggaattctccaggcaagaatactggagtgagtagtctttcccttctccaggggatcttcccaacccagggatagaacccagctctcccacattgcaggtaggttctttaccagctgagccacaagggaagcccttgctggtcaggttgattggtaaatccctcttttcctgtccctgcaatctgtactcctataacttctccccactggtgacgtagcggagggctgggacccgtcgtggatggtggcataaaagtaaaaagaggactccgaggtcgagtcaacctggattaggagctatgcatcccctcactgatatgaagagccgactcattagaaaagaccctgatgctgggaaagattgagggcaggaggagacagggatgacagaggatgagatggttggatggcatcaccaactcaatggacatgcgtttgagcaggctctgggagatggtgatgggcaggggaagcctgagtccctggggtcgcagagagtcggacatgactgagggactgaacagcaacatcagcctctatgtcctcatgcaggagcccgaatgatggatgaacctgcattgaggggactgagtggcagatgccgcttccatcaccaggcaccctgagatccctgggtatcggggagctgctagggtcatggtgacatctgttgtttatagcccatccctgccatccctggtcatcggtccaggccctgctgtggctcatccctggcccatgcccagactcccctgccccaggctgcccggctgcctgcagctcaggtgaacccagctgcgcctgctccctaatcaggataccaggccccctgccacctccccccacggggccccgagaggctcctagctaattcctcttcctcaatcagccagcgctctcgtggcctctccactgattggccctttgttccctgccaggccagggccacctccagggcccagctctcccaggaccaccctctgggtgccctgccccctcacccccgctctattccttaacctgtg

SEQ ID NO: 42624 - DNA, 1077 bp, Bovine  19866881284490
taagctggggctccagggggcttcacccttgcattaagggtgaaccaaaggtaatgtgaatttgagtaaactccaggagttggtgatggacagagaggctgggcgtgctgcagtccatggggtctcaaatagtcggacacaactaagggactgaactgaactgaactgaaaggtaacgcagccttgaatcatgaattggcagcctcatccacactaccagggtattccagggaacctcaaaccctgaattttgtttaaagcaatcccagaatggtagcactgcagccaaatgcaaatcctttttagaagcaaatgccttcatctgaggcataaaattcctcttaaaaaattcttccaaaaaaaaaatttccaagtacaatggccaacacatagtcaaagataaccagacatgccagaaagcaatgctagtaagctaagtaagcactagaggtacagagtgagcaaacaaataccatccccctgcctcacagggcttatagtccagcaaggaagacagacaccaacactcttatcaaggccactaacaacctctgcaatgccgactggactcacttctcctcctcaatttactttgcctctcagcagctttcagcatgttgacctctagttactgttcttggtttccatgacaccagtctgttgaatggcctccagccttactgggagcttctcagtctttctccttccttttcctcctctattttatctctaatgttggtgggcctcagggaccatttctgggtctgctctctatctcaccccaggtgattgcattcatttcctcagcattaaatatcacctacatgctgataaacctcagatttatatcccttctcctcggagtccagactgttccatccaactgtctgcgtacatatctcctctcacatatcttgtgaatgtctcaaaaataacatacctaaataggaactcttgcttcctaccaccaaccttccttcatttactccatcatggtgtcacaccatccagttttaggccaagaatctaagaatcatctagaatccctggtttgaattagggtggtgatggattatg

SEQ ID NO: 42625 - DNA, 1087 bp, Bovine  19866881290318
cagaaggtgcgcctgctcgctgaaactagagaaagccggcgcaagcgacggaagacccatcacagccaaaaataaagacacaaagacatctttaaaaaaaaaaaatagacttctttaccagtactctggaaagaggtagaagggcctcagtcagggagttgggccagaaacaaaacgactcttggtccttctgttcagagtgtgcaaaatttgcatggtgttctccttcgtgagggagtatcaggactgggtgatgaaggtttaggacagctttcagaggagtcagctgagctcagaggatgggcaggaggcagactccacaatacaggccctatttcgaggtgtctgtaagaggacagtctaggcagaggctagacccagctaaggaaatttaatctccagtcctctccaaagacactgtgcttgctttattctctacttctctccaggttgtcactcttggcctctaaagatgtgctgattgccccataaatcgacaatcacagtttagaatgataatactggttaataataatatagttcttatggactgtctgtattcctccaaaatttctatgttgaaattcaaactccccaatattatgatggtattagaaggtggggcccttgggagatgcgtaggtcataagcgaggagccctctaataaaagagaccccagggagcccctcaccctctctgccatgtatgaacagggaggaaatggccaactctacaccaggaagcaagtcctcaccagacactgaatctgctggtgctatgatcttggtcttccagcctccatcactgtgagaaataaatttgttgtttattagccccctgggtctatggtattgttacagcagtctgaaaagatgaagacaatagtatgacctgaatctgcctcttccttttaaagatgaataacgttaggcaaggtcaagattagaagtcaagttgcccactctcagtgccctgtggtcattccaaatagtcaaaacaagttgcctatttaaagtttcttcctagaaatgtcaaccaagggaatgccatcaatcaaaaagacacacatgcctagagcctcttccc

SEQ ID NO: 42626 - DNA, 926 bp, Bovine  19866881292615
cccccgcgcgcgtggccatgagcacgtgcacgtgggagcgcgcgcacacatgtacacgcaccttgtggtgccgcagcaggaagggcagcagcatgagcatgccgccgtcgtgcacaatccaccagacgtcgaatgctgccttcagagaagcgctcagggttcccgggaaacatggagacattcttggtgaccagcagggccaggtggccagccgtggtttcccggaccagctctgggggaggccaaggagatggcagacagtaaaacagtgaccctggtcccctccttggcacccagcacccctccccatcccgcctcccgcctcagccttggactgaggagtcagaaaagccccatctgcctgggcctcatttgaaattggggggggggggtggaaacctctctgggcctcagtttccccactggtcaagtggtaataaggatacctgccctttctgattaagaaggcgaccctgcagcgctcacttaatcctcccaactaccttctaactgggatctactgataaagcagcctcagggtttaccagctgccgtgaccttcatctctccatgcatcagtttcacgccactaaaatagagacagccatgcctagccctcacaggcctcctgagagaattcaagacctagagaaagccaccacttgtctggcgcacagaacgcagtgcgtaagtgttagttactgtatgacttattatctgctactaccaaggaatctgatgctcagagagggtgaggcacttgtgaacaatcacacagcaaggaagggccagaggttagatttagacccgggcctcagtggtgacttcaaaactgtaggtcttcccactggcctgcactgtcttccctgcaggggttgtgagcccggcaagagccaagtctgtctccttcacacctgagtccctgg

SEQ ID NO: 42627 - DNA, 1103 bp, Bovine  19866881331280
agggacatatcccttaatgtctctgctcgggttgcagtaaaaattaactaccctgaatatgtgcatcatcaatgcagctccaagacagagaagggatggaaatgcgacgtgtcacacacttctggggtatccaggcaggctctttaatgactccttggagggccctccactctaggaggacacctccctccagagcctgctggtctcctctgctttggcctgggttgggacccgatgccaggcacaggatgggtgccccaagaggccttgagtgagcagagctgagggtggggcttcacccttgactcccctggttccagtcccccctcaacccacttatgcatcttactagtacatcttgccggaccactcagggtcacctcagttctcaccccagcccagatggcagtgttctactgtctgagtgaaggtgatgggtgagaacttctcccccaagcttgctagagtaaaagctgatgtacagagggcaaaggatgttgctgtgggtctcagtgtctgcctctgagtatcctttacaacagataaactttaatagaatcaggtctgtgggaacttccttctggcctaagccacatattccaagaactgagtagggggaggcagagacctagaagaagtatccaggcccctcgtaggatggaggaactgggatcaggtaagcatgatatgaacagatacagcagacagaacagtgagagacagacaaccaaggaggcaaaatggggagaagataggagggtaggaagagacagactagaagaaagggcaggggaaaggaggaaagcagaggaaaagggggaatgactagaatggatattcacacaatggagtactaggcagcagtgaaaaggaaagacacagaacaaaaatgaatcgtaaaaacaatgctaacaagacacaaaagagtgtatacaggatgagcccatcaatctcaagttaaaaaacctaagactgttggaatgcactaatgagttggtcagctatataaaaggcaagggtctggtcataacaaaagtctgggagaagggaagcagtgggttatagtcaaaaagggacacagtagggagcttctgaagagggga

SEQ ID NO: 42628 - DNA, 936 bp, Bovine  19866881344127
cttccctggaaggctgtgtgaccttgggcaaatctcatcactccctgagcttcgggtcctcatcattcaaatgggaagatgacagttcgtacctcacaaggttggtacagttgcaaatgaggtcatgtatgtaatgtgcttagaacatggcctggggctttagtaggtgctccactgatggcaggtaggtatcgccaggtcactcttgatggcaggactcccggcagagcctctgtgaagacgtgctgggtgatccggaaccttgtctctgccgtggggacctctgttccttctctccttccccctgtccacaggtgggtgcagaagcagcagccagtggcctgggtctctgggaggagggggctgtgagtcagccccagcccctggtctgggctaggaagtagcccctttcagagcatgacaggcccttgctgcccccttctctgccatttctctcctcttccaggaaaaaagtttgaagttgaatgggtcccgaggtggaatattttccaaatgtcagtgcaatctgtggtacattacagctaaatgcgatcgtcgccgcgctgggctctgaatgtcagcgcaccggccgcgatgcagtgacagaccgcaggctgacaggtggggtcccagccccccacctcctgggaagtcagccctggccggggagggaggcaggccatctctgggctcagcagacgtggaccgtgggcctcggagggacatgccatgggctcgtgaggccgtgtgtgttgtgtgtgcgtgtgcatgagtgggtacacctgttcctgagtttctgtgctacgtacctctctctttttttggctgcactgtgtagcgtgtgggatcttagttccccactcggggattgaacccgtgcctcctgcagtggaagcgcagagtcttaaccactggaccagcagggaagtccctgtg

SEQ ID NO: 42629 - DNA, 751 bp, Bovine  19866881361211
cgtctggctggataccctgctggcttgtctctgggcctgaggcttgctcttccttttttaaaagaatgatttgcaaatgttagagaggtgttaaagtttttccccaccttactgagactttctccccagcataagcagcgttgataaaggaatatttttctcactatcggagtcagtgttgtttgataccttgtcctcaggctgccccaaattgcctcctgtactgaggccccatgaaataagaaacactgcacgtcatttcctgtggggcgagtgtggacctgacttagggaacaatacaattagtgattattgatggtgggtggcattcacccagggcctgggctcagcaggcaagaacccacaccacctgtaatccccactccctgggaggccaggatgactacgggtgctacatctgactgaagctggaaggacttaggagggtcactcgctagggagcgggaagctgggactccatcccagttccatctaccgcaaagctcaagttaagtgcccgggtacctcagggttatccctccatagaggaaggagatccagagccagcccaccaacaggaacaacagcatgagaggaaaggcgaagatgaaccaggagccgaagttcaccacgtcgcactgcgggaagaaactggagaaaagaagggaggtgagagcccgccagcgtcagccagacggatgggtgcacacatccctacagggaaaaccaaaggaagtggctcggcattcag

SEQ ID NO: 42630 - DNA, 1344 bp, Bovine  19866881376689
tggttacacttggcagccctcctccaaggcccttgtacccacatggctgaggccactgctggagactgctcctagatggatctcagcggcattaagctatgcctgggctagtttgtagtgactcactgcagagcacccccaagctggcatgtggttctatatttgtaaagttattgggataagaagcaattaaacagtttgtaataaacacagatggtgagcctgctgtgaggtctgccagtggggcctgacaaaatatcaagggctctagaggaagtgggtgtaggaaaaaaggaccaggcaccctcaccccaggaagcccagtgcccccgcgaacatctgctttgtgagatgaagctggagacaccgtgtattttgccaatcttccctgtccctctgttcctgtttcctcttccaactaaagcgtggaataccagaatgtgatggttggcaccatgggagattgatgacaaatcagaaaaaaaaatgtaaggtggcttttattacccccgttttataggttaaaactctaaattttgtgcccagggtaatgcagcaaacttggagaagcagccagtgaaagctgttttccaatcaggactctggctctaaccatcagcttctagttttttccctcacctgcgtgttcagacacctaaggccccaaccaaagtgcctaggacattaataacaggtggaggagctggggtttccggtttgagggacgagtgtggcttcccaggtggcatactggtaaagaatccgcctgccaatgcagtagacagcaagagacactggtttgatccctggattgggaaaatccccaggagtaggaaatggaaacactccagtattgcttagaaagttccatggacaaaggagcctggcaggctacagtccgtggggtcgcagagttaggactcagcacacgcacacatcacaagattggagactctcggtaaggacgtgcagggtgttgccgactgtagccaagcgtttgacctaaagggattcatcccacgtggacgtcttctaggccctttaatggttggcgttttccaaaggcgaccaatctattacaggttcgttaatcaatgacagcctcttctgccaatcgccagtgagaagcccgattccgtcgcccaatagtggtacgctggtagagggtctagcggttgcgcgatgacatagcactctggagtgccccattggctggatcaaacccaagcgagccactgattggttaacgctgccggagggttacaattcaaacgcgggcgggcgggcccgcagccctgcagttggaactgtgagctccgcgtaccgcttttctccgtctcatcg

SEQ ID NO: 42631 - DNA, 673 bp, Bovine  19866881390391
tttcctccccttttttcttccatcaggaagctccattcggaaatgcagcctcaggtattcgagagagagagaatgatcctgtttatataactccggcagcagccggtgcggctcagcctgggagggggtgggagctgagaatggagtcagtgtggttccaggaaaagaagagactctaaggagatggcttgggctggggcctcaggcctgggagctcccccatcctgccctggggcgacccaaacagggcactagggattggggacagagagtccacctcgctaagtcttgaggagacccaggcctcaggctaggcttagggagtaaattttcatggccccggcgagggttgggtgtaccctccactgcccctggactcctccaagtgcccttaagatggagctcttgactagaggcttttgcttcctagaagcttgtgattcaatataggcctctctagagaaagtctagacttttttttctaaaactaccaaggacaggctctgacctcaactttttcatcagggcaatgggcataattgaattttgtcttttctcccatggaagagtcaagtactaataagaaatttgtctgaaagatggtctgagctctaggtatctgccaaagggaatgtttttctcattgagaatgatgcagagggcggcaggacaa

SEQ ID NO: 42632 - DNA, 809 bp, Bovine  19866881516378
tcatgggaccatgaaagggctgggagaccagcaggggtttctccaggtaccccagaagggctcagatatgcccaaccaagcatatctccgggattttcagagttccacacttgactcgcttctagtttaaatgtatttttgtagttcctcattctggaggctgggaatcccccaagtacctgacactgtcatccccacccctctggtctccccctaaatttcaagggctgtactttctggcatgaaggcagggcaggaatgacccatgaagtagggggtcggcagcaaggggagagatgctgtggggaagctgctctggccccagcactttcattttcactgtaagcaatggctcttagggagtaaggaggcaggaagggggctcttggaggagaagtggaggaaaagccagtggggatagggtgaaaggtggtctgagcttctcaagagcaaagtcccagttttagctccaggtggagactaggctgtgacaacaatatctgaggttatttactgagagtttcctgtgtgtcaggctctgagccaaatactttacatgcattcttggtctgatttcttccaactcccccattatacagatgagcaaactgagtctcagagagagaaaatggcttgccgcaatccacttagctagatggaacctgctgataaatgtacatctgcctgatttctgagccagcctctcagatggtgagagtttccaagccttggtcctgagctaccgcatgtcagaaggcttgaaactatgacgtgggaactggggattcgacacattttcagaggagggg

SEQ ID NO: 42633 - DNA, 560 bp, Bovine  19866881518918
tggttaaaacgctgaccccgagcatgtcctgcccactttgagctcttggactgctagggagaggggctggcagcctagcgtgccagtgcaagtgcttcaaccatgaatggtggtgccagcaggagccagtccctccccttcctcctgctttccccagaggaaagggaggcagcccacatccctgaagtccctcggccggtgactgggctcaggaggctggcggggggccgcccagatgtccacaatcttgcgcagcgtggagcagcgctcctccagctctggtccctcactctgcatcagcagatttgcaagctccctgcttaggtcctgaatcatgtcgttccgtcccggctcccctggctggcctgcatctgctgggatcagaatggggtcccggagctccccgcagggcccgaggaggtgctggtacctcttctgccacccggcggcacaccatggcttcgctcacaggcctctggctggtgtgcagcagcgccaggatgtgccggcacggcaaggtggtactgctgctgaaagtagcagctgcagctgcagcccgt

SEQ ID NO: 42634 - DNA, 1222 bp, Bovine  19866881733383
ccaggcggttcagtggtaaagaatccacttgccaacacaggaactgcagaagctgtaggttccatccctgggtcaggaggatcccctggaggaaggcatggcaacccactccagtattcttgcctggaaaatcccatggacagagaaagcctggtgggctgcggtccatagggccgcaaagagtcggaggcgactgagtgcacacgcacacacacgctcagatgtataaataaaggggcttaatggtgctatcatgaaccagacctcaggattcagaagctctcaggagttgagaggtgatgcctttaaactctgtatactcaaattgatgagtatttgtctaatagacataattctcagaggaccaaaatctaaaattggtttagaattcatgccctaggttaatacagaaaataattggcaaagctagaaagaggatttagaggacatcctaatcaatcacagccaaggtgggtaaattgaggcccaaagccaggggaactgacttgtccaaggccacaggcagaggcagaatctgaagtcagaatcccccctccacgtttttttttttttttttaatatttatgtatttatttggctgtgccaggtcttagttgcagcacgcaaactcctagctgtggcacgtgggatccagttccctgaccagggatggaatcccagtcccctgcattgggcccatggagtcctagccactggaccgccagggaagtcccaagttccccaacttctaaagcaacgctggacagaccaaggtcttgccagctggttcagaagtcctagcaggttcctgtccccactggggcccaggaggggtcgctgcccagaggatgggatacctacagccatactccagctggatcaagcgcacgctcttggtggaggcgaagacgtccaccaccgcgtagaggggctgggcggctggcagcccccgggcgctggggcccatgtcctcgccgttgatgacgatatgcatgtcagctgtgccgtccgggcgcgggcagaagagaacgcccaggcggctgcggcgcgcggtcggaggcagcacattcagctcatagagctgatccaagagatggctgtacaaacccggccggctgcggccgaccaggcgatcgcggggaatacgaaactgctcgatgcagagatacggttccaccaggagggctggggggcgactcggggccagggcctctgcctccgg

SEQ ID NO: 42635 - DNA, 1478 bp, Bovine  19866880397167
tcaggaatactaatcaggaacactaacagcccttctcctgcaccactggcggcggctcagactggtcagagaagttaccaagtcataagtgtaagcgatggcctttgtgttgtgactcttgtgggcaagatgaagagcgtcatgcaaaataagctctgcctcttctggctcatctttcatgatgcagaactgaaaagagaaaacaaaataaaagaaactgaaacacgaaaagaagagagacacgcaccaccagacagaaacaagtacggctacgtgtcccagtacacagagggaagctagtcattgattcctcgaacacttattgaatccctgctgtgcaaaggtatggtgtctgcagtggtgactggagaggggctcccctgcagctccgcatggccacagatatagcacactggctgacagacataggcagcaggatcgtgagcacttttcacgaactcttataacggagctgctggccctacatcctcctccgctctttcctgcaggacaggtgagctcaatcacaaccaatgatacaggctgtgaaggaaagcaagagaaaggaacaaggggtttccttcaaatgggagtcaagacagttaaacagaggtaaagaggaagagaaacagccaactaagtaaggaactgtggggaaaaactgacccagagagcagggaatgaccgaaggtgctacaggctgaagatgacggatcttcaagaaccactcaaacaatgaaagtgaacagatgtgaactgaggatggtgactgttactgccaagtagggaggcaatgggggtaggatcacaggtctcaccagccagggcaaggagtctgggttctaccacaaacgctgtgacgggtcaatcaaggcttgtgggcacgggatgacaccagctgatttacatttaaatgatcgctccagctgctgtcaaacctggatggcagggggcaacagggcagacaagactgcaggctgtagcagcgtggccagggtgactcaggagacacagaagaggcgacaggtttgagaagcattttggatttggtggcaaaatccaaaaattcgttgctggattctcggtatatgggaggtggtagttaggtaccacaagttctcagaatgactatggagcgtccaggcaggaaaacggggcagactacagaaaagaggtactgagggaaggggtcggagagatgcctaagaccacaggttcgtttgggtcagctgaagcctcaaacagagttggcacgcgggccgcacccgccgtgtgtgggcactcgggtggacgcgttgggcatgaggcggtggtcagcccaaaggaggaggcccggtaccccgggaaaaggagaaaacgttcaggaagaggaggcccgccccgctcccctcagcctgtgcgcacttctccccgcgctagcaacctcgcagcccgcagcgccgcctctacctgcgcccgacgcgctgaccccaggactc

SEQ ID NO: 42636 - DNA, 3114 bp, Bovine  19866880407524
gctcccgcattccctggccgcaaacgcacgggcccagagcgcgtcctcgttgagctgcgccaccggcatctgaatgaccatcgaatacatcggttaggcctcaggactgcccctgctggttcacttgggcggcgtttgtttgcaaaggaccgcactttgaaaaggatttaccttgacttactgttttttaagaattgagagcaggaagccaacttttctcatttcagttaaatctaaagcagtacatgtgcttaaaagatgagacgagccaggtatccgaacatcctctaatcccaaaaagcttggggggaaagccagtctgttgacagctcaaacagtggttgccagaaagggctgtgtgtgaagaggacagtgtgagagtcttgaagggggcgcccctgaggcttggggctcatagagaccactatcacctattcacgtttttcagagccattttctgctatttaaaaatgtttgttcttagacagtcatacactcttcctgagccccctcctccgacgataatttgctttagatcagtattctgagtttacacttgtatgatgatgtaaaaatctagtcacagctgagccatgtaggaagtgatgactacttctcctttactgtaactttttgcttcctctcaaaactgtcatgattgcatttgtttggttgtttacttttctatatgtttattcctagttcaataacttctttatagctcagatggtaaagaatctgtcagcaatgcaggagacccaggtttgatccctgggtcaggaagatcccctagagaaggaaatggcaacccactccagtagtcctgcctggagaattccatggacaggagcctggcaggctacagtccataggggtcacaaagagtcaaacacggctaagtgttagtcacacacatccataattcaacttcaaactcttaccagtgttctaaatcctctactcaagatgctgaggtgttttgtccatttcattttcctctcctagagcttccagggtgctctcctgagatctccccccaccattactatctggggaattcccttaacctactttgggccttaatgtttagtataccgtacaattttctttttctcagtttactgtcttattttatagagcacatattctcctgtcctgagacttaatagtttggctaggtgttactgaattatatgttggaaatatttcctcagacgtcttaaagtattattctactaccttccaacttcttaaacttactttcacagagtcttattttagccctcctgcttcattcccactccagagccatctggtgccaccaatttctggaggagggttttttttgtttttttagggagtgagggtactagagtctgaagtgtaaatcaggatgttgcttggctcacctattactagcttaagtttcagttttctcaggtcttgtaaataattttcaaacatgtcttagctgtgtttctccctgtcctcatccttgagagtttatgcattttagaaaattcttttattattgtttagtggaatattgaggagtaaaatttgatgagtaggttcagttcaccatcatacacataagtctttttggctataagagcctttgaaaaatgtttttgtctctggtcactggtttaacacaattcacttactttccattcctgttttacagttcccgatgagcatctgttatcgtaagtatatatccttttgtatttgggattctttataaactactaatgtgtgtttttaaaggccagttctttcaacatcaactctttttttttagaaaatattcttactaagctaggaacaatagtttattgatgtgattgttaaaaatctgtctcaagtgaataaccagcaccgtacttgacagtacaaggcactcccttattgtgctaagtgccactgtattttgacatcgttctaaaaggtgtagctcttacactagtaacacatggaaagagaaggacatttggcccttgaacaacaactcttacacatgcagtgcttgggggagcctgtttcctgagtgagaggctaagagtatttaagaaagaagatgttctaggtacatacactagaatattatccaaaaattaaattttaaaatatatatttgtgtatatacatatatgtacgtgagcacacacacacgtatatatgtgcatcattctcagaagcacactgaatgggaaaaaaagttgcccaaaaagcccagaatatactgttcatattttaaacttagaaaacatcaccatatgtatatatgtatgtgtgtgtgtgtatgcacatacacgtatgtactatgtatagtaaaatataaaaacattaatatgaaatgcatatggttgccttggggatgaagaaattgaggaagaacaggaagacctctgacatataaagaggcttctttataaacaacatgttaacatttattctgggtggttgattatgtgggattttgctgtattacgtttttttccgaattaaaataaattttcagaagctgctgatggtaatccttcgggtcgagtcagagcggtggctttcagtccatctaacctgaggctcctctccttcccaggctgaaatttgtcttcggctcatcagccgtccaggccttggacctagttgaccgccggtctgtcaccttaatatcctcgcccagcgggaggcgtgtttaccaggtagaaacccggaggtggagtaatctcaaccagatccccttaggacaaacgttttcatgaatctgtatgaaagctggtggacagttgaaaggacttgacccaacttagtgaaatgagagtgtgaatagttagaatcagaaagatgtggccggttaaccccacctgggagcagcatgtggaaccagcaatgatccagagaggctctttgcccaggtctgatagtcacagccaactttccctttctgtcatttgacactacatggatcaccctgttccttgtctcttgcttacaagcaaaagccaaaatgcattttaaggtcctttcacatgtcaaggttcatctaacagaaacgatctgtcagaactgttgttggaagcattcacgaaggccacattgtgctcaatg

SEQ ID NO: 42637 - DNA, 1843 bp, Bovine  19866880938428
ttcttattggtcaaaatggtcaggtgaagacaatttcatgttgttcaaccaacaataacatactggacttaaatacaccctgtggggttcaggttagcaggtacttcctgaggccctcagagcagaaatcatttgggagctgagtgaaatgccttcccagatccccgcattgctcaggaccgacaggagtgtaagacaggcttactagaggacatgatcgttcctcagaggtggggaaaggcagttcgatagtgctggaggcaaaccaacacctcagaggcctgctgagcaagaccgggcttctgaggagacacaaaaatcaaccaaagaagcggaggaagaaactgggaacagcagtattgaaaaccaagggaacagggcatttctggaaggggtaagttgttcactagtgttaacaacagcagggagaaaagagtcgctaagtttagagcgtgaaggcttctgcagagtaaaagcactgatgtcctcagtgggaaccctgagctgaagcaaagccatcttggttgccgagggcttggacttctcgaatctagtaattaagagctgggataactacacaaacaacatgtgacactgggctcatcctttctcctctgggactttcaacctttgttaatcaccatgtcacagatccaaacataactccacctggcagtttctagttggcagggtttactgatggtagaaaccctgggttctgcagggcttccccagagccttggatcgctggatacatgtaaagagaaggggacgagtgaacctggttgatggcgtgagtgtgaaaacagtaggcaaggaaggttccagcccagctgttcagaattctgtccttgtgggcatttatgagcagccctggtgagggtgttgcgtgcagaactactggaggcatggactctggagctggcatccatgagtctgaaccacagccccatcacctcaagagtcactaaacccaagcctcagtgtcctcatttacaaagtggagatgatgccaacatgtggcatggagagtgttgtgaaggtgataggagataatacacattcacgctgacaacagggcctggagcaggcagtggtgcccagaccatctgctgccgctgcctcgaggccagcaccatcctcagttgtgggaggtgcgcttcgaaggtaatccacacagactggtagagcagagaaaggcgcaaacaagtacatacatcgacacaggacagcagggagaggtatgggccgtgggcagctcgtcgaaggaggctggtattggtaccaacactaagtcactggaactgaacacaggtcatggaaacacccagtgtggtcccagaccctcttaagatgatgaattgggatgggtcctaccacagtactcagaaccgaccgaaaggctaactgaatgaaaggtttttagtgaccagcacctgggatggtaggaatgcttagagctggctgcctgcgcacatccacattggaaagacaactacaggagcacgaccttgtctgcagacagctggatggtctacccaagtgaggggtagaccagggggtaaacactggagagccaatccagccccatgtaagacacacacttctgagacccacacttgttcgaagagaaaatgggtagctgcacacgtgctgggtggggctccctcatagaaagcccccaagcagagccaatggaggcctgtgggaggagttcatattacatgtggttggaccggcctgccagagcctcatactcaagggttacgtgagaggcaacatggagctatcattatttatgcacattttattgggagttcatgaaagaaatcccacttaccca

SEQ ID NO: 42638 - DNA, 702 bp, Bovine  19866880954672
agagcgagatctattctgtttgtgaacaaaatactgtgttcctgacacttagaacagggcctgacccatacctagcatccgcttcctaaatgtttgttgaatgactgaatgaatgcaggcacctccacatgcccagacgacccagggcacaggcacaccggtgagcttctgtgcttggtccctgctacttcagcaagcaaggaggcgcgtgctcctgtgtggacacttgccagcacacacgtgcatatgtgcttacctgtatggagggcagcctgtatgtgcgccctgatgctgacactcggtgagcctgcctgctgagcccaaaaggagtgcccctggggtgcagtgtccagctctgccagtctggctgcacggggctgcccctgcctctcaccttctggatcatgacgctgtagatacccgtgtactggaagccacgcatgtagtagagcaggttcagccagcccagcaccagagagcacacgagcagcggcaggtatcccttgacggccaagaagcgcagcacctgggacagcacggtgagcagtgcctggaccaggctggggggggcaggggtcgggtcagtttcgcgggcctcccctggccggggcagaccccccttgcccctcaaccctggccgcggtctcagagatgagatgtcctctccgtgtccagactggacttgagcatcctgacctccat

SEQ ID NO: 42639 - DNA, 1728 bp, Bovine  19866881007195
tcttagttttttgaatgttgagttttaagccaacttttttactctgctcttttactttcatcaagaagctctttagttcctcttcactttctgccattagaatggtattatctgcatatgtgaggttattgatatttcttctaacaatcttgatttcagcttgtgattcagccagcccaacatttcacatgatatactttgtatataagctaaataaacaaggtgactgtatataaccttgtcgtactcctttcctaatattgaatcagtcacttgttccatgtaaggttctaactattgcttcttaacccacatataggtttctcaggaggcaggtaaggtggtctggtattcccatctcttaaagaatttaccaatttgttgtgatccacacagtcaaaggctttagcttagtgaatgaaacaaaagtagatgtttttctggaattccttagctttctctgtgatgcagggaatgttggcaatttgatctctggttcctctgccttttctaaaccaagcttgtacatctggaagttctcgtttcatatcctgctgaagcctagctagcatgtgaaatgagcacagttgtccagtagtttgaacattctttggcattgcgcttctttgggattgaaatgaaaactgaccttttccagtcctgtggccactgctgagttttccaaatttgctggcatattgaatgcagcactttaacagcatcatgcttcaggattttaaatagctcagctggaattccatcacctccactagctttgtttattgtagtgcttcctaaggctcacttgacttcacactccaggttgtctggctctaggtgagtaaccacaccatcgtggttatcctggtcattaagaccctttttgcatagttttgtgtactcttgctgctgctttttaatctcttctgcctctgttagtccttactgtttctgtcctttatcatgcccatcctggcatgaaatgttcccttgatattcccaattttcttgaagagatctctagtctttcccattctattgttcgtctctatttctttgcactgttcattgaagaaggccttatctcttatctctctttgctatttgattcccttattattttgctttaaatttatcagaatacgaaagggtttatctatcaaaagatgacttatgctgtttagttattagtcaaaataaatctggttgggttcattagggcctttgggtccttagacccttgttggttaagtgattaccctgtagaatcagcgaagcgttgctcagaagcacgtgttgtctctggtgaataattactggtggggctgacgtgcagcagatgcctgactctccctttctgggtctcttagcaacagcttgaagaggaggccgcgaagcctccagagcccgagaagcctgtgtccccccctcctgtggagcagaagcaccgcagtgttgtccagattatttatgatgaaaaccgggtaagttcacaccattctgtggcagctcagggcttgaagaccactgggctataccttctccagttgtctctgttctgtggtaatgttaactgtattaaaacctgctttctgctataattttttaatgttcttaaattttgaagcttggtgcttttctttacatactgaagaaaagttgatagttgtgtcttaaattatttaatatttcatattcatgttatagggtataaatacttatttttaa

SEQ ID NO: 42640 - DNA, 948 bp, Bovine  19866881024928
ccaagtgctgcaactactgcaccaaaagatcccaaaggacgtaaggaatatcccgaggcagccaaataaataaatattaaaaagaaacttttaaattgtggcttaatgttctggaccatggctatataattaatcacctactgctacgttaggttgctatcaattttttttgctgtaatgaatatcacaacacacagtcaccttggttcctatttttgtggtatatttacagcctctttcaaggagcagaatcagccacaaatacatgccttgttgaggccagcctccctggtcccactcttcttctaaactgacatgtgacttgacgacccagcctccctccagctcccaggataacttgcctatgaagtagcacgggagcagccttccatgttggcacagtcgctccatatcagcttggtccactgcagtctcctcccacggctccttttctaggaaacgttgtcctttgtgccctctgggaggatgggagccctgccctgctcttgccaactggggctggaacgctgccctctaactgtacccagtcacttctttgtgtctttggagaaaaggccctgtgaggagcttcgttttctctctttacagtaagaggatgcttggtcatgttcactttggcacttggcatatggtctgttttggtttctggaaggggccggcttttacagggtctcaagaggagaggggattagttaccaacgggaccccagcagccccagactctctgctttgtggcttccctttcactgatttgtgtgcatttattggaaaacacagagacttccaggaactggtagcaggccaggctcatttatgttgcctagtgggtactggattctatttccttgttcaactcaaatcagtctgttaaggtcttgggcttgttaatgccaggatgacgttgagacgagcagtgggagaaaagat

SEQ ID NO: 42641 - DNA, 1695 bp, Bovine  19866881167647
tgggcttcaagaggctaattataaaagtcaaaatcctcagcattctggtctctaattcagggtatacttgaattcatagaatggctggataatccgttgtttgcctgttgtgatctttattgcatgtgaaaagacttgattctcctaataagaggacagagaaagttctttgtgctttgaaagaagaaattgtcatcggatttttgtggatttcattaggtcagagtactggtgcttacacagaagatttggatgtgtagggttttgtaacctagacctctatagtagtatagagttggatctgcctctggacagtgtgggctggtcctgtcacacttgctatttcaatctggggttcttcccttatgttggtaactttaacttccataggaaaatcagtcgcctatatgccctatgctgaggccacacgtgctctagagcaggaggcacagatgcacagtaccgcggccaggtcagcgtcaccgtgtaggctctctccgcagcccggtgtgggtgcagtccgttctagtggcccgccaggtaaataccgatcctcctgccgtggctgctggccatccacctacactgctggcaggggtggtttgctcccaggacatgtccctgctatttcagaattcctttcttgtttctctgcatcccatcttcagttgtattcagttgagattcactgggccactgggaggtttgtgttcatacctgtatactgtgacgttgactgcctgttctcctatgagtacatgtactttgtgaaaatcttgagatccaccccctgctaaaaaatattccagtgtctatgagagtcagaatcagtgtttctcaaattatgcaagatgcaaagaggacatataactggctgtcagtcatatctgtatattttctagagttgtaatatcagctgtccctaagaaatacccttcttttcacctcctgtgtgaggttcaaggagtggtgcaaagagagaaaaaatcactaaagattgccatttgcataagctgaacagaaatagtctgaaatggacatcagtctgaaagctctggtttgacagggagttgagtatttcggtgtcacagataccatttgtgacctgagtatggatacagatttaatctaagtgaattcatcttgcacttacaattgaattgtgattgaagaaataaattgggataggtgggaacatcacaaactaggaaattgactatttcgaataatttttttcttccttttaaaagtcctccagcctgctcctcatcaggtgataactaacctccctgaaggggttcggcttccaacaactcggcccactcggccgccgcctcctctcatcccgtcatcgaaaaccacagtggcttctgagaaaccatcgtttttactgggaggctccatctcgcaggtaagagggcttctcttcccaggagattctctgttggttactgttttgtaaagattttccctccctcccatatttatttgtcagagtctaaatgaaaatctatttatgacgagacattgacttaaaaatgcagcagtcgctttgtcttccatggcacatgcaggtttgttcgagttaggtccccaaattgagtgagtgtgtcatgtggccactcagatctctgtctgcttaatcagtggtcagctaatgatcagggagctctgtgcccgaaggacttaaattcc

SEQ ID NO: 42642 - DNA, 1258 bp, Bovine  19866880116101
gtccgtctagtcaaggctttggtttttcctgtggtcatgtatggatgtgagagttggactgtgaagaaggctgagcgctaaagaattgatgcttctgaactgtggtgttggagaagactcttgggagtcccttggactgcaaggaaatccaaccagtccattctgaaggagatcagccctgggatttctttggaaggaatgatgctaaagctgaaactccagtactttggccacctcatgcgaagagttgactcattggaagactctgatgctgggagggattgggggcaggaggagaagggggcaacaaaggatgagatggctggatggcatcactgactcgatggacgtgagtctgagttaactccagaagttggtgatggacagggaggcctggcgtgctgtgattcatggggtcgcaaagagttggacaccactgagtgactgaactgaactgaactgaatgagatatgcatgctattttctcaagatgtgcttttcttcttaatttgatataaagcagaatgtcagtgtttgagattgaccttagtaaacctcagaaacaaagaaggctggtttgctgtattactatctaggcaggcattcactctgttaaaattattatcatggtataaaatatgtgaataattagaaataataaatggcattcagtaaagtaaatctaaccacaattctgtagagtaagtatagacttagtagtaactcctgctttaatgtatttttttataatgtgaagctcaaagttttattaccattgtacagattggctttccaggtaaagctaggtatcagtcttttaaatgtgcactggatgtaaagtaaaatacttaatttctttgaaaaaatgttataaaaacgttttaatcctgaaaaatgtatttccttcaatatcataatttaatttcttgcagccaaagttcatttccagcattcagcagaattaatcaaacacctaataaaagctggagtgaactatactatgcaggtaagccactttttcagaagaatgtgttgttctaccttagtttcttgtcgtgagatacagaacacagtttttgcatgattccatctcccacccttttatttgtttttgatttttgttcttcttttttctttttttaccaaattgtctttacttccttattacagtgagaatgtagatcatcttgttttacatgtgaattgcataaactctttcaaaatgcttgtttctcagacatttattcattatcattga

SEQ ID NO: 42643 - DNA, 1592 bp, Bovine  19866880832809
tcccaaggccatttctatacaaattgctgcatcagtcagggagccagcaggacacagatggtatgctgaaattaggataatttgaggagattttatttacaaagtgactaattacaaaggtatgggtgaggagtggggaaaccacaagagatagtgcaagagtgtggagataatagcagtagcaaagtcatcatcattagtcatgagaagacaaagtgggggctccagccagcctgaggtgacatcaattagagagaaccagaggatcaattccttcaactcaatctcacccagcctaatcatctcttcctggcccattttcttcaagtctcagctcagaacatatctcctcaaagattttctttgcctctccaccatctccctcctctgcttaagtacttgctatccaatgattttacagctgagctataagggaagcccaagaatactggagtgggtagcctatcccttctccagtggatcttcctgacccaggaatcaaaccagggtatcctgcattacagacagattctttaccactgaactatcagggaagcccaattttatggcatgtatcagcatttggcattatttaatgtccttcttctcccactacaatcttaccttctagtacaagtccatgactgcaggaatcatgtctagcttattgtttgctgtttcctcaacaatcaaaagagtatctgacatataataaacagtaaaacagtatttggcaagtgatgtgaatgaaaacaatttggaacacattaaaaaaaaaagtattgagaacataggctagtagtagtcattgattggagaagaaaaggtgagttacagaaagtgattaaggagaaaaattcaattagaactgaggaaaagaaagagacaaagatgatgccacaatgtcaaacctgagggaatgaaaccattttaatactcgtatagataacttggaaatggcactctttttggagattatcggtttacttttggaaatgtttaaaggactgtcttcaaaactgatgcttccaagtgaaatgtttgaaaaacatatgaaataacaaagtggttattaagggactgcttcaagagtcaacgatatggaagttatatgaacaacaacaatcacatattatacatgcctcaaacatctgatgttttgtttaaaccaagccatgcaacagtcaaggcatatttacggaaatctttctgtaggtccaatttctcttaatgaaccaccaaatgttttcttataatgtggtataaacaatgtgatttcagaatattttaagatctagcatagctatttaagtattaataaatttaatcattcatttttctgaaccatgttcatctatcaagtcagtaaaattagcaaacaaacaaatgcatatttcgatagatgaaatgaaggaagaagaaaacaaaaggaaggagggatgaaaaagaaaggaggagcaaaaaagccagagaatcttaagtctgaaacacacaccagcatgtcctgggctcctttcacataacatgtcactgaatcctcacacagctcttgatttctcaatttgaagaattttaaattgaggataaggaaa

SEQ ID NO: 42644 - DNA, 1580 bp, Bovine  19866880892809
ccctccatctattgatttatatgttaatccatctaaagacaccctaatagaaacattagaataatgtttgaccaattatctgggcaccctgtgggccagtaaagttgacatatagaattaactatcataaacaatccagggaagtgactgatcaaagaataattttttttttttttttttacttaaggatgtcttacatttaaaggacactatttgaatgccccttacaaatgaaaacacttcttattgagaaagtatatatagcaaatcaagttggtcaggttctactttggggcccttcaagtctctaactctgggcagttaaatgaaatagtctactgtagacatactgccttggtatttaaattatatttgcaaggaaatatacatgtagcatcatagtgcatagaaatagaagaggaaacagttataaaaactaaaatgtagatatgatatgtttatatttatataaaattgaaccctagagtcatagtataataattacaggccaacaaggatacataagtgttattaaagatgtttatctgtgatctctttgtaggggaaaaatgcctcaaccaccaatcactgacaagacagcagtaattttataatctgcttcatagtgggagtaatgaatattatttcttggtgcacaaatatctgcctcttgtcatgtagtttccttacatttcatctcttcattcttgacaagttggaattaagagtcctcagtttcaaagtgattggtgtgaaatgatgttatgataaaacctgctgtgatgccaaggaaaccaaaaccagaagcaaaacataagacattccataacaacacaaatgctcaataccaaaatatttttgaaactcacacacacacagacacattcagaaaatgcatgtcttgccaaatgttgcaaaggatagtaatttttctttcagtaacttctgaaaattctccaaaacttatgtttcctttgaatttccgttggcaagttaaaattttcatccccatatgtaaaggcttatggaccatattggagatctcaatcttcctcccacaaatcagaggttattcattattggaaccccataattgaagggagtgtctcactgtgaataggagtaaggcttgcctttcacttttctgataccacctggatggatgccttcatttttctcaccttccagcaaatatcacctatcccatgttccatttcactccaatgcaaattaaacccatagacagatgagtttagagactccattttgagaaggaaactcaatggaataaaatcacattgcccaacagaaggtaatgaaaaagaagtggtgttgaaaagaaaatcaaatgaatgacttgttgccagaaatgggaataggtattatttcacattcaacatctaattagatcagatgtactttgcacaaccttgtaatgttaaattaacaaaaataagcactttctgaaagtcattggaagattctgatagggcattttcacttaagaattatgatagattctatcacttggggggtgaggggacagcagccaagatgaaggagtagtaagaccctgagtt

SEQ ID NO: 42645 - DNA, 896 bp, Bovine  19866880909248
ttgcctaaaagcagaacataaatttataaagctgtaccactctctcctctctacctggaatgatagaagttaatcattagatacaattctagacccttatcagcccagacatggcaccagaggagactaaataacaaacattgctaattagtgcttttcttgcactatatatataccgcccatatatacacctttccacaatttgccacgggtagaaactcaaagtcctttcccttcctcttaaaacttctctaaaagtttattattcttttgttaaaatgttaacgccgtgtgagttaccatctctgagtacgcccatgtgtatgtacaataaacatgttaataaacttgtttgtttttctcttgttaatcttttatatgtctaatttatggggcactggctaatgaacctaaaaagatattttttgctctacaagagcatcagctgaaactcgactgatcctgtgcagaaggttatgctgctatgcccaaaggtggtgccatggcagcagcactgggacacgtcccataagatgagccattgctgagatttgtcaaccagtgttgtagttgataaaagcccgacactgtcatattcacattagacagtaagtgaccagaagaccatgatttgcttttctatagatctagaaacttcactgtacatttactcagcaattaaaccatcttgggcttcccttgtggcacagctggtaaagaatccacctgcaatgcgggagacctgggtttggtccctgggttgggatgatcccctggagaagggaaaggctacccactccagtattctggcctggagaattccatggactgtagtccatggagtcgaaaagagttggacatgactgagcgactttcactttaaaacatcttaggca

SEQ ID NO: 42646 - DNA, 1508 bp, Bovine  19866880930871
cagagtgctgaggccacccccggtgaagctgcctggtgtggcatgaactttcattctggaaaataggaatttagaaatatttcaaataaggacaactgctgggttagaaaatggaaactgagcttgtcagcaaccactcaagctgagaaaaaggtcagactggcaggggcagtaaagagcacaggatgaagcatctgcaaggggagggaggaagggaattaacatagacattaaacctgtgattccagagagatgatgagtcctttgttgttaaacctcattcccctctcaaaacgcccttgagatacacatccttatctttattttatacatatggaaagaactcaaaagaaagatcagacttgtcctgagttacagagtaatcctggacagagccaggctgcgaatacagcagtagtctttcctccccgctgtgttgcttctctgtgcattaacagtggaatgtttgtcccagaacttatgctttggtgaattcaggatactagtctcctttgcagtaaaacaaaaggactcaacaaattttaatttatctcagagaagcctaaaatatcattggaataataaacttggaattgttgatttctatcttgtggaaagttcatctgagaataagacaaaaaaagaaaagcagagttaagaaatgaagggcacttttatccaaagtgcaacatttgtgccttgggtttagttagtctagttctaggacattttcagagcatgagctaaatagatctctcttttgcttaattgtatttaagttaaatatctaaaaaaagtcctggctgattacaatcatgtagaaattatgttatttggaattatataaagatgaaaattttttcttcaatttttttttgcaaattatctaaattggtctgaatatacaataaaaacaaaaccacattatgccagttccagattgaataattcattttagtggcataagtttgatgttatgtccatcttctcatccaagctcaaaacttctatttatcccttaagccagaactcaagcgctgtattttattaaaaacatctcttgtttccccataataatatttttctatctgatccctttcataataaactatgatcaggatcagtgtacttcagtaattaaaaaatattctaatttgttaaacgaatatattctcaaagtaaaatatttcaaatgcagaagaccctacaattagttataaactaccacacagcaaaaatcatacctttaactcttaagaaattgtactcttaggagctattttgcatatatatatatatgtatatattagtatttattttttaggtatgtatttatttggctgtgcaggatcttagctgtggcataagggattttttaactgcagaatgtgacacatggtacattggtaaagaatctgcctgccagtgcagaagacacagaagatgtgggttccatccttggtctgggaagatctgcggagaaggaaatggcaactcaccccagtatt

SEQ ID NO: 42647 - DNA, 746 bp, Bovine  19866880938974
tgattacattataacattttttaatgtatatgtttaaagttcataatccctaataaaaatgttaaaaagactcgactgacataactcaggctatgaaatcagagaactattgttggatattgacttttatcccagttctttcaaagtttgggtctttaatttgtattttccaagtctctaaagcattcctaacattgaagtttcatttccagaagataagtcaagaatcgtcatgactacttaactagctccactaccatcctatgttgacatcaattgctttggataatatatcagagtcctgtgtctggtcctcagacttgaagattcaggaacctagtattgttttctctacaaaagcaacctgtctctcagggaaaagttataaattggaatttctaacttggaagttaaatcattatttttaatcaaacatttatagcatgcctactatgtgtcagagactattcaagcactttggaaataatagccactttttcctttataacaattcatttacagatgagaaatagcagacacaacaatgctatattactttcctatagacatacagcttatcagtagccatagtttagagttgaatccagccaatctggttctaaatctatgcctgcaaccatgctacatttgataatcatcaggaaaaaactaaaagagtcaacctgataatgaaagagttcttgagctcttgttcaagatatgtagaaccatcgtattcaaaacta

SEQ ID NO: 42648 - DNA, 969 bp, Bovine  19866881174448
tttcttttaattcattcattcattcatttattcatttaccaatactttagtaagtacatgttctatataagagagggcaaatccctttttcctttatatttcaacttgaggatgttaatatttttattccacaaacttttaggactattttgactagttacaacaatgggaaaacacttttagaaatttgatttcagttgaatttccttcacagattcttttatgtcctgaggtgacattttatagtataatttattgtagaaagcaaaaataagcactagcctgttggagctgtccttatgtaagaaatcatttgataaggacacttcctaaataaagagaaacaaaaaaagaaatgaaaacgtcatatactttgccatttgtgttcttaaattattaatctttcattaataggatgggctcaaaacatttgagggaagctgaatcaataaatcaaatgctgttgatttaaaatatcaactgctactgtcaggaaaaattagtttctgtttttctccctcatataaactttttagtttagacttaggtatgaacaacatcaacaaaaaatcacttcataaaatagggaaaatgtgtttaattctataaggttataagatacttgcatgtttttttatactatttttatttacatatattaaaatattgtttattaaatgtattaataattaaatgattatgttattttaattataaccttatgttttactataattgtattccaaatagtttttactatttagaaattttattcattccatcagttttaattattacctcctaccatgtggtttgaagtgtttaaacatttaaaatgtatcaagttcagtcgctcagtccagtcccgactctttgcaaccccatggactgcagtacgccaggcctccctgtccatcaccaactcccaaagtttactcaaacttatgtccattaagtcagtgatgccat

SEQ ID NO: 42649 - DNA, 1171 bp, Bovine  19866881291609
caccagcaggagctgtcttgaaaggaatgatgttccccagaggagggatgtacccatgcccatcaaaaggttctccacagactcagattttcaagcaagatacaggatctgtcaaactgtcaggaacccagcatgaaaagagtcaatatgaagccaaatcacagcagcattgtcagagggaagcttgactgcccttattcttttccttgaaaataaacaaaaataaaaacttttgatactattgctttatttcctgattccaagggtgacagtgtttcctcttatgatcgaatgaagttaaaattttatttttaaagggattcctgagtttgtttgatcttcgttgagttttatctcaacgtctgtaatcacatggaccatccctttgtaagctaaaatttgaagacaaaataatgtcatgatgatgactctttgtaaaaagtactcacaagtaatgattacaggaacaaggtaagctgggaactatttccatgtcaagtctcagaggaaaagttaaaaacagaaaacaaaatattgactggtagtgtgcttctaagaatgctccaggtctccaatgcaaacaatgatttcaacagatccctgaatcccaaattctctgccagttttcataggaatacatatttctcatagaacattaccatgaagtttatggtgttttgccccaaatgtctagaattttactaccctgatgcatcagactgtaccacacatagactgagtatgctcttctgcttttctacattcaagtctgactgtgtgtgtccatgtggctcggcttcccctgatgtaaactatgtactgatcaaggctctcaggacctcaaaatcctcaaagctaaaggggaaatgtataaaaagtcaaggtgtttgccaataactctgatccatttataccctcacactaaaaagggaatctcttaacaccgtggcacaggtgtctgctagaagtaccatttaatggctccaacaaagatgcacactcacactttaacagctgagaagcaatgcttaaggaagccacaggcttccactgtatgctggtgatagaaatctcatccaagctcagaaaataaagaacagataaaaataaattcttcaaggacttgagactaaactgaactgggtatctaggtcaggcaccccaatttttt

SEQ ID NO: 42650 - DNA, 1379 bp, Bovine  19866881693925
ttaagttgtttgatattttaaaaacaccttatggtgtttttcctattcaatggctttgcaacaaaaaaatatcccaagatatcacacttttgatgcttttttttttttttttttattctcattctcagaaaagagtacaaactttcctgggataatggactatccattgaagttttgtgttttgaatctttattccattgctattctattcctgaaaaaaaaaaaataaaagtttaaatcatgcaacaacacacagcctgccaaactgccacaagggagctgcttgcggagaacctaacaatagggtacttttgtttcttcctgtaaactttccctctaggcatggtaaatgagacaagctagcaggtcagctttgaagacactcaaagcagacatgtggcaccacacagattacttttctttagtgagacagacatttatcctgcttcttttcttctgtagagaaaggccaccacacaatgaaatttaaacctcatgcaacaagcaggttaaccatctgccctgacacacagatactccctgaggagctatagcagacctcttctaccccaagacttagccatcagctgaattgagaggccaaactgaggcattaacacttttctagctattcagactggtgaccaccaaccccagtgtaattagggaccaatctcgatcttctactgtggtaaagaaatttgggctagttttaagtgggaattgcaaaggtaacctcatagaaactaggacagaatttactttaatttcttgtaactggtgagccacattcactaaagggaataagatgatggagaagaggtaaaagatccatgaaacatgtgattatttgacatcaaactaaaatatgtgaaaagagtcaataagcaggaaaaaacactgaatttagagttacttccatgtctgctacttattattggtaactttagcatggcttccctggtgactcagaggttaaagcgtctgcctgcaatgcgagagaccagggttcaatccctgggtcaggaagataccctggaaaaagaaatggcaacccactctagtattcttgcctggagaatcccatggatggaggagcctggtgggctacagtccatggggtctcaaagagtcagacatgactgagcgatttcattcattcacttagcatggcctggggcttttgtttggtggttagtcaggactcctgaatgatgaaatagaaaatcacctaaaataatttagagaaatagtggatttgttataataataccggatatcttttggagcctaaagcagaatgaaagctggattggcaaaagagctgaaaaaagatttggagttccatcaaaacactgctccctagtggaatttcttca

SEQ ID NO: 42651 - DNA, 1990 bp, Bovine  19866880914404
tttttgttggtagtaattttaaaaattagttcatttcttccccaagaacttcacgtgtatgtgtgttgtatcttttttccatatcagcactcaatcttagatccttttaacttctttcttttaaaatttctttatcttgtttgtttcttgcatttcttctccttactaaattttagtcaattctattattctttggatactttgtacttagtttttatgtttgatatgacttgatcttttcttttcttgagtttaatcatccctgtttcatctttttgttgaatgtatttttttcacatccaataatccttattaagaacatttatttcagtttaaagtggtatgttacagatttgtttttgatttacgagaagaatttttcttagctgaagtgtgtggttttgcttcagtgtataaagctgttacaggtcttagttgtggcacatgcagtctctgaggcatgtgggatctttagttgtggctctaattccctgaccagggattgatccccggcccccttcattgggagtgtggagtcttagccattggaccaccaaggaagtccctagatttgctttttaaaaaaattcttacagtagctttatatggaattggtttgaatctttttatttctttgcatttaattgaccggtgtcctaattcaaaagcattcttctgtcattttagtgatgtgatgtttcttcaatgaatgttgttactgctgatcatggtggagttgtttttcttttcatctttgtgaaatcctgaattttacccccttttttttctttttcttcacttcccaggaatgctgaaaactagataaaatctagttttatatttttaaataaatgtttaaataaataaacatttatttttcatttacggtttgggtaaggttaccattattctccagacccaaagtctatatacagacttctggaagttattactttagtggtggtggttgttcagttgcctagttgtgtctaactctttgcagcccaatcagctgtggcacactaggtcttcccgtccctcaccattccatctcctgaagtttgcccaagttcctcttcactgcatcagtgatgtcatccagccatcttatcttctgacaccctcttttccttctgccctcagtctttcccatcatcagggactttttcagtaagttggctgttttcatcagatgaccaaaatactggagcctcagcttcagtatcagtccttccaacgtgtattcagggttgtacttgagttggtagcaaagaagaattatcttaatattaatgaactaattaattagttctataaaagttcaactcctttttcatcttagttattttatcttttttttccccctatcttttttttgtctattttatatgagtacttagagaacacacgttcatggttattggttgtttaagcatttacatgctatgcattattcagtcgaggtctctactgtaacagctgtagggagatagtatttgagtctgtctccactgcttaattagtttgttatatttagcaatgtacatcacctctctggagccaccatgtaaaaatgaggttgaggagaacatttacctactagaattactgaatgagatcaacattgtaaagctcttgaaacatttaagtgaatattcattgtttcaaacacttgacacactaaaaaaagccttcctttgtaggtgaaaggtgaaacctgttggtaacatccttgttttctaggttgctggaggagcaaatataagtcagatttcagaagcactgagctgctacaggaatagatcatgttttatgaaggaagccctctacaggctcttcacaggagacgttttcaacgcaaataaccatgcctgctattttaaaggtaactacaactcagaaatgtaatttttaaaactacttattacttgattcaattaaagttgtttaaaatttggaaaactcagcagtggccacaggactggaaaag

SEQ ID NO: 42652 - DNA, 955 bp, Bovine  19866881111813
tttcttttttttttaattagcaagtctgaactataatgtctagagaagaatatttttgtgataaaattgttaagaaatgcaggaaagtcatcaccataaaaagtcaggaggaaaaagaaagtcatgagagttgttacttttaaggggtaggtgggagcagtgaacgaatcagggcacacgagatttctgggtggtggtgttatcataactcattcagctcgagaggaagaagtctggctgtagagaaaagaatcacatggagagagatacatgaaattgaagaagggttgtgtaggtgtgtgtgtgggtctcacaatggcagaagcaggcaggaatcactggggcagtcattctcgtccctctccccatggtgctctgaggttctcaagcccttccacttctgtgaggcagaaagggcaagggttattctcccgattttatgggtggaaaaactgaggcctgagtgtgtgtgacttgccccaggtcacactgctcatcaagggtagaggctgcccagatcccaggccccagcccaggagtgagcagggcagctggctcacccaacgctgccctgtcccctgcaggaattgctgagattctgatgaacagacccagtgcctgcaatgccctggggaatgtcttcatcagtcaggtgagtaagggcgggcaccagggtgggatggggctgagctgggaggtatctgatctggtctcctctgcagctgctggaagctctggcccagcttcgggaggaccgtcaagtgcgtgtcctgatcttcaggagtggagtgaagggtgtgttctgcgcaggtgggtttccttccttgcccccaacccggggctcagcagggctcccaccagcctgcatttagggaacagttaggttgttttagcacaggactcgggcttcccaggttgccctagggtaaagaacccacttgggatacaggagaca

SEQ ID NO: 42653 - DNA, 680 bp, Bovine  19866881976176
gggtcttcccaacccagggatcaaacttgcatctcctgtttggcaagtggattctttgccattggcaggtggattctttaccactgagtcacatgggaagtcacttttaaggctcctttaattattattcttttgaatggttctaggtaagacctttttattcagaaagaaattacaccgaaataaattagaatcactttacataactgaaacttggagatttataaatttctgaaatacactcttaccaaaattacaaggaagctataaaagacactgagaaacgtaaaatacactcaatacttaacaatatgatataaaatttcaacttataccacttcatagatatacccaaaatctgtatctgcttcttctaacccagggtcctcctggtagtattttacataaattttacttacatcttctgacaatatgacataaattttcaatttgtatcacttcatggcaacacctgaaatctatatctgcttcctctagcccagggccctcctggtagtattttacataaatcatatcttcaagcttcttctcaatctctgtaaagacaagatctaccataaattaatcaactgcagaactgtttggagcagcctcaatttgatgagttctaaaagaactgtggaaaataatctatttcaatccacggactcacacaggta

SEQ ID NO: 42654 - DNA, 1935 bp, Bovine  19866880356552
tgatgggaccagatgccatgatcttcggttttctgaatgttgagctttaagccaagtttttcactctcccactttcactttcatcaagaggcttttgagttcctcttcactttctgccataagggtggtgtcatctgcatatctgaggttattgatatttctcccgacaatcttgattccagcttgtgcttcttccatcccagcatttctcatgatgtactctgcatataagttaaataagcagggtgacaatatgcagccttcacgtacttcttttcctatttggaaccagtttattgttccatgtccacttctaactgttgcttcctgacctggatatatgtttctcaagagacaggtcaggtggtctggtattccaatctctttcagaattttccacagtttattgtgatccacacagtcaaaggctttggcatagtcaataaagcagaagtagtttttctggaactctcttgcttttttgatgatccagcagatgttggcaatttgatctttggttcctctgtcttttctaaatccatcttgaacatctggaagttcatggttgacgtattgctcaagcctggcttggagaattttgagcattactacttttgagcgtgtgagatgagtgcaattgtgggtagtttgagcattcttcagcattgcctttctttgggattggaatgaaaactgaccttttccagtcctgtggccactgctgagtttccccaatttgctagcatattgagtgcagcacttttatagcatcatcttccaggatttgaaatagctcaactggaattccatcacctccactagctttgttcatagtgatgcttcctaaggcccacttgacttcacattccaggatgtctggctctggtcccccaattttgctcatattgtaatcactgggggattattaaaaaagcaaaacaagacaaactactactgcctggttttcagacagttttcagaactcctaacattctgatttattagtatggtgtatgacctggccagcaagacttctaaagactttctagggattaaaatgtgcagcaaatttggggaaccctgttagcataaagaaagatggagttccagaatatcatcaggggtgcaattgctctgaagtatacaaacaagacacacagacacacacacacacacaatgttttgagtctgcatgtgctaggttgccatagacagtagctttaaacagccctgcttgaatgagttcaaagaataagactaagcattggacagaacaaggcactgatgataaaccaaatagctatttactatctcatgtctgaatcttagctttcctttgagatgcctgggagcctcagaagcatcagaagtgtcatcctcactatcagtgaatcatctggatgaagaggagctctgcctagaaagtcactgttaaaatagaactcaagcctttaaccaggatgcctggttgaagacattagtataacactgtaaatgtacttaatcttttgatatatctgaattatataattttaaggtatctattcccttgtttttgcctctaaaatactcattatagagtctctctctcctagaaaatatatgtaaaatctatgcaaaggttttatccagctccttctgatttagttatcagaacacacaacatctgctaaaactgaagcccacagtctcagaaatttttctttcactgcactccaagtctgcacatcattagtacaattcagatggaaatcctgtagagatgcggtattgctaacagactgcactttcccagaaaatctgacctcccaaatttgatttatttaacatatttgcattttaatggatttttctgaaatggtaatctcatcaagatgggctgctgtggtttttttgagtaattcacaattttcagctcatttatatgtatttatt

SEQ ID NO: 42655 - DNA, 2354 bp, Bovine  19866880452707
aataagatgaattctcttctagcccaggaatagttttttcctgaaagaatctagagaaaggacaaagtaaaatccttatcatctataaaactgtatgattctctattataacaattacatgtatgtaattgcatgatttgaaatattcaaatggtatgattcctatgcaggaagatatgttcctcacttccccatcagcatttttttagtaatattaaaaaaatcagaattgcacttaatattttcagttcccctgaatgagtcaaactaggtgacaaggggttttgccttttaatctggttgaattctttatatgcaatattaaatcttattagtagacagggcaaactttcaataggcaaactgaacattcatgcacagaagcttaattcagagtcttaagaagaaagtggtcatacaattcatgagtgcaattacacacacagaggtgtacagagaagttaacagagcttgagtccaaagcgctgaagattagaatatgttatactcattagaaagtgttcattcaagtccacagcaagtcagtgagcaaaatactgaatccagtccttgagtgcagaggtcccatggaaaaataagtacttgtttctgaaaagtagttttggattcttaaatttgataaactctaagtccctagtatgtcaatttttgaagctttaagttccatgttaaaaatcttgatttttctatttatcctatatcccatttgtataaactatactttggaattttaaagttacttaaaacaaaattgttatttatttatgacatgaaatttggcaataacttgatacttagtgagatctgccactcaccatttttcctcgaaaaaatacagggagatgcaaaaacagcacttcagataagaaaacaaaaaaagttactactatcaagggctatttgattgaggaatgctaagttaccattaatgagtgaaatatcagtgataaaccaaaatatatttgaacaataaataataaaaataacaataataaccaaaatgatctagtatctagatcccttctggttataatggaaacttgcacagaaggacacacattttgtatttgccttagctttgcaactcaattttaacaccagtgcgcgcgagcgcacatacgtttattgccttaattgaaggtgttcacagtggctgattcccattatccagctgaagagtcttgcgagacaatctttaaaggaccttccctgtgaattttcttgttgaccattctcaatgggttggattcgggacacctacaaaatgtattttatatattatttcagtgtttaagtattgacttacttggataaagcactcgtctatttaaaagccgatgttatattgctggaccaaatgctgagcttaaatactgttccatttctttctttctggatgcttataaatagcttttggcttttaattggaagttatcagcaatcagtttttatgttaaacataaaatgggatctgtgcatatggtatcttgaattcagtgatttgtgtcttcactctattggtaaggaagccgtggggcacagtggatgctgcggtcaggtagtgtgaatggcaagtgtctgaaggtgggctctgtagcaactgacattttcacaagcagtttaatctttcagagatctggctttcttatctgtaaagtggaaataataatacatatttgaatggattttgattaggattaaatgggatgatatgcacaaaggtcctcatctctctacacaaacatattatggttgtccataaaagccagaagcaagacaaaaagtaaaaaagaggaagaaaaagagagagaacaaagaagttttttataattggtcggaattccaggatgctatagtctacaattctaatatccaaacgagctttaaaacccaaatgtttcttttttggtgcaagctcatttggtggtgtttcttaccaccgtcggtgaattccctgtgaggcaatttgtactctgctgtgctgcagaaatatccatctttgattacaaagtgatgctcaagatcctgcttgtgtaacaatacacggtattttctcctaaaatataaaatagttgaatcctgagaaacatctagcactaatgatttaggatacggaaccacagtcctataactaacaattgttacagatacagcctacgttttaccaggggaaggtagatggatgtcatattcccaaatactggccatctttattttgctatttgcttcttccttcattcaccatgtcctctgatgaggcaaaatgaaaaggagaagagagaggaagaaaagcagtcatgtttgaagtgtgtgctctagattcaactccatca

SEQ ID NO: 42656 - DNA, 4055 bp, Bovine  19866880651073
actgaaagtgtaaatacccagtaaaggacaagaaaaatattaaataatttgcaaatgatataattgcttacctaagcaaaaaaatcaaatgaaattaaaataatcagatgaaaaactgttcaaaacaatgtgagttcatttgtcacaaaatcagtacgcaaacatcaaaagcttattacttaccagcaataagagaaaatgagaaaaaaactgaatcacaacaaaaaatatatagtattaaataataacttcaaaagatatgttttattactatttgaaaaaaaaatgagatgaattgagggacataaaagaaagcttgatcaaatggagagatatattgtaaagataacttttcccaacctgtagatcaaaatcttagaattttttgagaagcctgacaaaaattattgttttattttgaagaataaatgcactaacataaactatgatttttttttttaaagagtagcaaaagtaggtcataagtgttagtttctcagtcatgttcaactctttgcgaccccatagactgtgaagcccaccaatctctggccatgggattctccaggcaagaatacttggagtgggttgccattctcttctccaggggagcttcccaacccaaggatcgaaccctggtctcctgcattgcagacactctttacagtctgagccaccagggaagcccaaaaggaggtcgtagttgtactgtaattaatatgcattacagagctacaggcttccctagtggctcagtggtaaaaaaaaaaaaaaatctgcctgccaatgcaggagtgaaatgaaaaggcactcagtcttgtccaactctttgcgaccccatggactatacagtccatgaaattctccaggccagaatctgggagtgggtagcctttcccttctccagaggatcttctcagcccagggatcgaacccaggtcccccgcattgcaagcggatgctttaccagctgagcccaagggaagacacagattcaatccctgggtcaggaagatcccctggagaaggaaatggcaacctagtccaatactcctgccatggagaaattaaaattagatagacccaggagcctagtgggctacagtccatggggtcacaaagagtcggacattactgagcaactgagtgtgtacgtatgcacacacacacacacacacacacacacacagacaccccttgagatcaagggctgaaagtccttgtcttcaaattcttagcatattataggtgtgcaatggtttttgttaaattaatgactatataattgaattaactgttattgtcagtgtttgaattaaaccaactaattactgtttaaatctaatttttttctttaaaatgtggcacaagtgctatcaattgatatatagtgaatcaagattattttactttgagcccttctaggtatttcttatcagatattaagataattagtgtcattgaatattacttaaaaaatgaatctagatctgtgagtttaaagaaaaagacaaagtttactgctaaagaaaaaccttgggaattgtgtgaccatggactcaacagtgtgataaaataagcaagcagggaaaccaaaacaagtgaacaaaaactactgccatcttgggtttatttgcactgggttagtttttaaggtgcttgtgtaaatattacatctttgacattccttaatatttgtatttgtaaagtgttttgtgatcacagaactaaagtagtgcaaaacaaggaagttcacagataatccagatgcttctaaatcatattccattaattctttggaaattcaaaaaggggcttctagagcatgtatgaggaagtgtggtgagcggattgcatgattctatgttaccaggactggttatttaatttgcaaggtccagtgcaaagtgaaaacgagagatctctgtgaagaaatcatcagcaatgtcaggataacgagtagagcatcaaaaccaagcatggggccctcctgagtgcctgacagcacaggttacacacacaatggaactggccctacctgttatgattcccattttagacagccacttggaaaattacctgaagaacaaatggattacaggggcaggaggagaggctatagaagaggctataggaaaatgatattggtaatccaggcaagctatgatgatggccccaaccacatttgtaggtgtgatgaagagaaggattttatgctgaagttaacacctcttataagagttcaacttttctatttaattttccctatttcaattatatttgtaaattacccccaaactaccatcttaacaccacagaccttcacgaaatgaaaatacccagtaagaaaaactttacaaagaaaatcaattacagaatgagtttaaaagaccatgtctttatgttaaaaatggtccacctgaattagcgagtgtcatcgtcagttagttaaacttaatagcaatgaatatatgagcacactggggccattaggaacccttaagtataagaaatatgtctgattgatgtgcagtggctatctttagtgttctggcaagtgcactgtgatttctggctcgccctaagaaaccaactgtgctggaacactatctaaggccactgccatgtgtgagtcaaaactctgctcctgggaaactacagagacattagccactggaacaaagggtctcaggtaaggcacctggaatctgcagagtcagcactccagttgcgcaccttggttttaccggctgcactggggggccgtggagggggtgtggctcagaaaggacacgtgggaagcattctggattcagactttggctccagcatacactcactgtgtgactttgggcaagttattaaatttctctgagtctgacttttttttccatctttaatttcagaattataatagctcacaattgtgaggactgaacagtatcagctacagaagctacttagcacagtactgggacacatggtaaaagcctgtcacttgttatgcagctattcacacaaataaggtggacctctttttagggaaagtaagaatcaaaagagcattaatttttagggcttttttttgagtgtataagtattgcgaagttgactgctggcccaatacctgggccacagaccagttctggtccatggtctgttagaaaccaggttgcacggaagtgaagcttcatttgctttaacagccactctccatcacttgtattaccacctgggctccacctcgtgtcaggtccgcagcagcaatggattctcacaggagcacaaaccctactgtgaattgtgtatgtgaggggtccaggttgtgcactccttatgaaaatcatgatttccatggcccgccctggtccatggaaaaattatcttccacgaaactggtccctggtgccaaaaaggctggggaccgctgctgtacaggatgctgaggttatgtccatgagcagccacagactgggttggggacagaggtcctttcagccagcatctctgtggatccaactcagctgcgtccacattcttaggcaatgaggacaaagtaggatcatttaagggtgtacaaaagcctccccacccccgatatgtgcatggattcccttcaggcctcatctccaaagatgagattgtgtaaaggttttcctagttgaggttagagtggcgaagaggctctgggggagggcctatggagacttacataaatgccaaggtgtatccccattacttctcttgtctctaataaagtgccagagagagagaatgccaatgcttaatttacttaaggaattagacctatttattcagaagaattgatccagggctttgtataggcacaacctctgagtatcattttcttcatcactataattagagactatagatttattagggagcaagggcaaaacatcttttaaaacttcctagtaacaactaatgagcatctgaaacaggttgtcattatttgaaccaatcaacagacgtttctagattgccttatattcatgctactgctggcactgtgatggctataaaggaatggt

SEQ ID NO: 42657 - DNA, 996 bp, Bovine  19866880912758
atgtcctaattcatctcacccactctcccctttcccccttgctatccatactttttctgtatatctgtttctttctctgctttgtaaataagatcatctataccaattttttggagacggcaaatggcaccccactccagtactgttgcctggaaaatcccatggatggaggagcctggtgggctgcagtccatggggttgctaggaatcagactcgactgagtgacttcactttctcttttcactttcatgcattggagaaggaaatggcaacccactccagtgttcttgcctggagagtcccagggatgggggagcctggtgggctgccatctctggggtcgcacagagtcggattcaactgaagcgacttagcagcagcagcagcagcagcataccaatttttaatgcatgtatatgcattagtgtacagtatttgtttttctctttctgacttacttcactctttaggggggggatacatttttttaaactactgtgattttagccctctattacagcatctgaaaagtatactcaataaagcatttcaaaactgaagtaatgaggcacttgtttatctgtgggatggtcagtttaaacacgcattcaagaactcaggcagtagctttttttaatgtgctactccctcacttgctggaaaattgccatattcacttattatttcaaagtagcacaaacttcattattcaatagtcaagattagagcttgataaagaggagatttttttatattcatatgttattttttctctttctcactctctttcttcaagaaaatgcatataagctaccaattaaattactatgggttggtgaaaagataatttaaccaaatattccctgaagttagacaaaacccattacaacagtacccaagggcacacaaggttattggcattatgggatgattttaatatcatttagtgaaattcttcaatagaagctacaattgataatcaatgaagttatttt

SEQ ID NO: 42658 - DNA, 1403 bp, Bovine  19866880913758
accattatggaaagcaaaactatcgtgcgatccagtaatcccaattctgagtatttatcaaaagaaactgaaatcagaatcctgaagagatattggcacttccttgttcactacagcactattcacaagtaactggaacacctgtatatccaagataaatggatacacacacacacatgcatacacactggaatactattcagccttaaaggaagaaggaaatcctgcaatgtgctacaacatggatgaaccttcaggacactatgctaaatgaagtatgcaagtcacagaaagacaaatactgatgaatctacttatatgaaggaatggcactacttcctgaatgtgaatttctctggttgcagaaccagaaatgatgacaagtttttgcagcagtggatatatcgttaccttccaggcagctgcatggatcataatacccctattgaataatctactgaacatctttgcactaatttgtgactcacctttagcaagtttacaggccttcattaaaactattcatgtactcattacactgctggttctcttattctgttactaatatcaaattcttttgcttttgttctaaaaatttttattattgacgtttaatatccttaatttttataagccatcttaaatcatttttgaaaaattgcttaaagttgattaaaagggggaagcagtcagcaaaatgtggtggctgtgtacataagtactgagcaagacttctaagttccaaattttgactcctctagttatgagacatgtgactcttgggcaaattacaagacactgttatatctggtttctactgtaaaaatggagatacacagatgtggaaaatgaacttatggttacaggggtaaggggggagagagataaattgggagactgggactgaccatatatacagtattatgtataaaacagctaactaataagtccccactgtatagaacagggagctctactcaatactctgtaatgacttatatggggaaagagtggatatgtatgagtggatctgtatggatatgtatgagtggattcatcttgttgtacagcagaaatacaacattgtaaatcaaatatactccaataaaaaaaaaaaaagacaatagttcctatctcctaaggttgttttgagttttaaacaacatcaataagatacttagaatgatgcatttagaacagtgctaggcacacagcaaatgctcttatggtagctgtgaggaggtttcatgctgtagtttaacatacatagctgggctaacaatctaacatcactctaaataaaccagtgtttctaacatagcatctaacaggatgtttggacataatattttacaatgattactaaaaaaactctttttatcttctttactgcactttctaca

SEQ ID NO: 42659 - DNA, 1482 bp, Bovine  19866880939520
aaaagtaaatataaccgaagacttctccattactctcaaaatagacataacttactcttttcatcactgtaggatttaaactacttaaagtaggaccagaaaagcagaaaattcctatttctacctttcagacttctctagcaagttcagttttggaggaaatttagaatactaaaaagcttagaaagccttgacactctttaaagattttttttaaggcaataacagtggtggaggattcacttactggaaatgaaagtggaggaaatgatcataatattttaggaggcaggattaccagtaacacttaaagaggtctattttctcagttctagcatcagtcttcaaggaatcagtcacacttttcttgttggaagcctcatatatatatttgtaccttgctaaacctggtctgaatgcaggagttaaaaattcctcagaaatccagatttaaacctgtaatgtcgtctgtaaatataaatgtcatggacccaagattgtgtaatgaatgatcctgccatgaaggaaattcagaagaataaaaagatacacatgcctagggcaagaagtcagcaaagagcccttaaccatgatgctgttactgagaataatgaaaacacattaaaaaaatactcatttgtaaatatgtgtatatatagtctagtaaaaacaggcaaacacatatctttctgataaagacatctttttattctacttacttggggcccaggtcagtatcaattggtcagcctgaaaatttcagtagtctctgtttgcatggcagaaattctgcacatgttttatctgattcctaagagtatctaaaaggatcttttatgttaaaagagaggtgaaccttcattgacagactttgtctattccacttctaactgggcctctcttttctcaggatctatcctagccaaatatctcagttacatttaccatgcagtttcctttgtgaaagagcagtaggggaagaaatagttctctgctgtgagttgtatttttcaaataaaatattaaaaattaaattaaaaacattaagtatgatttttgtcccatacattaattctttcttgagggtagaggaataaagaatgcttgctatcctgatgaaagtcagattgccatagtgactagagaatgtttggaaaggcatcacgtggttctgatcggaccgggcctttgggcagataaatgaccccctgcgtccaatgggccatcctgggatctcatcaactttcttatttacaaatcacaatcttctggagacagcctgggatattgagcaggtacacagtctacaacatactctgcctcctccatgtgagcaaggtgctgaagaatagggttggtcaaacattccttcacgtttttctgtaagttggttttagtcgtgcttagttgttttaactaagtctttaatttcatttgaaataattttgctagattttcattgtgacagatgtcatatcagca

SEQ ID NO: 42660 - DNA, 1524 bp, Bovine  19866880966199
tgaagaagctaatttgtgattcttctttctaacatggtcattacgtggttagacatacagtaattgcttttttgtttttcagtgttagtgattttctgtactataaataactggatgctctctagttgttcataaacaacttccatctggggtccaaaattataatgggcttggcttgatatgtgtttatgaattgccagcatctgaaatctactaaaaagagagattttatctactgacctgtttctagtcacacattcctgaacttccaaataacttcaaaatgccctgttcatttgtatttttataacaaataaatgcatctttatagaaacagtattcattttaaatttattccctacacaataataaggaagccatgagtacatattgttactgcggagggaatttctttacatgcaattcatgagataaaagaattgtgaacacaatgctgcaataaggagattattgtccacttgggttttaaaaaggtttgattttcctatttgtcagaaatctttgagttaaagaaacatttgagagatcagtactgctaatgaatgctcttaaggtgttattcaaaataaaatgctttgttatgaaagccctccaacttttatataaaatcctctctaatcagcttgagtaaactcttcaacatgaaaattacacagaaaagtccatgtgattgcatcatctggatgttaattgaatgcaaaaatgtctcctgtggtctttaacactcaaacatttttcatcctttgtttttttaattttatagctcttcatgaaaaaacagcagcatattgagaaatccaaaaagaaatataggcttctcccgtgttaggaggacagatatgaaatccaggagaggaagaacatttttttttcaccaaagtgaaatacaaagcaatgagatttacctgtttcaagagatataattcactcacataaatgctaaccataaaggagtattgtcatcagataaacagctattcatatgctgtgataacttgtgagacagtgcctaaggtcttattaatgttagttgctgaaaattttcaggttaaagagtaactataccactgaaagctaccatcttcaataaaagtcgtattttctgattccaggattcaatctgtctgcttctttctacatttgtatttctgacacccaaactggtgatcttatttataaagtgcatgatgattagtatcagatcagatcagatcagatcagtcgctcagtcatgtccaactctttgcgaccccatgaatcgcagcacgccaggcctccctgtccatcaccaactcccagagttcactcagactcgtccatcgagtcagtgatgccatccagccatctcatcctctgtcgtacccttctcctcctgcccccaatccctcccagcatcagagtctttttcaatgagtcaactcttcccatgaggtggccaagctagattaatccacatcatcatggatattctggcaactttgctgttttccacacgtcgttttt

SEQ ID NO: 42661 - DNA, 1051 bp, Bovine  19866881008316
ctagcgaccccctggactgcagcccaccaggctcctctgtcctgggattttccaggcaagagtactggagtggggtgccattgccttctccagtctatgtttagaggggggcttttctaggacctaattataccttaggctattgagttcgtccatctctatgttagattgacattattccatgacctttgcagttagaaaattcagattttacatgcatgaaggcaaaattctttattttcagcaaaatattgaagattttgaaggagcacacgtgcccagattcgtaaacaatcctgcttacggcacctagagttctttgtcttcagaacatttgggtgacaggcttttttaaaaattaaaacatcttagaactgcaagcttttgctttctgtttcgtacacatactgataatttcttggtaactggatagtttaaacaggaaggaaatgactaggaagctttctctcagctatcaatagcagatgtataggactataaattgctcttattaaattaacatcataaaagacaaggtcaaatgctgattataaaggccaaatcatcaggaaaatagatacagctacctgttccttactcagcccaggaagcctgattttcagagcaaacagttagtatacatccacagatttttcacgtctcctcgttatataattcagacattctgccaaacccctcactctgcgttatgggtgcttggtcacctcattcagagaataaagatgctattattctgaatttactctgaggagtaatatatgaacacgtttttcaaagggtgaagccgtaacacatgtagatattattgtcattttcacaggtttgcatacatatccaaaataaactgtgtttaaaagacaaattcagaaactaatttttgagatacctttagaaatcatgagtaatgcaactcaacaatttactttctaaatcaaacggctgccattaagttggcattttcttggttgatttgaacaacaaaagaattggttttaatgtataaaaaattctagcagctcaagggaattca

SEQ ID NO: 42662 - DNA, 1557 bp, Bovine  19866881014208
tgcttctgtaaaacatgtaatcatgttttctcgagcatggatccttcaaagaacaaggtgtaacagagggaactgcacttatagagatactggagaagatatgaaaatgatatgagatgaaacctgtattttattaataggaatttagaaaaatgattgagaaaaagatctctcagggtctaatctacatcctaggaagaaaaattgggaaactttgttaatcctttagttataatagtggctagcatttattgagagcttaatgttattggcactatacttgcatttttatacacatcactcacaataacactgtgaaacaggttctattattactctcattgtacagaagaaaacggaagcaaaggaaggttaaagaagcttgctcaaggtccaagagcaaggaattggtgggtagggatcaaagtcctggcagtctgaccccaagggtttcactgctaagcactaactggtctgctttcttaaagtcactggaatagttggtaaataaactccctgaccatagctctgcaaccaacttaattggataaacttatactgtctccactgactggctgtctttggagaatgatttttcataaaatatgtaatagatggttcacagttaatttaggagagttagctacagatttgcaaagtagaaatgttataaaaggatacattgcacggaagtatcccttcagatgtatggcctactaaaaaggaacaccaagaaggaccaaggattctgacaatgggtacagcacttattgaaacacaggtttgagatcaaagacgatctggagaaagataatgttatttaatatttggataaataatacataataatatttttatctgtggatttggcagtcagagtaacaatgtcaaagagtaatataaacattcatacacctacaaaaataacaatgctgactaccagatctatagataaaaacattattatgtattatttacccaaatatgaaataatatattatctttctaagatcttctttcttaaaggtcttacccaaaataacatataaacttcttaatttccaaatcagtatgattttgtgtgcaaagaatataataacaaatgccacccttgaccaggcaatacatctattcacaagggctactgcatcatttgatagagtaaatattatcagaaagagcacaagtcacaactagcaagctgttattgcaactgctgactgcagagaatgtttctaacagcttctaagggtctggagtcaggccacaaattcttctcacataagtcacacagggcttccagacaccaagtactgtcaaaattgagatgaatggcttctttagcttcaatcactttggcaacaatcactttggcaacaactgagagacagaaaattcaacattggtcagtaagtatttggtattgaccaaatatcatcatctttcctggtgaattatatcttaatagaagaaaagaaaaaaaataaaataaaaggaatataaaagggaatctgtattagaaattagaacctctaaaattaggtaaatgaaggaaaa

SEQ ID NO: 42663 - DNA, 1460 bp, Bovine  19866881053419
tgtggaaaatatacaatgtaaacctgtgatagtatattaagcatttatttattaaatgaatgttaagttataaactagctacaagtaaattctgtatttcagtttgataatagaatataaaactcagaaaaagaaggctcaagaatatcttacctactagttcagtataagcaatataagcaactaattttcctgtattatttaaatcactaattcttgaaatttgatccacctacatcagaagctttagaaatgccttttaaaagtggcaactcctaaaccttatccttctatctatgaaagcagaatttttaggagacgcttaggaacgtcttttttttttaagtaccagaactttattttcgtgtacagtagaatatgagaaattctggtttagtatgggatataatcaattgaaacaagggtcagtttgctttgtgtaaaaggtcttctattttagtggtagccacggtaagctgttgttgaaatgccaaatatatatgggatgtgataatagacaataaactagggttaatgatgctactaaattagaaagtgccaatcatagtaggtgtattatgaatgtaatgatcttgaagcaatgggatataattagcatttaaattaagttgtaggttagccacattaaggaaaggttagcttgctatgaatttttataaggttatggtgttatttttatcagtttgagcattgactataacctaatttaatgaaaattttggaataatagcattgtcattattaactgagctacatattaattgatgaatactcttgaacacacttgcactggactacaagataaatttgaatgtaaggtatagacatgtagtatttaagtcatgccaatactttacttactatgattaatcaggctgctcacaaagatcatgtttatagggagcatggctatgttttaattgtattttttcctgaaattgtaggttgtatgtgtggtaaataatttcaaaggaagacaaccagaaaatgagcatacacacacggatagcctggcacagctgccaatgataagcattcctcgagtagaaagtcctttggaaaaggtaacatctgtacaggtgattcataatttaaattctaaagtgcgattgttctctagagcaaatgaataattattcttgagagttctttcacattttttattagctaaaataagctcagagtctaatgtggtatttagcaagaacttaatcactgaagagaacatctttgaaaaatgcgtatcacatagaaaacatttcttggaacctctcaggcttaaaagttgagtctgtacatggactgtgctataatttgccatagctttaagataaggaacgttatacagtggtcccacgcatgggcaaaatataagttttacttgagaatgtatacatttttaataatacatattccatttcttccatgcttcatttata

SEQ ID NO: 42664 - DNA, 1537 bp, Bovine  19866881079779
tataaagattgaataaataggccaaaaaccttattaatatacacccaataagattttctacataaaaaatttcaaatattatataaagaagttatcaaaaattatttttaaaataatttagaagattgctgataaaagataaatatgaaaaagtaaattatatttctgtactccagcacaacaaaagttagaaaagaaaacattttaaatatgtagtaataatttatgataaatacaaacaaaatataaaatactctggaataaacttatgaaaaagtatagaagacctttatggaaaaaaacattctaaaacttttttatcaagagattatcaaagaagacaaaaaaaagtatggtttctaaaaattattctaccttaaatcttctatttagtacctccttcaatttcagattaagtaccagttcctcagacagttcttatcagaatagcatttatgtacagtgtaggtattttttcactgttctctccctctcagtctgctgttcctctccttaacattcattaggacaatcattttatgtatgtttatgcaatttcctgttacaatataagttgtaacatgagccatgttacatgtttgaccattctatccttagtacttactacttagaaatgtgataagtatttgtagaataaattaatgatttcaggaaggtgaaatattagtaacaaatctagtcttgtttcaccactcctttccaaggactgttttattacactgtgaaacaccacagaaacttacaagctgcctgtaccttatcctaaaggtgtgtatcaccaaaatttctgagcaaaataatacaacttgaggataacagctattcttacttaagaatatcttcactttttttctttttaaatagtttctctattattgccttttatggaaaaaaataaccattcaatctatttattcaaatgctaaaaatttctcttcataatcagaatagctgaggaattatcattttgaaagtccttgaaataatatacctaaataaaaaggtttaggttgctactccatcaaaagacaatagaaaattctaaaattcagttctaatctgacagctacctcttcttaacaagtattaattaaattgcaggggagggagaagagggctcttaacaataaaattacattattttctgatttgtgagagaggtaagatgtgtctgaaaaattagatgcttgattatacaatgctgctcaagcattcatgtgattaccacacgtgcgtaccttttttatatactttataatacacacttttctttaaaagtagaaacctctcttcctgaaattcactgccaattttattatccaaatgtaacttgttcagtaaaacacaatgcattttcttaaaatgacaaattaagtcataagaacacccacaaacggagttgacacatcacctttcaagtcagtacctccaacaccattaacatccttcaaataaggaagaatcatgacactggaggcaacagaaagccaattatttaaacagccccattttagga

SEQ ID NO: 42665 - DNA, 754 bp, Bovine  19866881220722
tggaacttgacatttgagttctttatattgcaaagtttatgctgagatattttctttctaaatacataattcaggacttattttattcaggacttcaataagctagacgcttctagtctctctccacgatatcaaataacctagagatttattaaaagacaagaaaattcttttaacattgagggcttaagtgatcagatatccttattttctttcttattattttttatcactgagattttttttttgttggtgaatttcaaaggcaattgagttgattttcactttttaaaaaaattgggagtatgcataaagtgtgtgtgcatgtgtttctgtatatataaaccaagattttatttttattatatcactgagaggaaagactctaaaatatcattatttaaagctctgccttatttcttccctcagacaacgttcttttttgtttgaaaaataacaacacttagacaaattctgaaggctacatattaactcatatgttcacttgcagtagagtttgagaaatttatctggtgaaaatataaaatgaactcaattctccttgcaaaaaactaaaaccatgaatacaggcttcacattttttttttactaaatcttatcatagaaaatatttgactaattaaactatttagacataattctctgttttttacttctagctcagaaatggctgaatttgccttagcaactccaatggacaacttgcttcaggaatgcagatttattttagaaa

SEQ ID NO: 42666 - DNA, 1783 bp, Bovine  19866881265137
tgacagcctaatatggctgttgtctggacagccgagaccgtctatgtgaaagtgctattgaaagtaccaagaactatataaatatgagggttattgtctgattttacaaatgcttgataacaaactgattatttgcttgtctgtttctcctacatttttacatgtgtaaatatatggacaaataaaaaatgagggaaaagaccacttaaacagtacccaggccaaacatttttggtattctttactatgcttctaaatatttaatagattattagtagatgcaaacatagaagacactatttcacatttgcatgttaatgaaaaatcatgaattatacattatttgctgtgtggagtagtggaaacagtattcattttttatacccataaaaacttagattgtctcctgaaacacacatcaaatccccttctgtaacagcgccagaaagatctgcaggctttttaaaaccatctccaatgaaattagatagatttgtttgtgctgctttgcaacacgctagtgtgaaagttcattttaaacaaaatagttttaataatgtcattactaatgtatatttggtcatcactaaaaaatggggttttaatatgaatgtttcattttaataaacggcaaaggaagcaagttgccctgagtcagcaggaagtagttatacaccagagaacagcctgattgtgttagattcatccagaacactgaacagcccagagacagtccaagaaaaaacaactggctttattcaaatgattaggcttactgcagctcaatagtgagattcacacattctcctattatttcttgaccttgtgccaaaaactcccacttacagtaataattagaattagcgtttccagtgcatgcctccatcttcccaacaaacagtacaaaaaaaaaaaaaaaaaagtggtgcttacaaactatgcagttaataaaaattttctttactctgattaatacagctccattttcttaactctttaccattatgccaagtatagctaccttctgttgcaaaatcactacaagtgccatgactgcctttgttgatcctacagttttgaaaggaactggtatttcattctttctctaattaaattctaagaaatttcttttttcttttcctggtcagagcacaaaagaaaagctgcctctgactactgtcattctgggccacatgtatttttttgtctggtaatgtggaaaactaaatacttcaaatactggaattagcatcggtacaaattgttgtgcctcctgttttaataagaggcagagtttgtgagaacagtctggaagggcccgtgaaacctgagtagatgtctgtgatacggttttctctacactacctaaccgaactcctctctaggcttcttactacactcagactgtgccaccatgaagggaatggcaagaagggagtcatgtcatatttatgtgtttagtgattcttgtagcactgtggttattaccagtcacagaagcctaacacatacatccaaggaatttacccttagttggcagaatctaatgggaaatcaaatagaaatcacaaggtgtgaaaaacaaacaggataaaaataatcaaaacttaaaaaaaaaaaaagctatatttaatagaataaatctgattgctaagccaagtgaatttcttgtgtgagacagagctcgggactagaatctgaaaacctagactacaccgcacagctctgtcgctaagtatttttactctgtcttgatgagacgtcggcggaggaacttcaggca

SEQ ID NO: 42667 - DNA, 768 bp, Bovine  19866881277499
atttaaactctttattttaaagtctgaaaagactgcaactatgggagatggactactgtccttcagcaaattaatgtctttattttgttctaagtcaaaatatgatgagtaatctacccataaagcatttatatggtgcatataaataggttgctggcaatagaaatagcagccaacaggtttaccctgtcgacagcaatttattaagatgacaaatagataaaagtaacatataaaatgagccataatcctacttcattttcatttcaatggttactccagaagaaatcttacttactcattgtactttaaactactttccctattgaatatttggagtgtttttgatagagaagagtctgcagagtcatcaagtttccctttgaatgacagtggaatgtatctagagagggcaccctttagaaggaaaaattattctgaaaatatacacattataggctcttcatgagcatgacataaaaaaatatagatgccattattgaataatggactcaccgttagtcatcagtaagtcactgttgttaatatattatgtattaatattctacttaatatttgatcatgtacattatttttataggaataactgcaagtgtagacagattgcaagtatagaaagattgaaggcaggaggagaaggggatgacagaggatgagatggttggatggcatcactgactcaatggacatgagtttgagtaaactccaggagttggtgatggacagggaggccctggcgtgcctgca

SEQ ID NO: 42668 - DNA, 796 bp, Bovine  19866881312113
gatttggcacaactttagttgctctgatataggattcatcaaaaaggagtcatattcataagctattttaactgataaaaagagaaaaataaaagtgttttgtgtgcttgttactttttcccaaggggaaagggaagaaggggagctggtgggataaaaagtcaagggagtggaggccatgtttcttggatgcaggaatcttaaggtttgcctttcagcttcaagattaagcttttttctcacaggggtatgggtttccaaactgggatgcccaggtcccttcatatatatatatatatatatatatatatatatatatatacacatatagtcttctaaacttctgctttttttcaattgggttactgtgttctattttagtacacttctcacttactctataaagagagactgataccagaactaaattaaagaggaaacagtgcctattttcagataaagtgagaaccatcagccttcttgaaaacattatgttttgattgataagactttcttactggctcttttctttcaacttccccttggtagaggacctcataaacctttttctgctttccatcagtttcagtggaaaaagatggtttcacgaagggtgatcctatttctcatctcatcttctcactcttttctgctcctttcaaaatcaaagatgagttcttcccctctggctcctttattcactcacacttctggtggttctcagtcatcaaatgcgtgcgctgattcttcctttcatggggaaaacagaacagaccaaagaagtctttaccttgca

SEQ ID NO: 42669 - DNA, 854 bp, Bovine  19866881324704
atgtatggttatgattacaatgccatcttctcttaaaagaatggctacttaacccagatgaaaggccattcacaagcatgccccaaataagtggacacaactgttttgaagctgttttggctattgacgctaaattatattctcttgcatgttttagattcagaaatatttgaggaaaataacacacagacaaaaaagggaatacaagcttaacaagtttctatattttttaatttcctgaatcatttatctagcaattatttatattagactaaggaggcaaagctgacccatatgtatgtatgtcctcaagtaatctaccagctaatgagaagtaccagtatgcatataaaaaacaacaatgaaatagatgctggagtaaaccatgaaataaataccaatgcaatgggaagagaagggggagagtggcaaaccataaacttaagacaaattgtccatggattcttctttctttctttgtgtagatgatgcaatgggcagaaagtagtcaactgtacaattctaatcaggatatagaatatgctatgaagaatgtcctctgcagttatgcatcacggcagccctagaaaagaaaccatcctttacaaacacctccatgtgggggcttagatctaccacttcttaggcctgtcaataatgctttgggttgcaaaagcttagtgtatgattatgaaagacattattatctcaaaatacaaaaactgacattagacactctttctccttgagaagtctattggcagctctctaattctttgttgtcatggataatctattctttcagaatactgaagaaggtgaaggagagacaatgcaagtaacttaaggaaggg

SEQ ID NO: 42670 - DNA, 879 bp, Bovine  19866881331793
ctagttcctctggcccggcattcttcaggcaagaatactggagtgggttgccatttccttctctaagggatcttcccaacccagggtttgaaccctggtctctggcattgcaggcagattctctaccatctgaaccaccagggaagcccctgagttgcacattgcagaatctgttttcctctgattacaatttccaagtgttcccacttaccaggatgttctttgcaaagatgagattggatacaaacatctactgccctgtgtcagtataggtgaggcagagagccattctgtaatccaatggaaggtataaagtcaggaagagctgggaatgggaacaattgaggaaagagcacaggagggtagactaccccaagggtgctctgtgcatctggtcttgcagcagaacacagcctgttgaagaagagttacagaaaataggtattgtaggaaagtctccatcagggaggcctggggcatgttctgctgttgggcagaacagaactcccaggatctaagagctggtgggcgtggggaagacttgctgctaagttacaagaggtccactgcttggaagacagaggaggactgccagtctcatccataaggccactggggtgctacataggtgaccaaggtaggtcaagcagaaatcaggcacaaagtagaaattgcatttcaggaacaatgcataaatcccattatcaaatgtaggccagaatgttcaacttgaattagcggcagacttgatattgaatcacagagcctgggctataccagtgtagttctctcctgcctgaagtcagggttttcagagatcagagagaccagagaattaaatttgggggataaaggcatcaagaaatatacccaagggcc

SEQ ID NO: 42671 - DNA, 893 bp, Bovine  19866881400073
ttgattctgttatccttacagtgttcctggaaatctgttgaattaggagccagaaataatgaaaaaaacgggagttgagaaattgcaatgttatctttttaaaatatatattgttcaagtgaacagtgttagagcctcaattgatggtggcccagctggtatgtccatatgtctttagcatttcgagattaagaccaagcattcagaataaatataaaggcatctcaaatggtatggatgtgatcccagatgctgtcaccatatgtcttatgaatttcccatttaaaaaataccaggtctgtatcatttagcttatctggtataatacacaagttgatctagcacaaagcgctgaatcacagataaagtaaaatagcgaagagagcttgaaatgttcgtagcactgaaatttcactttcaatcattgcaatttatgttctcaaaggttgaaatttcatgtataataaaactattaatatggaaccatatgctaaaagaattttctaagagagcaaacataatgatttgacatctgagttgttgcagattatgacttaatataagatgcagaaatctcatgttatgtttcttcacttttagtagtgagaagaaaaaatatcctaatttaagatatatttatcaacatcatgtatataattatggccccgcttttgatgatcagatgactttaaaccatagagagccatctgaaatcgtgcagcagcaaacaattcagagtaacagtagtgaaaacattctatcaccaggcccacatggttttattacataaaagaattgagtccattttagccaaattgacttaattttacatgtaatagctccatggttatctgggtcctgttggcattcttcagttcttctgtaggacacaa

SEQ ID NO: 42672 - DNA, 870 bp, Bovine  19866881511942
tctagcatctgacatttgatggcaagtctttggcattccttgaagaatgtattactcattattggcttgagggctccagtcacatggccatcttctccttgggtgtctttacatcatcttccctctgcacatgtctgtctctgtgtccagatttcccctttttataaggataccagtcatactgggttagaccccaatctaaagacttcatcttacctttacagactacctctgtaaagatgctacttctaaataagatactggggactaggacatcaacatattgttttggggagacaaaatttcacctttaataccaggcgtctgtttttaatactgctcctttgttttaaacctttgagggtttgttgttgttgctgttgttataattttatttatttttggctgtgctgtgtctttgttgctgtgcagcctctaaagttgtggcaagtgggagccactcttctctgcagtgagtgggcttctcattgtgatggcttcttttcctgtggagcacaggctctgggcatatgggtttccgtagttgaagcctgtgggctcagtggttgtggctcttggactctagagcataggctcaatagttgtgatgcatgggcttagttgctctgcagcatgtgagatctcaaaccagggatcaaaaccagcgtcccttgcattgcaaggcagattcttaactagaccaccagggaagcccaaatacttttctttaaaggagccatgtgacttcaaatctcccaacccacaaaagctgtatagaaagcatttttctgagaactgtctcttgtgtgtcctacttttctttacctagcttcccagccatcttctgacagcctcaattgagagttgcct

SEQ ID NO: 42673 - DNA, 1044 bp, Bovine  19866881757875
tgatgtttcttttccaaatatttcctccactttctttcaaagtgatacaatccacacgcacttatattttaatgaaaatttttctgctacttactatcttccaattcagtaattaagacattatgtctttacttgtccaaaaaattactttccatgcttatagttgtaaatttgtagatggaaaaaagcccagtcatttactaatccattcaagaaagatgaaatttaagccagaaattcatcatgccagaagcctttatgctctcactaaaacagcattctgaaaatcctctgatattaaactaatagttgaccctggaccacatatgaacagaaggactattctgagtgtttagtttctgttgtatctttgtttcaagcactatctagtgcattgaaggacaaccgaataaatgctgattagcattcacaagctgtatccttgacaaaggacccacagctgtcataaccatagtttttcccacatgctccatatcgctgctaaagaaactgtttctcaaagtgttagcaggatttgtgattttgtttagttggatggttttcatttatcatagcacacataacgactttcaggtgtcttcaagtaacatgaagttacaaagatagttcagcagaattttatgcaggcacatttccaaatggatcaataaaagttttgctgacccagcagtggcaggattaattacaccagaagagtaacaatatccgtaatgatcatttatagtcgtgaatggccaaggttctataccacatcttggtgaagcaggcaacattatccccattttaggacaccacagaaattaaaatgacttggccaaggtccctcaattatgaatctacatagtaaagatatgaactcagttctgtagagttctgggtcctcgggcttatccatcatagttaactgccacatttttatgttcttatccttaataattggttaaagacattcttagggaacatgcatattctgaaacttcccttgatattatggatccctgggagttataggtaacaactttt

SEQ ID NO: 42674 - DNA, 857 bp, Bovine  19866881862965
acttggggacttgctgtatgagcaaccttttaagccctggagtcttcatcaccaaatctgagaaaataacaagagttccacctacctcaaatgtaactgtggaagaccgtgaaaacactcttattattttaatctataaaattgaggtcacaattgctcttctatcttaaaatggtagtttgagaattaaatgagatagtgcgagaaaatatttgaggtgaacaagatgcttttcaactatataatgcaaccattattaaaatgtcctcttcaagggcatcaatatcttttcctcatgactaaaaatgaggtttttctttctacagagattcatggcatgggcatcagtgaaacagttatcactattatatgctctttgattgagtgatacatgctgaatcttcagtgtcaattctctgtgaagcaatggacatgatacaaaaaatgccatcagagtcataaaacccacatgccaaagaagttacctgttggctcagcatcactgatgctttttaaagagttgttaactgtaaaagctgtctccttagagcataaatcattgtaattggagctttggaaatagcaaggtagctagaaggatgaataaagcacagtcggaatgtttcaagcatggcagtttgtgttttctctaaggcctttcttatgagaaattgggaagccagacaatatctatagcaaacataggtcataagaaatccaattccatatcagagggctttttttttttagcagctagaaagatctttcatgaatagatttcaatttgccacaaacataaacaacaaatttggtttgattatatggtatttttcctaagtcagacgaaccctccaatt

SEQ ID NO: 42675 - DNA, 1536 bp, Bovine  19866880387878
aggggcaggaagcgaaggcctccttgaggaggtgacatctgagctgttggaagtcctaggggggcattgcaggtagtgggagcagagagagcaaaggccagagaggaggaacccttgcttctagtgggacaggtagtcaggtaccagataagacatcctcataagcccagttaaggagtttggattttattccaaccgagtggaaggggaccagtgatccaggtgagagacctggttgcagttgatggaagcaatagcttcaagcacctctcgatcttgccttctgtcagggtagttggtttttttttttttttttttttttgagtatgcagtggcctgaacagcaccgagttccacttccccaggtgagctcacttcccaaatcaaaggaggaacaaaagtgatcacactctgcacttgagtacccgctgcaggcggagcaggaaggccccgagggttacaaaagttgatggacaaggagggcagcggagtgctgagctcctggtccagaagatcacagatggtggttcctaggtttggctgcatagactggaggtgctattgttgtttgttgagggttccttgtaaatacagcatggtgcaaaaaggaacctgtaaataatggagcaactctcctggcttgctcaggtttcccaaggaacacagtgacgtatgtgcagcacactgcatcgtttgcctcatgaagaatggaatgaggccctggagtttgtgatctgcaaaaatcttccatccagaaagctggtacaagttctggacaacacttgcagtggagttttattttttcttgctggtgtcaatgatgagttgatcaaaaatgtgcagtttccctagtttttcatcagaccttgcccaatgggagatattgatgtttttgagtgcttgtgataaccaactctaccttctaccttcgtgatctcagttagttcttgcaacaagcaaccaaatgaaagtattatgctctttgcattttacctgctctggcctgtcccagcaacatggccttggatcatgccttgacctctctgtgccagtttgctcatttataaagtagagataataactgatcctaactcataaggcagtggttctcaaagtttggtctgggtacacttaggagtccccaaggttttttagagtccagaaggccaaaactcttttcataataacacaaaggtattatttaccttttacacattcattcctacatgagtatacatgatgttttctcaaggttaacctgacctgggagagtgcagcagagtgaatgcaaaagcagtaggccagtccagctgtcttctattgagccagactttaaggaaatttgccaaaatgtaaaacaatgccaatctcccccttttttttcctttggaaaatattgttactgttcatataagagtttctgttaatgtgtaacaggttgattatagtttttaagtgaattaataagtatctaaattttttctgtgcttaaattcacaatacagtaaacatcaatacaacttaaacaaaaagtct

SEQ ID NO: 42676 - DNA, 1579 bp, Bovine  19866880521357
agacaaagttaatagatgacagaatgggataagagagttgcagtgtttaacactgacgagggatgaatatttacaagacagcaaacacaaaagaaaaataggcaaaggatataaatagaaaatttaatcggaagaggaaatccaaaaagccatcaaacatatggaaggttgctcagactcattagcaatcagaaaaaagcaaattaaaataatgagataacactgtatgcatattagtttggcaaaaagtgggaggctggaaaatgccaaaggcttggctaggatgggaatgtgaagatagaggagttctttagagcctctggaaagcaatctggccattagaaaaataagaacatgttcagatataaggggatacacatagggatgccttcgaaaacactgttcacaataatagagagttggaagcaagcagaggctctatcactgagtcagtgaccaggtaggtgtgggcattcataacgtacagattagatgcatgcaaagtaactaaatcgtacagtgatgagtgaaaaaaaaaagtgaaaaaaaaacagtgtataatacaatgtacataaaaatacatacatactgtacaataaagcccattttgtatgaatacaaacaagcaagaaaaattagcattaaacacattagtgtgcttgcctatggggaagtggtcagagttaggaatgggaatggagaatgaggataaagggaactatcaaaaaaaaacttgccttctgggagaagcaagctacttaattgggtttagagagaggatcatttgatgtgatgttttcaggctgtcaattaggaaacaacaggcgaggtgtttggatgcgtcacctccctgggctcatcttctccgaggctggaaatagaagccggagcttgggagccttcctcccacagatggggtcagaggtgctggatgttgggcatctaattggacatgctgtgtcagaaagcagagcaggggtttccaaagaaacgctcaggatgtatgtttagcctctgtgacgcattttaaagggaaagcaagaaggaaggcaacactcgcatcctgtgattaagctctgggtgttggctatcagagctgttattttacagttacagctacgtcaaccatcactcagactgtgttcctaaatgcccttgggtgttaacagaatggacatatttccagaaacactctgcaatgccctcagggcttcctgaaaacacagatgccttctttcagacaaatcttaaaagtaaactcttattataatcaacaattctctgttacctattcaaagttgctgaaagactagatcttacatgttctcaccacaaaaaaagaaatgataattatgtgatgtgatagaagggtgtttgttcatgttacggtggcaatctctgaaatagataaatatatcaaatcaacactttaaacttatacagtgtttatctcaattatattgcaataagaaataaataataaaacataaacacacacaaagtaagttcctgactacttatgattttctccttggcaaagtggagcccccatgctctggcacctcattcatgtatgatt

SEQ ID NO: 42677 - DNA, 1764 bp, Bovine  19866880541567
attggcatctactgagaaaatagcagtgtgtctgtggtcctggagttgctattcccttgatggccaaatgattcgcattaactcaatggaagatatcacttcttgaaactttgaaatccctggcttatatcttattaatgttttcttgttttctgtgagcctttgccatgcatcattgacattgtatatcatgttatttcacttaatagaacaactgactttctttggcaactggggatcaactttaaatcatgcagaccacatgggcagtgtagcatgacaggatccctggggatgaggttccttggtgtctgttgtacaaatactcagcaaagaaatagtaatggggtaataatcagcttgggagctgccagaattcactgttgcttaaaacctctgcatgagggcctgtgtagaaggcaacttgaagaaatggaaagaagctggagtatgggttaggttttgaatcctgaccccttctttaactgatatatgttctcagggaaatcaatcatgtgaactatccaaacttttatttatgatatagtgatattatgtatctcttgtaggattgaaataaagaataaatgataaaatatatgagaaggcacctggattatgttaaatttttattaatttggttcttctttgtaggttactcttgcaggaagctgcatttcttgaggtatattattcttctttccaggccattggatgctcatttgtaaaactttaaagtgcaattgaaagagaatagatatatgtataggaataactgaatcaggctacacatgttgagttatttttaaaatttcaaaaataacatatgaaaaacttttaaaaattaaaataatttgaaagtaaaaagagagagagtgagagagacaggaaatttcccataacttatcatattgtactccacttaccatgggaaaacaattgtaccagtttgggatataatattaaaattttttttccatgtctctcacatagacaaaaacatgcacaagcatacatatggtattatatactacatacaaacatatttgtgggcttacccattggctcagtggtaaagaatcctcctgcaatgcaatagagggaaggatctatccctgggtcaggaagatccccaacccactccagtattcttgcctggagaattccatgggcagaggagccctggcgagctacagtccatagggtcacagagagcaggacatgactgaagcaacttagcacacacaaacacaaacatttatataatttaaaaaaacacacatcaaattttatacatattatttattccctgcactctctatttccagctacactttttttttccagcacatggcttttatcctcaagttcaccctcatgatccaacatagctgctggaattctagccattccattgttaatccagaaaagaagaaagaatgagatagggagaatataaaaacaagttaaaagcttgacccagtcccatttgcattttgtttatacagctctggctacctctcttttcaaggaagaatttatttgggtacatctactccaagtaaaactggtgctcaatcagtaaagaaaaagaagagaatggatattagttgttgttgagttgctcagtcatgtccaactctttgcaaacctgtgaactgcagcacaccagggttccctgtccttcactatctctcagagcttgcttaactgacagccattgagccgatgatgccatccaaccatctcatcttctgtcacacc

SEQ ID NO: 42678 - DNA, 1571 bp, Bovine  19866880609427
attttattgggaaagggtgccagggcggaggacagtagggtaagggaacccaggagaactgctctgtcactctggcttgcaatctgggttttatggtgatgggattagtttcccagttgtctttagccaatcattctgactcagagtccttcctggtggtgcacgccttgttcagccaagatggctgccagagagaaggattctgggaggcggttggacatgtggtgtcaccttttgacctttcttgaactctaccggttggtggtggcttattagttccttattccttatctggacctcctgtcgtaaaacaactcatgcaaatggttactatggtgcctggccagggtgggctgtttcagtgtgcttccctaacacatatatgtgttaatatatgatatttgtttttctttttctgacttacttcactctgtatgacatactctaggttcaccattcaaaacttgagcaacctattgggtaaagggtaaagagaaaactccatatatttttcagattgccaaaaggcagtagacaaagacagtccccccgacccccaatctaagggtttatgtgttaaagtgtattaattaaggattgtacacaattaagcacctaattgtgttgaaaatgcaattacacacttaggagaattctcactagttacaaagttgtttctgtagtcctataatcattttaattgttccttaatctcccaatgtaaactatttatctgcatcctaatgaattcagtgaaagcttctaattaaatccagtgttgaatatttccacctattgcctaagcctcaaaactaagtcatggcaggattcagaagggcatttacatctcagaaaataagataccattatagaatttatctcagtgtttgtgctcagtgtctagaaatcaagtatccaaaatgccataaaaggaagtatgtgtacttcttaaagctttgttcccttttttaatctttcccaccatcacagagttcagagttaattcaatggaaaaaaatgtccaatatattcttctatatacctttggtgaaatgaaagaatattgggttattacttagagccgactagtgctttcaacaaagtcaaattaaaaagtagagcattgaagaacccgtttttcaaagagggtaaatattgattcatgtgtttatttattcactttttcaaatatcttcttcacatatttagtttctggcaccgttttaagaaaaacactaggaatatagcaatggattttatatcacatgacagaatgagagaaatcattcgctgaaattttggttgtctagggactattgataatctatctggatcttaattaaaattacagggtctttgtgtgataccccagagtttaacaagaaggaaaagtccatcttccagggaagcttccattaattggagatgactccttagttggtgttgatacaggaacactgagtaggatatgaagatggttggcaaaggactaattagattggttagtaaaacagccctatgggataaagatatagatctatgtctagatatacaactttaataaagtcatt

SEQ ID NO: 42679 - DNA, 714 bp, Bovine  19866880751427
ggaaggtgtggagaagcccagggagaggcctgttttcaggcaagacgtacagttgatctcgtttgtctgtgtgctcagtcatgtttgatactttgcgatccatggactgactgtagcccgccagactcctctgtccatgggatttcccaggcaagaaaactggagtggcttgccatttccttgtccaggagatcttcccaactcagggatcgaacttgcatctcctgcattggcaggcggtttctttaccactgagccatctgggaagcccacagttgatcttgaggggttgtgaatggttatgtatcattttccaccctcccctcttttcttaacaggaggccactgaaaaatcagatgatttagtctcttgctcctcatactcatcttttttattatactgttcttattttccatactacagatgatatttttttttttttttaaaaagaaagccttgaattcttatagaaatatctctgcattttctcctttctgcttcaggagtcggtaagatgttaaagaagatcaacaaggccatcgtctccaagaagaataaagacattgtgatggtggccaacgctgtgtttgtgaagaacgactctaagatggaagtgcccttcgtcacgaggaacaaagacgtgttccagtgtgaagtccggaacgcgaacttcgaggacccggcctccgcctgtgcgtccatcaacgcggggt

SEQ ID NO: 42680 - DNA, 724 bp, Bovine  19866880929983
tgagtgcttttctctatgggaaattgaaagtgtgaaaatgttagtcgctcagtcgtgtctgactttttgggaccccttggactgtagcccaccagctcctctgtccatggaatttttcaggcaagaattctggagtgggtagtcatttcctttttcaggggatctgcccaacccagggactgaacctgggtctcctgaattgctggcagattctttactgcctcagccaccaggaaagtccctatccctacgtgaattactttcttataaatcaggaaaagctggagaaagaaatggggtgtgaaatgtaccagttagaggaagaaagctggacagcagtgggaaaatggaaatgcttctatagatcacaaggtatagttacaggaccctcatcagaaacacaattccctctgaattcagcattccttgttacacatgcagtatgaataaaatactgagcactatttccagaagaatagcctgttataaaaatggcagcagtgaaagaaatggggacagcaggagcagtcatgaaagtaccctaggagtgccataacacatatttttccattaaaagtaaatgcttcacataaaaatgcactgcttcacagtaactactctattttgtagcttctgtgaatcaaacttgggctatcaagtgtataagagtggaaaataatgtgtcttgctaattaccatcttatccaattggcatgcagcctgg

SEQ ID NO: 42681 - DNA, 1866 bp, Bovine  19866880939529
agatgagttgctggggcttccctggtggtccaatagctaagacttcctcctcccaatgcaaggggcctgagttcaatccctggtcagggaactaggtcccacattccacagttaaagatcccacatgccgcaacaaagatcaaagatcccaagtgctgcggctaagacctggaacagccaaataaatattctaaaagaaagggaagagagagagagatgagttgctggagcaaggaatagcgactttattcagagagccagcagactatgaagatggtggaccagtgtcccaaagaaccatcttgcctgagttagaattcaggcttcttttatactaaaaagggagggagtaaagttgaacatttcctggtttccatcagtctccagaggggatgtgtcaatttcttcctccctgcaatcattcaaaggtgggcctggcctatttcctatgagctaaacaaaagtgtgttagcttagtgttgattacctgggaggcagggttcccagagatgggccagtaggtataatttaagcgtaaaggcaacatccctttagcaattaacttgtaagagaatacagagattctttcctatcgcaaccctgcatctccccattcagcataagagaaagtacttccatagctcttcctcaggctagaatggggagcctgttgcccacgaggttgaggacccccctacttgctgttactgttccgttttgccatatatatgtttgagagatggatcgttctctacttacctggaactttaatcttggggttaaaatttaagatatgactgttcagagtatacatttaaaaacatgtttgtaaacattttttcccactggcattgaatatatcattttgtatcatttataatgatgttccccctgttttctgcttttgtgctaggttcacagccgtagcacagacagatttgaaggagccgctgaaagtccttggcatcactgatatgtttgatccatcaaaggcgaattttgcaaaaataacaagtatgttcaatttagaatttgctcttaaacttgaacagtgtgttataaaccaagtttctgatttgttcaggaagaaaaggtcagcattagggatgtgttgctgtgaaactcttcagggtttcattggatgcctcactgaatgacgctgccgagcctccatcacttatatcagcatgagtcatgcatcccttacatttcccatgtacatttcatgggaaacctacgtgactgcatgcatttaaagaaacatttcatgtattgtttccattacctaaaaatttggctcttaattagatattagtctcttctttttccaaatgcacaatttccccctgtattttccaattttcaagatcaagaatgtttgagctctcaaatggcttaacttccaccaaacaactgcaggtgccagtatgtgcaaataggattttggcatctcaatcccattaatctgaaatataaattcaaaggaggctgattaattgcctttgccacaccatctgggacacagctggtatgatatcccttcatttgccagttacatgtaatttttttccctagagtcatatctcaatgtttggtctttgtctttttaattgatagcacagccagctccttccacagacaagacttaaaccattatttgtgctctattttgtacttttccccctgagtgataagagaatagttcagtaccaacctcagttgccttttagtgaacacctgggtacctgtcgtggggattaacgcgacttcccctggtaaaactgcagctccatggaggttctgagactctcatcctgtgttaaccaaactctcttccctcatccagctgcattagcatcaccatgt

SEQ ID NO: 42682 - DNA, 891 bp, Bovine  19866881045132
gttaagaattcacctgcaatgcagagaatgtgtgctcaatccctggtcagggaactaagattcctttgtgccacaactactgagcccaagccacaaaagatccccccatgctgtaactaagacccatgcatccaaataaataaataatatatatatatatacatatatttatatatatatattttttttttaaggaaaaacatggagatctcccaagagagtaaagaagagaagaagtcttagaccacagttcctaggcatcattggctaattcaccatccctttctgggtctcagattccctaccagttaaatgggagcaaagtaataatgatacatcctatcccaggctggaggaatctaggagtaacactctttccttttattcattcttgatcgccctctacagtgctggcaagtaagaagatatttttattctatgtcctaacatgttctcaaataggttgaaagactgatgagggctttggagcaaaacaaagaataatccttagaacacagttcattttcctctcattgaatgtggcctgaagataaagctccagaaaagtccttgttccttttcctttcagagtgctcacgatagcagagccagggatgttactaacttcttgatgtaaaccctctgaatctgagtgacattccatggctctaaggagtaaataagcacaaacctctgtattccaaccacataatcatatctgaaaattcagtttcaacaccaggatttacaaaaacccagcagatgcttttgtcagtcaatcaacaagtatttactgtgtccttagggcacgtggtatggatgagactgcttttgtgagcaagcaagtgtgctctctgcttgaaaatagaaattaatcacttgttcgtccaa

SEQ ID NO: 42683 - DNA, 891 bp, Bovine  19866881267140
tttctattttctggaaacccctccaatagatcaaagggagatgcctgagaggcagcagtcctagggggttggtcttgtcatatttagagaaggcttagaggaaggaaatcggggctagttgttttgttttaatttatttggcctcgtcaggtcttagttgcagcatgcagaatcttctttgcctcacgtgggatcttacgctgtggctcacggactctctagttgtggtgtgcaggctccagagcatggctcagtagttgcactcgggcttagttgctccatggcaggtgggatcttagttccctgactagagattgaacccatgtccattgcaacagaaggcagattctcaaccactggccaccaggaaagtccccaggcacattgttaaaaggatcattcttacttgcagatataaagttgggccctgaagaaatgagtgcccagaccagtcgtgtgtaacatttgtgtaactgatctagcagagagaacagagcagctggagctcttggtgtataaatgctattaaactcttctggccagagaactattaaatcggtcaggataagcggccagaagattgggcaaaaagcaagcgatagttcagtttactgaatctggagaaatatcatcccagtttcaagctcatgatgctcaacaaaaccccaaaccacagtgttctccagcccttgtagaaaactcagttccctactcagaatattaagacagagctagttgccatttcgcaaaattcaacagttccacctatatttactgagtccttgttatgagcaaaatgtggagttaaacatcattcaggaaaaaaaaaatgcaaaatggtaagagaactgagaaaccgatagtatgaaaagaagcttcagaggagaatgt

SEQ ID NO: 42684 - DNA, 762 bp, Bovine  19866881284568
caggaataagcagtatacacagggcatttgtgctgagcccatttggggattaagaaaagatgtagaagcttccaaaactgaactgatgatatttcaaattgtaagggtcaaagtgagaactatcccatccatagatcctgataagaactatttggataaaggaggacctaagaatagagtatcattattgtcatcatctccttaggaagtatatatatatatatatatatatatatatataaatatatataaagtacataaatatatttaaattcctataagaattatatacataagcatctatatatataagatttgaaaaagaatagatatatgtatatgtgtaactgaatcacttttctgtacagcagaaattaacacaatattgtaaatcacctatacttcaatgaaaaaaattatagggacttccctggtgatccagtggttaaaactctgtgctttcatgcagggggtccatgatttgatccctggtggaggcactaatatcctgcatgcagcactatgtggccaaaaaaaaagaaaaagaaaaaattacaaaaaaaaaaaaataaataagtgggcctaaatttatgcagcttataaagggcagtgcccatactcctaactattatactctcctgcttctaaaagaatgaagaattacctatattgagtagaaacacaaaaaagcattttgttttatgactaggtttttgagttccacagccaaaacctatgtttgattcatgagtttgcttcatt

SEQ ID NO: 42685 - DNA, 2355 bp, Bovine  19866881285056
cttgatttttctcctggattatgtcggcaacacacattctgccaagggcctagggcaagttttgaaagaaaacatctttttcaggtgatacaacacaaaaattacaaggagcaataaaacccttcagtcttatttctaaaggcaagtcgacatctactgcagatcattctagaacatgatgacctgacctcctttcctaatttgtgccactggccattaagacatcttagtttaattgcctgtcttaaactgttattaaaaacacactttcattaacaactgttatttaaaactatcaagtcccttagttatgtcacacagaatgatgctgtcttggtttgatcccctaaaagcaatgcagtagtatttttctatatccatcagtaagactaacaaaaatactgctgctatctattttaaaatctatccttaaaatagccctaaagtaacaagacacatgtactgccggttaaaaacaaataaatatctgaatattaaaagacaggctccccatttcctacctcttccccaatcctagtactaagtggccaaaaccttttaaattaaaatgccatttgataacaaaagattttgctaactgttctgggaataacttacaagttaggaatacctgtgcaggaccttgttaatagtcactgctctgggttaccaatttccttctacgaaaaaagttttaactaaaagtcaacctagtttaaaaagctttggagttctcttctgaggtgtctactgaagtgtcacggtatttacaggggctcatcttgggctgcaaatagactgtgtctttcaggaggactgggctgttccacggagcagactgctcgtttcccatcccagtcacgctggtagctgggttttccattagtcatccctaattgcaatgagaaaaagtcaggcggcttgtgcgagtcccatgttaacagcaccatagagacatcttgtcctcagagcacatctgggggacagggaaggatgtggactcccttggttagtatagacactgtacagctcacttggtgacaacagtaaggatccgcccacggcacgctggctgggatgagaaacaactgaagtggaccacacactaagtgcagacatggcactacctggagaggacaggtaccatcaagaggtttgtcagtgactaggggcagagaatgttcacagacgccagtggacgaggaggggctctgggtttctaagacccctgcacccccccaagagagaacgcaagtcctcctccctggacccctgctctgaccacagagatgcgtgggaacccccgagggcccagcaagtctgggaggaggggagtgtgtttgcacttggaattgcttgcagaaacttctaggctttaagtctttcgttcagtgtttttcttctgaaactctcgtgtgctaaattactgtctcggcacacatcagctcactgctcgcgggacgtctcgctggagtaactccactccttggggacccgctatgtcagtccccacggatagttccataaatgcccaaaaacacacgttcacgttttgttctttataaaaatgctgatttgattttagtggctggctgtccatccacctgaaagggactatggagctagagggaagcgttgtgtgtaggggaaggtggccgccgtgaagactcagaccccgctggcccctgcatcagtgtggagagaagctggttgccagactgcagcccaccacgggcgtcatgtcccaaatctgcaagagaaggagggggaggacctggagaggtggcactggctacgtggtcccacaggaggacagacagctggtatactggcccgcaggtcaagacacacagctcagcctcttctttccctataaagcttctggagatttacacagtgacaagacaatgtggttggctagaacacaaaaaaagcttataagcagtatttctctcaacacctgcgaattacatcataataatgtttcactacaatttacttttatttttaataaaaagcccactgggaaaaagtccatttttaaaattatgaaacaaattatgacagttttatggggtttctcaggtggctcagtggtaaaagaatcgacctgccaaagcaggagccacaggagacatgggctcaattcctggcttgggaagatcccttggaggaggaaacggcaccccactccagtattcctgctgggataattccacagacagaggaggctggtgggctacagtccacggggtcacaaaccgttagagacaagtgagcggctgagcactatgcaggcatggcagttttataactcaagaatggcactaaggataaagcgctcacactcagttt

SEQ ID NO: 42686 - DNA, 839 bp, Bovine  19866881358810
tgcagtccctggttgagtaaccaagatccctgagttgtacggcacaaccaaaaacaaacagaaagaccagaaaaccccccagaaaaccagtcctgcaacttcggctttctgtcatcctttaattaaaattggttttcaaaaccatagccacatttcggggagcaaattttgacactgttaccataaacatttcctttatgttgctaagacgactcatccctcagctctagaaaccatcgggtgagtttaaatggcctctcttctctctgttagtcggacatctctagcaaccttccatgaaggaaaacataacatctcccacatgtccatggatgttgctaggggcctgatggtgacctgcgggaccgaccgcgtggtgaaggtaagctgcctaattgtcccaattagcacctccgtgcagactgctccactgatatgctgtgagtgtgtaaggcagttcagatggacaagctcgccttccctttggatgaactccccatggcgaggtgaaagccctggctaacaaattgcatgtttgtgagtttccatgcccttcccggtggctcagtccagtggggtctccctccactgtctcagtctctccaagtaagctggtgagggtctgccacctctctgtcgctatctgccctgagccggccccagggtcctccctcccactgcctggccttagctgacgtctttctctggtcgctccttccctggctaatggtcctttatcctgggtagaatactccccatttataagaaataaccatactttcctttgttaaatccctgagtgactagcacagaaactgagtgtgagcgctttatcctta

SEQ ID NO: 42687 - DNA, 1476 bp, Bovine  19866881367188
tattttgccaccaatgacctatgcaattaactgcagggttgaggacttcaccagcttcctgaggtgcatcctgagggtgtggatagaaactatgtgcttgaggaaggaaaactgagattttgaattaggttaagccgattgcattcaccttcatacaaaccaatagccagttacactacagttagctgttcaattaagttacctcacaaggcataaagagatattaaccataaatttttcattctggcttctaatattttttcccaaatcacagaccaagttcaataacttatttttcagtttctaagatttcaggaaacaaggccaactttctccccatttccatcatctgactcacacgccaagcccctgaggaagcaacagcaaacatactggtgtcagcaattacaggctgactcatgcgagaacgtgcacaattaacctattgaacatctctcgggcaggcgtttcatcctccgtaggatcagctgctctgcattcacccagggtaggcgcccagccagcctgccgtgtgttcccacgcatttccgctctgatggctggccagaaacaattcataacctgaccgctagcagcatcagcaacagagctcaaactccaaacattccgtctaagctgaacagatcatttccaggttaccctgctgccacggtgttcatgccatggagggccctgcggggctcctggacacaaggcctttgtatcctgcatttctttgatcataggaaacagccttcattcagcctctagaaccttccctgagttccaatgggcagatccaagcagctgttaattagagaagggagggcgggtaagaccagggagaaacagtcaagagcagccctagggcaaggtcccatttcccacatcaatggatagacacaacaatatctttgagttactctgcagatactgaaaccccctccaggtgggagaagattaaggatggtatgctgcccacaagcctgtagaccccagacctgttggacctgaaggctgacatcatgaactcctacttgtgtgcttggttgctcggttgtgtctctttgcggtcccatggactgtagcccactaggctcctctacccatggaattttcccgtcaagaatactgaagtggagtgtcatttccgactccagaggattttcccgatccagagattgaaccctgtgtctcttggttctcctgcactggcaggtggattcttgaccactcagccacctggggagccatatagattaaccatttgccttgctgaataaggatataaaaatcacttgatctctctaaatttcagtatcttcatttgcaaaacacccaactaacagactgttggtaagaatgtaatgagatacatgatgtaccagggttacaaataagcattcattctctaccattcgggtcctcccaaggtgacgctatggataaagaatctgcctgtcaatgcaggagacg

SEQ ID NO: 42688 - DNA, 486 bp, Bovine  19866881394448
caccccaccccccgccccacccccaccattccctcaaacacccaaacagtatgaccttgtatttaaataaaaactacccttagctcccaatgggtgatggtgttttgtctggaagaactactgatgtttctataataaggtaataatggttgctcctctcctatctaacctctatttaaaatacatttcatcacaactcgacttgttacacaacttcacagatgcaaatgctgtttcataagatggttttaaccagaggcaaggagattggttacaatagttcacttagacaattagtttctggggctgttgcattggtctaatttctttctctttttttttagcttataataggcaattgtctttttatttctctttcaagttggctttcaaataaatccagtttcctcttgctgtaacttctgaaacaattcacgctttcccattgtcatcaatactttcccccaagagcttcagagaaaagat

SEQ ID NO: 42689 - DNA, 1485 bp, Bovine  19866881535973
gggcctagaggatttagatttaagtgaagaagatggtttacttttaattgctgtgaagagtttagccatccaaaaggcagtcatttggggcagtagtaaatttaaaatttaaaaatatattaactattggtaacaacttgccattaacactcagttactctatggccatagcagtttgtggtaaatcaggtgtctacacacaataagataattactgttttaattccaaaacatggatcaaaaggaagaccacaggctggaccacaaagatgtaattctgtgctattttctatcaatccatatgaaacacataacagaaaagcctatatagcacatgatatatctgagtagtcttcccttgtttgattctaaagtgtatgatactattttaagtatctcatgatgtacgttcatttgtagcaaacatttttataaaggctctcatggaagaaagaatttcactacaccagatgtccaacacggaaagagaaaataccatggggcgtttgcctgcggctgacagccttgaccttgccagcactaagatacatagctaccacaggcagcctgatgcaagagcgcactctacatgaaacgaatacagcagcagaatttcagagcggcaatttcttaacatctgagggatccagaggcaccttcgagagtcatataaggattatgaaccctcttcaaacacacacaagaaaatgaaaaaactccttgtagcccttttatgaattccagggtcacaaattcttatattctcttgccaggtctgcaaataacccactactagaagattcattcctttttttccctctttacgcaacaaaaagtcttttctttcacttcaaaaagcaagggagtgaaggaggggtctgtattaatgaggtttagattttctgagatttctatattaaaacacctatggcacaccccagcagagaacagcaattcatttatcacttttaataaaccgtttttaaaagtatttcatttgtttgttttaatgtggaccacttttaaagtcttttctgaatgtgttaccatagtttttctgttttctgttttggggtgttggccaagaggcgtgagggattttagttccccgactagggatcgaacctacaccctctgcattgggaggccaagtcttaaccaccaagtcctaataaaccaattttatacccaagaaaagagagacataaattcttcgattttatgtgaaatatgtaggaatcattcagcctttaggtctcaattagcagttgaggatcagatgcagagctaactgctgagactgggaaggatactgcagacacgaggcccaggaagagaagaagtgcctcccgagcatgttcccgctgcgggtgcacatccaactgacacacttgtcgtggccagtgctgatcacccactcggggccaggctgaagatgatcgccgtcacccggttctgatgagctgcgggagcagagaagaaaca

SEQ ID NO: 42690 - DNA, 1317 bp, Bovine  19866881673251
atgtgcttcttggtcttctaagaacaacttcactgagcatcacctatcccttgactttattattaggagacatgctgcaatgcactctcatagataagagaagcatgccatttgtgtgggaggctgaggatgagggtgtagtcttgcccaatccaggcaaaattcatattgtaaggaacactggctttctctatgcttctcaaaatagctaagcttactcccacctcagagtctttgcacatgctgctccatttgcctgaaattatctcttcccatatctccaaagggctcagtgatttccatcattttggtggatgctcaggtaccaccttctccaggaggctgtccttgatcttcatatgtaaaatgaatcctatctccttttatcatgttacacaatttcattttcttcatagcacttgggaaagcattgttatatatatcctttgtaatcttttgttgatggagaccttttatattatttttagatagctgacttaggctcaaaactgaggacaaatcatttgttacatactcctgaattctaaaaattggcataagaaatcagggccggcccttcccttgggtctatctaaacagctgcaaaaaatggccctgttaacctcaacaaaagggtagggagaatttctagaaaaaaaaaaggggggagccagaaagagagagagaaagcaaagaaccactggctttgagtaaagatgagaggttacttcctccacttctgccacgactctgcccagccaagtgaccctggaatctccaagagatttgtttctggagttggagttggaaagaccacatctgcttcatggagagaagattggctgagctatctggtgggcaggatgaccctggtgtctgagtgcattgagggagttgctgtacaagtttcatgaagattctggggagcctggggtcatgagtaaacaggggagagtttgtgactgcttctcacatagaattatgcaaaggtaggatgctgaagctgaagctccaatactttggccacttgatgcaaagagctgactcattggaaaagaaccggatgctgggaaagattgaaagcaggagtagaagcgtgcaacgaggacgagatggttggagggcttcaccgactcgatagacatgaatttgagcaaactctgggaaatagtgaagaatggggaagcctggtgtgctgcagtccatggggttgcatagagttggacacgattgagcaactgaacaacaaaggatgcttaatggagaagatgggatgccaagagtgagtttggaatgtggtctggtgtacctggagaa

SEQ ID NO: 42691 - DNA, 933 bp, Bovine  19866882226918
attgatgttctgggcagaacttcttcttgccctcagtttcataggctaaatgctcagctgtctaaacttacctggcttgtgcgcgtgtctaagattaagcttttacttcttcccaaagttctgtagccaggacagtgagtattaatccaaacattactatcggctgataacattcctgatatgaatacatattcatcttcaaacagtcttttacatgaaataactgttagagttatcaggctttgaaatgcttactctctagaaggaagagattctcattatgggaggaacatagtaacatcctattttatttttttgaaagaaatcacactttaaatgttcaggtaaaagaaggaataaagatgtcgcccaaatgtattacacagcatcaatatggacgatcctgctgctgctgctgctgctaagtcacatcagttgtgtccgactctgtgcgaccccatagacggcaacccaccaggctcccatttcttgaataatcttttcatagtagtgaaaagtctctactttaagccattcttgtagggagatcacaaacctataaataaagccattatttcaggtgaaaatgaaagtcactcagtcatgtctgactctttgcaacagtccatggaattctccaggccagaatactggagtgggtagcctttcccttctccaagggatctttccaacccagggattgaacccaggtctcccacatcgcaggcatattttttaccagctgagccacaaggaagcccattattataggtatatccttccaaatgtgggcttctgtttccccatgaacttcttgtttctgacttcaaatctttcctttccagagtgaggaatgtttttgagctttaagtgagatttagtgttgtaaatcggcttcccaaatggcactagggtaaaaaacctgcctgccga

SEQ ID NO: 42692 - DNA, 851 bp, Bovine  19866880492441
tgtactgactgatccccaggaggtgaaacgacatagttgattcaaaagaaagagaccccatcgaactttcgagtactcctgtttttggtttgttgcttgcacggaacttcaaatatttcatgaagctgatcattctctttggccaacgtcacatccaaagaactgtcaaacaaattaacgtttattactatgactttttaaagctaccttatgacttgatacaaagacttccttttttttttttttttggtcaaaaggaaaaagctcttatgttgggaatgtaaaaagaatttctttaaaggttttccgaaaagatggactcactgcagatttcattcaacttgttttattttatgttgctcctttgcttgaaaaagtcattccttatatagaaggatagaaggataaagaaggtttgcaaagaagatcaattccatgaggctaatgagatctggggtttttatcttcaatttgggttgtcttttccacaggcttttttttttttccccaaaaaaaacactaattcctttgaaggactctattggccctgaaggttgctatcacaaagctaggacagagctaaattattttttctaccacatggaggcattgaacaaccatgtgattttcaaaatttaccaagatttgataagagttgaaaggtttctcaggcaacagcaaaaaggtgggtttgatgtcgacaaatgactggcacttagtatggaagcattcttccccgtttataatttagcatctcctctgaggagcctgttctctaaacacactagctttcagcctcctacacgttgataacataaggacacactgtatttgaacatactggattgcag

SEQ ID NO: 42693 - DNA, 589 bp, Bovine  19866880715810
tccctgggtgctgccgtcggggttgccacaacaggacttcaaggcatgccccacgcgaaagcagattttaatgtaaaatagatatgtgtacctaaaatggatctctccacaatctgagatagtaataacgttcccaaaacccggaaccccgtatcccttcctctttcaaagagtcttgtagagttgggtgccttctgttttgtgataagaggggacactgctccggtatatgtttaaggtactgactctaactctgtcactcggagaacaaagcggacttttctggaatgaatcatgccttagagaaaaaagtcacatgtgttccttgggaaacttgcaagctcacccccagtcccagagggacagaggataatgatttcgtgttgttggctgtttactccctaggggttctgaaacacgggttttcctttgaaaggaaagatgcctcttttttttttttttccctaaaagccatcacatggctctccatggcatgggtttggccctggcacccaccacaaagacatctgtgtgtcctttggggctgggtgccaggcccagagactgcccagactttctgcccatcttc

SEQ ID NO: 42694 - DNA, 1522 bp, Bovine  19866880810610
cccggccccacatccgacactggcctcaccgtttctctgtcttgggtccgaagggaacccccttccagctcaccgcacggtcttcctggcctttcctcagcttagccgagcattacttttaaaccctcattctgatctttgttttgtgtttacagaagtagattccttttattcctttccccagacaggcctaatccctttggaattcgagcttttaaagagcacctccttggttatggaaaggcagcccgccaccctgctgcagagaggaaacacgccccaccccttcaccgccccgggcaaaggcaccctggctcccccttccctcagcttccctcccatttcttgttgggttggcaccaagggcaacctggaaaaagaggagggaggggtagggggtgcagggggacagagaggcggaagcaggtggctcaccctggaccctgaggcctgaccgcaccctgctgagggatcgtcatcgaaggaagggacacagtgccaccaccccagccacccagctgccaggaagggggcaggcagccagggcgtggctgccacaacggggagccactgccaccggggccctgccagggcggccccacgcaggaaccaagggcgggagagggcacctgatgacgcctctcactcctcctgcagctgcaggtcccgagggtgctccctgataaacagctgttcacaaagcctctgagttcacttcccggggagaccgagctgggaagcagagaccgttggcacaacaggtgaacgccctaacacccgagaagacagtgcgctacggttgtcctttcaggggacaatgatgaagtcactgttccatgtggagttggagcacacggcatcagtgagttccctcgggcctgcgtgcacgactccatgtccatcatgcagagattaaaagtcctgagaggtggttactctgttcccccattttacagatgaggcgaccgaggaccagggagaacacagtcctcgctcagggcaccgcggctcgtggctacgctgcggctgaccctggaggctcattgcagagtctgtgctcccacaccaggcgcctcctcctcccctgccaatgggctaggttctcctccagggctagtcctcctccagggctagtcctcctccagggctaggttctcctccagggctagtcctcctcctgggctagtcctcctccagggctaggtcctcctcctgggctagtcctcctccggggctagtcctcctccggggctagtcctcctccggggctaggtcctcctccggggctaggttctcctccagggctagtcctcctccggggctagtcctcctcctcccctgccaacgggctaggtcttcctctggggctagggcaggtggtctggtctcggtccctgccggggacaggaaggcaacaaagaaggataggaagatgagacaacggaagagcagagcttgaatagaaatgcaaatctcaaaagacattcttttttttttagttaaaagcgtgtctctcggaggt

SEQ ID NO: 42695 - DNA, 3961 bp, Bovine  19866880926364
aacgatgagttggacaagagcctcaagtatgctttctgttctaggttcctaaactcttttgattttgtttctatggggatttatgctgtttttttcacccacaggtcactgttgattcagatcagctattaaaatcccctatccttttttaatgcattctactgagttattgttgctgttgttcagtcgctcagttgtgtctgactctttgcagccccagggagtgcagtatgccagagttccccgtccttcaccatctcccagagcttgctcaaactcatgtctattgagtcggtgatgccatccaaccatctcgtcctctgtcgtccttttctcctgccttcaatctttcccagaatcagggccttttctaatgagttggctcttcacatcggatggcccaagtattggagcttcagcttcagcatcagtccttccaatgaatgttcaggatgaatttcatttaggattgactggtttgacctccttgcagtccaagggactcgcaaaagtcttctccaataccacagttcaaaaggattagttcttcagtgtttagccttctttatggtccaactctcacatccatagatgactcctggaaatactatacctttgactagaaggacctttgttggcaaagtactgtctctgctttttaatacgctgtctaggttggtcatagcttttcttccaaggagcaagcgtcttttaatttcatggttgcagtcaccattggcagtgattttggagcccgagaaaatagtctgtcactgtttccactgtttccccatctatttaccatgaggtgatggggctggatgccatgatcttagtattttgaatattgagttttaagccaactttttcactctcctctttcactttcatcaagagattctttagttcctcttcactttctgccataagcgtagtgtcatctgcttatctaagcttattaatatttctcctggcaatcttaattccagctcgtgcttcatccatcctggcatttcccatgatgtaagctgaatataagttaaataagcagggtgacaatatacagccttaacatactcctttcccaatttggaaccagtccgttgttccatttcctgttctaactgttgcttcttggtctgcataccagaccaagaagcaaggtttcttgggaggcaggtcagatggtctggtattcccaactctttaagaattttccctagtttgttgtgatccacataaaagctttagcatagtaaataaagcaaaagtaattgtttttctggaactctcttgctttttcgatgatccagtggtgttggcaatttgatctctggttcctctgccttttctaaatccaacttgaacatctgcaagttcttggttcacatactgttgaaacctggcttgcagaattttcagcattactttgctagtgtgtgagatgagtgcaattgtgtagtagtttgaaccttctttggcattgccctcctttgggatcagaatgaaaactgcccttttccagtcctgtggcaactgctgagctctccatatttgctagcatactgagtgaagcactttaacagcacaatcttttaggatttgaaatatctcaactggaattccatcacctccactagctttgttcgtagtgatgcttcctaagttctacctgacttagcactccaagatgtctggctctatgtgagtgattacacatcattgtgattatccaggtcattaagatcttttttgtatagttcttctatgtattcttgtcacctcttcttaatgtcttctgcttctgttaggtccatactatttctgtcctttattgtgcacatctttccatgtaatgttcccttggcatctctaattttcttgaaaaggtctccagtctttcccattctattgttttcctctatttctttgcattgttcattgcaggaaggctttcttatctctccttgatattctttggaactctgctttcagatggatatattttttcttttctcctttgcctttcgcttgtcttcttttctcagctatgtgtatggcctcatcagactaccattttgcttttttgcatttctttttttggggatgattttgatcactacctcctgtacagtgttatgaacctccgtccatagttcttcagacactctttcagatagaatcccttgaatctatttgtcacttccactgtataatagtaagggatttggtttaggtcatacctgaatagcctagtggtttcccctattttcttcaatttaagtctgaattttgcaataagagaaaaaaagattaaaaaaaaaactccaatattttataataattatcaatggagtaaaccctttaaaaattgtgaatcattattgtacacttgtaactcatgtagtattatacaataactacatttcagaaacaagtacataaaagagaaagaaaaagaccgttagagtggtgattaagctctccaggactctggaggcgggggaatggggcgtgtctagcatccctcttcagttcatgcatttctcctgctgctggagatgatgctttgagcagggagggctcaacatttacacgaatgaggggccacaaaagcggggcaggtcaggcaagaggggaagggcctcgggagcacatagtggggtggcctcagccagagtaggtatgagaacgtggtgtgtgggagagagggcgtgcttccggggagcagcccgcgggcgcggccagctgcaggcggacagtgagagaagcacgtctgtgtggacacacggcctggtactaacccacgcctggccagtcctctcatgtgttaaacaggtctgtcatcttctcagaaaaagagcagcatgagtagactcgctctgtttttcccttgttccagtgattttcacagcaatgcctctgcgctcccaggaaaaaagaacggtctcgtagcttcatattatctttaaatgtgcttttgttgcgtgcttatctgcactggcggacgttcagtgtacagaccccacggtgcatgctccatttttaaaatggggaaaccacgtaaggaagttaaatgaggaaagacagaaaaacatcaaaacagagtgcacacagcaaggttaaattgagtcccgttaaccccctgctgacagcaactgatagtgtagaagcggcagcaggaatctgaaacacaggttactgttgggcaatttcagctcatgacagttacagatgaaatatatcggccagtttttcttcctagggtatccctttaaagaacatttaaaaggtaacatcacagatgctacttggtatatatgcagtagaaataacacaagctaaaataatatcttagtctgaagttagaattcaagtgagttttccgcatgcctgtaaaaaagtaaggtataatttatgtgccacaaagtatataaacatgaagttttatttatccatcatataactcagtgacttttcagataggaacaaacccctgtaaacagcaatccgatcaaagttctgaaccttgtcaccgccccaggaagttccatcatgcctctcaaaaccatgtcagtagttattcagaggtttggttcactagttattctcaatttacctccagttctatataaacgaccgttatcagtttcaaaattacaggcttgtagcatgtagccttctcctctccccagtgtgtttccagaacagttctcttccacttttggccttattctctcatattcagctaaatggaaaacagctcttatttcacgggtaagtagataattaaataacaatgacatagtcacccttggttgaaaacttgctctttgagaatatacgtaattgagaaaatctgagaaccaatcgacgacattgaatggaaagtataaaatattcataacactgtacatagggtatacatatttaacagcttaaaacccatcccttagaaata

SEQ ID NO: 42696 - DNA, 2297 bp, Bovine  19866880940525
cgggtcccgggcccccttttcctcgactccccttccccattccccgcaaggaactggcctgtttctgggcaactggaactgctctagcgggctccccagtttgtgaaacaaactgcgtgtcatctggtgacctgcttcttaccagctctgctgtaaaccctttcgagggaaaacacatgcgtagaaaatcacgaaaatttctaaatgtcacaggtcacgtcttttcctcttaagagattctcgacgtaaacgaatatattaaaggttctgagaattcttgcaagagagaaaaacagttgtttaaatttgtttcaagcacccttcaaccacagagcccctccctgagggggcaaggggtggcatctgttaatatcttaggaaacaggggttctgaggaagccgagagggaggggctcgggaagacggggttggaagcctcaggagtaaggggaccctgcgctctacttacctgttcgcgggtctgtagggtgagtagggagcagtggtacatgcaagggtcctgtggctcatcccttctctccttccctagtgaccaccctcccttggtgggtgcctgggaaaagggatcttggtctaccagtatgccagtcccaagtgggcactcgccatcctgctgctggagaataaactttgaaggggtatttcaggagaactcagggtagcagtctcaggccagaaatttgctctccttaaataggtcagaaacaccaaaggcaagaatcagacagtggggtccctgagcagagccactcactcagctagctcagaggctgacaacaaacagacaagaaaggcccatcaatgctgcaaaccccaaacctttccgtcattttgataaggctcgggcttttgactctgtggcagagtttaccgactccagttaattccagcttcaagtaaacctttagatgttgatactgattaattgtcagcctaatctttattcaaatacatcaatacgtttaaggccaacataaaaaggcaaatatttgccccttgtgcgaaagtaaccagcttttaaataatagactttgctggaatcactagcaaccattctttatctttttctctcacgttccaagcaatctggcctagcaaactatatttaccaagtaattaatttgtttccccttaaaaaaaataaataaatccaaacatgtgtcatttggctgtcttcccagatgaaagcaaagatacttggtatctgagttatatttagtcgctcggttttaatttggcgttgattctgtctcactgtggtttatatttaagtagatgcagagaactgtgatcctgctgacccaactacctaaagaatacaagcgaatgctgctgctgctcacaggtcttgaaggactggaattggagcacgttttcactcattcactcgcttggttttcagtggacaattctgggacctctcctctggagaactggcgtcccactggaatttcctatcctccatgtaataaaactgtcaccaagctcataaatagatgcagattcatgatggttccgatgacccctccctacgtggggctccccgagaatggctcccttccccactccatcccttcctccccagaaccggcccctccccactcccccggtcccctccggcagcgagggtgcagttgggagccctctgggattcagggtttcccatataaggcaccagaccctggtttacttcgtctgaaattcaccaaggatacacgcagagatgcagacgcagtcccagcttcctgggtgcccagcccttggagcagaaggaaaccagtgagtttcatcacgtgggagcgggggagcccttctggggggtcctctttacctgttcctagtccgggcttccctgcccccctcccaccccccagcaccagctcctggcccgcagcagagggcggtgccccagagcaggagcgttccctgcttcacctccaggagccagcaaaacgtctgtaggagcgacatgttccagctgatccttgaggaaaggaaattcctgcagctggaaacagcagagatctgtgggcgggggcgctggagcgagaagccgcctgcctgcctcctagcaggagccggaagaggcctgagagacccgagtcgggtgggcaccagcttccctggggcccacacagggggtcagacttggggggggtcctcctgcgtgtctctgaggttcatgcctctgacatgtcacagacacggcagattgagcttcccctgcccagcacaggaccggggttgctgggggtacagctctgtgccctgggggt

SEQ ID NO: 42697 - DNA, 1497 bp, Bovine  19866881131534
cgcttcgatcgtgtctgagtctttggtaccccatggactgtagccctctaggctcctctgtccgtaggatttttcaggcaagaatattggagtgggttgccatttcctcctccagggggatcttcctgacccagggattgaaccttcatctcttatgcctcttgcattggcaggtgggttcttgaccacaagcgccgtctgagaagcccatctgagccctaactgttgctaattctgtctgagacattctgtagaaagaacattaacaaccgggattgttgtgggtttctcaaaagcctagaaattcaaccaatctccctcagctagaggaactgggccctcttgtttgatgtgcaaattataatgagtgttcattacaccaaagcaggaatttataagctgccgaagcatatctgagagcgtcaagtgagaagcaacttgaacacacacgcacacttaaagctattccaatgtcttccagaaatagaaacacctatgaaaactcagtttaagatcatgaaaactctttaaaagccctagctggggcattggaagattccacatcttttggatatggcaattatctaacttcttccactgtaatcacaaggaacagggttgagcaggtgaatcacactctttttacagtaacgaccctgtaatcactggaaaagaccccgatgctgggaaagactgaaggcaggaggagaaggggacaacagaggatgagatggttggatggcatcaccgacttgatggagattgagtctgagcaagctctgggagttggtgatggacagggaggcctggcgtgctgccgtccatggggttgcaaagagtcagacacgactgagtgactgaactgaactacagtaatgacaagacggaaattaccatgaaaacttccaatccccaaattccaaagtaccgtcatctgatagaatgtgcttatttttctttccacttgtaattcacagaactcagcttccacgactaggattcaggtgggaaccaaggcccttctaacacagggccagggaggccagttctactgattttccaagagaagctggaaatcctcttttttggggggaggggttgttgataagcattgaaacgttttttgaatttctggagtctagttggttcacagtgctgtgttagtttcaggtgtgcatcagtgactcggccatgcatatagttcatctattctcttttgggttctcttcccaaataggtggaaatgaaatgcgtgcatgattggttttgtctgactctttgtgactctacggactgcagcccaccaggctcctctgtccatgggattctccaggcaagaatattggagtgggctgccatgccctcctccagggagtcttcctgacccagggatcaaacccatgtttcttgcgtctcctacgttagcaggaagattctctaccactgggccaaggtgatcacagggtaaaatcccttgttttcagtgctggcatctaa

SEQ ID NO: 42698 - DNA, 2330 bp, Bovine  19866881136102
ccttacacacacatacacacacccttacacacacatacaccctcacactcacacaccctcacactcacacccacacacccacacatacacacccacacacagacacccttacacacacacatactcaaccctcgtatctcttaataaagaactggatgtctctcctgatgtgctgagcacttcatattatttacctctattaatgatttcctctttgaagctctttatgttttatctgaaaaaataaacatttttgaagaattcagtaaattttaaactgataatttaggaatatatgcaagaatcctcactagatatactctataagggaaatgttggtaagtagatgcaattaaaagaagatccattctactcattttatttgccacaaatagtcattgaggtatattttccacagggctgtatattttgtttggttttctaaacctcagtaagacagtatggtatatgtcagtgcccagaatttgcttactggtcttatacaaaatggggaaaattttaacaggtctagacagttgattgaatcttaaaactgtatattttaaaaaagaatcattcttaaaaacaatcacggtgtgtgtgtatgagtgtactaagttgcttcagtcgtgtccaactctgtgcaaccccatggactgtagccaccagactcctctgtccatggattctccaggcaggaatactggagtgggttgccattccctccttcaagggagtcttcccaacccaggaactgaacccgcatctcttatgtctcctgcattggcaggcatgttctttaccacctgggaagtatgtgaagagtagttatttaaactaatttgcaagtgaaattgtaattgttcaggcacatgtgagtgcatcctcatttaggggcagtgggtctattcactgctttaccctcccccaaaagaaaacagctctagatgtgtaatctccatgcaaatctcgtcagcatatttacactggaaacaaatgtagccaattatagaaaaataggtggaactattcaaagcattcattacctctttcagggcaatgggataaattaaacttcataaaactgctgtaaaaataactactttagaatttaagtacagttgtgtaatttactgctggttaccagattccatttcaacagaaaaatttagcttccaaaaaaaagactcccaatgaagtgctgcgtctgaaaacccggagccatgcccccacaagcatttaaagattagggccctgtgtggcccgtttcacgctgcatcaagaggggcccttctgggcttccctggcggtcctgtggttaagatgccacgcttcccctggagggggctgaggtttggtccctggtccgggagatcctgcatgccatgagatgcaaccaaaaaggaaaaaaaaaagagtggcctttccagtccaaaaagtacccccaacggtttaaaccgtcttgattaaatacagtggtgggataaggcccctgagagtggggttcctgccagcctccggctccgagttgagagcagtgtctcccacccatcaaaggatctgcagggtcagagcaggaagcgagcttcctccaacccattccctccattttaataacgaatctgggaggaagaattcaagtactgtcataggaacgatccccccggagtaggaaatgggaacccactacgggcgggttcttgcctggagaatcccatggacaaagcagcctgcgggccacagcccgtggggccgcaaagagttgggcatgactgagcaactgagcacgcacaccgcacaggcgtcagtgttatttgcaaagttaagcttcagcgtgggtcagattctcatgagtgatgacttgtggaggcagctccctgaggagtcatcgtccgaatcaggcttatgaagcgaggacagagaacactgctggactcacagcctgcactgcgtcccttccagcggcagagtgcaggctggctcgcagctctgtggcgtgaagaaccccaagttcctctgagtccaagccaaattacgcacctactcctttgctccagttattttgtgtcagtttcatttctctgggctaaatggggtctccggagttctctttaaaaaggtacaaacctctggaaaagatggcctattcggtgccagtcacattgagatccaatatatgatcatttcctctgggagaggaagatctgtgagtgtcaagaagggaaagtggctacggcagggagttagccagatggggacgaggcagccagatcaaggggcattttccctgctttgcagagttgcactgcagttagctagaggcccagtta

SEQ ID NO: 42699 - DNA, 3551 bp, Bovine  19866881240788
cttcggcccctgatgcgaagagctgactcattggaaaagaccctgatgctgggaaagattgaaggcaggaggagaaggggacgacagaggatgagatggttggatggcatcaccgactcaatggacatgaatttgagcaaattttgggcggtcgtgaaggacagggaagcctggcgtgctgcagtccatgggatcagagtcagacatgactcagcaactgaactataacaaccccagtacttgtagaaaaaacagggaagaagctcttccttacgggttttggcaataatttggggggaggggcatgacaccaaagccacaaacaataacgaaaataaaaaatggcagcacatcaaatccgcaagctccagcccagcagacaagtaacagaatgaaaagacagcctacgaaatgaaagactgtctctgcaaagcatacattggcaagaggttagtatctaaaatgtataaagtgaaagtgaaaatgttagttgctcggttgtgtctgactttgtgaccccatggactgtagcccaccagcctcctctgtctgtggaattctccaggcaagaatcctggagtgggtagccattctcttctccaggggatcttcccaacctgagaatcgaacccaggtctccagcgttgcaggcagattctttattgacattcagtcagttcaacaacaacgacaaaaatgatagaaaaatggcagaagagctcaacagacatttctccaaagaagacatacaggtggccaacaggacatgagaagatgctcagcctcacgcaccatcgggatggaagtcacagccacagtgagctgccctctcacctgtcagaatggctgtcacgaaacagacaagacaagtgctggtgaggacgtggtgaaaggagacccagcccctgttggtcgaagtgaagacgggtccagctactgtggaggctcctcgaaaaaattaaaaacgggtttacttaccacaggatctaacaattccacttctgagtgtataccgacaggaaatgaaaacaggaattcagcaaggtgcacgcaccctcatttttattgtggcactgttcacagttaccaggacacagatacagcccaaatgcccatcagcagatgaatggataaaaaagatatgatacatatacacagtggactatttttcagccatgagaaaaaaaaatatcctcccgtgtgtgacagtattgagcacatcgtcctaagtgagatgagtcagacagacaaagccaagtgctgtatgacggtagtacttctatgtggaatctaaaaacactaaatgtgtgaaaaacagaaagatggtgatcaccagaggacggaggggaggggtaagagtaatggtgtttaaaggttcaaacctgtaatgagtactaaataagccgcagaaatctccccgcatctccatgatgaatataaacaataatattgtactgtaattacacagctgataaataattacttcatcagcagtcgtgttacagaacacaaattaatcaaagtaacactttgcacactttaaacgcacgcagtgttgcacatcaaattgattccgataggtgaagagatgggaggatggattacggataggtccgagggtagatagatacatagatacgcacatagttagacatgcgtgtgtggatacataggcatgtacgtcggtagactgaccgcctttctacacggagattctgaccctggcctggctagtcttgagactgctcttttccagtgagtcagctcttcacatcaggtgactaaagtattggagcttcagcttcagcatccatccttccagtggatagtcaggactggtttcctttaggatggactggttggatctctttgcagtccaaggaactagttaccattagataagagtgagatgtaaagaatcccttataatatgaaacattccttcggtaaaactaagtggttcctcagtgctcgacagggaggccagcagagctatgctaatagcctcacagtgctgcactaagttgctcagtcgtgtctcactctctgtgaccccacggactgcagcccgccaggcccctctgtccacgggattctccaggcaggaacactggagtgggttgccatgccctcctccaggggatcctcccaacccagggatggaacccacggtccttcacgtctcctgcattggcaggcgtatgatttacgacaagcggcagttctcagtgttcttttgggggtgaggaggtaaggggacaagcatattccatctttctgaggtgcctcaacacagaggtcactaaagaaccacctcttggagcaggaggttggggttagtagatgtgatctgttctgtatggaactgaccagccgcaggccctactgtacagcacagggaactctcccctgtgataaaccttaatggaaagattataagaatacgcatgtatgtttccgtaactgaatcacttagttatatacagtaattaacacagtagaaatcaactgtacatcaatttaaaaactaaaactaaaaaaaaaagaatggttgcccttggagtctttccccagctgtcggcaggaggaccccggggtggccgaggcagccacggtttttcagccgtttcgggcggctgatgctgcagtgtccgcccctctcccggcgcctgctccacgcagtggcgtgggctgcccaccgtccctccacggcccctcttctttgctgggtcgcctatatcttgatttcactcttaatttgcccaggtgttcagacattatatcaaaaagccttccacgctgttggtcatagaacacccattttgagagcttgaagtaagtccgcctcactgactgtagaggactcgttcctcgagggaccagtttacaggcccagggtgaggccgccctgtgcccagcgctccgcaccccggtcatcccggcgcagctgcgaccagagctgcagagagaccggctcctgctctgctggggacccccggcctccccgccttccagcaggcctctccacctcccgtgtcgggagctccccggcacaccaggagccgctctccacagatgtttgacgaatacccactgcaatattctgagtggggaagctcaaatgcttcaaaaattagataaatctaaatgccagttgtcaagtcatactaaaatattgtttgtttaccttttgttgacagacttggtttttctcgccttcagtaatctcacagcgatggcaggtcattttacagaataagaacaaccataataacgactgtcgcatttcttctctttactaaaagcactttacctgaattcccactctatcagaacttgacctgaaaaagctattgaatccccgtgtcattaacttttctgtctaaagtcaaactgttgagatctagaattcatagataaatttctttatcctcttcctggttttttctgttatttcctaaaatctctgaggtatggattgttttcttgtgtgtatttgtattgggttggttttccttcctccttgtaaattttttacttacaattggaat

SEQ ID NO: 42700 - DNA, 2118 bp, Bovine  19866881349107
tgtcagagctgcatgggttgcaaggggaagagcggcttcaggctgcaagccttgctgacggtgagcatcacctcctcctttgaaaccgtggctttccccagcagcgtcctgagggacccaggagaggaagggagagcgaagccacccagattgtgatcttgattgcttcccctcctcggagcctcacttcctgccgattcttcttgtgtcactgagcctgtgacagccccttcctctctccccacccacactgcaccaggtcttccacggaccagtctgcccacacacaccccctttggcctcctaatccaccctgacacaggccccaatctgcagcatgacttgcaaaactgcaggcccggtcacaccacgccccaggtagaaagccttcgctggtccttcattcctgaagaatgaagaaaggatacatagatgcattaattatgagggcttcccaggtggcgctggtggtaaagaactgtctgccagtgaaggagacataagagacacaggttcgatccccaggtcaggaagatcccctggaggaaggcatggcaacccactccagtattcttgcctggagaatcccaaggacagaggagtctggcaggatatagtctttaagatcgcaaagagtcagacatgattgaagtgacttagcacgcatgcaggcactcattaatatacgtacaacggaagcactttctgtatacctgacgctaacacagtgctgttaaccaagtgtactccggggacttccctggtggtccagtggctaagactccacactcccagtcaggggacctgggctcagtccctggtcaggaaactagattccacgtgtcacaactaagagttgtgatgaatatgatcccacatgctacagctaagacctggtccagtcaaataaataaatattcttgttaaaaaacctatactccaatatattttaatttttaaataaataaatgtaattattgcacgttatttatgtctgactttccaactagcagtcatccaaacactcaagcctgtagcgttctccatcagccatcctggctgagaaaggactcctttctccttgactcccccagaaagaatgaaaggtatttccccaccctcttcacctgcatccctgcagagaaggtaaccagcctttgaacctggaactctgacttccccgagccccagaggaaaaacacagccttttcctgtgttttctgtgggaaaaagggaagctgtttggtgcaattgcctccccctatgttttctgaggttgaggccacaagttgaaattggaggcccagaaaatccttatttggccttgaagaatttaatatgaattttaaacatgtattgcaatgttcaaacagtgggagatttcttatgaaaatctaaatttctgggttctcttggaaaacaaagatggagcacctctggtcccctacgttcacgtggcaaaaatgggcaaaatccaagtcgcgtgatcccctttagacagatcatgtgctccctggcctgtggcaatcccaccactccctaaggtctcatactgtaaatagacaggttaggggtccccagggaaagagaacgaggcatggatttcttgacctaagagaagccgttttggcctaggcctggtcactgtgcttatcccttaacaggtctccataaataatgatcttaaaggaacaaaggaatgaagggacagagaagaggcagtccgagcacagtgcagtgataaagcaagtcctgcttcctcctcagggggaaggtattattattattatatcaaacataatagtacctttgagttctacaggaactgagggccccacccaagaggagggcgggtgatggtgttgaccctggtggcttccatcaactaaaacctggagtctgtcggcctttgccccagttctatgctggattctcctctgctcaagccccttcatgaatatgcatgtactcatagtttaaaacttccccacaaaaaaaaaaaaaaacttccccaattttgttgttcctggagacgctgttttgggaaagatccctggtgttgtccttactggctgcaagtaataaattctcccttctcccgatctttggcgtgattgt

SEQ ID NO: 42701 - DNA, 1190 bp, Bovine  19866881894082
aaatatttatgaagcttctaaatatgaacatggctcccctctgagaatgggcatcaaaaattttgctttgaatgaacagtgaatacatttttaccaggtgttttgggagatgaaattgcatgtttattttctttctgtgtttgccttgaaattgacagttaaaggcaaatgcagggcttatatttttgccaaagtccaaggcacaatagaaggctgaaaattgttaggttggcgggcaagagggcagattctctgccaaatggctctaaatgagttgatacaaggaattcaaatattaggttttgatgaaagattgttgaatttcctcaatgttggtgtctcctttggtatgcaagctaattagacaacaacaactaattggaccaatggcttagacagcttgcctctgttggcacagatgccagagggcggagcagttggcgttactgccagccaggaagatgtccatcaaggcttcactgttaacgtcttcagacctctcccggcacgctctcggagaaccttgccttaaatgaccgttggtagcaagggtgttccaggagatccctactgctgtcactgtctgtaatgttggtgttatttatactcgcctgtcttaatgtatttcagcaacctcaagttctcccactccagaaaaatggagaaatcccctatttgggaagaacaaaaatgattacagagcatcctgcttcgtgttgagtgataacttgccacagaacagatgatcgtagtcgtaactgtgcatggaaacacccaggactcctgttaaaggttgggactcctggggcacaaccccgtccactctaacgcagcaggtctgggaggaagccgtggaagccagcctttccccggcttacccgaactggagcctgcctccttaattagtcggaagtcagagaggactgtaaggccaaagcgcttataaacagtttaaaacagatttggcctgtaataagtacttcggagtcaaacagtactcctctgtcgcagtgatttagccatgtttgtttacacagttacttctaagatcaaaccaaattagtgtcctggccacagaaagcttatttgaggtcacaccttttgtctaaagagcttatttattgttcctcaaggagaatgcataagatttactgttgactgaaaaaggttagggccacgttgttatactg

SEQ ID NO: 42702 - DNA, 1168 bp, Bovine  19866880092821
ggttggatctccttgcagtccagggactctcaagaggcttctccaacaccacagttcaaaagcatcaattcttcggtgctcagttttcttcacagtccaactctcacatccatacatgactactggaaaaaccatagccttgactagaaggacctttgttggcaaagcaatgtctctgcttttgaatatgctatctaggttggtcataactttccttccaaggagtaagcgtcttttaatttcatggccgcaatcaccatttgcagtgattttggagcccagaaaaataaagtctgacactgtttccactgtttgcccatctatttgccatgaagtgatgggaccagatgccatgatcttagttttctgaatgttgagctttaagccaactttttcactctcctctttcactttcatcaagaggctctttagttcttcttcactttctgccataagggtggtgtcatctgcatatctgaggttattgataattctggcaatcttgattccagcttgtgcttcttccagcccagcgtttctcatggtgtactctgcatagaagttaaataagcagggtgacaatattagagcatagcaattataagcaggtagactgagtgcatgtttgagaaaaagagttgtctaacatttatagctgttccaagactgaagaaccagtcttgtttgtgccttcataggtctttgtagaggctgggatgttatgaagacgtcctctatcaggtgggggcttcctcatgtggtggtctcttgctccaactatgtaaggtgtagcatattccttagacaactacattgcagataaaaccttgttcttagtccatgaagtttttggtcgatctctagacctaatctcagagctgggtgggaatatggtctgtgaactttctgaaaatttcagccaagtgtgtgaatgtgcaggggtgttttttctcaggggagagggttcgtggttttcagcaaattctcaggagtgtttatgacaccccaaatttaaaaagtatgctctacctgtgctgtctgataaggatgccattagtcatgtgtggctacaaaaattaaatttaattaacatgaaattcagtaactcagtcacactggctgcctttcaagtggcttgtgtgttagatatataaatgtgtgtgtgtgt

SEQ ID NO: 42703 - DNA, 2541 bp, Bovine  19866880405552
tgtttgcttggtgtctgtctctcacacaagctctgtgagggcagaatccgtacaaaaaatctgtgttttgtttaccgtggtaccaccagtgccagacggttctgagcacgtaatagcactccctgagtattggttagatttgttgaatgcatgagggtcattgtcttcattttctatagaaaaacttgcaattttatactgtcacagaataactgactgtgattcaaggtttataacatatgtagttgatttcgtctacttttgagagtattccatttttaactgttattaaatactctattcctctgggaggttggggcaataaaattacaaatccaatcttaggggtatttttcctccctgttacctgcattcatcatggtgactctggttggcatggcatgacctgtcatctgtctgacagtgatgtggctgctgagttgggtgtttgtggaagagttgagtagcagccttctcctgtaacctgatttgggaagtgtcccaatacatgctgtttgcattgcagctgtgggaaaatccacctttgtgaagttactcacgaaaacttacccagagtggcacgtagctacagaacctgtagcaacatggcagaatgtcctggctgctggctcccaaaaagtaagttttcagttgtggtgggtagttggcaggcttgggttcataaactagttgcagtaatctaatttgctccaagtaggtgaagtagtccattttgtgtctcctttttaaaatacctttatttcagaaagcagaccgtgtacatcagggagggatgacttgtttgaatgtgttaagttttgatttttgtagttttgacatttctgtttaagtgattgcctctgttctttccagtttcccaaagcatggccagccatcctgtcattgaagattaattttgtcattcctacccttaagtattttattgaaattgaccatcaggaatagtagttaattacagtgattttagcttagttttgaagtcttagaaattgaaaggaatcttagagaagatcttgtcacattttaagtcaatgcagaaatcatagctaacatttataaagtgcatactatgtgccaggcactgtcctgtcccaaacactgtacatttcacagatgccttgtggctgaagccctcccgtcagtatgttgctgtgggagaggccacgggcttggtttctcactagccacatcagtgtgagtagggaacaaccaactggacgtgaccctcagaagcaactgagggagtggcagcatctccgcagactcctgtagttccaggagcagtcacgagtacctcattcttgcttttaacagcctattgttagaaagttcttgtatgagccactttgcatacctgtgactctgattcattggttcaagttctgactcttaagacttttaacttttccacatggcaactcttcattcatttctaaggcaatgatttcttgattttttgccccgttgagtcttctctttgaaatcaaataccattttcctccagactgtttctcatgcagaagtaactttgtgtaggagatgcactcctgtctgttggttttccacctagattttagtaagagtagcactcagagctgaacaggacatcttagatatcgtctacatggtacagaataccatagaactggttctctgtgccctttgcttgtgcttccaacttaggatcgtgttaccttttttggcagacacttatacttactgaggatatttgttttttttaaactgtctccatctatgtatgtacctgtgtgtgtgtatatgtgagattaacttttctatttagtaaataaattatctttttctgagtatgccacagggcacctgctttggggatttaaaaatataaccacagatttggtactgtttccttcaagaaggaaatagtattaattcttttattcttaattctcccctggagtgtgatctggacttggtgacttgcttctaatgagtacagtgtagcaggattaatagtgtgtgactttctgtggtaggtggtaaaagacaccgtatcttccgtcctgctctctctcgatcacttttggctctggggctgccagctgccctgtgatgcagcgtacctgtctgtgaaggggtccacgcagcaaggaactggtcctgccaggagccgtgtgactgagtcttcttggaagcaaatccttgaatccccagtcaagtcttcagatgactgtagcctcagccaatatcctgactgaaatctcatggaaaaccctgaggcagaaccacctggctaagctgtgtcccgaattcctttcccgtagaagtggatttaatgaatgtctttttttgttcaagccactaaattttggcacaacttagataattactactctgataatcccattgtctggaaataaaacagttaacatttttgtccttttaaatttttttaaaaggacaaaatgtatatattaacacacatataaatgtataaaacatacacacatttcatcttttaaaaaatgtatttaggctgtg

SEQ ID NO: 42704 - DNA, 1094 bp, Bovine  19866880576461
ttagggtgtggggggtatcttacagatatgctgagtactcctttcaaggtcagaaaattaatgagtctagtctttcctcttcccttttctcaatctcataatcagcaatgtataaaagaggtcaagagcctgtccagtgtggtaaggagaaaacttattttttgtctgggatgggttttagccactgcatcccaaggcagtttgtttccagggggtggggccctggtattataatacatttagttcacttaggaacttccctttcttctaagagttcattcctaaatgataagccaaggtaatcttccacaaaccctgcaaaattctcaagtttcacagttaaatagaaacaaatgtgttgagacatactttcatcagtcctttctttctttcaatatattttattctgatgaagttacaaaagtagatacaaaacactttttttaaaaagtacagttaaccgacttagaaaaatagataaaagcccctaaaggtttaaaaatacaaaataaattttcatgtaaagaacatttaaaaatattttagataatcaagactaacttaagcaagttattttcaatgtagaccaaacatagaatgttgtcctataataaatctatagcacactggtaatccattcggatttacagaatacttgtttgaaacagaatctgatgagagaaaacccaagtgaatttcaatgcagttgcttcagtaaaattactgctaccacagataatatcatcccccaaagcccattacagtctgaaatatcaaaatctaatgcaaaagcacaggaagactgaagagctactattttccctctttgccagaattgtacaatagtttaaaaccaagtcctgaaccagttactgaagtggtattaggaggaaataatgtccctattgaagctgcttagtttggtgtcccagctagtattttcaggccagaattctacagaaagcagagacagactcctacagtcaggcaaaggcgacaccagcagcatgactaaagctgcttagaaacaaatgtctaggacttacactctttgggagtgggtttgtttatgcgtatgagggaaatgatgtaat

SEQ ID NO: 42705 - DNA, 945 bp, Bovine  19866880632651
ccccagctctgcccaccagctgattcatcctttcagtgtctccttctcagtgaggtctccttgaactctctccagctccactttatccctgggcagagttaattactgcctgttctgctttaaaaggcatcacagtgtaattatttgttgactcatcagtctctccagctagactgggaactcacgttttgaagacagggaccaaccttatttcctttgcatcctgagtatctggccaggtgctaagaaggagatggatggatagaatgatgtaaatcacagaaacagagaatccaatttattcctaacattgtatccaatatacaaagattccttttttccctaggaatcttgcccaaatgtttacatttaatgaaaataaaagatgacattagcaatgttaaatcactaattttgaatgctggaatgttattaggaacgctctccactgctttacatacaagcctctaaatggcaaaagagaggtttcttctctgctgggtctttgaaaaccaagacggggggaaaaaaaaaaaaaagagactagtctgagatgactcactaacaaaagttcctacagcaatcctttattcaatttaggtttgtaaacacaaaataactgactttggaaggtgataatacactttagtgatggatacacttatataaaaaagatagggtaggtatttttattttttagattttaagggattctagatcccaagctttgacttttaatcataacatatggctcacaactcatgctagatgccattacttgctgcttcactgatccatttccttacgtgctactgtgcgtacctgcggggtcagatagccaacatttagagcagaaaacaagacaggtccctctaaacttatctaactccagctgggacaggggttcaccttcccctgttcaggtttcctgaatggatactccga

SEQ ID NO: 42706 - DNA, 894 bp, Bovine  19866880698670
acggacagtgcagtgccactgcctctcctctcccctctctgttctcattccaactcccccctcccctcccttgccctcccaactcccaattaagggagtactccttcctggggttgacagcatctcaaacacacatcattcattcattcattcaattagcatctgagggcttctgacgcaccaaggaactgagccaggtcctaagaacacaaggcataaaaagtccttgacctcaagaagtactgtctagcgtgggaactcaaaccatgggtttctcattgaactcccaaacatttttaggtaccatccccaaaaggatggcacccaaaaaaagatttagggaaagaaacatcccactccatcagggcagcgtaagactaccctatcactccaaatttttccttccaaacccatcagcctccatcccttacctgacaccatcactcccatatcacccaagcattagcatgaccttgaaatatatctgaggcttcaaccagacaaaaaacttctaaagataaagctggataccactgtcccaagtcaaatgcaaacatccgggatgagagtgctagctcaaagccctgtgcaacctggttaccctcccaccaattgtaagcgcggcaaactagcccgaaccagcttctaaagacagctatgctcctattcacagccctcactgaaagttggacctggaggatcaaaacgggagaatggcttaacggtcttcagcaagactcttgtaaatgcagcaccctcaaggaagaaacagggctgtcaagcaagacccaacttacctccttgagaagccccacttttttcttcagcacctcacacttgcgcagtttgcagatttggtgtgtgcggcggttggtacagctggtgcaagcccca

SEQ ID NO: 42707 - DNA, 2245 bp, Bovine  19866880700019
tttgccgagactaaggctcatgctaaggtcaggaaagtgggtgagctggagaggggtgggtgttggagaccccagcctgggtgaggccatgggctgatctgctgcggggttctgaccttcgggttcctggagttgggagtgctttgtgtggtggtttggaagactcctggccgggcctgccctagaagcaggagacacattggaacgtgggatggaggttaggaggttctccacagcctagctgagaacccactcccctgtctcgctcacaggcaattgagatggaattgaggcagatggaggtggcccaggccaaccggcacatgtccctgttgacagccttcatgcctgacagtttccttcggccaggtggggaccatgactgcgtcctggtgctgctgctcatgcctcgactcatttgcaaggtacggtctgtcagccacattcccagcagggggctgctgagcttgctgtgagccaggcattgggggcaccaagcagaggtggcagtcgttgtcctgctctcagggtttatgacgtagtacagggacgcagaatcacagacagatgtatgtcacagatggcgttttatgaaggggagatgcagcttgtgaagcggaggtagtgtctgggagagagcacagctgggaagctgatggagacagtgggctattactgaaggagtaacatttgaggtgagacccgaagatgactggagttcgtgggggataactgtcaggatcacactctagttggaaaggcagcagcagcagctttaaggtgggcaggagctggtcccactggtcctgctgccctgtcagcccgcacccgaatctccgtcagtaccagcagtcacatcaccctttgtccatgtgtgactccctgcccatctaagagctgtttctgccttctctcccgtgtcttcatgccctccgcagttgctcagctctctgtactcctgagtctgtgttctccatcctctgctctgagccccatgtctctggtgcttcttcccacaggcagagctaatccggaagcaggcccaggaaaagtttgaactaagtgagagctgttcagagcggccaggacttcgcggtgctgcaggggagcagctcagctttgctgctgggctggtgtattcactgagtttgctgcaggccacacttcatcgttacgagcagtaagtgatccctgacctccatggcagggccgtgggtcccagattggctggaactgaggtttccttgtagactctggcctcacagggcccttctctggtctccagtgccctctctcagtgcagtgtggacgtgtataagaaggtgggcagcctctaccctgagatgagtgcccacgaacgctccttggacttcctcattgagctgctgcacaaggaccagctggatgagactgtcaacgtagagcctctcaccaaggccatcaagtactaccaggtctggggcgagaattgaggcttagcacaggaggagcgagggtttcttctggggatgtttccagtgtagccagggttgtatgtcccaggctgaaggcgtgaaactcttagatgaactcaccttaggatccagttccttgagggttttggattctttcatacctctggagtcccttgatcactggggctcaaactgcagtttgggaagcatgcttcgttcttccaaggcctaaagactgttcatttgccatccctcctcagcatctatacagcatccaccttgctgaacaacctgaggacagtaccatgcagctggctgaccacattaaggtgaggtgtttgggccaatggttgagccccttgtagagattggaaatgaaagacatcagatcacacccacaaagggtgtcacataaggaacagggtcactaaggccaggtcagggaagccagagagctcactgatggatggggtcagccaaggagggagacttctttagagacgttaatggggcagaagggccccgttggaggctgacagccacctgcttctgtcttcacagtttacccagagtgccctggactgcatgagtgtggaggtgggacggctacgggccttcttgcaggtgagagcgcaaccagatctgttggagttcctcttccttcagagtccccaccttcttgcccccagccctaattctgacttggcttcccgtctgtctcctgttctgagtagggtgggcaggaggcttcagatattgccctcctgctacgggaccggaaacttcgtgca

SEQ ID NO: 42708 - DNA, 1173 bp, Bovine  19866880716661
tgaaaagaagactcctgatgctggaagttgacaagaagtaagtaacaagcaagacagtaagaattcaagatcaagagttgtcccagaaacaatgcctagaacaacaacaacaacaaaaatggagggcagaagagaaatgcaagtccaacctggcccagcccaagaaaaggaggcgtcaaggagacgaaactaaaagagaagagccttggatcattggaccacatcattctccacaaggtgcattcaaccaacttcgccctactctttaacgaagttacaaaaagggcttcttaatcccttcctttgctccttaaaagctactgcaagttcacgttaatttaatagactgataggacttcagaacaactataatagttcaaactggatggctctttccttcttctctaaggttattaattaaccaagacatacgtaactgtaagtgcataacacataaaatataatgctatgtagaatataagtaactatgttaattgtattaatgagcatctataagaaatgttgcaatgatttccttcatggaagagcttgagggaagtaaatctgtcttggaggatttctcctccccagagctcaaacatttaggtgtttcctacaccttttttctgcatccaatcctgtcttcttattggcgatctgacctccctattggctatatcatacctttaaactgcccgctttgtgacatcattctcccaccaaatctactaccacctggtagaatcttggggtttccatggagttgtctgtaaataaatttggatcatcgcaagtgaccagtgaccagtgacctttgtactggccacatgtacacttggctgcagtcattccagacatcctctcgtatcatctcctcctcccttgtatctacagttagtttttcctctacttctctgaccatgtcaggtatggaaagaaactttgtaaagtttttcattagatttatttttctgcccgtaaatttagtagcagattcaaaatgaataatgaaggaaagtattgaactagaaatctggagacctaatttcagttttgacttggacatttactatctctgtgactttggacactttggacaagtctcacaaggtctgttttttcctcatctaatgttacatctaatgttacattaggatgctacatggtctatct

SEQ ID NO: 42709 - DNA, 1291 bp, Bovine  19866880814787
ccatcatatgccccatttggctccttctagctctggttaggaacccagagggaagaagaggctattcttgaagcatcctgcaacctccaataaactgtcatggggtggatgtgatcaaggaccctttaatgcggcccatacttgggcatttggggctgggagtggctaaggaattcagtcttgacccatagcagaatattttgagacgttctacaaacccagaggtttgttacaattattctgaagagaaatcgaggacagctgctgccttttctcacacaactgaccaaaagaacatgatgcacagttaacagcggagcagagaaggcaggcagcacggctgactcagggctacatgcacagatgccacaggactcccagctaccacctgagctggggagcgcagcgccgttcagtggcccaagttgtcagaccagattttccttggatgtcttttgcttaggctttatcgttctttgatattgagaacaatgtaaggtttatttgaaagccacttggagatgaaggaagaactataacatggataatcccagaaaaggtccaactatcaactagttttaaattctagtgtttacaaagtggtactcacttgggattgaaagcagccaagtcagtgtatgcagcatccataaatagaatacaaatcagttacaatggaaacaagattcaattaaaaagagtgcccccaaacaagctcttccaatagagtgagagtgccatggtcaaactgggttttgcagtaacactgggattatggaactgttggaaaatgagtggcccgtggactgggaaagaaaccatcctagttagctccctcactccagcctgctaaacatctagaatcttccctttcatattctcctaatcaaaactagctcgtcctgtttcctgttcctttccttttcatgaggaaactgaaaacctcatctcactagggctagttgctaataatgatttggtttaatagagctgtggttctcaaacttcagcgtgagactcacccagaaggcttgttagtatacaactggctctacctacccccagtttctgattcagcaggtctggggtggtgcctgagaatctgcattcctaacaagttcccagatagtattgatgatgcttctagggaccaactttgagaaccaaggcaatagcatgacccaaaaaaatgcagtgacattagggacctgggccaggccaggccagatgctatttggagttaggggattcgataacggttctcaaatcctactttatatgtcctttcagg

SEQ ID NO: 42710 - DNA, 1399 bp, Bovine  19866880843528
tgcttttgaataactcagcaaatgctttcgtgttttttaatcaattaacggctgcactgggtcttcattgctttgtgcgtgctttctgtagttgtgggcctactcttggtttcagtgcacgggcttctctttgcatggcttctctggttgcagagtacaggctttagagcatgggctcagtggtgcatgggcttagctgccacacggcatgtggaatcttcctagaccaagaattgaacccgtgtcccctgcattggcaggcgaactcttatccactgtgccaccagggaaaccctgcttttgtgttttacagctatttctgtgagttcattttgaatttaggttcagtcaaatagactccttgttctactcttacaaggaacatgcaagcgtccccttcataatggaaaagagattaaataacctaaaaatattccaacctaagggaactgggcaggagaatgggaactttgattgactcagagactcaagatgctgaatacccaacaggatcaggatcagttaggttgtggtagagtaacaagcaatccccaggtctcactggtctgacacagttttatgtctccatcatgaaatatatcttctggagatcaacaggagctctgttttccatagccacttagggactccggctgctgcaagtagacatgctgcctcctcaactcagaaggcaggaaatgagggtggggcaaattgagcgtgaacttttaaagcatttacctggaagtaacatagatcacttttgctctgatttcattggccaaagcaagtcacaaggggcgggggaatgccataggtgcaatgctctcatgtgcctggaaggagaagcagaaatacttggttaataacactaatagctaatacatggggaaaagcatgtgtgcgtacgtgtgagatagatgtgtgtgcctttgaggtatgtgttaatgcaatgactgctgcccatttctagagtgtttctgcctcctagggacatatatttgagatttccactctaatggtttgccattcctcccactacacatgttcagagatttaggctagggtgaaagaaacctgagttgagggaagcatggtgggagaggtaagtgacagtggagcagactcagtagaaattagtgtgtaaatagaaaaagaatccaggaaaggaagagattcagggtatatgtgtcattaagggcctgcctcataaagaaaactactaagacagcatagctttagcagaagcatttcctgcttcttgccattcactccccctcatccttcctggctaaactcaggtggcactccaggaagcctttgatctttcaagattgagcccacagatcacatcatgagtcagtctgtcccatccacagtgcagggacagggaccatat

SEQ ID NO: 42711 - DNA, 1778 bp, Bovine  19866880843655
ggcagctatatataagtatgcaacttacttttccccaaagaactgtcaacagctggcagcttttctctgctgcacctgttggctttccttgatcaatttttgatagtgagagttaatactgaatttaatcagactttattaagggactttttgcatcattttgattttttaaataaaacacttctgacttgatatggaaagagtttctgaaatacttcatctttctgctactatcctcctgtggcctaatttttctcattggatgtaatcaatttaaatattcctatatttggtaacatccaatcctttgactttaacaaattggtttaaagagctgtggagaaaccagcctagtccttttaattgtacatcccaagccagaagtttcatctgtaagcttcatttcagtggttagtcttgttctgagtattttaaaccatatgttcaatttacacgggacttcttgatgtgttttgccaaatctccccctcctccacataatatgtataaatttttttcctgtgtgtgtatgtgtttaaaacattagattgcacagatcggaaggtatttgctgtggcaggcatgtttgcggctcggatgggtcctgtgtcttctgctcgagggctgagtagttggctttcataaagcaggagcagctcccgctccaggcagcttgaggcagcgagaggaaggagaacaatgcagagccgcccttctcccctgcttgttcctttgctgcctttatgcttttgatagttttctggagaggaagaggggtgatagttctagaaatgtttttgtaaatgaggtatagttcctgtctgtacatcatacctgctgactcacctaaattattaaacgtggagcaagatgagcaaatgggattaagttttattgaattgtagttacaagtggaaaaaagtatgacctgtatgaagaagtaacaatatgtcaacctgttaaaagctattaaaattaaaatgttcctgtgtatgtgtacaaaatgcaaataacatacaaggtaaaaattacagtgatcaatttacaacaaaaaaaatcaacattttagctttccagcttgtttgattaatcaagcacatttaatcctgaatccataccatttctacaacacagcttggacaaagtgctattggaaatcagccaggttttaaaactgcaatgttaagagtagattgttagctctcccagaattggtatagatgaagacaaagaatttatacttaaactcaggcaatggttctggatgagtgagcagctaagtaattctgttgctttcagttgaagtggtggaggtttagcgttttacctcgtggcagtatccctagaagggacttctgatatttaatttcataaacaccgagagctttctgtggaccaggcactgtactggctctggggatcagaggcaattagctgtccccatactcaagttggttaatgagtccagtgtcatgtgcacctttaaaaaatgaaaggaatgaagaaagagcacctgcatttgtcatcttgagtaagtctggtaagtaactaatttacacaagattcaaatccatagctgttttggagaaggtaaatgtcagatgcactgtggctgtcaggcacacacaggtggtgaataaacatggttggtgcttgttcaatgtgaattgaagataaaaagactgatcttaagcaaggtctgtgattaatgggttttagtctacccagtttgtttccaattattccttaaagtactagtgtgactagtattacagagt

SEQ ID NO: 42712 - DNA, 927 bp, Bovine  19866880871190
tttgggacatccaacacgagcactggaatgttcagcagagcctcagagtggagcctgtaagaagcacgaatatttagggaacagaaaaaagatggtaagcttcacatactcaccagtcttaataattcataatagctctaaggtcacagggcttcttagggaaattttatgtaaacagtttaaaaaaggaactcaataaagttggctggaaagacgagattgaaatttctctttagtctgaagactgatactgaaggtcggagccccaaacaatttaaagggacagcacaccaagcctgaagggaggaaaggctgaaaccaggaatattaacttagtacacactgacaatgtttcagccctttaccctgagccaacgactttatcatcatcaatcaccaagttcagtctaagggcatatcgaaaaataaaaaagctgggaaacaatctaataaaaaagtttcttgaaatatatagattatatccggtattaaatttctgctggggataacgcttaacaatcccaaccacttccaggacattctgaacctgcttaaggggctgcgtgttcagcttcctgtattttaatgcctggctgcaggaaggcaggcccctgtccactgccgctctcttctccacttacgggggttgtcttgtggacaagccaggctttcgtgttgaccatgaagctgctccagataggccaactcaacttctttctcctcttgccgggccctccgctgtagtctctttaaacaaacctgaaagacaatccccaggctctgctgagctcctgggttatcttcggctgttacagaagctggggggctctcaggcctccttgctgtgtctatcctgggcgctagtgttgggacattccttctgctgccttggcttcttagtgaatcacaggttaatggcaaccatca

SEQ ID NO: 42713 - DNA, 1158 bp, Bovine  19866881012411
caggcattgctaagggagttaggctctggggagtaggactagatgatctaaggggggtttccactgtttgttctgtaggaatttttaccatttcgtaagtatgttttgataatactgagatggagatacctaccagttcgcttaattatttcccacacaccccatggagtagctggtaacatggaacactggtccaaacacattcgccctacattaattacatgaaagccatcgacatctttgtctggagaaacagcattgcagacctttctctcatcgatgtgctctgaaaaagaaatcagagcagtggtcaagtcactgttgcatagttagcactgcttgactccagcgtactcgaaacccattccccttctataactcaccccacaacttattcatctgtgcgttgggaacacacagcaagcaaagccaaatgccaagaccaaaccagtgtcctcttgtcctctccaaaccacttccctccactgtcctttgtattaagacctcaataccaagtcagggagtaattggtattctgagtaggtcggtcccatatctaacaacatactcactctcttgagtttacctcccctttctttaagacaaatacatatgaggagccaattgtataaactaaacaagcctctccacgcctcagagatcattttaaataaagctatgtaaatctcacctggaagaggcagctgaacaaggaggccgtctacattatcatcattatttagtttattgatcaaattcaacagttcttcctctgaaattgaagctggtttcagaatggtctcactgttgattcctataaaaaattttcaaggttaaaaaaaaaaaatagactatggaagatggcggaggaggagaacacacagctcacgtctcctcacgctgtgtcagaggtgcgtcagagaagttcttctggagcgcgtgctgggcactggcagagggcctcggacacctagggggatgggaggagtcccagcgcaatctttatttcagaaagaaaaaattttttttttcttttctgtttagtgtccttcccaggtagggtgtgggaaggaagtggggaacagtggaggcaggacaggaccagcacccctgggggaagctgggggagaggaagcaatcccacactcagggaagcat

SEQ ID NO: 42714 - DNA, 1335 bp, Bovine  19866881099131
taatcctgtcaacaacctgtaaaagtatatattattattatcatcatcatcatctccatgtataggtgagaaagctgaggcccaggaaggttaaataacttgatcacaaccctgaagtagcggagctaagactcaaaccccttcctgttccacactgcttcccacacatgtctttgtaggaagattcagaaaaattagtgacagggctgatcttctgtgtgggccgtgaaggacactgtgtcgcatcagctctgactgtgctccctggttaaagcgtagctgcagctccctccacagggatacatacacagaagaggggtgggtccttgctgtggggatgaaatcctttctggcgacaggaagaaatctcctctagtccatggtcagtgagtctaaagaatccagttctgaaataagaaaaagcaggtccagagtccagcaaaggtgtcccctcaatcacacacacactgggcagggcagagctcattctgagacaccttcaaacgtctgctggcccgcagatctcttctctggtgaatgaatcagacagtgattcatcactgccaccacatcagttttactgggagaattcatagtaaataacagggtttaaaatgaaaaagttaattttcagagataatctgttggatactgaaattctctaatctgacatcaatctcttgaaattcctactgcttcaagtcaaacacttcaaatttcttacatccttttcttataaaagcacctacattattgcttggatacttttgtaaacaagcagagtaggtttatcaggctacaggacttaaaaggaagacctttagaaaagccaatcaaatatcacaatctatatattagatagagaacaaggtcttaagaatgcagaacatttcctctgaggcttttcccctgaacaccctatgtacttactcctggaatttgggggaacaaacaatggctatcgactctggcaacatcatctggtacgagcagtgagtgtgtaggtcaacactggagaggaaggctgtctgcgtgggatgagtctgagaagagggaaaaaaagcctctgagaatacacaggcaagcccagcccatgaagaaagtgaaatgttagctgctcagtcacgtccaactctttgcaaccccatggactgcagcctgccaggctcctctgtccatggaatgctccaggcaagaatactggagtgggttgccatgcccttatccaagggatcttcctcaccctgggatcgaacgtggatctcccacattgtaggcagattcttaccatctgagccaccagggaagccccaccatgaaggaaggcagagccaa

SEQ ID NO: 42715 - DNA, 2296 bp, Bovine  19866881137572
ttcttggctgtgctgggtcttattgcaacacgtggcctcttcattttacactggcttctctaaatgcagtgcgtggttgtggggcatgggtttagttgcccattggcacatgggatctgaattccctgaccaggggttgaaccctgtcccctgcattggaaggagtactattaaccactggaccaccagggtagtccctagtggacttttaaacaaagtccatccatcaaaacccagaccccatgggggctcaggtctgtttctgggctgctgttttctagatccctttgtctatatctgggctggaattataatgctttaattactcaaggttttcagtaagtttttatatctgctaaaggcatgtcccatccccattcttcttttttagactttccctaactattctctgacattccccaactatcctctttttcagaggaactttagagttagtcacagcccaaaaatattcccataggattttgactggaatagtttgaagctactcagtaatttgaggtcgaaatttaataaaactgagcgagcaggtctccggctaggagcctttgcctccttgcggctctgtaggctgtccagtgctgccctctgcagaggagtcacaggccggtgccgcctctgccagtggcccaaggccttcccacgtggccctccccctcagcctatgatcccgaggcttctagaaaggacaaattcttacacatcttttgggtttaatttctttcctcccataaattacatttggattttaccctgaactttcagaaccaaaatccgagtgtgattcatggaaacctcaggccctacagtagaactgtggggaaatgatcgcctctcccagcaaaccataccctcataaggcaggcactgaacacacatgtgaccagtagacaggtaactaggatccagtggatggtttgttttttaaagagctctattattgtaggataccataaagttcccttgttttaagtgtattaattaaatgatttttagtaaatgtgcagagttgtgccaccatcaccaaacccaattttgcaacatatccaataaagcaattacctccaattagaaaataaataaaaggaaaaaaagaacagtcttcacacccatgtatggtcattctctgctgccattttgccctcagcatgccctgagcatggccccatcaggaggagtgagggatgagtccccaggagacactctgcctatgagtagagggccaatgcccccacaatgtgcagagcatgacctgcaagccagcatccctctcctgaagagacccagctgggggctcctcctgagggcaaaggccatgctgagccccgtccttacctctacaggtggataaagtttgaagaaaaggtagaggaaggaggcgaacgctggagcaagccccacgtgtccacgctgtccttgcacagcctctttgagctccgcacctgcctgcagacgggaaccgtgctgctggatctggatggtggctccttaccacagatcataggtgaggcaaggactgctgtggcccccgaaaaccagggcagcatcccccttcccctgccccatctcttgcccacccttggtctatgtggcatgcccacctctgatgcctgcctaattctgcagagaccaggttttgggtctgatgctcccaaagcagcatcacagttactcctagtctcagatgcctatagagagggcaagatcagcctctgaaatgccattcagcaatggaacgaaacggagagcacttctgagcctaggtggagacccctgttgccatggcaacctgtttcttatcagggtaaatggatcatcactcatcttcaggaaattagctctcgtttgatggagtgacaaaggaagggagtagcttgccttactgtccctaaactccttgtgaattttgttttagcacattcagttttaccagaagtatgctgccccaaatacttttctaaaaagaattcacactgggactaaaaccacttggcatagtgccttgtgcttcttagggtctttcatggttacaatttcatttactttccacaatattattgatagaaagagcagagaatcctatacccatacctgcatgcacacatgcacccacaatgcactcacatgaaccacatctgcacacatgcgcccacatgcacacaccatgcacccccatgcacacacatgcaccaactcccacagacacacgcttttacatatatggagccgaaggttcatgactggtgcatattttcagtttgggcgaaggtgggac

SEQ ID NO: 42716 - DNA, 1201 bp, Bovine  19866881281998
tacctcttcctcaaggaattttcacttttaactcagatctgttggtcttaggactcctgtgctaggcagaattcaaaaagaactgggctataagaattgggactccaaccatatggaagccccaaatcagagtgtatagatttcagtggtcttcactttagtgtgggcaaaccccctctttccttccttaccccttgtgcccccagttgcccatggcaccacctgccccctcttgcactgtttcagatgcactaatccaaacatggcctgttgagcctcgcatgttgcctatgattgttgaaatgactgagagctcaaatcccagctgagctgctcctctaggagagcaagtagcatcacactaggattatgaattagtcaaggtcctagggcttgctccccgaggttctgaatgagtgacaaacaccttccacatgttggaagggaacctgccccaaaaggaccagatgtggtttatgaagaccctgggggattttttttgctgtctttacccactcccagcctcagcttcctatcggtggacagtcctgtcatcaagacaacacagtctatcctgggcgtagtctgaaagatcccaacatgagtcctgaccctggtgcccctaagggcttggcactttcccattttaggcatcctgccagcccccacaagggccttccagcaaaggggcttccccttatattctcccacagaggtacttcttccttgtgaatttcccactctccttctcctttcctcttgtatacatccatctcccttcctcattttcccctggcccctgccatgcctcccacctacctctgggtgaaggaataactgaagcggaagccacccacctccggggtccctgtatcatctggtgtagcactggccacggggttagagaacagaaaggagaggaaatgggtgagggaagcactggagaaagagtattctccagaatagttctcaaacctgctccacatctgacactttaattttcctgccaggacaaagatcttccagttggagttactcactctgattcttccttcagtgattcagaacttgaccgaaggtaatagccatgagacagtctctttgggtgttagataagagaataagcaatggcttgaatgcctaggatttctcaagtcagtgtctcagtaaaaggcctctgcgctccacctcaggacacaaa

SEQ ID NO: 42717 - DNA, 914 bp, Bovine  19866881350107
aagttgctcctcattttaataataaaatgccacattctttctggcattgtttgttgggatcaggaggaagcgaggttcccttgatgtctgatagtcattattttgagagtgtttgtttaagggctcctgttgagaatgaggtgaaacaaaaggtggattctttggagagttataaaagcaatgaagaagatctggggaaaggattatctcagtgttttgaagtaaaggagaatagaaatactttagtgttttcagaggtgcatcccagatcttcagaaatacaatatattgagaatgttgtagttcctgataattctgtagaagtttcagaagcacatatactctcccgggggcttgatacctctacgatggagatttctggtggtcctcttcagactattaaattcaactcaaatgagacatcagaacaactgtattttcaagaagaaagaaaccaagaggcaacttctgtttttgatggggaaaatgttggtgctatgaaaaatgtagcttttcgggcagttattgcctctattgaaccttccaagaaggagagtacagtaaatgaaatccaaactgacatcaacaaatctttaacaaatgacagccaagaaagtgaaccaaaaagtccagatccttccctgttaaattatgatgaaaaccttttatttgataaacttaaacgtccacgctatcagtctactcctggggtgtttgaatcaggagcttcaaaatcattgtataaaaaagatgatggtgatagctccctgtactggcatcacaattttaaactcaatccccagtgcttctcaggaaatactgattaagccactttctcttagtccagagcttaagccatcatcttctttaagtgaaaaatctctcaaacaggctgttggtcttggcagaacatg

SEQ ID NO: 42718 - DNA, 1558 bp, Bovine  19866881381331
agagtctcttggactgcaaggagatcaaaccgtcaatcctaagggaaatcaaccctgactattcactgaaaggactgctgcttgaagctaaagctctatatactttggccacttaatgggaagagccgactcattggaaaagaccctgatgctgggaaagattgagggcacaaggagaagcgtgcgacagaggatggcatcaccgactcaatggacatgagtctgagcaaactccaggagatggtgaaggacagggaagtctggcgtgctgcagtccatggggttgcaaagaatcagacacaacgacaactcctctccatagttcttcctcgaaaagatttttcagaaggatagggattgtggacttccctggtggtacagtggataagaatccaccttccaatgcaggggacacaggttcaatccctgatccaggaaaatcccacatacctcagggcagctaagcccacgtggcacagctgggaagccatcgctctatggcctgtgcgctgcccctacggaagcccccacacctagagcccgtgctctgcagcaagagaagcctgtgcactgtaacgaagagtagcccccgcgtgcagcagctagagaaagccatcgcacagcaaggaagacccggcacaaccaaaaattaatcagttatttattttaaaaaagaattgggattggaagggggaccagggagaatccatctcatagatggcagtgtgctctaccacaagacctcagtaccccatccacagctgacacaccaggagtgagtatctgatgcccagaacaacaatttctaggctggcctgcagtctagttggcgcaaaagcttatgcatcaggagtagtggtagggaactagatcagtaagagcctctctctgatctacattcacatactagaatcacagggatgagaacctgcttgttaggggacaatgagacaactcagatctagaagaacctgtagtccctcaaatatgttcaaatctctgaaagcctatctctccctaataacaactgattatgcagctcttcctgggttccaatgtggaagattcctggctttatttccacatatatccatacagtaaagttcacattacttcaagtagaacaagaaggtgtaccttacgaaaaaggaccaccactgaaaacaagactttcccttcagatttctgtccccagtgtcataaggaatgttacaactcaacactaattaagaacatgattctttgaaacatcgaaacaatctatttccccttatagcgcatattttttttaacagcacatatttaacactcagggatgacatcaaggtactggatattttgtatggtcagatataattaatttgccaggccactgttaaataaaatgttaaagctctaacagtctaagtcttcaatgcctgcttttaagttgcattgtgattaaatacctactttaaaccaagtctcagtgtcttagatgtaatgcagtaattttatatctaaaccttatattaatctgtatttccatcttttgagatagtaagatgatatcaacgga

SEQ ID NO: 42719 - DNA, 1655 bp, Bovine  19866881390719
tacagacagccttgtaacaaggggagtcctcagctgactcccagatgcccgaggacaagagaaaatgaggccaaaaacccaggaggtcaggatgggaaagacaagaggccccaaaactaagccaaaacaaggcccctccctatactgcctgcccccatccccagccagccaaaccatttgctacagcctcaggggcatgggaggggacttggcaacaccacaataaccatttctagcagaaatgtccatctgcagctgaagggagcccaagcacccaggcccctcctcagccagcccagccagggggctaaggagccatcacagtggccttataggcagctcaggggcagaaaggctctcctttggactcagtcacccacctgtactgcaaagttcccccctctcccacaacattcacaaatggctggggtcacaaaggaggtggatctgagctctgggactctaatactgtactcattatgcacggggaagccctctctttccatcctcaaactcaactctgaaatccccttggttggttcctttcctagcctagcttgatatgcccacctgcttccatatctgcccaacttcactaccgcttgtaaacaatacctcagagataagagagttcccgctggaccctcagagcgggaacagcaggcaagaaagaactaggaggagctccccacggtgtgtggaaagttgaggatcacagatccttgacaaaaggagcagtggtccaaaggagagacagaaggcagagatcctgggcacaggcccaaaatagtttccacacatcctcagccaatcaagggttcccatggggcagagcatgggagcagcgtgggaagcccaagagcctggtgcttgaggctctgggcactcactcttgtccaggctgccaagaggcaggaggtgacaacagtgtgtgctacggcatgttccttgggatgtcataggtagacatgcaacacgccagacagcaaagtgacaggctgcacgatcagcttcatgcctgtgctgggcacgacacacaccctgtatcatggatatttttgaaaccctgtcaggactcagcacctgctagatgtgcacattcccactgctgctggatattcttcacccagagagcttacccatcctgggcccctcccatggaaacccccaaaccgggagaccccgtttgccctgtgtcccagagtctttgactgctctgattgagttcacacaccacacacatcttcctaaagcaccaccttctgacagaagaggatctcacaaaaccgctctccgagggtatgtggaacaccacactaaactatgtgagagaactatgtggggccgcggggaggtggcaccaagaacagagggctcagatccgagtgcttgctggcagtgcccaagctgggccaagaggaagctaggactttccaacagacaactcaacaataaaaacaagcacagacacctcagagctttaaaaacaccaccaattcaggccccacgccaagaagggggcaggaggaagacacaggtgaagagcattctctaccttctcaggcagccctgctccatgcccacaacactaaggactgagataggctggggagatcccagcaggggtggcagggccggcacaatgcaggcaggga

SEQ ID NO: 42720 - DNA, 1074 bp, Bovine  19866882000301
ttctttagagaggaaagtagatctaaatagctcaagaagcaatccttcctacaatgaaggttgagaaaaagaaagccaagaccagttgattctggtttggggaatggtaacactggagaacacactctgctgtttcttgtgatggcatcactcgtgctgaagttatctcctttgttggcctggccaccatcccgcttcacagcagggaggaaaaagagatgtatgagtgtctccataattaagtccaagtacttgattactgcctctctgggaaaatgaacttgactgaagggagagtgagcaggcattcattcaagcaacaagccacttactgagtgcctgtaattgatggggaaagatgactctttttagactggaccatccaaaatcagttgggggtaaagaaaaaaaataagctggaggggtgagagggagaaagaccatagttggtgggtctttagggtactcctgaggaaacccctcagctcctgagctcacagctcagttccaaattccaagatgcctggttagagagagagggaaacacacgttctcagggacagaagcccacagagccaaggggtctgatttctaaggcagaatttcatcaagggctgggtgacactttggaaagccatctgatctccagaggtcctgatacacaagaacaactcggcccgttccatcaagggagagagatgtggactcaccccttggcccctcacgcgtgccctctttcttgccccctcaagagccaaagcagcaggtccatcgtaaaaggacgcctcccttaggaaagcttagttcaagtggggatttttatacaagctccatgtttcctggattcttaggagcctccaaaaaggctgtaaataatccttactaaacaggaagaagtatgaaataggcacaggaccaaccactgtgacttccatggctgaaaagcacggattaaaaacgggcagtcagacttccatgcagagactataattagggggtagatctcagccccttactggtagaagtctgatgttgcacagatgcacacacgcatacatgatcccttctctgaag

SEQ ID NO: 42721 - DNA, 1906 bp, Bovine  19866880414352
ccaggaaggcccgccctggaatagagagactcagaacctccccaggcctagccgctcctacaaatgcatttccccttattctggtccccctgtcctcatccccatctctggggagcgtctggagctcccactcctgctccccacgttgcccctataattcaaccctaccttaacttcctccccttcccttccacctttggctcattccatccttcatttgtttattcgtaaattctgaaacaagcgttattaagggcctgctgtgtcaagtctcgttctagtcagcgtggatgcccccatgaacatgacacagtctcctccgcaagcccctctagaggggggcacagggaagagcctgtgagtgacagtgcagtgtggtggggctctcagaggggtgagaggagccggtccctgggcctggagagaagggagtaggggagagccaaggatgtttcaggcagaataaagagctttaggcaaggtgtggaggtaaaggagagccagatcacaggttttgtatgtgctaatacggtgtggccagaatctctgtccaagccacgggaatggccagaactgaaggtaaagagatgccaaggtggagggaggggggtgcagggccactgaaggtttctaagcaggcagtagcagatttgtattttagaagggtcccaggctggattgtggagaagagatctgaggtgtgccggattcagcagaagacaggtgaaggggtgttgaagttggatgggtgggcatgatggtggcctaggctatgggtgatgcccaggacttgggggggctcttgagatggtagaagccacagacttgattacctaggggaaggtagtaggaaggggctgagagaagatgaggataatctcaggttaccaattcttgtagtagatagatggtgatgccagacagggtaattggaaataaagatattacaagcaaatttgtggaaaataatgttgagcctggcttttgagatggtgagattgtaaactctgaggtagagtttagtaggtagctggatgttaggatttggattccaagagattattagtacacacacacacacacacacacacacacacacgtgcgtgtccatccatcaaagccacagaaggaagtgaagatagccagataacctaaggagcatttataaaatgaattcagacaaagcacaggtaagaaccctgaagacatagaataagagtgaccagagagcagggggaaagtgtttcagaataactgagaataagtaagccaaaggcaggaggaataaaatgttgtttcaagaaggaagccgtcagcagtgtcaatgccctctgaggtcaattcaaacaaggaaagaaatcgtgcccactggtttgacaaacagcaggtctaccccttcctgctccactccccacctccagccctgagagactagttctggcaaagtcaaaagaggaggggctaggttcattttctccagcattctttgatgaacaattttaaacatacagaaaatttgagtgaataatacaatgaatatatgtataccctccacctagattcaattcagtcgttgttgccattctgtggtatttgctttatctaaccatctatctataaatatttttggctgacccatttaagttgtagacatcatggccactgagccctaaattctaatcagcatctgaagccagattaaaagtgaataggagagtgaagaggaggtaaatgaataaaacacggtgaatgggaattttgctttcgagaagtatgactatagggacttccttggtggtccaatgattaagaatctgccttgcaatgcaggggatgcagggttcgatccccggtctgggaactaagattccacttactgcaaggcaactaagcccatgaaccacaa

SEQ ID NO: 42722 - DNA, 1086 bp, Bovine  19866880447184
ccccaacccctgcactcagacctctccctgggcccactcctctgacaaatggaatttatttcctgccctattggtaaacataggatgtcacagtcatcagcaattgcagccaccatagacagtgagctggtgatccctgagggaactcagcaagaaagaacacctgccatctagcagccatcagactgcagccacttcccatggtgagccctggagaaactcaggatatgaaaatacaggatactggccccagatagctggggtgcatatcaaaggaatgatttcagtgagcccagactcttgcatcttcccatgcacagaaaatcaccaaactctttaacctgggttatctggttttctttcattaacaactgttttttgatgttagaccacctgccctttgttgcacaacttctatataacctgacttctccccttgcctccttggagcagttctgtcagttacttagatgctgcctcctaggcttgaagtcctaaaaacacccacctaatgaaacctaactctcaactttgaggttgtgaataagtccacacctccaatagagccccatcaagacccagaccccagggaggcaaatggagacctctgaccttcaggccacgctggaaggtggagatagacagcagggctaggtcttgctgctcctcagcgtagcgcaccaggtacacgtagacgagcttcttcacctggggaagagggggtttctcagcagggactggtgccccttccctgagagatgtcctcaccccgggtggctgtgctccacagagaaagcatccagggtaccctggccccatcatgctgatccacatctggttcagggacatctgggaggtgtcttttcctggaccagggacattctgagcagattggacctccagggactgggatgtcccctttctcatccccaattagctccagtttactcctggaggtggacaagggagacccctccctgggagcactcacctctatgttcttacaggccacattcttcaccacggcggggaacaggtctgaggcgttctttccccgggcaatcatctaggtggtggggtcagggt

SEQ ID NO: 42723 - DNA, 1465 bp, Bovine  19866880490633
aattagacgaatatttgcttaaatagaaaggaacctcggtatcctcaacaactacagaactctgccaaacatatgcagtaaatgttgaactgaactgaacaggcagcctgatgaaaagggatatgggatatccaatgagggatggaagaggattcgtgcacagaatatactgatgtctaaatacagtcagaaccatacaccataactgagggtcaagggtaccagcaatacaaggggcagcggaagccacaggaataaatacaattcacatgaagagcacgcatggagaatgagaggaggtcaagggctgagtcctggacacactgacctcagagagaggtcatggcagccaagagttttgaacaaaacctcctgaacttcagatcagaaactctgcctgctggaggaaaggggaggacagagctgtcacatgggtatggaaacctttaagagtatttattaatatatcaggggcttccctgctggctcatatggtatataatctgcctgtaatgcaggagacccgggttcaatccctcagtcaggaagatccctggaaaaggaaatggcaactcactccagtattcttgcctagagaattccatggacagaggagcctggcgggctgtagttcatggcatctgtagaaccaagaaaagggaaagcctgtttgggggtctgagaagaggtccttatccccagggacctgagtgacagggctttacaaatggacaggactcttcttttcaacaatataattttccttgaaaatggatctaataatgtgccttgtgcttccatcaagactaaattggactccactgactcataagtctttttgtgtcttcagctccgatccttgcttcctgtagcactcactaaatgacagcgctgttgttctttctacccgaaaatctatttcagggacacagtggacagtctatagttgcctgtgctattattacctggggcacagtgggatcctttattgcattcattttggatgtgaaggaaaagaggaaacgcaaaatgaagtagaatgatatcttgctaggtaaaatcccctgagatgaatgttctttatgatgaagtcagctgtgtggagaaaaaaaaattaaaaatggctacttcataaatcttgccttgcagtatttgcaaggatctttgtggctcagaaacaacatttgactaaactaatatgtgggggtaaaaatatctctagtctgtttgagtaaaaatggctgaagatacacacatcttatccctggcaaaattcaattcagtctggcaaatatttatggagcaccaactgtgttccagggatgcagaggtgcaaggccagagaccatggccccaagtgctgcccagatactgagacaccggggaaggggcaccctgagtcactgaggaaaggaaggtgtatttctcattgtaattaacaagcggtatcgatctaacgagaaac

SEQ ID NO: 42724 - DNA, 1057 bp, Bovine  19866880527427
gctcccccgtccctgggattctccggcaagaacactggagtgggttgccatttccttctccaatgcatgaaagtgaaaaatgaaagtgaagtcgcttaatcgtgtccgactcagcgaccccatggactgcagcctaccaggctcctccatccatgggattttccaggcaagagtactggagtggggtgccattgccttctccactagatgggagatgctggtcaaactatcctgttcttatcctgtctccaaacctcatcaggaaccctcacctagccaggacctggggagaggaaaaggtcagatgttttattccatcctcaaatattttactgtcctcctctcctcagagctaccagggagttaggagttaggcttcatttccccccacttaaactctcagtccccataacatcccccacgcccgcccccctcctggacactaaatgccagtccagtcctcctgctaaagaggtgggacttaaatggttcctgctggaagagatagcttcccatccctggccttcctatctgcctgggggagagtctctgagggctcctctgtaccgtaatggctggctctggctctggccctggccaggctctgggcaaggtcctcccagggattcttctggggtcgtgtcttcttctggggcttgcagccaccgaagctcctctggctgcagggcctggtaccagggtgggggcccaccttcgggggccagcacagggctggcagcctcctgatcggcctctctggcccctggcctcactggtgcccctgggagctgcaggaatcgctgcatcagggcaccagatcctgcttcgaaatgagactgagctgaccggggagctgggggtgcctgtcccggtcaccagagggcccgcccgaaactcagaaactggacactggcaggagggaggctctggtttcctctttgctgctcagagacaaggactcacgtggtggaggagggcagggactagggacagagccaagtcccagtctgcaggcaggggactggcaggcaggagagcagatccagacacaggtgag

SEQ ID NO: 42725 - DNA, 1004 bp, Bovine  19866880637088
attgaaggcgggagaaggggacgatagaggatgagatggttggatggcatcaccaacgcaatggacatgagtttgagtaaattctgggagttggtggtggacagggaggcctggcgtgctgcagtccatggggtggaaaagagggtaattgtatagaccagtgctactcaaacttttaagtgaattaatgtcaactgggaatcttattaagatgtagatcaattccaattccagaagtcttaggtggggggctgagaggctgtataacatgattctggtgatactgattttgttggtcggccatgctagactttgggtagcaagagcatagttggtatctagattctctctgcgtgcggcatggagtccccgtgaacacaaaggccctgattttggccggggatgggaaaaatgattgcttctagatgtgggtgtgctcacagtgtggtggaagggaccatacagagagtttgtaagggggaatgggtacttatatttggatgtttttaaaggaagcattatgtttttataactattacatatgggttatttttaaagtatgtactaagcttgggggaagggtggacagagaagctggggggggagtggtctggggtgggggcagcaccagcatgggtgggttcttggctctgactgtgcagtggtgaagaggttttgacagacacaggcttggagcaggcagagtatctacagccagacaggaataacatggatggatgacacagcagcaaagctctttaaaaaaaaaaaaccctccgaggggaggagtccctcccacagactggccgttctccccttctcagctgtgcctgagcgcctgtggacagaaggggacactctggaggctctggccagccgttcctgtggctaacagcagtagctcccactctgcccaccttgtaccctgtcccgggtggtcccaggtgggcatgcttcctgtgtccggttccttctcgctgtagcatggcagagcgagcggggtc

SEQ ID NO: 42726 - DNA, 1830 bp, Bovine  19866880714453
cccacacccagcaagctcccaagaggttcctggcctcccacctgactttggcacccacagcatctgatctgctaagtctgaaagcgactcccttgggacaaaactgatgattaatcaagtttgacttttgtcagagcttcctctttttttttctcctctcagtttttttctttcttttttttttttttaaagcaggcatgtttcaccaaggatggaaaattctggaaaattggaatcccaccacctgactgaaagccctatcactggcttcaagggagggagctttaaaaagccactccttggcttctcccatgaattttaagtattctgaaagctttgcccacaaaggcagcaacgcctcatcccttgaataattaaatagagcacactggggttggcgggacagcataggcccaggcacaccgttcctctgggagcctcctcctcaagtggggagctcagcggaagcccgaggaggtcctcctcgcagagagatggatgcagctgcaaacagccgtctttcaagcagtgggtaaggttggcacaaccctggcagtgtcgcggaagcggatgcaggtgtcacgtgatacggcacatgttttccctcaggtgctgccgtccagcagctgttcgcacaggccctgtgaggtcttggttggtctttcttgtcccttcgctgccacatcactgcccatgtaaggtgtccatggccttgggccatatcccccatctcccagccactgtagtattgacattggtttctctgtgtacttggtggaaatttctggagactctgtgagggcaagagaaggctattttatcttctagcagatgaccctccccctcaggagccatggtagcatctcggaactggccgattatttcctggctgtcttcctgttccataattacacaggctctttatctgtgaggccacagaatggtgtgctggacagacagaggttgtgtcagatggtcactgtggtgtcttacttgagttctgtggaagactgagttttgctgggaggaaaggaaggcatatttgttgattatctataggtattatttcatttaagcttcatgttttatggataaggaaatgatttcagagaggttaagttacttggcgaatgtcacacagccagcacattgagtgggctggtggttatgtatgttatctgactctgagacttgtacagttccaggagaaatgaaaaacactctttgtttcaaaagtataaacttgaggtctaaaagaagagatatgtttaaggaagctctgttagcacaccttccaaacagcaggggttaagagcaggtatctttggtctggtgtgagcacaaagccattcacacagctgagttttctttatttttaaaatttttttacttatttatctatttatagctgcactgggtcttcattgctgtgtgtgggctcttctctagttgaggcaagtgggggtctactccctagttgcggtctgcaggcttctcatggcggtggcttctctttttgcagagcacaggaactaggtgcttgggctcagtagttgtggtgcacaggcttagttgcttcgcaacatgtaggatctccctggaccaggcatcaaacctgtgtcccctgtattggtggattcttaaccactgggccaccaggaaaatccctctttcttttttaaatccaaaatgtgctttttgtgatggtttcccactcatctggattcagggtgcttttaatgctgcttccatctgaaagagcatctgtctgcaagcctggcttttcctctgtaggctggctgaggacagtagagcagccagcacacaaag

SEQ ID NO: 42727 - DNA, 1250 bp, Bovine  19866880941094
ccccagccagacactcagactgacttgtaccccgagaggaaaccagctcaggtgacctgtgtttctcagttactagtgactaactgtgaggtggagccactcacagccactgtgtattgaacagtttcacacgtaaacacgttattttggtttcacttcatagcctttttgaggggagtgttttcccctttcttcagatgaaaataaaaacatcagagtaacgaggcttctttctaacctcagtgccaccgtacctctcccacccccttaccccctctcagtggataaaagggtgttctgctttgctttggattcctttttccccagggccaagtgtgggaaagtgctgctgtcttctgctgtcctctttacctcccttatctctcctggccttggattcactctttttttgatgtttaatatttaaatattgtgcactgggctctgctgtgctgagcgctttccatctgctattttaattaccgacccctcctgaccatgttatgaagcagttggtattccacccaagatgccatgagaaaacggagactcggagcttcccagagcaggcaggtgtatgaaggtggtatcaggctcagccaggattgctgtcagccagagcagctcgaccacaacatcactgcttccgtcctaaatgtttgaagtccagggttgtctaggagaatctgcatgggctggaattctgcacacagtagcctctcggatgagatggatgcttatgctctgccggacttctgggtcatggcatggaattctgtgtcctagctacgtagtgttagaaagggcacgcggtgcattcttctgatagacgtgttggcaggcagcaaggaaggagtatggtttgggcttcctaactgtgctgacggtgtctcctgtgatgacatgggcatgtgtattcagacattggtagcggctgtcacaagggccccccagtggcacagaatgtcccaaatgctactgtcccagggacctgggtcttcagaaagccatcctattcctgcctctcattagataccctgggtgtacatctgctcgttacacttgtcactgtggttctctcaggcttttggtggtcctgccttggtgtgtcttgctctgggtgtaaagggaaagcgcttgtctgggaagaaaactaagaggtcacgagattctttttccctcctcttcctagtactgagcatgctccataacccactgggcaatgttttgggaaagccccccttagcttc

SEQ ID NO: 42728 - DNA, 751 bp, Bovine  19866880999825
caagtttcctcaatatattcgagagcctgttatttattttagtcaacacaaacctccccctccacaaaagtctctaacttgcaagaactatgaaattaggtgtgattcaagaggagtggaaaactaaaggagaaggaatgatcatcagaagaaagcaaaccagtatagattaccaagcgaaggcccccggtgttagataaccaagcgcaacgtaatcttggctgaacaaaacaaatgagtgtaaattgaagccaaacagaaatacagtagatgttgtttgtaaacactgacaaaatcatcccaaagtcacaacagcacacaagctggcttttctcttagccttctgcaggcaggtagaaagacaatttacaaccccaatgctcgggtgacagccgacagcctgaaaattaacccaagtcacaataaaagctaaacagtgtgcttcagcattaaaagaaaactgtctccaaatgtgatttccttctctcttggcccttgcaactctcaattaagcatgctatataaaaggtaatccagaaattatcacgacttctaggctggcatccaggcaaggctgcccaccacttcaagcattgactcaatcaaaaaatttattggaagcctattaggggcaagacatggtgctaggtgttgggattcactggtgaagaacgtaatacctcctcctctcgggatactattggggaaggcagatgataaacaagcacaaagaacccaaacaacagcaggt

SEQ ID NO: 42729 - DNA, 1237 bp, Bovine  19866881027454
aagtcccatgcctattgctttcttttggataattccttagaacagattcctggaagtaatattataggtcaagatattaacactttatggctcttgatgaatattgccaagtgggtttccaaagagttctgtcctccagcctgtatgagaatgccagtttattgcatcctcgccagccttaggtataagatcttgtttggttttggtgttattagctatgggagttgaattttattaagtggttttatagtatttcttgaaaaatttttttcctggtgttttcattattctgctgtcttcctcaatattttaaaagatatttatttctttatttcactgcaccaggtcttagctgtggcatttaggttctagttccctaaccagtgattgagcccaagtctcttatgttgggagctcagagtcttagccactgggcccccagggaaatcccttcctcagtattttgccatattattatgggagcagagtaaaggaggattatcaatagacatatcaccaagtttacaaaagaaaagagctagactcgatgcttcatagtttcttctgtgtctttaatctgtgttcatcctgatggacattttcacatggattatctgctgtcaccagaaattcagtgtatctgaagctgaatacccttatttgtcctctaaaccacctctccattttcccagtcatttgttgccagaaaatatttttaaaaagaaagcaaatggaaaagcgcaggatcagttcccttttagttgatcaaaatgaaagccggactcacgtttatgcctcgttctagatttcaaggccataactcttgtcctggtacagtcttgctcagactgttgcagtagccttctgactggcctcctcctgcctgcagtgtgtctggtcagtgctcctaggcagttggaagcaggggagttttgggtgcaggctggttgcagaatggggcctggctgtgggctcctccctccatgacccccacgaccatggagcaggaagcctccattgaggatcccccaggaacagtctgagagctcgtggtgccctggatcttttgatgaggctcccgtcttcaggcaaattctcccttcagcttaagttctctaaaggcctcctttgtactctcagcaccgctgaggttgcagatagaggagcttggcctcgcagtcctctctcttccttcaggttgccacagctcttactcatattttacgcgagttcaccc

SEQ ID NO: 42730 - DNA, 1411 bp, Bovine  19866881056656
atgctggagatgtctgctggacatccgatagaaatttccgcatgcagcaatacttccagtctagagctcagatatgatggatgtctggggatatccattgttgagtcatcagcacagagcgggaagctgaagtcatagaagagtctgagtctccaagggcaacaccaggagagcagagtcggggccatgggtaggggaatgaggggtcagctgaggagaaagaaacagcaatccagggcagagaagaatcatgagaaatctgaaaacagagtgagaagaaggtttaagggagggaggagataaaagtgtcaaatgcttcccagatattaagtaaactgaagattttaaaccaacagcagctgaacttggccctaggtcaactttgtctggggaactttcccagtgtggtttcagtggcgttgtctgtgggcagaaacctgattgcagtggacagaaaagaggggagggtagaatgctgaggctgtgggcactctttgtaagatgtgccccatgagggggaaaggagatccgagatctttataggaggacacaggattgaggcagggtatcagttttgttttgagactggagaaacttgagcaagtttacatggtgtggtgggggtgggaggagcccttacagaaggagagttgaaaacagagaagagaaggaataactacaggagtgatgttcagcagagctgaaggggacactgatcaaagacacagcagcgagagactggaagacaaaaggtgaaagggggcagaaagaggtcaccctgcagcagaggtctttccctgtgagatttggaaatcaagggaattgatattgaagcctcaatattatctgcaaaataagaaaatgagaaaaccaaggcccagagaggtggtgatctgcatgataatctacagagtaatagtttgatttagtcaagtttcttgactccttgcctggtcctctttctactccctagaattaactcacttgttttgaagacatttgcattgcctgaacatgtgtttgaaaatggggcttttttgtacctttcttttgaaagatgaccaggcaaggctggcttcacaaaatggaagactctgccacctgtcaccaaggacagtgagcctaccaaaacccaggaatgggacctagagattttccctcttgaaatgagtaagggactttcctggtggtcccgtggctaggactccatactctgggttcagtccctggtcagggagctagatcccatatgctgcaattaaagaatctgtatgccacaactaaagattccatgcactgcaatgaagacccggcacagccaaataaataaatgttaaaaaaaatttttttttttaatgggtaagatagcagcagttcaccctcggacagagatcctgacttactcatgcct

SEQ ID NO: 42731 - DNA, 1957 bp, Bovine  19866881101314
aattctccaggcaagaatactggagtggtagccattcccttctccaggggatcttcccaacccagggattgaacccagttctcctgcattgcaggcagattctttaccatctgagccaccagggaagccctgacacagtgacacaatggtggggttggagggaaagttgggtggaggcagcagtgcttggagctgttggcttaaagaatctggttctgggacttccctggcggtgcagtggttaagactcggtgcttccactgctgggggcacaggttccatccatggttagggaattaagatcctgcatgttacaggacatggccaaaaaaaaaaaaaaaagaatctggttggacacctcctgtgtccccaccctctgtgatggctgctgactcacctctcatgtcccagaccaagctgctgacccagtacgtgctgagcctagccaagtatgaccagaactacgatatccgtgaccgagcacgcttcacccggcagctcattgtcccttcggagcaggggcggggctctcagccgccatgccaagaagctcttcctggcacccaaaccagctccagtcttggagtcgtccttcaaaggtgggagctgaaatcaaaaggagccttcctgggggaaggggagaattggccagcaccccaggcctggctcttccccctgaggtctcagtctcggccaggcaccagcctttggtgggcaggattcctttgcccctgtggctggaccagtcctgtggcgccccaggcttgctccttcacccgctcaccaccaccactagcatcatctcacttggtctctgccctcccaggcaggatgggccgctgtctcctcagctgtcagactcctctttccatccacctccctgagcaggcatatctaggaaggcaggaagtagaactgcatacaaaggaggggtgtatgttggtaagggtcctgagaaagcggtttccagcattggctgggctgtcattgcagatcagcccagttcccaggccctcagccctgcctcatctctcaggtgggtgtcccgtgacaagggctctgacagcgagggggtgagggacccagctggctctctggacccaggaatctcctcaggagggagcttccttcaccaagctcggttctcctacgtatcttcttgttctgctttgtctctgccctggacccctggagtaaggagattcagagccgtggggcagatgggaaaagccccagggaggaagtgggcggtgcttttcatccccactacaggtctctgtgctgccctcctctggctctgatcccgtcccactcctgcgcagacggctcagctctccccatgcaggccagagcctgaccagacacagctctttgcccttggtctcagcctggccagtctcttagaggcgatacccttgtcgcaagcgggcctccctcctgagcctggcactgcggccatatagccctcatcccacccgcaccatgccctgggagaagccacgcctgcatttctactcctccctccccgccccatctcagcaggcagaccccggcagacaggcctgcagcagctctgggcccagtgccctcccatctcctctgagctcccagtttcccccaaccctccctggcccctcagccctgctcttgtcggtcatacaaccttcttcccagcctgtggacctgccgatgtggtcagggctgaagagcccttaggggacacgaccaccccttcttccgtctagctaaggatgttcccaccagaatcatcacctggccccacccaggaaacaacccccagggcatttccttattgccactcctggcttgacctctcaccctgtcctcagaccgggaccacttccagctgggctccctgtcccacctgctcaatgccaaggccacgggctaccaggagctgccagactggccagaggaagccccggacccatctgtg

SEQ ID NO: 42732 - DNA, 2716 bp, Bovine  19866881180679
atcccccatggacagaggagcctggcaggctacagcccatggggtcataaaaagttggacatgactgagcgactaagcacagcatagcacaggtcctgtgttgttaggaatttatcaattttttctagattgtccaatttgttggtgtataattgttcatagcagtctcttatgatcttttgtatttctgtggtacctcatttttcatgaaattccaatcttatttatatattctctctgcttttcttggcaaacctagctaaatgttggtaaattttgtttacctttccaaggaaccagatcttagtttcattgatcttttctattgtctttttatcctctatttcacttatttctactctaagctttgttattgccttctttctatgaacttttggctttcttcttctttttgttgttccttgaggtgcaaagttaggttgttcaggattttttttccccttgagatagatatttattgctataaactccttcctagtaatgctcagctgatcacagcactacaagtgtcagcagccagcataaagcaattgaagagaccacagtgagaatgactggctctgaacaagatctgatgagctggaacagcagtgcaatgagataaacagagagaaggagaagaatatccagttgaagagaagagctgaggatctggagtccaagaaaaagagatgaagctgaaaggcctctgaaaacacagtgaaatcacacctccactcacgccagagtgtgaacacatctctgagaagttacaggcagcagagagagacagtaggaaccctggaagacaaggtgtgttctctgaagacagacattgaggagaccaagtgccgacaccaccacctgaaggtggagctggagagcttctcggaggtgctgggtgggaggatctgtgccctgcaagacgtccaccagggcctctccaagccggggtgccagcaggcagggctgctcctgagtccccagcgtgtgtgtgagagagggggtctcctcctgagtccccagtgtgtgtgagagagggggtctcctcctgagtccccagtgtgtgtgtgagagggggtctcctcctgagtccccagtgtgtgtgtgagagggggtctcctcctgagtccccagtgtgtgtgtgagagagggggtctcctcctgagtccccagtgtgtgtgtgagagggggtctcctcctgagtccccagtgtgtgtgagagagggggtctcctcctgagtccccagtgtgtgtgtgagagggggtctcctcctgagtccccagtgtgtgtgtgagagggggtctcctcctgagtccccagtgtgtgtgtgagagggggtctcctcctgagtccccagtgtgtgtgtgagagggggtctcctcctgagtccccagtgtgtgtgtgagagggggtctcctcctgagtccccagtgtgtgtgtgagagggggtctcctcctgagtccccagtgtgtgtgtgggagaggggtctctagtggtagtgctaggctgtcctctcgtttcgttgcttctgtaaatgcaggtgcagtgtatcgcgcttccaaacccgaggtgctgtccatgctctcctcctcagaacagaaatctcccttcgcttctctggccttatgagcttgtagataactgaacgattctgactcaggaatccaaaactaggtctaccttaaacatttatgctgtcaaggcagggatgtttatatctttcttaagggttgttgcaaccacatgaactgaaaaaaaaaaaagtctcttctaatccaaatatgaataccttcctttgccacttcctttttctgagtagtgttcagagtattcgaatgtccatcaggcaccagtgcgtggggatgtggtgacagcaacttccctctcagtatacatggagatgtttcaaaacaaccacttagtagagatttgtcccaagaaagaaaacaagtttctggtgggtgtgttttttggcacaggaatcgcctgcattcactctgcccacttccacccgcccctagtttgtagggttgtgacaattttctttatcttggtttcatttctgagcagattacaatgctgtggggacacgacacactgagggtgcctaacacagtgcctggcacaaagtaggtgcttagtaaatatttgttcagttaaacacattaaaagaaacacctccctcttagaactgcttttgctgtagcccattaattttggtatgctgatcagacatttttattttcgtttgtctcaaggtattttttaaatgtcttcttcaatccattggttgttcagtagcatgctgtttaatctccacatatttatgaattttccagttttcttcgtgtaattaatttctagtttcataccattgtgcttagaaaaggtgcttgatatgatttcaatcctcttacattgattaagtcttattttatagtctgacatacaagctatcttggaaaatgttccatgtgcacttaagaagaatgtgtattctgttgcttttggatggattgttctaaaaatatctgtgaagtccatctgctgaacatgttgcttaaaaccaatgttcccgtaccgattttctgtgtggaagtaagtgggatattaaaatcccctagtactattgcgttgctgtctcttgctccttttaggcctgttaatatttactttatatattcaggcgccccatgttcggtgcatataca

SEQ ID NO: 42733 - DNA, 1273 bp, Bovine  19866881258508
cgtttcctggaacccattccagtctctgtcctggagatattattcttggagccaacggcttccagttctaatttggactgggtgcttctgaggcccactcacagccgtctgtctggaagttcttttcttcaggctcctggaagccacccattctctttctgcccccagctgcctccttactaggcttcacccttgtatggctggcacagaccatcagaatgaatgggaataaaccttaagtccttgtatacctataactgacttcactctcccctgacactggatgagactggctcagtgtatttgcttcctggggctgcaaactacaactaactgggtggcttaaaagtacagggtcttgggacttccttggtggcacaatagataagaatttgcctgtcaatacaggggacaagggtttgatccctggtccaggaagataccacacgctgaggagcaactaaacctgtgtgccacaactactgaagcccacctgccccagtgcccacgctccacaacaagggaagccactgcaatgagaagcccatacactgcagcaaggagtggcccccactcgccgcaaccagagaaagcctgcacgcagcagcgaagaccaaccaagaccaagaccaaaagaaaaaactacagcatttgggaacttctctggtggtccagtggctgggactccgtgctcccaatgcaggggtctgggggttcgatccctggtcagggcactagattccactgctgctgctgctgctgctaagtcacttcagtcgtgtccgactctgtgcgaccccatagacggcagctcaacaggctcccctgtccctgggattctccaggcaagaacactggagtgggttgccatttccttctccaatgcatgaaagtgaaaagtgaaagtgaagttgctcagtcatgtccgactcttagcgaccctatggactgcagcccaccaggctcctccatcaatgggattttccaggcaagagtactggagtagggtgccattgccttctccagattccactagattgccgaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagagttgactcattgggaaagactctgatgctgggagggattggggcaggaggagaaggggacgacagag

SEQ ID NO: 42734 - DNA, 1423 bp, Bovine  19866881324902
aatgcaactaaagaaacagtatgtcataaacagtaaatctgataaagtaaaaacataaaacgtaccaaaatagcaagcttacatgaaagttgcaagttctcgcatgtccctgaatggctgcagtaaatattgaaagaacatggttgtcgcagtaactaattcctggtacgcttcatcttcctctcgatacacattcattaatgctaccatggtgttggctttttcatgcccttgaagcaactagaaggcaaaatgtaaataaagttcaagtatggacaggataagatcataccaaaccaacagagctaaagaaacctgaatgttcctaacattaacacatcaatttaaaatgctgattaaacatgaaaatgctattgtcctccaaccaaaatgcccagtaagaatggttaaataaatcatggtacatccatagtagaaatattattattgtaatcatttattcagcactgtgcttttgaagaccggttctgtaatctgggcacttttataataataaatgggaattagaggaggatgtagagttgaaaatttatgtcctaagtatgtagtacatgtactaaggactcagagaaaagggcctgagagaggatatttttccatcacttttttgaccataaaggtattgtgagaatgcactccttttttaaaactgctaagggacttctctggtgatccagtggttaagactgcatttccactgcaggcggcataggttcaatctctgatcagggaactaagaccctacatgccgtgtgatgcaatcaaaacaaacaaaaacaaacagacaaactcataaggacatacagatgattccaagtacttctccagcatgttgactcttaattcccccaggttagtattcccaccaattccccagcagagtagactcattcacagcatcacaaatggggctgtagcctctgaagaatgcttctgaggcagggcaagaaataaatcgaacacttataatctagaaaaactcatttggtaagaaactaatttactgcccaggagaagagaaataaaatcaattaatagtataaactccgcaccccaacccctcggtcagtatatccttaaattcttctatttccttccctctgttaaggataaagtgatctatgttcagtagtcattttatccaggtgataacagtaggattatgccccccctcaaaaaaaaagcaaaagtttccctcaagaaaattaaaacacgtgaaaaagtaaacttaagacaatgatgtttttcagccttatttcttaagactattcagacttcaaaacattcagtttcactttctgtattctagcaatgttagtaattggtctaattctagaatcaattgctttcctgttctaaatatgagctgagtactaaaattattacatgctcttccatggat

SEQ ID NO: 42735 - DNA, 1456 bp, Bovine  19866881420923
tgctggcgggagtataatttggtatcatctttctggaaggcaatatgaggagagatgtttaccagctgagccaccagggaagtcccatattaaaagtccccaacatgcgaatattgtattcttagtcaggatacattatgtgtgcttcagtaaccgtgacatgccagtagtgttaagacttaacatttattctttatccacactgcaggttcatgcaggtggggccgtgtcatagtgggagaagggcagctatccacacagtcactcagggacccaggctgacagaggctccagccctgggacgtcaccaaggcaacaggagtctgcagacctgcccaggggcatctcagagtctcagcctggacgtgtcacgtgtcactgctgctcgtacttcattggccataattaggaacaagacctgaatgactctaggggctgggaagtggtgtctcctgtgtgcccaggagtgggggagaagacagggcatgcttgcaccacccttcatacttttagccagcaagtccaattttagaaagttatcctaagtaaatattctgagaagttcatgaagatgttagaagaaaggatttcatcatatccttgagctgctgctaagtcgcttcagtcgtgtccaactctgtgcgaccccatagacggcagcctgttaggctcccccttccctgggattctccaggcagcaacactggagtgggttgccatttccttctccaatgcatgaaagtgaaaagtgaaagtgaagtcgctcagtcatgtctgactcttagtgaccctatggactgcagcccaccaggctcctctgtccatgggattttccaggcaagagcactggagtggggtgccattgccttctccgatccttgagcataaccatataaaattgggaccaacctaagtaccgaaagtacaacctacactgatgttaaacatgatgctgttacacatttactgacatagaaatatactcacaatatagtgttaaaaggaaaaaagcaaattaaaacagtataatatgtataacatagttgcatctcatgaaaaaagtaataaaacttatatagatgcatacaaaaatgtctgaaaagatatatgccaaagtgttaacagtggttataatcagatggtataacaacaggtgattttttttattttcactcattttaatttcttcttaaaaaaaaaaagggatatattatttatgtaccaaaaaggcatgaaaaaaaccccagtattcttggggaaagtccacttaactacctcacactcatcattaaattcttatatgtgatgcaagaaatgcctaattgtctgtcacaccataagacactgctataacagtttatttaaaggcaggactttaaaagtggaacacagggcaagaacagtaacgcactgcccatgggctgggtatcatcagacctgtcaagcatcccacagt

SEQ ID NO: 42736 - DNA, 1195 bp, Bovine  19866880561202
tgatgtctacgaagccaaggaaggacgcgcgtgttgttttctttccccatttgcctaaactcaaacacacccttgacacaaacacacaaaaagacacactcaaacacacgctgaccccagacagcactgacctgcacactgccaggtctggggaggagaacagaggcggtgggtctgagtctggggaggcaggagcacccagtggttagggtcacaccccagccctgccctatttcgctgtgtccttggtgagctggttactgtctctgtacacagtgagctagataacatggcaccctcagcactgagaaagccctcagtaggtgccaaccataaccatcattgaaccatgagagtctaaattctcttaccgagtggagagggtagaaggcacactgggcctggacccttcaggcaacagctccatgtctcccaggtccatgttccaagctgggccatcctgattccttctcggagtccaggatttggactctatagctttttcccccaaggcccgagcctgctccaggctcagcattcaaggatgcccacgagggcctgataagccaggcacacaggctgcaggaggtcccggccccagtgctcagccctggctggggcctcccacacaccccaggccaggacaggggccagcaggatttcctgggtcacagcctgtcttgggaggccatggggtcaactggcctttcccaggacatggctcctggtttgcaacatagagggacaatcgtaccgatttcataggttggggatgtatctgtctggctgccggtggtcagcacgacacacagccagtggcacatgcgcccttgcactgacacacgagagtgatttcacatggggcagagcatggatgtgcagaaagggggtgctgattccctcccctgtgccccgctctgccctgagagcctggctcatgtgacagtcaccccagggtggagagtttcttaataaagattctctaatacctgttaccccctgaagcatccaccatccgtccctctgacaaggctgtcagccctggtgcccaacccaagtgcaggctggacccagaggcttgccctcctctggttcaacccacacttctgctgacataaccaaaagcagaccttacaacacctctagtatttccaactctgccccgtggcttccctgtcacagctcccacaagcag

SEQ ID NO: 42737 - DNA, 1520 bp, Bovine  19866880578640
ttggatttttcttgttcaggatgtgagtgccttcagccctcagcctccactggtccaggtttccctcctccttgtcttcccaagccactgagctccaccccctttccctgggggctggaaggtctcgattgcagagtctgtccctgaggttgctctcatcgcccttggttcagcctctaaccccatttccttgagcagctctgcctccccaacccatttagcacaatggtacagccctgaaccaggtgggcagtgtgtcaacatcctgcttggggtctgggtgggaggccctgaaggtgtgtcctgtgagcaaggtggtgggaaagggggtcctccgacctctgcagcctgcatcttcacagaggaccctcaggccgggcagtcaacacagccccagcccctgtatctcttcaaaagggaggtgacaacagcagccacctctgagggctgtcgtaaggcctaaagggaatacctagcacaatgcctggcacttcataagtggcaggcagtccaacccctgtgcatcctttgaacaccctggtggtgtaggcaggttggcattcagtcctcaggttcctggcctaggggttaaagcaccacccacggtctcctgagccccagcagggcgttctcatcagggcagctacccccaccccacctccccaacatggacagggtgaagtgcagggaagggtgagcagagcccaacagtactgctgggagaccgtcagacaggattgctggacagaaatagtccaggtcaagaggccgggctcaccatgtcactctgaggacaaccctgggagaaagcagggtcattgacctggatttgccctccctgggctgagcctccgtgacccctaggcactgaccaaggaggatctggtccctgcactgctccgggcaccacggaggccccatcaagtcccagcacgtccgcctgatttgccaatctgttgactgtgcccctggccctcaagtccctattcattggtcggtaaacatgttacctagcaaccgagtgtcaatatcaacaaaggctcggatgaagttgttaatctggcaagactgacagctctgcactcgcccctgcgcatattgtgtgatgctcagaccggcccacgaggatagcgatgctcaaaagaccctgtgtctccctccactatgaaaattaaatgaagtgtgcgttgcgggcagggaaaaggcaccggcgctggcccgcctggggatcttgtttttcttttcctttcctccccccggtgccatagcccgtggggtggagtgcttcccctgacgcagcaaccgctgctaatttccgggaacaatgtgggacactctagggccagtccgtgacacccaagcagacacgcctgtcatttgtcatttgcgtgcagggctccaggtggggtcagcagggcgcacttggctccgggacccagccctgggccaggctcaggccacgattgacagtatggcctggggatgtggctgagcatgtggcagccactgccaaggcccct

SEQ ID NO: 42738 - DNA, 1893 bp, Bovine  19866880588892
ctagattacactggggagaggttttcggggtgggggctggagaaatgtctctacagcaactcctactttggagaagaagggagaagatagttttcatggccttgtgtgatggaagagaattccatgggtgttatgagatccccaaaatctgtatgttgaagtcctaacctcagaatgtgactgtgtttgggacagggcctttaaaaaggtaattaaattaacatgaggtcactaacctaatatgactggtgcctgataagaagactggacacagacatgtgcagagggaagatggtgtgatcacatgggaagaagatggacatctctaagctaagggaagatgcctggaggaaatcctgccctcatctggctcttggaaggaaatagttctgctgacattatgaccttgaacttccagcctccagaactgtgagacggtacatttctgatgtttaagccccccagtctgttatggctttgttatggaaattatggaaagtctagccaactaacccatgtggtaaaggatgtatcaggtagagtgcctttgtttttgtttatttatctggcactgggtgttagttgggcatgcaggatctttagttgcggggtgaactcttagttgtgggatgtaggatctagttccctgaccagggattgaactcagtccccctgcattgagagtgtggagtcttagccaggggagtcccagatagggtgttttagctgcaagtaacaagcgatccaactaagaaagatttgatcaggccatttaacaaccacatatggcaaagaagcaaggcaggcacatgattttaagatattatcagggcttctgtctcttcccagttctgagttccgcctcctggttgtgcttttggtccttggaatacttagactggtgatctgggaggacctcgctgaagagatgacatctgacttggacttgcaggttgactagttacccatcctgggcaaagccagagaatgacctctttttagggctggggagccagcaactgtgtcccccttggggctggggctgaagacctatcggccattgactttgactctgagcccaaggccaccaggtctcctgcctgccttcaggcagtgccagtaatccatccagcatagatgccttattctatttgactatttttcattcctggcaacatccgttgaaggatatgcaaataagaaaatcaaatgaatttgtttcacaaagaacagcatttaatcagcacaataaatacagaacattgttggctgcctaagatgatagttcatggagaagaaagtgtaggagggaaatttgaagggcaaagaaatagaaaagaaggaaaagaaggagacactgtggtgataactgagtgaatgaagagccaaggggtccaaagacctgaggttgttcattcatttgttcatgcatctatccatcctttcatccagccacttgtcgtttctttctttcatttattcatccatcaatcctttctttcattcactcatccaataaatatttatggagaacctatatgcaggtacaatactagaaattgaaaatatgggactcatcaagacaaatactgctcctgcctaccgggcacttcttctagtgcagtgagaggagaaagacagtcatgaaacagtctcacaactatatatacagctgcagactatgatacatgctaggaaaagggcagggggtgaagaagagccaaggaagtagtaaaatcagatggatgagcaggaattaataaggaagacaggttggggtggaaggcttggtgtttcttacacaaggagcagctgctgctaaggctccgaagggaggaagacgcttggctccctcaaagcactgaaggaagctggtgagaccagagcgctgag

SEQ ID NO: 42739 - DNA, 1300 bp, Bovine  19866880666507
cttcttggtgacgtgagcgtctgggcctggagccgtcttcacgtgcttccggagggagctggggtccgtgtaccgcttggtgcagcctggaatcttgcagatgtagggtttctgggaagtgaagaggcgtcatgcatggggcaggaaggcagactccacagggcagcactgcggcacccctgttgagaggggctggacccctggatggagccctgccccaccggcctcacctgctaccttttcttgcaggtaagcatgtagctaatgagaccctcatccccaccccccctaactggagatatggatcagagcctgtggagggaggggtcacagtgcctggtgtgatcagcatgttgggatttttagtatcaatgagtgtattacctccttatatgtctgtgagacaccactgaacaccctgctctctctcatgaggaaagacaggatcagagaggcaaagacactccaagtcacccaggagcggaatgaaaacccagggtttctgacgcttagtcctgagctcatacacacacacatgcacgacatccatatgtaaacagacttttgtctacatgtatacacacagacatgtacacacatgtatgcacacacatccacctaaacacacttaaacatgtatataaacacccacgtgtgtacacatacttacaaatacgtatccatacctcctccccgcataacacatacaaccacatccacacaggcacatacatacttgcaaacacacatagctttccaaggctatctcttgtctttagatgctctgagttgatacctttgggaatttctctgacttcttatcaaagcaagtctctttggggtccaaaatgtccctaaacttttagagacatcctttcctgagtctacctgagtgatggtggttgaccctaggagagaccgggaggcaggtacagcccacaccaagggctccctcagctctgcccggggctctggctatctggggagatagagcctcctgtgccccactgagggtaggttgacagccatggcaggccaggcagcactagtagctggagtgtgtcatcagctgctgtcggactgtggggacaggggtaagggctgtgtgctgagctccaacagcacggggtggcagggagtgacatctggctaccaaatggcctataggtgtcaagaagccatggggtgagggtgacccatgccggggcccccaggcgggtacctcgttggagtgggtgcggttctggtgcttggcgcggtctgaggcattggagaaggctttgttgcagccctcgtgctc

SEQ ID NO: 42740 - DNA, 1486 bp, Bovine  19866880699450
ccccaccgaaccctgtcttgagccaagtgccattctgctgggctgaccgtggggaacaggatgcctgccccgactgggtcagtctgcagggtgcgggtggtttccggtggctgactttcccaccggcccccaggtgtcgcagctgccccccaccctctgtcctgtctctgtgtccttgcccttctggcctgcaccccttttgttctaaccatctgttctttgtctctacctctttctcctgactgtacctcccctaaggatagacggtactgaggtgagcagaggagctgggtgggactgggggagggctggcatgagtaagggcggctggggtgcttggccaggctcctcaagggcctgggaaggcagatttggttaggtagacagcaggtgctgcaagtgggccgtcggaacaggttacagctggcaacagggggcaagtgtgcagtcacaggaggaagccatggggtccgagcctgcatgaggatcagggcagagtggaggtgcaaatcaggctgcagaggagggaaggacagacctccagaaggtcttgagtcctgaggtgaggaaggtgggcagtgccatgggcaagtgaaagcactgcagcttccctggaaaggcctggaatgtgggaccttcagaccaggagtgagccggagatgcttcatcccaggtgagccttatttgggctcagatcctaggtcacggtgaaggttgcccacattctgtgaagttccgcaccatacacgtgtgccatgaactctcatcccactttgccttgactcagagggagtgctggtttggggagggtgagggcaagggctgcatccagcagctacaacctctgcagtcaaactccctttctaacaacccgtctccagccttttgggcaggcagcaggtcagcaggccttcactcttccttgcttcctcgagcagcccatcactgctgtcaggatgcttaagtctcctctttttgtgttaatttcacacggctgcggcagcctctgtggggctcagctgccaaatgttcacatactgaaagctcttcaagcagagctctggcccagacactggctggaagagcttaggagcacagcagggaggctgtgtgtggggagaggggctgtaggtgggtgcctgatgattacctggtgccttctacttgctgggttgtctccatctatccattggctctctccagggggcagctcaggtccagcttatagttggggaagctgaggttcagagaagtaatgctttgaaagctcctccatgcagcagcttccttctcgccccccgcccccacctccccaggtgtgcaagagtgctgtgttgggtggcagggcccatggcttctcgcaccctctgagtctgtgccttatcatgccccctgcagctgtgtcagtccagccccggagcccagtcttcctgcagcagcgagccctctcccctgggcagtgcccccaacaatgacagtggcgtgg

SEQ ID NO: 42741 - DNA, 1148 bp, Bovine  19866880710691
ctagagatgatcttctaagtgaagtaagtcagacagggaaagacaacatatgctatcacttacatgtggaagctaaactatgaaacaaataaacttttatgaaacagaaacactcataaacctagagaagagacttgtggttgctcagggaggggtggcggggttggcgggggagggttggattgggagtttgggattagccaatgcagactattacatggacaatcaacaaggtcctactgtacagcacagggagctatagttaatctcctatgatacagcataatggaaaagaatacaaaaagaaatgtatatacatgtataacggaatcactgtgctgtacagcagaaatgaacacaacactgtaaatcaactataataaagtaaaattttttttgaaaagcaatcttctggatgctttgccagggtggctttgcctgaaggtcgagataaccccaccaccaccaccctgcggtgggagtgggggcggggtggggagcagccgccagtgttttgtttggcgcagcggctggcgtggttgcctcggtagctgagaacatcggctctggtcacgcttgcctccgctccaatcctattactccgtgcggttgggctccgaaaatagcctctgtcagccccgtcatcacagttcagcgtttccaccaccggccatttattgttcctcggacacaggcatcgttaacccctccgctgccagccggctgggggcacctgagctgagcggccccctttggggaaacggttttcttttcattgtcttcatccaggaggagctgcaaagggcggggagttggcctccgtgccagaccctgcatacaacctctcattttaactcatttgagaaactgactgaggccctggcgtttctgtccgcatctgacgcagcaagatgaagtgacttgcccaaggtcgtccagccgggctacagtgagcgtgggtacagaccagaccgcctgactcaatgaccgtgaccaggccccgacaccacgctcctgagtctgatgataaagcccaccaggacatacatctgtcccaagacactgcagggccccctgggaaggaaagaacacgggcccacgggcccccgcagtgtgctcttcagactattaacacgcatcattctgtt

SEQ ID NO: 42742 - DNA, 3217 bp, Bovine  19866880900572
ttgggtagacaactgtctttgtttgcttgtttgttttcccattctctagacatttttagaaaatctctttattcttggttatctgaaatttcacaaagacatgttgaaataagattttttttttcttttaagtgttaggcatgcagaagagcattttaatgtaaggatttctgtctttctgatatggagaattttcttctattaactctttattcattttctctcatccattttctgtaacttccattagttatatgttcagccacctgctttaacagtctagctttctcaactctcttcatttctctttgcctttgcttgtttattctcctttccatgatgtttccatctattcctttgatgaaccttttatttccaccaccatatagttaatttaaagctatttttctaggggtgggatggattgagagtttgaggttagcagatgcaaactattatatagagactggataaccaacacagacctacttactgtacagcaaggggaactataccaacctcctgtgataaaccataatggaagagaatattaaaaaagaatgtatatatatgtattactgagtcactgtgctgttcagcagaaactaacacaacattggaaatcaactatacttcaattttcagaaagctgtttttctgctctctaaaaattcttgtttcatagcattctattcttgttttatgtatgcaatgctttctgagaatacccatgagaaggatatctttgtcatttacattttcacttctttcttgaatttggtttctcctgggacaatactctgcccatggtttatgctgatatcactctttcatgtcattttctccagatgttggttaaacactgaatgtcaatttatctataatataatgatgagagactagaaacctgtctggaagttccacaatgccgactgggacttgttcagtggaaacttttactgttccactgggggatccctaaatgccaaggtgcatgaggctcagctctggggctccccatgcacgtgttctgccctggtgacccaagagagtcactttagtttctctgcagaagaagccaattatcaactaatcactactgacataaaagattaaaaacccgatctcaatcattctccacaggggagtcacaaggaagaaaggggtcacctctcactgaatctttattaaaaaatcttgtaaaatattcataacagagaatttgccatttcaaccacttttaaatgcataattcggtaaggttaagtacattcacattcttgtgtgaccatcttcctgaactaaaaatgcatccccaatacacactaactgctcatcccctatcctcccagtccttggcaaccaccactctactttctgtctctgtggatgactattttggataactcatataagtggtatcatacaatatttgtctttttatgactggcttattttgcttagtatagcatcttcaaagtttgtccatgggatagcacgtgtcagaatttccatgctttataaggctaaataatatcccactgtatgtatgtagtatagtttatccattcatctgccacccatttacttttattttttcccatttactcttaaagcagctcagaggaatgcctgacaacaatacagtactgccctcatcgtgcacaagcagcccaggtcttcagacgctccacctcaccccctcccaatcccgccctctctctctcatggacacctccatctgtcagcttccagacctcttcacgcaagtaggacatatccaagacccacatctcatttcccccagcccccagatcctctgtgtgggtggccttgacggaagactagctatttttagtggaaacacagaattgccaccatttttagcagaaaaggcaaaggagccaaggaggcttggtttcccttcaactcttccctctccagagtgtcttttctgccaggtccctaggcaaaagttgccaagaataggatgaacaatggaaaacagacctaagttctcatctctgtcatgaataccctatctccacctgaaaataaaatgaaaatctggagacaaacccagtagcagtgtcaaggggctgggtaccacccagtctgcaaacacgctgtgtaagcatcattgctctggacaccaagttccctaggtgatgagattcggggtagaactgcatagccccagatatcacagacttgttcgtggaggaggcccaggccttgctggtgcaaactacaggccagaactggggcctccccttcccagggctgtcccagggatggctcagtaagtgccatccagagctaagaacagcttccctcccaagttcaggggccaggagcatccacgaccagctcaggtgtgcaccgcccaactagctccatgaagatgcagcctatatcattcatgccttttccctcttctcccagctgctctgagcactacccccacctaagtacatgtcattaataaaagataaacaagaagcatgtttcgggatggtgacatctgccacaccctctgtgggtctccgactttctgggctttagaaccacatgtggtagggaaaggggggttggtagggacccagctgtattctaagcctccacattgggtcctggccttggctggatgaaatcaattccctggctccaaacaggaatcccccacccctaccccccatgcggccagagcatctgaagaccagaatgtccaggcttgctgtgggagggtgaggactgattttcaacacacacactgctaccctgtcatcaagctcccaataagcattttggggctcggcacacccagacacacaaccatcactgcctttcccctgctagaatctcgggaacctcactgcctggatgcctgcggctgtgcacccatttttgccaccagccgccagctcttcttctctgatcctcagacagagcccccaggcagggatttggggagggtagggggtgcggtgggtggccgtcctcccccaggcacacatgaccctcgtggccctgagcacttttgcctttaggggctccttcatttttaaaattctatttcaggcacgtatggtttagagattaatatgacccagacttctgtgctagactctagtcatttattttcttctcatttaaaaagcaattaaaactttttacgggcccctaacagcactgtgggccttcagcatcctgtcca

SEQ ID NO: 42743 - DNA, 1612 bp, Bovine  19866880918114
tgtaaaatgggggataagatgtcttcatggtagagtaattgggaaggtgaatgtcatgttgtacataaagtactgggctttgtggtcagggattgactacccgggatggagaggaacaattcatgagtctggttatcacaatttatcacagcatgatggtgggacaaagaagtaggccaagggtgaacttaagtcctggctgcaaaggaaatttccagaagctccacacagcacttgtgcttaccttctactggctaatcccacagccatacttaggcaccaggggaaacacggtctactgtgagtagccttgtacctagcaaaatccaggcttgtgttactaggaaaggtgggatggttctccacacatagctacacggcctcacggcctcatctcgtgtgagcctcaagaggcatggtatattggctccgtggctcagaggagacagcgaaagcccagagagcttccatatgtgtgtgtgaagacttaatcggtgaacgactgagcatccatccctatctcaggtttgcccctgcccctgttccgtgcctctgtgagggtctcagagaagtccagacacccgagagtcacccctcaccttctaggtttcctgctactggaatggaccaggcagttttccctcttcttcagaggtgggagcagggcatgatttggcccctgtgatggtggctgaggacacctaggggacacagagtttggtagaaccccaggccggtgggggtagcatcctgggagagaggagaaggtggggtaagggagaggaacacccaggggtggaagaactgctccctgaggcagagaaacccccacaaaaccaaacagatttcacccagcgacaggttacttattagcttcaatgtagacagcatcttcaatgtagacagcatcacccttggcctgaacgcggaagtggctttgtctctagagccgccttgtgtgtggagatacatctgggcttgagaataccacaaacaggggtattttggttcttccttgtttaaagagatgatcctgctgctgcctggccccacctcaccctccagattggaagctatgtgaccctcatggaaggaattccattggacacctctagccagatttccaagctgaagggaacacaggagcctccccagggccaaacccatgctccgaacagctggggacgatgttctgtcctgtccctccaaaacaaaacttaaactgagcaaggaattgctttcaaatcagatatgtgttggcacatgtctgtgtcctgttggttagaaaacatgtttttttgttttaaaatcagatttccctggaaagaacaatggcataatcaaagaagacaagtgtttggtggggcagagaaaacaaactcctttgccgaaaaaatcttgaggtttggcgagtgccaagctgctcatagcagctggctcctccagcttgtgtcagaggacagggctcaggccttatcaagggttgtgttgtggccttcagagtcccttagaggccctggggcaaaggatcccaggggcagtgtcagtgactggcgtctcacagctccagtcgacctctgctcctgctgagctgcggcactgcccgaggcta

SEQ ID NO: 42744 - DNA, 990 bp, Bovine  19866881089265
gttgtttgtttagtttttcaaaattttctgtattaaccatctaggaaaaattatttgggtagggatggctacgtgaaagtgttgactgagcctgagtccctgatgagaaagtaaagaattgtgaactgtagcgaatagacctggagggatattcactcacacacagactcactgactcacatattttttcttcttccagccacaaatattcactgtggcctcctccctcctagaggccagctgagcaagaaagaaagaaaatcaaatcctttctgttgtagaatgtattggttatttcttatggccgttaaaggctctcactgaggaaggccatctgtttatacagtgaggtccatgcagagctgcctaagcagaaatcatgggtacagtaaagtcacttcatagtgttgagagacttggctgaataaaggggaaagtttaaataaattaatgcctgtctatggaatgaagcagtttgaatcctctaaaatgttatttatgcagaatcttaatgatgatattaaaaaaacagaatatagaattatatacactgtatgaaatgtatttttcaaatgtgaaaaccagtggaagtgttagttgctcagttgtatctgactctttgcaaccccatagactgttgctcaccaggctcctctgtccatggaattctctgtactggagtggatagccattcccttctccagggcatcttcctgacccagggattgaacctgggtctcccacattgcagacaggttctttactgtctgagtcaccagggaagcccatttttcaaatgtattctgtagccaaaaggaaaaatgcaaacttggcttactttttctggttttaaaattttttcttctacttgaaatatcccttgaactccctgattctggcaccattctgccctgttggcacgcacccacatctgggtacagccacggaggggtgggaggtgtgtgtgtgtgtgtgtgtgtgtgcgcgcac

SEQ ID NO: 42745 - DNA, 1858 bp, Bovine  19866881170666
tggttcctattttgtcaaggttggggttactatgcacaatctacagcccacgtgatttcaaaggcaaggcttaattggtccccagtgcggggctttttttcatctcccaagaagaaatgagttctgttgccttgatggatgggggaggacaggtggaacttgcaagtgtatttggaagttgcagaaggagttcattctgagactctgtatataataaacggttcaagctggggctgaagtgagatccaagaaataagacaggaaaggagggaatcagggccagacggccagagggagatgttcagggcttggtttggtttggcttaaaagggcaattcagatggtcacttttcagtggctccagtctcttggtgctgggtgctggtggccctcgctgtcagaggcctcagtgatagaactgggatccagctattcagttctggctgctccagaaccttctgctgtcaaacctttgaccttggcccaagaagacaggttggctgagtacgcctctgagggtcctccagccctggctggtctttagtttcatgtcctgtcttcgtgtctgtatgtgtcctcatgggcagaggatggggagtctctgtccacacgggagatgcacatgggcataagccttagatgccgcagagctggcagcagtgacccaggtgaaggggagccttctgcagccccgtgatgctccccacacttaccctctgcccactgtcttcctaacggccccacatttgatccgtaggtgtcatgacagaagaacctataagagggtcctgggaagagacgggtgtgactgggaggtgttggtgagcggggaaaacagggacttgctcaggtgcgggcatctgtagcatggggggcctcggaggaggaggtgtgtggccagcctggattgtgatgcaggggcaggaagagccatcctcagcccatcacagtcctagggatgtgttcatcgctgagaacaactgtgggcagtgggcacaactctgtgagcaatgccaggagtgactgtgaggacaggtagaggtcttgccagacttgagttctggaatctgctcggtgcttctggaaagtgagtgtttggggagcactgagcaccatcccgaccgagggaaaatggagtggtctgaggagcttcttgtaggtggaagccattccttcattcgttcttcctcatcccttgagcactagcctcaccttccactcagatgctcatttcaagcatagcttctttagagtggaagggtaggggcctgggtgctgagggtgaccttgtgacctctgggttttggttcttgaaccatccagtactgcccagtacctcccaggtgcagaaccaggtgtgatcgtgcatgagcgatggacggcctgtcctggaggaagcacaactgtttgcaaggcctacaagtcccttgggatcccccagggagctttcaaaaatgctgatgtctgggagcccaccccagaggctctgttggccagagtgggctgggtattggcatttttaattccctggtgtttcaaatatgcttccaggtcctgcaatcccctgaggttgagaaacgggaagaggtaagggggatggtgggtgatggcctccctggacccctaacccctcaggcatgggggggtatgcagccagctggtgcagggacagaaggatgcagagagcagcccgcactgcaggctctccctcagccattaaagtttatcgtcgccgcggacagtgattgaaaaaggctttttgcaggactgaaatgtgagcaatgaaacttgccagctgatacctacacagggcacttatctcataaaaatatcctccgtgtcaaaaggtttcagtaag

SEQ ID NO: 42746 - DNA, 991 bp, Bovine  19866881194402
ctgagaagcaccttggcctgaagcactctggtacccagagcacaagtccctgaggtccttcctgaggcttcccccagatttggtccagttcccctggcccctgagcccactctgtggctgttgagccacctgcagatgctcactcggcctccgctctgatcagataccatgtgccgctgggggtagcgcctgcccacgcccaggttcctgatcgacaggagcccctgtgagtacaaagtctgccatgctaggctcagctaccaccaccagctgcctggccacctcagacgcagcacagccccaagccacagtccagcttcccaacacctacaagagtgggtgcccccatccatctgatggatgaggaaacaggtctatttcaggctgaatggggagaaatccaggacccaaacccaggtctacctgtccccccagccctcccccagccacattccactgagtgattgctggccctagggccgtcagtcccaggaacacataccccaaatgaaagtcacctccggcacacccttgactgaactgaggttcccaggcacccaacccccgctgcgtcctccctgtagcttctcccagcaccaccctccacactcctttttcttctttgcacggacagcagctgccacagcatgcagctgttgacaaactagtcagcatcctgccgaggcatctttccaagccgcccgcgtcctcctgagcagagagatacctcattagcgtgctattatatttcagcccccgagaaaacaatgcacgccaggagaccataaacaaccagtacaaatgctacagggtcgtggatgatggatgccaccatgggatgttcgacgtgggccctgcttacacagacaggagtgcagccgcttccaggcacatccatcttttccccaaacgctgacgcgggggaagaagtcggcacggccttgctccacataccacggggccatggcccccagccacccaccacaagcct

SEQ ID NO: 42747 - DNA, 1382 bp, Bovine  19866881285254
tataggtaatgggttttccatcccctgggtaataggagacaccaaaaaaatgaggacattacttagtgagtccctcacctccctggccccattcagcagactcggaggaaggacattgcccagcattgagccgtgtgtggatttaatggggtttccagctaaaccttccatcaaatttacagctgtgcctgtctcctgaccttccccctctcacacattcttttcggaaatgaagctgtgtgcaggctgggaggtgtcacttccctggcgtcggagatatacagctgtgggcccgggttgagatggtggatttaatcaggctgggttgctgcagtgcacctgcccctaagccaggtaacattagaagagccactggggtccatctgacccacaaagagtcggcgagtccttatcctgccagttacaggcccaggcccaaaccttgcccatctccctgctggaccgaggcctgatgtctgctcaccccagccagctaggagaaggggtcactacaccatgttctcccttcaccccccagcctccctgtcgctgctgtgagcgtggattcacttctccttcctcctactcccacgctgctcctcactgccccctcttcctgtttcttcccctaaataccgactcctacctctctgcccatctatagccaactgtccttcaagttcccacataaacgtcaccacctccaggaagccttcttctgggaactacgagggcattggaggtaaaagccacagacactgccttcacaagggcattctccctcttagtatgcagccccatgtggactgtgagccttgagggtgggcttctccctgtgggtccagttgctgctgagcttggtccacagaaagcacttattatcataggcactgtccatgttgctgccataaggccttatggtcagacccctgccccagagagtgaggatacagttacactgtgaatgctcccatccccaacagggcatgctcaaggctcacagatgggccctcctcagtgccagggtgctggcctccgtatgtctgggctctaaaataactggtcccgtgggaggcacccctacacctttctgttccagcctggaagcactgaccaggtctttctgactggcctggccgccctcgctcccatccctggatggggcaggcagtttcttccgctcctctctgctctcttgggggtcagggtgtattttcccagcccttcccttcctggccctgtgtttgtctgactggctgcctcagaggcctgcggtagaggctgtagcaacaggcagtgtccagtgcccacttggacaaacagcacgcgaggcggctgctggcacaagggcggtgtctagcaggtgggcagagtgactcagg

SEQ ID NO: 42748 - DNA, 648 bp, Bovine  19866881287324
tcttgacagcgtccagtcgacagaagaaggcaggtgacaggacaggggcttacaggggaaccccacagggccagactggaagaaggccacatccaaatcactctgcaaacttgaactgagccgcaggccaccagagctggccacaaagcaagagcctgcaggccaggtcccgctcattgcatctgagccactgcagcccggctactccctacccgggagtggacttcctgagtccctgtctgagcgaacaataaaaggggtctgcgaatgagcgtctaaagctttggagctgcctatcgtattgatggagcaccgcgccaggagcccagccctctcgaggacctgggcaaatgctggtattagtgctccccttcctctcaagggtttactcagcagccactccactgtttcctcaggaggagacccccgaccctgacaatccatcaagtggatgcaaatcgtggtccagacaaaaccaggcaaacagcaccccgctctgcaataatggcctctggaggagaagggcccttgccaacaatgattgctgtgtacacagcccactaaatacccaaacttctgattagcctcataatgatctgtgtgcacccgtctcctttgaaaggctcccaagtacacggcacaagttga

SEQ ID NO: 42749 - DNA, 1730 bp, Bovine  19866881307847
tctttcctgagagcagtcctccacctcaactcaggggtctctccttggtccaccccatggaccagtggctgccctggggggtagataatgtaatggtcctgtctaatgcagggagatcctcttattattgtgccactcaatctacaaatgaggatgttgtagagaggttccaaacttgcacaagggcccctgaagttgggtctgtggcccaccctgtggtccccaccccagggaagcctctggaaggcagcagtgtgtggctgcctggtctcctgtgtcccccagccccaggtgatggacggccttctgctgagacttatgagctatttgaagccgtcaaccagctttgtgtaaatatcaactctgtttggcaaaatagctggagagggatttttatttctgctgggcatgattatgagtattgatttgagaatctgaaaagtcaataaaacagattaaacctcctgaagaacgaacgcagaccatcaacttgggttgccgagggcgtgaaagcaaggtgggtggggaggagaaatcagaactgcgtcaagtacagcaactctcaggccccacctattgcttagcctggtcctaccccaggcattcaggacacagtgaacacacggccctccacctgcagggcacttggcctggctctgctgtaaactgacatcatgggagtaatttggatattctttttctctttaactttgatttttcttttgaagggtaattgacatataacatattagtttcaggtgtacaacataatgattcaatacttgtaagcatggcagaatatcaccacaacaaacctagttgatacctgtcatcttagcatagctacaaaaaatttgtttttcttgggatgagaagttttaagatctattctgttaacaactttcaaatatacagtgcagtattagtataatcaccatgctatacattacatccctaggacatatctaatttatgactggaagtttttatcttactcatttctctgcccccctgaccattgcctctggcaaccaccagtctactctgtaactgtgaactaagggtgttttttttttgtttgtttgtttgtttgcttgttttagattctacatataagtgatatttatggtatttgtgtttctctgacttatttcacttagcatcctaccttctaggtccatctgttaggtaggtagtacaggaaaaaaggagtccaaaatggtggtggctaaaagacaaagatgggttgaggcctcttctttggggtccacctgccctcatgcctcgagggtgtactatactttgtcaaataaaactctcccgtcaggagagtgtgtaatttcctcgattctgtctcactgcaacaaagattttaaactgtgaccagtgttacaactcagagttttaattggcaaacaaaggactgtacaccctaggcatgagggtgggggcacctcagtggagagacctcagcttgtcttggctccttctttttatatgtttgtctcctccccaagtctgactatgcaaattagggctagccgggaagggggcgtgtttgtttcacctgaggttctcattcaggtccatggatttttcctttgtccccttttcacgcccttttccctttctttgtcttttaaccactgccattttggactcctttttcctattctaactacctaacacatcaatgttgggcaaatgccaagatttatattttaggccaa

SEQ ID NO: 42750 - DNA, 937 bp, Bovine  19866881351349
cgtattacagtgatggtcactttggatttatttccatgcatttatgtcctcccccagaaggcacttgttaacacttccaccccctgcttcttaaacctctgcttggtgaactatagatcctcctagaaagaatcaacacattaagagctattttctggccatcaaggcctacctatgccacaaatacttgcatactaatctccccatcacaggttgaaaaatatggacttatttttttttaactcccaacataatgaatgagtttaaatattagaagttgaaattattaagtaaatcatttcacctgcaaagcttctatttgcataatattaattcatggtggcagctaaaacaaattcatcacattctgtatattagaagctgatttatgtaggaactgaaaaaaatcatgagctcaaaattatattgacatgatgtacagactcaatggagaaagatttttctctttccttctttccctttgatttttttttttttaacatcatctgaacaattgaattatggtgagaaggaaaaggatttgaggagaggaaggaggcgaagggctggcatctcagaaaatgaataatgctcccgcctcacgtgtgtggcaggctcccggtgcgggtatacacacacactccggttattaatgtcaagtatgccaaagatacgctgggaaatcattaccattcatcgccactaaccgccattaaatttcaatcaattcaacttagcacaagtgtacttgagcggcccttacagttccttataaatgtggctcaaaagtcgggctgacttattgcattgtccacaacacaaaggagcattgctaagcgtctgcttggaccccgggaccgacgctcttttaacatcctcagcattcaaagatccttctttttctgagcgctaagaggtcttcaatccctacagatca

SEQ ID NO: 42751 - DNA, 1049 bp, Bovine  19866880837360
tggtgtgatgggctctcctgaggcgagtatctaggccaagccgtgccaccctgccggtcagggccccggctggcttcccatccaccgagactgcctctttcttgtttggcacctttctctctagctggtgagcgaccgtgctctcctgactcctttatagaacggccttccttacatatatgcaaaaatctcttggaggggtccctttggcatttgggagagcagagtcccaggtgggaaatgctgcctgggccttcagaagccatgtaggtcttacatttttgaaacctcgataaaggacttgcagctccctcttggtgaagttggtttgtgcctccagctgctccagcccctcaggccgatggcaaaccatggtcatctccagctcgtcttcaatcttatctggaaccagaagacatggcattggggtggctcaccttggtggtcacttgtcagactgtagcctgggttgtcagaaggggggtgtggtgaccaggacatagggtcatgggctggggggtcacattgcagatgaccttcttgccttgagccccacctctctattcagttgctttctatctcaccatcagtccaccactccaggtgtgttagacaccacctatggagggaacttcagcccaggaacatgcgttccaagtgctaaaaataagtccatacaaaaacatttccttgtctttcaaaatatctgttttgtatattcaatttgctgcccactgaatattccactgctcatctgaatattccagagacacaggtaagtgagcagatggattaacatcctccgaacagcaaagggagacaaacctactaaaaaaccatagagtaaattcttaccatctgggaaactagaggtaggctagcttgatttggcaaaaagtacaaattatagcatgttaaatattaatttaaaaatatgaaaccactttccagtattgtaatatctaacagacatccttaaataataggaaagtaacttaaatgggagctactttacataaatgaaaacttggaagcattgaagggctcta

SEQ ID NO: 42752 - DNA, 1071 bp, Bovine  19866880929677
caactacggcaacagattccaagcgagaagtgataaaggccttcgtgatttctggtgcactaagtgtctaataagtggggttcagttgatttcacaaaaggaactgatgctaccatcctttgccacagagttaataaataatgaacactgttgggagcaaattcccaatgctacaaaaaaataaagcaaatgttatttaaactgatatcatatcttcctagaataagaactccagaggcaaaataactaaacatacatttaaaactaaacttattctgattataacactaatgaacatttaacatagcaaattttaaatctttgtgaacatccttctaatcttctttccatgaatattttttaagagctgatatcatgcagaaaatatggttttaaaacttctccccaaacttataaaaagaatttttccaaagcctaatctgtaaaactttattttatttctccacatagatttttccacagtttctcaattcactctttaattattagataatcagatggcctctaaattattattataaaatttgttacaaagaactttttcctaaaatcttgcaatgaatatttttagcaaagtgctttaatagacttttttaaaaatccctaccaaatcttatcaagaaagtattctatttacagtttagcatcaacaatgtatttttacttacctgtagactagtaatggtaaaattggcaatcaatctgataacttcaggatattctttcaccataactaattctcctagctgataatttgtctttaaacgagccaaaaatcgacaaaattcatgataattacctggatcagacaaaccctaaattatgagacaaaaaggaaggctattttaaaaacttaaaaataaaccaaactaatcaccatcaataaaattccaagagtattttactaagtttcagtgttttcatgggtacttactgcactttgcatcaactgggtaggtatcaatttaaaagaaaatgattccccctgggcttaatgttgtcataaatgattagtaataagggaattcatagtagaggcttcggaggaag

SEQ ID NO: 42753 - DNA, 2474 bp, Bovine  19866880931251
ttgtgaatttgtattactttctggatattttatttaattccctgatctgtctaactaaacatcttgcccaattatttttttcatattattaattttctaaaactataaaattaaggctatgttaagttttaataatctcattttgaatataaacatatttcattgaaatacaactactgtcctttatcctactagcaaagagttctaggaagaaaataccttgtttacagcaaatgaacttctttataaatcttgatatttactgccaaagtgttatgaaataatattttggcaaccatttttatagttaaatagctaaattaagctacttatttaaaagtaacttcactcactaaatatctttaatgctattaaaatttatgaaggaaagcttaataaagatcaaatttaaaaatcatattatcaaccacgtttgtttttctaaagaagtatttattctttgatttgaaaggaggaacaaagctagcttttaaagtctacgtattgttcaacgcatagactgctgaagtagttttagttaaataaatacagacaccaagcctcatctctggattcaggtgattttaagtaatgcatatcctgcttttaaattctttatgagtaggacctcccttttcctactttagttctttgctgattctatgcaattgcttgtttactttcatttcctttaaatagcatacattccaaaaatctgaagaagacatgaaaccaaaagacaagtttgctggggtgcctttacaactcatattaagctggtgatttgcatttgcttaagaggcaatgctatcccaagcaggagagtaggaaaaagttcccagcgggggtacatgacccttttgtcaaatacgctttgatagttgcattaatacaggaagttcagctgcaagtaactgaaatccaaaataacaattgcttgaacaatacagatgttgatttctctctcaagcaaaaatccaaggcaacgctctaggactagctggtgagccatggtgtatccagacgcaggttccctccatcttgttgttataattgccttcactcgcccagtcacttcatggtttaggatagattcttcagataaacccatgtgcatatatgttacacacaccacgtttacttacattaaactgcccagaatatagtcacttaaccatacccagatgtaagaaattatagtaaatctagtctttattcaggtggccaatgcccagcaaaacatttcaggtattctattactgcagaagaaggaaagaagagatacaagacaactagtagtctctgccataggactcttcaaagatttgtggccacctctaacaaacgcttaacaccagagtttgtattgtatataggttaggttaggttattgaatattcacttgcagtttaaatttagtggcctacatttatttttacctttatcttaaattatctttggagcatgaagggaatacaaatacaaaatacattaaataactttgattcaagtatatgcacaccattacaagtataaagaaatgaatttttggataattaactcttttatctcttttacattctccttatatccaattacataagtagtttttcagtcaataaacacttgaaggcctactataatggtaggtatatgttaggagttcagaaaataacactgagcaaaacatatatattcccagtcctccagaaatctataatctatgctgggaaagacaataaaacaaataattagaataagcaatgacaagcgctataataaacactatgaagaaattagcaagaactcctgacattcttggatgtaacagagcaaagagagcattgagagaaaatggcaagtgtgtgtagttatctagacagggggaaaaaaaaggcatgactcattgaagagctgaaaaaaagtccagtatggctataaagcagttagtggcaggagataaggctaatgagacaggtaggaccctgattatgaagagcctgacaagccacattaattttaatcccaatagcaatgaaagtcattgcagagtttaagcaaagcacagatataatcagatctttgtttttgaaagccagaaaggaaacagagtgtcgatttcaaattacagcatgactctaggtaaatgatgacaggcgttaaaacagcagggtgacagaaataattgaaactagctaggataagtagaaggtaaaagttgatagactttgatgaccatatggatgctggtgagagaaaaaagaaaaagttaaggagaagtcccaggatttaggccttggcaactgagtggacagtgatgagacacatgaagaaagtcagggttgggagtggatggaagagatgagtttaattttagtcactgaattagaggtacatgtgggataaaacttgcaagagaaccagttcgataagtgttggtaatcagaagataggaattactaaaacaacacaga

SEQ ID NO: 42754 - DNA, 3113 bp, Bovine  19866880973266
actatttcttacactcttaatcgtcatttcatccatgactacattgagcagaaaaggtaagttgtggaaagggaaggctagtccatccctttggcctccagttcttagtactgctattgtgccaggcattgtgccaagcagagcatcaccctcccccaggcaaatatcccattcaaatgcaaagactgtgaccataagcaaatgcagcttaaagatgaggctcttcacgttgtcccttccagcacaactgccactcccaagaccctctggtgtagaaagtctggagcctcacatggcgtggttggggatacagagatgaagcggtgggcaggacctcctgctgagggacttagaatccaggagttcatcaagagactccagcctataaacagcaaataattgcttatattggacactgggagtcttggtttcctcatttgacatcatattaaaaagattaagagttaacagcagcattcttggaaagaaagcaatgtactgaacccctgttacatgccaagggctgtactaggggcttatatacataaccttattttatggtagaatgctctggaaggtagagtcttcatctttctggtttggaccctgaagctcagagaggtgagggacactgactaaggtagcacagctccctaaagaggttacactcttcccacagtatcctggagcctcctactaggggattctgtctcacctcgaggaaccaagggtccttcacacaaactgcattcatctccagtcagctccgagaggcaaaggcgttctttgaacccaaatagcagatgaggaaacagatatagagaaggggaagccttaggtgtctgtggatacctcggatatcttagctatctgtgcaagagcaggtcaccacacctctgcgtgcatgaaatactcccagtctggttgcccttggctactcttcttatggctgggaacacagaggccactgctctgcctctctatgcgagcttcctcagtgcagccatgcagtcatctaaggctgctggataggtggctggcccctaacaggcatacagttaggcccaagcagaggatctccacttgtgaccctccccacactggatgtgcactgcatcctgaggttgtacagtgtctaggccatggttctccaccctggctacacgttcatcatcacctggggagctttgaagaatgccaacacctggaccccatccttgaccacttgaagcagaatctctgagggtagaacccagatatcagaattccttagaagctgcccatgattgtaaagtgcatgcagagctacagtggggaactgaccatacccggtgctatgaacgagcacaggatctgaaccatcccactggctacgatcattggctcagagctgggcttcgtacatatgccagtccacacagcatgaatctcaagacttgtgctaggaacggtgggacaaagatgttctgtctcctactggacatgaataagagacagtcctaggacagcttgcagtgatttgggaattctgagagcttatctgataaccaaaggacagataaaccataatcacaggagataagcagagaggttttgcttttttttttttaataaacaatgtaaaaataaaccagaaattgatgagatcattgagctgctggctcccgctgcacccgaacccaccacatacctatgacctttccaggtgcctttgtctgatgcctgtgttagtttagccagcatttctcccccatggctacctatcagaatcacagaaagtttttggagtacctagtgcctgagccttgtcccaggttctgaatcagaacttccagaggtggggccctgagcatcaggaggtgttaaaaactatcccggtgattccagtgtgcacctagggctaagagcccttgctctaaaagaatggaagggctgctgccgttctccctgtcctggccaggccacaaataagaaactcaactcagtcctcagaacctaatactgacgggaaaatcagcatctggagatatcagagagaaattggaatggaaggaaggttcaaaacttgtcctaagatgaataagcaacagaaaggacgttggtcatcctggtgggtagagagataaggacaccctgttggagcaattgcaaataaatgggccatcattcgtcaaagcttttcataaaggaacgagataaaaataaactctgcggtttccacagaggcacagaaagaaaaagtggcctgggctcttgtgaatccatgcatccctcagcagcggaggtattagagaaacaaggttctcagcttggaacatccatccccttggcatcctggagggatcctcctcctcctgaatcatccaccagattatcactatttgccagtcatcacgcctgctgctggggattcagctgtgtagtaggtgccttgccagacaccctcggcactcactcctgcggactcaacggctgccgactgcaaatgcatgtgactttttgcctgtgactttgactgtcacagcagactgtggccaagatagccccactctgtttgtggaaagggcaggcaggaataatcaggttgttaacacttcctaggagcagccctgagccaatgactcatgccaagttggcgaatcaataacccaggtcccaataggaagaactcttgccttttcccagactactttctccactggaattgagccccaatcacccacagtagtaacctgctcaaaagtgcacccctaattgacctctttgtcttccccgtctcatttcctgcatccccctaccattacttcctggaatcacctcccaggtagaccacttacttccacatccttgtcccaggactggcttctggaggaacctaacctaaaacaagcaatgactaggacaggtatgtgtcctgctctcaagactcttatattctattgaaagcaaacagacaacaaataaaatgacttgggctacttaaagtggtatgaagagaacagaagtgtaacatgaggaaaatgacgggggtggctgctccagacagggtgcagaggaaaggctcctttgagcggaacctgacggatctcagaggtgaggggtcatcaggcact

SEQ ID NO: 42755 - DNA, 784 bp, Bovine  19866881104553
atgtatgcccattacctcttccatgccttcgacaccacgcagacaggctccgtgaagtttgaggtatgtttgtctctcagaggccccagggccccaacaacgcttcctttaaatgatgggcatgttgggaggagtggatcattcaatgcttaagttctataccatttaagaaggatttcctgaagacagaagaaacaactgtcttccaagaactcagggcctcagggactgacagtctaatggctcacatgtgcaccgggctgaccagcgctgcagcgctgcacttagcactctacgcgaattaactcatttaaccctcacaataacaaggtagggttctactatatattatcagtctacagaagaggaaagtaagataatgagagacagagtggctttcccaaggtcagacagtaagaggcaaaggagggctttgaacttgggtggtatgtttccagagtccacactcttagccgccagaggatgcccccacttgtacggtaattgcagccctggggtaaggcgacacccgatgtcagcacacgctgacttcccttcttcctccagaagctccttcctcagtatggggcaaggtaggcagtggaaggtgggtggcgtactgtgctgagcttggccacatccttcaggagacagaggacctgggcgataccattctgtaaagaccgtcacggagtctgacccccagacagagtgccgccccacccagtggctcgctgcttaatgtctcatgcctcttccacttctcaggactttgtaaccgctc

SEQ ID NO: 42756 - DNA, 1090 bp, Bovine  19866881490127
atcctaaaggaaatagccctgaatattctagaaggactaatgctgaagctgaagcttcaatattttggccacctgatgcgacgagccaactcactggaaaagactctgatgctgggtgagggcaggaggagaagggggtgacagaggatgagatggttggatggcatcaccaactcaatggacatgaatttgagcaaactccaggagatggtgggcagggaagcctggcgtgctgcagtccatggggtcacaaagagtagaacacaacttagtgactggacaacaaccccaccatcagttatgaaagcaaagtatctaagtagaggcttgtataacttacttttttagatactttttccctttgggattccagacaaaatgatacaagcagtccaagttgctctgacttgtttccacctttcagctgttatgaacgacagtgctgtgaacatttctgtacaagtccttttatggacatgatttgatttctcttggacagatacttaggagtaaaacgccgggtcaaatttatgtttaatttttcaaaaaactgtcaaatcgttttccaaagtggttgcaccattttacatttccaccagcaacactctcaccatctattactgtctatctttttcattacagccattctggtggatgtgaagtggtatcttactgtggtcttgatttgtgtttcccttaagactaatgattttgagaatctttttatgtgcttattaaccactcatctgtcttctcaaaggtatcatctgaggattaaatgagatgataatgttgtaaagcacttagaaaggtaattgattactaagcgatagatattatcatcatcatccatgggctttggtattaaactttcttgaggtccagtacaggtttgtttctcatttgctttgctgtcctgagaaagttatgcagtctctctgaatctgatcattctcatgtataaaagggacaaagcattacagttcctcaattctaaggcacagcatgtatcgaataggaacactgcagaaaaaatgtaggctctaagctctacttaatatataacaactggagatccatttcaatttca

SEQ ID NO: 42757 - DNA, 697 bp, Bovine  19866881769002
actgacccacactatctggctgtttaagtgacagaaaaagtacatataaaacaatgcaataaaataagtatgtaagttatagaatgtatgaacagaataataaagcctagaataaagtttatacaccaaaataattaacagtgggtagcaaattccagctacgatggaggagtaacttaggcaaaaataggccataaagtctaacagaaaaacagaagaaaaaaatgttataaaaggaaaagattccacttcttctttggcctcaaaggccagcatacaatttgggaaaagagtgaagaaaaagtaaatacttcactatttaactaaaaatagctttaatggaaacaactccaaaatttgagaacactttcaacagctgttcttgacaattatgatgagaatcgtgacataagaaaaaaaatttctcacaactggcacatttcaaccttaatttttattaacattaaaatcacacacttacacaaattagattaaaagacagattttcctagcattaaactgtttctcctatggattaaaacaatatggttcttttaaacttcattacatataattttttatttccacgacaaaacttgagaaaatgatacagccatctgaatataaaagaaaatcgacttatttacttctattagttttatttttaatatcctgaaaaattttaacctggaaggga

SEQ ID NO: 42758 - DNA, 428 bp, Bovine  19866882019035
tctggactctggctttaaccaagtctctcaagtattgcttagtgcagaaaaactcaggaccgctgtgaatgtgggcaccaagtcacacattcactctaagagtcaaggtgaaagttctcttggagtggcccttaagagggagggtatactttttatagcatccttataacactctctacgaacccatttttcctttcttagaatcacaacaactgttgcatgtaacatggacctgtctaaataccccatggacacacagacatgcaagttgcaactagagagctgtgagtatatgtcatgtgggccccttagttgagtttctggggtgacttagatctgtgtatgtgtgaggagtgtcctattcatagtagactttctctccttgatgttgatgacaatgggttcatcccttctgggtgtatgtccag

SEQ ID NO: 42759 - DNA, 2343 bp, Bovine  19866880345005
cgcagaggaggaggtaggagagagtccactggaagtttattcctgcaggtctcagaccacatcagctgcctgtaatgtgaaaagtgatggagagagattttttttaaaaaaaggagggatgtacaagagagaaaaagatgtctgtttcattcaggagtttcgctactacaatcagaaggagaggttgccaaaactaggggtccccaaccccaagagcgtggaccatgcaggaggaggtgagcagcgggcaagagagcaaagcttcatctgtatttatagctgctccccactgctcacaataccacctgggctctgcctcccactccgtgaactcaataaatgtaacatgcttgaatcatcctgaaaccatcttccatgaaaccggtcctgggtgccaaaaaggttggggacccgtggcctaaagtaatgaaaaagaaacattcaagctgtactccatttaagccaaaaatcagattggtctctcttgttcattcatgggttcattgacacattcaaccaatactgagccaccaagttggaggtacagtagcaaacaaaagtcccgtcctatgactcattttgaaaagacccctggatgctggggaaagattgagggcaggaggagaaggggacgacagaggatgagatggttggatggcatcaccaactcaacggacatgagtttaagtagactcagggagttggtgatggacagggaggccttgcgtgctgcagttcatggggttgcaaagagtcagacacaactgagtgactgaactgaactgaactgaactaaatttaacttttttgatttttttgtttactttgcccacataaagattggagcctctgtgtgtataaatatggagaacttcagaactgaaaaatagttaaataatgtattttccattttaatggcagttatggagttgactgaggcaagaatagtcggtggcagaactaatactaaatcccctgacattgagtgcaatatctacttgatgacactgttccatctctctgatgcatcatgctttaaggtttttaaatgcataaaactaatgccttcaggaaaagagtgcttcattctctgctgtcaagttattatttgtaatttgcaattgaaaggcgttttcaggccacagtgataatactgttctcatggagtttgaccaccaaggaatgactgcagaaagagaaaatctgggacatataatttgtgaggaatgctagtcaaattcattgccaaatatgacttagctttacaaaagtgatgataaaagtcattggacttttgcagcaagtaaaagcagaaaccattggaaaaggctttgtagatcatctcactcaattccttcattttaggaatatggaaaatagaaaagagaagagataaaactagttctaattggcaatagaggtaatcttgatgtcaagactatggatactttcccatatttttctaagaagtaatatttgtagcatcaaaatatcaactgctgctgctgctaagtcgcttcagtcatgtccgactctgtgcgaccccatagacggcagcccaccaggctcccccatccttgggattctccaggcaagaacactggagtgggttgccacctccttctccaatgcatgaaagtgaaaagtgaaagtgaagtcgctcagtcttgtccaactcttcacgaccccatggactacagcctacaagcctcctccgcccatgagattttccaggcaagagtattggagtgggttgccattgccttctccaaaatatcaactagtatttgcttattgacattgcagaaagttatctaagatgcagactctccagcaacagattatgtatttagcaaaacatcatcaaaataaaaatagttttaaatgtgtgatcatgtaattaaatcaattacattttacacaattgcattttgaaagaactatattatacacctgtcagatagaatacataacccagtgctttgactattatgaagctattttcatgtttataaaactatttaactcatcttgagtttatgcttactggaagagtagaagaaaccacattaagtgatgattgcaaatattaacataaaacctcattaaattcaaagaacaaatgaaattgattaagattattcacataatttttagcatagtgaaggagaaaacagacagaacaggctccatcttgaaagcaggactccatcttgggccagactgtggactttgagctatatgcccagtatctatggaaacaacataccaactggaaaaccggacctcccagcggaagagccccaggctcgtacctacactctccaggcctaaaagaatacc

SEQ ID NO: 42760 - DNA, 1072 bp, Bovine  19866880552204
ccatttccttccccaggggatctttccactcagggattgaacctgtgtctcctgcattggtaggcagattctttaccatctgagtcacgagggaagcccattcacagccttagcccattcacagccttagtccattcacagccttagagttggacaaagaggagaagctgaaagtggatttccctgtaaggcaacacgcccactatgcccacccctgcaaagctccccaacctctccaatcccagccacacagtcttacctcccacgaactgtgcagctcccatgcaacgtcccatcattctggagatgagttcttccatgcagcagcccaggacagcagccagtgccaccaggagcagcagagcacagccagcacctgtcaccactgtgcacatctgccaggccaggctggggatggcactgaagctggcatagcgcccacactcttcaaccatgatcagactctgcccctctcccctcacagggtaattgcacctccggaatgtgctgaatgacactggcttccccagctgagatccaaagagccaataaggcaggaagtaactggtagaactggccacggcggtaacaagggacaggaaggcccagagggtccccaccagggtcaggctgctcctcatagtcccaggtttctcggtggggatggggagatgagtcggttcacagcgccaaatgcagaaagttgtcatgtaggctccaccagcctagttttcatctgcctggccagccccagggctcagtcatgtgcttcttggcccttacttctggataaggttattgtcttgaggaccatttgggtccctatgggattctgctctccaccacttttctcatcttcccttccttccacctggttcagacttctatgatctctaggctgcaatggaagaaccacagaagtgaattagtgactgtttcgtctactccaatgcagcctgcctgagtgtgtgaatgctaagtcatttcagttgtgaccaaccctttgtgacactatggattatagccccgccaggctcctctgtccatgtgattctccaggcaagaatactgg

SEQ ID NO: 42761 - DNA, 2423 bp, Bovine  19866880918823
tttctgtgcttcgaaatccttattgcttacatagtttatgtgtatatgtatattagtttgtatctgttaaccccatgctcctaatttatccctccccccacctttggtaaccatgtttattttccacacctgtgagtctgtttctgttttgtatatagattcatttgtattatttttatattatatgctgcatataagtgatatcttttgatatttgtctttctctgacttccttcactttgtatgataatctctgggtccatacagcttgctgcaaatggcactatttcattattttttatggctgagtagtattccactatatatgaacactgcatttattaagcctcttgtctgttgataggcacttgggttgtttccatgtattactactttggctgttgtaagtagtgctgctgtgaacattggggcacatgtatctttctgaattagtgtttttgttcttcccaggtatatacccaggagtgtaattgccggatcacatggtagctctatttttatgtttttaaggaatctccatattgttttccctagtgactgtaaccaatctacatccacaccaacagtataggaggccttgccttctctctgcaccctctccagcatttattatttgtagactttttgatgatggctattctgacagaagtgaggtgataactcattgtggttttgatttgcatttctctaatgattagtgatgttgaacaccttttcatgtgcctgttgaccatctgtatcttttctttggagaaatgactatttaagtcttgtgcccattttttgatagagttgtgtatttttgttgttgagttgcatgagctgtttgtatattttggacattaatcccttgtcagctgcttcatttgaaaatattttctccaattttgagggttgttttcacatcttctttatcatttcctttgctgtacagaagcttttaagtttaaaactgaagtatagaccaatgttacaggacaggaaacccagggataaacccacacacctgtgatcacctaatctatgacaaaggaggcaagaacatataatggagaaaagacagcctcttcaataagtggtgctgggaaaactggacagctacatgtaaaagaatgaaattagaacacttcctaacaccatacacaaaaataaactcaaaatggattaaaaacctaaatgtaagaccagactctataaaactcttagaggaaaacaggaaaaacactctttcacataaattatggcaagatcaaaaagactcacctcctagagtaaccaaagtaaaaaacaaaaataaacaaatgagacctaattaaacttaaaagtgtcttcacattttattttataatattactgacattgctatgttccaaaaataaaattctctattgtacaatgtacttttgtacattgatgctgtatgcctgctggtcaatgatgagaagatgatgaattaaaccttatccattaatcagacatccaaatggtacattctttaaggcatccaagtatcatatttgttttctcaaatttgtacacagtccatgtcactctcaatcatttttcatcaaacaatatagattaatcaatcatttaatcaagacatcttctacgtgcccagaaacacgctagatgttgtggagtatcatagtaagttgagaaagagaatcctgttattgaggcacttgaaaaccagctgaggagacaggtttacagtcatagactgtataaagaatacaataatataaagtgctaaattctgtgatattagaactaagcaataaggtcttatttgtgacataaaccaataaatgcaaaaaaaaaaaaaaaaaggagaattcatcagaaaaggtttcatcaccgggcttcctggtggctcagtggtagagaatccgcctgccaatgcaggagacccaagtttgatccttaggttgggaagatctcctggaggagggcatgacaactcactccagtattcttgcctgggaaatcccatggacagaggagcctggtgggctacactccacggggtggcaaagagtcagacgtgactgagcgacgactgaataataacaacaagcctttttgaaagcaccaaatttgcatgaaaaagtatatttttatatgtaaactaaatgctaatgcatgacttctagagaacactaaatgtgtttctggtcctcagatgctttcctggtgaaaaggggaaggggcaaggtctcagctattggcatagaaagctggcttattctttgttgatggagaccatcctagcttccactttaaatcagttatgttttattgtaatgaatattttaagtaattagagcattgaaaaacttcatttccttgtgaccaagtcctttctgccatttctaaggttatataacacttttaataaa

SEQ ID NO: 42762 - DNA, 1340 bp, Bovine  19866881139901
tgaagacagaggtagacatgatcctggcatgttaatgaaatggtccgggaaaataatggatgctgagaggtaggaataactaaagttaggtagctggagtgataccagattataaaaatctttgaatgtcaagtataattgcttaaaggctgttgattaaaggattaaatcaggataaaagcaggatttaacaaagattagacaaaaatacccaaaacatgtatcaatttaaattaaggtctctgttcattattggagtcaccaatatcttgtcaatatttgttattacattaattgacagtataaaggctcatgtttgaattgcattgactttatatttcctaacagaaatttagtaatttatagattaagtattatcatgaaaatagaatcttcctcctgtccccattttttcctgataaagaatttctccatagaactataaagatggtcctcttaaattcaaacctgaaaaatgacccctgttcttggccattaacccatgttttctagctcttacattttgaaatgtagagggagtcttttgaactcactagagaaaaggtattcttcaacagagaaacaaaacttttcttaaattggcactcgtctttctttaccttcaactcattaaaatagtgtgaaattagtttgtaggccatcatattgagtttttaatgtacctattattaaagcgtgttttttctctaaatgagattgtaaggtccaagagaatatttcaaatctaataattggattttggattaccttattccaggagtatattttctaaattttttctgaatgctattaaatgaaccttctgaaacattttcaatctaagttttactttgttgaaactgacagctccaaatccacttgcttagttctaattcaaacctctatttttaatttgatatctttaaggaatattattaagatatatagtttttaaattttatttgagatattattagtatataacattatattattttcaggtatataacatagtaattcaatgtttgtatttattgtgaaatgttcaccacaataagtctagttaacattcatcactgtacatagttacaattttttttccttataatgaaaacttttaagatctactctcttagcaactttcaaatacataatacagatttattaactatagtcaccatgatccattacctgactaattcatttttagtattgccttaccaatcctttctttccttttatttttcttgatttaatttattacaacctggtatattaagcatttatttctttatttttttgtctcttctcactaaagtttaacatctatagagcaagga

SEQ ID NO: 42763 - DNA, 752 bp, Bovine  19866881255231
agcaggagggctgaagaaggtggaaggtttctcctgccatgtcgggaaaggcatttagctaacacagggcccctgcttgaaaagtcagagctcatgcccatcccaagagatctgaagtatggaggctggaatacagaacttgctgttttttttttataaacatgtgtttttttcttcctactctgtgtgggaaagctcattttttattaactcttctctcaaagggtagacactgaaagcaggaaaaggctgaggtttcatttccagttctgtccttaacccattgtatatactctgggatcacatactttggtgcatacctcttcatatcatatgatttcagtttatctgtagtaagaaaaaaatgagtgctgttccattgccactggacaaattccagagcctagaaaagtcttttgagtgaccagtttcatttcctttaagactatcagacagataagaatgtcttctaattttaagcattccactgaagggaatttctaaccttacttggtcactctttttagtttctaaacgctctctcaccatcagaaagctccttctgttttcctatttaaactcttcttgttttttctttaggtccatatctttttctctggcctcactgaatattgagaacagctcatgttgccattggagaaggcaatggcaccccactccagtactcttgcctggaaaatcccatggacggaggagcctggtaggctgcagtccatggagtcgcgaagagt

SEQ ID NO: 42764 - DNA, 1846 bp, Bovine  19866881496276
gtcgctcagtcgtgtccgactctttgcgaccccatgaactgtagcgcgccaggcttccctgtccatcactaactcccagagcttactcaaactcatgtccatcgagtcggtgatgccatccaaccatctcatcccctgtctcccccttctcctcctgccttcaatctttcgcaacatcagggtcttttccaaggagtcagttcttcgcatcaggtggccaaagtattggagtttcagcttcagcatcagtccttacaatggtcttggtcttgggtaaagcttattcccaatgctgcattgcctgtcttgcactgggaagaagtgaagacctggccataaagggcataactcacagggctccccatgttggtcttacaactttgcttcttctagcagtagctgcaggaatcgaagctgtggactgtgggacaggtgtggacagtagcacggaggggagaaatttgtggatcctgacctgctgttgcggttcccaagatgtttccagtggccccagcactatgggtatataggactggtccagcccatatccttaaatgcttggattctgtacaaagtcagcccccttcctcagaccctccagtcccagcttcattccctcagaccccagcaacaccttatctgggccctgctgcctattttcatcttgctcctgggaagctacttagagcatcctggctagaaatgggagcaactggtaggattggaatgaaaaagagggtctggaccatttggaggaaaagaagaaaattgaaggaaaagagtggactaagaaggaactgtaggacatttaagtgactgacagctactgaagcaaaatgggagggttagggtataggtgaaagggggtgagaggtctcaaaagacagaactatatgtatctttaaacaggcagatgaacacatttttcagagtttcaagcaagatcatcttcctttggtgaaatacaggggtttatcaggattacctcatcattgctgctcatgaaaatttacactgactggctaaaggtcacattccagggagaggctgaaacttctgttaggttaggtattaagtcttggtttgctgacgtggggcttagcacaagtgactccatttggggcctgtttcttctattaacacaatgtccttaatgaagctgtaaaaaagtgttccttttactcaattctgagcctggagtatgtgtccttttgttattctgtgtgacagaatgggaactataataaagcaagtctgctgcatctgaagataactatgctcatcttgaaaaaagtgttaggaaaggtagttacgtgctcagtctttcaacccctgtactgttgtataagaatgtgctttgggcccagaacatttccttacaaagatataaagagctctcacagtctgggctgggcatgtgcctttgtttgggcatatcttttcctattctggactggatgtgtacttctttgttctgcttaaccgtgtgcatcatgtgacacccaaccaaccctactgctgtatctgtttgcagcagggagagaattggggcctttgcttatagcacaagaagagtgcatacagatctgctggccatagggactgtcatcagtgaagctgatcttgctctttctcttcactggtaaagagtaaagcattgttcacacattgcctctgtgaattgtgtctttttgcaacaccaatacctacaaccatggagcaggttggacaccctcgggctgatactctggtggaagatgttgttataccaactactagcctccatgcagtgggactcctcccctggaggtggtaataagtgtcacttgctcaacaaaaagcaatt

SEQ ID NO: 42765 - DNA, 1626 bp, Bovine  19866880507229
cctgctgcctgactttatttaagacttactatcagctttcttcaaaacatctctgcttgtgaatttcttggagcccactgacccgtttctcttaggcttgagccttttgattgtacaccctcagcctctccgggacgcctcctgactctccctgtcaccctctccggcccgcagtcccggccagcgtgcatctgcaagccgccgtggagcagcaccactggtgcatccccttctcggtggacgggcagccagcgccctctctgcgctggctcttcaatggctctgtgctcaacgagacctccttcatcttcaccgagttcctggacctggcagccaatgagacgatgcgccacggctgcctgcgcctcaaccagcccacccatgtcaacaacggcaactacacgctgctggcaaccaaccctttgggccaggccgccgcttgggtcatggccgctttcatggacaaccctttcgaattcaaccctgaggaccccattcctggtgcgagggccaccctgaaccctgctcccaccccctgggccccaactgggtgcagatccaggtgtccggggaggcctggcccacttcccactgtgatcctgaccctggaagttggagggcctggtcccggacagaaagtagcctggagttctggtgtccagctctgtgctggcttccttgccccagccttccccagccccaggagtcctgcacccctgagttattccattcactagggctggctgaagagagagccacaaaccagggcatccctggcccagctggagcagctccgcctccccctcccactcccacccacgaagggatgagtccagagggggaaggggactcactgctcctttcctccatgtgattgctctctctcctccctcctgctgcagtctccttctcgccagtgggtgagtagcccaagctggagggcaggttctgtctggtccctggagctgggagctgccgctggggcagggggcacagttaacccttgagggttcagccggggccagggtggggagtctgtggaggagatacaacctgtgacaaagcctttctaccctgtgtccccacagacaccaacagcacttccggagacccagtggagaaggatgagactccttttggggtaagcatgggaagtggaagcttgttcaggacttaggacagggagctgggctggaggctcctctgtatgtcatttccagtcagagcacagagagcagcagagtctggcctgagctccatcaacaccttcacagccgtgactcgggggccaggggaggagaaggcaggtgtgggggcctggctctgggcatctatgcaggatggagaagtagttgactagtggggagctctgagggttcaggatgactactagatccaaccaccccataccccaggtctcaatggctgtgggcctggccgtttttgcctgcctcttcctttctacaacatttcttgtgctcaacaaatgtggacgcaggaacaagtttgggatcaaccgtgagtagaggggctgtggaggggccgtcagtctgtcttcctggctttatttcctcctggttgttcccgactctgtccttctgtgtgggggcctgggtacacatgggg

SEQ ID NO: 42766 - DNA, 2715 bp, Bovine  19866880590315
tgccacacggaggaagagggcaaacgtggggtgtgtcccccactcccctgcccaacctgcttgtcttgggccctcggaaaccagggagccaggaagaggagttgcaccgccaacaggcccgcagaaggcacggctgggttggggacacctaacagagacgctgctgcgcccatcactcacctgcggcccattttgggggtgaagggaggggttgggttctcaagagacctgtggagagaatgtcaactctgagccaccctcggctgcctggcccccaagataccagtgggcggagccctcccccgagccccgcccacctggtggagaggctggaggcagacgaggaggctgactggtgcaggcgggcggcctccgcggcggcgtccatgtccacgtcgctgcgagagcggggcacgttctccgccttccgggaccgcttcatctcctcccggcccttcaggctctcagaccggcccaggcgaatctctgagcgtgaactgggtggaaacagcaagagactttggggtctcacatctgaccagctctgacctgctactccatctcagggcctgcctcggcactgcaggcttccactccaaacaccagacccaacgtgcccaaactccccgtggcagacactgctcagtgacaaaccgcttttactacagactccttcctctccccagctaggcttgatggacagagcctctcatcttcctctttcctttaaaaaaatttttatttatttatcttttgggtgtgctgggtctttgttgctatgtgggctcttctctagttgcggtgtgcatgggcttcttactgtggtggcttgtcttgttgaagagcacgggctctagggcatgcaagcttcagaagcttcagggttgggctcatcacctgtggttcccaggctcaacagtggtggccccgcgggcttagctgctccgcggcatgtaggatcttcccagaccagggatcgaacccatgtctcccgcactggcaggcagatactttaccactgagccaccagggaagccttcatcttcctcctgactgatcagaaagggatcccaaaaggaagctaaaatctgggacttaatagaatcagacttgtggtgtatctggatgccaaaggccctgagtccccatcaggctgctgtggacaccaaagtctatcaccaggaaccatgaggtcctaccctccctgaccccgccgtctcctggccggctcacctggccctctgctctggaacgggttggtgcccacccgttccaaggcaccagagtccaggagagctggactctgctcgaggcacagctctccttgtacaagtacaccctcacatactctttagcattctccatactgcctgtcagaaaagtctatctgaattcccacccctccagttgcgatgtggatagtggatttcttctgttcttatcctgagagcatcctttctaggcttccagccccctcggagcagagcagcttggaagggtccttcaggggcatgcttactgatgggcagaaacctgctccctggcctgccattcttggtcactgagtgtctgtggggcttgagatgctgacgactgggtgctgctctttttcaagtcctgcagtgaatcagccctgtgacagctggcatctctgacccctagctgccccaggatggtgcctccccccatggccctgctgggctggttctttgctgacattattgctaatctatttgctgctctgcatctaggaccacagaaggcctggggagtctggagagttcttaatagcacagcagactgctgcagagaaagagccaaatggcctggtctccattcatcaagtctgaactgccaagggatacaaatgccgctcccctctgggttccacagtttgtctgcagggttagaacccacactgtcagctgatcccctactgaactcactccttgaagcctgtcaggacaatgccaatacagactacctcaaaacacttgcaccagtgccccacaatgggtcacttgagcatctctcatcaaaccttgtgcaatgaggttcctggggcttctttcaagtacccagaagtgagcaatgatcccaagaaggaaggcatacaacccttctctagccacaagttcctaggttaccgctgtctagaactgggggcttcttatacctgtttagtttctacaaaaacctttgacacactacgctgccgatgtcatttcttccaagactgtcagtgaatttataatcaccaaatccaaacgcttctgccaggatcctatcctcaccaatgtctcagggaaaatttacctaacaactttaagaatacgtttacaaatggtctcaaatatttcctcaaagtgctgacaatatatcttataattgtatatttgatatatctctaagatcacacctacctcagcaatcatataatttgtatacttaatttactcaataacattagaactcaacctctgttgttgttttgttgtttagttgctaagttttgtctgactctttgcaaccccatggactgtagcctgccaggcccctctgtccaggggacttccccaggcaagaatactggagggggttgctgcttctttctctaggggatctcagcctctgaccccggcacaaatctaacctttatcttgcctaaatctttggtaattctcactatggcaaaaccttttaacatatattaag

SEQ ID NO: 42767 - DNA, 1182 bp, Bovine  19866880593847
tttgcctcctagtacctggcctcttgtctgcatggtagtgaaggagccttgggtcagtttcctagaccttcagaccccaattgcctgtctctgtgtttcattcaggaaggctgcagtgggaggaattgaagttagatggggtggtggacaggatggaagcattgctggggtgagtcttccttgtatcggagttcccaaaacagagcaagcacacaatacaacaaatggttgagaaagaaagagaggtggggcgagcttgcatacatgggtgcatgtatgcatgtgtgtgtgtgtgtacatgtggctgggacagggaaggagtagggtaaaggagtggctgagggaagcaggaccccttcttccttccactttgtcacgcttcttggctctgagtgctttgaggtccgttcctggaggccagggactgagcaaggtggctatttcctaacgaccaggtaggctgtctccccattccattctgcctgagggaggagcatgctctccctgcccctctgtcccttggaacaccactggtcttacttagtggcctgaggcttctgtcaactctgaggccgggtgaggtccccccaccccgggacctgggccctgtccccatcttcctcacccaggagcagggagaagcaattccaccccccctactccagccccatcacttccaatcacctgcccatctcctgcaataacccacgctctccatggctcctcagggccgacagcatggctgtctcttttccctgggtgtccagctccccccacccggtgattcaatctgggtcttatcaccccgaggcctagcccgatggtgtctgcctcttgtccaggctggttagtgctaatggaggtctgacccaaggctgcaggttgattgatgggggggtctggtccctgaaggccaagttcagaagccctcttctcatgtcctgggctgggtggggctggcgaggcaccactcctggggagggagggcttaagcagaagtgattgggaggaaaggaggttggaatatgctgggagagacagggtcggaggatcagatccaacggatgagcccagagacagtgcgaagagagagaccgtgcagaaaaagaaagggagaagacctgtagatgtggagacaggccaagagactgcagggaaggtgcatacagagaaggagaaaga

SEQ ID NO: 42768 - DNA, 1116 bp, Bovine  19866880607045
aactgaaagggcaaaactgcttccaagaaacttagctgagttctataacaaaatttgagaatatatataggaatataaaaatatctagcatccaactaaaaattgccaggtatgcaaataagggtgacataatatcaactggaatatatatcaatcaactgaacctgatccagaaatgacatatatgatgtaattaggacacaaaaatagttattataactgtaatctatatgttcaagaaattagaagactgggcatgctaagtatagacatacaagaaactttaaaaagaatgtaactgaacttcttggaatgaaaactacaaatgtttgagatgaaaaatatactggatatgactaatggtaaatcagagaaagcagcagaaaagattaatggatttttagaagagcaatagaaaccatccaaaatgaaacatgaagagaaaaaaggaagagtatcagtgagctgtgagacccctcagtggcctaatatacatgttaccttcaaaggagaagaaagagatggggaacagataaaaaatagctgaagaaataattaaccaataaatttccaaatttaacaagaactgtaacccacagatccaagaagctcagtgaactccaagcacaagaaagtaggaaaaaaattacaccaaagacatcacctacaccagcagacctacacaggaaatgatgaaaaggaagcatttcaaacagaaagaatgataccagataaaattccaatttacaaaaaggaatgaaggggatcagaaatggttactgtgtagataaatatattaacttccattttaaaaaatatttatttggtagcgctggtttagttgcagcacgcaggatccctgatccttatggcatgctggatcttcagttgttgtatgagagaacccttagttgcagcatgtgggatctagctctcccagcagggatcaaatccagccccctgcactgggagtgcagtcttagtcgctggacagggtttgatccctgcgttgggaagatcccttggagtagaaaattgcaacctactccagcattcttgcctggaaaactccgaagacaggggagccggcgagctacagtccatggggtcacaaag

SEQ ID NO: 42769 - DNA, 1747 bp, Bovine  19866880656565
ttggccttgctggtgctgggctagaatccaggctcccccacatcttccccgctgtggcaggctcatcaatgtccacatttgctgtactcagctagtaggtgaagagatgttcatcatactgactgaagaaaactagcactgagaaggtaggagagtggtgtgggaactgtgagaaataaagcatctgcaaagaccacagctgggttcaataaataagagaaagaaaggggagagaaggggatgcacactcagaacccaggaccccaggacttcggaggctctgttgtgcccacacctcaatgacgtgctgcaccagatcccaacttaacaggctggaagggcgtaggacagcaggaaggagccacacatactgagaccttcccaactgcaggacaggaaatggctccagccgtccagtctcagcaaccagactaccatatagatagagagcgaagtgctgcaaaattctggaaagtagaagctgtgtctgggaggcttggtgtacactccagtaccaaggggaacacgtgtttgctaaaggtgtagggacagtaacaatgaggtgaggggtcagattctgctttggggactcccaagggggccacccagtagacctttctttcccacttactttgctgaatgatttcatggttttctcttctgtcaatgacttggtcatccactgctgggccccactgagctggtcgtcacctttgatctccacaaagttgatctcctccctccctcggttccttttgccctgcagccgcttaaactggaaaaggggggagaaattcaggagtcgagggtctgggtaggggatcaggagatgtcaccaaggacccagagttcatggaatgattttggggctccccaattccactgcacccttaattctctctgtgcagtatgtcctttcaccatgccacctaccaagctgacaggtgaaaggctacttctcacaagctctcctggcctcaggaaaaagaaggccaaaatgtattcccaaacgtgagtgcagagattcactggtatgaattttactcaaattgtgtataaattgtatatgcctaaaagaactgcacactattttcaaattaagaattaaaggtacaaaaacaatcctaggatttctcttctaaaaatcagttcttttaacatgtctgttctttctcattggttcagtatcaccaaatcagcagaccacacaccagattagacattagaggagaaggcaattcgagatggagagagaggaagcctcaaaaaagagcctggcaaaatttccaggagactgctactctttgcccttcctccgaaagaaaaaaaaagtatcacactgttaagtcaccagaagatgtgctgaggagtgtaggtgaagaggaattaaattcaagaacacttggaaatctgcagtgaagcctaggttgtggtctgagcatcagcaaggcctctctctacccataaggagctgacttttgccactggataagttccctgctgcctcctaggcttagaacaaaaagggcctaactactgaacttgtcaaggaggacatacacaggaaagtggacgaacacaggacgaaccacaggcagaagtttacaaagtttctgtgaaaaggtgaggagaatgttatttttataagaccttgcatcccctatttctccaacccactcctggtaggctgcggcctccctacagatggaatactttatctcctgaacatgcctggacggtcgcagaa

SEQ ID NO: 42770 - DNA, 1388 bp, Bovine  19866880718916
gcctgcgtagggaccctggtaggtggactttgagggctctctgttctgatcaagactttgaaaactatttgccattaagccttgctgtgtcctgtagactgaccagggacagtgtgtctcccctcagtgttgttggaaggaggaagatgaatgttttgacctcattagcaaagaaagagaaaaatgtaagaaaccactggtttatatccagccaatgaataacagttgggattttgtatgcagttacagataccatgaaggcagtcagtgcaaattaaagcactctaattactctagggggcccttcaatttaaatgtatgttttttgtcaatactttaaatgaaaattaatgctttaattattctgttttttaatgtattattttgatttaatattaaaccttatttttcacgtataaaatgaatgttcttagaggagcatttcttggagttttgggcaaaagtggaagaattaggaaaaagtgcaggcagggaggaaatagtttctcagccctgcagttgcctgagttggccacagtaggggccttgcccttgccttcacccctgttcctccacggtccacagcaacatctggccagctcacctctaaaggggcgtcatcaattcctgaactgaaaatctggtaatgcaaacctggtttgttcccagttttgtcaattccataccacccttatggtggtttatttttatcagagatctgcaacctccctgcctgctaggggagggagtcccccgtgcccagggctgctagatccaacgaggagcaggaagcatgcctcatgccttctcctctctgctcacactggagcgtcctggggtcttctgagcaggaggagcccggctgaggcacggtagaggtcagcagtaggagtcatgctggggaagcagctaagggagcaggctgtgaattgaagcaggagagaatgtctttatttcttgtatctcttccctagaaaaaaaatccatctgtctggatggtgtagatcagaaaaaactctggttcttgagttgtagggtaggtccttaggatctgtgctttggctggtccgcttgaggggtctgtggtgtgagtatcaccactgcctcttggatgaggttttctccgttctctgcactgtgccctcagctggtgtgttttctctcctccttgactacaggattattacagtggtggctactatcccgcacaggacccggctctggtctccccccaggaaattgccccagatgcgtccttcattgatgacgaagcagtaagttaataaagccaaagtgaccatctttgacccctagacaccaggtttcaagtctgaagctaaaggaaattctttttttttaaaaaaagcaaaaaagctgtattcatttgg

SEQ ID NO: 42771 - DNA, 3301 bp, Bovine  19866880735722
cgaatccagcttggggtgatgcaggtctccccccaccgccctccagtgcctccgtctggtccccaccctgacctggggttgctctctgggcctctgaggcctgaaccccgagcctgaagagtagagatcagcgggagtacccaggcgcctcccctgaactttggtctggctgaatagctggcctgaggccaggagcaaggttcccctctccaagggcagacttcctgctggccagaggccggggaaatcccagaagcgagcttcccctgccccacaggggctcccagcggccaggccagggcagggagctgctgggccctcccacagcagagggagtgccaggcagggggaactggggctcgggcccaccaaggacagaggacagggcgagagaggagctagggagaccgaggagcagggccagaagcccaggagggagggagaggggacctccttcacctttcatttctgggtatcaggctgtatcactgttatcctgctcaggggagagggtgagggctgagggcacagtggaggtgggcagccaggagacactgagaggtgggtgccgggtttgcctgtcaggaggaggggatctgatcgtgatgggctgaggtgggggaggagacagctggcaaggcccactctccccagctggtggtcctgtgggaagatggggaagggaggaaggaggtagtaagagtgaggggtttccacgtggcagaaagcaaagcccccgctgaagacaacacagcacgcagagggtggtgctgggcattacagtggttattcttgtcctgtttccctagagatctcattcgggccccctcacaacagctgtggtatgttcctcctccagctcccctgctgggaccaggcccagaatcttccctgcagtgagcacccccccccccacattctgtctccctcctttgcagctaactgcccctcctgaccaaacctgagcctcctcctcctcctccaggaagctctcctagactgacctcccccatccctgcattccagggctcctcatccccaccacaatggccttttctgggctctgataggtggctgcataagtgttctacacactgtggtttcctgggtgtgcctcaggtctcccattagtaacaagtccagggcagggaccttgacatcaggtcacaagccagtccatgtggagagggggtgggggagccacccatggatttttacagctccaaatcctaattaaagtgtctctttctccatcacaacctgcccaaacctggccttatatcttccctttcacctactttcttctcaaacttccagttctcggccaactggtctacccttctcctactcactgaggctagaaacctggagtcatcttgactttctcctccaacagcccagatacaggctgacatccagccctgccttttccagggctccaacccaggtcacttcacctcatctcaagtcagcaagcattcttgatcacctgccagggcctgaccgatgtcaggtgctggcacacaaaagatgagtaaggcagcagccttgccctcaagggcgtcaccgcgctgttagtcgcactgtaacaagttctgtactggaagccctgagagctttggagtcggagagccgcatttccactggggacatgaggaaggctgcctggactgtgtctgtccttccttcatggaaaggacaaagttctgctcaccagtgactggctgggggacttggacaagttacttcacttctgagcctttgtttccgcagcaacaatatgggaatggtaaacccttgccggatttgggaggattagctgtaatgatagctaacatttgctaacccttattaggtaccaagccctctcctaagagttctataggtaacaggtcatcttatccttacagccctctgtgagacagaggacgaagtcatccctattttcagataaaggagctaaggctcagggatattaagcatattagtgagcccaactaaaaaggactgctgccaaaatttgatgcaagacactgtttcataatttggtcatactcacttgtgcaagtttatcttcaaaataatgtaattattttgttaacaataattaattgtaatataactttttttgagagctctactctgttccaggctgtatgatgatgacttgcatttaatcctcagaacaaccttgaacagcagatattatcatattgtgagaaaatcaaggctcagaaaagttaagtaatgtcccagtcttacagccagttccctggatagtcaggctttaacccagatctgtccaacaccagagttttctcttctgcccagcaccctcccgtggctcagcctgtctgctcacctcccaggctcacacagtcacctcacgtgttcaccatgtttgttaatgctctgctgctgctgctaagtcgcttcagtcgtgtctgactctgtacgaccccatagacggcagcccaccaggctctcctgtccctgggattctccaggcaagaacactggagtgggttgccatttccttctccaatgcatgaaagtgaaaagtgaaagtgaagtcactcagtcgtgtccgactcttagcgaccccatggactgcagcctaccaggctcctccgcctatgggattttccaggcaagagtactggagtggggtgccattgccttctctgctcactccccaccaactctccacatcacctctgattcaccccctccacttttcagattcccacccgccatcacaggctcagcgtctccataagccgtccacactgagtcattgaagcccaccctggcttctcccatacagcatgtttgggacatatattttgacacttgaccatatttaattggggcttcccagatggtgctagtggtaaagaatctgcctgccaatgcaggagacataagagacacaggttcaatccctgggttgggaagatcccctggaggagggtatggcaacccacctcaatattcttgtctggagaattcaatggaaagaggagcctggtgggctatagtccatggggctgcgaagagtcaaacacaaatgaagcaacttagcacacatgcacacatttaattgagagtgtaattatattttatttggcattgtcttataattatctaatatttagaaatcatacatccccaaccagtgcaaaacttccttgagggcaagaaacttaacgaaaatttcccttcacttcttttgtctcctcccctcgtcacttcagcagattgctagacacacagcaagtgctccttaaataaatcgaga

SEQ ID NO: 42772 - DNA, 1453 bp, Bovine  19866880829478
atgggtggttttatggtttgggagactttgcgcctattttgaggttattggttgtgttctggatttttcagatcattaaatcagtgattcaggagaaggtgtaaacaggctctgaaggagagccattctctaccatattctctcccacacctcttcccttcccgtccctccctctcttttccacctggagccagaggggttccccaaagacatcagctctgccccctcctccaccctcctgcccagctgcctccagccccaagccagctgaagctcttcttcattttcccctcttttctccgacccaggaatctgggagtctgccgtccttggggctgaccctggccaatgtcaccagtgacctcaataggaagaacgtgacgtgctgggcggagaatgatgtgggccgggctgaagtctccgcccaagtcaatgtctcctgtgagtgccagtgactgcctctgtgcccaccccatccctgcttcccggaaaaaaggatgtgagggttgggggctgcaggaaaggggtgggatgtacgtgtgtccacagctgctccctcccagctctttccagattcccatgaactgatcctttgagggaagtcctgggggctcgtcaaggccagagggatggagagggatttctttttggccccctgcccaagtcttgctactgaagccctcaacaccagctacatccattctctctgctcccttgtatttcttcatgttcattcctctgtaggactttttgccctacttcctagttttaaaagaagaaattctccatgcaagtttctctttaggctccctgcctaatttctctaggtctgccaacaaattatttaaaatcttctacatggtataattttttcttcttttcttgggaaacatactttacatagatatgtacataaaacatatacactttaaacaataattcggcttacagacacttcagaagacacccccttctcactattcagaaccccatccttctcctccaccccattctgacttttgtgacaatcatctccttgcttttaaaaataattttacacacatatgcttccctctcagcatggttgagttttgtctgatcctgtacgttatataaatggaatcatacctcatatattactttgtgtctaatttcttctgctctacattatatttgtaagatttgtttatgttaactggagtaacaattagttcattcatttcactgctgaatagtatgctgctgcatgaatgctggctggaattccagtgtcaattgggtatatgcatgctcctctgtccatgggattttccaggcaagaatactggagtgggttgccatttccttctcctggggatcttcctaacccagggatcgaacctgcgtctcttacatctcctgcattggcaggtggattctttagcagtagtgtgcttcacccagttcttgtcca

SEQ ID NO: 42773 - DNA, 917 bp, Bovine  19866880898130
tcattaaaataatgaaatagtctcataatggttcttaagtagcactgcccacatgtcctgcaccctctctggagacccaacccccttccttgtgacccatcattaaaggagtcatgcctggtgcagaaggagttgccctctctcacaggctatattgtcgggattgttaaaaatggaggggtgattcagaatatcacttctgcccctgggacactcggggacttggatgcagggggagaagaacattgaaagctaatgggcccccaaggcagagaggagggtgggggcattctggatggagaggcgaggtctggtggagctctggggacaggcccggctttcgtgcctacctcactcttcatacccatggggagcagcgctggctgaaatagagcaggggcccccagcagcaagcagggggacggggccgtccggatctcccacagagggtagttaacgacgatgagcttgctgaagttgaacttgtaagtgaaccttttgcctttggtcttgtgcaggatcctcttattgtagtaatatctggagatcccaaggatgagagcaggaggttggcagggaggatgcattcaagagacccagccatatccctgctccccaagattggcaagattgacccctagctgttcttggataaccgctagacacactccagagcatttcccaagcctcagaggggcgggaattggacaggggtgccagaaaccacagcctttttctctgaactcttccctctctggtcacgttggctgcctcctctcacctgagggcccggctcagcttgtcgtaattcatctgtggtttgcacttcctgcggccccagaggcgggccacctcgtctggatccttgatgacgaattccccgtattctccctgctgccaggcaatgacatgggtgg

SEQ ID NO: 42774 - DNA, 1205 bp, Bovine  19866880919092
tgtagagagtcagcatctgccaaaaccggcctcagaccgatccccaccctttcagaccaacagccttttcagattcaggtccctctcggtgcagcgaagctcccacgcaagagggtttcagaccttgggaagccacacgagggggacgaaggccaggcctgtcccaggcagcctcttgcatccgtcacaccaccacaggcggaaaagctaaggcctgtggctgcacgtcagcatgctctgggtccccaacgcagccttcgtccaaccgcagtcacctccctgtgcactcagtgagtcacaaacaggccagcacctccagccacaacccatatctgcagagcctgctggcctgcaaagcttcagctggttggtctcccagcagggcccagggaccctcactgtctgtgagctgcaagctggtggacctgccctacaccctggggcagtgaactgtcctcctagagagtctcatgatccagttttcacagggtctcttcatcttagtcttaacatccatcccatcagtcacaccaagtacattaccttctaagcctggagaagcccctccacccccatggagaaacagcactcaacccgcgcttgtgtccagctcccatgcaccactcccatctaacctcactccaatcacaaatctggggctcttcttctgggcttcctttattacaagattttcctcctgattcttggctggacatgttctcagcaactctcttccatccagcgaggggaggacagaccacaacagccagcacaaccttcctcccaccccaggggttcatgtcacaccaaacaccccacaaggaggtaggtgggctctgcagatccccaattcacaatccctgaaccagtgcccacagacctttgagaccctcccattgggggcacagagaggaggaagagccccagcatgaactggtaatgggaaaacctccccattttcgaggtcacaaacatttcttatggttctgagaaagaacccccatcatcagcctccagcctgcagacctgctccccttccctggagtaagaatccttccctcccacccttgccaaactcccaccaacccatccagatgcagctcagatggccacctggaaccctgccctatcctgccccagataaattaggcgctctctgtgctgggctcccacagcacttcagcaagttgttggtcgtttgggga

SEQ ID NO: 42775 - DNA, 1131 bp, Bovine  19866881090322
agtaggaacaactgagtggctaccaatcctcccagttgtacaccacttaaatgacccatccatgtctttatgagatatgagggctgaaagttccccaacatgctaaaacaaagaccccattagatgacaaaggacgggaggaggaaactcagggaccccaaatctttaaaaatgggtatgccaaggatattctctgttgaaaagttatagtcaaggtttctgtcttaatttatgtcatattgtgtgaatcagtggtgaggataaatctgtaagtgataccatagaaaactcgttacagagagacaaaagagaactaactaagcaagaagagagaaactgaacagctcatctggcagtctaaaagcaccagagttacacctcgcttaactggaaatcaggctctgacaacgccagttctgtggaacacagtaccaaatccagaagtgaaaaaggcctttaagcgcacagaatagctaacacagagcttttgaaccaaagtcagatccttagggctacacacagagccttactgagttatgctgaacaaggttcctgaaacctctggcttcccagcccatggtcccaggaagaccaggtgggtgtgggtgaaaggcctgctaaggagggaagtgttttgagagcagagagatagcaaacagcttaagagcccaggacaacaggactcaaaagtagacacagcattgtgctgtatatcacttcactttagagaaaggattataatgcctcgtctggtgcctgatggctcatcaagccctttaacacacattatctcatttcaactccacagcaagcctatgaagtagatgctgaggggaaaaaaaaatacacagagagggttattgacttatccatggtcacactgattaacgagtgctggagctgggaataaacccagattttatgatgtctaacacaggccttttcctctacaccaggatgtctcctttttgataatgacgactgtgagtcatcaagaggttagtttgcaactagcagacgctgttgaagacaacagggaagtaggtaatatgcttattttttttttaattaaaaaatgatacaaatagacaaaggttggcatttaggataaagatcagctttccattctca

SEQ ID NO: 42776 - DNA, 1024 bp, Bovine  19866881193648
tttttggtcttgcatctatcctgttgcaatggcaatttcatttggggaggatcagagccgggccttaacagatttgaaaaatgctgggtccttaagcccagggagacacaagaacagaacatttccttcaatgttgaggattagagcagacctggaggcaggatgcttaagtctatgctccgtgctgcacggaatcctgagggctcagggaggccaggatatacagctgtcctgcccaggggaaggcccagctcctctcttctactctcccacttcccaccctctatagaattcctgcttccttcgtggcccctaccctgtatggcagagacccaggtgtccagccccacctgggtttaatttctacatgactctccgccaacaaactctctgatccagcagatgcaataacactgcgcagggtgaggcccttctacaagtgctgcatttggctgggaatctcccggtccccgttgggggtgagggtgaggggttcacaacactcccgctcttgccatcactcctccccgactcagcctcaagggaatggtggagagaggtggggcagcctcctcttcccaagcccccagaccccttaattgtgcatacatctacatccactcacaccctactcttgcaaccattcaggagcctgcccatctgcattccttctgcaaaaccagccactttccacatagccacactgcaatgggaacaaagctccagaatgtttctttcctaactctagcttgtctgtttcttcctcacccctatcctgcctctgctcccccaccttttctcaccaatctggcaccccccccacccgacttgagtctccaaattcctgggggagccccaagagaggtatgacccaggctcctagaaaggggaacgcattgccccaggcagatctgcagcagatttggtaataattaaaaggccagcgacactaggaaattccttctccttatggatcccggcgggaaattaaagccagttgtttgtgactgagtgactgatgctg

SEQ ID NO: 42777 - DNA, 2704 bp, Bovine  19866881301688
ggcctgtctggaggggaggcaggcaggggttaacctgtgaaggtcggtagatttgtttttccaatgactcccatcaggggagccctagagaggccagggcatgatgggaagtggcatgtgggctcctgaaagaaccccccatctgcctgcagagcctgattggcctttgcctagagggaccagaagtgttttctctttgtgtgtgtgcatgtgtgcctgcaagtgctcagacacacacagttgctggtagagctaagcacaggggccattaatgacgacagggagaaggtatgaagtaagccccagcgagccagcctagcctgcccaccccctttaaaacatcaggggatgggcctgggtatttaagatgcctgccgtgttgcttgaggactgggtaggagtggaggggagtggacgccggagacgttagcaggactcgactagcaaaccaaaagattcagacccgaatcttctaagtgaggaccatggaaagtatccttgggagaagggagtgcaggagccaggtaagcaactctattaggggaaccattctaggtgacttggggaaagaaaggaaaatggggccagggtcctgggacctgaaaaatccagacacacccagttccctgagggaggaatagacttggggtccagatgccgttgattcaactcacaacccccgagtgcccagtgcttcctgccctgaactgggcaccatggtgattgacaagggccccaaccacaggagagtccctccttagaaatggtgacagagagagagaaagcaatgttgcagcaataccccaggtattctggtgtgagtgctggacttagtgcagcagagcctgaagggaacgtgattaactcagggtcagagggtcagggaatgggggcttgacctgaggctttcaggacaagaactgaggggttaacaggccaaggaacttttctaaggtactagtggggcccagtttatcgacgtcctggaatgtcaggctgaagaatttaaacttgaacttttggcaatggggagccatggaatgttccttcgaaagtaaacagatgctgggaccaaggttctagcttccttaggcctgggagagaaagggagtgtatgaagctcagactattgcttctcagtcacagaattcattcactcattccttcatcaaatatttactgagcaccaattttgtgccaagcactgtatcaggcaccaaggacacagcaatgaattacatgatgacccctgcccttctaaagcttacaacaaacaaaagaagtaaattgtatattagccagtgttaagcatttgaaggaaaactaagtaggaaagggagtaggaggtaatagggtgatcagagaagtcctcactgagaaagtgacatctgagcaaagacttcaaagaggtgaagagccatggagagggaagagtgttctagccagagggagcagaaggtgcaaagaccccaaggcagcagcttggcaggctcgtttgagaaaccacaagacagccggtgtctctgaagaaaagagaaaaaggggataaagtgggagaagtgcagaggccatgtaggctgtggtaaggacttcagcttttcatcagtgagatggaggccgctagggtgctgtgagcggtagaggagtgtgatccaacttgtgtggtgtgtttccactctggctgtggagtggaggataggagagagagggggagaggccggaagtggggagaccatttaggaagctattactgtaaagtctggagaagacgatggtgaaagcagtgaatgcgattctgggtatattttaaaggtggagctcacagggtgtgggggttagagaaggaaaggaatgatggaggctttcgctttggagtctgactgcaagaaggaagttgcagtcaactgagaaggggacgtgagtttgggagggaaggtcacttttgcccaggtgggctcctctggtggggatcctgtaagctgcggatgaagcctctgaggccgagagaggaggttccccccacacccacagcagagcctgactctgccttaatgttccctcccagtgtggttccctcctccccagctgccagagcaggatggggtgcttggcccaagctgtgctgatggctacctgccgcttgtacccacagtgtgccccagcctggacatccgctcagatgtggcagagctgcggcggctggagaactgcagcgtggtggagggccacctgcagatcctgctcatgttcacagccaccggcgaggacttccgtggcctcagcttcccacgcctcacccaggtcaccgactacctgctgctcttccgggtctatggcctggagagcttgcgtgacctcttccccaacctggcagtcatccgcggtgcccgcctcttcctgggctatgcgctggtcatcttcgagatgccacacatgcgggatgtggggctgccggcactgggggccgttctgcgtggggctgtgcgtgtggagaagaaccaggagctctgccatctctccaccattgactggggtctgctgcagccttcacctggtgccaaccacattgtgggcaacaagctgggcgaggagtgtgccgatgtgtgcccaggcctgctgggcaccacgggtgagccctgtgccaggaccaccttcagcgggcacaccgactacaggtgctggacctccagtcactgccagaaag

SEQ ID NO: 42778 - DNA, 1280 bp, Bovine  19866881347372
ttctgtcacctccaccagctttgttcgtagtgatgcttcctaaggcccacttgactttgcactccaggatatctggctctaggtgagtgatcataccatcatggttatccaggtcattaagatcttttttttcacttctcctgtttcctcagctatttgtaaaagtcttctcagacaaccactttgccttcttgcatttctttttctttgggatggttttggtcactgcctactgtacagtgttatgaacctccgtccatagttcttcaggcactctatctacacatctaatcagtccctcgaatacacacacacacacacacacacacatccatagttcttcaggcactctgtctacacatctaatcagtccctcgaatacacacacacacacacacatccacacacaaataccataggccagcagaatgatttgtgggctggtcactgcccttcagctttgctgtctagaagatcacagcccttttcttgcttcatcacacaccctctaagctcggatgaggaggctgtttctccttatttttacagagcacctgtcctgtgtctggtgctggggagcatactgggaagaacaccctgtaatctttgccctctggcagggctgacacaccagatgctcgggagcagggaggaacatttgtgtcagaatttgggttgcattgtaaagaaaaggataaagaaatggaagatttctgggaactgatagggagtttctttgaaggtctgttaaatgaaaaaaagtgtaaaaagtgtaggatactacctgttgtggaaacaagacaggaaaataagaatatttatatgtgtttgtttagtttttacaagaagaaacacagaaaaccaaaaacaaatggaagtggttacctggggaagagtgagatgaagggacaaggacacttctgaatgtaccttttaaattgcattttgagttttcaaccatgtaaatgtttgacagatttaaaaaataaataaccctgaaagagcaaaccctaaagttaagtacagatataaacagaaacctaaggacttccccgtcggtacagtggttaagactccacgcttatcctgcaggggatgcagtttggagccctgttcagggaactaacaccccgcatgctacacagcacagcaaaaaaagaaaaaagaacaaaacctaaatgtatctcaaattgatagcataaaaaactcatccaaagtgactttcacaaatagttcagtcagttcagttcagtccagttcagtcactcagttgtgtccga

SEQ ID NO: 42779 - DNA, 2704 bp, Bovine  19866881349784
gggagacattccttcttagtggatccttcatccttcaagcccaaaggaaatgtcttatcttgcatttggaagtgaaaggcggttcttcatcgacaacatagaggatatgaggtctcaggggaggcctgtgtccccagtacagacatgtgtctcccaggcggtgcctttatatccagactgtgactcagaacaagtgagtcaaggcttagtgagtcagggtggggccagagaagtgctggagaccccccactgcacgtcctccactggccaacaggggagggggctctgctccttcccagccattttaggaatcctggcaagttacttccccctggctggggctcttccactcccacacctgcctactgcctttgcctggctccttcagacaggccggagcataggaaatcccatcctgccagagcccatggacaccttctaaggtctgaagttcccaggtgaggagtggtgagagaaaattaaacacctctcccccagcctcatacccaatccaggcccaggggcgcctggctcagcacaccggaaggcagcccagaaggctaagcccacactgactgccagccagggttctgaccaccacacccagggcccaggcctgacctgacccaggaaccggaaaatctggggcaggagacagttggggccaggaaagtgtggcaagctggagaggcagaaaaggtggtgccttgggtgtggggggagggggcagagagagaaaagatgggtgaggccctcgggctgtgcaggttttctgggactgtgaaacaggaagtgaagaaaggaggaaggaacagaaggggaaaaatccctgagtcttgcaggttaattgttaagtgcttggagatcccccggggaagttaggcagaaggaagaggaaaggaaaagattaagatggagtcacaccgtccttccaggcaggtcttgcctaccacgtggtccctctggctggactctgcaaacactgggctgttccagtctcacccagagtcagtcaccctccccagaagtagggcctaaggaagaaaagtccacacatttgccttcaccatggctgagggctctggttgcctattatatggaacagttagcaaggctcctccattcctcctccatctcaggaagagccagagtctcttcagactctgccactctatagactaagacagcatccaagggtggtaaggagaccccaatttgtctgctcttttggcattcaagcagaatgtattcggaacataactaccttgggtgtaccactccctctaattttcataatcaagacccagagcgcaggcaaagggtggggtcctatctctttgggatccagtctggtccccctcccccaactctaacttcatctaaagggtccagccctcaaccgagcaacagactgccccctgtcctagaggcccgggatgaagaagaaatagacattattcccagccccagtgctgcccttactccaaggccaccagaaacccgaaggtcttcttcatatgggccagtatgcatccatatggggccctcccttctctgcagccctaaggggtcctctgcaacccacattccagctgagccccttccccagtctctgggctttctcccacccccaggaggtaggagcagtagagacctcggttcagttcttgccctgcccaccaggaccttggcatctgaaccaagaagccagatggatcaaaggtgcagggtaaagtacacgagtgtccacacaccacaaacagacatacacacacacagctgaccgtggctgcttgctcacactgcccccagccgccaccaccacccaagtcccctaggaggccttggaagttgggagagccctgcttcactctagacttcactcccactccagaggccagacatctagaagtttccaggaacaaggagctcaaggcatatgggattaggcacattcctgaggagagggtacagagtgaggatctcctggattttctcaggctggccccaaagttggtctgcacactctgagcaggacccaggggggcctggaccaactttcctcagggcagggtctggcccagatgaagacacagactcacgtggaaaagagcaacccacagccaataacgcagttctacacttggccccctcgtccagaagactccttccctctacttctctctgcccttggatttcactctatactcgagggccaaacccaaaggccctacaccatctttgaaataagttgccggaggcactgtcccttgtgacaccccaacctcctccaacaacctctggcaacctcccatacagttacttcacctgtctcagttctaggggaaacacgatgaatgctccaggctgggcttttgggccccaccctcccacctggccaggtgctgggcggaggtggtggtggggcgcctcatattggcgggctgaatcaaccacatggcagactggaccgttctggcgggagaggcttaagaaatggggaggagaagcaactcgggttccctccacctccacttacagggagggcagcctggactggacttctcaatccaacaagggccctgccaccctcagccccaagtctgagttggcagcacacgaagcagtatttttgtggggttgaggagtgaagggtactagcgggtgatttccaaaccaggcagattccctcttcttccgcccc

SEQ ID NO: 42780 - DNA, 1373 bp, Bovine  19866881357400
atggcagcaccatgtttggcacgtagtgagcatttaagaaatgtttgttgaattatacacacgtgttcatatgtgtgtgtataaacgaatacggtatttgaagttttttctcccgtcttggtcagggtcttcgttagcagggaaaaaagggagaggacagggattgccagcaatgattcagggcagcaagcacttttgtttttatgtcttcgagacctcttctatatgctaatcaagtgttctagcaatgaaacatctttccctttaacagtatgtgttgtatcaccctgagaaaaccagccttatggggacacgcattagcacacatcaggcaagcagaggacagccccggacaatacgtaatcatgcgccaaaacgcacacagcaaggaacgtgtctgctgctgtggcttgggaatcccctgtggccgagcactagggctcagtgcctgcaccgcagcggtctgcgctcgatccccagtcaggggaccaaggcccacaagctgcgaggcgcagtggagaaaagtgacgaaagacgtatttacaaaacagacatagactcaagacaaagaacactaacttatggctaccaaagggaaacggagggataaacaaggattttgagattaaaagatacacactactatatagaaaatggataccaaacaagatgtactatacagcacagggaactctattcaatatcttgtaataatctataatggaaaagaatctgaaaagaattatatatatatatatatatatatactgaaaaagaatatatatatataatggaatcgtctaaatttgtaaacattgtaagcaacattgtaaatcaaccatgtaaaaaaaaagtaaaaatcaactgtaatacaattagaaaaaaatcacacagaaataacttaaaaaacttccctgttaatatataatatgctcttatttctaaggaattttaagggcctcaagtctcagtccaagtgattatggtgagatgaaaagagcattaactgataattaggaaatttatattctaaatttggttcctctacatgtatgattttgaacaagtcccttcttctctctgggcctataaaattagagggttgaactggatgatctcaaaggtcccttctggctattaatgtgtggttcatgaagtctgggagtcctgacaccctaaaactctgccggaacccaggcgtgcttctgtcgctgcgtctggtgtgacgagcccaggagcctgggtcaggggcggttggtgagctcactttgctgcgtctcagcccagttcccactcctcctagaagaaggttgagtagctgcttggtgctcttcccaggggaagcctaacagccccagagggccagagggtgt

SEQ ID NO: 42781 - DNA, 854 bp, Bovine  19866881398146
tggacagagatgaaggggcccttaagggcagaggaggtggcgggaagtaagaagggagggaggtctcctggacctttaaactgctttagatggactgcaggcggtaaagctggtgtcagctgtccactgtgggcagagccccattcttggtgctgagggtggtgggttaccaaagatacagaagacagccctgaccgcaaaagtatttccagtctaatgaggatattggcagactcttgtaggcaagtattctgagcttgagatttttgcataataactttagtaaaaataactatcttgtaagtatacagacttaaaaactgctccaagatgacttcttccccctaggatttgggctgtgtagtttttttcttaatacccatccttgttgcattggggcaagtgagaaacttccacttttctttcaatgtgttaatgattgttctcttcccttacagaagaaaggtgagcagccaacaggccagcagcggcggaaacaccagattacgtacctgattcatcaggtgagaggcctgagggccctggcctgctaggcaggatccctgtaaacctggggatttgaaggctgagatcttggctggaagcctgtcagacaacctgcttccagcgggcaccctccgcagttctccacatggccactaggtgggggatgtgtccttcagaattatcctactctgcctcaggctcacttcatgtaagactcaagtacaggtgcttggaataaactgtaaatgaacattcaggtatttaaaacataagagagggggtgaaatgtttcttataaggttcttttaagtacaagttcatctataatttaaaaaacgaaagaaaaa

SEQ ID NO: 42782 - DNA, 1569 bp, Bovine  19866881418140
ggaagccactgtaagtaaagcctgatccggcgggggtgggtgggggaggtggccctaaagacaccgcaagcagagggctgtgggcctcccttcgggtgggcccagagttgctgggaacctctgcttcctcgacctcccccctgttttatatcttcccagccggaaacatcgtgaggttatgaaaacaaactgccagtcctaaattcatgaaaactgactttagcccagcctacagcatggaggaaaaatgttcttggagaatatgtatgggtcagaccctgaagtacccaaccaggctgggagaggacagagccagggactttacccttcctgagcccaagttgaaggaagtctcattcctttcaaagcaaactgcttgtttttcatgacataaattatgtatattctttaagaaacataaagagaaaatacagataagcaaaaagaaggtataaatcacacataacctcacctcccagatgaatgtttacgcttccagatgcttctctgggtttgtacatgtaaatgcaaaaaatcgcatttatattatgtgaaacctcctcttgccattcttcagtgcatcacggccatctttccgtggcactaaatgtacgtctgcagcatcttttcaatgatatcacaattagatgacaacagtcattcgtatagtgctctatagcttacaaagcacttggcatccattatcttatttcagcccttggccttcctaagggaggtctctcccttatgtaattctgcttccaaaaggggccacctctgcctccttggcacctgggcctccccctccccctgctccccagaagtttctctatagccctacctgcatccttcctgctttgggcaggagtcaatttccagttgccatctgcggagatgcatgctggctagacccctctatctctccatctttctgcctgacccagctgtcaacctctgtccttctggtcaccctctctcctttctctgcccctcagagaagaagggacctctgttttgttcgcttgagaatcttcctgcatagtctcagaatgtcttccctgccgccaccctggttacccttcccttttctccccctgcaccgctgcccacttcccttcttctgtccagtgctgcttgaggaccaacttgaccccacctgatagggcgggaacccaggtggccccctctgctccctcaggatgtgacccccccctcacctccagatacgactaaacaccaagtttccctgttgttgcttatgagtggggaaggtgggggcagactcacagagagccgaggggtggagggtctgcggagcctccagtgctcgtgtgtggagaggttctgacgcctgtctccctgttgcccgggtctcccctcccacaccccctgccttggcttggctctctcccctcattccctccccagcatcctcatcctttcctgctccccctctgcccgacatctgaccatggctctggggtttgagagctgcagccactggggatggaggtggggatagaggcaggaaggaattttgtgcctccttctctgtcctaggatttcagt

SEQ ID NO: 42783 - DNA, 908 bp, Bovine  19866881516495
ttggcaggggcgagagctgagaggatcaccagccctgaagtggatgagaaaaaggcccaggagaatgggtgggatgacttccctaaccaggctggggctgtcctcagaacagtgccctggggagggccaagcccattagccgcccaagcctaggtgtctcccagcccgccctgcccagccccggtcactcacagtcgaccgagccgcggagtgtaatggaaggcatttggcgccacagaacggagaccgctcttcacgatggtgctggggagggcacagcggggtcaacactgaggggagcagttacctgggcccctgctctccaccctgccagccccccagtctctagtgctgagccccaaacacttcctcggcaaccctggacccctgaggccaccaagctctctggccagccagcgcctcagtcctcagccaccccagtccacccaggcccctcgcgcccttggtcctagcaccctccctgaccctctggtctcccaggccctgtgtggagcccctcacagtttcctcagctcccccaggcccctcaggtcgctgcgcttcagctgctgcagatgctgctggttctcgatgtagctgtgtggagacaggatgggaatcacaggggcccaggcccgcactcgagtccccacactcacctgcctccctccctcccaaccacaggcacccacaggcatccagtcacacagagacctgtttacacgtgtaaacgcctacacacccatccacatacgcacagagaccctcacacagtcacacagtcccatgcctgcatcctcacactatcacacatgcatgctcttacacattcaagcacacacacagagatgtgtaaagatatacacagagacgcacctcctcacatacaccagcatatgcatgcgtga

SEQ ID NO: 42784 - DNA, 1725 bp, Bovine  19866881579057
attacaatggttatcttctctgagactgaccgtaagaacacaaggatgaagaccctcaagaccagagagatcaagtgacttgctaaggtcacaaagcaggtctgtgccagaaccaggctgtgggctacgggctgctgcctcccaaggccaggtgtccgtgggccctaccctctgtgtgcttgatgatgttctccagcagcagcgggtatttggtgagccgctgcatctcggagatgatgaggtctcgaagctgtagtcgccggcactgagggtggctctcggcctcctacagggaaggacgcacagaggaagatggcagcccgggttaggagctggcttgtgggctcaggacccacaggacgggacagatgctaaataggtcctaattccagaagagtcactcagaaatggtggtggcagcttcttgctttgatatttaggaaaaagctggtgggggcagaaagacaatagcccaagaaagggatacggtcaaggcacataaagcaaggattattcccactttataagacaaaaaaattgagatccatctgagtgaatacaggcattagcaggtgagcaaggccatctgatagcaaggctggtgtctctgtattgagagcgggtatatgtcagtgtttctgaagaggcagcctggggagggtgtggatggagcagaattgctggtcaccaaccctggtagagagaagaggccaaggtacctggagctgggggccagtggggcagtctgggagatagtgggtcgacctggtaaactctccccctcggcctcactgagctaagactggactggctggtttcagctgtgacaagtacaggccaagcgtacctgcatgaagagctgaaaccggctctccttgcgctgcctggtcttgatcagctccagagcgatggactgataggagcagaactgtgcggccacctcctggagctcctcccgggcagggccgtcaaactgatagagagaatggacaccatgcagcccacctcacacccttgcttggaacctctccccctcttcctccaaggcctccccagggcctgggcagccatacccgagccagcatgaggtcactgacttctttgataatggggccctcctcccggagcttcctcatagcttcacaccaggaatctgggggcaaggagagaagacagagcgcctggggttgagctgtgtggccaggcccttggtgatgggggaaagaggtctctgagggtcgtgccatgggggcagggtctgggagccacttcacacatgggggagttggaatgctggcttcaggctgggcatcaggttctcccaccaaagagaagaggcaggggctatgtgctcaggggtcctggcatgtgggcagcaggctggccagaggtgggggcgggcagggagctcctcactgtggatctcgatgagctcgggaaggttgggaaagagccgggccagctcctctcggggcagcaggccctccttcttcatccgctggtagaagatcaggtccaggacccggagtgtgcgcagatgggacgcctcggtcacgaacagctctgagcaggtgcaggaataaggagggccaaagagacagcgggacagtcgtcagcaaggatatactgggacctctcctgaaggccaggatgggaggtggtcctcataggaatcacagcatgggctggccgtgccctaaggccccaccctctttctctaccacc

SEQ ID NO: 42785 - DNA, 1485 bp, Bovine  19866880096455
tatggatgtgagagttggactgtgaagaaagctgagtgctgaagaattgatgcttttgaactggggggttggagaagactcttgagagtcccttggactgcaaggagatccaaccagtccattctaaaggagatcagtcctggatgttctttggaaggaatgatgctaaagctgaaactccagtacgttggccacctcatgcgaagagttgactcattggaaaagactctgatgctgggagggactgggggcaggaggagaaggggacgacagaggatgagatggctggatggcatcaccgactcgatggatgtgagtgtgagtgaactctgggagttggtgatggacagggaggcctggcgtgctgcgattcatggggttgcaaagagtcagacacgaatgaatgactaaactgaactgaactgataccatatttatagtatatacatatgtgttattaaaaatctttctgggagattctatttaaaattacaagaatcttttagctcacagaattcttaggacagaatgatcgtaaatagggagaaactagatacattaacaagaatcattatctcccacattttagctcacatatcttgaaatattctctacccccaattacttcacaattattcattagctttgacaacatcaaagaaataaaggattgacccagatctgcaacttagaactgggtcctctggtcagtcagggaaggtcaaaggggctaatgcattcaggaaacataggaaagggcataatgaaggggatatatttaatcctcagagccaaataatcattagcagtggtgatggataaagttaaatatgcaataactacagagtcagtactacatttattcagattcataaatgaaaataaggagtgataatcaggctctgaggtggttggatacttgaataaaagataaaatgtctaagcccataaactctgacagtaatcatgaaatcatatactgcctttctactatataattctgattttagtattttaacattatttattgagagctcatgtgaagcaaatgtagataaaatatttcacctaggaattatatatactttgattcaacaaatactctttgtgttcatattctatacacatgtgaagtttcaaataacacttgtactttagacaattctatctattgcatgcaaatctagttttagtatttcttatcacaatgtacaaattcaacacacctaagtctataatatgctgatctttttttaaatataaatttagtttttaaaactatgtcatcactattgcaatttaaagttgcttgtaaactacaattaaaattagcattgtgataaattctctttgaagctctgtaaaagacagcatacatttttttcgctccttttcaatatcaaaaattaaatatttgttgctatattattcagtgacacacttctaaataaattggatttcaggctgccattgcatagtaaaata

SEQ ID NO: 42786 - DNA, 1205 bp, Bovine  19866880456612
taagctttacttttgtaggagaatcaataaaattggaatgagtggagaaacagcatagcttatttaacattctgtgaatttcttgtatgtgttaaattatttactatttaacgaaatgtgcatgttaataaaataaggttatgtggctctttactgggcttgctgcacccaggatgttttttttacagaataaatatttcataattttgttgcaacgtattttttgcaaaggcattgatttatactaccaaaaatcccaataagtccaggtatgtattcataattttatcctgttaaacaaaaatatcagaagtattgcttatattaagtaatgaaaattatttactttttgaagttaattctgttaaatcatgctagctttgtttggtaaatatacaaaaatgatactgaaaatgaattatataaaactatcatttttgaaatagagtagtaaatagcaattcacatgatggtaacaagactcgtgagaactcactgtgtagtgatctaaatgtgatttagggaaattgctttaaaatgaggttttatgatatcatgtcttcattgtcataggaaatcagaattgtaattctaaaaaaggtacatttcctgtattttgtcaataaagttaatgcagcatatcaatggggagagtaagccaccaacatgatatgccaactggaaactgcaatcagagaatattaaagatacaactttaaatgtactaaccatctcactgcagagagaaggaaagggaaaggcaatgaccagtctcattagtgttaaaaactaaaaaaaaaccaaaaacaacaacaaaaaaaaccttctagttgggaggataacagcaagcaaaaatatagaagtcaaaaaatagtactgacatatgagatattaagaagtctatggaaaaaaaataaactgaggaaagggtaattggtcttgtcttgagaaataggtttttggttcaaatgagcataggcctttctgaagaggtgctataaatgatttatgaagaggttaggaagcaagtcaagtgtgcattaggcctcgtttttttaattatgtggtgataatataattattaatagaagcaaattcagttcagttcagttcagtcgctcagtcatgtccgactctttgtgaccccatgaattgcagcacaccaggaatccctgtccatcaccaactcccagacttcactcaaa

SEQ ID NO: 42787 - DNA, 982 bp, Bovine  19866880475881
tatatcttataggcagcaggcataattctttaaattcagttgctataatgccaaagaattaaatatatctaaaggacctactgaactaaatttttctgtttttagcgatttatttactttaatattcttgtttctataacaagaaaactcattcctcttaataaaagcactaataatttggatttgactataataaaagcagggaggaaggtggaagaactataaagataaaacaccactaagtttatatcaatgtggttcaaatagaattattatttgttcatgtaatctttttttgctcttttattttaataaactttagtattatgatagtaataattattaagtcagtaattcaattaatccagaaacatgattatgtaaactaataaatgaacagaaaatttatttattgaacaccaaatcttcaaatatttcagatagaatgctctgagatcaagtgaaatatatagaatctgtactatgtggtcatagttgttatttatatttatacctatcctaaaaagaatagaaacaaagaaaaaggaaatagatttaccgttagttataagtctggtttcaaacaatcaatttttaaaataatttttatattatttaatggacacctatccttgttaccatggtaacatgaatattaacttacagtttgcatagtttataatctaagaaagtgttcatagctgctctcacactctaaacagaatacagttgtctttatagataccttagtttccaagacaacatgatatgcactcatgcaactctatggaaaccaaaaaaaactcgcaattggtgttcaacacttgtgatagccaaattctgttgggttttcaatataaatgctaatgaaaggagggtgggtagctccccctctccatgtttcaaaataatgcatctaagccccaaattgcattgtttccctggataaaaggttttgtatagacacagcattacattattt

SEQ ID NO: 42788 - DNA, 1392 bp, Bovine  19866880542413
ttgtaagtgagtattctaggattcaaaccaggtttatccaattctaacccataagatttcagccacttaatagaagatttagctacacctcccttttctcttcaaggaagtttaatatcattttggcatgatgaaaattatgactgctttatttaaatgcaatgcatatactgaatattattacaaagggcccacaagccattctgaagggatgagtagttaaattatcttccaacactgttacacaataacaatgtacagaagtaaaagaaaaaaaaactatagatttttaataaaatttaaacttggtttaaaagtcaatttgttagcatcacatatgtgtatatataaatatatttatttaaatatatattatatatttaaaatatatattgcattacatatttttaggttccaaaacatttatatgtaaaattttctaatgtgagacaataaccttaaaatgagagaaaaacatttaagtcaataatcagtctacaaaatatattgaaaatatatacctgttcagagctgccatcctaacctttgcatgaagttgcaaagagtaaatagattggtaactatatcatctgtataaagatgccttaataggtatgtgaatgtaaacaaaagtgaactgaagttggaaagagaagagggtatggggaggtaaagagaagagatgttactgggagtgtttaagtatcggggtgcctgacagaggatgggtttgctttagcaaggcttaatggaataaggaagaagagttccttcaggtcacaaagctatcaaacctgaaactcccttactgaagtttaagcatcctctcttctgagaataaagtctgctagattgttgactcaatctacctagatccccagaaaaaaagatctttaactaaaagctttctttatcaactcaaaggttatgtttggatgaattgaaacaaatattgtttgacttaataagaattaagaaaagagatcaagagttctacaaaatcaatcaaatagtatttaactggccaaagcatatctgttagtatgataacaataagataactcagacttactgtttgctatttgaaaagcactgttctaagtgctttaccagaattaattcatttaaatattagcataatttttataaggttaaataatctgcttacggtcaaaatgtcactgtagagaaataaccagcattcaagttcaggcagtctaaacttcattgtacttagactgtgttttaatcgctatactctacagccttccttagcaacgatcttttataattaggagtattttcttcttgctactttaccatctgtaaagaaggcagaatgataacccataagtatatccaggtatcttaaaaataaaacaattataatat

SEQ ID NO: 42789 - DNA, 1890 bp, Bovine  19866880578281
ggtaatcagttttagcaaataaaaaacacagttaaacttgagtttcacagaaacaatgcatataactagagctacacctgaagtattgtgtgtatatggtaaccgtatttataaagatgtctaagacgtaagactaaaaattcctgcagatagtgtggtcagattttaagaatcttgatatcttaagatcaataatgtaaaaaggttaaagtgtgtcctattttcctttccaagtccccctatatcctgttaaggaaaaataaaacattaagttcttaattgacatgttacagagaatttatcacagatctgaaaccatggcatatctcagacataatgtggatttggcaccacagctctgcattcaagtgagtcacatggattttgtgtaatggtttcccactacatataaaggtcagtttatactaggccttaatctattaactgtacaatagcattatgtctaaaaaaataatgtatataccttaatgaaaaagtgctttattactaaaaaaatgctagccatcatccaagcctttgtcaagtcataatcttgttgcaatagtgacatccaagatcacagattacagagcaccataacaaatatgctaattatgaaaaagtttgcagtattccaaaaattaccaaaatgtgacacagagacatgaagtgagcaagtgctattggaaaaatagtgcagacagacttgttcaaagcagagttccacaaacctttaatttaaaataaaaatgtaatatctgtaaatttgcttaatcaagtcaaggagaaaaatcaagcaaaatttattttatgaaaaaggtgcaaaaatctgaatttttacattcaaaaagtattcaatatcaacagtttataaataagaagatagaagaccagaataagtttccagttatcatctactatacacaaaaattaaatagaggaatgggttcaatgataaatttcctatttcctccttgcccaggaaaaattagttttgctttcattctaggtttatctgttttaatgttagggtccatcattattttgtaactttgcactgtaaacatatatataagccaaatgaaaggcagtaacaactcactttgattcctgtgaatgttttcttgagtttgaattcttgaagtaaaatatattttaaccttaggcgtcatcagatcacagtttaagcatcttgaatttacatttagatgatttgcttattggtcttggacatgtatattccatgaaatgtattaggtggtatgtatagagtaaattgtcaggaaagagggaacttatataatggcaagttagaaacagatcgtttagcatggtgacagtatttgtaaatgcagagccttgtgtgtgatgcttttgtcctgcacatgtctgatgctgttctggagcacatgaacatgattggtgaaccagccacatcccctgtgtttgcagagtagtgaagcatgactgctcatgtgctatcttagccttttcctgttatccttgatgacagcatctaatagaatctctggtttctcccattcccctgcagtaaggctgaatggtcatgctttttttacattttcccaccaaacaattccctggaaacttgacttttattaacccccaaattcccttcatttgtttagttttcccaaactgtatccaacttttaaaattcaacaaaactgatggcacgtagtccgatataatacatttctttgtaagattcctttaaaagcttcagcacttaagggaaatcaatagcacttgatgtggttttgtggctttcagtctcttgaacactaaattcaacttgatccattgctattagtggcttaaaggttgcagttcagccatctagaaaggtgagggtctttggcccatatt

SEQ ID NO: 42790 - DNA, 1158 bp, Bovine  19866880643597
ttaagtgttacataaattctttgatcaaaaaatagtccttgtatatttcataaaaagttggtgatggaaaggaaagcctgggcgtactacagtccatggggttgcaaagagtcagaccgacttgagccactgaactgaacctaaaaaaatgttaactaaattattaatatttgagccatcacctgcaatattttctgaagaatatgtttcaaaatctacacattttactttcagttgaaactaattctttttatttctttggagtggaaacctacacagtctgagttattattccattattttctgcaatagacaaattgaaccttgctttctaattgtgatttgtacagctctcttctgtgtgctcacattcaaattttataacctactctattttataacccactgtataatagttgaatcctaaattaatgtgttttcatagcaagattcaacaatggatttaacatggactctaaaatctagacagatattaacattttagtgatatctcaatgtctgtatgtaaatgtattttatagaaacaaaatagtaaattcttgataacataaatcccaagagttttccttgggaattataaaccttaaaatgtctttgtctttagttgtgacatattttacaatgagtacattactgtctcaaaattaaagaatataaacaagttatgaaacgtattctttctcaaaatatttacattataacaaacaaacaaactggaaatacacatcaagcagaagtcctttaaatgttgtaaaacataaccctctagtgcgacaattgcccttactgattgttatatgtaagaattatatttccagctttatatgaaatgaatttcttcttagtactacaaatatgtctttttaatctgaatatttctttatttgcagctgtcattcttgttttctttatagaaaataagagacaactataaggccaatttatttctatatctgaatatattttggctgaaatcacttaatcagttgtgaaaacaattcttaccagtagctaagctagaagggggagtcacataaagaactcaaatatgtaaaaattttctggtaggcctgaagctattttctgcatagattactaaaattattcttaggataaatatttgttcttgcattaatt

SEQ ID NO: 42791 - DNA, 1635 bp, Bovine  19866880667852
taaagagatggaaatatcagaccacttgacctgcctcttgagaaatatgtatgcagatcaagaagcaacagttagaaatggacatgaaacaacagactggttccaagttgggaaaggagtatgtcaaggctgtattttatcaccctacatacttaacttatatgcagaatacataatgagaaatgccaggctgaatgaagcacaagctggaatcaagattgcagggggaaatatcaataacctcagatatgcagatgacaccacacgcagaaagtgaagaaaaactaaacagcctcttgatgaaagtgaaaaagttggcttaaaactcgacattcagaaaaccaagatcatagcatctggttccatcacttcatggcaaatagatgaggaaacaatggaaacagggacaaactttattttggggggctccaaaatcactgcaggtgatgattgcagccataaaattaaaagatacttgtcccttgggagaaaagctatgaccaagctagacagtgtattaaaaagcaaagacattattttgccaacaaatgtccatctagtcaaagctatggtttttccagtggtcatgtatggatgtaaaagttgaaccataaagaatgctgagcaccaaataattgatgcttataaactgtagcattggagaagactgttttgagagtcccttggactgcaaagagatccaaccagtccatcctaaaggaaatcagtcctgaatattcattggaaagactgatgctgaggctgaaactccaatactttggccacctaatgcaaagaactgacttatttgaaatgaccctgatgctgagaaagattggaggcaggaggagaaggggatgacagacgatgagatggttggataggattatcaccaactcaagggatatgagtttgagtaggttctgggagttggtgatggacagggaagcctggcttgctatggtctttggggtagcaaagagttgaacatgactgagtgacagaactgaacttaaaaggaaacatttcttgagttgaaacacactaatagataatgtattagatctagttctaaaattaagatataataatagttcaaacagcattttgcactctgagcaaaatcaaacctctgtgatttcatcaccaataagttgtttttatatgaaagaatgtcattcaattatattctcatttttgaatgtatgggaatatctttgcttatgtcactcaaagccaattatatctgaataatgaacaatttggaaatcactagctgttttttctttcttctggccagcactgatcaatctacttctgataaccatgtaggctatttagaagatagagaaattatgatgtagattagtgacgactaatatttcaaatatcttaagaagaaataatgaggttaccaaggttaatttgtactaatttgcacttagtaaattaccaaagagtaaattatattaccaaaataaacataattgccttatctctattagtagagataataactctctaaattagacattgtcatgaactacttaatcttaaccataaatccttaataattttatattatttctttgaaaataatgccgtattatagtgacatctttgtgtatatatgca

SEQ ID NO: 42792 - DNA, 3864 bp, Bovine  19866880686282
agagtctggagtaggatgccttgccttctccgtgactctgtattctccccaaagatatattttggctgaaagagacaggctctgtggccacaaagaaagcccttatgcctctacaatttactagatcaaattgacatatcctaccattatctgcattgaatgttagctaattaaaatttagacaagttcacttacattagattcagtgtggaaacattttaaatgtggctaagagttaaatcaactcaaactacctagtttaagttcatgaaaagccaagaccttaaccatattacttaaactctcatgaatataatcactgtatctacttcataaagttgcttttgagattaagtgaattaaaaatgggtagaagacatatagctcaaaagtttctctagtcacactgatcccttgatttaaaaagaataagagcttccccagtggctcagcaggtaaagaatctgcctgcaatgcaggagacacgtgttcaatctctgggtcagaaagaaaccctagaggaggaaatggcaactcactccaatattcttgcctgaaaaattccatggacagagtagcctagtgggctacagtctaaaagaatcacaaagagtcgagtatgactgagtgattaaacacaacagaggacagtgcttatcccatagtaactgtttaaaagttttattttactattattatttataatgaatagtttaaatgttagtcttcttgcaaatttaattgtagcatgcctacatttatactttaattttgcatattaactcatattaactcatgaatatgaattatctacccacattatataagtagtgttttgtttttttctttctaatttagcttctagatttttgcctttgccagcaaatcctgtggcaaaaattgttccatttcaatttcaagtccagaactggaagcatcttcctcaaagagttgtggaggaataaatatgtatagcctggccccaaattataaatctccttccaagactatcattagctggagagattgcgtttcacaaataattaaatcaagcttttgaagcatattgtttaatctcttttacaaaagaatacaagccaaagccaaatcaaataaaaccttacaaccatcctttggctagatcaaattagggctgagaaccctgtgaaataagagtaattgctgggcagtgggtatgtagtttattatttaaaaaaaatatgcagctataattgaataaggatgacataagattttaataaagcactggcaatttttggagcttaaagataaaggctatcatttcccttgtgtgttggacagacatgtgtttttggcaaccatgtcgaatttttgaccaggccctattatggccatccttatctacattccatacacagaaatagaaaagaaagaaaaatcccagtctgctgaggcaggaagaaatgcattgtgcatctgatatagttcattcatctactgaaaaaaaattctagccattcacctgcttgcagcaaaaaaagacttatgttcagttgtgaaattaatttctacaaaaatggcaagattcttttcactagcagactgttctttgttaagatgaatagtaaaactaaacaaacaaacacaaaaaagcacaaggagaaaagagaaggaatgtatcttaacaaagcgatgcatatatcccacaaaacaacttgttttcatgtggtgagtattatctatgggtgagatattttaaactaattcaaagaacatggcatttaaacactagaatatttaaaagaattcaaaaagattgatttggaggtgaagaaggaataagaagttaatgttgagagtatttaaaatgtacattctcttgtatttatgcataggcattatactataataatgtatgtgaatattctttccttaatttattatatattttgactgaatactaattatttcctcacaggatggttatcatttatggagaaagtaaccttcaattctgttattgattagagtttgatgaagatcatcaaagagaaagaaattctttcaagtgataggaaacaggagaaagtttcttactaatgataagagttcttaatgagagtatttaattcatgtaactctattaagaatatctttcttatatttccatttatttatgaagagttctcagtgtgacagagtgctaaacacatctgaagaaaattagaggcatagttaggatgtaggagaaccaatatcataatgagagaatgaataaattaaaaagtcttaatgatagaaaccaaataaaccacacacacacacacacatacatatacacatttccataactatgatctagttatgtttctttttaaaaagatcaatattttgatgtcttgggtgattattctgtgtgcttaaattctaattggcaatgaactttaactataattatttaaactctgaaaaatatatattttccttttcctcaaaatgtgaacaatgactggcttaatttatacattcatggaaaagtgctattgggttaagaaagtattttttaagtaaatatgcaaagttagtaccttctagcaaaatcatacctgtatattctagctaagtaagttatatttacaaaattaattaaatatctagcctcttagagcatctaaaatgtttatcacaataacttttaaaggtaaaaaaataaatatatctttatacattatattttgttatctctgacaaaagagatttaagtcagataaagtatttctacaggagttcttttccagtattctgttatcagttaaatattaattatccagagtcaaattgttcatttctttatccaatatatatttattatgctgcttactaagtaataatcaacatgctgcattcacaggaaaaaactaagattttgcctctacctctaaaacacccacagtatggaataggatttatggattagcaatgatgtttttggagttacataatttctttgctcttcctttagctacctactttcctgattgctaattcttctccatgaagaccaaagagggaaaggtaagtgttgatgtaccagaaactgtaacacttaaggtgtatcagacgctgtgtgtaaatagtaatgttatctgatgtttatgtgttcttccccgttaaatgttgaaaacagagggtaggtgagtagaggagaaagaacctaaccatgagagattaaagtaaatgactttagtagaaagcaaaagaaaacaacagtaaaaacaaaaaagagaaacaacaacaacaaaaaaatgtattggacagaaggaaaggaattgacctaaacaaaagaatatacatatgaatatgtaaagatgaatagatatgtaatacataatatgtaaatatatataatttagaaaacaagtaacaaaacaatgtctttgttaaatttaaaaaaaaaataacaagtaacttgttttataagtgttgtctgaatgttgtaggaatggggactctttcttgggcctgagagtgggctcttgtctaacattcaacaatgaattgctagaagaaatgcatgtgttgatgaagcaagaggcttaattgagaaggggaacctgggtcaagagcgggagagtaagggaaacagcaggactgttctgccacgtggctcaaattctcaggtttcatggtgcttgggctagttcctgggttgttcctagcctgtcattctgacttagggtcctttctggtggcatatacattgatcattcaagatggattccagcgaggaggattctggaaggtcggtaggacatgtggtgtgtccttttgactttttctgaattcttcaggttggtggtaactttgttagttctatgcttc

SEQ ID NO: 42793 - DNA, 3428 bp, Bovine  19866880803731
tctgatctgtgcctaataagagaagtggtattgcagatgtcacacaggtattttagactgtacatacagcatgcattaacttatatgaataaaaagtacctgtggccctttaaatatttaaatttatcagaatttccaaatatattttaaatcaaaatatatcagtgttcacttatttgatgataaagtcagccttcataatcttaagaatgtgattttgttaaatcagaattgacaaagtaaatgaattcctaaagatggctttattttcttcttatgattcatagaatttagaaaaaatgtatatttagatacattagttataatatgatgaatgtctaaatataggcctgaattgagggatcaacactaataaaattttgaagctactgccttcgcatataactatttgtctttatgaacctgtaggcgaaaagaagagaaagggtcaatagacaaaattacctattgatctcccaacaaactgcatccttttttataataatgcatttcctgttcccttctggatgttattgtattgtattgttattgcatctaaagtatacaacagctatctggagcctgaagtatgagtttgattgcctgtggttaagacaagactgttcttccaagtgttttaactgtctttaaaaatgttagatactattatcatctatacattagttgagacttttatctttacttatgttgtatttataagagaagctttacagtcaggtctttttccatttgataccaagattctattttagatgctattgctgattatctactctttcccagatttcctatatattctgtcacatgtcaatatggtgtttcaatcttcatgtccgcactgatatgttggagttagtactatcaaaacaaagaatgaacacagtaaactcaagagacttgggacaatgtaatttggggtacaagtgtgtgtgtatgcatacacatgcttctgtgtgtgtgggaaggcaggccaataaagacatccattttattttcaaatcactaagaaggggcctgatgctcttaaacatgcaatcaatgtttatatattgtcctttattcattttcttaaaaaaagagtctttttctcacaaacagatttaccaataaaattaagaagtatcttgatagtattttgtagacaaacatttgggtcataataaaaataaatcagtacttgccacagaaaataaattatgtttcataattttcacattctttaattttcacaagtcagggtctaagcctcaataatgaaagaaactcctttttggagctttttttcattaaaaaatgtcccaagttaaagagtctatgctttggcaatagttatcatgagtcacgtgctttatatttattatctaattttccgttcattacttaatgaggcaatgaggcaatgattattgttctaagataggatatagcttgttcaaggtcacacatatctaataactggagaagccaaaatttaaccacaggtctgccagatttcatgttctttcatttttccacaatgataggatgcttcccttcagaaatgatatctcaaggccatactcctgcaatgactgcaatttaatttagttgtaaaagaatcaccctgtgtttcaaaaaaatgaggtgcagtatacttaatagcagaaagaaattaaattggtgcttctgtgggaaataatgctagctatacttgaagcacataatgttaaaatatgtatcatagagaatttagtgacaaattgttcttattctttgggcttcaatggtgactcagctggtaaagaatccgcctgcattgcggtagacctgggtttgatccttgggttgtgaagatcccctggagaagggaatgctacccactccagtattctgtcctggagaattgcaaggactctatagtccatggggtcacaaagagtcagacacaactgagcaactttcactttttgttctcttcaataatgggagaattcacatttggtctaggaaagtgttagttgttcaattgtgtccaactttttgtgacctcatggactgtaggtcaccaggctcctctgtccgtgggattttccaggcaagaatactggagtgggttgccttttccttccccaggggatcttcctgacccagggatcaaacccaagtctcctgcatttcaggcagactctttaccatctgagccactagggaaatccttctttttagtaataagcatgttatgtaatgtcagttgaatattggcagcctttttatcagacctatcctgtataataacacaatgtgaaaaatatagttccatttacagggaagcagaataaaaatttattaaaaatattttgtcttcacttaaagcctactccatttgaaaaagtatctttaatataattgtgtcattaaatcataaaaatggaaattgtgttaacagcaggatgttatcttttattgaaggcaaacagcagggttgctgctaatgagaacgtcatcaacttatcagcaaaaggtcaacctaaagagctctttaaccaatttctccctaagtagttattttttcccctttgatggcatatcacactgacaagctagacttttacgtggctgtattattatgaatcagtctctattatgacaagaaatatatataattgcaagacatccatggaatttgggacacattgttcagaagttaatttctttccctgaaaggactatcgggctctttggtgatgttgttgctttgttcatttattttaaacattttgatattatattggtgagtcctccattcaagaccttgaaaggtgtaaagatattttaaacaatgggtaaggacattggtaatgtcaaaacaatgataataaaaacaggataaaaacagtgccttatacagattgatcagattcttatctttattctattaattgccttctctacaaatagataaaatattaatcaaaattacagtatcatttactatgagcttattttctgccatacactcatccatgtgttggataaacacctttcattttgtattcacagcaagcttttaacaattacagtgactgacttttgtttgcgtttctgtaggtttttgaagactgtcctagagctcataagagttctccaagatttgattagaattgatttactaatgatatttattaggctcaaacttttggaatattaggacaccggaagccattgagtatatcacctggaaatctgtgcttataccagaagtatgtagcaagcaattattaaaattagtgataataataaaaacagtagtatttattccagatatctcattttcccaattgaatctctctattactcgtttaattttgaattaaatgactataaaggattatttaaaaggctaatgaagaaagcaaaattaattcaaa

SEQ ID NO: 42794 - DNA, 1392 bp, Bovine  19866880920382
ccagcaagaaatctttctgtagtataaaatacaaagcaagcaaactaatactaaacgactatttgcatgctagcaacaccaatgggcaaacaaacacagttaagacattttcaattttcaatttattgtgagtgatttttcaaattataaagtctgcagaaaaacacatgctttttgtacttgtttagattttcagtgaactgtatggggaacagtaagttttaagcagaagtaatcatagccacatcctaaaaatgctactttgaaatctaggaataaaaaagatttgaaacctgcttaatttctagtaataaaaatttaaaaaaaatcgctggaaattaaaaatcacacagacagctgaggttgaactactcattattaattaattcataaacctcactgtaatacttggctgcaatatttttagcttgaaagaaaatagtaaaaactgagactagaaaatgaaaacaaaacaaggtgatctaaccagttcagcccattagaactattccaccatccatgatttctaaatttaggaaacaaattctggttttttttttccccttttcttgcttttttcatttattgtaaaatcaagaaagtgaaatattctaagtatatgcttacaatgattttaccattaggaaaaatgctagtgatattgtcagtgagtcatttccttctttgtttatattcctacctagattttaaaccacaggccatctcacctctcagctctctctcagtgccttttcctttatccctagagaattaatctcatgtaagtcttcaactttgtggctgtgacctcggaaatttctttggcactccacattgtgataattctttgtctgaaagaacaagagcatgagttaaccctaaaagaggagctggactgcagaaaggaagcaactccaagctactgaccaaggcaagcctctatcatacctctatttcacctttcccgaagtttcatgtatgttgtcaatattgtatatctgcacatacacacagagattgctagattgtggtacctaacaataagaatttcaacataggactttgtttctagtattatctaaactcaatacctggacgtaccctggagattcaactgatgtttaaatagatatatttaaacaccaacaatatatatttaaactccaacactatattattgttgtttagttactaaatcatatcaaactctttgcaactccatggactgccaggctcctctgtccatgggactttctagacaaggatcctgggagtaggttgccttttcctcctccaggggatattccaaacccaggaatcgaactcacatctcttgctttggcaggctgattctttactgctgaaccttcaggggaagattcatatatatca

SEQ ID NO: 42795 - DNA, 2478 bp, Bovine  19866881021712
aattgatgcctttgaactgtggtgttggagaagactcttgagagtcccttggactgcaaggagatccaaccagtctgttctgaaggagatcagccctgggatttctttggaagcaatgatgctaaagctgaaactccagtactttggccacctcatgcaaagagttaactcattggaaaagactctgatgatgggagggattgggggcaggagaagaaggggacgacagaggatgagatggctggatggcaccactgactcgatggacgtgagtctgggtaaactccaggagttggtgatgggcagggaggcctggtgtgctgcgatacatggggtcacaaagagtcggacacgactaagtgactgaactgaactgatgggtagctcagtgaaagaatggagcaagactttttacaccataagaaagaaatgtttcatatccaattctgtgagtcttaaatcagtaggattttaaaaaatataatcgagtttcaatggtgagggactggcaatcaggaacaaagaccctggcaagtatgggatgagagactacagaagcttcgctccacagaacactttatgtgtatagaggagggttgccaaccatggaagaagagttccagagtaggagtcccaagggtttggaacagcaaaaagagaaaggattttaattaaaagacaggaagaacaaataggtaaatgcacagtaggaaatgaaagttagctctactttggacaaatacaaaaaatagacttctacttttgtcagatacaggggaatacagggtggaaaggcatggaaaacatcacccccactaacttcatgagactgcaggttggaaatcaaatagaggaaatgatctgcagacacacagacacagaaagacaattccagtagcgtcttgtcactgactcacaataggtcagtctgtttggatgttagtggatacagagtctctgttgcaaatgtttatgagtcagtgggattgcacaggtcagtagtaagcacatttttaatagattacctctattttaaattgatagcaagaatattaaaaaatggtagtaattggagttttcagttatgctcattttatggataattagcaattaatagagtttgaaaatgtataatcagcgattatatttacattttattacagtatcataacatttatttggaagttgagagtagaaggtttacatgtaaaatgtttctatttattttaggtgactagggaattacaataaaagtttcttccattattggagtagtggttcagaatacctttagagcaatgagagtgcttttttagccattctcatgaagagccctaggtcatttaaaatttatgctatgcactcaacaggaaagttatcaggatcctgggctgtgtgaaaattgagaacatttattgatcaatgatgtatgaactgaatctacaactttttatttggcttcacctgcacttcactgacactccgattcatattcctggttatatatatatatatgtcagatacatacttgaaaataaaccattttgatactctaataatatctaatttatgcagtagcctaaatcttacctcaatcttatccaaggaccaaaatcatctgagtagttttatttggaacatgttcattaaaatcctccgagaattttcttggggtttacccttctagtaaaacaactatcacaaattctgggcatatttgaaataaatatacagatggatacctgcttattaaactcagagaaataaatatacagacatagttgcctattcaattcagagaactttgccataaatataaaattgtataaaatgtgtgaatttttttaagaagcaggccaaatgtgtaacaaggtattaagactattttattagaaaaatctaaaaaatctactaggctttatttattataatctgcttaggcaattatctttttgtcatgttctgcttggatttaatgcttccttctgggcaaattttgtctcttttattgcatgtatttggaccttcgtagtcaacactagagttaaaaagtcctcctactggtacaggatactcaggggatgcgggtttgatccctgggtcaggaagatcccatagagaaggaaatgacaagccactccaggattcttgtctgggaaattccatggatggaggagcctgatggactataatccgtgggtcacaatgagtcagacacaattgagcactcatgaacacacacacacacacgttatatgtattatatctctttgtcaataaattaatagcttatatctgaccagagtggctgcttctcttatcttagtgcatcacattttcatagggttcacactttttcaccctatgacacttacttttgttactaagaagttaagctttattttactagtgtatcttactctcagattttcttttggtacctaattcttccaaagaatgaatgtcctaccccttcat

SEQ ID NO: 42796 - DNA, 696 bp, Bovine  19866881401444
tgtgaaattggaacattggtctccttttgattatattacatattctacttttcttccaatatatgttctctaaagggtttgatattcataaattaaaatgtataacaattaccactcaagcaaaaattagcaaattgctgaacagtattttaagcaattttgaatatgtctataaattttccatatatatagatttctcttcactgttaataacattgtttagtagatttttatttaaatcattttttagttttaatattccaattatttagaaatcttctgaaccactttgaaaggaagtaaatgcatagtgattttagttgaatattcaaatgtattcatatatttaaagcatttgaatatcaattcccttatcagttattaaagcaaagggtgtaatagactaaaattatcaagaaaaaaaattgagcttgatttattactttcaatatattaagtgatagacataaagttagctaaaatgtaggaagtgtaggtaaggaaaatactataaatcaggagaacagactataactgaagagcacattcaaaatgttgatgaaattggaatgtcgtgggataacatagtgaatattcattcacccaggaaaaactcatctaatcttcatctaataattcagcattctaattacatggttagatttgaattaatatgtttaccaaggatctgcattt

SEQ ID NO: 42797 - DNA, 1184 bp, Bovine  19866881501621
tctcgttagaaatataaatggacgtcgtggtgtgggtatactgtgcaatggagcagggaggcgtgatattccatgtgccatatcccttcacttcaaacaactaattgatggtctgctatatatcttgtttctcaagggtcagagatattgttaggaatcctcagtgttgccagtttaaattaaaagagttggcagacagattcatctagggtgttaagcataaaggaaggataaaacccttgtcactctaggaagttcatgctaaagaatctgagtacaggaagccagaagacttaagtcactctctttggtaaattttgtttattaaaaatgtaacccttaaataaagaaaaaatatagtttattctgggcaaataatttggtatatttatctgtgaaggcgattccatgagtcaacttctgattaaaccactgatagtatagtcaacagaatattttagaaagaaatcatttttctgagcacagtgtcactagtttgtagaattttcttctctcttttgcaaagaaacatatattatttagatttgcttgaataatgaaatttagagtttggagcatattaaggttataaaaaatcaataaacttaggtaagctatcatttattaaatagggtaaaacccacactgaagtcgtctacctcattaggtagaaatattgtcttgatagtcagaggaaacaacttttgattcagcatattttaatcatctcttcctggattagaaataataccaaaaacggggatttttttttttaatacatgatgccattcaaaatttgagatgaacagaattcaacacaaaattaacggtataaaactctcttccatgagctagacatttgtttaaatgctggaattaatgacaaacatcacgaagcttatgttcttatggcaatgacatataatgaacatcaatgtaagtaaaaacttagatactaatagttacctatctcctgagaaacctctatattggtcgagaaaccacagttaaaatcttacataaaattgaccgattccaattgggaaaggagtagacaaggattaatgcagagtacatcatgtgaaatgccaggctggatgaattacaagctggaattaaaatggccaggagaaatatcaacaaactcagatatgaaaatgatacctctctaatggcagaaagtg

SEQ ID NO: 42798 - DNA, 1945 bp, Bovine  19866881590161
tgttaaacactatttctgaactagatatttagcatttttacagtaaaggaaatttgaatcacctatagctgcaccttatacaattatacagaatgactttaaatattttccactcatctttttatggaccacatatagtccaggaagaatataaatagaaaataactaccaaacattagaagaagtgttttgtgataagctcacttatcctttctatgaatgcccaaaactactgtgatgacaatcatttttcagatttcttaaaaatgacttgtctgtgaaagaatgacaatgttttacattcagtccctaaacttggaaagaaaattaagtcaaatattcacaagtgccaactacaaagcaaatttgccatggtaaccgtacctcaaaagcctgtggttgcagatttttgccaattagcaactccaaagggtgctattagttccttcaaaaacataagggacgtggttttcatctgtgattgctagtcctcttttacaacatgccgtgacaaaagatggaatacacagttatatacaccctttagctcttacttataatcataaaactggttcataaaaagaacaatgtgtattatggtacagtacttttcaataaagaataatacccttgctaaatcataatcattaactttaactctttcatttaagcagactgctgtatcaacagcaaaagctacaccatatttaatatctagactatatattctttttataatatctatcttctaggctgtgagctagagaatagatgacagatacataatgagaagcttcattactatgaatatggcatctgggagtagtctcagactattcttcacaattaaacatcaactacatatttggattgccattccaaaaatatttccaacatatttttcattcctaatacatttcctgaaatcttattagacattctgtcctaccaatgatgctctatattaataaaataaaccaaaattaattggttaattataattattattatcttgatacattagtatagatgactttatggagctgcaatcaaacatgatgaaacatttactgtaatagttaagtaagcattgataatattaatgtttattaaaatgatggcttattataatgcagctcaaatgtaaataattcttgtgtactgaatattgcagataatcaaactatttgaggagaaaaaaattttcaaatgatttcatttaaaatttcctttgaaaattagacctctaatccttaaccaaatttgttgtttttaacttctgtaaagttatatagataagctggactgaatacaagttttgaattctcttaatatgagttgtcaacccaagaaactgtcacaaacaaaatattgggaaatgtctgttcattttcaaattcagctttaattaaggcagaagcagcattttggtaacatacaagataagtagaaaaattcataagtagcattttaattaatatttttatcttagtattttatactaattatatacatatgtgtaattagctatttcaattgtattcaaagactgtaatataaattacatgtaattttttttcttggattagcactgcatacacatatataagagaaaacacatgaaaagctctcaacaaaaacaaatgaaatgatgctaaaaagataacagaaacttatgaaaaaatttctaagaaataccaggtgtcaaaagaaaaagtgatgatgatgatgacaggaaattttattattctggaataactgttgttgaggatgcagaacataagatacatgtttttatttaaaaactaaattttatatttaaacattgggttttttgaaagttttctttgttatgcctcacaagtttttttcaaggtgaaaaagaaattcttaacagaatacctctttcggaagataatagaagtttatatatatagaaaatata

SEQ ID NO: 42799 - DNA, 2817 bp, Bovine  19866880201651
ccatctcatcctctgtcgtccccttctcctcctgccctcaatcattcccagcatcagggtcttttccaatgagtcagctgttcgcatcaggtagccaaagtattggagtttcagcttcaacatcagtccttccaatgaacacccaggactgatctcctttaggatggactggttggatctctttgcagtccaagggactccatagcatataattggaagttaactaaatgtccaataattggagattcattaagttatggcacatccatataatgggctttatgtgttcatcataattcatgacttcaaaaatatttaatgtccttaggaagtgttcatccataaagttatatgaaaaaagatacaaatttgaatatgctatacagtatgtaacacaaaatacacatatataaattaacaactggaggaaaatatattaaaacattaatactatatcaacattgtaacaatacacctgctagcaaaaggattatggctaattttaattttattgctttgctttatttcctataataaaattgctattatgagtatatatttcctttactattgtaaattattaagatgtcttaaatttctttttccaaatgtattttgtatacataatgatgagtctgttttaggttcaatccaggtgtgttggaagagtttccctgagacttatggagccttttgctagcaaactgtgcaccaggtggacaaagttgtacagggcatattatttacagcatttaattagggcaaaagtgcttaaatacgaatctgatcatgttgttccagaactaaaagttctctgttcgcccccacccaccaccttcagaacaaagctccagtcctttagggtggcacctgagaccatctccgtcagcccttgcctgcttccacagctgacctttcgttctgcccatagccaccactctccagccacagtgacttcctggcagtttgggaaacatatagtgctacctctggtctcagtgcctttagattgctgtttgttcttggaagagaataggagtgagtgagtgagctgaaggggtgagagagaagagccagtatacgggtgcatcatcacactattgctatgaggaaagagactcaattcactggtctctcttgagaagcctgcagaagtcctcccatattcttcactcaaaggacaagagttacaagcatttatccatcaagccccatcttctgctgattaagagttgccacaagggcgttaactccctttcgtgtttgaaaagcatgcacagtaggaatgcctgcctctccctgactccccttgacttactcctgttcaccactcaaaattcatttcggagtttctttggaaagactcccatgatcaccttctataccaaactcctgaagttcccttaggtacccctactccaggtaccattaacataaagctctcctgcaactaaaaatagcatcctataatcatgcagtctacacttgtaagccttttctcctattcctgcccacaggggcagaattttccttccatttctgtgcttctgccagtattctgtacctgcacaggatctggcaatagtaggcactttatacatatatgtcagttgaatgagtgcagcaggtagtgatacacttttaactaagcataataaacattatgcctatatcccatattgtcttcaggcagccaactgagtcattctcccgagccaagtctcaacaacctctactccgaaaccgcatctcattgaaatctcggataacctgcagaaagcagagctatatgaaagcctgtatcatctgttacctgtgtgccaagaagataaaccaatccctatagagaacttatgcagtatagcacatcacaataatacatttgtgccaaatcagcctcctcccagctttacaattgttcacacgtcctctctgccaacctgggtatgctttctcagttagacttggcttcagacttcattgttaacggtcccttgagatccccaaatcctcaattctgacttctacaggatccttattttttttttttttttttcctagtccggggctgtctctaaaagtccccactctgaaaactaaggctaagatttactttattttcctcaatatgctttacatattacattttattttattcattagaaatgccaaggggtagtttttgtacgtaatttgtataatggcacaaagataaaaatataagtaataaatactgttttttcaccaacagttattcagccctattctcaacaaaatttaagcatctctgtcaaaagtcttaacagtatcctcctgttcctcatttctaccacatagcacccaagttcactgctaaatacatactgagaaagtagttaaagaatattaaagagataacagattattagcctttccaagacagtcacaggttcctgattgtaccatattttttagttgtgcttttggtcgatccacacttccatgtagacagaggcatgcccagcaccgctgtccctatgatctcagacaccttatagtctcttgtcgctcagtggggcatctgggagaatcaaacagcctcagagttcttgagtaaattagaaactggaaccactcaatactaataatttccgttaagtcattaaacattcttttctcacaaacaaaccgatacaaaagacattttgtagtcgagacaagggagtcaatacttttctgttaaaggacagacagtaaatatttcaggctttctgggccatatgattcatctcatcgattcagctctgctattgtaatgcaaaaaggctgcaacagacg

SEQ ID NO: 42800 - DNA, 1595 bp, Bovine  19866880247519
acatccagaatagacttatgctcataaggagaggggaggagagggttagatgtatagaaagagtaacatgcaaacttacattaccatatgtaaaatagatagccaatgggaatttgctatatggctcagcaaactcaaacaggggctctgtatcaacctagaggggtgggatggggagggagatgagagggagtttcaaaagggagcagatatatgtatacctatggctgattcatgttgaggtttgacagaaaacaacaaaattctgtaaagcaattatccttcaattaaaaataaatttttttaaaaaatcaacagtttattctgcactggtattctggattgttttatgtctctattaagaatgtaacatgggactttttattgtgctaacatcttattaggatggttactattttttgagtattctggttgcaaagctatacagatatggagagactggccccattcctacttttttcccccatttgtcctatgtgtgtttgcagaatattaggtttttctggaatgcatatactatgttagagcagaaattcatgtactgtaatacattcattaacatccccaagctaaccatatctgccaaactgaagtacatgctatgccaacagatcccaagaaggaaaagaaaaactgtttgcatcacaaaggctaacactagtttatggcatgtttgtctgaaaacatgacctatgaacatcctaaaacatggatttttctaagcaaatgttagttgactcctcacaaattcttatacctcagccagagtagactgtaactctattttataggaacgagaattatgaggtgactgtcacatgaagggatgaactgtacagccgccacacctaagggactggcaacaagccagcccatgctgccacaacctcctgaccctccacctagggaccctccacctggggatcaaggaggctgctggcaggggagacttctaccactgcattcaggtttcagaatgaataactcacttgcacttttttgttttctggtcagacataatactctaggtcagagataccattatgataaaaaggccacttaggtaggctccataactgtgtagttataaatgatgacaagcaggtaccatggctcatatgtatgtatgtgctaagccactcagtcacgtccaactctttgcagccccatggactgtaggccaccaggctcctctgcccacaaaattttccaggcaagaatactgaaaggagtgtcatctccttctccaggtgatgtccccaacccagggatcaaacctgtgtctcttgcatctcctgccttggcatgtagattctttaccactgcaccaactgggatgcccatgcctcaaaggaaaacacacacacacacacacacacacacaggtgtgagtatctttgaagggcaacccttgggacttctctggtgggtcagtagttaagactgtgcttccaatctggggggcccaggttcaatccctggtcagggaactaagaccccacacgctacacagtgagacctgagaaaacaaaggggcaacccttggtggagcctgtatttggtactgacccaaa

SEQ ID NO: 42801 - DNA, 993 bp, Bovine  19866880392214
tttctgggcctcaatttgcctacatggttcctaaagagttaaacttcaaagacagaaataaagaaaaatttcatgcagcctttcaaacttaggggaaaaaaatagattccgtcaactttagaatcagaattaatttttcatagacgaagtataggaagtaagtaaatagctgtctggtcatgtccgactctttggtaccctatggactgtagcccaccaggctcctcttcctatggaattcttcaggcaagaatactggagtgggttgacattcccttcttcaggggatcttcctgacccagggatcaaacccagggtctcctgtattgcaggctgtattctttactgtctgagcaaccagaggatgatctctttagataaacaagacagattttctcaatgttattgatatttaagaaatcccttgctagaggtctttagtaaaaaaatttataaattgaaaaagaagggactctagaagaaccaaaactatttaaagccattgggagaagatagtccaatttttctaaatttctgattatgaggaggaagttcagaaaaataaatattcactatgacacctaaattcagctttcccattggctaagggaaccccatgttatgtgaaacagtggcaaaggcaagttgcttttcggaaactaccatcaagttttgttcttttagaggatttaatagggatataatggaagattaaaaaattgatttccactggaagtaggaattttgccaggtgcctataccatgtttggcttcccttatgttcctgctctgcttactaggaggcacttgaaaagtctggccaagcatcatcgttggtgtttcatactgacaggaataaaaatgatgcttgctaatttgacattatgaaaactgctttcaaagcaccattattgcaatgaacattttagaatgatttttttttcctgtcttctttcaccaacagctcatatacaatattttctgtcctcacat

SEQ ID NO: 42802 - DNA, 1681 bp, Bovine  19866880457490
cttgacaacatgcacacgctgggcctatacatttttaggggatagaagatttaagatgtgtggtagcaggaatggaaagccttctactttattgcaataatgaaagggaagcaaaacttctgtagcacaaaaataataaaagatttaatttctaaatactctgagtatggtattaaaccatgaggtggcataaggccaggacatattgggataagcaggaaaaaaagaaaagcacagacattgcatattttggcttttttatgactagctaaaaaatgtatcagaacaaagcattataacttttggacactgttattcaaagtctacagacttgtgctaacacagtagccactacccaaatatggctactgagtccttgaaatattgctagtcttaactggggtaaaccatattaatagaaattgttattctccttgaacataaataaatagactatcaccatgtctccagttcctgaccttaacagtgaccttggatgcaagcagatagtgacgtcactcaagaagggtctgccggttgatttttccagctaaaggtgcataaaggtggtagctagatgtactgatgcaccaaacccagagatcaattgaaatttttaatgctttactcattccagcacttgtgagattttgcatatttaagaccagggctggtgatatgtttaataactagacttaagttctagggcagtcttggctctttatatggtgttgggcaaatcaataaacattttgggttttatttcccctctgagatgagggatatgaatgagatgattgtttgaatagtctccagctctgaaattccacatgatgaatttccatagaaggctgcgtttcacttcggctacaacctgcctgaatctttctcatccattgtcatatgagaaggcagagccctaagagtgagtgttttgtgttacaggaggtaagagttttggctcatgggttaattgtggagataacggaaggccagatcagggcatcatacaaataaagggcttaaagcttcaggatgctgtgtatcagcagagttctaaagaggaactctgctatcttccagtttatatctatgaagtaactgtgtgtgtatatagtttctcccctcttgcttctattatatattgtgacgtttttcctttgaatgcagaggcaggataagacaaattaggaattacccttcactttggacagtgaactaaatggatcatggcaggaaatgcatgaaagacatttagggagagaaaaatagaaaagaggttcaagggtaaagtgacaggtccttgagactcaccaagaagtgctgttcagtttcaaagatgacggcattactgcaaaggatgcgtacaagagtctttcgaagaggacaatttctctcaaaatgtgtggagataaatttctcaatagccctgaatttttggcaccaggtggccttctcagtatttcaatttacttttatagacacttcctgatgaagacctattcccttttctttattgtttataatgggttgttcaaatatctgaatgcacagtgaccaggcatctgaatcagcaatactcttaataattctttaacaaactctgctgataggagacgtaagccattaaaaaaaaaaaaaaaaggcttccttggtttggaggagatgggatgaggggggg

SEQ ID NO: 42803 - DNA, 1850 bp, Bovine  19866880475984
gggcaggaggagaaggggccgacagaggatgagatgtctggatggcatcactgactcgatggacgtgagtctgagtgaactccaggagttggtgatggacagggaggcctggcgtgctgggattcatggggtcacaaagagtcggacaggactgagtgactgaactgactgactgactgggatacatttgggaatattatacaattttctggatagtatcttacaattgtttactgattgatcaaggatattcgtattagataatttccttggagttctacacagtgctgattcccattagactgtggccatcaatgggctatagaattctgtgtctctgcgagtgagcgaatagatgggatgtagaggcattggtttgcttcttgaagggtcttaggttagtaatcagaacactggctgattgaaagctttagttttgcttatgtttgataaatgttatgtggagaaagctttgctaagattttagcagaatgtatattccactggagcactgccagttctttggggtgacattgttgtttaccaaactttgtctccttaattattctgagagacaaaatgagatttagaaatagcatacagaaataggaggaacaggaggactacatttttaaaaatctccattaggtcttcttatatagatatttgtgattattttctgctattgttgactcagttgtttatttctctgattttttcctttcaaattctgaaaagcaatctaagtaacactgaagcaatttttctgttagcaaacataaaaggacccagcaaattcatctgtgttctgtgatttgtatacaacggtacttagaaataataatttcttcccctaattgttgctaaataggtctgcagtggatgcagagtccttccataattgcagattaaacaatgttgcagttttgaatgaaattagggaattgaggactcaaattggcaacataacaaacgtctgttatccctgaggaaatttgtgatattgattctaactaaaagtagaaattgtacacactgggatatcaggagaacagtttaaaaagccaatgggatggtagttgtggtggtgatacagatttatgattatgaaattacagagtataatactttgaaaacacctgtgatttttactcaactattttagttgaaaactgtctctgacaacactgttgttctctgaataagttatttactatattattaaaatttaatgcactgtggcatgctcttgagaaatccattccctcaaaacaaacaaattacacttaaagagttctttctagcacacacctgggagttaacttctatatgtctttaattggtaaaattagattaataacacatattggtcaagtgacatatagaatcaaaagagttgaatatgtaaacagcggtatcctcctctacctatcacttccaaatgaatgcaaatgagcatttcaagaaaagtaacgtagaccgtttaagcagtgtttactttttggttcagaatatgtttatagtatatcaaatatctaaggagatttaaaacgtagtcatgtatttagatgtttgaaatcattagtgccattaggacatagagtcttttctcaccgttgtattccctgcatgcatcatttaggttgtttccatgtcttggctgatgtaaaccatgctgcagtgaatattggggtgcatatatctttttgaattatggttttctccagatatatgcccaggagtggattgctggatccattagtagtccatttttagcttcttagggaacttctatactgttctccataggctgtactattacactcccaccaacaacataggaggattcc

SEQ ID NO: 42804 - DNA, 1717 bp, Bovine  19866880482184
aatttttatgattggcctctgtagctgctagggtactggtaaacagatttataaacccaagttttaccaaaagacaatggaatctaaagacagaaagccacatgattatagagctccctcccccaaccccgtcagtctcagagcttgccttagcagtgggtccatggtcattgttcactgcagacagcattcagagtcggggatttataaagctcctcaggtatttctaactcagcagcaggatttcgagtcactgcccttgagcttgtaacttgctagaagagcagaacttaggctggcagatggaaccaaacttgccatagacaaccaggggttgctgcctttgaattgcacagtgtctgttgccccaggccctgtggtaacggtactggggaaactgtagttcaggtcttatcgagagccccctggacacgtgtaccaggtggtgcggagtggtggcgagagcagtagctcttttcccctttgcctcattttgaggattctcagggaaaagctgggttccttagggtgccagtgggcttccctggtggctcaaacggtaaagcgtctgcctgcagtgcgggagacctgggttggggaagatcccctggagaaggaaatggcaccccactccagtactcttgcctggaaaattccatggactgaggagcctggtgggctacagtccatggggtcgcaaaagagtcggacacgactgagcgacttcactttcactttcactttctctagttgcagcaagctgggcgtagtcttcactgtggtgtgtgagattctcactgcggtggcttctcttgtggagcacaggttctaggcacacctgcttcagtagttgtgattcacgggctctagactggggcctcagtagttgcttcatggcatgtggaatcttcgagaccaaggatcagacccgtgtctcctgagttggcaggtggattctttaccactgagcccccaagggaagcccagaagtatattatcttgaagagaatatgggttgatatttggatgtttggtgttttcttagtaatatctagtaagtagtggtcattgttattattataggcccaggcaggaaatctgtggaacaaacaatcaggaatccagaagaaggacaagaaaggaattgatgaaaaccacaaggtcaaaggtctacacaactaaatgttgggattttgctggaggcatgagtagcagactccaggggtttgagtagaggggcagcaagtatgacacttggtagtgagccaactatccactgaggcacatgtttgcaaagatttctgttgaagaccaaggtcatctgagagcgtagacatctaggcttatgtggggagacaaatatgcacatgggatactggtaacttactgacatgaggtttacatgaggcaaattcttctaaaatgaactgtcttatttgttcccaaaacaggctttttcactcctagtgttttttaatacattatggttatgtccaaatttccataatgacaaaatcctctccttgttggtagagttagagtttttatgaaagttacatcatttatgtgtctaaaattattttaaaaagggaaacgggctagaagttctaaacaaattttgtatctattaacactaaaacttctatgcttacagtgatagatatagctgtctttgacagcagtaaagaaaaagcatcctattgctgctgatgctaca

SEQ ID NO: 42805 - DNA, 955 bp, Bovine  19866880551794
cttgaaatataaaataaagatatgaatgtttttgttatcaaaaacactaaaaaaatttcctgagcctctaatctgtacaaagcagggtactagtattttttttttttggtgtctcccatttttcttcaaatttactattcagtcttatccacatgctctcagctcagagtggtagacacacatagcttgcatctgtacaggatcccttgccttaccgcttctcattaggtttggccagtgggagatactgacatgagattgagggtaggtaaagaatgaagttgtagtagttattctcctgactcccttcttaccaaattatcctagatgggctgctttactcacagagccactctcttcaggttctagtaaatgcttggtgccctgcccttcatgcccagggaagtactggttccctgtagctgctcatcctagagtagtgcactctcttctgttggttaaggaaagcatacccaccacagttttgcagatagtccctgaagttcaatacaagttgctcagttttaaggttctgtctctttcacatctggattcaaactcatacaaaaataaatcagacaagtatcaggtcttcaaagagaagataaagcatgtatcaacataaatatgacaagacagaatttaagtatgacaagacataatttattaatgtaccagcggaaaagtgatcttgagattagattatatagattcctcatccctgctctccttctaattgtgaacacttgagcaagacatgttaactttcttggatgttggtttccttaggtgtataatgagagagatgaactcaatggacttaaagattccgtccaatattgagattctgtgactgcaggcttgctttcagagctgtaaggggagtagtagttaaatgctctctgggagtgacagcgaagtaagatgggaacctgggaggaaacactgacctcta

SEQ ID NO: 42806 - DNA, 1649 bp, Bovine  19866880597286
aaactgtttactgagaaaacattgctatttggttatagaatatgtaggtagcagatctaaaagttgacctagttaactgaatcttttccattcttctaactgagttagtatttacaataattcaatggaactattaaataagagataatgataatagctattatttacagagccccttccatgtttcaggaacatataaggcacttgttacacacattatttcaccagcttcccatctacctgtgtgagaagaagcattgtccccaatttacaggtagagtcattgaggttctgggaggtgaaagaaaaatggtccaggtcatgaagcttgtaagtctggacccaggtttgctggtttcccccactatattcacttggcttcagtctgtgtgagaagggaatctgtcctccccctcagacatgattagccaaacggtgatgtgacaatgggacaggctgcttttcacaaattaaatgttgattgaaattctgtgagcttggagtggatagtacttctggctgaaaacagattattatcattctgtttgatgctggttgattggaagccaatgaaaagatattctgacttcagccagttgcattaaaaattttaagttctcagttttctctttttactaggattatcttgggttctgaagtgttcttgccttaaaccctgaatgaattaacaagagaagaacaatactatatttctcctttttaatcaaaatgtcatgtctttgaaaggaattcttctttaagagatgacagtttgctcttagcttgcttgatgttgtatttagatatgtttggggaagtctttcacaaactcaaaattctgggaataagtaagctttcattcttagtctcttttcactcaaaacagcaaactcacacaacaatagctcaatcttactcagtttctaggcattcacttttaatccatgaagagttcctaaatgagcattatgtgagccattctggattactcaatatcctaaataagatgatgggtgccctacaaggacagggcctattgcttaaattatttgagtgtactaatgctgtattactatcatatttgagtttctgttgttaatctaaacacaatatgggataaacatgtccatgactctccttgatattcagatggggattctgtagattctggcactaaaacagatgtgcaacagcacagatttggagcctagccccaaaaggtcattggggctttcggtgttgatcacgaagcaaagcacagttcccagcacatattcagtgcactgtaaatttttgttaacttcatgattgggttgaaaccaggttctgaaggctgtatcacagtaaattatgtgtcaattgaatttttgagaatcaattctcattttgaatgtatagtaagagcttgttatacttaagaactttgcctagaatcatctgtaaaatgaatagcttcttcttaatttgcctactctgtaagttttacttaaaaaaaaaaaacaattatatattccctcacactgcacatttcatacctgcgattcatttattttgcatttgggagtttgtatctcttaatctccctcagctacttctctcttcctcctaccctcccacctctggaaaccagctcttttttttctctgtat

SEQ ID NO: 42807 - DNA, 2089 bp, Bovine  19866880632325
tcagtgaaatattttttcttgaatattttgctgatgaagcttgaagattctatagtctgtctgtttgaggtactattatagcaaggttgccatgggaaaatagctgtccttcccttaagattaattattgtttagtcactgtcattaaaatgaggagagatgattcaaaaattattaattctggtctccgaaattgacgttgtgcctacaaatctattgtataaaatcctatggtcctagtgaaagaaaacacttcctatgtttctcctacaaaactcaaaagtccaaagtatcaaagaaaaatatttactgtttttatgaaatgcaaactacttttggttttatatccctggagttttgtaatactaaacacccattatcttttctcttctgctcaaatctttttcttgccttgtctatgcattttgaacactctggatcagctgtaaccagtatttcccgttttgtacgtcagggcagtaataagtgcctgtgtcacactctcccacccaaactgtggactttctgctcaaagggacaagcaagcataatgatatccatctgggagggagcttaaaatagtgtccatgcgtcattttgcagttaggaatctggatatggctaatgaggtgttatcaatcaagagattaaaaaaattaaaatcctacattaggaactgctcctgccagaaacagtggattttgtaacagctgttttatattagatgctattgtgttctttagcagcaaattacatagatcagaaatgtacagttaacagtttccccaagtggggttgtaaataagcctgttgtcctctgtacaaagatattgcaggaaggagaggaagctatgagcaaaatcttggtggacttaatgcagttttctgctcccccttgaaggctagctagttcgctcagaagggaatatatatatatttatatatatataatcctagtaaggaaatgatcctagggaagtgatcctagtagggaaatgaccttttgaactctggaggggatggtattaaagcttttacctggatagtgtctcctaaaaacctgaatttgattggttccagaattcattaagccttaaggggaaaaattatatggaggtggggtagagggaagagagagagaaagaggaagccgtgtatccagcaagcaccagtgtttcagctccaaatgaagataagttgtttggaattaatagctaagagacagtcggtgcattctcctccttattgcgactcagtaaattagacttagcatgctcaaagcctgcttcatgctgatgttcctgccttctggaaaataacacgcttcttccccacccccctccttttttttctctctctaacagatgacagtaataatgagaactaaaaccactcaagtcagcgtatgaaagagaactgtctatttaaaaaaaaaaaaattaaaagacatctcttggtaccatctgctgaggtacaataatgttttgtaacgggttttggaaagcacattaaaaggcttcatctgtgcttgtcctttccagttagtcaagatatagttgtgtttctcctgtttgatgtggattcttgaatcatgtaattatttctaatttatgtctaaattgaagcatctcaaatacaattttaattgggatttcattaggcacttattataccatgtgtcaaatgatagttgattattcttagcctggatatagattctgaaaaagatagcaggagaatgatgggtacctctgaaagctgatggtgctcaataaatatgtcttaaaaataatcagttgatatataattaacgtaagtaattactgcaattaaactcagtttgtggaaccctgctgtgttgttttccatcctgagcttaaacatgattgttgttcttttgtccaaataaaattaatgtaatgagagaaaaatagaataaatataggcctggataacagagagacaaaaatattttccctttattagaaaagaatggcatgaagagaaaattttcctttcataaggaaaacgtatatgaggctttaactatatccttttcacctaaagaattagatacactcaatgcaca

SEQ ID NO: 42808 - DNA, 1978 bp, Bovine  19866880681507
gtgaggagatacccccttgtccaaggtaaggagcagtggctgtgctttgctagagcagtcatgaagatataccccacgtccaaggtaagagaaacccaagtaagacggtaggtgttgcaagagggcatcagaaggcagatacactgaaaccataatcgcagaaaactagtcaatctaatcacactaggaccacagccttgtttaactcaatgatctgtaccttaccccctcccaagtatcaaccctgagaaagctcagaaggtatttccttcactaactaaagcatttgggaatgtattagtggaaggaacactggaaatgttccatgtctactttctttgtcgactaggtacatctgtataagtaggctcctgatttcagtggggataaggaggacccagagtaggagaggccaaagcagttcctaatcactagagagaaggtggcacgtctaccataaggagtagcaaaaaatgtcaagtaatcagaaatttttagcctgcagagatacttggcagaggataattgataactatgtttatagaaacaaccctagatgagcagcctattagagtattgctggatacataaaaggggaaaatgatttctcaaagccaaaaacctgatctgtggacagacaaaataggcacagattgggaagatatttgtgctccacatgaatattcattacggtagacaagattccaagtaaccaggtggataaagtgatattctcagtagacatcagtcaacctttagtcatagtcacccagtgcttgttcagtggaccaaagtggccaaagtgacagggatgtaagctatgcacaggctcacaaataaatgggttttccttcaccaaggaaagtcactgcatgacatggctcgtgcagtgccgagtgtctaatttaccaaaagcagttcacattccattcaaaaaagacacgaatggaggtcccatctaaacctagtccctcagcttagatgttaagtggagtcagttatagaaaatgcttctctctctgagtttgaagcagtagaaatttttaagctctctaagtgattctacttggaagccaaggttgagaaaaactatgtcagtaaactccagttcagttcagttcagtcgctcagtcatgtccaactctttgctaccccatgaatcgcagcacgccaggcctccctgtccatcaccaactcccggagttcactcagactcatgtccattgagtcagtgatgccatctagccatctcatcctctgtcgtccccttctcctcttgcccccaatccctcccagcatcagagtcttttccaatgagtcaactcttcgcatgaggtggccaaagtactggggtttcagttttagcatcattccctccaaagaaatcccagggctgatctccttcagaatggactggttggatctccagtacaagaatataatccagtcttttttttttttttttgcttctggcaaaataagactcttaacaattgaaaatccctattgtttcaaagcaaatttaagtcaatatagagcaagatttaaattaatcagagatttaaatacacattgatagattttaccactaattctgccttatcaattactgcttaactttgacttcctattcttaagcaaatttttactatttagaatctttgcagctttggggcattcataaaaccaactgactaacctgagaaccccttatctgtgtttgctttgtaataaacaggttgagcaaagatttaaagcctagagtgggatacaatgcagctgctggtgttgtgaatttttggtgacttcctcaagccagtgcaaggtgattaagccacagaggctgcctgcctgggtgtgaatcaaaattctggcccacttatataggatcatctcatagccttgtgaggagaaggcagtggcaacccactccagtattcttgcctggagaatcccagggacggaggagcctggtggg

SEQ ID NO: 42809 - DNA, 3147 bp, Bovine  19866880686318
acctggatccaaatttgaccctggttcaactgggtacaaactatttgacctgtttgagcctcagcctcctaatgtcaaatgcagatactaagatctcctatagagtgtgtataataaagtgtctgacagagtacagtagtatggtgtctgcctggggaagcaacctccatcagcaggaattttgcataaagactgtcagcatcatgtcctatagctgatgtctccagtcaagagcctacactcatctaaaaatggctttccaggctttttagcagctacatcatcagccatatttagccatgtggctttcttgcctgtggcttctggagtgccctggtacctcctgcttccctggagagctctaggcagatggaaaagtcaaggttcttttcgttatcagccctctggttcttgctgagccctgcaagagcagtgacaaggtggcatcacccatcaaggaactagtgagagggccccagagtagcattcagagaaggaaaagtctgtcccatgactgtgccacacatctccttagtcttatgggattaagtttggggcaggatctgggtctcctgagtctcacagctgaggtgaatttccagtctccattaggcctttcttccagaggatggatgccaactgtgcccttctgacagtatctgaactttgtacattaggcaattggggatttggcagaagtcccaaatcactctgcacaaagctccaaaggactcaggaacacctatgcaaataggacgctgagaacagtctctgttatcctgttctatccaaatctatcctgagatagatttgctaactcagttttaacagtgcctctgagctatattcctgtgtgcctacatatatatatatatatatatatatatataaactttctatgtttatctcatctttaccgtcagatttcaaacctgaggggaactgctctggtagtcagtcttcagtgggtgcctttgctttgtaagagcttagtgaatgctcactgatctagtatacaggtcaaccttgtgaagtgcttctgatttaagtgacaggcttacctcacagtaacacacacacaaacacactctgtgtttaaatgagggtctaccactatggtttgccacttggcatctgggcctctgccttttacaccagagcaaatccagctttaatgtgcacaggaaccatttgaagatcctattaaaatgcagattctgacccagtcattctagggtggagcttgcgattctacttttataaacaggctctctggtgctgcctgtgctattctgaggacggcaattagaacggatatcaacaatggagaggccttgcttcaacctcttcagctcccattgtgcttgctgagttgcagggtcctttagatgaagtttctggtccctttctctcctcacttcttaattcaggctctgttttctttggctctccagaccttactttggaactggaaactcagggccaaaagtcgacattttcatgacagtcccattggagctccatcagagttcagagcaaggttaaatttgctctggctgggctgctgacaatcactttggggtgcccaaactcccagacttaaagatggaaatataatatctccccgaggaagcgtttttattgagtccatgaataagagagcacgccttttgttgcaactaatttcagctttactccctccatgtggcgtgcctgcaaggcagcggtgctcatggctggtgacgtcggaaatgaggcaggatttagaaaaaacctggaacttatgtaaaagtagaaagctatttaaagcagcataaatggctacacggagcccgtgcttcttttgatattatttaggattttaaaatcatgagataattcgtctgggaaagaaacatagtctagagcctctccctctctctcttcgctttctcaccaccactaaaaagtacataacaaagatagttggcacagacagatcaggaggatgtacatctgcttggttttaaaattttattgcaaataaacaacatagatagaaggcagttgatgttacctaataaggcaatagaactgaaggtattttcttagaactgtttaaataataaaatggccatcatcaaaaaaatccacaaacaataaatgccagagaggctgtggagaaaagggaaccctcttacactgttggtgggaatgcaaactggtactgccattatggagaacagtgtgcaaactccttaaaaaactgggaataggactgcatgtgctgtgctgtgctgtgctgtgtctaagaaggtcagttgtgtctgactctttgtgaccccatggcctgtagcctgccagcctcctctgtccatggggattctccaggaaggaatattggagtgggttgccatgccctcctccagggaatctttccaacccagggatcaaatccaggtctccgacattgcaggtggattctttaccatgtgagcctccagggaagcccaagaatactggaatgggtagcctatcctttctccaggggatcttcctgacccaggaatcaaacaggggtctcctgcattgcaggcagattctttaccagctgagctactagggaagtccttagaactgccataaaatccagcaatttcattgctagagttacaccctgaggaaaccagaatttaaaaagacacatgtaccccaaagttcactgcagcactatttacaagagctaggacatggaaacaacctaaatgaccatcagcagatgaatgtataaggaattatggaacatatatatacataatggaatattactaagctataagaaggaacacatttgagtcagttctaatgagctggatgaacctagagcctattatacagagtgaagtaagtcagaaagagaaacacaaataccgtatgttaatgcatatatatggaatttagaaagatggtaccaatgatcttacatgtggggcaacaaaggagacacagatgtaaataacagacttttggattcatgggagaaggtgagggtgggattatttgagagaatagcattgaaacatgtacattaccatatgtaaaacagatgaccagcacaagttcgatgcatgtcaactcaaggcacccaaagttggtgctctgggacaa

SEQ ID NO: 42810 - DNA, 780 bp, Bovine  19866880689051
tccccccaaatcaccagtgataagccacactgactggattctatacatttcccatgagggaaccctgggaattcagctactctttgtaacactgtttctgaagggaagatgtttgactccctcattttctcgtttctccactgatcaagaaatgatctttaggaatgcaaaccctacctggaaaggtgagggttaatgctgtccacctgagtagagaaaggtgactagtgtctgctgttttgtttcaggcaaaaaatgaactgagtccttgaaacgagatcaaagaaggctccccgtgaaagctgcacagagcaggcagttgaccctggaacatttggtatccctgggaacactcctgctttcagttggacagaccttgagccatatctgctccaacattctccccttagcatttcccttatttatgtcccccattcattctgaaaacccccttcctccctgtacccagagaaacagtgggaatatccatcccctgtttctagggaaaaccctacctcttctataaagccatatggattcaaattctgccgcaaattttggagcccacactataaagtctattttattttattcttctattaaatttatactgtttcatgtagttgaatattatttttcaaattattttgtcaagttttttaagggcaaggactgattccatttattcctcacataacactttacaattctgaaactcaagaatgttttgaagatgtctggttactcacagattccagacagcaagactgccacctgcct

SEQ ID NO: 42811 - DNA, 1767 bp, Bovine  19866880719220
gaggagaaatgctgacctgtggcactgggcaagaaagccaggaatggaataaaaggaagtgaagggaactctcactggaatacttttttcagttgcatctgaagccccatgaggaaggtttcagatatgaatcactgacagctgcctgctaggctgttacgcttaatcctttacattctgagtatgtcatggtactccataaaaaagcttattgcctaagctgttctcactctcctaagttcattctcttcaacaatgccagaaatataataacaggtaagcgaccaagaaaataagtgaccaactattgtataagattgcattttgctaaaggtcaagacaaattatcatgaaatccttaaagatgctgttatgtggttgctgggggacaaaaggtttcttttcagaagagattcttagaagcagaggctgctgtgtttcaatcctcagctaacttttagttaatgactcttgccttttctcctaccggctctgcttattaaaaggagaatgcaatctggaatgtgtgctgtcagaatgaacagcagggtcagtcactaatcccaaattgtatgcccccaggatgcctgctacagaatgaggaaatgcttacatttgattaaccttccaggtagagaaagggaggcagccaggggtctgcagctacatgacatggtataatggtagttttaaaatatggcattcctagaggatgcaagaaaagtcacagcacagggtgctgacttagtgtaatgagtgaagattatgtctctacaatagcaagcaagctttgtggggaagaacattgccaacctgggcattcattttcttcaaaatatttataacaatatgcactaatcccttatgtctgtgtgatgctttatggagtacagaatgcttcaagggcaccaccccatttgatcttcaccactgtccttggtaacaaagggttagaactgagaagcacttttcaattttttaaaaaaaaatcctcctcattagctgtcaatgcactatttcttgccctggtcttttctttaacaatttctttagatacaatgaagagggaaaaaataccattgggtgagtcaaggggatattgggtggatagggaatagataaaaccatgtagtttggaaggatatctcctgaaaatatgagtgaaagaaggcacaaggtctcttctatctctggggctccaagtacaataaggaaaaaaaaaactatcaattttataaaaaatagtttcattctattgctaaatctagcattatatgctaattaagtcaacagtcaaaatttgatatttttgtgaatatgaggcccagaccaatggcacccctagagacctagcaatagataatagatgcttttggtatgctactgcaagatgacagtggactaattagaggcagttctttaatctcttaagaaaggtatgcctttgtacttatttcccctcagcctttgattccatatccatgcattgaacaaaatcctatttgcttccaagatcaagcttagataccatattcaccatgaggtcttcttgacagcacttttttttctgtctgttccagtgtgtcaattatgactaccatgttatgtcatatatgtgctttccatgctctctttcctagcagagtctgagttcagaggagtcaggggtggagtaaaacaccaccaccaaatatgaaggtactcatatttgctgaataaatggaacgataaagcaagaagatttaccataaaataatcaagcccagt

SEQ ID NO: 42812 - DNA, 755 bp, Bovine  19866880724744
ctatcctagtaaaagtgtgatctttcagtttcactctaaggcgcaggtctcccaggtggtttgctcattatgtgatggcacaggaaggagaaacaaccctcattggaagtagggatcaaaatgagagcgatagagttctatagaacagtattgcataaaggaggagacctggaaaggtgaattctttcatgtagtttgaaaaaagcgagcttcactggcaggtggagaacctacgtggagcctttgctcccctctagagaaccacagtgcagacttttaagagcaaaactagactatcctctacagttaacagttcatttgagaaacagctgctggcctgctgcttggccctaatagagactgaatgtctgatgatgaagtgtagacttatagaataccttgttaccatgatggcattccacataaggtgcttctgaccagggaatccattaacagtgtctgatacaccaagccataacgtgggcaggcacggtagcactgcaccatcaagtgggaatgctctatttgagcggccccatgaatgtgtggctcaaattttcgtgattcctacttttgctatactccctcctttctctcagcctacccctatgaccagctgaccaaggccaaaaatctcatgcttgctttatgacgatttcgcatgaaaagctggcagcatctacaagtaggcggtggtgacacagcctgacttgagcggcctgaaggacatggtgaggggacctcctgcaagtagg

SEQ ID NO: 42813 - DNA, 2671 bp, Bovine  19866880734236
tatagctgaaaaggcatccatataatccataacaaacaggacacaatttttgtgggagttctgtgggagtcaatttttgcagaaggcaattacactggaggataattgcacttgcagtgttccacaggtctgtgaaattagcaattaagcacagaagtagctagaacaaatagaaatagtgtagatgggctgtatgcagcaatggcaagctaaaactttagaactctgcaattagaagataaactctagcaccaggaacctaaaacaccaggattaaatgggggcgggcagggtgcagggggagatgtaggaagatgtaaagatgatgcataattagtagcaggtagcaagaagaggggggattccctggcagctcagactgtcaagaatctgcctacaaggcaggagcttgccctgtgtgctaacttgcttcagtcgtgtccagctttttgtgaccctatggactgtagcctgccaggctcttctgctgatggaattctccaggcaaggatactggagtgggttgccgtgccctactccaggggatcttcctgacccagggatcgaacctgcatctctttcgtctaacctgctttggtaggtgggctctttaccactagtgccacctgggaagcccacaatactgctctgtaacatccctggtcacatgatgctgtgatcactcacctagagccagtcatcctggaatacgaaatcaagttggcctcactatgaacaatgcaggtggaagtgatggaattccagttgagctatttcaaatcctaaaagatattgctgtgaaagtgctgcactcaatatgccagcaaatttggaaaactcagcagtggccacaggactggaaaaggtcagttttctttccaatcccaaagaaaggcaatgccaaagaatgctcaaactactgcacaactgcactcatctcacacgctagtaaagtaatgctcaaaattctccaagccaggcttcaacagtacatgaaccatgaacttccagatgctcaacctggatgtagaaaaggcagaggggccagagatcaaattgtcaacatccattggatcatcgaaaaagcaagagagttccagaaaaacatctacttctgctttattgactatgccaaaaactttgactgtgttgatcacaacaaactgtggaaaattctgaaagagatgggaataacagaccgcctcatctgcctctgagaaatctgtatgcatgtaaagaagagacatttagaactggacatggaacaatagactggttccaaatagggaaaggagtatgtctaggctgtatattatcaccctgcttatttaacttatatgcagagtacatcatgcaaagtgccgggctgcgtgaaacacaggctggaatcaacattgccagaagaaatatcaatagcctcagatatgcagatgataccacccttatggcagaaagtgaagaattaaagagcctcttgatgaaagtgaaagaggagagtgaaaaagttggcttaaagctcaacattcagaaaactaagagcatggcatctggtgagatgaacagtgagagactatttttttgtgctccaaaattactgcagatggtaactgcagccttgaaattaaaaggtgcttgctccttggaagaaaagttataaccaacctagacagcatattaaaaagcatagacattactttgtcaacataggtccatctagtcaaagctatggtttttccagtagtcatgtatggatgtgagagttggactataaagaaagctgagagccaaagaattgattctttggaactgtggtattggataagactcttgagagtcccttggactacaaggagagccaatcagtcaatcctaaaggaaatcagtcatgaatatttattggaaggattgatgctgaagctgaaactccaatactttggccaccttatgtgaagaacagactcatttgaaaagaccttgatgctgggaaagattgaaagtgggaggagaagggaatgatagagcatgagatggtttgatggcctcaccaactcagtggacatgagtttgaggaaactccggtagttggtgatggacagggagggctgacatgctgcattccatggggtcacatagagtcagacacaactgagcgattgaactgaactgaacataagttataaagcaaaatagcctttaatggaaataaaagagatcattagatccaagatattttggtagataaataggcttcagtagaataaatgggatatggaaaaaaaaggcatcaagaataaattctaatctctgtactatactatgatatgaatagtattttcattcactgtcataggaaatgtggaaatagaaccatacttttagggactgcacatgggtgttgtcaatttggctatataattcttggtacaccaatatagaaaagtcattttcacacctatttggcaggttcttcatatttgatattaattaaaatgtctctttgaatattagaatatcaataaataatgcttctctcttcaattctcaaatgtagaaccaactcatagactgaagtgtcagacagatggaaatgaaacatgacttttattgttatatagctaagtggaaaaatgatttgagactgaagtttggtttgccagttgtgcatcctaga

SEQ ID NO: 42814 - DNA, 746 bp, Bovine  19866880752241
gtggggagcgggtggtttcttgtttgccctcagcctaactttaggttttcttaagagaaaaacttgtccatatgtggctctaaactcattgtgtctatgggaggaggtcagtttgggatcttcctgtgttgccatcttgaacagtaacttttctagatggaattttaaagtgaaaaagtgaagtcactcagtcgtgtccaactctttgcgaccccatggactatagcctaccaggctcctctgtccatgggattttccaggcaatagtactggaatggattgccatttccttctccaggggatcttcccgacccagggatcgaacccaggtctctctcattgtagacagacgctttacagtctgagccagatggaattttaaacactcttcaaatcatgcaacagcttgcagcctacaggtttttagagaaaatcataggaaataaactttttaagtagcatcagtgtgaaaagaatgaccctggaggcataaaacattgtcgaggtttttctaagtactccttgagacattggggcctcagtgattgagatttgaactcctgtgatctacttaatactgacaaggttattctaagggctttgtgctctcaaacatgagcagcatttcattaccctagatttctgcagaacctctgaaatgccaagaatttgcctgctgttcctaagttaggagaaatactgcctggtccagcaggtcggaggaccttacctttgcatggggccca

SEQ ID NO: 42815 - DNA, 4333 bp, Bovine  19866880771527
catgctttttggaataactttaattgtacatctaaaaccatccttcactaacacaggcatgacagaaaggcacagagctatacgctaaccttaatgagatctatttaaagcatctcaacaattattttgtaatggtttcaagttcaaaagtaaggtacatttctatatggagttctaagagcacctcagggctgaagtgctctgttcataatctgggactgtggttcattaaaggagacaggagctggaaaaattaccaagttgcaagaaaaatgtaagttcctgcacagtttgtgcagcattcctatatcagcaacaaacctttctcaaacaacctcgattcctcgcagttataaactgggacgtgtatagagaaatatccacgctccacatctgctgatcttcatcatgccccacaactgaattatttctgaacattactggagacgccccgcttttgttttgcccttttatttaagtaccacttcctccaggagaccttcccagacccctggaataggttaggtcttgcacagtgtatttacataggactctatacttcccccatggcatttctcatcacattctgtctacaggagttaaccttttagctaacctatgactcaatattgtagatagtgaatcaactcgtgtcccacccccagctcttactgaggatctcttggaatttggagattctatgttaagactcattaatctgatctaaatcccctagttcatgaattaagaaacaagccctatctatggtaacatacaacaaccagtaacacatccaatctgagtcaggcttagataagaatttagatttcagaattcaacataagggacttctaagtgttgagatcattttttaacccatcgcaagaatctgacctatgtttcctccatctttttttttttttccagcaccagccaatcctctcaccttgctctcagcctggctctcagcctggctctcagcctggctctcagcctggctcagacaggcatttatcaaagtgaaggagagatatactctgattctatgccacatctcttaaaatctacatcatcctctaaatattctgccaatacgcacccctcagatcactccctgcctctgcttctccaacacagctagtgttccctcctctcctactttatcacacttctcaccattgttgcccttgcaaagactcttctccccctgcacaaacattttgacttagattatcccaagacagtagcccctggtctcagctaataatctttgggccagcaaattccctagatactaagttcaaaagctaaagccactacttcatccctacctatcaatgtccttttttacaactttcaataaagtattagatgaaagtgaatgataagcatttattccgttttctactcaggaagcatccactattatgtgagccttatgggaagcagtaccatgcatgcctcctacccctggagagagagaaaggaggatattctcgttcttgcagcagtttagacatttgctcatgatgtgaggctccaccaatcttgccttgtactttgagtcttgagggagggaggtgaatgtgaaaggacagtgaaagagtattcctgactcaggactgaaagttcaaggtgagatgccagatacagatataagtagtgtatcctctaatgtatgttcttccctctttgctgtgttatatgcatacttacatattttaaactcattttctctcacttttccctaactactgtatatggactgtgttagaaatagttaactttatagtatattccttagatcacagaaaatggaaagaggatcatgacagaatatggtcaaactgtggatattctaagtttttaacaggatgaagtaactgacaagactaagaaccctatgtgtgaagattggactatacagccagttctacaaagaagacttaggttcactgtaactggagacatgtctttttaaagtacataaagaatgggtttccctggtggctcagtcagtaaagaacctgcctgcaatgcaggagacccgggttccatccctgaatcgggaagatcccctgaagaagggaatggcaacccactccagtattcttgcctggagaattccatggactagaggagcctggcaggctacaggggtcacatggggtcacagagtcagacatgactgagcagctaatacacacacatgaagaatagtgtagatgaagtacatgaaaaagtatgtggatgttggacagccaacgaaatgactacaaggaggaggcattttttatttttttggttatctgcgatctgaatcctgtcttaattttagaggattctccattgtgcaggtcagccataggatgaacagatgattcattatccctcatgggaaagctactaagagttaaatgggcactgttaataattatgctggaataatcaacatcaactatgactgctccaagcaagccagggaatttggctgctcaaacccaggaaaaggcagtctctgccttctacaatagaaaccattaagagataaaatccctctccctgctgcctgacagttaggacacaggcacctttactggttcactcagacactccttgaagaaattatgtaaaaatgcagtggctattaaagaatatcactagcccttgtcactactagacgtgtgagtacgcagtggccacagggtcaacaaaaacatcccactagccacactgttgttctttgtatatggccacacttgggtgtggtatctagtctcccaaatggctcccaataaaccttacctacaggtatttcaccccttataatagtccccacttaaacaatgaatgtagggcttcccaggtggagccagtggtaaagaacccacctgccaaggcaggggacataagagatgcaggtttgatcccctgggttgggaagatcccctggaggagggcatggcaatccattccagtattcttgcctgaagaaccccatggacagaggagcctggcaggctacagtccacggggtcacaaagagtcagacacgactgaaacgaattagcacagtgaatgtgggttgacctgagacttgcttcaaccaacagaatgtagagaaagtgatgctatgccagctcaagacctgcaccttgaaaagacctgggatattctacttttgttctttggggagccctggctcatcatttaatagtctggtcaccctactggagagaccacaggtagagagggagaagctctaagaaaacagagaacaagaaagttccagcagttcagagggagctgtaagatgacagagaataagaaaggcctggcagttcagctgtccctgtcaaagtgtcaaacttgtaaagtcttagacatccagccagttcagtgttcaaatgagtgtagccatgctctgcccagctaacctatagaatcaaaagagatagtgtttcttaaagccactatgtcttaagtgttgttacatagtagtaagtaactacagctctaagtaatcagtttgccagcctattttagctattcccatttcatgatttcatgagactagttctctagttttcccatttcagtttattagtctttatacaaacctcttttctatctcctgatttactgattagttttctaattttcctgcttcagttcattagtttttatgcaaacctattttctctctcctgattcattgattgctctctaaatataattatctccactttttctcactgtaggtaggtgctccccaacatttcaaacatgaatgcttcatttttacttaataaattgcatgcagcaagtgtactttctagtaaccactgactgaaaaaacataaaatggcaaaaagcaattaagaactcagaaacagctttaagcagatgtgtctatccttcagaataaccacagaaatatactcaaaaacaaaaaacaaaatatccatgtagaagcatgttacttacttagtacttaggaagtttacaaatgtctggactctttccatagctcctcaccctcaaagtccacatcccagaggatgggagccacttagtaggcacacgtttctcttttgcattcccgtgagatgaagtggttcccaaaatacactatttcttgggaaagaaaaacaatctggaagacactgtagctctggacagataatatcactgagaacagaataaacacataatttaaggaaaaaaaccccaagataccatcttcaaagaatgggctagtgggggaaatcaacattttggagatgcactggtatcaaagtttgataacaaggtaccgaatcatagaagcaaa

SEQ ID NO: 42816 - DNA, 1364 bp, Bovine  19866880809462
gtaggcagtttacagtaatagcataggaatgaagctatgcttcaggcaggaaaggttaaacatttttaaaatgcaaaccagataaatttttaaaaacctcaaaatagtcttggtgccacattgcctctatgccatccccagccattctcttaacaaaagacgcctctctctctcgcaggcttctcgtttgtcagaggagagatttccctgtctcctcagcggcacactctgtataatttaaggtgactcactatacaggaaagttcaccttccattagcatgttttctttagtaagcactctcttgcaagtgctgtagtgtaaacatgagtgcctacgaatatgaacatttattaaatagcactgatgaatatttcaatacctcggggagagcaattcacagctcaatcattcaggctgttttaagtgcagcacaggacaattccactacatcttccattaatatttaattgcccattttattctgtttacctttttggttaatatataatttaaagcccttctactaaaaaggggggaaaagagaacagctgttcatctgcttttaacaaatctctagtgagagcttttatctcatttaaaattcattgcaaagagtttttatttaatatcagtaacacaaaacctcaggtattaaaagtaaaacttggaagtggctctcaagcagaaagcctcgttgtgacttgggtttgattacacatccattcctgagtggcaggcattgacaggaaatgtctgaattgccagcaatggcgccatgtgtcacgtcctcatgaaatagaatcacagtaactcgacctgacacattctgacaacatgtcggaaagttgttatgcaccctgcagaaagtgagtcctgtcatcccagcaatgcagattttactgacgggataaaacacttctctgcttgctaaaggacaagggagtcaaatatgtgtgtggccttgaggagccggggaatccctgatgcgctaaccattcatttctccttggcttcccttggtggatgctatcagcttggcttctctttttgttgggttcagagccccagggcttcactcttgtcatttcaagttttctttcctcccagttggctgcagttgtttgtcccttaaaccctacctggtggcagggatcctgacatttactgacagatctccacgttattggggtctttctagacctcccaggctagccagtaaaactgacccccacatccaccccagtgagggtcaccctatcccttcatcctcagtcacctggaatcaacggctttccaggacagtgagctgcataatctcctgtttttcctgctctgctgatctctgcagcggattcattcctt

SEQ ID NO: 42817 - DNA, 1089 bp, Bovine  19866880812466
aagcccctgttttcctaaaggtatcccactttacagaaaaggaaatcaaacaaaatgatacaaagcacaacataatacaacaataacaaaaaacaatgtgtaatccattgacatagtttggagttgtggcttattattttttaatctcagaaaaaaccttaactctattgcttaaatatagagttctgtaaaagccctaggctttctgtgagcaggctttttcttttataaaggaatggagattacaggaaaaaaataccagttggaggaatccttttaagtaatttgcatatgaataatccccagggatgttatttaggcaaaagagtatagcaacttctacaaaatggaagtgacgctaaacagggaaaaataattttatagattgtgtttgagaaaaagtaaactaggaaaggaaagatgaagagtctgattcttttataaatgttatgtacttggatagtaaacacatcagtagcaattctgtgttttgtttttcttcagccatgcatggtgcttttttggatggatggtgtttctttcttgatgctgtcagtcccagttcagatctccatatcccagattgcttgtcttacattagctatgtattaaaattgccttatgtcatacactccatgcaatctagagaaatatttttcattgtggaacaaacttgaaaaaacaaaatatttctatgaaaagcaatttgctttgctaggcttcgcttgtattcccagtacaattactatagattatatgagtttgaaaatgagctttcttccttgcaatccactcctacctctgtttgattctctcatgaagtcataatcctctgacataagcctgttaccatggagattaatgtgatgttacacatttgctattatttatgactttgttgtaggatggatccaaagagaaattaatctctgatttcttcaccaaatatttggggagacatatgagaacaggtgaaggtatttcagcttgcacctcttaattgggaaatgggaagtgttttcacttgtaacaaatatccaaggaataataatttttaagaatattaaacatcttgaaggaaagttgaaa

SEQ ID NO: 42818 - DNA, 696 bp, Bovine  19866880843487
ctttcaaagacaatgggctgcttttctggatgcctgatgtcctctgccagaattcagaagttgttttgtggaatttactcagcgtttaaatcttcttttgatgaatttgttggggagaaagtggtctccctgtcctattcctctgccatcttctgattcttggaagttagtttttataattcactccaaaatatttttaagacaaaactaacttaacataaactgagacttgagtatgcatttgtaattcatttcaccatatgataaagaagacttgatacaataggctccaacttggagcctggaagttcaacccaggaatatgtatctgtttcataaacagttgttttaaagaatataatatacagatcacttagtaaagtgcctggaacttagcaataaccatctcaataaccattactaatttactcaaatgtataattttttaatgtaacccaaggcctcactcagtaaattcttgatctttgaatttttactcaacagaaatacagaaaactataaaccagagtttctttgaattcattagaattgccaaaaataatatagcttttgtgaattttgggaccactatacagtaaaagataatggtattctgaaaaataaggctatttcttgaaatagaactactcatgacgccacactgaaaccccacattaatttctattgtaatttttg

SEQ ID NO: 42819 - DNA, 1419 bp, Bovine  19866880882027
catattggagtgggttgccatgccctcttccagggaatcttcctgacccagggatcgaacccatgtctctttcatctcctgcatttgcaggtgggttctttactactaacgccacctggtgtcttacaggtactcaatttacatatgatctctgaatactagtatacatttaatgaatcagggtgttttttgcatatttctaaatatgaaatataaatataaaaagacccttttgaccaatgtctctccaactttagcatgcacaggcaggacctattatagcagatggcctggccccaccccaagtttttgattcagtgggtgctgtggggctgagtttacatttctaagaagtccccagatgctgctgcttctgctggtccaggtaccacactttgacaaccactgcattagtctttactataaatgagaatcagaaacaaaactccaaaccacaaaaccatgtatctgaaaggttagggtcattgagttgtacttaaaagagtagatccaaagccacttagtaaacaaagtgtcccttacagaaactcaccccataacccctcttttctctaaaaggcggttactcctttccagtcagttctttaaaataaaagagaaattaaaaatcaaatatatacttgataaagcactgcaatttaaaatgagatgttcttttttattttactttgcaagtctcttttctaatgagctgagtgccctttggaacattttcttattctctatataagttcgccttccccagtactacctgtctttacttatatggtatatttgaaatgactaacacattcccgattttacagatatagaaatggttatataacataaataatttgcccacagtcatggagattttgtggtaatgatagagacgtctttctggctgctcagttttctgatttataatccacattttacaatatttataaatggacatatcctgtacattatacttaattccaggtctttagtgattgcctcattgcaatgcgatttgctatagaataagacaagttcaggaaattggagaataattcatcatttatatcccaaatccttttagaagaatgtgggatcatgaataaacaataacaaaatcatccccatcctcttagaaaccacattgcaattagccaggtgcatcatactacatatttaataaataagataaatttggggtggtggaaaaattcagcagtggctctgggagcacactcgtgagtgaaggaaaggcactttccttcagcctaattcaagttagtgaattaaaagatttgaaaagtattgatacaaaacagttttcttgattaataacatatatgagatccagatgcctaaagttcaacgtcttcagagcttctgggttgtgtcatatgtagaaacacagaagtccct

SEQ ID NO: 42820 - DNA, 930 bp, Bovine  19866880905455
cgtggcagatgggagaatctaggttatccaacttggaaactaaagaccaaaagaaatgtcttatggggcatgttggaaaaatgtctccaaactacaccagctgacttccttctgttccctggttcacctgagctgctgactgaatgcgaaactcgagagctgcacgttggtgagaaagagctcaggctaaaccttctgtattcatcgcaactgcaggattctcaaacaagaaactgttaaatatcaaggaatgaagaggaaggggcattgaagaatagtgagaaagagtgagaaagaaagaaaggagggaaaataacaagaaaggatatagagaaatgacaaataacgcaaaaaatacatctctaatccagaaaacagttatctttgcagtactgccacccagcgattcaggggacctgccctaagccccagtacttagaggcccctgatctgtaggcttttggctgtaacatccctcaaaggaaatatctgtgagcccataaggagagcccacctgagacccacccaccttcctccttccagataatgctgtgtgtattcaggagcctagaaatccttgctgataagaccctcaggtgcctggagggttcgtgagggccttttcttctgtctgcatgatgatgatgatccctgaggctgctcaggagtggccagagcagctgtctgggtagaggaatgaaagggggcttgacaaggtgggggcatccctcagcgagcacgcaaaacagctcaggatttggaagggactcagaagtgggaagggaagggatattcatgttctggacccacaatgttagggcctggtgacctttttcacttaagtcagtcaatccagtcacgcagtatttccacatttctcattgggagaaaaaatatgcggattagaccttcctgtaatattttttttca

SEQ ID NO: 42821 - DNA, 1345 bp, Bovine  19866880920790
ctgttatttattaaagcgcagataaactgatggattcagcagcagtggaccaaagttgagctttgccacaggatgctgaagaccttgtcagatgtgtgcagccagcagacagctgtaaggcaacccttgacctgagagctccaccagggtaatcagtgttgcaaatgagttaaactcactgtggcatatgctgaaatctaaaatagctccctcagtcaccaccctgtgcctggatgagcttgactgctgttagtgtgtactaaatgtattctcaaagggttaacaaagcaataataaagaggctaacaacttctctcccatcccccacttccccaccctagatgacttcccaaacccatttaaaatagagatggattccagtgagtcttctataccacaacctgatcttgggctgtataagattacttttcaacaatataagatgcataagtgccttttcatcgtatgaagaaagcatgcccactggcaaatgaatcatattataaaaattgattgtatcccaaaagggaaaaaatgttattgaagatccaatggcctgggatgatacaccattgatcattgtaagaaatacttccagaaactgtttttaatctttccgccagagcattagcaattattctttagcccatggtgagtaatgacttgagtttcccagcttctcaatcgataaaacatttaccctaccgctacaaatgtgctcttcgcttagacaagcagaatttttcttccaattactctttttttagtgtgacctcataaaatattttaaaacatatttcaaggctttttttttttaaaggagaggaacaatgctcttccatgtgcttatattttcctctttcttttaagaaataagtcatgacaatttcatagttatttgaatagctaggactgctttttttttttatcattttgtgcaaacttaagacatgatttgagtccagccaactgctacattttggggttagccaataacaaaacaaccccctttccattttgcctgaacaaagatttgaattcctttgaaaatcaacaacaaaataactcccaaggaggctgagcaactcctccactttctctgcatggttcataaacctatagcactggctaatggagagcagccataaaacacactgttatcagggtaacaaatagctgtgcagaaaattagagataaagacaaacatccagaaatgccctctgatgactgaaaagttaacgttccagcaagttctcctttccaaagaattcatgctgtatttccatttgaaattacaacctcaactcaagcaaaagtgcccactactatttcttatcacaattg

SEQ ID NO: 42822 - DNA, 695 bp, Bovine  19866880922782
taaacaaatgggaggggctgtattgcaacacaaactttatctgaaaaagcaggcggtaggccaaatttggcccataggctgctgctgctccctggtcgggataaatcaatactattctcaaaaatctaaaaagttcaaaggaaaacaacccctctcaataattaaactcttatttaccaggtttaccaggatgacaacagcacagctatttcttttattaaagccaaagtatcaaactgacccagagctctatgataggtggtctccaatatctggcactgaggcagcttgacttttgcagagacctactgatctgaactcaaggttttgtttggttttcagtaacaaccagtaactcacagtaaagtgtatgctaaataaggaaatttaattacattcaaataatcagaatctgtttattttgcttaaaagtaacaggaaaaagctaatttgatttcctaatgtaatacagaaaaacacgtttcctgtatcagagactccctggaaattctgatggaaggctccagtttgacatcttaaaggaaaaggagatgatcctcttggaaaaagacaacgagcaggctgtgtatctgcccacttctactttctctttgtcaggtcttttcttgctgaaactggatttgtactgattagaagctatggtttccagagaattcaagcatagcataattttt

SEQ ID NO: 42823 - DNA, 1431 bp, Bovine  19866880925623
gcaatggcaccccactccagtactcttgcctggaaaatcccattggatggaggagcctggtgggctgcagtccatgcggtagcgaagagtcagacacaactgagcgacttcactttcacttttccctttcatgcactggagaaggcaatggcaccccactccagtactcttgcctggaaaatcccattggatggaggagcctggtgggctgcagtccatggggtctcgaagagtcggacacaactgagcgacttcactttgacttttccctttcatgcactggagaaggcaatggcaccccactccagtactcttgcctggaaaatcccatggatgcaggagcctggtgggctgcagtccatggggtcgagaagagtcggacacaaatgagcgacttcactttcacttttccctttcatgcactggagaagtcaatggcaactcactccagcgtttttgcctggagaatcccagggacgggggagcctggtgggctgccatctatggggttgcacagagtcgggcacgactgaagcgacttagcagcagcagcagcagcagcctgtctgggagaagccaatcctcaacaaattatgtcagctttaagatgttccataatgtgagtgacttaacctttagctccaagtgtgtttaggaaattagaaataaaaattctcatatcaagttgtgttgtgagaatttaatgtgaatatgcgcagcaatcattaaaaacgaattgcctcattgaaagaatgaggtattaatatcggcagaaaagggagaaaagagggcatgaaaagagaacttcacctgcctcacattttggtcagcatgtttctgggtttcccaccaatgccccatgtgtccccatcctgccaggctatgctccacatcagtcactcctccaggcctgtgtgaagattaatgaatagctgcttgaataggaccacaaagcactttcatctctagcacaacagaaagaagcaatcaagtggagaatattaataacaagccaaatcctcatcttctggaactgcaatggaaaatctgggttatttgtttcaatatgttttcattctcacgactttagcaaaattccttagcgctcactgggtaagaattcagcctgctaagaattacttccatttaccagaaactgcctttttctcttcactttacatttcccaaagcaagacaatgttttgatgttgtcacatcaacaaatatgtattcactgcccacaaaggctctggaggaagctgcagcgggaccagcagaagctacaagcaatgagaatcagaagtgagttctacttttggttctccctctcttctgaggaagccttcacttaacccttccatgtttcttgaccttcctttgtaaactgtgatcacctcttgtgttcccctcctagctgtaactcactgaggt

SEQ ID NO: 42824 - DNA, 1119 bp, Bovine  19866880986649
gctgtaccactgggtggatttttgattatcctaggacctcacatatccatgccctaactacaatgtgaagccttgttctttgaaaagacacatttgactgtgtcagaaagaacagctcagcagtagaatcagtggtgtatctccccaaattgtacattttaaattgataaccctcctctgaacatactttctattatgtcaaaatgacccagagtaaagacttattcatttatgacaagtgattggctagatatgttttcattaaactggattgtatttagtacatgtgggaagagcaggtataagtggtaaaaggtgttttttatcatgaaagaacatattttagtagaccagagttgctggtaactatgaaaatttgattccagaagggtttcattcagggaaaaaatcatcttgaagatcaaggaaatattgaacattcatgacaagcagctttctctgtctcctagggtgtgtgatgggaacgggatcagagtgtactgtgattgtgctgcatttgagcaaggaccctgaactgtctgcaccaggacactggaggtgtctattagctccggttggcccggtgagggtggaggagcagctcccatggagggcagcgcagaaagctggctaagagtacagagactggggtcaaacatttttgtgttaggatctcctttacctttcattagatgagcctctactaaaagagagagtgggagagacagagagagtgggttgctggggctggggatggggggagagagagaggttgagaaagagaaggagactgagagagagactctgagctgagctgaactaagaaaggcttcctcctaacatttccagaaagaaatctcttcatatcagaggcaaacacctgtgtttattattaaatttctggtcattactgagaactatgcggaaagtaagttatagttcataagaactatacatgaacatatagttcataagatgctatttatctggtaatcatagtatatattttactaagaaaaacactcagcaaaccatatatagcaaaggcaggtgctacccagagaagcaagtttctgtaaattatctgactgtgtaagaatcatgtaacagcaagtcaca

SEQ ID NO: 42825 - DNA, 1953 bp, Bovine  19866880996306
ctgtgaaaatagctggatggttattgatcccctttattagtcggcattgacccggatttttgtaacctcggactaggatgtgagggcagagtgggcggaaggagactggttctttccattgtttaaaaattgaaatggcttttaaacaagttgctgccattccacgtagtgcccagctgctgcgtgggcatcttgcttaaacacagaaacacagaaaagctccctgtcatcattgccttcacacttctactcccagtctgttcagaatatgctctcctggggcactccttggctttggagtgttttgcagggaaggaaatgaaggccattactaatgagcagcattactaggggcagcaaccttgtgctgagtcctccataacccagcccctgggcatcgagttggtgctctcaggccactatcatgaaaagcacgcaccagcagggggcttggagccagatgatgggaggcctggcagcctcgggaaaagacaatggagctcatgaagaggatgaacagaaaccaggactttcattccagctctgccacctgctcatatgtgagcccatgtcttctgatctgtgaaatgggtatcataataccacgtggcaaagttgtgaggatgcagcaaatgacttgtttttggtaaagcataatgtgctgggcaagtctaagcaacacttgtcatcaggggaaatactactgatgctcttaacctgccaggtgagttcctgatagggtcatatcccaggcttcccttgctttcaaagctgcttgcctcactggactgctctgagtctcatagacctccacttgtctcttacattctgaacattctgctcttgacttcccagtctaacagtcatttctgcaagagaaaaaattgttttttgctggtttatttttacgtggaacattgatgacaatgttgaacttgacttgagctccagattcctggaaaacagcaacatttaggaaatcctcctacccttttgtgttcctgaacatggtttactgcaaacctcccacccctgcctcctcttaaatgttccttgtgtttacctttggcaagaccagattcctgtcctttttctcgtaaatgattagctgaaccatttatccccactgaccaatctggataaaatgcttgttaattcaactggaccaaacttaagtctgacttttcttctgagaatcacctgaccttaaggaaaacaatttcctgtccacctattcacctcactccccacagggcattccagccttactgtacttctccccaaacaagtgattcttttctgccctcactatgggggtgcttgcaggtattttgatcagagtgctttccctattacaatagtgttttcaaataaaatctctccttacctgagtctaggtttgtttctgacagtagaaaccccactttttttttttttttttttctggtttcctttcctggatcccgttcccttgccatccttaaaatgttgatgttcctgagttctgcttgcataaatcccacagttaatcccactttgaataatgaaagaggaggagggaaataagtttcagataatttattataatgatagtgatattaaccttttccttaatttccttaggaatgttttccttaatgtttgcatttccccaaatgctgatttcgccttccttgctatgtcacagccttacttcctaaagagtcgtctgtagttctaacctcttttctcactttcattcactcttgaacttgctgctagttttcctcagctctcccatatccatctctccactactgcactaaaaatctgttagccattgttactgcctacatgccaaatccaaccagacatctccatatctttatcttttttttgtttttttaaacctctctggagcatctgacactggtgggagaaaaattaataacttggtgtgtagattccctttgg

SEQ ID NO: 42826 - DNA, 1384 bp, Bovine  19866881016238
aacaatattgcataggaacctggaatgttaggtctatgaatcaaggtaaactgaaagtggtcaaacaggagatggctagagtgaacatcaacactttaggaatcagtgaactaaaactggactagaatgggtggatttaactcagatgacaatgtagcttatgtaagacagtttaatatgagagcaggtcatctggtttttggcttcagcaggttacaaactttaagaaaaagtctgtctaagatgtaggttataacatcttccttcactgtaagcaagcattcacaggatggaaaaactgcctggaatttctcaattataggagcttgcatgcgcactcatagccacttctgtgcaatataaagtccctggggccaacatgccttcttgtttctctggctatttcctaccaaatagtgttcccaagtctggttgcctggccacacagcccaattggtttatcttacattccttgactattgtaaatagaggctcatgggatccaattattattgtttcttcctccctgatagagttattagacctgtgagctgtgggcagcctctacaggattcttgggggatacttcaatacaaagattggagttcagcttcctatccagggataaggtaaaaggacatcaccagaagagaaaggcttgaactgcctattaaagtgtcagaacccctagtaatggtgaagtaagatattactttccagatttttaggttagattatccacttaaatcaatcattttaccttactcatttactccagggctaatctcttttaaaatagtttagatgactttttcttttaagcctttgagacattctttttctttttttcttttttctgtatatgaaaaaatgaacatatcatggaattgttgcttattagtctctgcatgaaagaacaattaagtgtttgacccgtcaaaacacatgatgtaatctctgaagctctttctgtacctaaggatgacttgaagcttgctgattgggcattcttaagttattaggctacactcgttctaagatttagacttgcatggatgtgaggaattggccatacttaaacatcactccaaagcatgaatttcactgtgtgaagtaggacctgagatactgattcattttattgtttttagttaagttgtcctcaatttaaattgactagctgggttatgtgagctttgtgcagtatcctggagcttgaattagctcttaggggttgcaagtgggaatttaatgatatccagtaaaacaatgacaaaacggcccaatcaaggacttcttgaggcttttgcagatgattgtaatgctttttcagtaagaaaggccctgccagctagccacctaattaagcaaaatgacttgtctg

SEQ ID NO: 42827 - DNA, 904 bp, Bovine  19866881107367
tgggtaatacagcttttctcagaaagcccaagacaatttgcctattttccttatggccaaatggaagcatattagggaactagaataccctggaagtcaagaaaatagccccttgggataaagacatccagctctatttcagaaagagagagacaaagaaaggacacacgcagtgcacaccagagcctatcctgaaactggctctgaaagaagaggataatcatctggggaggagaggcagtgtgtcccccacaacagtgagccatattaacatggagtttttcatgtgatgacatgccatagtgttcttgcctggagaatcccaggcacggcagagcctggtgggctgccatctctggggtcacacagagtcggatatgactgaagcgacttagcagcagcagcagtactaatagttgatagatttcttcacccactcttatcccaccccaggtgaaaataaagagtacgtggccagttcacttgaatgtttatgctactctttaagttttttcagcaaagagattgtgccaggtttctggatggccattcaggctaagtgtactgcaaaactatccattcagtggcaccagaacccatgacacattaggaaacatctttaaactttggcattatttccatgaaagcctaatgtgctgcagaattcaagaatgttttttcccttctgcaaaatgttcgcaaatagtgtaggaattattactccattgtatccactaggaaactgaggcactgattaagtgacaaatccattagaggagctataccaactcatgcttggaaatagtacctcattatgtggaggctaactttgaatgtgaatagttggagatgtcaccttgtgtcgcgtctaagcagccacaccccatacagtgctcaccagttt

SEQ ID NO: 42828 - DNA, 1013 bp, Bovine  19866881111750
atttaccccaaacaaatacatcgaggcaagcccatttctccttctcaggttcagagggttattttctctgtgcacattggaatggcctggaaagtctttacctctggagttatgcttccagatttctctttacttgggaattgaagcaaaagagtacacacttaaaatggttcaggagaccatgacgcaaacattttgaggtatttaggaaccatgggatgtatgagacacacacaatgcctttgcatcttaactcaaatccagtggcatgggcttccctagtgactcagtggtaaagaagctgcctaccaatgcaggagacatgggtttgatccctgcttcaagaagatcccacatgctacagagcaactcagcccgtgcaccacaaataatgagcctgtgcgccacagctagtgaagaccacaggccctagagcccatgctccacaggaagagaagccactgcgatgagaagcctgagcaccacaactagagagcagccactggtcactgcaactagagaaaagcccatgcagcaacgaagactcagtgcagccaaaaacaactaactaaataaaaattatttttaaaattccagcagcgtgtgaatcccactttaagcacaaggaaggtatattgccttcatttgttcactttaaacgaccctgagtataattcacactgaagttgctgtgaaggaggaagtaggatagattaacctttcggtgccacacctggtctccggatttcccaacgtgttaatgaatttcctgagatgggagcgtcagacctgctggcagtacattaatctgagagagcatgcagcaatacatcctccagactcaaaggtgggtgaaccaatttagaaaatgttaaatcaagtccaagccgttccctaaagacagtaccaactgcaaagcccaaagacatctggaaaagttactctggcacagcttactcagttgctgctaatttctagcctactttcttcattgcatctagaaaataggggat

SEQ ID NO: 42829 - DNA, 809 bp, Bovine  19866881115525
atttaaaaatgtgaaaatatatttgctctcagactgtgcaaaaagaagcagcagctgtaggattctggtccttgtagacaataaatgttaatttagtgatgatatctcttttctcagattgcatgatctgagtgaacctgcatcagcctgggactcctaacaggtgagttatttgaattccattgtatgttaaaagatcctcataaataatattacccctcgatctctctatcccactctcacaccctgcacccctctctcccttctctgtctctatctcattcttgaaagacaagatgggtttaatggcaaatgtgccccaaatacttccagcattaactattcatgctattaataccaaggtaacatagctgatgacagcttttttcattgattcataattcatgtccctgttaaagggtatctgatccaatgatttttatgtatttcattctgaatatgctaatcttgtcagactacataaaaagaaaaccataacttatttctttctttactgaggaattaaaggagaaaatgcctctgctgggggtggatgggaaatcccaaggcctagaaaatgcctctgagtctgaatgatcaactcctgttcaagtcaaaatcagactgcctcttagaaaatcctgctcaagtcagtgatggctgtcctatggcatcatggtaatatttcttatgtactagcttcacagagtttcaagagacagctttcttttacaaatatacttcaggaagtggttgtattttttaaagcaatttttaaaactctgtttaaagaacaggttcatcaacgg

SEQ ID NO: 42830 - DNA, 1128 bp, Bovine  19866881127931
ggtttgtttgagatttaaatgaattagtacatgttatttgctaaaaagagcacctgacacatagttagggcttaataattatttgtaaagtcttgaaataaaagtatccattcaggtagtttaagcagagatagataaaccaggaccattaaccagcattggcaatcactctgctaggacagatcacatcatcagatatattaggtgctctagaccttaaatatgggtctgtcctaagttgcttcagtcacgtctgactttttgcaacccgatggactgtagcccaccagactgctctgtccatgggattctccaggcaagaatactggagtagtttaccatttcctgctccagaggatctttccgacccagggattgagtctcttacatctcctgcattggcaggcaagttctttaccacatgctgctgctgctgctgctaagtcgcttcagtcgtctctgactctgtgtgaccccatagacggcagccccccaggctccgccgtccctgggattctccaggcaagaacactggagtgggttgccatttccttctccagtgcatgaaagtgaaaagtgaaagtgaagtcgctcagtcatgtccgactcttagtgacctcatggactggagcctaccaggctcctaagaacataaaagttagataggattttgagtaggcataacttaagtgtatttttatatacctgagaaatgaactccctggaaatggaaaatccattacttatctttgcttccagaaatctcatccattttcttgggtcccttttattcttgctctctttgaaggccaagtccacactagtaactcttggatagtgatagttgaagtattggggttgaatttcacagtccttaaaaattgaggaattgaacttaatttgaagctgtatcatgcatcttgattggaatgacaggaagactagaatacgattatgatgaggtaaaattgtacaatatttaggatcaactgaatctcattaagaatgaactatttgtgcttaaaaccagctttaatgaaaaagttattctcattactttgcaacagtttctttctgaagattttcctcctctgttgcccccttttcctttcttgaggggcatatctg

SEQ ID NO: 42831 - DNA, 1594 bp, Bovine  19866881154337
tgaaaatgaacttgaaaccctatgctgaacaaacaaacaaaaaaatagtattaatgggtgacttctagtcaagaaactctgtcctttcatgagaaattcaagacagcaaggctagtttccctaaatgcagcacattcattgcaacctacaaagcccctgaaataatgccaagcttttcctcttctgtgaaataaaaaaaaatgtccccaaaggaaagaaaaaaaaatgtgactgtaaatgaaattgaaatatcctttcaaactgttgcatataattcctttcagcttaacattttgccttatttttttcaccaactgacagtttaggtaataacttagattcaactcacctgcttttaccagtgccctgtgacgctatagaatgacaaaatcaatctgtgagtctcaggatttgagagaagggtatattctaataatgcttcaagggttgaccaagaaaatcccgaaaattttggtcttctcttcaaaaaattactgtaaataagttcagtttatgaacctttaaaatttttttttcctgttaactccctgaaaggtttaaacagtttttgataaccattatcattcaaactagttggaaatacctatcaaaatgcaaagggttgggttcactgttcccgaaactatgggagattagatatcagcagttaattgcattgtcatgttaaatatttatttcttatttttctcacattctgaaccactttagtataagtggcaaggatctaataaagcataaaatcagaagtttcaaatatgtagccagtgcaatgaaagtcagaaacttggaaaaccaagttgttgcaaaataacgtaaaattcataatgggaaaaagaggcttttgccccagtcatttaaagaccttttctgaaatgcatttgctattcctccaaaatcattttcctactatttgtttctagatttcccattatataaactttcacctttacttaaattattgtgttattggaaatatttttaatcttgaggataaattttcttaatgttctagattatagtaaaagggtaatatttttgtcaatctcaaataccaaaatcaaataggaaaagatcaaacttgagatgttcaacagatgatggccttggcatattctttccagaaaagactgatagaaaaaccatcatttcctgtctgctctcacctcactaaactcccctactcctcacctttttagtattcttttggggagatttcctttttacactggaacttttgccttggaaatttacaatttcttaagtgctgtcatttattaacatcatttcaatgttgcattcttcaacactatgaagttgatactatcctcatctttcaccttggaaactgaaacctaaaaggttaattgaattgctcaggatcacatagtaattgaccaccttgcaatttaattcttcagacctgattctaacttacctagaatgttgcctgtagtgtagatcttcacaattttcaagcagcaatataatttcttggttcctgtcagcccttccttctttcttgtccacttcctttgaattctcagctttcacccatgttcaaaagactcatatt

SEQ ID NO: 42832 - DNA, 1412 bp, Bovine  19866881218195
atgacttagtgactgaacaacaacaacaacaacaaaatacctacttggctttttattggaattacttagatcaatttgaagagagctgccatctttccaattcataaatatacctttccatttaaaatttttttctaatcttttattgctgatacaaagaaataaagttaatttgtatatataaaaaagatactaggccactcacatagggcatattaagggaatgtgatattagttttgtaggatggcaaacacctacactcagcctgtatgagaagtagaagttggagttggggggagggactatcttgaaatgagtcattggtatacgcttatgggaagggaagtgtccttgacctcaagtcaagaggaaagggtgatgagaaccactaggagagttttggcccatgtcccctgtggtttaggagccacagggccttatgtcctttttctgttctttgagtccatgtgtgtgtgtgttctaagttgcttcaggtgtgtcaaactctgtgcaaccctatggactgcaacctgccagactcctctgtccaaggggttctccaggcagaatactggaatgtgttgccatgccctcctccagaagatcttccggaaccagggatcgaacctgcatctcttacatctacctgcattggcaggtgggttctttaccacttgtgccacctgggaagccctctttgagtccattctgcctcctaaatatggttgttctgatagttgtcatgtgtccatgttaagatggccactttgtataggctgatgtatgccagttgctctgaagccttgataatgctaactgctgctaattcacttcagtcgtgtccgactctgtgtgactccatagacgacagcccaccaggctctgtcgtccctggaattctccaggcaagaacactggaatgggttgccaactactagaaatgaatacacacatttacttttctttaaaaatataattgataatcaagaaaatgcttttttaataaacttgtaagagttcagagtccatacaaatctatggattcttaatcaacttgatacaagaagtagcaaatatgaacaaaatatgttccctccactttggaaattgattctttggagagatttagcctcttgatgaacccatattatctttttactgttaggaaaaaaccattcaatctcattgaaaggagaatatataatactgcatctgggaagaaaattagatgagttagagcttgcatggtgtagaaatgacaatttttgattaacaaattgtcagcatgggggcacattccttcaattttcagcaatttgaaatcccagcattaatcagcttttgctgaatgccacccactgttcatacagcagtgaggaaggcagtaatgaaaaattgaagaactagcatt

SEQ ID NO: 42833 - DNA, 1422 bp, Bovine  19866881295659
taaattgaactacctaatgaagtgactggggagaagttagaagggtgtctttctacacagactgtgtgtacacagtcacttgggactgtttcatagaggctgcctgggaagccttcctataaacctgaggttaaagcacctctcagcatgctccctaaagtgtggctatccttccaagaaggctctatctgaatatggttcatatcatggacttgactccaaagcaaaaggtaggaaatatttgtgcatgggggaatgctgatttgaaacatcattttacttgacctctgggcaagtacatagactaatatctctgttctattgttgagggaaaaaagatacacctctaaagtctttagtaacaatatacaagatttaagcacctagctgaactctgaaataggcttttctctccctaactctctaacatgttttgtttccatattcatatacagtagaaatttatcaactacccctctatgctaggagattttctaaactttctcacttattatttggaattactctgtgcagtaggtattaggagctcttttataacccctactgtcacatagtaggttctcaaaaaatacttgaatgaagaaaagctcaatggataaatgagtatacaaatggctcggatagtgttaagtgatttgatcataatcacagaaataataagcaaacgagctggcatttgagttgaaaaaatgaggactggggtaattgtagactttgtctaaggtagtttgcccattaaaatattttagttatttaggatatatcatgagtgactttcaaatgttataaataaatgggactaatgttttctcacggattgtatttattgatgaaataaaatcttaagaaggatttctgccttacttccccaattcattggcaagtgagtacagcaaagtcataaacccatttcttggaagcttatgagtattcccactccttatcctgttcaacattctgacaagcagcttacttgtaaaatgtacccccaaggcaagtgcagcaaatattctgacagcaggataaccaatctctagttgaattaaggaacagaatcctctattacgtgaggaacacaagactacagaagaccatgaacttgttcccaaggagtgaagctacttgtctgcagctcgtgttcactcatgagagggcaaaatgtctgtacagaccttcaagctgacctcgtctgaccattcagagtgttgccaacacagaaccctgttgtttccataacagttgccttgcattccccagtaaacctttcttccaggaactgctgaaaattttgacctgaagctattctcagatatggtcacccctggaaaaatgccagagtacagatgctggacttccaagtgagagcttccagggggtgctctttgctcgacactacttcga

SEQ ID NO: 42834 - DNA, 1709 bp, Bovine  19866881336606
cttataatgagaaatggggattaaaatgctacctgatgttctagaacactgtctaccattcctcatatcctaaaaattctgggcagaattgaattggaaaagtcctttcagcacccattatctcttgagtttaaatccaaaatctttgccaatcccttctagggcactaaactggaagatctcttatctatctttccagcgtcatctctctctgggtattaatacatttgtcttcagccacacttgtctcttggtcttcctcaaacataccaaagggctcacgacctttggctttgctgcttccctctgcctggaagttttcttcatataattgacttcttcatcagtcagttttgttctgatatgacatttcttcaaggagcctttctctgaccatttttttttttttctaaaataaccttcctcaagccctgtttctctctaaccttttaaatattctttacaggatttatttcttccttttaaatcttctccacaggatttattactacttaattcctttgtttcctgtcccctctactggagtccaaggttcctgatgaaaagggctctgtcttatccaggccacaaggaagtagtcgtcgtctcatgtagggtgctaggtaagtggttgctacattaatgaatgctttgttcatcccttcactggttgaggggttctggataagtcagtttacatcttttaatcatagtttcctctttcatgagatttttacctagatttaataagataatgcctatgagaaaataatgaaagttgttaaatatcacacagatattaagtaagtattgttatttttccttctgaggttaactgggcctccaaacagctatcaaaattccttagattcagagtagaaaacaccagcgtttgctttgcacagcaaaaacgagtctctgcacttcagccagcaaatggaggtattgtgggaggcatgccgtgaggatttcccacctctaaacaaccacagtgttgagtccaaagaaaaaacaaactagaatgttgtaagactcatccccaaggatgccacggtcttttgtgactgtgtctgttgggaaggcaaaatctctaatggcattcccatataccagtctcaattacttcttgtctacaaaagtattttgtatttagctactgtttttgtcaacttagtcattattcagcttctgaagggtgcatgtaagaaaactgaaaatgaaaggcagtcagctcctactttcttagataatgacaataatcatgtggtaaattggtatattcttcaaggaaatatgtagggagattcattttaagcaacctacctgtattaaataggatctacttaaaataatcatacagctcagatggtcatgacataggcatactaagagttacatagaaatacttcaaaataagggtagccgaattctgcttttaaatctcaacaatgttcatataatacataggaaagaaaataagggagtaaattattagctgacagtgcatattaaatgcaaagtcactaaaatcttttcatttacttaaactgatggtattacaagccacgtgctaataaacagaggagaagcagcttgctgtgtatagtcactccttagtaaggttaacaaactacattaaccattcactcatctgtaactcataattaatcactcctcgaaaattacattgtataataaatgaggacaga

SEQ ID NO: 42835 - DNA, 720 bp, Bovine  19866881340076
tgggctacgagtcagtaaattaatatatatctggaatcagactgaaaacccaccatttacattgcagtgttaggtgtcagccttgtgctcaacattttcaggattattattattactgtattgtaaaaagcaagcaatattttagtcactaactataggccccactgcaaggacaccactatgatctattactcattaccatagattcctgggggcaaaggcacccgtggctgccactctgcccttgctgtccattacagtaaatatacatactttgcatctgacagttaaggattgccacctggactcttctgttttagaattttataatcctcatagatattagggagcccagggacatggcagcaactctaactaacacacctagccttcacaaccataactaggctctcaaagactctggtaccctccatcccagtatattctttattgcctaaacaaggtagtgtcccttgcttaatccccagggtacatagtcatgtgaatgtgatggagtctcagatattacctagtaatacagagatacattctgaattctctacgttttctgatttcttccttcacaccatgccaaggaagttctggcatattagccctgtttaatagctctcattgttgcttaccagatcccaggaaccgtgcctacaaattatcaccatcaggtccaaggattccttgccagaacatcaaattccagtc

SEQ ID NO: 42836 - DNA, 1012 bp, Bovine  19866881341053
tggctctcctgacacatccttgaaaacccagccaagatgctgtctcctccaagagcctgcctggacccctccagaggagtctgggtggatctctgatgtattccctatgaaccctggcttccctctcacagatccttcctcatgtatctgtctcttccactagcacaggggtatcactggatacccattgcagagcctgacataggtattccgttcatagaagcatatttcctttcattaggtagttgtaacagcctgaaatgcttctgaaataagatatttggttatcatgttacatgtctcaggtaacaaactcagttcaggtcctagttaagtacgtgccaaactggtgcagacagtcgtctgtactcttgttagtctgaaccatctggaattgctagtaattgactgtcactggctgagaaaaacggcagttccatgtggctcaatctatgactgtgctgtctgcattaacagatagcattctaattggaaaagatgtgctttccttcctacacattttagttgtttcgccaagtgggtacaagcatctgcatgcttttcttagggcaagctcagaagctgctgagcttttgccaccgctaattgatgatatgtgactgtccgacactggcagtgataattgacgctggctggtgttggtgcgggaagaggtgaatgacagggcgagggaagccctggatcccgcgtgtctctggtgcccgtgtcacgctcagcactgtgacctttctgcctgggagatgactcctggcagatggcagtgagcgaaagggcagcgctggcattaattaagtcaaaaaattaggcctgaataatttgggaagagaacattatattggtggtaaatgggattttgttggtgggggagggtacagaaggtttttgcttttgcagaatttccatcatcccctggtttatacacagcaaagaaattttcatgtgttggagaagaactttgtgtttggagggaaagagggaaaggaaaggaaag

SEQ ID NO: 42837 - DNA, 772 bp, Bovine  19866881422596
aaatacgttgccattagattcttctcaattgggcttggtttttctttttaatatttttatttatttatttgctgcatcgggttttagttgtgtcatgcaggatcttccattgcagcacacagacactctagttgtggcacaaggggttagcagttttgcttaggcttagttacgctgaggcatgtgggatcttagttccctgactagggaccgaacctgcgccccctacattgcaaagcagattcttaaccactggaccaccagggaagtcccaaggcttgctttaaagatgaagggggtgggggaagtgagcataaaagagatgaagaatgaggcaacaccaaactgactgactgattagaactgttaccttcatgcttttttccagattcagaagcattgccaagtcttacttcagaagagcagatggtgttttgctgctgtatgatgttacgtgtgagaaaagctttcttaatgtacgagaatgggtagatatgattgaggtaagaaatcaaaacagacaacaaaaaaattacacgggagagttataggctggatctcaggaaatgctgtttctcctttgtaaaaatgaactcagaaaccattgatctaggatctcagaaagaacctagatccactgatctaggctctcagaaagaacctgtgggaggcagggttcctaatggtacttggcagcactggtctcctcctcagtagcgggccagttcccacagaaccaaggacactaacaaagtgagcttctgagtggtgg

SEQ ID NO: 42838 - DNA, 1112 bp, Bovine  19866881579648
atttcctttaggtctgtaactgaacatgactgatggcgccagagtaacagttgcttattactgcgttcactgagctgtgattgctccaatacttatgttggcagatgtgtttccctaggaacagcatctccgagacagaggtcattgatcaaaccccctctggctgttccattatgtgcaaattattgctaaaagcagagaggctgcaagggaggtggtgtgtactcattgcagatatagcggagggaagtccaaaaaaaaaaaaaaaagcaagtgtaatgaagcaggaaaaaaattccacctaaactagaacaatgtttctataatgtgaattagtgggaaaaagggggaaattaagtgactttgagagagacacaatgggagaagagtcagattttattgtcctggggtaactctagaattgggcttgctgacagcatccttggcagctgtccaaggctagaaaggggcatgcgtgtggacacccagagcactgttgtcctaatagggtagggatgaagtaggttaagtggccagtacacagcactctcatgtctatttctggccaaatgtttaggaaatgctagagacactcagggatcatatgcagagacctcccttgtcccgcagcttctcagggaaggggtggaggtggtaatgaattgactgacttttgggaagcacttagatctagactgtcctttgctcaggctcgaaagagtgagaccactgagttttatgctcagctgtagcagcggttcttctcagcagatttctgggaaggataaatgcacccctccccgctccaagtggggatctgtcttttgctgaattcagtgagaccatgggatggctcaggtagagcacatggactggacacacagcaatactcccatggtgctgggccttctgggccacagactgctaccccacttctcacactgacttgctttttgattggtgttggcaagactcacctttctaggattgcgattcagttctctttatctgtaagatctttccttatgatgaactggatttttcctagggcttaagacattcccttgacacatattagagactttaggaacagtgtgtgctaattcatatag

SEQ ID NO: 42839 - DNA, 891 bp, Bovine  19866881797919
cagtatatagtttagcacttgcagaatatcttgtaattaaagaaattcttcttttcccttttagttatgtcaattactatgtaatagaactttgtttaaggccagaccctggtttcatatgcttgtgttcatatattgggcttattacattgaatttaccttccaatctactattagtagaatagaacatatatctttaaaaccatcaacacatcaaagtaatagaccttgtaggccccagtaactgaatctaagagagtagtggggacagtttgtttttttcttcctttatacttgattttgtgattataaaggcatggactttaaagtggatcaataaacaaaatagactcttaaagtttatggtattgaaattcctaggtaaaatcctatttctgtaacataaaacggtgttgctccttcatctgagctcatcacttctcacagtctatggcgagtggtagaagaaacagattcccagagcattcctttaagaattaacatttgtgaatcatcacaattttacttggggaggtaggcaggaaaatgtatatttaaacaaagtgttttcaaaataagtgattatacacctgcttcagggattagcaatacctgactacagacaaattagatgtctggatcaatagcatataccgtgaagccaagtgttaagtgaaggctaccttctggatctttctgttatattacagtgatttcaaataacatggtccattctatcatggtttttcaggcataggttggccagagcaataagtatcaagccattcagttcacttcagagagcacttattggaaacatgagacattgatttgtgtgccaaacagaagtaaaagtgagtaagacagagtccctgacttcaaagagcattg

SEQ ID NO: 42840 - DNA, 1016 bp, Bovine  19866881936731
aaacatccttatggtcataacttttgggtgtttcaactggattatagtaagacaatgtattttattcagcagatttgttttaatctaattatgtaggtgaataaaaattactgcatgctggtgcatctaatgtaagttatctattattcacaccacatttacttttaatattcatgcagattccctttgacataacctactgtgtcacagttaatccaataaagataaaatatagctcagcaaaacaccagtcgattccagctttctggtaattattaaagactatttcacactggttccttcaatcaatgtatttccccttggatatgatggctctcctctttgaagctttcaatcctcccagtggattcagaggaatactcaggccccttttcagtctctggtctcagaggtagttcaaagagcactacaaggcttcacaggtttatcctcaaaggctgacactgtctgtttgatgtatggtgacttaaaaagtcgtctctggcaaagcatgtgtttgctaccagtctatcgaatcagccatttatcaacttatctgtattcacccagcacacctgctaacagctcaaaggagaacacatactgtctctcgctggactgactattgatttgattccctcctctaattttatattgttttgctaccctgtggatgaagcagctcctttactggatgaaatcaacatggaatctgtgaactgatggcctttggtggttttattcaagagccctgagggcgacagattctttacaggttgaggacagctggcctgggggagtggatttcctgtcccagcatgccttgcttttcactattatctacatctcaggtatttcactgtacatgccttgctaggaatttcagggagatcactaggaactctcaacctcatcatcagaagctggacatacccaatgtctacccaatgcatgcaaatagaaccctggcttgaagatagggatacaccaaattcctctcagtttaaccatttcat

SEQ ID NO: 42841 - DNA, 1298 bp, Bovine  19866880349430
acttctgaatttattattttaacatgacaattaaaaaaataatcatccccacaagccctagtccgaggctgaaacaacttagaatgctgtcacaggatgtcagagagagtccttattcgagtcattttagctgttgaagtacctaatttcaggtaaatctaccggcctagctctgtagtttactgaaaaaaatgagagggcaatatgaacatgaattcactgtggtatgacccgttgtgaaaagtgtactgtaaatcagaaggagggaaatacacattatactgtgcgtattgataatttccttatttgaaaaattgtactattagtaaatgggcacttaccatagaaagacttgttaaaggaaaaattctggaagaaacaaaaacataattgccagaataaagtaataaaaccttcattaacttgaattcataaatgaaagaagaattctgaaatataaatatagaaataacttttaaatatctgttgacataaagcaaatgaagaacattgggctgtcatatgtataaatgagattatgcaacctttgttttcctctctgagcaggttttctggccagcatctgcaatcaaagtcgaagagtgcaaaatggctggcaaagatcccacagtgagtgcttaaaaaaaatccaaaacttaaatatttggtctttgaattcatgtactttgagtgcagccaaaagtgagacaaagggtgttggtgttctgaatcctctgcaggacatatggtaaaaaatgtaaatgcaaaatgatcggaactcttaaacactgtaatttaggaattcctgactgggtaaaaatttcctgctttgcttttattattgcaccctgacacttttcatgatggattttagtaataacccctgttcaaagtggatccaaccttcagaattctcagcatgctgctaaaataatgataattcaagtgtctggagtagctcccagatacgatgtgggcttttccaaagaaagattctcggcaaagggttatggttagccagcacattccagaggtataaatcaccagtaatgactggtatctttgtaattaaaaataaccacagaaacaaaaatcaagagggatataagaataagtaagtgttcagtgtgcaacacttttacaaaatgtattcctttaggtgagatttcatatagagagtcaaggaataaatctatatttatttctacaaatagcttgctgaaatggacacattaaattattcttgaatattattttcaaaatggagcaactctttacgtgcacaagtcatttaatgg

SEQ ID NO: 42842 - DNA, 1839 bp, Bovine  19866880388375
caacaccacagttcaaaagcatcaattctttggtgttcagctttcttcacagtccaactctcacatctataaatgactactggaaaaaccatagccttgactagatggatctttgttggcaaagtaatgtctctgcttttcaatatgctatctaggttggtcataactttccttccaaggagaaagcatcttttaatttcatggctgcaagaggaatgtaactgatggtgatagtatttggtgatgtgaagaacaaaaaggaagacagaggtgtaaaagatatagtcaaataaatgactgcttcattgagcagtagtcacctgggggtgaagtatatcaacataagtggggatagagaaaaagtcagatcctaaaataatttctgagaaagtatcaatagaatttctttaataatgtaatacatcaatctgaattaaaagtaattcaccctttttatttctatgcctctacattgatgaatacaatcaagttcaattattaaggccaatgatcttctcaagaaaacaggtaaacaggaccatggatgacttctgtcctttcttaagtaccctttgtccagagagcactgaaagtgtctggagtaggattccttttcttataattttgattactcctatttggaaggaatgatgctaaagctgaaactccagtactttggccacctcatgtgaagagttgactcattggaaaagactctgatgctgggagggattgggggcaggaggagaaggggacaacagaggatgagatggctggatggcatcaccaactcaatggacatgagtctgggtgaactctgggagttggtgatggacagggaggcctggcgttctgaaattcatgaggtcacaaagagtcagacacgactgagtaactgaactgaactgaactgatgatacatatgttatcctagtatagcatgttttgtatatctatattgtaaagttgagaaaagctcaccttactgctctttttttttcctctctactttctaatatagagatgttcatatctaatagtaagaacctgtaagtcatagtgtagctttaagaagatgtgttactagagataaaaaacactagttggagtcaagacacctcacttaaattccctttttcagtcactcgctatgtaattgaagaatagtcataatatgaatatgtcttattagactgagagtgaaatccttaaggaatcctcatatgccattcaaatccagttttttttcctcttctagcaaaattaggagctacagtattaaatgtaaaatgttaaaatattgtttgatgaatgagtattcatgccaagtctgtgttccattcattacatacaatatcactgtttaatccttatatgattatatctaatttgcctatttatttccaagacttaccctggggctaaagatatgacagatgttcaacaaatgtttctttaactgaaaattcaaaccttcctggtttcagattcttcatttgtaaaatgagagtgctggaacacttgatttctaagatccctctgaactttgaaagttctataactgagcacagggtgggagttgattagtcttaatctcatctcagaggataatattaaactcataaccaatataaaaaagatggctggaaaataagagatttaatatgagtacatgttggaacatatgaaatgcctcattaattcatctctacagatttcctcaacaatatagtacagataggacttcccaggtggtactagtgttaaagaagctgcctgctaatgaaggagatatgagactcgggttccatcctggggttgggaagaccccctgaagaa

SEQ ID NO: 42843 - DNA, 3243 bp, Bovine  19866880458803
ccctggacaggacaggtcctgtgtatggagtagagtagaagacagaagagctgtttagaaggcagaatttccctgacctggtgactgggtatacaaagtgagagagagaaagagagataagtctgggatttttcctaggtatttcgatcttgaaactgggttaaagtattccactcacagtctatttttcttaagaatgagaacaagacacttagttgaagggcaataaggacacatgttggaagaaggtataaagtgagattaaagaatattgaaggaaaaaggaccagcccacagttaggtatctacatttctttctttctctttctccctctctgtttctgctccattcccccaaactcttttaacttttaaaagagcacattatatatttgttgccaaaaatattttatttttatatacccccaatggattttaaagtcatgacaaattcacagataataagataacatctgtgcacttagtaacaacaaagtaaacacaagtcagagtagtataactttagtggcagtattattttgtacaccatttagactcactagcctaaaaacaacagactttagataagacaatttatacatgagataaacaagagaaagcaagaagtattgctctgtatagtcttttatttgctagagaataaaatctgatgtctaacattgcagggcagggtgataacaaaaaagctaaaagcaagtttcagatttaaaaattctagtaccagatgggcagttaaagtgtccaattggctacaaacaataaatgataaaggaatcttttaaaaagatttttaaagactttaacttctttacaaaaaactccaaattaaatgatctaacattgaaaatatgcctcttaaatattacaaacagaataataacatctccaggaaaacttttacggagttaagactaattgggataatataaacacatgcattcattttatgttacaaggcagtccaaagaggacttacaaagaaaatacaaagaatgatattcatttgttactttgtttatttaagctctgatgctgatgagagcaattttaagccaatactgtttttgctgtcttctgagctcctgaggcatgctgttagcacttttattttacagcctattagatttagtcagttttcacttttcataagtctgtgaacctctaaagatggaagctctttaaggaagaaaacatcttatttttctatactccagaagactagcacagagtctccagaagactaaaagtaaacactaaaagaaagatatatattaaatcagtttgtgtactgaagactgtaatatgaatgaaaacattaatatcattctaatttaaccctgacacttcacagttagcatttttactagatgtgttattaattgattcttgactctgataattaatgatttatggaatagtttcaaggtaaagaacatgtcagaggaactggtaaagtaattttttcttttgctttgagattcaagattaagagatttccaatagcacatcagtagtaatattctagattcttatgttctgtattttaggtcccctgaagacatataatatgttctttaggtgaaatgaagtttaagtaaataagatttgtttactcaaacaatctttgcttagtaacttgagtttccatatccaatatacacttgccaggctgtagacaataaaattcaataaatgggatgaagacatttctcattttaaaagtttgttttcattttaaatttatttctaagaaaggcttttgttaagctgtagtcagcagttggcctaatttgactcttcttcagtttgagaaatgaggataaaaccgaaaattttaaacttgacttactgaaaggatggaaatacaagtacaacttaatcctcatactcaataattttacaatccagcaagagaggaaaaaaataataaataaacaaacacaaataaacactatgaatattgaaacgtaaaatcagaacaaagaaagaagcaatctttgggtgaatttcccagtgaaaattgtatccttctccttgaaaaaaatacaataaaattgtatagttatatagctatattatttattatttgtttgtagtaatctcaagcttatatacctaagctacctggtatgtattatcacatatgttatctctaccccttaccttccaatttaacatatcctaacatctgaaagattttgctactatttgtggaatcactcttcttaccacctcatttcataaatgtgtccatacaagtactagtcctgtgttttaaatcacactgagaagggttacttgaaagtaaaggtctctagcaatatctgctgaggtaaccaaattttacacaggaacctatctattggactatttacaaagtctgtgtgcatctttttcatttaatttacttttttattgaaggataattcccttacagaattttgttgttttatgccaaacctcaacatgaatcagcaatgctaatgctaagtcacttcagtcatgtccgactctgtgtgaccccatagacggcagcccaccaggctaccccgtccctgggattctccaggcaagaacactagagtgggttgccatttccttcttcaatgcatgaaagtgaaaagtgaaagtgaagtcgctcagtcatgttcgactcctagcgaccccacggactgcagcccagcaggctcctctgtccatgggatttgccaggcaagagtactggagtgggttgccattgccttctccgataacttctctagcatcttctaaattggctgtaaataaaaattcaggtctcagagatgaactgaatagaaagtactcctagaagtaagcacttcagagcaggttgtgtaaaacatctttaataagtttaaagttcttgaactggaatcaatctaggtataaggaatcaatctagatacagtgtgtgtgtgtgtgtgtgtgtgtgtgtgtgtgtgtgttagtcgctcagttgtatctaactctttgtgacctgatggactgtagcccaccaggctcctctgtccatgggattttctaggcaataatactgaagtgggttgctgtttccttctccaggggatcttcccaacccagggatcaaacccaggtcttctgcaatgcaggcagattctttaccttctgagccaccagggaagccccggtacaacatagtcaatgtaaaaaattgataacttcaggatttatgtcacagat

SEQ ID NO: 42844 - DNA, 1496 bp, Bovine  19866880519961
catttgcagagaacttagaactcttcttggaaaaggcaatggcaccccactccagtactcttgcctggaaaatcccatggacggaggagcctggtgggctgtagtccatggggtcgctaagagtcagacacgactgagcgacttcactttcacttttcactttcatgcactggagaaggaaatggcaacccactcgagtgttcttgcctagagaatcccagggacgggggagcctggtgggctgccatctatggggtcgcacagagtcgggcacgactgaagcgacttagcagcagcagcagcatgagctcttctgggccttcaaagatttctgtgttgaacaggtattagttgtataactttaaaatagatgttttaaaaaaaatacgtcttggagctcagattaatagggctttaaaaatatgactcttcatggtccatactacattttttcttcttggtctggggactgtatcaaggtattttgatatatgtattactaaagaaaatacattttcaagtagtttagggtcctgtggtcacagaaacatggaaattgatattctacaattaataaatcaagtttgacattgtgcatatgtaatgtatataggtctaaatatatgtaaccctgcttaattttttttaatgatctcttacagtatttacttagcacattcattatatcctatctcattggatatgtttgacagcatgtgctattgtttagggctcaatttatttatagtattaataaaatatcaacatttggaaataaatggagcatgtaggaatgtaaataaataggggcagaaagggaaattgggaggtaagttatactctctttagctgaggtagaaaataagctatattgctaccatgatattttattttatttataaacattagtttattatatagtattattgtgatattaccttgggtgaaatttcaaattatactgaattcttttctaatgaatgagcattatttttataactttaattaaaattagatacaagtaaaaaatataaagaagtaaaggatgtttgtatactttttgattgctatagaagtaggaaatctgttactaggttatgcttttattagtagacaactaatataatattttaaagtaaaacattaatttaaccaccatatatctttaaaattatacataatgaatttataaatttagtaagctaaaggcattaataactcaatatccactatgtcctactcccaacatgagacaatgacttggaatagattcccatgcttactgcttccatttctgttttttccagatcttgtttacattttatgaagtgcctagatacagatctgggcactagagataatgacatttactacctggcatttccaaccactaaaaatgcactgaaataagctctagagggtttcaagtgcacatacagggaggggcagctagcctagttctcagtggcaacagaagattctccagagaagtgaca

SEQ ID NO: 42845 - DNA, 2030 bp, Bovine  19866880535513
caaaaaaacataaatttaacttaaaatttatggaggaaaaaaatatgcaatggtttgctaactttttttccccttatctatgtaaacctaataatatataggctaagtaagggctttgtcttttccaagaatctgggtcaagatctttgtaattctatttaagtttcctcattaaaacattaactgaagtctgttgtttgtggcttcaatcataatttctagtcaaggataatttaatatcacataacttatacaaatctttttccacactggggaatttgccaaaagaagtttcagtaaaacagtgaaagcaaaagcataactggagagagatcagaagaaacaggagaataggaggtaaaatcaatgactatagatatcttttgaagagttttgctttaatagcagcaaagggaatgtggggtcaagagctttttactgtacttgtttttgctttttaagatggaaatatgacattttgatagataatgatcttgtagcccttgatcttgtagggatactggacaaggactgagtggcaaagtggaacaaaatccttaagacaggaggcatgctactgggaaaagggtaggtttaaccctagcacataaacttatctttggtcaaacaagattgtgtagaaaaggatatggagtttgaattcaatggatcaaaaatcagaacaaattttaataactaatcaggaagtgggatctcagttttagaaaattaagttataatgtaacttttgataatcataagttccagaaggtaacaaccattggagtgactgaaagatagggcagaagaaaaagtcattgaaatgacacaattttaaagagaaatgaaagatcaggtgctggatgtgccagccgcatggatgttgatattgtcaagaatgatgctgtctgggcagggagaacatgcttataaggcaaaagcttattagtgagtgaaacaacaatgagtattggtagatgacataaataagaaggttgagaagttaagagttaacatgtaaacctcaaactgatggcagcatttcaagatggaggagatggaatgttatggatgactccttgtggctctgaggtcaacagctgatctttgaaaaacaaagtacagcgtacagtggtgtaaaccagatgtagctttggttggaagatcgaagcaactctgtagtgtaatcaaagatctgtaacagcaggggtatatgctcataaatggaacagtccatagtatcttcaaatgcctggttttaaaacttaacatgtgtggcagaataaaattttgtgataaactggacagacactgttgggtaaagccatggaattctttggggtgagtaaaaatcttgagagagagatacttcctttatattagtagaataatggaaatttttagttatagttgatatttctagtccattttttctaggtcatcaaaactctatgtataggtatgcacttatatattttattatacaaaatattgacaaagatcagtcattcttgatgatctcatgtttttgtcataacagaagcatatgaatgctgtgccaagcaaagtggtcagatactcacttagtgaagtgaatatttattctctatcacaccattcactgactagtcattcacagttactttcatcttaactagtttattttgaagaaataagacataaccttattaatgcttttgattttttccctcaaagttggaaaggggaaagtctctcagtcatgtctgtctgtttgtgaccccatggactacatggcccatggaattttccaggccagaatactggagagggtagcctttcccttctccagaggattttcccaacctagggatcgaactcaggtctcccacattgcaggtggattctttaccagctgagccacaaggggatctcttatttcaatgtaaacaatttattgctaagagcatttgtcacttgtattttattatgcatgttctcttgattcaccatggggaaaatacattatgcatctgttatgaactgctatt

SEQ ID NO: 42846 - DNA, 2551 bp, Bovine  19866880594959
ctgtaaatccttgtagtgttacctttccgaaactagcttaattgactgtgttaaagtatttgtcactgagtcacgtccgactctttgtgatcccatgaactgtagcctaccaggtccctctctccatggaattctccaggcaagaatactagagtcagtagccattcctttcttccggggtcttcccctcccaaggacaaaactagggtctcctgcattgcaggcagatactttaccatctgagacatgagggaaggccctcaattagctcaagttatttcccacctatgaggacagggtcaaaaactgcatacaagaaaagtggcactggccagcagtgtttcttatataagtcctgtcaaggttttttaggcttctaagtagtttgggaaaagaggggcagagataaatcttattatggtcacctattgaccctcttaaaatttcactatatggcccaagtttcagtcaaacatgagaagtaattgtgtccttgtgcttgaatctgacttgactaatgcctatcaatattttcatgactcattttgaggtgtggtcaacggtaaatgtctgagtcctgcgcaaatactattaatgtctcagtactgggcaaatactgttcagttaaatacactgaaagaagtttattcagcaaagaaagagagaatcatagaacaagtttcatagactggttaaatataagctatttgtcataccctctaaagccttttgaaaaattgagatgattcttgcagctttagtaaagtgagtttggtagtaaatttggcatgcatttcaccttgcatttctttatcttggttccctgtgtaaatatattctactttgcataggtttacagattgctactgctaagtcgcttcagtcgtgtctgactctgtgcaaccccatagacggcagcccaccaggctcccccgtccctgggtttacagattaatcagtgtctaatggggcttctctggtggctcagcggtaaagaatctgcctgtaatataggagatctgggtttgatccctggaggagggcgtggcaacccactgcagtattcttgtctggagaatcccgaggacagaggagcctggtgagctgtagtccatagcgtcacacatagtctgacacgactaaagcgactaagcaactgcagcagcaagtgtctaatgactccacattttgaaattaaggattatacagtttgttaatgctcactgcattcttcttgctaatgatttattctttccctccctaatttacaaatgctgaaggatatatacaaatgcatcagtaggaaagtaatagtgatcactataactcggatcttaatcagtttcagaagtatttcagagaaaaccacgcatagtgtttactcatgtttacatctggtttctaatactgtcagatgttttgtcagttaaattcattattacagacatgtcaaggagctgctcacatttttatttcactaattatcgcaaaaataatttaattgtattagatttttttaaaagaacagatctacttaatttgaaatttctttcataaacatagtttgtgtctgaagataatattggccatggaatataatttttgaatacaagtttgcattcttatttggcataatcccttcgtatctcactgcacagaaaaagttagcgccataacatgtctacataagaagtggtgcttagatacatgaaagatgtgtcttaatcgcttcttctcttcctcctagtgagatttagctcagctgtcccactccatcaaagattttgcactctcagaagtattttctatgatagtttataagaatttagtgatctaacttacttcataaagaaaattatgagaaacacgggtggagaaattacactccatgttctctctgtatagtgacatctactgggctgtagctcacagtgatttttaagcaagtacctgctcattttatggaggtggaagctcatttctccccaagtacaaatatctaattaattgtgatccagagaaataattctcacttaaacatcaacgttagttccagaatttaacaaggttacctgaaggtagtgctggaaatatataccccttgatgtctagattcataacctctgttggcataattcaaaacaggcttcctctacacaactgtgaaataatttcttataactatgttttgggagtatcccggaaagtagggtattgtatatgagtgactgtggagaggtcgacaaagttactgctttggggacattaaggaagcacagtaggaaacaatacctattaaaaggataaacttctgcgatgagactgttttatgtagaccggttttagaaaacgttccacagggaaaggacgagactcatgccttttaaaaacccatctatttgccttaaaaggatgctgtgatccttttctagcaaaaactgctttgcactttgatagttaaggccaagcttaatcctgaatgccttcccagagcagccggtaacaaacaaaaacctggaacacaccctgtaagtgctcactccaccgcgga

SEQ ID NO: 42847 - DNA, 1847 bp, Bovine  19866880658406
gtagcttacaagttctgacatgatttttttctgccttaaatgaatatatctttgtagactgaatcgacaggaggaaaaaataggaccagaaagacagtacatggtgaaagatgaggaaaaaaggcatagcaaaatatcccatggccaaagatgtccataaaggtgctgaaaaatagagggcattacatgttgtagcttggtctaggagaaaacatgctgattaggggagtcagtatgatcactgagagtcctggttgttaggaaagagttttaattagtaggtgaaaattaaattcagattaggaaggtttaatgcaagatagggaaaataggaatataaaagctgaaaaatagtttactagtctgagaagttttgtgataaagtaaaagagagtgaaaggagagggttggaaaaaagtcacaggaagggaaacctactgttagagaagaaaaaaagagtaaatgcaggggaaaggaaagaagatgtaaaacagtgatgaaggctaaagattaaataactttattagtgagaaaaatgcacagcttttcttctgacatgagaaaaactacaataaaatgaagaaaaagaaaagtttggtgattaatttgctttaaaaagcacaaggaataaattgaatgcctgtgatattcttgattggtcaaagttatctgattgatgagctgcagcatcaggagcttaaacagtatttattcacttatgggaactgatgttatagatgcatctgataaaaccaatcagagatgagatgtaacattttaagattgcacggcaaaattaaccaataattgtttcttattaatgttttattcattatttaaagtcatcatttacttgtgtcactttatttttcttccaggaccagaagacaggggataaaagagaagaaccatgttaggaatctatgcagcaagaactgtagactctttgagaagcatcactgaaggctctaggaaagcactgactcagttccacaatataatggaagggccatagagtctaataaaagtatgtgatgttccaaacatcaagcagggttatacaatatcctttgagaaccaacaaattgctattagacagacaggtaaaaaggtggtggacagtgtctcagaaataaaatgtaatacttaatgagtgtgccaccctaaccttcattttcaaagtggcttcaagtacaagaaacatgccatatcttagtacaaacaggatgttagcagtaagtactgcctctgatcactacaaaatacaatgttagtgatgaataaatagaactctctcaaaatacaatgttctgcatcatggccttttattttaaactaaataaaataaatacattaggtgtttgataaaactgtgcattttgtacttgtattattaattacgtattatagatatgtaaatacgatgtggaaaaacactgacttaagttgactattaagtaaaacatataaagcctaaaattttataacccttttcacacttaaatatgctcttaagatatttaaagagattaattaatggaaatgctttccctttgaaacatatcttttgaagtgagactgaagtagttcttatttagtaaagtgattaaaatttgtttcatgctggttttccaaaggagattactttttggaccaactttcctattaaggcttgaagtgtatgttgggcaatttgtacatgggaaaatgattttacttaaaaatccgtcctctgaaaagtgctatgctatcactggcctataccatgactgcacacccttctcagtggagtttctgacagactgcagatgtctggggaagtagtttatttaatcagtgatcacaga

SEQ ID NO: 42848 - DNA, 2786 bp, Bovine  19866880921093
ttccccgtgtttgcattcattgctacacattcctctcaaggttctatttctccttgatatgtcattctttctagatatattacagttcttggtaaactcagtaaatatttgtcaagatgaattgaaaatcataactatatccattgcttctcatacaatgaaaagaattcataactgattgcagaaactaatttttgtttgcttaaaaactgttttcaaaagatgttgtcttcatataaataactacaatcttttagccttgattcagatcatctactgtggagtttgcattttttaaaaaaactttttttcctgaattggtcgtttagagttacacctgtccttaatgtttcataatacttaggaaaaaatgactgttttcttattttccttttgaagccagtcttaaaggtggacccttttcccagttttattgagatataattgacatacatcactgtataaatttaaggtgcacaacataatggcttgacttatctttatatattgtgaaatgataattgcagtaattttaagtatccgtcatatcatatagatacagtaaaaagaaagaaaaaatacatttttccttctgatgagaactcttaggatttactctctgaacaactttcatatgtatcatacagcagtataactatagtgcatcccctaactgctcacgtgtaccttatatcccaagtacttatgtgtcttataactggaagttttcacttcatttaattcttcctctccccacctctggtaatgaatgtggtttttcattttgtttttgcttttttgttccatatataagtgagagcttagcataatgccctcaacttccatccatgttgtcacaaacagcaagatttaattctttttatggcagaataatattctgttgtgttttaaaccacacttatttttccttttttaaaaatgaattttgaatgaagttaagttgctttacttcatagtgttgttaatttctactgtatagcaaaataactcagccatacatacacatgtatctcttcgcttttggatttctttcccattcaggtcaccacagttagtacgttaagtagagttccccaagaagaatgggaaattgagattacggcgtataccctattgatactattctgtagaaaccatgtagctgtagacggacacttaggctgtttccatgtcttgtctcttgtggatactgctgcagggaacatgcgggtgcagatatattctactgttagtgtttttgtttcttaaagttggactctgatgccacattcaggttgttttttcatgaaagtctacataagatatacaggtttcatgggtggaattttctagtctttaaaaattgtccaacaatgttcatttagatagaaagcagtaagaaacatgcctttgcacaagttctttgactttttttactacataaaaagtgtctggcatctttactcggacatttttatattggtatttaaacacttgtgtcattttcaaaaacagtttttaggcatatgtttttaattgtagtgggaagctccactaatcactgcttacaaagccacataagtctcttgaagattgtattctaataggaaaattcatgctgtgaaatgcctctgccaagagcgtctttctggatagatggtaactcacttaaccattgaacctaatcctcatggttatatcagatcacattgtaattgatttcaacttacttgaaactctaacaaacagtacattgttatgaaatatattttctacctgagtagatcttgaatttctggtgaaatttcttcaaaagaaagttctctatgtttgtttgctactgaaagtgaataaaatagccttttctgaaatagaagttgggagaatcatggttcactattcccagaatttcttaactttctgtatctaaatgtcttaggaaggattatagtatgtcttttgtgttgtcaaatccccaggtaccaaatagccctttagttgttattaataagtaatgatgcttcaattattgccacaattaagcaagcttctctcatggcttcccttttctctggatcttcatgaagaattaaagggaatttgatgaagatattggttgtcaaaaaagttgccataggaaaaacttatgggacaggtcattggaatgcaaacaggatatcttataactgtatccactttgaataataggaatgatttgtagttcacagaacttttatggtagttgtgcaggctgaatgctcggtaacttgctgctgcagctgctgctgataagtcgcttcagtcatgcccgactctgtgtgaccccatagacggcagcccaccaggctcccccctccctgggattctccaggcaagaacactactggagtggattgccatttccttctccaatgcatgaaagtgaaaagtgaaagtgaagtcgctcagtcgtgtccaactcctagcgaccccatgggctgcagcctaccaggcccctccgtccatgggattttccaggcaagagtactggagtggggcgccattgccttctccgtcgataactgttacacttagtctactatagtttactattctggctgaggttgagaggctggtattctggccttctacttttctgggactgcctgattattttttgtgtactgtgagctgccacaataaacaaacacatacatacataggtacatgtacaagtcaataaatgcaatgaagggaagaggaagggagggagaaataaaagtaaattttgtcctgtcgtcttttat

SEQ ID NO: 42849 - DNA, 2731 bp, Bovine  19866880940480
agtggaaaatggaaaagtgtttttattctttctagctagtcccagcagagagaaacaagttattaattttccattactatcacacacatgtatacacagatgtatctttaatgtcaggattattttaaggaaataattgattagggtctgagctggatcacatcacaaaactgatctgaattcagtgatttttcagaatgatgatttggacttagtttaaggttgtttcttcttttgcctggtactcaaccacccaatgagcagtgaagtgaatatacacaagaagaaagctatagatgagtagactacttcctcagttcagttcagtcactcagtcgtgtccgactctttgtgaccccatgaactgcagcacgccagtcctccctgtccatcaccaactcccgaagtttactcaaactcatgtccattgagtcggtgatgccatccaaccatctcatcctctgtcttccccttctcctcccaccttcaatcttccccagcaccagagtcttttctagtgagtcagttcttcacatcaggtggccaaatcattggagtttcagcttcaacatcagtccttccaaagaatattcaggactgatttcctttagggtagactggttggatctcctcgcagtccaagggactctcaagagtcttctccaacaccacagttcaaaagcatcaattctttggcactcagctttctttataatccaactctcatatccatacttgactactggaaaaaaaaacatagctttttggataatttaaaattcacttattaagctgttcatttttatatgaaaaatgcatgcttacaaagtatttatgcatgtgtgcttagtcatgtctgactctttgcaactccattaactgtagcctgctaggctcttctgtccatggaattttccaggcagtaatactggagtaggttgccatttctttctccagagaatcttcctgacccagggaatgcaccttgtctcttgtgtctgctgctttagcaggcagattctttaccattgagccacaggggaagccctataaagtgtctaggacagttcaatttctttgttgactccagtgttatacagatcaaatcctctggcaagcactgtgtgaagaactcaaatgtaaaattatgtaaaatgtattgatcttttgatgtttttgtcttttagacattaaagaaccagcaggatatgttattatttaatatacttcaaacatgcttcataatttgtagtaaaaaaaagttaatttgcatgtgacttccagatatagttgattttttcatgcccttttgtattgttgaactatctcagtcatttataaactgctcctttatacctagttgacctatgaaatgtgagcttataaatatacctgagctctagagtagaatgttcttgccttacttatttacatattcataaatagtgctcagatggtagagcaacaaaatttaaaaaggcagagaaagagataaagtgaaagaaatagatggaaaagtagatcttcaatgagtattcacttgtaactagagacagtgcccctgctacaaattagatggggcagggttgatccaatctaataggacttcttccttttctttctttttttgtcttgggtttcctttctgcatctctcttaaggaaacttcccaaatcaccacaaaaatcagaacaaaagaaaaacagttttaaggagttcaggttatcatatctcatttatcaagaatatcaattccagactttctcctacataatacagggatccacttttgtttttgccattatttaaaatatattggggtgatatttcagtaaaagtgtatgttggattttaagtagaattactcttcatagaaatgtgagttaagatgcatagatatccccatgcactcaacgtctcacactagtgtctaagaggtacatgaatgtgattacagaatcctgaaatatatgtacttttttatacttttatttgttaagtgtacatttattttggctgcttctagtaagtttgctgggaaataagaatacaaatatgcataagacagtgtttttccttcagaaacttgtgattcaatggagaaaatggagactatttaacacattttatattaaatgatttataaacagaaagagggtaccatgaatttacattatcacttgaggtatctagtttacacttatcaattaataggctttttgaaggaagagatactcgagatggattctgtaggctaagtaggaattccccctagacgcaggaagagctcttgtgtttagaaaaagcatgtatagtgagaccagagggtggaaatatttcaacatggctgacagaagattatgacacaacttgtaaagtatgttaagaagattgttctttaatcctaatgctgtttagtactgtagcatatttatatttgcatgtaaaaacaatcactctttggcaagagaagaagtgatctaaaggagagtaacagcagataaaacaacatcaattaagaagttttccatggcacttaaggtaaacaaatgtcggtggcttgagtagcttctgaacaaatggaacaagtaaacaagttggggagagcattaagaaagacaagtaaaatgtgattccaaagtaaaggctaaccaggaagatagaggtggtggttccacagaagtagatgtgaaatcccagaagatgatttatttttaggtacactgaagga

SEQ ID NO: 42850 - DNA, 2212 bp, Bovine  19866881012096
atggtgctcagagtacatggtgctctgagttttttgtggttttttttttcaaacaagtcaagtaatgttacaggcgtattaacatagggaaattctatttattttggcattatacccttctgtactttgcttcttgtttttagtctgtttcaaaatgcatccaagggtctgtgggtatatattatgggttcctgctgaaagttctcttttaacttccacatctgaaataaatcaccgtcattcttctgatagcaacagctgtatgtgagctccaatgaaggacttgcccaagtgtctctgcatcgctgccacatctacgggtcagcctgtgctgactgctgcctggcaagggatccttactgtgcctgggatggccattcttgctctaggttctatccaaccggaaagcggtgagtactcaatattcaactgaaaatcaaaatcagtatcatcagacggttaagcaatgctccacattattggaatcagttctattgcagtatcccggaaaaatgacactaaaagtagtagctatgttcagcgccatatgtagtcttcaaataaagaaaacagccactcataaaaaacaaacttatggctaccaaaggatacagagggctgggggtcaggggaggggatacattttaacttgcggttctcacaggaatattagagtacagtagtttggaaaaattcctttttcattttaaagttcctctgcaacacaatcctccacctgcaacccctaaaatatgtcaagcagcattttaactttcacatttatccaatgtttatcttttttgttttatatgcttcagatatccttaactctaactttcctagggtttccttgtgccatttaattcctctgtaatcaaatgcttgtcccagttcaggcaaaaggagctcgctccagaatggataccctgaatacttccaaaacctagataaccatgctttaccccctacaatggtgtgtgtatgattattggttagattaagaggttcaggtagtctgaggcacagtgccttttagccaagagaagacttaggaaggaaactctgaaccaactttcaccaagttggaaggaaacaccagtaatgaaattataaagcaaagaatatgcagaatttgggatcaaagtcacagctattttcactcaaagtttattatgggtcatcatgagtgacaaggggtcatcaggagacagcaaatacgactagccttgagcaccagtgatctttcaagtaaagtcactggagtgatgatgttttataactcctttttctctgttatagatataggtatttaaggacttgacagattaaaacaacctagcacttctgcatatcaagattattctgatccttttatgcattacttcaaaatatttgtattatggggaaagtatttgccaggtagtattctagagctaggcatataacataaaaaaagaaaaaaaaagttacaaaaagacaaaaatcccttcctttagggagaataagttttagagggggaatacagacaattatcaaggaaaccctaggtatatcaaataataactttttgaagggcagggaagagagagaggggctgtgaagtgggggactgcagtattaaatgggtggtcaaaggaggcttactcaaggtatatttgaacaaaagcttgaatgtgaggatgtgtgatgaggatgaatgtgttatgccattatttgggagaacagcattttagagagaggcaccagaatccttagagctggagtgtgccaagattgtccaaaaaactccaagactaatgaggctatctgtactggaatgagcagggggaaacgtaggaagaaatgggctcaaaatgccagatgacacaggatttagtaaatcagcaaaggattttcatttagagttaagtggaaaactgctgaagggtttttgaccacaggagtagtattgtttgaattttgttttaaaaagttcatctggtgggtttggctgggatcaaagccctgggatagaaagaaaatgtgaggagaggaaatagaaggtgcaagacagttagactactaactgatgatcaaagtgagagaaaatggtgacttggtagagcttggaaggtggtcaaaagtcttctgattctggatagggctcacagaatctgctaacatattacatgctggggatgttatagaaatggaggactcagaaataagccag

SEQ ID NO: 42851 - DNA, 842 bp, Bovine  19866881077507
cttacagggtcactaccttgctgagtacacattaatcaagcctgaggctgaatattgttcccttcacaaagtcattgttctagcaatgtttaataatattacacattagagacaacatttttataaagaaatatgtcagactcagtggttttcagatgggtgttcatacagtgtatttttttctcttctaggtaccacatactttactaatattttataatgcacatttatatattattaaaaagttttttaaaaattgccaaaatttaaagtcaatattattttatattttctcatcattttctcctttgatactcattattacttgccagcaaatatatgcttattttcatatgtagtaattgtatacatatatatgtttctgttatggatttttattattaaataatcaatcaccaactctgctgttatataaatttaaccttacagagcagactatattctttatttttattttaagacattaagaatttttgtcatatatagtgtcattgtatcttgacacctgtttatagaggtgcctagaaactgactacatactgcagctgaaatgtgtttctctggagaaaaatcatagatgaagtatggtgtatatacagtatgtctatgtttaaaggtatatgtgagcaatgagacttgtgtttattttttttcatatccaagttcagtcattctgggattctgtacataatattttcctgcaaaacatgaatttgattcaattctattgatgagaggttatgtctgtttcatcttgaggtttgcagatttttccattatgaattattggtattgggataaagggaagaagtcactaatat

SEQ ID NO: 42852 - DNA, 2144 bp, Bovine  19866881107730
tattttgctattttgtacttgggagattcctattctctctgtctcttccttttcctcacctctctctctgttttggtcaagttccaaagaagcagaccatgagccaaggacatatgtgtaactgatttattaaggaaatgaccatgagggatactagttaaagagttggaagcagcaggagagagaagggaaggaagccaagcaacagtgcagactcggtctaaggcataagtcctgcagaagttaatgtcagcctgatcatgcagggagctctggagttatatacattataccttagaggtaccccgactgaaggcaagaaagctggttttcacagcatctgtcagtgttctgtcattgtgaaggaggtagaagataggctgttgaatacacaaaaataattaacactccaccacttccacacagaaaaagtaaaaaggatccaaacgaatgtgtgaagagcccccacactgatgactacatacttctcaggtattcagtcaactctgtgctaaaatttaccatctgcttagtgtcctctgttgctgttactactctgctgtgctgtgctgtgcttcattgctcagtcgtgtctgactctttgtgacttcatggactgtagcctgccaggctcttctgtccatggggttctccaggcaaaatactggagtgggttgccatgccctcctccaggggatcttcccaacccagggatcaaacccaggtctcctgcactgcaggcagattctttaccatctgagccaccagggatgcccaagaatattagaatggggagcctatctattctccagtgggtcttcctgacccaggaatcaatccatggtctcctgcattgcaggtggattcttaaccaactgagctaccagggaagtcccctaccactctactaggtcctggttaataaaccaggaacacttaaactagctgtgagcagttgttctggaaccaggagttctaggattgtctcctctgagaatcttttgatatgaagaatcaatacatagaactatatctttatcacatacacacacaaaaaactgagtttatttacgtgtgtggaaattcactggcactctataagaggtccctggaccaaaagcagcctcgtgggaactcccatctcaaggctttgtcttaggcagaactggaatttttagcttgaggaaaatgataattcctttacttagggacagctggaactttcatggggaactaaatttaattttacagctagaaactgatcatcttttgattcataaataggaattcattgttataaggagtgtaccaggaacaggcagaaaggccacagcaaagccaattactgttttatttcagagccataaagaacttgtcacatgagccttgacatacaaattcctacctactgaagatcatgcaactattgcccaataaaacagaatgactgtatttggccttaactgtccagtttctgtaataagaaacaggcactgaataataccatgatacacaactgagagacacattttttaacttcttcacaggcaagactgtgaacacaatcctgaaataaatatcaaaccatcaaaaccccaatgcaaaatacatattctctagcatattgtatcacttacaagaaaaatttatacaattgatatccttgacaagtgatacaatgtcatttgatacaatgacaattgatacagttgatatgacaatacaatgacaattgatagacaagtgtcatttatgacatacttctttcattctctctgctgtgctgtttcatcactttccttttctctcttctctttcctctccctttccctccctgtccaagttagtatttattgtttagtaaacaagtttatatatcctttagttacctctttgccaccagagatatctcacttttcaactgcaaaaattaaggtatttttctaatgaattcattctaaagagaaattctaaagtccactgattaaataattgttttcaatgtgtttcaaataaattgatgatatttgactaagttattgtaagcagaagacttcttaatactgtagtgctgacaaaaagtaagtttctataatcagattgttattaaagaactctgattctgaataaaaggactcagtttt

SEQ ID NO: 42853 - DNA, 1857 bp, Bovine  19866881132426
ttttttatttggtggacaatggaaagcaattagtaacttaaaccactctgtaatatatgtcatgatctaataagtagatttttaaaataccctttaaaacatttgatttgcttttaattttgttgacatttgctttttcatagatgaagagcttttctctggaatgtatatagatttcatggggacagatgcagctatttttcgaagtttaaccaagaggaatgcagtcagaactgatcaacacaattctaaatggctaagtggtaaataacactttattcattttttgagaatcagactttaaactactttgtttaatttcataatgaaaattacattaaaattgttaaaaaattatgagtgacaacagttttgtactctgtgattttaaatatttaggctaaatatatgaatgaaatgatccaggtttcacattgtaacactttattaacaattatagaattatcgtaggatatattaataataaaatgacagtgatattcatcatatgtacctatagacaagaatcttctccagttgtttaattgtaacatattacaatgaagtgtcatttattcatttggtctgcttttatattttaatgccaaatctaaattttttcctaaatttatgacagatataatgagtagggcttatttggaagctcttcctaattgttttatgcttagattctaaagctataaaagtagtatatactatttttctcacaaattaaccaataatttgtggaaaccataagtatgataattttattatattcagtattcagatgtttctaatttgagggtcacatggaattcacatgatgaaaagtgctcatttgactttaatgaacagttccaaaaagttgctattgtttagaagaggaagaaactgctaagatctttgccgtttcaccctggggatagtttaaactgaccttaaatttggcaattcactcaaccttgcacagttaagcatgaatcactatagttgagcatcctattccactcttagaccagcataagaaggcattgattgtccatttacttcttcaaatttttcctccagtacatctggaagtagagtattctaaaggtcgttttgttcttgaaataaggaatccttctatgctttcaaatgactgcattttttgtcttgaaaagtttctccttcatttcctatgctgtattttaagaaaaatgtgtttttcagatcttggactctgaactcttcattctgctctgtgaatttgaatttatatgcactagattgaaagccacacatttaaaaacaaactttttttttctgtgaaatggctatcagatcccatgggaaatggctggtagaaaacttcaattttttaaaactcatcaaggcacgaattttgcaattactgtactttcagaatgtattgcaaacagaggaaaatagtttaagctataatattatagctgtactttgtggcacttgacattccaaatgcagtatgtttagggaatataattaattgcttttagattttttgcctgtgaatgttgaattgttcctttataccaaagatggagaaagcacgtgtctgtggtctacatggatggagagtagaagggttttcatcatgactatatatatcatctttgtatttttttctagaacctatgtttgtggatgcacatgtcataccagatgggactgatccaaatgatgctaaggtgtatttcttcttcaaagagaaactgactgacaatagcagaagtacaaaacagattcattccatgattgctagaatatgtcctgtaagtattaaagttgttctaatttgaagagtaagaaattaatatttcataaacacatttt

SEQ ID NO: 42854 - DNA, 1756 bp, Bovine  19866881149198
agcaaaaacaaaagttataattggactgccttcacagatccaagtactttatgatctttcaaaggacagcaatcatgtcttatgcttagtacaacaacctaagacagtttagacactcagtgtttttgttggcttctgaagaacagagtaggtaaataattatctctttctgggagattcaggcaagatttcacatttgtgatagcattcaagccaaatcctaaaactgacaaaaagtggtattgtgagagaggaagttatttcagctacagggaagagcaaatgcaaagacatagagacttgaaagggaaccacatgttataacaatgagtgatttagagcactctgagcttggaacccactatatggcaagcaaagaaaaggctggttaaggtcaccctggaaagctcttttaccatgccagagtgtaaattttatattctgggaaatggtatgccatttaaggtttaaacagagaagtggaaggctcagggcttcccaggtggcgctagtggtaaagaacccaactgccaatgtaggacataaaacacttgggttccatccctgggttgggaagatcccatggaggagggcatggcaacctactccagtgttcttacctggagaatctcagggatagagcagcctagtgggctacagtccatagggttaaataatcatacatgactaaagcaacttagcacacacgtatgcacgtggaatactcatatatattaaaaaacaaaaaacttggtggcatttcgaagcatggactaaaaggataaatggctacaattactcaagcaagtagattttatctgtaaattaagggtgaagttcaggagggagcagttctagcagctctagaacatttgaggggaggcggaagtggggggcaccaaatgaagtgctcaaattagagatagtttagaagttaacatcgtctggcatgttgaaaaagataattagggaacagtgatatgaagcagttatgagtctgaaagaaaatttgtttatttctatcttttggttttcatgtagatatgactattaggaaaataggggagaaaagaagagttattggtgcattctctctacaattcactgtctccaacatctttttattacattttatactttctattctcacatgactatctttccagattggcagtatcaattttcttttggaggcttttgtggggtaaagtagaatattggttccagggaaagaatatagtattttcagaacttaactaatacactttatacatgaatcataatgttatttcttaaatcagaaaatgttcattcagtaactattttgaatcaatttgtttaataatcaaaatcagcaaacatttatttactgattatattatctgagtaaatactcaatgccccaagagggaaaaaggaaaagaaatagcataattcctcccctagaaaagggtgttttccatattttcaaagtaaaattaactacctagagttattctactccccagctttccaagccaatctaataaccactacttgctcataggaaggaagtggttccatttagggctagcagccaagaatttgcattccattctattcactgcttcagtaactgatttattgagtaatattcagtagctattctgcaaactttccttttatcctctggagtgggcatttcactggaaatgccaccattgtggacatggcctagggcatgacagagaaatgggtggagactagaaatacatct

SEQ ID NO: 42855 - DNA, 1725 bp, Bovine  19866881200358
tgcttatcatcacttaataaacagaaaggctaaaactagaggaaaacaaatacctgaaggagaagtttaaccaaaattacttaatgactatttgtagagcaaaattatccttcctatgaatgagacagccggcccagttaatggacaaaggcttccaccaggctcccccgtccctgggattctccaggcaagaacactggagtgggttgccatttccttctctattactttatagtagcatgtgggtattaacattttcttgaggtttcaatacacatgctttcatatatcacaaggtgagggatatgttaattgcatcttatttatacttgacagttttatactgagcaaactcacaagtccagatagtctacaaagggtaatcaatttcgttcttgtcacataactgtcattcattctttgtcttatctgcaagatttaggccatgaatcaatgggaaaaatcaattattgactaaaggaattcttctgtaattttgaaaataaacttttactaggagacattgtttccaagtaaaaagtttgtttattgtgaatataacataaaagtcccacatggagaacatttgaatgaatataaaataattgatttcagttgatttatttgggttacctatttaataactggccttcctggatggttcagtggtaaagaatttgtctgacaatgctggagacccaggataccgagatgcaggttcaatccctgggttgagatgttcccctcgaggaggaaatacccactccagtattcttgcctggaaaaatcccatggacagaggaacctggagggctacaatccatagaggtcaccaagagtcagacacgactgagcaactgagcacacacaacatttagtaactatagttgtgagtaactgaaacataatttttagcttaatttcagttaccattaagtaaaaccaggaaactagacacgtgtaatttaataaaagcttatgaaagtgattgctagctggagattatagaaattgcctagtaatctacgctaattttggataatccttgaatttataaaaacaatacttgcaaatatttaaggagacagctcaggaaaccatcctttaagtggtgctttttgaagggctggagctatataaattgcccgtgcacttgtactttccatgttttcattcagtgaaaattcatgatcctcatgcatcttctggttgttgtgtttccctttctccactttgtgtgacaaatgacagtaggaaatacccgtagcactacgtttttcagaagtatggaacacattcatcagtttagaatatactcacatggaattgtttgtccttgtttggtcttttattgtagttaatttataaatatgcatatttaaatataatacttttacctaaaagacaagcatatgaaccctagatgaaagtctcgttaatgggataatgaatgagaagcttagttttattacttgtctcattatctctctttagtgaagtcatttaattgctccttatgcctttctacaaaaagagaactatatttactggtcctataaaatattctagtaatgttaactggttaaagctagtctaaaaattgctttagggtgatacaattcaaatgagggagagcacattcagtttgtggagacttaatttgcaaatgtaggactgcctgggcagtaatggcccagaagcactgacattgtaggatagccattg

SEQ ID NO: 42856 - DNA, 2633 bp, Bovine  19866881232982
atattttatctctataaatctggtttatttacttattctccagtcaatctctagtgttattttctgtttcctgtaaaacttccactgacaactaccgcaaacctcccatgagaaatcacacagaaaatcaaaggatttcacaaaacttgtgattttggttaataacatgttaggtaaacaaattacaattaacagttacattgatgaagaattgatacattcagttaattttttaaatttattgagtttttccataatgaatgattcaatattagtttcttaaagacgcctctcaaatttcaaagatgagtcaaaagttcaatagaaacttcaacctcaggggttcaggtgtggaactatataatactatttatatttaaaatatagagtaaatggaattttatataagcaatactttacatgctgttggcttccaagaagcatgactcacacagagtctaaatgtgtcctttatattctactctgtcagtttgaagacctgtttcaatgttaataactcaagccaggagggatttatcattttccaagctttaaaacaagtgcatctgagaaaataaaatattttttatcaaatctcataaataataattttaatctgagtgacatgcttcaatcataaaaaagaggaaaaagacccactactttaaaaaatactaaagagaaatgttctgatatgatagatactgttaaaagcatacatttcatatttgatacctaggtagatcatttttaaataactcttacatttacataacatatcagtaataatcctttaacaaccactattaatcatttaagtcatttttaaattcaaaagcaaacatgaattttaaagagaataacatttaaactttaaaaatattattcaaattcaataaaatattttgtattatttgaaatatatacttaattgctactccccaaactacactgccccatcatatgcactatctatttaacctaaaaaaaaagtaaatactcacgtggttacgtagaatggtagaattaaacttactatttttttttttcatttttatagtcactctgctttcaccatttgcttggaatctgctattttaaatgcaaaacagtgtaaatacatgtgagggatgtagacaagatctttacccagaatgaacttgaatgattcagaaacattaggaacttagtataggacaaacacgtgtcacagagtgtgtgcctatgtttacgttgaagaatacagatgtaaaagagttggtttaaaaatacttgggaagaatctcaaagttactttcccaataaataatatttatatgctcatatgatgtgaaacgtttatatttaaagagactacttgatttgctgggacttttttcagatctgttcaacattaaaagcacagacatagaagatttttctttttaaccttgaaaaatgatctgctgaatttgtattaggttatctgcaaaactagatcagaagatgctaatccatgagaaacggtgtctcctcctcctattttttccatcctttaaaaccaagaaatgcatattatttaaccgtgcttgctttgggtaataaccagcatggggttgcaatgcatcgagtctgctttctaaggaagtacaatactttacatttttaatgcatcactgagcagaggtcaaatagagtagttctaacaaaacacatcagagcacatcaaactacccacactatagtaactcaatatgccctgtgtatatttctcccacattaacaagtgggtcatcaatctcagccaacataagcccagctctaaatttatggtattatgcttcctgacatgttcctgctcagtttttatgattgtctctaatatatgatcacttgacaaaaaaaaaacaaacagatatttatttttgattgccagattaacctaaaatgattaatgagaacttgggtaagccacataaactatcaaaaatagtgtttgtccaatagaagagttataattattcatctggttttctttaaatttctttagagctgtttaaataaattggtaaccagggacatcatcttgagtagatgtaattcatgtcagatggtagaatttacataatccctaaattgaaaattttaaaaatgcacaaaagcaaataagataattagaaattctataactgagaaaataaatatttcacttagtgtacatgataaatagtctatatgtaaatattacctaaaggtagttcattctccttgctgtttaatatatgtttggagaaatttatatatatatatatatataattttaagaacaaaactgatatcatatttcaactacaaatgagaatatttgaagagtctgtggcttatttgaataattctctcatagatatatgattatattttcatacagcaaaattttgggtttagatttttattctatcttcttttcaataaatctgagcatctaacatgtacatataacatctaacacatgtaaatatatgtttaatttaaaaacacatctattaggcaattatttaataacatttgagcattatacatgttttgaggatatgaaatgagtagtatatgaatcctagtttaaagaactttcagtctagtgaggaaataatatt

SEQ ID NO: 42857 - DNA, 856 bp, Bovine  19866881368719
taaaactggagaataagtctaatttccactctgacacttctctaacctttaattctattcattaactggagtaaaaatgtatagctatattctcatgcaaaaggattttattttttttatttttattttatttttaaactttacataattgtattagttttgccaaatatcaaaatgaatccgccacaggtataccagaatatcagaattcaaacatgtatgaaatacacaaccattttaaaaaagcacaagcatattattacttatatataaattatacaagtacttctctctgtcggtctctatgaaacatatacaaacacacatacagaacacactgatctatatatcatggtggattcaatgaactatatgtttcagcagtgcacttaggggtaagaaagatttaaaaactacttcaggagattcatgagtagtacccagatcattaattcagaattgtaaactgtacaaactctctttcaaaaccattttaaatctcacatttacgtacctaattcatcaaagtgtgtctctgggccatcttcatcggttaccgagcacaccagcctcgcttttaagaaagttgtccacttgttgacaaggctgcgcaggtccacctgtgtcattctgaaatcattttgaaaacatatttcagactgcttaaatagacactgaaatgtatttaaaatttacattggattcttattatttggggatttgttatcacctgaaggatgaaaatgttaaccaaatctgcatgtcaataaagaggaatagttgttatatgctgctgctgctgctgctgctaagtcgcttcagtcgtgtccaactctgtgcgaccccatagacggca

SEQ ID NO: 42858 - DNA, 1047 bp, Bovine  19866881474707
aataatttatctttagaaagtaaaaagctggacttccctggtagtccagtggttaagaatctgcctgccaatgcaggggacatgggttcgatgctggaagggaagatcccacgtgccgtcagggcaattgagttccagtccacaactactgagcccgtgccctagagcccatgcccctccaggagacttctccacgttactaccacaagaagtctgtgcatcactgggaagaggagccccacctcgccacaactaaagaaagcctgtgtgcagcaacaaagacacaatgctgccaaaaaaaattaattaatttaaaatttttacaaaaggaaaaagaaagtgtaaggctataacaagggaataggaagtttttcaagaaagaatttaacattcgtttctttaacattattattcctaaagagacttatgattttctttttgcatgatcagcagtctgatcctcttcttagaagaaatatcaattaccttttgcaaaactatattgctttgactcctttggtctagcagttctgtattggctagagacttgacattagttattacattatatatatgattcaatataagcaatcacattcaaagtctggtacctggtaattttttataagaaaacagtttcagcaaagtagtaatttaggaattaattacatagaatattttacatttttattatcaagaaccttaagtgctagaaaacattaaagttgagaaaggcaagaatatttggcactttcattggcatcacttcaagtcagatcttaagattatttaaatgattgcttccttctaagataatacatagaatactctcttctagggattgataaaggagaaaatataatcctgatgtacacagtacagcaagtgaaactcctgactacaagagcagtaactcagagaaggcaagacaaagaaagtatgttcattaacttacttaaattagaaataaaaatatgaagttttagtatttatgtattgcctcaatcttttcaaagaaaatttagagacatttttatatactattca

SEQ ID NO: 42859 - DNA, 1710 bp, Bovine  19866880361330
gagagtctcttggactgcaaggagatccaccgtccttctgaaggaggtcaaccctgggatttctttggaaggaatgatgctaaagctgaaactccagtacttcggccacctcatgcaaagagttgactcattggaaaagaccctgatgctgggagggattgggggcaggaggagaaggggacgacagaggatgagatggctggatggcatcaccgactcgatggacatgagtttgagtgaactccgggaattggtcatggaggcctggtgtgctgcaattcatggggttgcaaagagtcggacacgactgagcgactgaactgactgactcaataaagtaaaatttgctttgacagaagttaaaaacttagacgtcaggtaacatggagaagtatgctttttacaaaacaatctgcttattgacatggcgaacagaaataatttaacgttttcattttttccatgtatttcactataagttcagacacataataatacacaccagatagacacgggggcagaactctgggccagagccgtgctgcctgccctctcctcacagaagaacaaaggagcagtgtcgtcgtaagtgcaggaatattattatgggttttttaaatttcctactattttaatctcctgtgttccttcttgatctttgctaaatagttgcaaagaatgagtcgagccttcattaatctttttttttttaattctacctagttttaatggtttttctttctctgaaaaatagtgacttgttctttctgaaatctgaatgatcagatgcagctgcatttttgttgctatttgagtttagggagagggaggtcgagcactctgaagggacacagagattagagtaactgttaggctgacagaaggagaagaatcacctattctttgcctagtttaagatttagagacagtagagtgggtataggtgaaaattgtagaaggaaaataaaccagatggattaagatttttttttttttattaaagtgttactacatactgaagaagatgacgacgttctaccattagaagcaataaaggaaatcgcagaggaaaaggtcaataggctttgactacttaaaaatttagaactactttaaaactttttattgcttagataatgcatatgtgcttagaaaaccatcggaaaacaatagaaaataaaaattccctcaatcattctcccaattggcagctctattgctataatgacattttacgatcatcctcccacacttaaaaaaatttttatgtaagggaaattaaatgtgcaaacaaataaattggaaaagtggtttccagcacagacaaagaattgatggctttaaaatatgtaaagagcttaggaaaaatgcttacattctcaaggcaaagacaggcatccgttccattgtacatcattcagcagacgttgagtgcctgctgctaagttaaaggagtgcttactgtgcacaaaaacagctgttaggagggacagacatggcgttttgtcatctgttttattccagcgttttgagtcataatcaagatataagtgaaactatatgggaaacatttttctttacactttcaaaaataatgtaggtgagtgtgtgtataaacttgagatggaaaaccatttcttaagcaagactccccacaaaactaactatagaggaagagatccataaattgagctgtgtgacataagaact

SEQ ID NO: 42860 - DNA, 4679 bp, Bovine  19866880367659
cgaacccctgtgcagagttctaaccccagagcttaattttactgcttctggactttatataaacggaatcacacagcatgggctcttccttgtctggtttctttcactcagcattacgactggaagattcatggtgtttcagtagacttttactgtgttactgcccagaccaagatatcacatgaagcacgcaaaagtttccctcctccaaaaaaaaggccatgaggaaggagcttacatgggaaaccgttcaaggcatgtcattccgtgaaaaaggcagggacaaaacaatatgtgtaaagcaatccctgttttgctgggggaaagagttttccttttatgtggagccaaaatgattctagaaaataagttatattttctctcggccacagtgtactatgctgctgctaagtcgcttcagtcgtgtccgactctgtgcgaccccatagatggcagcccaccaggctcccccgtccctgggattctccaggcaagaacactggagtgggttgccatttccttctccaatgcatgaaagtgaaagtgaaagtgaagtcactcagtcgtgtccgactcttcgcgaccccatggactgcagcccaccaggctcctccatccatgggattttccaggcaagagtacctggagtggggtgccattgccttctccgagtgtactatgaactctctgtaaatcgaaatagccattggatggagggacttgccttgtatttgaggatgtgctgaagaaaagataggatctgcccactgggctcacctgagctatttaggtcacgtctctctccctcctatccccactttggccctgtgctcatggcgaacttaaatacctgtatcatgtgactcaaccctggagtcaaggtttcatggagagtctccctgcatgctggggatgacaggtggattttatttttccttatttgtttattctaatttgtgtagaaagaataagaagtcttgtgtgttagataatagccgtggcagtggcaacaatctgacagacagaaaggaagccttttccatccatagttgatgctgctggtcaggctgagaaaagggatgtcagctgagtcaaatgggaccggggacggagcctcgatccccctcgtcacggccggaggtgtggtggagcagcactcatggggtcataacggaatgactgtcaccagacagactaggatttgaattctgaccttgccccttgctagctggggagtttggctgctactgctgcgtaacgagcacccccaaacttagtggcagaagacagccattatattcttttggatttatatcccttagatcctgtgggtcaggaattcagacaagacacagagagatgtatttctccattctatgatgttggctgtctcagctgggatgacttgaagacggggggtgacttggtgcctagagagcactggtatcacgggaagtcttcacttgtgcagttggcagctggttcctcttcagggctggcgggaggacaccctgtgtgtgacttctccatggagtctcttcacttgggctggttgggcttccatataacatggatggcggtggggctcccagagcaagcgttccaggagatcacgctggaagcgcagggcgtttcaatgctctgggctcagacgtcaccagggatcatttgtgttttgtccgttgatgcagtcataaaggtcatccgagattcaagggaaagggacaggagaggtggcgagacctccctactcaatgggaggggagtcaaagtcagtttgtaagaagagcctgaggaggatatccggaacctggaacctcacacatggctgggcggagtttagcatgaggcagacattttggaaaacagtttggaaaagcacttcctcaaaaggttaaacatggagtttcaccagtcattcttctcctgcgtaaaatatatactcaagagaagtggaaagagaagtctgtcagcagatgcacggataaacgaagtgtgccgtacccattcagtggagtattgttcagccctgaagagggacacagtactgacacaggctgcatcctggggaaaccacagagacatgccaggtggaagaagccaggcaccaaaccccacagaccgtacgattccattcatccgaaacatccagaagaggcatgttcacagagacagaaagtgggttactgacgccagagtctggggaggggtgaacggggagtgtgctaacggacagggtttcttccgggggcaagaaccatgttctaaattagtagtgatttttgtacaactctctgaatatgccaaaatccactggtttgtacactttaaaaggattctgtggtgtacgaagtatatctcagtaaagctgtttctcaaagaaaaagcaagaaaagtcatgagggtgggcgacgcggctgtgaacctctctagacgatacactgggtgaacaggagctcatattccagtgcctcatctgtaaaatggggctatttgacaatcaaatgggctcctaaggtctttgggggattaaagatacagccctgaggctgcattgtgcaaggacaatgcggctgggtcagggtgagtgaggaaactttctcatacgtgccaaaaagagcctggacacacagtgattgtgacccgaaccccagctcttcccgcacctccgtgccagcgccctcgtctggcccccttaccttgtgcctggactactgcagtgggtcttcactgcctccacgcctggtccccaccccgccctctacacacgcacacatgtacacagtcccttcatgcagccacctaagagaggggcgtccccgatgactctaagtccaaccatgtccctcttctgcccagaaccttccatggctcccacctcaggcagaggaaaagccacagatcctagaaagccctcaagatctgtaccctgacgcccccctgacctcacctcctcactggccccctcaccctgcagatgcaccggcccctcaccgtttctcaggcacacaaggaacggtcctgcctcggggcctttgcactcgctgctctttctggctggagcattctttccacagataccttcaaggtttgttcctcacctgcttcaggtactttctcaaataccaccttttcagtggggcctgcctcaaccacagcctcacagtccgtacccactttggctgcattgtttttctctggcatttcatatatttttaacttccttttttgttcatcatctgtgttcccagctggaacataagttctacgaagtgggggatgttcttctgttttgttcacagctatgatcccagggcctggcgcacggtaagcgctcagtaaacattgcttgagcgaataaagtgtgaaaacaagcagcgaatgaagcagtgccgacggagggcagcagggagtggtggagactggcacgccggtaaccccggtcccatctgcaaggtgcagccagcactcggctctacacagcctgacgtttccacgtggggacatggacccagtatggccaagtgccgagtgtttcgagggaagccagaaacttctatatttatgtgaaatgttttgattttgaaaccactgaacgactgctgatcaaaaatccacaccggccgcctatatggatgtgtgcacgcaagtgcgcttacttgcttggtcatgtctaactctttgcgacccctcggactatagccaccaggctcctctgtctctgggattttccaggcaagaatactggagtcggttgccatttcttcctccaggggatcttcctgactcagggactgaactcacatctcctgtgtctcctgccttgcaggtggattctttaccgctgagtcatcggggacgcccctctctaggtgggaagctgccatctgtgacctctgacttaagtcacaaatgcttccaaaggggtttcacagaaccccagatttccgggaaagctgacaggacttctgagagcggcagctgaagaagtaaacgtggcctttgagtgtttctgtgaaacgaatggcattttcttatttaggttcttgagacgattttattttagggtgagttcctttctcttctcataactctcaattccaccctcacatttatgccgtgcccgggcatctttccgccacgctggagcaaagatcaaaagtaaatattggcagaacattggttttactgtgacccagataaggaacagcctaaaacggaaatagcgagattttattgttcctcccacaacttccctcctcaccgggctccctcaatatttaattatgaacttcacttcatacaaagtcttggtgttaatttggttgccaacagggcggggcctgaacaactccaggagctccaggctataaataaccccatgaacagcgccccctggagttgtgccatggctgcgtacacgtgtcgattcatatcatcatctcattctcattgacggggcagaggaatcttttttgcttcagcaaatgtttcctgctttgtgaaagaaacatgagcacacagaaaaattcagacagggtaagagggttgtggggcaaactgtcttccttctggcttcacctgatctttcccagttcctgtctccagaagctccaactgttgctcgttttttgtgtgtgcttttaactgtgcgtacgaacctctctcactgtctccct

SEQ ID NO: 42861 - DNA, 773 bp, Bovine  19866880475790
gcaggggcaggacagggatttgaacccaggccgaccggcgcccgtggccatgccctaaacccctagactccacggagccctttggtgtcagtccctccccctcgcctggaattctctcacccaggctcgttttttgaactcagctatttctgatcatcccaagggagaatgtttcctgcctctggcagaaaaatcaggggcaaaatgagagccctgtggtctggccctaaactcagtttgggcaagcttggccagatgagaattctttccttctctctttttcctttcccttttctctttcattcttccttccttctttcccttttcttttttccttttccttccttccttccttttgctttccttttccctctgtccttccttcctctgagataaaacactgtttactccagcccactcctcacctctgcctgggtgacctccctcagccctgctccaggctggctggctgcattagcccccgtacagcagccgtcagcagcccgcattcaaacgcggaccccaggacctcgcggatgcaggtgtgtttgcacacggggttgggggcagggcgggtggcggtgaacacccggaggaggtttggtaattcataggacaggtcctatttggtaattcataggacacgtcctgagagtgccctcggaggcccttgaagatcaaggttgaaagttacgggagaggggcgggggctagggagctaccgcctctgaactggagtggactgaggctgcggccctaaggaggggccctcc

SEQ ID NO: 42862 - DNA, 1697 bp, Bovine  19866880532200
gactgtgagcgaacagacacagtccctgccctgaggaaggagacacggattaaacaaataaaaatataatatgacagcgagtcaggaagaaagaggggctgagggtgacactggaggtggcgcttcagcagggtagccaggggaggcgtcccagagacactgagatgagctctgaatggtgcgcgggatgcagctaggcgacagagctgggggaagagcattccagatgcatggaacaagggcaaagccctggggttagaccacacccggtgtgttggagagaccgcaaggaggcaactggagtggagaaaagtgagctaggaagggagagtggtgatgcggaggtcagaaaggcaacggggccgacgaggcagggccctgcgggcctcgggaagactttggcttgtgttctggacgtgagccatggagggttctaagcagaaggacaagatctgacttaggatccacctgggtttagcaggatcctttgggctgtgcggagaatggcgagatcagcagggaggtgctttgaatccaggtgtggaagggggcaacctggttgggtctggatgtgtttcaagggcagggctgacagaatctcctgccaactattgggtgtggggcaagagatgaaactagtgaccccaaggtttgagcctgagcacctggaagggtggagccatcatttcctgagagtggagagctgtgggtgggcccagtggccacgtctgccctctgcccactccctgaaagccccctgctgactcccagcccaccccagcctctgctgggtcagggcacggagggagagagtgagaactcggctccacccaggcctccaggcaggaaaggggcacccggggcctggccgcagggtgacacaacagttaataattttgccgctgagagttttgcaatgggcactctttatcgactgctaaagcgagggggattttgcaaccatcccaacgggtgatacggctaatgccaggccagagggacacgggaccaagccacgggcatctccttgacccacagggactgacgctccaacaggccatccagggctgagccatcatggcaccacgaagggctggcagcgagctttggcttctggatcacgagattccaatctcagctcgtccacttggccggggaccttgggcaagtcacttcccctctctggacctcagctcttcctttgtaaaaaagagagcaattaaagggattgttttcaaattactttaaaactattacccaacctaccatttaacctttattgaacattgactgtgtaccaagacccatgcttaggcacttcctctacatcatctcatttaatcctcatgtcttttaaatcttttaaactgccgttttcctattttacaaatgggaaactgaggctgagagagagggggtgactgctcccaggtcagccaacctgtgaggagcaggggctcagacccagcctgtctcagtccaaaccccagctctgtcttaggaagtcactgcgggcctctgaggctgtttcctcatcagcacactaggaagcacagagtgagtagaatcgagcagtgttgccctcagtgggttagtgtccagtgcttgggccgccctgagaacacaagggccattggcattatcactaggattgctgtgagcaccacccctcaaggtgcccagcagctgggatgccc

SEQ ID NO: 42863 - DNA, 1620 bp, Bovine  19866880601786
aaacccctcagtccccggcaagccctcattcatcttcacaaacatatatggatttaggtactgttatcactttaattttgcagatgaggaaaccgaggaacagaaaagttaagtaattcaccccggtgtcacacagataagcatcagagctggggctcaaatcccaactgttggattccagaggcttctaggttgcccttcatagggtcgagtgagtttcagagatgggtttaaacgtctttcttccttgatgaaatacatcattttatctggaaacagaaagtcctgcctgtgtcctttaccccttccccgagacaatcctacgggtgaaaagtcagctaagagtcaggttgcgagacttgttgcctcctaggagccttctagaaacccaatagcctccaggggatcggccccacggccccagcatctgatcagaattccccatgagattttttttcagggggagggagagtgtggttcattatggagaggagtttccaaaatgaaaataaaccagcaaacaacccaacttgttaccggagatccagtgacttagccttattaagttcagtgttaaggaaaagagaacgaaatcgtttatagaaaccctcttctccctcaggagatatttaagaactgaatgtattttaaaaaaaaatttttaaggcatgccaagtttatgtaaaattataccaatgatgaaagaggctagagaacaacaacaacaaggccagccagagtcgtgcccacgtcttaggctcttaggaaacacagaggcaaaccagaacaaggaaactgggagcgtgagaacagagcgagccgggggacggctggggagcccagtgcgacgggcagctgccgcgcccgagctggcacctcaccccccgagcctcatcttttcaaaggtgatccagagtagctgcctcagacggctaaagattccaccagatgacaaatatgtctctgaacactctttccggcatgtgtcaagtattgaatccatagtaccagtcactgttccaagaccctttgggggttgtcccttttggtttgtgagcaagaacccccaagctagggtttgaaggctcaggctgggtcaagcctgagctgagtgcgctgcacacgtggtggcatttatttatttaaatatttggttttattttatgtgtttgtttggctgtgccatctcttacttgcagcacatgagatctttggttgtagcatgtgggatgttggttccccaaccaggggtctgaacgtggacctctaggtagtctccatcctgtgatacttaaccctcaccttaactcaggtacggggcttctcaggcggcactattggtaaagaatccgcctgccactgcagaagacctcagacaggaggggttcgatccttgggttgggaagaccccctggaggaggaaatggcaacccatggcagtatccttgcctggaaattcccacggaccgaggagcctggctggggtcgcaacagtcacactgagcgactaagccaccagcacctgacttagggactgttgttattattctctttgcagatgggagataggtggaggtggggaggagaaaggtttgcctgtaagctttacacagagaggca

SEQ ID NO: 42864 - DNA, 1163 bp, Bovine  19866880643126
tcgttgctgcccatgaaggttcttctagcgagctggcctccacggcctccctctgcccccgtagggcctggctggtgctcccagggcccgtgcccagtggggctggcgtgtgcctccatcagccaagccgacaggggagggagaggaagtaaacagggaagggagagagccaggagaggaggccgagtggccgggaagctggccaaatggcagagggctgaatgggctacatcagcttctgacagcgcctcagatatccccgatgtcctgtcccgctgctgcctgaatgccaggggaacacaaaacccctctgcctggtcgtcaccgagaattcataaatgttgctttttaaaacagcacgtttagcagagcaaaatgttcatgattttgaaggacgaaaagctagagacagaaggtgaggtcaccttgacgtctcttaatcaagttgtgaagttcaagttcagcctgccaacttcttgttttaatcatggttagcgtttttcctcttttgcaggatttacgcttgaatgtcgaagactttaggagggaggcaagatacaagactgatgatgcttaagatcggactggggggttttctttccctctcctcttttagccttgcaaagacaaataatggttaaggatggataaaatatttaacagtgaccatgcataatttattcctgagttgttgcttatttccagctgaatagttcgctctcaattaggacttctcagaaccgccgtgtctccttgacaaactgacattaggcttattttcactcttttcttcctaaagctaattgtttttaatctgtgttgtggttgttgaagtactcattcctagatgttctttttatcaataacaaaaatcaaaactggaggcaaagtttttttgtttttttttttttaatatttattcctgggtcttactcagcttactcagagcttcagagacaatctggcaaagacaaaagtatacttgcatatataactgcctcttctgtgtgcttagcagctcagctgtgtccgactctgagacccagtggactgtagcccaccaggctcctctgactctgggattctccaggcaagaataccggagtgggtagccattccctgctccaggggatcttcccaacccagggatcgaacccaggtct

SEQ ID NO: 42865 - DNA, 777 bp, Bovine  19866880690413
cagtgccgtgctggggcggcatgccgagacaggaggtgctcccgtgcggagtgtgtgtgcaggaggtcagggaggggctgactggttggctgggccccctctcccatccccccacctcacctaggctttcatccggccattccgggagcatcacatcgacccaacagccatcacccggcacgacttcatcgagaccaacggggacaactgcctgctgacgctgctgcctctgttaaacatggcctacaagttccgcacccagagcccaggtgagcatgccagcgggggagcctccaggcagccctcggggacaggcacacacacccgcctcccacgagcctcccgtagctggtgtgggtgtttcgcccctcggtgttataaaagtttagttagttgccctcgtataaaattgggatatttgacataaagatctatgtttccaacttctctggaacaatccgacctggccacctggatcctggctcccacttggctgcactgggccggagctgagctgtggggccccccttgcacaagaggcacgctctcccgtttgccgcagtccccgctgctccctgcagtcataacctccccccgcctcgttcatttgaattcacctgcctggccctgggggcttctgatcttgctgcctgggcttagtggaaagagtatgtatagcctgatccaaactcagtcctgagttcagatctctgccctgcctgtttggggaagggaacctgtcccaaggcgagtcccatcacctctttgagcctcagt

SEQ ID NO: 42866 - DNA, 1786 bp, Bovine  19866880814684
tgttttagggcagagtgagagacctgtcacgcaaacattgttaaaactgtgctaagcaagccactagcatggacatggtcttcaattaaatttccctcattgttttaagtttgtctaccaccttgaagtcccatgagttacatgttgagatttctctagactcataatggattgccacatttctggaggtggtttcttttatcttagagaattatccactcaggctttctcacctttgcagtacagatatttctcttttacaaaatcgaaaattagaagctcttttccttcttatcgttaaaagtgttaacagccaactgtggcattttaaaacaatgtagaattcaaatgaccttgagtttaaggtggcagattttccaaagtatgtgtcaatgtaccgaaaccattatttttcagaaattcaaagaaatgtgtttatggttggtagaaaatggaagttaaaaatattttgtggcatgtcacaatgaaggcaactttctaccaagccactttgagcttgcttagtctattgtgatttttaaaataatacgtaatttttgtaaacaaagcagtgcagttatttctcactatactaacttctaactagaacaaaaagatgtagaaactcggaaacaatgggaaaagaacaaaggatgaagtagacttttacatgctgaggaatgtggcggcttaggaaacaaatgtttcaagcaaagattctgtttgtcagtttgataaagtgagtataactggttttagtcgttaatgctaataaacagcatagacattaataagcatttaggtctctaaaaagtcagctctgaaagcatgtgcaggtggctttaaaagttgttttctatcacttaaacggtcgtatgtctgggttgaaaagtggaagtaatacatagcgggccctgagtgctcaagagagaagagacgggaaagggattggttttggagccagaatgagaagagtgggcttgaatgaatgaaaatcggaaaaactatgcacttgtaatttaaagctggggtcaggtattttcactatttctctcatctctgattctttgattctgtgacactgttcacaacttttcagtatgaatgatttgattgtctcagataaaagagattgcaacaatagcttgtgactcgaaggcaagatttattctgtgttagaggcaggctttgtaaaatgggccactcttccaattgacatttgtttttatagctgctttcattgtgaaatacgacttaatgcctgactgtgttaaaaccatgttatagcagtagtccactaaaattccttactgctctatacttgttgtgtcattatagtctaaggtgaatattaaaatttcctaataattttttatgtaaatctatgctcttcagacaaaaactgtgctttgtgcagaggaagagatctacgtactatgactcacttcagttaaaaaaaaaaaaagacaaacggaaataacatggagagcttgggaagccctcgtcatcttgagtgacccattagatctaaatgttctcttgtagccctggtttgagtgcactaaatttaggtgtctgatccccactttggaaacatgcaaaggcgcttgtagttgtctggactcctcttagattaacagggggcacaagtagaaatagtggaaggaagaatgtttcgccgtcactctttgtttgacaccaccgatgtatttataggaatgctttggttcttttggaagcacatcatacaccatgccagatggttctaaaaagtcagctggcgggt

SEQ ID NO: 42867 - DNA, 1670 bp, Bovine  19866880815532
tcattaaaaaacgagacagagaaaaaaatctgaagcgaatcaccggggcgggggtcaagctgaacgcatctctgggttggatctgggcgctggctgctgccttgagacccttccgcgccctgggttcctagggatacctacgccaccggtacctgggagaggtcgctgtgggaggtgataggtgggtcccgctttctgggccctcaccacctgcagggccgctgggccgtgctccggcgctctgggccatagtggttcgttcacatcaccccccctcctccgggaaaggctgagcgctagtggcagggcagcaggcagggcctgttgagcaaccagccttgtgaaaacaagggcttacgtcatccgggcaggcagcctccctgcaggacacctgcagaggcgctggggtgggaatcgccactgatcccagcgccgggggcagcagggtgggaagccaggggctcagtgtttggtaggtgagggcgagaccccgatgggactgaatctgtccttgggggctggtccccagggcctgggtggccccttgactcactgtgtaacccccaaccgcccttctctgagcctcagtttttccactcggaaaatggggctcacatcagacctgttatgatttattacaaacccaaaggggaaggctgggccaggaagacgttaatccttcccacctcctgggatgtgaccttgaacagaaaccctgagctttgcgcagcctcagtttcctcatctgtaaagcggggatgataataggacctgcttcttaacaatgatcaggaggattaaatgagttagtatatgcaaagggcttaaaatatggttcagggagcgtgaaagactgacctgagatcacacacaaatccttcaattagctgcagactccccgtgtctcaccgcatctccccagaaccccgagaggtgggggcgggtgctgagtctcagagagatcacatagtccagttaacggggtgtggggggaacctcaccatctcctcctctaccttcatttattgagcccttcctgtgccaggcactgttccaggcactgggggaacagcagtaagcaaaacacacagcaatccctcccggaagtcagggagggctttcagaggaggccacctgcgggctgagccctgcagagctagctgtcttgggcagagctggggaatccgtgttcttggtccagaggtaacagcaaatgcaaatgcattctgttccccgtaaattttgagcatgcctgacccgcgattccccgtacttgagggccagcgctcatggagcgggtagtctgcagggggaccgaggcagacaagacgaggatcatggtggctgcagataagggctaggaaggaagttcgccggcaggtggggctgggagggcctctgggggcagtggcccttcagctcagctctgagtgtcccattttgcagctcgggaggcctggctgggtggccccagggccttaggtccctccctggcccagaggctgctgggaaggcccagaaagccagcaggctgggccagtgtctcaccctgtccctccctgccccccaccccccaagggcactcagagatgtcatttctccagctctccggggcggaggtcaccccagctcagcagataacgctgaaagttgagcaatgcccgcctgcc

SEQ ID NO: 42868 - DNA, 1517 bp, Bovine  19866880889554
catgaaaaaaaaataaatatatatatctcgcaagcttaaaatgttattgaaatagtagtttgataattcatataaactttggtgggttagaggtaaattcaagtctaaaacaaaggggcctttgctactgaaaatgatgtgcttttgctattttgtctatagagaactggatgttagcacatttcccagaactaaacaccctaaggactagatcatttccgtttgaagtggttgcatatttaacctgctgtgcagagcctggttaatttttcccttaactatattttttaatttctaatgtgaagaagtctgtcaattcggtagtttggggaccttggctcctatatgcccatattttattttgactttttaaatgttgttcctctgttgctaattgtaacagtttttccaaatgcttccccgcctcgcctcattttctaagaaatcaaaccaactgttttttaggggctgcttcaacttacaaagcgctgaagcaatgttcctgaattaagaaactgttaacaatcgatcagatctgcgtttgtccctcctgtgacttccacatttacaaactcattccattcaggcatcccttagatgtcatgaaaggcagttccatcgcccctgctgatgtgggagactctctcccatgtcttcttgtcctcattctgaatctcattggaaatcattcctttcttgtttgtgtattttgttggtctgcttttatacccttttaatgtgtttgagtagtgtgaatgattttcattaaaaaaaaaaaaacacccaaactaagagatttttatacacaggacagccttgtgcactttttatatgaaagttttgggttttccttagtggggtttgtaggaacactgcctacactttatggaaagcatgtagtattcacctttgacaggtagagtgtatctcgattaatgttaagaggctatttattactttgtgatgcatccacttagaacaaggtaagagtaaggctgctaacttttcgttccttgcctggtttcgttgtatgaggtgcacaggcactaccgtagcttgtatataaagactgagaatagtatgaactacgggagttccctggcttacggatgttgtgctcagagttatttattgattaattttatggtagggctagaatggataccttataacaattctgtgctagtaaaacaatgaagaatcgaatgactccgttttgaaggatattttctatggtaaaagtatatgaagtaaagttgattaaatgaagatcacttgactcagaatacttcaacgtattttgttcacattgtaccactaaacattatcactaaaccattaactgcacaatgttaggtaacacagtgtactttttgttgaattcatagaaattcttccacttatttaaccactattttttaatggcattccaggtttaacattctgttgagttttacaaacttaactcttgaatggcaaaatgttagtaagtagaaggttacatttcatttatatta

SEQ ID NO: 42869 - DNA, 984 bp, Bovine  19866880901615
accaccatttttattgcccagaagaactgaatccagagcagggatcgagcagtttttaattcattatccattgatgtcattttgaaaagtttatccatttttgttgtcttgtctccacgatgcatgacgcaggttctctgtatgtcttgttctagcttttgctctgcatgcctgcaggaatgtctgaagccgaagaagcctgtctgtggcgtgtgtcgcagcgctctggcgcctggcgtccgagccgtggagctcgagcggcagattgagagcacagagacttcctgccacggctgccgtaaaaatgtatgtgggagtggggcggagcagtcggcgtctgtaagatgggtaaaacacagagcttgccgccttgtttctgaacttagagcgtagctgcgtgagcagcagcacatgtgcatgctggctggctgtggccgtggccgtgctgttgcattttggtaacctgattggttgtgtggtttggttttttcttttaaataattggtttagcatattatatagcttagctttgaaaaccatagaaatcagttatcccagtttttttctgtaaaagacccatttttcccaaagcagcatacacagatttaattagaataagacagagtgatatttctccattttttaaagtataaaatgtagtcagtgcctcaaaactacctgctgcagtgagtctgaggggaaattttgtgatgtattcacgacagatgtaaaactggttcagcttttggcatttggcaaggagggattctagtacaaaggtcaatatgaagacatttcacgatagcgtgtccagtgtttgaaacgcatccgtgttcttttttttgtatgaccatattagagtcaagaatatttattttaaaataattataactgcataggagaaatgctattgttttattttcaaaagagatatatacagaattactgggttttaaataattgtatttcatattccagacagca

SEQ ID NO: 42870 - DNA, 900 bp, Bovine  19866880921163
ccattcatccatacatcccatagatgtttatttaactgatggctactatgcccaagcgttcagatcactgtgccttgagccaagagaaacatacctaattaggtttctgtttatttgctgttccaggaaagctaattgtggggtttgtaaacagccctttgatggctggagagttacttaagaggacagttaaataaaccactgctgggtggaaacagtccatgctggtccagagcaggtccagagccatggcctgccttgcacggcaggaggagggctgagctccagagagtgtggaggctctggggtcagaaagaagtcagagtaatggacagtgacagtaacacccaccaagtgtggaatgcctacggtatgccagatgctgtgttaagcacagttcttacagaaactccacgtgatggaaactatgatcccatttaaggatggggagactgaggtttggggagggacatccatgtgctcaaggccatagggctgggaagtagcacagtcaggacatcaatctgtctgtgtgcagcaatgatggtaataatagcacataattatataccattcactagattctaaggcactgtcctaagaatcccactaaatacacaaccctatgatgtcactgctatcatcactaccattttacaggtgagaaagttgaggttgagaggcttaaactaatttgaaagaaattactcagctgctagaatttaaaaaaataataataatctggacttactcttcaccatgttatgcagtggattacgccttctatgcatttaacttgggaagatctagccatacacgatgggccaaacactttttaaaaatcattttttcattttttctgttttatgtatctaaaaatactgtgaaattataacttgt

SEQ ID NO: 42871 - DNA, 1811 bp, Bovine  19866880935547
acttttgtctttttaaattcgtattaatttttttaatccttggagattctttttagtttaccctcactctagtaatttttgaagcatggtttccccttctgtgcctgctgttagttctgtttcctcgtcctctgacgaggcgtgtggtttgtaggctgtctgcctccagctgcgcgatttaagaagatcgcgttttagtgccccgttctccctgtttgacctcagaaataatcaatggctgacttgaagagtaagtcactccccactcccaggtgttacttagcttaaacaggttattgttgttatttaattgggtgcagcattttaaaatgggaagatttttttaaacgtaaaaatacaagactctctgacaagctggactggccacacagattcctacagtccttgaagagaagctgcctggagcaagagaagccacacccgttatcgggtcaggcgcgctcagctttgccagagccccctacctgttgtgtctgtctcggctcagcctctttgaaaagtgggaaaatgaaagattaagaacttgcccagaaaactgagggagagtgtacttgcagaagaccagaattctgtgtttgatacacgttcatttaatttcattatgattttatgtgtattatccattacacttaattacaggcggaccttggatatattgtgggttcaataaagcgattatctcaatggagtgagtcacatgaatgttggctcaaataagtgcattatgtctaaaaaaacccttcattttaaaatacctttttgcttaaaaaaaaaacgtaacctgagccttcagtgagtcatcatctttttgtggtagtgacatcaacgatcacaagtttgaaataccgagagagttaacaaactgtgacccagagacacgaaatgaacaaatgctgttgaaaaaaaatggcattgatagacttgcttgatgcagggttgccacagaccttgtttgtttaaaaaaaaaattatctgtgaggcaccataaaagagatctgcctgtacagtctgcccaacctctaaaacaggtacttgagcttcagaagtgtccaatttcatgtcattaagtcaaatataaacatgcaaattggagggttttgaacaaatgtagggaaaatacagtgtaagtaacttgttataaatggtgtcgagaatgtgtgtgtgaggcttatcagagattcatttgccgtatttaatgtttcagtccttgagcttcataaaacctaacgtcaacttctggtaatttcacggggactatttgagagggccccctagtggtttttcctggcacagcgtgtcttcctactgcactccgttttttatctgatcagatcaggtcagatcagtcgctcagtcgtgtcggactctctgcgaccccgtgaattgcagcccgccaggcctcccgtccatcaccaactccggagttcactcaacgggctaatatttaacgagttttgtttctgtaccaaatatgttttgagttgccctttctgtacagattccaccatagataaacgtgtactttcacagcattcctataattattttattttatttgtttgaacagaagaagcagactacagtgcctttggtacagacacactaatcaagaagaagaatgttctaaccaacgtgttgcggcccgacaaccacagaaaaaagccgcacatcgtcattagcctgccgcaggacttccgacctgtgtcttccatcatcgacgtggacattctcccggaaacgcaccgccgggtgcgtctctacaagtacggcacagagaaaccgctgggctt

SEQ ID NO: 42872 - DNA, 2037 bp, Bovine  19866881063828
tggatgccgatgtgctggtctccgtgtctcgggggtcctcggagctgaaggagtccatctcgggcagctcctgactgcggctccgcaggccggggccccgaaggtcgccgtcggacaggcagctgaggacagagggggccctcggcctgtccagcagcaaggcctgctgtgcccgcggctgcaggacagactggagacagacagacagacaggccggccagcctcagcagctgccctggggatcagagtcagacccccgagggtggccccagacgtctgctctgtatacccacagccgcgggatgaccggggtccgccaaggcgcctagcacccggaagcgccggtgagagccaggccccccgtaccccgctcactcgctcctttccagccccagctcccgagtcagctcgcagtgaagcctcaccacacctccctgagggtggcacacttctgcccccggagaagcgaggtgcgcgcgaggaaggatggatgtgcgggcattttaatccaggccagcatacacgaactctgaccccctctgctgtgccctccccctcatcaaccagaccaatggctgacgttcctacagcaccacctgtaactgccaggcattccagagagcattcctcatttacaaagtcacttatttaaccctcacaaagccccgtaggggcagagctgttagtttcatttctccgatacagaaacagaagttcagagaggttgagtgacttgctcaaggtcacacggcagatgaaaggcagagatagatagaatttggagcccaggccatctggcttcagagtccatgctcttgaccgtaaatgactttgtaagcaaagtacgctgggaccaccctggctggacaaccagtttcctttaaatgcacaagctgcctggctcatctaaagctgccttccccacctaaggtccagaggagggcgacagggtggtcccgctccgcatgcctggaccctccctgggcatcgacacacacagggtgacgtgtgtaccaggtcgtttactgcccgcttgttggtaacagcaaaaactgagcctcagtatcttgttaagtgcagtttttagccaagtacgagatgctgcatggcgccaacatgacagagaaggtctccagggcgtcaccagggcaagggctgctgagggacacaggctagagaggctgcatctgctcccagatggcccagagcctctctggaggaccacggaggaagctgagaagagtaggggcgctaaggaggggacccaggcccctggaggtcacaggaaagaggtatctatctcaccacaaacgaagtcaatctattacctactggaaacacgttccaagtgcgaaacaaacgagcccgaggctgtggccggggtggcagaaccatctggagaaccccacccagtcaaggccagaaccgaatccagaggccgcagaacagagggcaggcagtgaaaaagaaaaggtaccccaaaacacccccaaacaaggaaggctgagcccaaagcttgctgcagctggaggtgcacgtgctgaccatgtgctgacccctggggagtcacaccccccacccccaatcccagcccgcccaccacatccccacccagggaggctcactcaccaggtagtatctctcccggaagctgggggtgtttgggggtgtccagttgtacaaggagcccttcctgctgcctatggagaacttgcccggggggctgggtgacaccaggaagctctcggtatcaaatgggctggaggagagcagaggccagggtgtcatcgacggccggaggacatcggaccacagacaggaccaggggacttgagacagaggctcagtgtgggagggcgtggacaggcacagtggagggactccaggtcccccctctgaagcctccctgaaacgtctcagatatccattgccccgagggtccttagccaaatggggaggggcagcgattggcccctttggaggggctgatgaatgacccccctttggaggccctttgagaagctcagcagagcagca

SEQ ID NO: 42873 - DNA, 706 bp, Bovine  19866881071835
tccccttcccctgtcaagcctccccaagtcaggcacagaaatagtcccagctgtgagacgaaggctccagagtttaaaattgcagctctgtactatttatactccagccggaaagaggtttttttgcgcacccgtttatttggttgtggtagcgacagcctaggctgcaggcggcagcttctgcactgtataaacatttctctggggacaagtcggcgctgagggcagccttcaggtgagggggcagtgccaggcctgcccagaaacggttgggaacacctcccctcagcgagcaattcggcctcttaagccagagaaagtacttcatgttccaactgaacttccttccaagatgcctggttattaggggggaaaaagacaaaaaagcaggtattttatttgtcatgaaaatagtacatgcttgagggggaaaagggttcaaactactcctttatgcaagtcattgaagcagacccttcatgttctgttttgcttggcccatgaagcattaaaaaggaaaaacaatttttaaaaataaatgtgccactatttaaaaatcgggacattttctataaagttaaaatttctggcttctcttgaaaatggaagattctggcaaccctggcctcacgtttcctgatttctctgagtggctggctgctctcgaactaggcaagtgcttctcgagtcactccgagccccaggg

SEQ ID NO: 42874 - DNA, 1150 bp, Bovine  19866881125028
tgaggaaacagagcctcagagagctggtgagacgcctgagattccagagccaggccaggccccaggaggccctgcccgaggcctgggaagtgctgcttctctcagggtgcggggtgtggcccagacaagctgggaatcctcgcctctggggcctccccttgcccagacccgtgcaggaggagcagtggaggggttcagaccctcactttctgccccacaaacctcagtccaacctgctccctgggatacagctgctccgctggggtgcctgaggatcgttacagtcatctttagatgagcaagaaactctcattataaattacatcattaaacttcagggctctaggatgttgaagcagctaatatcactgcgtgtgtgcgtgttcagttgctcagtcgtgtctgactctgtgactccgtggactgctcagtcgtgtctgactctgtgactccgtggactgtagcccgctagactcctctgtccgtggaattctctaggcaagagtcttggagtgggaggccgttcccttctccaggggatattcccaacccagggactgagcccaacctgtgtctcttgagcctcttgcattgcagacagattctttaccactgtgccacccgggaagcccagatattaccattaaccccatttgaaacctgaggactgaactgtcagggtgggggcggggggttcactgcccgaggtcacacagtggcaggactggggctcggactcccagatcctcggttccaggggctgagctcttgtcaaagacgcagaatgaaacaggctgcccagaggttccactgagccccacagatgaggagagtggggacaatgaggccaggaccagctcgggacccgtcctccaccacacagagacccttgagcaagccagagaggctgcttcccacaagctgggcggctccgggccctacaggaagttgcccgggctaggacaggcccgcagctttgatcagctttacgagccgtggctgtttatggaggcccaggcccccacctcctgccgcctgggactgggtcttgtcaccggcactctggatatttggcagtcccccgagaggctacccgcccggggggtcttggccccacttcctccagcttggcccctgccctgccccttgg

SEQ ID NO: 42875 - DNA, 1786 bp, Bovine  19866881125548
cagtaatgcagggattttcagttacctaccattgggctccaaggtctctccagtgcattttgcattttagcacaaatagctctcccaaatctattttttttaattctggtattaagtaacgtaattaatgtatattgaatttcatgataaatctttaagtttcctgtagggttttttcagtctctaaaccgcgaaataactgcgtctgccccgtgcctcccccgccccgcctttttcctttttctgagctgtccgttctctgatcctttggattgcggagtccttttggcagttttcgtcccatgctgtgctcttaatggcatgcgtttttcatcagcttacctgatggcgtgtgagttttgcacaagctggcgcccctccctacagtgtttctgttaattcgttcgtggtaagcagctgatactgactgcagagaggctgggcgtgtttccttgtgctgggaacaatgggaagtccagctgggtctttgtgtccaagacagtggagtttggtaccagtcattgggtgcacgttttgaatatccaagagtgctgggaactttgcagtggttcttgattcctctgccacatctcattgactgatcaccatgacatgcttcctaccatccagtggtctcagttctcagattttgcctatgctgctaccatttctggtttcacatgacagaaattctagtgaaaccagaaacatactaataaggcccctcaaccatctctccacatcttcccccgccctaccggatgtagtcttcacattgtctctagagtagttgtgttaaaaacagacctgagcctgtccctcctctgtttacttctacgctgtcgtttatctgtgaggtccagactccttggcgtggcagccaggctccagccttccccctccctcccacacaccttttattctggccaccctggaaggtgcagtcttctcagacacccttctctctcattaggaacagctaaatcctgtgaggaaaatatgttgacacccttctctctgtcccttggctcaacactctgtttaggctgccagtcccactctttctggctcagacacatgcccctcacgctagattttggccttctcatttgtctgcatccgtacaccttcacacccatctctttcaaagccccgtgctctcactggagtggtttcttcgtatctgggctcatctcctgtagagtccaagctatggaagtcagctcttccatctttctcattcatcttggtgtgctttgcaccggccatagagtgccttaagaaatgttggggttgaatggattgtcagcagtttgctctgggccctgacaatagacgagtcatggttcccaactcacattctcagggaggaggaatggtagacacacacattaatagattagcctgtgtcggtactgatagcagaggccatgcagagaaaaccagcacggtgggagccatggcttgatgaggcagtttggtcctgcctactgtgctggcttggaagaaaagcttgggttcttacccagtaggagttcacaccaccagtgtgtttcacaggaactttcagtttaacaacagatttgtccttggcctggggtgaacttaataggaaacttggaggtagtatatttgtctctctaaaaatttttgaattactctcttctcatcactcttgacttattctcacatgccttctagaagggcttcacatgtacctggtttgtaaaatatgtttgactatgggggattaaaaataggttctccgtaaagaaccctttaaaat

SEQ ID NO: 42876 - DNA, 668 bp, Bovine  19866881224136
atttttttttatgcctatcccagatacttgttagaggtatataatgcttgcaactagccaaatttacagagagtctccgtggcatcctcgttcagaagacattcaagccgtgatggtctcatagtgtgatgaccgttccatcttcctctaagagtttctgatctggagcacgcgtttcgaactcggtgccggcgccactcgctaccggtggtaagctcacttcgttggcagggatgaaaccgttctgcccagattcgaaactgagctctacctgcgtgagcgactgcaggctctcggcgctgggcgctgccctggggatctgccgcggctccccgctgtcctcgatgacgatgtcctcctcgtcgtcgctgtcatcctcccccggctccaggctgggctccggcggcggcgcgcagctggggaggctggtgtcggtcgactggccagagctgcccgaagtccgactgttccggacgacgttgttcctctggttggccggccgcacggtgatgatgaggttgcggctgttggcgatcatcatgtcggtgacctggtcgaggctcttcccggagacttcgatgccgttcacctccaggacttcgtcattgacagccagcagccccgtgctctgagccaggccccccggcacgagtctggagatgaagatg

SEQ ID NO: 42877 - DNA, 907 bp, Bovine  19866881463842
aggtagggtgtgtatatttcagtgccagacgaacccataaccctgtgaacgctgtatcgggagtgatgacagctgtctaatatcaaatagcagacgtgtgttctttctgccacttaaactccctggctttgctctgagcaaaaagtaacaaaaataaatgcatatttgctgaatttttgttgaattctatttggattccgactgttgagatataatcagttcttttatgtaatggatttttaaagtatatacttgaatctttaccttatggtttttagcagctatggaaaaagccttaaaatatttttaaagagaaagaggtggggcaggagggagggatgtaagatacaattgtcagaatttaagacccagtgcaaacaaacctagctggtgacagataggaattctgaaaaggcggaaaataaaagggggatggtgcagccaccagcttgctttccacctgagtgtgtatgcaacctgtgataagcagaggacgcttgtctgaagggcaacggtgtacctcggacttctgagatccttctgatgtggtatggaaaacagattgcataggtgcaagggcagaagcagagaaatcagactggaggctactgcagtagtccaagcgagagatgatggtgacgtggcccagggtaggaggtatgcaggtgatgagaagcggttggtaactggatatactttggagaccaagccagtaggactggatgtggggtatgagagaagcagagcagtcaaggataataccaatggccgtttggaaaacacaagatcaaggatggggttgcatctgctgagatggaagaaactgtttgatgagaaggggatggagacatcaagggatcagtttggaccatgtcaatctgagatgcctgcctgcgtgtgtgctcgg

SEQ ID NO: 42878 - DNA, 1045 bp, Bovine  19866881507263
gttgtgttaatggtactgtgttaacagcagcccagaaaactaagatactacctcaggtctctgacctcagcagcacaaagcagtaggaaaagccataaatgatggtttggtttttccttttaatgaggagattaaaaaaaaaaagaaaagcacctcctggaaactgtacagaaaaggaactaattttaacagtttctgttttacagatgaggaaactgaggctcagagtgtgtgacttgtccaagtcatgtagttagaaggaggcagaggctggacttgaacacaagtttttttgaccccaaggcttgtactcaccaccctccctgagaatgtgtggacattgctctcacgggtcattgcagagtccccagatcctagttcccagatgtcctttttctttattgcgaaacttggtgctagctttgtccttaagggaactacctgttccgaccacattttcgggaatccgagcctctgcagatcgagccctctttcccgggtgattttcattacaaaacgggagatgcattcccaccaaaatcatctcccaatagacccaagtaagaatgtttggcaaagaaggaattaattagtaaacagcttgtagtatcccaactccagtgtctgcctggaatgttttgcaacactttcggattctgatttcagcacaatttgtttatttcaggctattaaaccacacgcatattcttcatgcttgggaatccactggccacacgctgaatggcaagaatggagaccctctctcacttcccaagggcatttgtagtggttagtagagcagggctgcaatccctggggagaccagtagggcttttcctccaacaggaagtaaatttagggctgaagattcttgcccgtcaaggctttgggtgctagaaaataaggctgttccttcgggagcaaatcctcgcaatgtgagttaaccagctggcatgaagtcacccagtcctgagaactgggcaagaaaaagtgtgaacaaaatctgacttttcctgccttcttgcctacacccaccccccacccc

SEQ ID NO: 42879 - DNA, 1481 bp, Bovine  19866881758473
tctgtcttcttataaagccttctgattataaaaaaaaaaaaatgcaaacaaaaaattacagttgggaaaccaaggcttaaacagagaaagattgggtcaagttccagtggaattacaaagcttaaaatgaagtggtctctcattcattcaaacccttgtaagcagatgaagaactgttatctgtgtgttcttacatgcctccaatgatggggaactcactgtctaaactgttcatcatgtagggctcaacagagaggcctcccaagttgcccctagtttttccctccgactctgctcagatgtcaactgctcctctggccagagttacgctgggaggagcccagcggacaggacaggaagtgggaagcaatgtgagttatgacagagacttcctgggtgccgccaccagctccctgccacgaggccttgggacataccctctcctctgggtttcagtgtctgtaaatggcaacgctcactgctccgcaatctccttccagttcttagaaattgattgggcctcgcacaggtgcccggcgggagctggggcagtcacagggggttcaccagtcccgcccacccattcccatctcggaggccagagctaacctcggggcaggcggggcaggcaggcccggctggggataaaggcaggtgccccagggtacagccagcttaataacaggctcccagatctagggggtttgaacccaggggaataggttcaaacacaaattgagcagcccacattcttgcctgcagctctgagagccaatggttcccacacccagtgggcttggcccccactctctccaagcccatccttcccgggggggaggtgcccccttctctgtgttcaccatgcgcccagcttctcactgtactcagaataagatccacacccctggccctggcccggcccacacctgacctctcctcctccctcctcccctcagtcactgtaccgggggcctccccagtgctctgcagacaggccacgctggtgctgccttggggcctttgcactgcctgttcctcctgcccagaacatgcttcctccagatcttgccttggcagctcatccttcgggccaccactccaaggtcacctccccagagaggccctccctgaccccatccagttgctctgtctcaccatcctgccttatttcctccaccggaggcttcatggggatgtcttatcccccgagtttggcgtctgcctctcccagggtttggagccttagatggcggagccgatgactggcccagtgctgggtctgatgtcaccaggcacagcctggcacccacccatcagtgtaggttaaataacaagtgaaatggatgttgcagatgctgagcccattctggggggcggtcagtgcttcacctgcatagaccctctcacctccgcacagatgggcttggaagaatacctgtattgatacgcagactcactgtgcccctaaacacacctgcatg

SEQ ID NO: 42880 - DNA, 2741 bp, Bovine  19866880473415
aattcattgcaatctcctttcaaccactgctgtgttttgttactgaggtgacttttagaaagcccctactgtggatgctgaatcccaggggaaccaacccctgtgatgagagggttgaaactttcaagcacccacccccccccccaaacctcctgtgaggcgagaggggctagagattgagttcaatcaccagtggccaataattcaatcaatcatggctatgcaatgaagcccccataaaagccaaaaggatgttttagagagtttctgggatgttgaacacgtggaggtgttgggacctcggtgcacccagagaggacatagaggctcagcaccctttcccccatacactgccctgtgtatctcttccatttggctactcctgaattatcattttatgataaactggtaatctagtaagtagcataagtgttttccttgagttctgtgagctttctagctaattaatggcaacccactccagtgttcttgcctggagaatcccagggacgggggagcctggtgggctgccgtctatggggtcacacagagtcggacacgactgaagtgacttagcagcagcaagaaggaaatggatttatgtaacccacttatttataaacacaggtgactacctggacttgggattggcatctgaagtgtatatggggggaggttagttttgtgggatctcatactatctctagggagtgtactttaggacaaattttaggacatctagccgatgtcccagaattgtctggtgtatggaaacccaggcacacacccacatttggtattgagaagtgttggaagtattgagtgggaggaataaaggaaaaaggaggatgtgaggtttcctttaccaggtgcaaatgaaaaacgttaaaatcacaatcacttttttttttttttgagaaatcaggcaaagttcattggatcttatcctccacctttactgagtgctaatttgtgaggaaggttgttttatatgatgaataatggtgacatgtcttacctcttgtctttagggtcattaaaagcagtgcaaaaatttacttatgaaactacatacctgctgcttgatgtgataaattctatgtcctacatttctccttatgtctcaccatctctccatggcccaaccaccctgcccaaccaaaaaaatcaactttcgaattgaatatgtgaaatagttcagttaaaatgttgagaaaaatggcggtgttcagctggaatctggagaagacaagacttatcagccttcctgcgctacatttgcgagtctctccctgatgggccatatactgtagccagattggtctctgtgatttccctgatggtcagggtatttcaatggctgcagaaagaatcaatgcactacttatgtgactcacttttcacctttactaatctgtcccacaaggaagggcaggattgggctaaaggaacttattacctttattggccagaattaaattagtcaccctgacttttaaagaggccacaatattatgcgatccatgatgacttagaacagccttttctaaggtaagaagagtcagaattcagttcttaaaaagtattaactgggtttctgagaaaaaaaaaaaaaaggagtgaaggcactttaccccaacagcttcctggaaacataaagtttgttccttcagatcttgtctaagacacaactgataggtagtaataaacatattgtaacttccatagatccaactgtttaattagatggacaccaggatgcagtatcagtactgtcccattgcttgacaaatagaatattgctttataatatatatgcttcacgtctttttttctcagtagtttgcaaacagtataaagaattgcttcctaattccctgaaaggatctacttaaactgtccaactcagtgactaattagcagttagctatcgatatcctcaatcctcataaatgccaaacattgagctctaaggacatgacgttttcaacagatgtgctggaatttagatcatcccttaaacattaatattgcctttatgtcttgatctacctaccttaggctgtattcccacccagaaattaatagacatagttaggctttattaaataaggtttgatatttgttaagaaaatattttattgaaataaaatgtccctaatcacaaatgtacaattaagtaaatttccccaaagtaaacacaatgatgtgtctggaacaaagattcaaaaagaggattctatgatctttctccagttattagacaccttaaaatattcagtattttgacttccatcatcatgggttagttttgcctatttttgagtgttgtacacagaaatccatattatacatgctcatttgtatctgcaaatttctgtgttatgcatgtaagattcatgtgtgttgatgtatatagcagttcattctcattgctgaattcttactcatcctgttgtatgaatgggcaataatatttgtctattttgctgatgaatatttggatttttgcagcttgggggaagcactgtgtggcaatgaacattatagcatgcctttttaaaatgtatgtgtgttttcctaaaggaatacactaaggaatggaattgctgcgtggtggtgttggctcagatgttaaagaatctgcctgcattgcaggagacctgggtttgattcttggttcgggatgatcccctggagaaggaaatagctcccacatattcttgcctggagaaatccat

SEQ ID NO: 42881 - DNA, 1367 bp, Bovine  19866880924028
cttggaacattttggactctcttctgatgctacaagttgggatcagctggagctcacttctctcctccactgctaaatggactttcttttctaattagtagaggacacctctggtcctctacctgctagctttccactcttccctccagcgggtctggtacaatgatgtttcctgtggatgtttacagactggggcagacactgaccttgtatattgaaataatttcactaaatccagtattcatatcccatttagactctattggttatatagttgacattgagaaaggggataaaatctggttttccaataaccagtgtaggataaagatctataattttaactgggtgatacaaacacatggagatagctttgtagagatgtttatgagaaggcaaaatatcttgttcaaaaaaaaacaaaactgatctgcatttctctgacaatgagtgacattgagcatctttttcttgtgcctcttggctatatcttctttggagaggtgtctatttaggtcttccacccattttttgaatgggatggaaggagtgagagggaagtccaagagggaaggggaacatgtatacatataactgatccacgtcattgtacagcagaaactaacacaacattgtaaagcaagtatactccaataaaaaaaaagcaaccatctctctaattcccactcttatctgtcttgcttggctctcttgccccttttctctccacctccaagtttatcatctcagcaaatgtcaccaccatctagccaggtgttgaagccagaaactccaagtcatccttaattggaggttttgtgtatcctaacacccaaagccattagcaagtcctcttatttctatcttcactatatatttcaaatgtacaccatctccaatgccatattgttctccacaccatgttatttcagcaagtccttgaccttctagttggctcatttttaattgcttttgtccactcacatccattcttcatgccaaagcaatatgtaaaccagaggatgccactgcctgtttaaaaccctaccatagggtctaccctgggagtcgagtaattaagactccacatttccagtacaaggagtgtggattaataagaggaagaataataaaataatttttaaaaagaaaataaaaagaaatatcatatttttaaaaaccctccagtacccatgattgtatttaaaatacaatctaaactccttctgttggtctgcagagccctgactatctttggttccattttgccggtctatgcttagtttgctaaattcgtttccatttctggaagatgccaggtcagttgctacagtatagtctttacatatgttatccttttcacctgg

SEQ ID NO: 42882 - DNA, 1485 bp, Bovine  19866880449531
catattccttttcaccaaaccccaatctctccctatgcaccaaactgcttaagagcattgttccttctgtaaacgttccctgcaggcaaaagcatatactaaatctgcattcatgaacaaaatatggcttgtggcaactttgaggctttgcttattagaaatgccggttgcttttcctgttattttataaggaaatttggttcctagctaacatttctacctaatagatgcctacagtaaagtttcaattgtgaacactttcattacaatttttcatgtataattctgcagtaaattttatttgtgcgaaatagacctatttctttcagagaaaacctactgattatacacattctctctaccttcctttcctataaaaagggaggatacatgtaaatgagtcaccttaaatgtgataggtgctatattcatatgtatttttaaaattgtttgtattactctctatttcataaatatttcaaaggaaccagaatttgactttaacccataaaaattactttataagtagtataatctaattcaattccagaaacattatagtgattctgatgaatacatataaaatacaaagcaaaatcagttcagacaatatcaaatacagttttaacttgccattgaatggcatatcagaatattaataatcactaattttaagatcagcagttcatggtttgctcatatcacattgctgtgaacgtagtaggtgtttaataaacatcttttggcagaccgatgattatgtgaggtttaggaatttaaaaatgaggtgggctgtattattcacaacagctaaaacatgggagcaactcaagtatccttcaacagataaatggattagcaaaatgtggagtatcattcagccttaaaaagcaaagacattctgacttacactacaacataaatgaaacttgaaggaatgaagctaaaggaaccagttacaaatggttcatttatatgaggtatttagagtggttaaaatcatggagacaaaagatagaatggtgactgctaggggctggtggggagggaaggttagggagttagtgtttaatgtacacagttgcagttttgtgagatgaaaagtgtttcagaaatgaatggaggtggtggttatacaacaatataaatgttttaacgtcactgaactataagcttaaaaatggttaagatagtaaattttatcttacatgtattttaccacatttttataaaaaattggaaaaaagttctaatggctataatgcaaaatgatatattttattaaagaattttctcagatattcttataaaagttggtttaagatggtgaattttctgttatgtgtattttaccataattttaaaaatcagggaaaaaatgagacgggctgaaaaatcttgatttacgtagcttcccaacaaagaacagaaccatttgcctccttagagctttctgtatcccttcactccaggactttaagtcct

SEQ ID NO: 42883 - DNA, 1184 bp, Bovine  19866880523490
caagtagacctcagaccagttggacccaaagggtggactcctacttacctcatcagcaacccatcagaagaaagtccacaagctgatcacgccctctttgagcaattattataaaacttgtcactatcttccccaagttgggacacttggttctggagggcattagcttgctgtgtccccctttgcctgaccaagtaataaagctgtctactctgtctccaagatttgattcggcaacagtgtacagagaagctaagcttgaggcatcaccatctcaaaacaaggatgctatggagtcacgtgtacacagtcagaaggaaagccccagccattctagcaggatccttgggcacaatgacaccagagaccgaggcaggctaggaagctggcccccctgcatgcttactagcgtccacaagacaagattgcaaaggcaacaaaacaggaaatccacatccagtccccgtattttacagacaagaagcctgggctcagcaaggtcgggtgcctccgtgccatcccccggctcagcattctttcccctgcatctcatggccctacattgtcctaagacttatttcccttccaattacagaagtgtgagtactaagtgccaagaaggtgaaatattctacaaagtaggtgaaagagaagtattaataccacaccacagcaataaccccacttcgtggtgacaataagccgtctcccggggaccctgcaggctttgccccagcctgtctcctgcttcagctctcactgactgctgcccaggtctcaggcacaagggcttggcttcatttcttcccaagtgccccgctcatacccatctcgagtttctatcatagggactttaatctttgccccaccacctcccatcctgtatctttcccacctctagctccatgacctttaattctcagctcaatcacctcttccttggagaaggctctcctgatctgcaggctaggctagcttccccttatgcaatttcctgggaccatgtattttcccttgactgtactggttagctttctaattacttctttcttttctgtcttcccttatgatgctgttgttcttttgacctctagtgtcaatcactgtgcctgccaaacagatgtttgataaatggttatgggaaggataagtattaggcagtatattttcttctctgccgcttc

SEQ ID NO: 42884 - DNA, 2884 bp, Bovine  19866880539481
tgatttttattttttaaaaaaagactaatatgggcccggtgataaagctactcttggtgtagctaagaaaacaaatatacatgatgtaataaagcatggatcagataagcccatgtttgaattctgcattaacacttaattgtacgatattgggaaagtttcttaacctctccaagtctgcatcctcatttgtaggaaggattagttattgctgctgttgcagttattatttttatttccactaaccctcttgattagtctctacttgtattgcctcttaaaatgtgtaattcagaggagaatataatatgctggacctggtatgatccaggtggcatcgcgtgggactcacctttccttgtcctagaccgtatgtatctgtgaacacagcactgtttgtggcagagcaaataacaaccacacacgttgttggctcagttgtgatcaatacctgcaggtctttttctcaccaactgcagataagtcaggtttctccttgcctcccatccatcaatcacaattgaattaaccaaaaagtaggagcttatgtttatcccagtcaaattatatgctatttcaaaactgaggggaatgtttcttgcctatcacacatcccagctgtaccagttatctgtgaattactggtccatgcaaggaggaaagaaatttactcctcttgttcagggaccctggctgaccccctaactcatctgcagaagcattggttgccaacgtgacttggagatgttttctctcctgtatcacctgccagcatttttgtgttactattaggagatatgataaagtctgcaccatactaatgtgcccatagaagagggctggagaagtgtagactcttccttctcattccgatatcatatgcagtaatacttccatgttatttttcttttttaaaaaagtaattgtatttatttatttatgtttggctgtgctgggtcttcattgctgcactggcttttctctagttgcggtgagtgggaatactctccagttgtggcccgcaggcttctcattgcagtggcttctcttgctgctgagcacagactctagggcgcgcgggcttcagtagttgtggcacatgagcttgtagaggcagcccccagcctctagagcacgggctcaatagttgcagtgcatgggcttagttgcgctgtggcacatggggtcttcccagatcaggttttgaacctgtgtctgctgcactggcaggcagattctttaccgctaaaccaccagggaagccctccacattatttttcaatgggcaggcaggtctggaatctggctttctaagatgctacagtagctttaattgggagggcaagcccagcacaggttagtagggacatttgcaagcaagctctgtcaaagaatcctctcaaagaggtttggggactgccaatagattttttaaaatctctcccatcttttctgtccagaatgcgtcttgcttctttacaggccacatcaagtacctgggcttgcctgatggatgtgagagcccttgatccaccccacctgggctcccaagcatcaagcggcagtgactgcaggggaggggagctggcttagggcaggtttccacaccagctctgttggagtggtaattggaggggctgtcattaggtacctcttaacagcttccttaaatgtgctgacttgaatttacttagtttcaggagttctctaagcaatcataactgtattttaaatagtcatctctataaattacaaatgtcatttttctttagccgaagaatttcaatgacccaattattcaaaactaaatttaatcaagtgtatttttttttccttccacaagtgtgtgtttcctgggcctgcaaagaaacacaaagttgccatcggattggctaaatagagctgatagatggggctgtcagaatttattgctaatttggctgttaagctttgcaaggacttgacagcattggtgccttacataatgatatttactgtctggtcttgggtttgaacgtcagtttccccaagtgctggtaaacacatagctttgccctgcatttgcaatatatatcctaaacttacttgatttcctttggtgaagggcagttcgcaagtgtggcagtagtgttagtgcattctctctttgttatcatcgttcccgtgtgctgtgacttatgttggatatgtgggtgaataagtgaccattctgacagtggcactgaaaaaacctaaggatgtagaaaaaatgaaatttacaataccctattgttacttccttggttaaaggtagaaattatggctaaagtaaaagaactgcatgaatttgctggagttgtgtagtatgggaaaaattagaagtgcatttgttgttgtttacagccaagtattgagagtctaagtattaagagtctaagatcacatgttaagagctcaagtttacctgtatctgattcctggcaccatcttaccacttgtgtgaccttgggtaaattacttattctctctgagcctcattttccaagctataatttggggatgatattatatgtaaaatgaggagtgtaaaatgggaatgataatcatctttttctctgagatttgttatgaggagattatgtgaagtggttggtcattgccttctcagaacatacacacttaatgttggctgttgttatcatctgttcaaagtttgaaggtactattgaatgactgcttcacagaattcttggatgaaggtaaccccatgaaacaaagacaaggcagaaggaccaataaatgattctcttcctaccttccataagctatctttgggtttgctatgtgcatagcactgtaatggaatctttgaccttccaaaaactacatattaataatagggaag

SEQ ID NO: 42885 - DNA, 1185 bp, Bovine  19866880541660
gttctgcattttgacatcagaccacaggaactgaactcacaataaacgtgcccttcattcgtgaatttttctagtcctgccaccactgtcttagttacaatcaggtaacgaccatgatagattaattgtatggcagtgttgtaactcagcattttccctcagctcagactcaaccagaaacaaagactgaaataattagctgacagaagttagaggcagaaaagtttgcagaatttgcttttctattaatataaaaatagacaaaactgggctagaagtggggaggtgagattagaaataaaactcagagtagagaaactggggtacttgaagcaagagtgaggaaaaaaggttatacctagagaaggaaagtggactgagagctgagcgatgacctccacaggttagcctgttggacaccaaatatccaaagtccccatctttctacaaatcccaggatcttcatcccttgttatccccagagggtgggaaagtagtaggaaactgagcccattccccgccacagtgtgagagaacagagcccattctatatggcccatgtaaaggagaatactggtaagcatagcagtatcatttcacgtgtcatttctttcaatggccttcccctttcccctctttgagccctttctcgtgtcttctccaacgattatattttccctccaatgactagagtgatctcacatcctagtgtttccagaaaaatcccagtttattcctattgcatcactgtaaccagtgtaattgtctcttttgttgttcaactatgaataataaattatcaccttatgaaagcctgtttttaagtttaaaattttccctttcttcaaggtagagcattactacctcttatggggagaattccctaatttcataagtcatagtctctccctttgccaggacttcatagctatttgaagggatatcatgatattctaccttaataaaatagtaatttgtgaatatattcttcctctgctagccttgtaaaggccaggacaacattccttttttagtgctattaccagtgatttgtatgtatatagataatatttctcaaagtggtttaaagttatatgcaattttcaaatatcataatctttgaatgtaaaaaaggaaggatagattttcttttaaagtaaaatgaattaactggcattttctctg

SEQ ID NO: 42886 - DNA, 809 bp, Bovine  19866880561047
cgacttctactctatttacttcaaccaaatgctaactaaatataatcctgaaactttttcttattttgaggacaactctgtaactacagtttgagaaaccaaagaatgctactagtagaaagtctagaatattaactttcacaaattgggaactgtgatttcacagagcccttctgtattctatgtttgacctgatttatgattctgagcattattttttttatgttttattcccttaaactagatgcagacctaatattaggtaacaatttacttctcatggtggcacagatggctccatgacaagacatatttatcaaaataaagcaaatgaaaaaacaagtaatattcagcaacatttaaataaggctctccaaagtgctaagactttaaagcagacagcaaaatgaaaatatagttattacatctgcctctgattcattttcaagtatattttgaagcatgattaatggttttataaatacttttctcacttcatccataccaacaaaggatttcaaattaattcactatttctgacttcatccttaatggatttttaaagtctatggcaacaaatcaatctattgcagattcaaatccatgaaaaaagtgctatacttttttatataacagaaagcaataggaatatgacaatataaatgatactgtgaaatagaagtggtactatttgctctaaacaggaaaagtgacatggtcattttaagaaatttaatcactaatacccaaaagttatattttgaatttttctagacaactaataggctcgagtaagattttaaaggctt

SEQ ID NO: 42887 - DNA, 1753 bp, Bovine  19866880562192
gtgaaagttggactgtgaagaaggctgagcaccgaagaactgatgcttttgaactgtggtgttggagaagactcttgagagtcccttggactgcaaggagatccaaccagtccattctgagggagatcagccctaggatttctttgctaggaatgatgctaaagctgaaactccagtactttggccacctcatgcgaagagtggactcattggaaaagactctgatgctgggagggattgagggcaagaggagaaggggacgacaggatgagatggctggatggcatcactgacttgatggacgtgagtctgagtgaactccgggagttggtgatggacaggtaggcctggcgtgctgtgattcatggggtcgcaaagagtcggacacaactcagcgactgatctgatctgatctgatattttagattattttctagaaggaattggtgctttaaaacaacataaacggctattggcaatataatatagtagaaagcctttgtttgggccctcagtttagatcttgattctaaaggaatgaccttgctaaccagacagatttggggattttgttactttcctcctgggtttgctgaagagattaaatgtataatgcttagcacatagtaagaattcatgaactataattatgatgagagtgtcagaagtcacctatgtatagaggattatcagattacgtttgagtgctgcaaaccaaaacattgctcatcccagtacattaatattcacggtgccttccaaaggatctgtgcaaactgttcatctgtcttcagaatacatgggaagataaggcacaccagtcgtgctaagagcactggagggcttttctctgcaggtggtcaagctgtgttgcaaaaataaaatccataacaaatcaactctgagtgaaagtacatacccatctcatcttgtcctgtcagatggagtgcaagactgtgtctcagagtagaagcagtgaagctccacaaacaccaggacgtttccaagacaacgatgtgtgaaatgatggtgaggcctgcagtcaccagactgatgaagcaaatgttttaatacaggaacctattacgacttatgagcgagctgcgagttctttccatctaaatgcaggacaaacagtatcacattttggaggacaacagtgtgtgaaatgatagtccctgttgaaatagctggagtgcagaagcaaatgcgttaaggtaaaaagcttactacggactcaggagctgtaagctctgcttccctcgggcaaaagcctgcagatctctggaacccgcaggctaattcctgccatcaggagtttgagagcataacacgtgtgcagggattcagtgaggtgtgagggccccttgtcccacagatgcagactgttcctcctgttagccttgtgctcacccccatgggggctccgtgaataactgcttgagtgataatcctcagccatgcgctcagaaagtgttacgaacggctggtttctcagaaaaatgtctttctgcgtgcatgtgcaaatggtgcttaaaatttcaacatgccaactcctcttgaggcacttcgccacttggaatattaaatacacctcatcagaggagtcaggcattaggctacttttcacacaatgtgaattaacccaccaacctatgggtcattcacacttgagggatacactcatagcaataaacctgctttacagaggttccgttgtgcatgcaaatatactctgggagagtgctttgag

SEQ ID NO: 42888 - DNA, 1223 bp, Bovine  19866880753008
tgcatttataatggattctttatgattaatctgttcttatttcaaagatgcttattgaagaggaaaatgctaagagaaaaccaaaccgcatttatgattcttcctttgtgcaaaaattatataccacacaaaaaaatgcttttaaaaattatcttgttttcagctgccacaagtttttgcacttaatccctcagcctgaaacattattccacccaaatatttccatgacatcacatcatcatttgatataaatatttactgctctgaaaaaaaatataggtattatttttctagcactgaagattgattaacgcacattcttacagtaaaaagcaagtaacaggagaagacactaggaatacatacaactggctatgaaattactatacaaaatatataaccatcttctctaaatcagtgaacaagataagcaacaaaatagaaaactgagaataagtaaataaattttacagaaaaggaagtacaagtgacctactaatatatgaaaatatgctcaacttcctaagtctttgggaaaagcaaattgaaaatcacaataagataccattcccaacgacgatattggcaaaaattaaaaattttgatggtagtaaatattggtgagggtatgtaacaacagaaactatcaaaatgtaggcaggtaagcaaagcattactgctttggatactcttcgccatgacacattacgatgaaacttattcacattctgtttccaggcaaattcactactaggtatgaaaggcagaaaagctcttccctatgcacacaagaagtcatgtatcaaaatgctattacagctgttcttgggataacaaacacatacacaaaaccaaaactgaaaaaaaatccaaatatcatataacaacagaagagaaaaataaattctatattaatgtagcagaacattggttagcaaagaatatgaatgaattctggctacacaaatcaatgtagatacatcccagaaacacactgttgaatcaagaagaaactgtatacagtttgattccatttttagtattcaaagcaaaaaagcatttttaagtatacatgcagaaatgttaagaaccagaaaggaagcaagagagtgataaacaaattcaggatagtgattaactgtgggctatctgggagggggaaatgtatctaggacgcttctgctcataaactatttcttggttggttggtacagggatgtttg

SEQ ID NO: 42889 - DNA, 3844 bp, Bovine  19866880827035
tagaacagtgcactttctcatactcttaggagcttacagattttttgagtatcatcatataatgtccagcctccatttttcagaacaatgaagtagctatactctgggaattaaaagatctgatttctagtacaaattctcccaactagttagctgtgtaaccttggataagttacttcaccttttcaggcacatatgtctgcaggaatccttttttgttttgttttctgcaacttgcacttttttgagtgtctactatgtgccaggtcccatactaagactttatgtgtatcgtctcatgtagtcatcatagccgtactgtcagcattctggtttttaaactcattttacaagtgaggaaactgatgcttagagaattcaaataagtcatcctaggttagctgtctagctgggaaatgatctagactaaattaaaacccagatctgctgactctgcagcccttggcctgaaccagttatcagttgcctcccttgagtctatgttgagtctatgaaacataatttactggtctgtttcaggagaaataccttaatatctgttgagatattagggcccattgcaactgagccacatttttaaaaacacagtcctgctcaggatttagaattgctatggaaactataggttgaagattttagggtttttgctgtcttttgtttaaagagtattgaatcacctttaatgcgtggctctgaaaggctcagaaggtaaaggatgtagtcactttaagcttttgagctcagtaattgtataaaaaacccccagggaatcatgttaacaagcaaacctcaactacagcccctagctccactcagagcatcgcaatacatgtattgcacgtggtgctttcaagagcgtagaggatgcagagagagagttgaggataacaagagactcatttaacaagatggtgccaacaagtttccagctgagctgcagtgacattttttctttttctctctttagggcagacaacaaactgatgggtatggggtggcttaattcctgcctgccctcaagtgaattttaaccacatttctctgtttactgactgttcattttgcaataaaataaggtgtccccatcacattccaccacctgaaagggaagaaattagttggtgaaaacagtggatgtatttagcttgcagaaaatgtttgcaggcttagggattgttcaaccctcatttacagacaagggtgagaaattccacaaggtttattttgtggcttcaggggctgtgtttgcaggaataaaacaagaccatacattgccccacaactcagcacttagtgcagaagctgacctggacccctgggacttccaagtgtaggagttagaaaaatgaaaaccaaaacacactctctagcaaggcacccccattaaaccaggctctagttagcttccaggtaaaagataagaaagagaaaaacacggtgatcattgtttgcaaaagacccgggttcatctgtggctctccatctaatttgctgggtaaacttggacaggccatttcgtctccttgagtctgagtttgcttctatatgaaagaagataagaataatactatctgcctcagagcaataatagaagagtaggatggaattaattatttctcttgctatctctctcatgttaacgattcagaatacattggcagggagaaagagaaatatattacttcctggattcaattaaggaagggctttagagagtgggcaggatttagagaggagtcttttgtagtatttatgtttggaggtagggattaatctcctataaggatgtagtgtttgctattagttcagttactaagcgctaaagtctttggtaaaattaatgagagtaataatattgggcttcccaggtggcgctagtggtaaagaacccacctgcttatgcaggagacataagagatgcctgtttgatccttgggttgggaagatcccctggaggagggcatggaaatccacaccagtattcttgcctggagaatcccatggatagaggagtctggtgggctacagtccatagggtcgcaaggagttggacatgactgaatcgacttagcatgcagtaataatattggcagtaataataactaggcacgtaagctctcatgatgaaaaaaaaaaaaaagatctcatttagccactaactaaaaaatcctttcatgtatcagggtctaagctaagctgtttgtgtgcaatatcttattacaacagcaatataaattgttactttagccagcctccaagatttacaatgatttctacctttaggtatttatatcctggtatagtcccttttcacagtgtattagcattggttgtgtgaccaatagaaagtgaaagacatgatggtatgtgacttccaaagcaagctagaccataaaagatattatggctttcatcttgttctttctgggatcacttagtctggggaaagccagccgccatgtcatgaggatgctcaagcagcccactggagaggttctcatggtgaaggaatgaagctgaaagaggaaacagacagaacaggctccatcttgaaagcaggactccatcttgggctggactgtggactttgaatatgcccagtatctatggaaatgacataccaactggaaaaccagacccccaagatggaagagccccagggcttgtacctagactctccatggcctaaaagaataccctaattatctgtgtaagcaaatagatcataaattctattatgcttattaggatatgaccacaggcctattgataattgtccactgttaactacctaggcttaaggcatacaaatcatgggtttaaggtatacgaatcatgggttaactttgattgtatctttcttttcctttttcagactagtttcagagaatctggggaggtgggtttgagcatgtatactttagggtatataaggttttcacaaaaactggtcggggtccttagctaagaggagactctgccttgggcccgctggtgtaataaactgcactccactatctgcattgtccttctgagtgagtttgtttcctggaacacgtggctacaacattcccctaccccagaaccacacccagtttactcaactttttctcatgatccttctagaattacaataactcaatgctgggcactgtggagtccatactcatccgatatccttctatagataacatgactaatacatggagatggaagagggacagctggaagaggcctgagcttggattgcagctcatatctgcctgactccagagaggcaggcacaagccttctgtatcaccctccacagcgtggtgtgcatgtgtgtgcatacacaccaataacaagtgtatgaaaagtagaagtgttagttgctcagttatgtctgactctttgcaacaccatggactgtagcccaccagtctcctctgtccaaggaattctccaggcaaacatactggagggtgcagccattcccttctccaggggatctttcccacctagggatcaaaccctggtctcctcattgcaggctgattctttaccgtctaagagttatttacactcccactgccttaggaggagaagggattctcacattgaaggacatctttgccgaatgaggagatggatttgaggacagaaaactagagaaaccaggtcacagctgaactgacctacacaccaaagtgagatggggagagtaaagatggggtgaacccggccagaagagctggagaggcagcaggacaggagatccacgtgagtggatcaatggtgcttgactggttccacaagaggcactttgggagaagggcaagaa

SEQ ID NO: 42890 - DNA, 906 bp, Bovine  19866880837440
cttgtccttttggtctcgcttgaccgccatttctctaggaaagcctttcattaccacttccctgcattctaggttactttgttttaatcattaatacaatttcattaaaaaaaaatctcagaacagttacatcagtttgtaactacacatgtattagtatgatcagttataatctgctattacactacaccatatgtttcctaagaatagagacttaacgtgtgtcatgtagccccagaacctggcccagagcctgacaccataattgacacttagtactggctcaatgaatgaatgaatgaatgaaaagcagttgatcaaaaccacaagtaccataaaacagagtgagagggccgatactttggatactagagaaagttttcaaagttatcttttcagattaatataacaggtctaaaagtaacaggacaaaatttaagatggagaatatgacaaagaagtgaggaggtactgtggagcagatggaaaaggagtgagttttaattaactgtaggtttaatgtggtctcagaatagtgtggcagaaaagctgattcagcctccaactgcagtaattggaatgtatattcttcacacgagagataattatttccctctcctcgacatccccccaattactcacggaagattgtgcccaaatctgaagaaaaaaatatatttataaaaaagaagcatgtttagaggatggccagaatgatttttggagactcaaaatgatgttgtgagaggaagcttcaagggttagcagtgcttatctaggaggaaaaaagtgtgtcagaggtcacattagttgtctgaaaatctatgattgttgtgaatatttcgagaacataaattgcaaaagtggataaaaaaataaaacaacaattctatttttcccctttaa

SEQ ID NO: 42891 - DNA, 1219 bp, Bovine  19866880852287
aaaaaaaaaaaacccatgacattttcccaaagaagtttgatttacttggcatccagaaggcctgatcaggtctcagatcggtcccttcaggtactctcaatactttccattcttgcgacatgtcacttcccagctctctttaatgaagacattcacttatgaccctaacgtttcttactaaacgttagaaaactcaggcatcatttctctacagggcagtgcgaacacctgagtaatcttcctctggtctgaagggctgtgcagtgacgggggggtggtgctctccagagtttgagtcaaaattctggctctaagcgagggacttcttggtaccacttttcctttcctatatgaacggccgccactaaacatcaaacgagcacagaaaatgaaaatgacctagggaagactggaattaaaatctgataggaaagacctcagaattctcactactgtttctaagaaaaaagtatgtatatcttaagtttttaaatcctttagttgatagaaatcaaagcgctgctttgttccatgctagagtacatgcactgttctcgtgtcaaggcacacctcaggaacccaacagtcccatttgctgtacgcagaccacggcttactgggagaatagggatttcagaatcaatgcaactcaaaagcaaatatccttttggggttcccaaatcaatgttctagaatctgaattatattggtaaccagggagaagcaagctttctacttcattgctcaaagtcctaacacttcccttgtggattcaattctcaatttcaattaattaaagaaggaagaaaaacatattgaagtcttagactcttctagtgtcccccttttttattgtctgaatagcaaagtgaaagtgaaagtcaccctgtccgactctttgccactccttggattgtatagtccatggaattctccagagcagaatactggagtgggtagcctttcccttctccaggggatctttccaacccaaactactttattattcaggacaatagattttgcatatattatcagataaacctaaatcatttttgtgactaaatttagattattgattaagtgatacttgggggaaaaaagtttgattttggtaccaatactggaaaagatggagggcagaaggagaagatggcttgagagaatgagttggctggatggcatcactgatgcaatggacatgaacttgggcaaactt

SEQ ID NO: 42892 - DNA, 774 bp, Bovine  19866880852756
aatatccataggataggatccattggcacccatgattatgggggaatttgcatcatatggatggaaaggaatttgtaaagtcatgccatctgtttttttgacttaagcctcccagatatctggcatagtgagaagtctggaatgagggcagaagacaaaggtgtactgcttaacttccctgggcctcagctttctcatccataaaataggaatgtaaaaatgccttccctctcgttgtaaatatcaaatgtgtgaaaatgctttgaaacttggaaagtgttgaataacatgaagtaattatttatattagtagtctgttctcttcaccctctgttctcttcacctttgcaaaatgacaaaaaagatcttgctcaggagagtaattgtggttaaatactctaggctaagcctgtggagggagtgtgtgttattgacatcaatcctgctacagttattttcaggagaaaaggtataagtcctatagcagccagcagagtgtttttgattaccccatggatttgggtagcttggagatctgctgtagagctggaatctgacttcctctgtgagcatgaatttggctgaatttagtagtgagaaaagcttaagaaaacccacacatgctgaaacccaaaaggctaatgagaataaacagcttgtgtaattagaccttgtgcatttccctaaaaagaaatcatgaaatatgaacaaaatgttgtctctgaagacttcatgggtacttggtctagttttcaatttggaaactatgctcat

SEQ ID NO: 42893 - DNA, 1022 bp, Bovine  19866880889655
gtaggtaacttgctcccatatttgaatagtacctggggaacttctgctttcactcaatatggaatagcaggtactggatatactctcctgcctgaaacaatcaaaaagtagacaaaacatagaaaagtggtttttaagatcctggacatcaggcaatgaaggacaaagatctctgaaagacaggaaacaaatgaggtgggtcctaagagtatgccagcccatctgcccaggacagttttcaggttacgacacaggaggggacacaggcagcgtctggtggacatcctgggtgaattcaggatagaccactggacagaaaccgaagagagctgcacagagacaacgctgggaaactcgtgagtattcagcggaatagtcatccgggcatgtgtgagagaactgcctatccgagacttttggaaagaaccacccaatggagagagagggacaaatgttcagtgctcataaggagctggggatagtgaaagtttccattcatcacaatggttactcccatattagtgaaatgtttgtgccacagaatggggcaatttaaacatgggagtaatttattaagggcttcccaggtggctcagtggtaaagtacccgcttgcctatgcaggcgatgtgggttcaatccctgggtgggaaagatcccccggagaaggaaatgacaacccactccagtattcttgcctggaaaaatccatgatcaggggagcctgatgggctagagtccatagggtcgcaaaagagttggacacaattgagcgactaaacaagaatactttgtaatattgcatataaaggccagatcctaaagacaaatgtcacatacccttttcacaaatggcatcagaaaatgcaaacaggcctgtatatgcagtcaggagagaagggattacttttgcaggtcatgtaatggataatcttctcactccagtcttagaactttacagggatggtaagaggcttggccaataaatgttagtagaatctagcatttgactctaaattcaat

SEQ ID NO: 42894 - DNA, 1786 bp, Bovine  19866880921675
ttaacattttgagatgcttggttgaaaggtacatcacagaaattcaaagtctaatttggcacactcattaaatatgtattcattaaacatctactacatgcctgccaaagtgctgcccatcaggcacacagtgggaaacatgaatgcaagagctctgcccacaaccccctcactgtctgctctgcatcatccagcttgttccaacagaccaaattctctaaggcaggtccacgacttgcggtccatggcattgattaacctgaaaataaagagagatctttggttatctgtgtatttacttttctaaggaaagggctcatagcttttattcatttccctgattcttcactttaaaagttaacaaccaatagtaaaagaaccatgatggaaatcaaggaatgaacaagcagttaatataagtggaggaccacttctgctcctctccctgtctcttcatcccatcgcaatctctggtcacatcttattgagaaatctcaagagccactagagtgtaactgtatgatacttgccttgaaatcgctaaagtactacacataaatactagttaatgctacggtcattattgctaaacttgtaggtttcttcttccaacattttccaaaaaagtcaaatatttcatgaccacctactatctttcaaagacattaccttgcaacgctggtcatttatgaagtaagagaagaaaaaactggcattcaagctagtgcactggccagttaagtttgatctgcttttcattttctcttcttactttctatcctgccttcctgactatgtttccttttgaaggatacaaagacaatgcaaaacttaggttttacaggatttttaaatggttattaattctgaatatttttaaatgatattagtgtatcctgatgttaaatgggaccaagtggctttatgaatacaataaataaagaaaaatgcattcccaaagagctgggaataaatacctatgttccaaaatccttctaggaactaagggaaattaatgtttttcatcataagaaccctgggcagggttcagactgcacaatggttggctagatttatcctcctcctccatcatttgtcatacaccatagtaaaaatcctcagaagaatttaagcaagcattgtcagataattgcagcctttaatggcagacacctaaacaacagccgcatacacacacaggcacacacatacacactgctttctacagcttgcatttccagactgcattgcctataaagatggcttattttttagagaaatcatacataatttgactagttttgcctttttaagacagtgtagctgtattcattgcaaaagcatttggaaatggttctatttgtttcttctagctcagctcagacagtatcagttcatcttgtgattatgatagaaataaacactccacaggaatcctctattttcaaagtcaggtaggtgggtaatgtctccaggtttttcaggattcaaagcaaagtatagggtctcaaagatgtggacatgattgagcgactaagcacacaggacatatctagagaaagtgctcctgccttgtgctgctgttaaatggaaaggaaacacggttatttggctttgcagaacacaagcagctcccttcctctgacagctcttgtaacagtggctgggatatagggtaagatcctcaggacgtgaaaatcaaattctatataatccgcttacagggggaagcaaattaaaagctatttttgttgagtttttgagcccaatacatgggtctcctctg

SEQ ID NO: 42895 - DNA, 2482 bp, Bovine  19866880946562
gagagatctttaaaacagtaaaaacaggaggaagaaattataggatacataacatcaccatgtacagaaattgaaaattcatgcacatagtacaacaaaacacattttgtaataaggtatcaaatagaatgcacgctaaacattgaaatgttgagggagggaagcatggcgcattgaaggaattaatgattcaaggaaacagcccaatcagaaatcatttactatcagctgaagactacaactaacttaaccccttttcagggtcttacggaaacatgatctctttcacactctaagtaattctcttcacagactttaaagctactttccttgttaaatatttgacaagactcattttacacttggattgagttgtccattgttcaaaacagtgactcacaggttttcgtataaaatacaataaccagaggcatttttataatgcagatatcaacagagttatttaatgtttactttgcacagaaaggaaatatctcaaagtttaggtatttccccaaaagtgctattagcaaaattgcatgcattatctgtctcccctatgctatagacatgtatacatacatatacagtaatatacacgacccactttactttgggctgggaaaaacatcctgtaaaccaggatttctcaatcttttttcattctttcccattcccccatagagtctttttagacatattttcctagtcaacacactatcgtgaaattttaatgtaacatatgtactatatactcacatactgtggcctttgggagagtcactaactgttgtaacatcttagaatattttcagcctcccaagaaccagttttcaccttcttggggacaatatcactcccactgagaatgcataccatacactaaagccagtttttaaaccaggattcaaatccagtctcataggaggttaagattccaagaactatttccccacctttccatctgaaatccttccttcatcaattcattcttttgtgttcatcattttctattctcatcctgtctgttttctaagtagcaaccattttgaagacacaacgtattaggaatacaaaacatcattttaaaaattaaaacacaggacacctgctaagagcagtatgctttgctgaacattggaaagaattgagagttgagtcagctgcaggctcatctctcagaggagttcagaactggtggactatgagaaatgggtacaaaagagagaaggaaggtggatggggagataattagtgtgggttgaaacctcaaagtgaaaaactggaacactctgttatcaccatatcattaaatttattcagtctttcttctggcaagaggggagaaaaaaaggacaaagcagataagtttggataggagagatgttcattcattcattcattcattcatccaacaaacatttattgagaacatgccatttgccaggtcctgtgttaggggctgatacagagactcattgtacgcattgagtctttccctgtgtgcctgtccttctcctgggggagagttaacattccagcgataatagcaaaaactcctctgccggtgtcagtcactgccacactggccccagcatctccactctggaaacaagtgttgtttcctgtctcagcctggggctgtcagcagcacagtaatgagtccagcacatagtatagcaagcagcccaggctcccctgcgactgcctgacagtgcttagaatcatttgtcacacagccgaacagtgagctccaagccttagcaaggtggcaattaagaaaattcaagcatatcttcatttacccagtggagttctttattcttgacagtttgtgaaattgcagtgttaagtaaagaatgttcttagcttatttgaaaactcgttaactagaaaataatgcagtaaatttgtacacgtaaatgatgtttatagttctgtgccacatctgaaatttctttcttttccttttctttctgtcattctctgttttattttgtttgctctctgaatttcaggagttttgttgtgttttgcttttatctttgattttgaaaccatgttatgtttggtgctgtgtaagataattcacctcctgcatagtctgaaagagatggttatgaaaagtttcaactttgggtctaggctttgttgaggaactttgccttttagtattcccataattgcaactgatccattgtgggggtaatctgcaaagcctttccaattagttttgggatagaacctaacataaaatatttaaaccaaggcctctatgcccaaatgttgtatgttattctttgtgtaactgaattatattttgttcattttgtaccaaaaacctgttctctgaataaggactagggcttaaatcagctcttttttttttaaatttctgggtgattgcatcagtcagtataggctgatgacgctgcatttatgaaagacctcacatgacagcttacaaaagcaaggtttattt

SEQ ID NO: 42896 - DNA, 1743 bp, Bovine  19866881089845
ttgtgttaattcacttcatgcacataatctcattacctcatttcactcctacagcattcctacagaataggcattattatccccaggcatcagtcatatataaccagaaaaacagggtagattgattgactggttgcaaagaattgacttacccatgtgagcacttggctagacaagtagggcaggctggcaggaagagcagtttggaaccttgggcataaggtaaaagcacaggtaaaatttcttcttcaagggagcctcagttctgcttttaaggccttcagttgattgaatcaggcctatccagatgacctaggataatcttctttacataagtcaacagactatggactttagtcacacaacagacctttatagcaacatctagattatattgaataaatggagaccaagcctagccaagttaacagataaaactaatcatcatgaccctttaaaagataaggaaatagaggctcagagatgtagtaagttgcagagctggatatttaggatttttattttatgctaaaatacactttaggtattttttcaacttcctaaattacatatatttgcagcagggtccaaagaaaatatctgaattgatttaccgagagtgatctaaattatgtaatattcaaaacataatagtgaagaaagtcattcactgtatagcagccaaaagataacaagaatgacttattttttcctatttaaaagtcttatcatgaataatttttcagtttggataaaatcttgattttaaggaagtcaatgatagtagagttttcttctctaaatcttcctttaggattgcaagagacgcaaaaccttaacatttatttctagccccgaggctgaacaagtcattgttttaattatagaaagctgaactttcatctttctttaattgagcatggatagtttgtacctgtgatcagtactaaaatgtcatcaaatcacttatgacgtttcacactcttgagctgcagtaaaaataccagttattttgtacatctgtgcagtcatcatgtggggcaatggtttcaatttgttggtaattatcgtctgctcttcatgactagtgtggtttggaaagcgtcacaagaagtgctgtttcactttggtgatggccagtacatttagcgaagaggaggccaatgaggagacagatgctggcttcctgggtacactgtttgaatgacaaacagagacgaacaggtcattacttttcacagcaaggagaggaggagggagctcagaattctgaaggaaatgttggcctttggatgcttcagttgtgcattctaacgtaagaaggcaaggacatttttatttgcttttcttccctccagtcacactctaggaagacagagctattattataggctatgtctaaactcatggtctttagcaaaaaagcaccctagaggccgaaatggatactgtgcctgttttctgtcacaaagtttgatggtagaaaagagggttggagcactgatttatagcagccttggaaatagttaccagtccacatgcctagtaacaattgtgatctagttcgaatgaagatggactttatctaaacgccagtctatataaccttgaggaaaaaaatgatagggtgatcaattacttttatcccttttagacagaattacattttttaaaaaaaggatagtttgcaaatttgaagttgaaacaaatgcatattttaatagaatatgtttcccctgaggt

SEQ ID NO: 42897 - DNA, 1359 bp, Bovine  19866881114674
tcctattctttaaggaaaatacttattttgttagtacatttgaagtgacttttgtacatcaagagccccttcagttctgcttcaaatagaggatatctttttttccccccactttgctaaaagcaggtgccgatcacaaatctttttaggtctttagcttctacttcctgaaccacgcataagctgatttttgaattctcataatattctacataaaataggtctcccttgaacataaaacacaaagggagcgtatttggattcccattcaattaatctgtcaagactaggtaatgaagtcttcttgcaagaaaacaaggcttgcctgtgcgtcagtaactgttgtttcattgtttcctcatctatcaaattttgtcttggttgtcacatagcagcgtaacttagcattaattatgatatatgaagatttcataattaatactaacatatatgaatatggtatgctattaagtacaacatacagtgtttctctttcatacagctgtggaagtggcagcatttacttaagttattttctcactggaagtctaaagatacatatgtttgaatcatctttgtttgtattgacacatttagggcctgaatttcatggtggatggatgggtggatgggtggatgaatgaaggaatggacaagagaagagggaatgagcatattttatgtctcaaacactgttagaagcattttacagtttattattgaattactatacttactgataaccagaaccttagattttagcctagaggtaagactatttcatcctttcgcatccactcaggatgtgaaataaggctctctcctagtgctttggcactatagtttttaagcatgttaatttcatttcaaaggaatgatccttaagaagtggcattttgaaagttcatataagttatatactctgtaatgctttaggaaatagacagctaaattatatcagccatgatgacttcccctgttaaaattaggaaagaagatgccagtgcttgtgtgtgtgtgtattcatgtgaagtgaaccattctttgtcgtttccagaaaattagaatgcctatttcctcatacagttggtgaaaataatcatacttcggggattttttgaaggcaactgatagtaagcaaatcatgttgtcaaacttaagatgtttttgtcaaagttggcaatagggaaaataaagtacctattactattatgactgctgttgatacgactgctattgttataaattataataatgatagtagctatcatttatttaacacaatatgtgctaaaaatagggctgagtatttttcatccattatttcatgttctacaaaaataaaagctaaggctaaga

SEQ ID NO: 42898 - DNA, 1496 bp, Bovine  19866881148368
ccctaattttccctttcttagacttgtggaacaaagatctcacacagccaggataacagccaaagaaattctcacaaaaggtgagactttggtcattttaaagttaccacatttgtttcgaaaatatctagatgataactttacaataaaatggcttattgcctagtttagaaatgccaactacattttatgggtacccttcaagtccatagtaaagacagaatcccaagtttaagtcacataagagtttattataatgatttgtaactttctgacttctagatagctcagagacagaaaaatgtaatcttggctataaccttttcttacttaaatttgactcagttcagttttacccttctgggaaagtacagcgttatgtgtttaaaaaaagtcactgaaccagcaaaaataacttaagaaaacaggtaaaatagcaaactaacatctgttacccatcccctaaacccctcccaccccactgaacttcaaaacaatattgtctctctctctctctcttttttttaacttgtattttaatgtccttttcagtgaatatatagaatacaggggcaaatgcttttcagtgaataggttcttcttcccttcaacagtgactgaggctgagaaaagatgaggccactggttggcttgtaagtaggtatgatccctgggactcatgtgcagaccacactgcctgccttttgttcagcagttgatcagtgccaggaagtcagcagtgcagtggtctgctagctactcttagacaaggcagacatttctctgtttgggggtccattgcatgagtgcctccctattcactgttctgtcctgtggccctgaaggccctcaggtgaccaggagtgtgatggtttcatctcctgcacttctacaagtttggtgcctgttactgaattgattttgacaggactatgaagatcttctagtgagatcttcctgtcagccatctacaattctcttcaactatattgtatatccctgaggatggagagcctatgcgagcaggaagtgggattactaaaaggaaaagagaagaaactctaaataaaagttgaggggtcaattcagaaattacttcaaaccaccagaagtggaattaagttaccttctgcttcatttaacacttttcctcactagctcagaacatccagcttaaatattgcaaaaaacacacagccaggtaaagatcaagcagtacttggagctttcagtacaatcacactcagagattttggctcttgaataaaagtgtcagcaagccttggaattcccaaagagaaaaactcactgagcctttattccattttcttaaggtctattgttaactaaagactccttgtcttttcaaattccttcatgtgaatggatgaggccagacatctgccaggatttgctcacatttgcatgcaaatcagagacttagggacacacatggccccagagccaacaacaccactttttaactgtagacttac

SEQ ID NO: 42899 - DNA, 2256 bp, Bovine  19866881149241
acacaattgaacccataacaaggaccaaacataaagttgacatgatcacacagaaaggttgtccatgaaaatagactattacttttgttatattatgagcagaattactcaatataaactgtatatcttctctattttatgtatattagtcctttctcttcggctaaacttaacatcattgagaagtgaagccatattttatttatttacttatagattattagcctgctagggctgccatatcataatacagactgggtgccttaaacaacatatatatattttctcatatttctggaggttgaaagtccaagatcaaggtacaggtagggttggtttctggtacttttctttttgggttgcagatggctgccatcttgatgtcttcatatggtcattcatctgggcatgtgcattcctggtgtctctttctcttcttataaagacaccagttctgttggattaggtccccacccttatgatctcatttaatataattatctccataaaaaccttatttccaaatataggcacattggggattagggcctcaccatataaattgggggggacataattcagtctataacaatgatattgtctcctaagcagaggtctagccatgtgatgataattaatcaatatgttacacttagcaaaaccttcatggcttcactggaagaaaaagaaaaaagaacccaaatgtctgcatatgggaatggagatgggagagtattcatcagacattctatagttgaattacctgatttcatataggttactactttgaaagacaaatataaatttatagataaagcaatccccaaaatgacccaaatatttgtttctggtcaggtattttgttgaatccaggggaggattccaaaaaaaaaattatattttcaaacctattccaaagttcttattttggggaccaatctaaggcttgaaggcaaagcatactatcttttttgagtcttccagaatgttgcagtaagagtgtcatgggtctcccatcaagtcaagtgtatgaggctcagaaactcctttttgcacaacaccataaaaactgacctctgggacactgtctctttgtgctccaaaagactcaggaccgtccacaacacaaagtcaaaaaaagaatcttgagatctaccaacatcttacatcctgcacacctggtactctgataaagctgcatgagctcctctctcaggagggtctgtgcaacctttgaggagctgaaactgtttcacgttataactactgtacactctcttacctacctgccggacagttcctaggagttctactgtcactaaagttccatgagtagggtggtgagggtgggcagcttaacccccatagcctttatctgtatactgttttgggatgcaggaggaatgggatccaaggcaggattttcagaagcctgacatcttctcacagaaactcctccagcaatgatcatgcctatattctgtgactatcccatcagcatttacatatttagttttaagtaggttattttgaccttgggtaagtggccccataactaaatcattcatccatccatccatccatccatttcttagcaaatcatttattaaagttaatgactgtgagctatacccagtaccaagcaaagggatgcagtggtgagccaaagagactgagtctttgccttcaaagcagtatattaaactgtagatggcctgcctctatctggaactgaaggcaaggaaaaagtctctggagattctgtgtgtgtgtgtttccccacagggctgtgttcctagcaggtgctcaataaataactggtgaatcaagaaccagatgtccagggtcagctttgttgcccgggtacctactgatttatggctccatatggtcagcttctctaaccttctcattgccttctatgccaaggctgcatcctttttccctccgtatctataactccatttctaagagcacagaacgtactttgctttttgttatctgtcttcagatcctgaccagcccaagtagaacagaaaaattggaaggagttggaggagttttcttccttcgcttgcataggcgaccccacagactgtctgggctgtttctccagttgaaatacaaagttaaagccattctcaatcacattaaccattgtcaggaaggagcagattagttacaaagcatgatgatgcagagaaaattctaattaagagagatgagggaatctaacacatatcatcagtcattatg

SEQ ID NO: 42900 - DNA, 861 bp, Bovine  19866881161647
attatgtgagaaaattccaccgcaagagggttatggacaagattttctttgcttcttggaagatggaagactccctgacaaggattttattttcattgtagtgggctgtcagcatagccatttatcatagcctgaattaataaggcacgaagagaagaaagacggcttgctgccaaacagcttggggacgctcggggctgcacagatcaatcagctggacacccgggctattgtctgctcatcaattcattttcattgagtttcagaacagataacaccaggcctttttctgacgcatgagcctaaactggccacctatgcttgcttcccattccacccttttaatcgcacaggacacacatcaaggtggcattctgtgtttatttatttatttatttttgcaggtttttttttttttaattttactttatttttaaactttacataattgtattagttttgccaaatatcataatgaatctgccacaggtatacatgtgttccccatcctgaaccctcctccctcctccctccccataccatccctctgggttgtcccagtgcactagccccaagcatccagcattttgtgtttagattatgctctttctctcgaaatcagctcatggcagaccactgctcctttccattgcccaagtgcacaagaaccttaagaatttttcaaaactaataggcaaaagagattagcatcaagcgcatctgagatgcaaagtcagacctctgtgtgctgtgacagcataataaattaaacaataaaatgctttctaaggtgacgggagacctgtaggccacaaaggaaaatgacaacattgatttccagggggctgctctaatggacat

SEQ ID NO: 42901 - DNA, 3310 bp, Bovine  19866881216798
ggtttctgacttgaaccttacagtggttaagatatgccaagcagaggtgagacaggaaaggcattttaagtataagaaacacactgtgaaatgtggaaatgagtacagacaggattctgtcaaggaaggttttgccaacaatgatcagtgtggttgggtaagagtatgaggcatatctagaagaggaagaaaagccaagtggggcatgaatcagagcatggaagaccttgagggctgaggtaaagagctggagacctagtggatgttgtgaacagagaaatcatttcttgctggtttgtgcttctaagccttaatccactcacatgcagcctcttcagtcctgaattcagagctgccttctcagctttcatttcctgctcttcactttaccctcatgcttctcttccagctctcccacatcatattcatctctttttgtacctttgcttatgctgaacccctcacctggaggattccctctccctctttctttcttcttaatcacatctgccctagctgctcatgcattttccatacctgtccttagcgatcctttcttccttaactccttgaatacctttcatctccatcacccagtctactcatttcctgataagaataaggtctttgaatgtagagaccatgcttttattttgctgtttcatacattcccggatacacagagagtgctcaggaaatacttggctaatcggacaggttagccacatcttcccaagagtctccttgtgtgtatcaggtcagtggtaccgtctctaatttgccttctcaaggttggtagagtaaaatacgatgggcttctcctggccctttttcaaggggttctggtgatgttaacatgtggcttttttatgaaatggggactgttagcctccaggcagcaatttgggaaaagaaactggtttattctgtgatgttttagatataactgacttgtgtgcattaaatttcagtttgattcacttcttgctttgagctagaagtgaagaaactcatttttagttttcagctttgccattaattagctgtgcgactttgggcaagtctttaccccctctctattaataatagctgtcttttattggatgtgaaataagtgcagcattactaggtgctgtaaatccactgttttatttaatcctcctaccaattttgtgaggtagacctcatgactgctcctagttccaaatgagactcagatcagaaagtaagtttcccagagtcacagagctaataagttacaaaatcagaactcaaagccaggactggctgcttgcaaagcttatgaacttaatccttatgcactatttcagttcctttaagtctaagcatcttcagccttaaacaaagagagagactgcaatctctaggaagctgtccaaatttgtgactcttctctaagagcacatgttatttcaggcatgaaattgaaatctgtaatttaccacaaatctcccagctaccacaattccaatattcctgtggaaactctcttccccgctgttagttggcagagtttggggctggggatgacctccctcatggatgtgacctaggaccaagctcatcacacatttctttcttgggccttgggcttggtcatgtgacttaattgaggctagtaataaccaaactcagaatttttattctcactttcagggggaaaagtattagtactcacttgcattgaactagatcctgggagaatgcaggcacttccccttgtgttgttgacagtcagtcatgtttctatttgtagaacacagaaattagccagcacagggcagagcagagcccagagaaggaaggactgggtcttggtgacatgtgtcagctccaaaatctatccttacctgaagtaaagccaagggttggattctccttacaagtgagccagtttgggggttcagtttgctgttacaggtatcacaagataagaggagttcatgggtcttttctttttttggcacaaacctaccaaaatcttactgaacaagcaaattgtcttgttcagattcaggcccagccagagtgcatcaggccttgaatcatttctaattatggtagaaaatatattctcactatggatgaaaaggtgcctgatttgtcatgtgataaaaaaatctgttaagtggtacaatgaaactttattcccctcttctgccagaaggcttcctgatcatttgcctgtctccagaagatgttaattgctaattgtcaacgtgcatttcaagaaagtgagctgctgcctggcatgcctgttagctctaactggtaacttgtttctgtcccctccatttctttgtaattacatttgaactttgaatccaaaaatcatttaggttaaggctgtatgacttgattgaatgaattctatctgtacttttacataagtcattatatgtcattaatcatagaatttgagggttggaagagacctttagagaacagcttttccaacccctttaatttagtagaagaagaaaatagcaggcagacatcagctcagagtcacacagtagttataggttgttaagggctataatcagggtctcctgaccacaagccagggtgattttcactatatcacacctcctctcctgaccctgtcttggtttattacatgaataaaaactacaaaagcctcagacacatgacaaataaatgcaagtcttccagatgagaattccctgcattcacggtcacccccttctcatttttaccatctcagttctttctgtacaggagactaaaaagaacatatatgctgcctggatagctaatatggtcaggaaaccacctggaagttagtgtaaagtacaaccttgggcattttcccccagaaattaaggaatttgttttggtacctagaaagtaaaagttttgttttgttttgttttttcagaaaaccacttacaatgatacaaatgattttatgatttttgagctttcattacagtagatttgatctataattctgcttagtgatattgttagactgtcgatctgtgtcattaatacccttgataagaagaagatcccacttacttgttatattctgtaggtttacctgttactccacttcaaattcactttgtgttctaagattttattaatagctatataaggtttactagagaaataaatggcaacccactccagtattcttgcctggagaattcccatggacagaggagcctggcaggctacagtccatgggattgcaagagtcagacacgacttagcgactaaaccaccatcaccacataaggtttactaccaacaagagaga

SEQ ID NO: 42902 - DNA, 1324 bp, Bovine  19866881287910
aagcatcattgaagagatattttaggtaagtgagatctaatcttcagagtgacgactggggtgggagagtgataccagagcacagcagaaactagctttactaatacagacattttctcttaccacctaacttctcacagagcttaccacctaacttctcacaaaaattccatattctacatacaaaggacacaatgaacattgctgtaaatcagaataagaggaagaggctaaacggcattcaactgtggggtgttttttttttgggggggggtgttttgagctttgtctataggaagcaaatttggggccctaaaacactttcttctactcaacttacaacaaacctcagaatgaaacacatgtattatacttgctatattgattaaatggttggaagcaagaattaagcaattttcaaacttctaccataagcaggactagcacagtagcacaatagagagaaaataatgctgaactagaaattagaagaccctcaactttgtcaatatgctgtgcaaacataggaaaatcactatctgcacctcaatttcctctgtacaatgagagaaatcgactacaaaatatctgagatcttttcaagtgtactatatatatgagagaagaggagaatagtaatcagacagagaagtacagccagggtcgttggagatattcaccagatatggggactccatgaatgactaacccacatgggcgatgatttctctggggcacaaattgctttttccatcttaacttcaaccctggtacttttcagattcacctccttttctaaaacttctccttccctccctttacctaccagaataagaaaatttaaacatatctataaccagagattaaaacaacatcaatgtcttggggatatttttcctctctgaaaaacaaaagttctactttacacataacctccctgcacttaaggagacagaacaaagagatttttctttaaaatagcattaagacagtccatttctccttttaaattatacaaacatgcatatgcccatccaatttgatattaggaagaggaactgtcttataatcttggaaagtggaagaagatatgagtttagtttgtacaagtaatatttgaaacacagttttgttctttcctataaatacagactataaatcttattaatcaaacttcatttcctccctttgcgaactaagattttaattgttctaatcccttccctgctgatttcttgctactatttcacacagcagcaggtcatctctttcttttctcagaaatacattagcacagtgccatagtcctaataatatatttttt

SEQ ID NO: 42903 - DNA, 1512 bp, Bovine  19866881289916
ctatcatatttacatgcctcttatatccccagtatcaatcaataaaactgctgggaaagattgaaggcaggaggagaaggggactacagaggacgagatggttggatggcatcaccaactggatggacatgagtttgagcaagttaagggagatggtcaaggacagggaggccgggtgtgctggagttcatcgggttgcagagagtcagacacgactgagcaactgaacaacaacatcaatcaataaaatggtgtctaatacagggaaaatgctccagaagccttttctgggtgggtgagtgaatgaagaaggaccacagctgccatctgccaccacctatatgataacctctattaatcagaatgtttaaccaaaagaacataacccctttctgactgtaccagaaaacagaatttctaatataccaaatagtgttacagctgcattaatggaatcagtaagtgcccaactgatcaggcctatatataacagaaaacaagaaaaatcacatgtaatttatatccactggaaatggaccatccaggatacagatggctgacaggaagaaacctacttaccctttcctttgagttctgcagaagaattattttattttcccccaactatgctaatgcagtgtgcttcactgtttccttcttgtgtggaatccatgaatttgcaagggagattggatctccttccctttgttgttcctatctggtaaaagatgaagctttttccattcatggaaactcacagaatcacatgtctcataaagatcataactgtctcactgagtgacatggtcagaaaaaaagctcacttcaaaatgtttcctacttgatgccagtgccccttaattctaacaaattgtgttttttcttaaattaatgtatataggtattatagtcccagccaatactattattatcatgtgtttatgtgaaagaaaatgtgcaaactactaatatgtttcccagttcctgacaagttctacatttaacatattaagggtggatttaagttttcttccaacaaaagcattttagttgtaccaaccccatatctggagacaagcactagtcagataccagcagttatttttgcttcctactcattttttgcccttcataagaactcaacccttgggagctgacaaataaagataaattaccagtctggagcattctaactaactaagccactatagtcacttaaatgaatgttgaaaccctttttttgctatgttagcagaaatttctcattgtcttgtactctgtgactaagaattacataacaccaagaaaaggttgtaaaagccaggttcattatcacactgactctaccttcagacttaatgatactccttcactggaaaagggactgctctatgcctagggaagtgtgtgataagagttttgtatcttacaagcataaaacctctttttcatatataaaaagcatatatatgactttcaattgattctagacaatgttatagagtatgatca

SEQ ID NO: 42904 - DNA, 863 bp, Bovine  19866881312668
aaatatggatatttattcttttggactccctgaagttcctcttgtctcttcttgcccacctacactctccgcgtaagacatcaccatcattctaaaggctttatatatcattgttatgctgacaacctgttttaaaatgtacccagtatttttttttattacatatatggtcaggtcagtagatgagaagacaatgggcgttagaacattgtttgtcactcattgttcccaagagaaagggcgtgtcgttgttacctggaaaggttacctggagagcaccgggtcagtcaggaggcagaagaagcaaggaaaacgtgtaggcagagggcttttttgtggttttcctaggaaggactggaggaggcaggaaggcaacttagcaggcttatgattggatagtttgaataatttaggtgggctctgagctttagaggtgggccctagttgcctggtacctaactgtgggttgattagggcagagaatggtgggtttttatgtattcatttttggcttccttaggtcttagctgcagcctgcaggatctttgttgtggcgtgcagattctccagtggtggcatctgggctctctcgtggtgcgtgcggggtctgtagcttgctgcaggcaggcctggaagttgctctgcgggcttagttgccccatagcatgtgctatcttagttccctggccagggattgaacccgtgtccgctgcatcagaaagtggattcctaaccactggaccaccggggaagtcctggtgatggtggtttgatacatgagcgcctgataaggaggtcactggggtgtgagctcttgattacttggtctgcgtatgaaagatgtgctcacaggggagatgtta

SEQ ID NO: 42905 - DNA, 755 bp, Bovine  19866881322244
tgttaaattcacggcaagtcaaaatttctgcttaaagaggccctggtattaaattgacagttgccttggaattcaaaatagaacttgttagaacagactagagagatttcttttttgcatttctctagttatttccattacagagaaaaacacacttctgtcaattgctcctttgctctgcttacagcctgcagtaatttctgagattcttaggttaaactggaactcccatttatgccagatagcatagctcattctgaaagtctcaaaatcttagcctgaatcaaaaatcttgatatggtcaaagggtgttaaaaataaacatgaaaacaatttaatttgatgaagaaatatttgggaaaacagagctaaaaatgctcacacataaatacatgcacattggtccagggaattatttgaatccaatggtggctttattattattataaaatttctggccctctccccagaggggaacactggagacagaaatgttaagtcaagtggcagagcaaggctgatgcttcaatagccacatcatgaagaatacttcagattggggaaagcatattcctcaaaatcatagcttcattttccatttatgaacagatacatttatatcttaagaagcactacacaggtataaatattttatttcatgtgattttaaaaaccatctttccagggagagtcctattcaaaacatgaggtgggaagctacttgcaagctctggttaggatgtcaaagatgatat

SEQ ID NO: 42906 - DNA, 1599 bp, Bovine  19866881378894
gacgcagccttggtcgatgatcccattcccttcactcttggtgttttaaatttatcaaaacctcctctctctccttcgaatactatgtacaaagagctgtggacattctttaatgtactctagaagcagtgtttttttgttttataaaaatgatttaatacatcattaatatagtaatatttcatcttcaggacatgtctatccacaaggtctatccttttgaaagcttaagccaatttgtaattaaatgcacttcagaaatattgctctaatttatcatgctatatcatagcactcaaaaaatgtttctttctcctcaccctctcaatataaaaaaacaaattccaaaaccccaaatgaaaactgttctgtcatactttttcagctttttgtaaactctttcatatagtcattaattttaaacagaatgtatacatgttatgtcatgttaaccatattaataggtccagattttctaactttgaaagatgtagagaaaatttaagcttgcatgttatcttttggggaggtattccctgtgctttgtagagtgttcaagaattagaatttagactacattaaaaactttctgaagaattaatatttacaaaaatttgagtgtcaaagtgttaagaagggacattggagctgggagctgaaggaaaagttggggagaaaatatttttacacttctaatgttaatctagggaatctttctttgcacttggataaagggggaaagctttctccttatttcacaatgcaactgcataaaaagtgatcttccttgcatatggatatgactcaatctcaaagagttttctcagccaaagttatcagcttctcttactttttcttcagcaataaaggcttttgctttctcttttctaatctccccatggtgagcttttgtcatgaaatttcttccgaaagatccaaattcccactgactctttttactttaaagtgtttacttaacagcaaatgatcaatgttgagccaaatagggaagaaatcatatgtagagttacgtttctttatatctctcagcacatgttctcctattttaaatgctaacatggcaaactatgttggataagcattctgtggtgtccatgtgttcattattttgcaacagaaagtgcagatactccatccttgaaaattgctttctgagattggatgctgcaccatgtctcctagctcatatttgtccttaataaagaggtattattggaagaatttgcttgttcttgctggagtaactctttgctataaaaatggattaagatatattgatatttattctttcaggaaacgctactctggtgtgtgtgtatgtgtgtgtatgtgtgtgtttcagttcagttcagttcagttcagtcgctcagtcgtgtctgactctttgcgaccccatgaatcgcatgcaactatttaccagttagattaactttttcagataacgctccttaaaaaaataaagaaagaaagtccagggttaagggtatggcaactctaaaagggcagatctggatttgagttttccagctttgggcaagtactgtgcttgattcctcatctacacagggagacagtcag

SEQ ID NO: 42907 - DNA, 931 bp, Bovine  19866881532902
cttgtgcatttccctaaaaagaggggggaaatatgaacaaaatgttgtctctgaagacttcatggttacttggtctagttttcaatttggaaactatgctcattgcctgcaggaattataagaacaataggcttctggctgtttagtgaattgatgtcctcacatggattctgacatttgatgggctggccttggccccactcacagcagcagggcactcatgcaggccgagttttgctctgttctgagcactcacagcttagcgaccttacgtggctttatatcgtgacttcttgatgagccaaagtcttcgtgattttggtttcaaacacgtttattcttccttgtatgtcttgtccacagaaaacaatgaaatgttttgttttaaataaactctactgttcttctcagagtcctggtgttttcagtaaaaaggacacaattcccttacccacccaggtttgtcaaatctctgtattttgccacttttgctccatgtcttttgttatataataaatatctttatttttaaaacaaataaaatggagatgcagttcaagcgcctgtgaaatcctccccaccagattcttgtttctcttcctctcttcccagaagtggtcactatgctgaatgaagcaagcaacatgaggctcaactgaatgttttgaccaagtaataatatttcaaaatgaagttcccatcccttgtggaaatgtgaaagtaggtgtctcaaatcaggccataggaaagtcatgaaattttgtttcttctagaaataattttcttagtttctaccactttctggtataaacctttaaactttcccctgctgaatttcattagtagtacttctctttaaaagataagtaagacattacatggttcaaacttcaaaattgtttccaaataatatatattaaggcttctttca

SEQ ID NO: 42908 - DNA, 1152 bp, Bovine  19866881768425
gagattttagttgattggatggagtctttctcgacatattaatgtatgcaggaactaactcttgggattcagacactcgaatggcattttttcacagtgctcagtcttacagaatacatttatatttgttgcaaaacaaagatttttccatttctgccaaattaaaaatgagctcctatacctgttatcatggcatttttattgaacttcttagccttttcaacatttgttactttatttttactctgtgtttttcatggaaccactcctaatcgctcctgagtcatatagtatctgcctttcaggtgtaacttaattaacactcagctaatttatcagtggattggataattgttaaataattttgatcagaaatcccccatcctctctcacctaagcaaggcaatcagaactatttattggcctgaacacatcagtttctctatatgcttgctcttaagaggatttaatactctgatagggaaaaaaaaataaaatttgaacaggattcttaatgaatcaaaacatgctcagattaaatgattagaaattcccagttaattactaggaaggaaaataatttaattatagttcagcttttacgtgggttactggagtgaatgttaagaaggaccctttcaatcacttttccattaaaataaaacaggcacactgagagatgtaattctccttttttttttttaccctttccaaattatatcatttaaattgtgttcaatgtctcagttgcttatacaaacaactgtgagcattgtaattgacttgtgagacaaaagctcaacttatgcatatggtgagaaacactggggatttataagtaaatattcaggttaaaatttatagacatcttgatatcctggttatattgccttagctgagagtacttgaggacttataatggactttggtcattctgaaggggtctttaagaaactgcctgctctgtatctaccaggataatcacaacacagcaccaacagttaaattttgtttagaatagcaaatacattttattaaacctagatatgaggcaagtcaacaaaatctcttaaaaaaaatcttaccgtgcatttatttcataatgtttaaagaataaaatgggaaaataaaggtagaggtagatgaaataaa

SEQ ID NO: 42909 - DNA, 2671 bp, Bovine  19866881838961
ccttctcactgacaatttccccaataaccaaattaaaattgcaaacctaccatatgctcctctgtcactccccatactgcttcctttccctatagtacttgtaatacatctgtttcctttgtagtgaagtgaagtgaaagtcgctcagttgtgtccaactctttgtgaccccatgaactatacagtccatggaattctccagttaagaatactgggtgggtagccattcccttctccaggggatcttcccaacccagggggcaaacccaggtctcccacattgcagacagattctttaccagctgagccaccggggaagcctactttctttgtagcacttttccttggcttaactttagtactttttattttctaagctattatgcactttactcatttgttttattgtcagtctttctccccaaagtccagtacaacataacttttacacaagcatattttcttttgttttgtggactgttgtatccacagggcctagaatagtgcctgatatatagtaaatattaataaatatttattaatatttataattataatcctaaatgacaggatctgcaaccaaaagctagagaactcctggaaaagcactaagacttttctttgtcatcactgcactagtgtgttgggccctgtacagcaaccagtgtgttgagtatggcactgtccctgccttcttcgggcagtttccccatcacttccctgtccttgtttgcctcagagcttcaggggattgggaagatgtttcctatcacaaagagagagacttgagagctctgctctggctttttttatttgccctgacaaatatgacaacctgtttttgttctttaaagcatttgggtgtctggaaagtagccactctgagaagactggattttctgtatttcaaagggaacgcgtggtctgttttgggttttgatttctatcttttgaaacagtcagcacccactgctttgttgcacttgaagcttggaatcttttatgtctgaaggtaagagggtaagagggtataaagcatgtggtctactaaggagactttcttctgtataagccagctctggtgtaagcaaaggtaaaatgaccacaagacccttgccttttcctgggaccagtgttgaggaaaaggtagagcctagtttggtctacactaatttattttgagacacagcatttggaggggcaagacagtttccagagagaatgttttctagtctgcatctttgccctgtgacttgtgctctggtgggagggcctagagcactttgatcacagccacagtttagtggccaagggccttgatgtctaagtcatggaaaggaaagggcagcacaagacaggttgaacagtctaaggtagtttgtgactaaagcctacttcattagaaatgattaagtatcttttgggtagtacttttgcaccatatctgaatattaagagattaggtggctattttattatttggagaaggaactggcaactcactccagtactcttgcctggagatttccatagacagaggagtgggacaggctgcagtccatggaatcgcagagttggacacgactgtgtgactaactttcacttttcactttcaggtggctattttaagctgacttcatctttaacatatgtccagaaaatgaatagtgttagtgactattagtaaatttaattttcttttgagttgattatcaaaatagcaatgtttctccattcccctgacatattcagtgtagctaacccactttccagtggtcatgtatggatgtgagagttggactagaaagaaagctgagcactgaagaatcgatgcttttgaactgtggtgttggagaagattcttgagagtcccttggactgcaaggagatccaaccagtctatcctaaaggagatcagtcctgggtgttcactggaaggactgatgtggaagctgaaactccagtactttggccacctgatgcaaagagctgactcattagaaaagacactgatgctgggaaagattgagggcaggaggagaaggggatgacagaggatgagatgattggatgacatcactgactcaatggacatgggttgggtggactccagtagttggtgatggacagggaggcctggcgtgctgtggttcatgaggtcacaaagagtcggacatgactgagtgactgaactgaactgagatgtacattaatcacagaatgaatcaatcaacaaatactctttagtacttatcatttatagaatgtactgggcaagatggggaagataaaggaatctgagagttcttacatcttcatcctcaagaaaatgaaaattagaatacactcacaaagacagacacatggcataatataagtgataaatgcatggtactgaagattaaagctatagattcccttctgaaagttggagcaatcaggaaagacagactttgaggagttttgagtcttttaataaagaggaaaaaggaagacaagccattctgtcagtactgagactcactcagtgaagaggactcaaccaattaggcagaaacagagggtccacattgagaagtagtaaagatagtaaaggaaattttggaaggcttgaaaaggcaagtgaaataatttgccatttatttgagcagattctcaccaatgttagata

SEQ ID NO: 42910 - DNA, 1123 bp, Bovine  19866881865170
tgattactctgataccttatgctggcaaagactaagttccttccagtcgcattacttgctatctatgtgtgtgagccatattcaaaagtcttgtccagttgaaccttcaggttagtgtaaagtcaacacttgattctaaccatatgaaatactccaaatgggaacgtcctatctgagcctttcctaaattcctgatgcacaaaatagtaagcaaaataaaaatgattgttttaagccactaaattttgtaggagtttatgtagccatagtagccattaccctggatgtagggcctgggaatctacattttaataagatattgtcagttctgcttttgtagaccacagtttgtaatttgcactgctctacatttatttttttctcttctccttaacacataatagaagaggctagagagcaaagacatcatcccaaccttagcctctggaaatgaagcacacaccatccaataacaattggctaaggaataatcttgtgtctaatgtagatggcaactctccataatgttctgggaatagatagttttctctcacagcttggatcccctgctataccttggaatatctagagcagaaaaaaattttacttctttccatttcacccaagctgctttcttgggccagtgagagagcagaaaacaggctttgagtcattcattatgcaaaagcagtgctgtgtgtatttctggggagaaggcactcatgaatataagttaacattaaaatagtcttctaggtatatgagatgttgagatacatgagcatttgcatgcagaaagttctattttttttctaatgctttatagtcatatgttggttattcatagtcatgtgaattatgtgttacaatcattcattagttctttgtacctggtacctttcaatcccaaacctcactgctctatttgctctctgccaatcattgtagatgagagggaaactcaggggagagaacgtgtatgtcagataaagagagaccagatgcagttggtgatgagatatgaattacacacgtgggctcattcatccccttcccttctgactttaggggaaaaataaagtttaaaaatttaaaggtgtgcttcttttcaaaatctcaattc

SEQ ID NO: 42911 - DNA, 779 bp, Bovine  19866881884960
aattgaaaacttccgaatgccatggaaaacacatttttaaaaactctttcaaatgttttgacttgtaacattaagtttttacttcctgcctaattatccattctcatgttgacaggcaaaatgtgttcttttttgttatcttctctcttaaaatgagtatgagaagtaaagaccacctgttgccatttagaagtatagttttcttctaaatccacttgacattttaagacttcgcatctgctactttgtgataacattttcctttatagatcatgtggtttctaaaatggtgtcatgtgagtcgaaatctagccaggatttttttttttttaattcctaagcttagggtttttaggatttcatcccctatagggagaagggtgcatggtgattataccacactcttatctaaaacatatgaagcacatttcttctgtgtctgttctgatcagttgtgagtgcatgaactactgggttgaaattggctatttatggttgcccaagtgaagcagtcctcactgatcagggttgccttttgtaggtgagagactgggcagtgtcctggactggccattcctcctttagagtcttcttacaggtaacagaagggtgtgacttctctcccaagtatactcacattctggctgaggcagtagggtggccatgggcatatgacaatagccttctacctacctgtcctcccttttcctttcctcatttagtttgactgatgttcaatccttgttgcgttttcctaacaaagaggaataatttctagc

SEQ ID NO: 42912 - DNA, 1028 bp, Bovine  19866880401959
gatgggaaaggaagagggcacttgaaatagcagttgaacgctctcattgttgtccaaaactcccctgaaagctttgcatttgtaaacccagttttacgccatttattcagattgtctttgcttatattatctgctagcattgacacaaagcctgcagagaaatactggttttggtgagccgaagtctgtaaaatgggccaagtctgtgaactgcacactgtagagtgtcctggtctccttactgtcaggctgaggatgtcttctaggtgcagaatagtattagagtgggagaagctttttcattaacacagaacattgttcacatgttgtatcttctctttggctctttttaacgatttaaaattgttgcagaaatattgctaattctgtatttctccacagtcatgatgaactgaagttaccagaaatattattcactctttgttgccattttatcatccattatcaagttcacttccaaaataatttattttgaaaacatacatgtcagaaaacacatgaaaaacagctattttaaattaatgtgtatggtttaataatctgtttcctaggcatgcttccagaagagcggtgcctccgtggttgctattcgaaaatacatcatccataagtacccttctttggagctggagagaaggggctacctcctcaaacaggcactgaaaagagaattaaatagaggtgttatcaaacaggtattaaatggttatttataataagcatatattagctataaatccatgtatagtaacatttaggctttttgtgctttgtgagttcgttaaaataagttaacataatgatgaagggcttatgcttaacctggttttacaaagtcactggtgccaattagctttagtaagtattctaaagaacagaagcaatatgatagtgtaaattttttctagctgcctgtacaatttttttttaagtatttatttatttggctgtaccacatcttagttgtgacatgtaggatctttagttgaggcatgtgggatccagtt

SEQ ID NO: 42913 - DNA, 1714 bp, Bovine  19866880847962
taatctgccttcttcttactatagagacaggacatttttttgaaaacttgtctgttaaacatgccttattttttcattgaactagaaaattttttgagcacctcctatggaccaggctttttttggtgtgcccaggctgttgcctttttgtactttgacttgcagtcaagtgccacgacaggttaacaccaaaaacctgttttggcaggcatacagtgtgcagctttcttacattgctctttgtgcataaacatgctgagtcaggttctacaccctcctgtgcaggagctgcgtgcatggagctcagtcatatccgactctttgtggccccatggactgtagcctgccagggtcctctgtccatgggatttcccaggtcagaacactggagtgagttgccatttccttccctaggtgcataaacataagtgtacagtatttgaatttttcaaatgtttagctttaaatataattcttaaaatcatgtacatgcagtgttatgatttaaagatttattaatcagtggtaccaagttttctatcattaaggacaaagaaaagttagaaaatccttgctgaatttcacaaaaactttgaagaaattcaggctttatgaggtcttgtatcataagggcaaaaaatatatactgctgtgtagactgttcactgctgtatgcaccattcactgctgtatattcaatggctgatacagtgccgaacacacatcaggagtttaaataacttcactaaataagtgattgtcaattttattaaatggaaggaagtagagaatgagttatgtttgaggcttttatagatttgtcataacttcatttgagtgttcaaaataggttaaattgtgacctggtatttgtaacctaacctgacttaattggggagtgtgggaggaagtgggtaatgtccaagaaagagcatatctaggttcacatcctttttcttgtcccgatgggacttctctttatctaatattttttcttactagcccaggagttctgtttccaaagaaggagccagatgattctaaagatgaggatgaggatgaagatgaagatgactcatcagaggaagactctgaagatgaagagccaccaccgaagagaaggtgcgagagtgtgggaaacacttcttagaactgagaacggccatgaggggagaggctgtgagaatcgtgtcagcaactctgcatccttctcaagtgctctgagtgacgtttgaacttaccctctcctgagaatttagaggctctgaacttgtgaaacactgtgaatgtttaattactctttggtcaaacctgtgtgtgtgtgtagtgtgtagtttggttatttaagaaaaataattccatgtttttctgggaaaaacatgtagacttccggaattggttgaatttttaggtgaattcacaattttaggtgaaaggttataacccatatatttttcttaatgtaggtgattttacctgtgctgtttcttttctggcaaagtatctcgtcatcacggtgaagtgaatctctcaagtataagtgattgccttctctctttggttctcacaggttgcagaagaaaaccccagtcaagtcaccagggaaggctgcagccatgaagcaaagagggtccaagctggcacccaaagtcccagctgcccagcgagggaaaacgaggcccctccccaagaaagcccctcctaaagcgaaaag

SEQ ID NO: 42914 - DNA, 2343 bp, Bovine  19866880914504
tgtatggatgtgagagttggactgtgaagaaggctgagcgccgaagaatcgatgcttttgaactgtggtgtcggagaagactcttgagagtcccctggactgcaaggagatccaaccagtccattctgaaggagatcagccctgggatttctttggaaggaatgatgctaaagctgaaactccagtactttggccacctggtacgaagagctgactcattggaaaagactctgatgctgggagggattgggggcaggaggaaaaggggacgacagaggatgcgatggctggatggcatcgctgactcgatggacgtgagtctgagtgaactctgggagctggtgatggacagggaggcctggtgtgctgcggttcatggagtcgcagagtcggacacgactgagcaactgcactgaactgaactgaaagagtcacaaacacctcaggagcacaactgatgctcaatgacaatctaggttactgtttaaaagttcacctgtgctatattttgtttcagaagccaaaggaatagtaatatagcttaggaaacccacctagtcacattaatttataataataaaaagcaaaagtttgcgaggttaaagaaactcagttctaaaagcacctacatcaaaacattttattctgtcactatactacaggttctcacccactctgtgtaaactagccaacgaacacctgactgtacgaatcctacaaaaatcaaagtagaaagatagcagaatacagagtagtgaaaaataaaaggcaacctcaaatataactgcaagaacagtgtgacagaggaatccacgggtgggcggtcaggccctttcactcagcttgagggttgcagcctgagggtgctagtttctctggagcgcctgcagcctcgccttgcggagccctgacacaagctcccggggctcgttggctgggcctggctttctgagtggagcaagctattggatatcccttccaccttatctgaactccataacttccttatcttggaggaaatcaactttagtgatgaaatgaatctacccatagggattatcatcacagagagagcgagagagtgtgtgttgtgttggacagccagccagcctgacaagcaggtcaatctttattaatgtgcagactgcttacctagttaaggtccgccgggaatcaaactctagaggtgtggatgacgcagaccctgaaggtgctggaggttgcaaagcagagaatctgtttaaactggaagcacttgatcttaaggcatctatagatattaaggagtgagaaagaaatataaatcacatgactaaaatgcagcttctaactgatctgccttcgtggggaagggcccgtggccaggcatttctaacgagcctaaccagctgacgccaatctcctggtccacagaccatactcttagaagcactctgttagaaagactttgtatgtaaaaaagaatttataaatatttattcattacaactatctgctcctttaaaaatataactaaattatcctaagtagggcctaggaatggtaaataggggaagaaagaaggcaagcgaaaccaaaagaaaatatttaacttaaaaaatgctgtgatgtcatttatgtaaaagtatggatgtgagtttaagtgaacaatttaatttaaaagaaaaaaggtcaaaattatgtaatagaagggaaatatgggaaggttgttaacaatgaagtttaattgttatgatccaagtatgtgagtcctaaagtcaagtctctcaaaatctacttctgacatagattttgaaaactattttaatcgaattgttttttctttcgcaacaccctaaagttaaatgcttctgggtaataatattactttactcagtaatatgagtttccattttaatttggagtcccagtaacttttctaattatattgaatttgtaaaaagcaacaaaacaacaaaggaatcaaacagattaaagttttaaatagtttttgaattaaaaaaaaaaaaacttgttttaaatattcaaaatacctaaggatccacagtgaggaggaaaccctcaattatgttaagagcgggacaccaataaatctgggcgtgattagtttatagatcttgcactaaaacgtacgcttgtgaaacgactgcagcacgccagcttccggaggaaggacactcctcacttaccggcctcgctcgccttggctccaccactgctgccctttccccagctgcccagctgcgctttaggtaccagctgaattttctcatcaattgtgggctgcaacgtaagggatcacaagtcaacagtaggaactattctagaagaatagtttatctt

SEQ ID NO: 42915 - DNA, 986 bp, Bovine  19866881057042
ctcatcaactcttatctttatactccagtatattattttgctttcattgtctaacaacagcataaaggttcttgcactccttgattggaggattttaatgttttccatttaccattgtaaaaccagtcacaattttataacttttttgtatgcagctgttacacataggaaaatctctatttaagtaaggataaattactctaaaagaagaaatgatcctatataattttcccttcaagtgtcttgttgtttaaataaacttgtttgaactacaggtcagggagaggctttgaggttttgacagttaaccacagacctattcagaaaataaaactatccccacaagttcgcatccatttcaggagatttctggaattcagcaacctctctgaagtctaggttctgaatccctatcttagaaggttgagttgttttaacatgtggcactaaaaggaataaagctctcctctaaacatcaatacggtatatctccacctgaagaaaaggccgcaggcacctactgaagtagcaggacgatgaggcagccggcttcatgaaaattctgataacactcaaagtgcacacgcacggtttttctgtgaaaatacttacagcactggcagcctcgagttctttctgcttcttctcaaagacatcatcatcggctttatctttttcaaattccttctggcaacggttcagtagtagcttccggaagttcactgtgttaccaggcttgtctgccatgggtactttcagctgcatccagatgggaaaatgcaaaaggggcaagattacttaaagaaatccaatgattttctcaaaatatctattttctttattgtgcaaaataatgctgaccgaaccacaggtaagcattctacaaaagatacatgatttagctttaggcatttcatgttttcaatggttaaggagctttaaattttatatagaaaaagacacacattccctctcatataaatgta

SEQ ID NO: 42916 - DNA, 1840 bp, Bovine  19866881203959
aaagtatttgtttatttggatttgataattctctcaactacaattatacattaatttattatgtacatttattatcctgtcacatccaggtattctggcctgaagaattccacggactgtacagtccatgggactgcaaagagtcggacatgactgacaactttcacatgctacatgaatccttcgtggtcaaagggattattaactgatttactaaattactattaagtgcccataaatttggcaagaattatttataatgggatgagacttcagagaccattgtgtcaaattcctcactgcaaagtgaaacagtagcctagagactaatggcctgccctacagttgcacataaatgggctaactgttgacttaaaactcaatctccatttctaaccatttaaatattactgagtgcctgtaagtactgataagcacttaggggaatgtctataaaattaaaccacatatcacatgaatcagcaaatagttacaaaacagtatcacggctccgaaaggcctcaccagtcctcaccttttacacaaaatcataaagcattccttcataacattaaaaaatacatactgcatatgttaaaagtcaacattaagaccttgaagttaagtgtttcatttagaacaatatattctagtttgcattttctgttacttcatttccatgttcctcaccctacaccactgagcctactctcctactttagtgaggaaatatctctcactaatccgtaaatgataatgctggtacagcaaggtttctaacctcaatcatcacctgacagggcaaatatgtccctaaaaagtatcttctgtacaggggttaagtcaataacaaatcacgtaagtagtattttaacccactggtttggtttcaggctgacgttagatattttggtaaacattcagaagaaggtaaaaatatactatacttgaaatttcgtttttttttttggccatgccaatggactgtgggaaaaccacatcccctgcattggaagctcgaaatcttaaccactgtactgctgggaagtcccacttgagaggtgttttgaacctagaaatttatctctattagcataaaaaacctttatagtgaagtgaaatcaaattctaatcctaagcagacactataaattaagggtaagtcttgattatttttgtttgtctttttgtaaatagtaaatttataaagttgttccctcttggttttcaatcagtagttaatgctctttcattaacagcatgatgtctaaggatattcccacaagataacttcccccaccttccctgggtccccactgaacgtgctcactctgagtcttactttgatagttagaattggtccctgggtggttctccaggacatacttcttcagagcggtggtggaacaggtcttcggctcattcatggcagcaatggcagacaagattgcatattccatcaggcttccaccaagcaggggtttctcccctgatttcttcagctgttttccaaggaggaagagaaaagcatcaagacaacactctcccaaagcagctcaagacaagactcctctgcaccaggtgggtcggagttcctgcattagcacagatacgttttacaataaattgtcaggttagggactttctcttcccactcattaggtattcaatctaactgaggagtcccaaccctcttgtggatattttctccttctatctatccctccatccaactgaaaatagcaaaagccaacctaacccaaagagaatgacagctctactccaaaaaggaggttaactgattatgtccctgacaaattaacacttctgagactacttc

SEQ ID NO: 42917 - DNA, 1704 bp, Bovine  19866880875750
ttttggctgctgttagctgcttgctaacaaatgcctttctcttgaggaaacatcattccaaccatctccaacatcaattcttacgccaattctaaacctagcctaaggtgaataatatcaaatgcctcagtttcttatgaggcgtagaaaaaccaagcattagttcagattttttcgaacaacttctgtaaagatagtaggtcatcttcagtcaaccccaaggtgctcttctaaattctaagctgacaaaaggtaaccaaatttttgactgatgttcagtatagaaagtatattggcattagatatacaatagctatatagctaggtgacaagcatatattttagagtaacttgtgtcctatggttttgcccctttttaggacccagcacataatttcagtattcttaatgattcatctagggaccaatgtgtctttgatgacacgctactggtcatacttagtttgcatgcatgctaagttgcttcatttgtgtccaactctttacaacccaatggactgtagcctgctaggctcctctgtccatggaattctctaggcaagaatacaggagtgggtttccatgccctcatccaggggatcttcctgatacagggatcaaactggcccctcgtacattgcaggcggactctgtaccactgagccaccagggaagcccatacttaaagaataacaaatgcttatcacagatataattattatttccaactggaaaaaatgatgtgctcttatcattcattttatgatggagttcccagtaacacttgcagaaatcacgggccacctatttagtaaaggaaagatactaggttaaatcctttcagtacaaatagtcacacccaaacacgtcttctaagcttaccttttcagatgaaagatatcagcaaatgtttgactttattgtttggtctcaacagcatagtgcacagcactttatacttcactagactaccatttagacaatgaccaggctattcctttcaaaaagcttcgaagcatgtttacagaacatctgtactagataaggatcacttccaatttagggttcactgagtccattaactgccaagatagatacttaggaggtacacattccagtaggttagaggaaggaaagagacagactagggtgttaattaggccacatgaaagaaataatgatatgccaagaagtaaaaattgttcttaatgagcactttattcactggctgttcagctttaaggtcacttcgagtttgtccaccaatgaattgcaactcttttgtgaagtgaacccatgaaaggaaccagtaaacattcgttgttgccaaagatcaaccaaaaccaataactagctggttgttctcagctgggcatagtgcaaggtgtatttgcccctctcagatctctgactccagggagcataagtgactgactgccaccagctactgagctctgaaatgtagtgctgctgcactttccatcatcgctgcattttcaccaaggccaaatttctcatgggctgctctcagccaatggcagagtgtagcagagatgctaagattggttattcctgcaagacacaggacttcccccacaggtgactgggcagggatgctgtcagggaagaagcccatcctcacaaaggatggcaggtcgacctgatcccacattacagatgcaaagtagacagacttcatggggg

SEQ ID NO: 42918 - DNA, 1135 bp, Bovine  19866880921883
caattatggccaatacgacctggaggctcgccaggctatgcaggaacagctggccaggaacaaagagctgatgcagaaggtccaggcggcctctgagagtgaggaagaggaggaagtccaggaggaagaggaagaacctcttgtccctgacatggtgaatggggtgcagataaaggcaaatggactgaacccctggatgttccagaatcacttcattgttgccaaagaggctgaggtccagaaagacctggaaaatcctgctgagcctgaagcccaggagacttctgaaagtgaggaagaaagtgcagtggtggaggaagaaactctcttgaaagaatttgaggaaaggcgatcacttagacagaagtctgagctcaaccacatggcggagccagtgcacagacatgtaacaaaggatcctagcagccaggaggttctgtccgaattgagggcactgtctcagaaactcatcacagagaaccatcagtcagggaagcaagaactgagttcagcgaggacagctcagagagaggaacctgccagggaggaagaggagcccatgttgctgcagaggccaaagagagctcggactctggacgagctggaggagctgggcagagaagggtgtgttgaaaacaaggagcttcccagaactgcagtggaagggctgcagttggagaagaatctaagtaatcatattggcgcccccaaggagaagaaaaggaaggagcaaatgattgatctccagaacctcctaaccacaaaatcgccttctgtgaagtccttggtagttcccatgactgtacaggcgttggaagatgaagaagagagagatcaaaggcagataataaaggaagcttttgctggggatgatgtcatcagagacttattgaaagagaagagggaagccgtggaggcgagtaagccaaaggacctggacctgactctgcctggctggagcgagtagggtggtatgggcctgaagcccagcgccaagaagagacgcccgtttctcattaaagcccctgagggtcctctgaggaaagacaagaatctgccaaacgtgattatcaatgagaagcggaacagccatgcagcagctcatcaggggcaggttttccgcatccattcacac

SEQ ID NO: 42919 - DNA, 924 bp, Bovine  19866880666274
atgggtagaaaatgtaactgttttattctttgggatagggcatttggtacaatcctgctgctgctgctgctgctaagtcacttcagtcgtgtccaactctgtgcgaccccatagtacggcagcccaccaggctaatcctgctgctgctgctgctgctaagtcacttcagtcgtgtctgactgtatgcgaccccatagatggcagcccaccaggctctccgtccctgggattctccaggcaagaacactggagtaggttgccatttccttctccaatgcatgaaagtgaaaagtgaaagtgaagtcgctcagttgcgtccaactcttagcgaccccatggactgcagcccaccaggctcctccatccatgggattttccaggcaagagtactggagtggggtgccattgccttctccaggctaatcctagctcaccttaatctcaagggatgggtcattctagaaacaacatggaatttggaatcagcagacctgagatgaagctccagctctgccacttacaagctttataactttactaaagtagcttcacctatctctgagattaagacagtaatagccaaattattccttcatttttactttattttctcatatggatcctctttcagaacatttgaagcagattatgaaaaattatatgtataataatcacctgaggctgatgaaacagaaatagaaaagcagaacaaagaaaacggagaaagcatttctaactctaaaggttgatataatagccataaatatacattacattagaatctgaggttcctagaagccagggcatgaagggaaaaatgaggttacatatacttggttttcattaaggaaagtgaacatcagttcctctgaggacacatagcattttcctggcacagcattctccaagaaattgaaaccatat

SEQ ID NO: 42920 - DNA, 1246 bp, Bovine  19866880679866
tttatgctatgcaaattctactaccataaaaacaatcactttacttggaatcaaatatcagtaacagtcaccttgagttcaatccaggtgaatgtgaacatcaaatctaatcttcgataatttatattctggcatacggttacatgagcttttcaattttctaaccactctaattttagacccctgggaggccaaaaggtatgggaacagagggacccatttgtgcaccctgatgatcagctcctcccacagtcaagcaggtgccctgtgaaacttctcaggtcctttcctgtgtgaatagccacctagaaatgtcaggggcctgccttgggtttctgacaggaaatggtgcccctgaagtgcaaattcacacggagggggagctgctgggcttaaggtgcactggcagcagagcagaaggaaccagaaagtcgcactgtgcatttcataaagataaaataattgaaaacgaaaaaaaaaaggggggggggatacagaattaatttgattaaaaatacaaatcaactactcctcaatacatctaaaggatagcctatctgaaggcttacagaggagttggtgaagaaattggaaggcaatgaaaattcaaatctattctcttctgtaagtgcatgtctttctccctaatctccttctaaatttttttgttgttgttctcaccctttcctcctttttttcctatctaattatacatctcaaagaaatttccttgcccctttaggttcaattcatccaacctatgttttgcctggggtggggaggatgagggggtaaggagcaccctgagtaaatactaagatccaacctcccacaaattagattaaaagaaagagtaagccaaggagaatagagtagttggccttaagagtaaaactcaagataaagatccagatcccttgaggccattttaaaatgtccataaaaccaaaacaatggtttccaatcctatatttggtgactggagctgcacacagagtttaaagcatatgttaatacattaagccaaataatcagtaattagatctataagccagaaatacctttaaaaaaaatctttttaacttcaaagacttttcctgtaagtagttttaactgtgagcatacaagttcatcatataaaaagtcgacaagttgcattacagtttttctttaaatgagttctaacaagatgtactttattacaactgtacaacgaattccagaaaattacaagacagaccagatg

SEQ ID NO: 42921 - DNA, 1500 bp, Bovine  19866880777517
acaaggaaacccagtctagccttcttatcttgcctggtatcacagtcattgcatctgacaggaactgagccagcagggatatttggtagaaatcatatgattagaaacatgagtttgcatgtaactccatgaaaaaaaaaatgagggctgataagagttataatatgtggttgtttttttttaggtattgctgcttgtcagtgaaagagctggaaaaaaattccttaaataaatatacagtgtaaatatacagtgaattattttcccagttttacacattatgaaaatgagagacccttaatcaaatctattaactcagaagaatacctaaggagaaacataaaaaaacaacagtgagacacagaatggatgaaaatgttactgtcagtaagtttgacattcagaaattttggaggattatttggcttgagttacaaatgctgctgtaacataacacacttggctgtgctcagtttaatgatgtatattttgtccagtgcattttccgtaagcagttgagtggaagtgtggtacagaatacgttacgttgtatttattgatttaaatacagctatgcttcagaacataaactggatgttgggttatatttctggtcctctgggaatcttttagttttaataggctgtgaggattagggaaaacccttgacactgagttcagccatggctgtgtgtgctttacgaaagatacacacaagacttttgagatcactttgcagagttttcaaagatctgaagattgataatctggtaaaataaaaatctggtagcagcaagcatcaaatacattctgcacaattatactctccaagggtctgaaaaactgctcaaataacaggacctgttgtgatatattcatatccagatacattaaatgctagattaaacaagaaaacatatctttagggaatttagtggtagcaagtcattaaggtctctataaaatacaactcgaggccaggaaaattcccagtgtattgaacaaggctttgaagttgtaggaccttgactggtgctgtttgatagaaatataatttgagctgcttcagtaattttagggttcctttttatgttagaacataaaaagaaataggcaaaattaattttaataatatatttttataataaagtcttgccatttcaacacataatcaatataaaatgataaatgaaatattttaaattatgcttttgtggtaaaaggacttcaaagtctgctgtgtatttcacatttgcagagcaacttgatttggacaagatacatttcagatgttcagatatggctgggggttcctggagtaaccagtggaagtccttgacttttagtttcattaacagtgtgggtagagattttatgcttttctagtgtatacttcagttcagttcagtctctcagtagtgtccgactctttgcgaccccatgaatcgcagcatgccaggcttcgctgtccatcaccaactcccggagttcactcagact

SEQ ID NO: 42922 - DNA, 1498 bp, Bovine  19866880825368
agagtctctttgggaacctaaagaaaaggctcagcggggaattttagccccgggctgctttataaaataaatacttcaacaaaaccatttgcataatgaaactgtatcatccataagagatttaggaaattgtatcaaatgaagctaaactacagtttaaggagatgttttagagggtggataagtgaatcttcttaatccacatagttttatgttccgttttgtttctttcggggagaaatctcttcactcatttttagaatggaaaatgctcattggaaaacaacagctgtttgcttttgtgtatgtaccaattttcatgatttatctgaggcagcttttaaaattcctggtgtctttttatacttgaacctttgtagttcatatatttggtaaataggtcaatagacaattagtgtctcagtgacgtccgttagtacaaaacacaagaagcatccaggaatcaccctgaacatttccccttaaaactgattgcttttatttgaagcatagattcatgttgtcacagactcaatgatgccctgccaggaaaagacagctctgtgctcagaaactctactctacatttgcttgcatttgtgctacgttccagaatctttgagatattgttccatttgtttatttttggagactaacaaatagaatgttttgacagaattcaagaaatgcagtcagaagtgtgcattctgaattttctgcaaaccataatgtaatgtcctctgggctctctggatcatattcttagttttttttaacatggtcttttgataaacaggaaatttcttgtggggctggaaaacccagattaaaatcaaagaataatagagctttaaatcttaatgaataacataatgaaggctcttatgtccaataaacattttaattaattgcctttattcttgtttcctaagaagctttggtatttccagattcctaagtggttttggaccatgctttcccaacagcatagctatcatcatcagacgtttattgagtactattgcatgcaaggcaccataattacttgagttttgaaactaatcaaggaccattttatggaattgaataaccatatctaatttgtatgtatatctcctcttccttctcccaagatgacctacctgcttttgactgctggaaagacttaaagagtctttaattctggctttctggctaagagatgatgaaggaaaatagacctaaaaaaaaaaatcacagattccatattactaactgcatgttggtacaatagccatcaatttcagtgggctatgcctggaaagaatttggggctagtatcagatataaagaagaggaagaaatacaacttttcctgatctttttcaatagtcttaagactataattcattcaaagatattcctaatattactctgagctccctatacatatactgctgctgctgctaagtcgcatcagtcgtgtccgactctgtgcgaccccatagacggcagccca

SEQ ID NO: 42923 - DNA, 1741 bp, Bovine  19866880845887
actttacttagaggtttggactttaaaatatttttaaatagtatcaaacaattgagttattcaatttcaaacaatgaccacaggctttcattccccaagttccaggcaacctcttttgagtggcccatttgtttctggctactctggtgttttccttctctattcttccattctctttgtttccgttcacccccaggaaatggagtactctacacaaatgatttcttcccttcttgcactgatctaagagataggaggtatattgctaattttctaacaaggaaaatgtaaagtgttgattctagagtgagaatgaaagagactggtgaaaaggggtggtttaaactatactttgtttttcttgggaggcagcaggctcactatgcatagaattatggaaaatgaaacaaattacaacacagcacattggtaattcatttaaccttctgcattagaacaaaatccagaacagttaagaatctaaagcctatcttcaagagttttctaaacacttggtatctgccaataataatgtaatgacctaacaaatgcttttgttcttcttgcaaccaacgcttatataattcatacacagcacatagaatgggacagggaagtgcaatagtcctcgttccacaggacagctcacacaggaagtgctagaaagaggtttccatccatcctcaaatctactgacagcctgttcacttttcaaaccactggggcatatgcttgtttaactattccttgcttataaggatctcttcattcaaagtaaaccactttatcatctgagcctatggtgaaaagtagaaaataaaatttttgttatgcagctctgttgtcctccaagtgagttataaatatgtttgttggaggtattttacagatcatgactccccactgaattagacattctttttttcttactttattgagatattagtgacatgtaactacattaatctaaggcatacaagtagctcagtggttaaagaatctgcctgcaatgcaggagacgccagagatgcagtttgatttctgggtcgggaaggtccccaggaggagagcatggcaacccactccagaattcttgcctggaaaatcctatggatagaggagccttgcggattatattccataaggtcacaaagagttggacatgactgaagcaactgagcatgcatgcatgaacatgcatacaacatgacgactttatatatgtatatattacaaaatgattactacaataagtttagttaacattcattacctcatatagttacactgttttttcttgtgatgagaactttcaagattttctctcttagcaactttccaatattcaatacagtattgttgtaggaagggggaccccttccagggcctgaaactgggctcttgtctaacactcagaaatgaattgtctgaggtcaattatgcaggtcaggaagcaacagttaagactggacatggaacaacagactggttccaaatagggaaagggagtatgtcaaggctatatattgtcatcttgcttatttaacttatatgcagagtacatcatgagaaatgctgggcctggaagaagcacaagctggtatccagattgccaggagaaatatcaacaacctcagatatgccagatgacaccacccttatggcagaaagtgaaaaagaactaaagagcttctcaatgaaattggaaagagtggaaaaaagttggcttaaagctcaacat

SEQ ID NO: 42924 - DNA, 2751 bp, Bovine  19866880848799
ttcgggaaaaaaaaaaagaattttgaattaacatgagatattatattactctggcccatgactttcagccataagtcagtttgttagcactgcaacaataaaatattttcattcaacttactgtggttaaattctggtttacagtataaagtaactaaatggtattttaatgattatcaattatttcttccagggatattttcttttcaaaacttgtttttgcatgtttaggatggatatcatccttgtagattctcagtcactatattagctgtgtgtcagaaggctcttatactataaattctggacatcactttttgctcagatatcgagatgactttttgtatttcatcatgtcacagcaatttcagaattggtagcaagtgtttcatgcgttactattgaaaaaacagcaggaatctcagtttggtgccaaattgtagccattcactcatttgccatttggcaaaggatttcatctatcatgaatgtaccctagtgatggtaatgattccttttcaatttcctaattccaaacacttaggaaacctgggttaccatagaaattacttttccatttatgtataatttaactcagctaggttattatttgaagagattccaaatttgatcactacaatcataatcttttctataataaattcacacttctaggattctactctggcttaaagttacaactttgtacagtagtacatttgaaaatgtgagacatagggggatttacagtctttagtgtgcattctaatcacctggagaccttgttcgagtacagattctgatttactggatccaggctgggccctgggattctgcatttctgacaagcttccacataatacttatgctgctcatccaaggtaggatcacacattgaggagcaaggggatgaagaatctattttgttgttcttaagaaagtttaagtgttttaaattattttactaatactttctatttgatgtttgggaatatatcaaagtttgcttctttctgttgatcacaaattagttaatagagcacagacatatatgattatttctatttgagaactgcgaataatgtagtttaagtaacataataggaaccaccatatagtcatatctctttatcacaagcacttgaagatcaagtcagtaaatgttttcctcttgggattttaagaacagtgtttatcataggtataaattctgctgtaatggtctcttcaatacagagatgcaagaaagaaatacttctagtagataaaatgtttatttcataatacaaaaaaatgtggagttctttaagaatttatttttcttctgacctccaatttaaatatagaatactggttttcataacatgaggaacgatgctggtgtctgaatccaaaagtattctcttgatgctagctggtaaagtgttatttctacaaagctaaaaatatttcacaacacccacccctgcaaaaacaggtagaaatacacaggtatgattcctgtcttttggaagctgaatagctcttctccaaggaaacacttacagagcacgaatcaaggctctcttttcagggtaactggagagacccttgtgaagacagtgaaactgacaaataagttttaagggtctgtcaatcatggatgcctttgctgagactaaagcacctagcttacctgttccaaattcttgttttctgtaaccaagtcttcagtgactcacattgaaaatataagcaagacaatcaaaataaacagcttttgcatctcccagctgaatagcagtaatgattagacactgtttctccaatagcttaataccagtaatgtcatctcccatttgaaataatgttcttgtggagtagataactctaaagcacagaaggtgacagtaccatgggcttaaaataaatactctggattattccttaaggaatcatggagtcaaaggcagacaagtcaagcagaaaaatctgtgctttagtttcacaggaagagtaaggtggcttaggcatagcttcttttgtacccccagtccattaaaaaagaaaatcttcaacaatccttatacccaaaataaaaagaggaaaatttccacttatccatatctgtaatatattatacactcaattttagaagggtcaatatttttatgaaatttcagtttttcatttccaattgatagactttatttttacagtctcccatcattttacatcctcatgctagatctctcaaagagacctgtatttgccttttctcttcttttgactttagaaaagcttaggctgcatagaatgtgaccattcatcttggtggcacctgtctttcgatggttctccatcgcttagagtccaagtaccatagagtagcataataaccttgtcatggtttagattgcagtttatatcctcactttggcctcagtttctatcatcctcaccacaccttcttatccacattatggaagaaaccctgaccctaacacaagggcagcaaggaagtgagaggtagtgtccacacccatgataaacccatgacatctctctctttcaaaggcttcatccctagacatccagttttaatctgtattcacaaactttaaatagcgcctcttcttcttaggaagtgaagttctttggaagggaacctataaccttaaatattactggagatttgaaggtataaatcattgttctctttttaaaactcactactcctaccaatttatttacatctttttctctccatca

SEQ ID NO: 42925 - DNA, 2103 bp, Bovine  19866880865419
tattttttcttgcctggaatatattcgaggatgaaatgaaacccatgtgtgtatgtatgtatgtatgtgcacactccatgggtgttatggggacaggatggatgcccttgaatgagggataaaggggagggccaatgaaatgatcacagttgacaggatcagtttgagaacatttgaatgccagctaaaggaatttttactttagtatgtggataataaggatctattaaaggtttgtgagcaaagacttgacattacatttgctttttttaaagtggcgttttgcagtctgagtatgggtgagagttaatcaatgctacctccatggatgactctgcctatgtgcaatgcattcctgtacacccaaaataagagagcaaaatccacatgatgtcaactgtatcattcacagaatcacctggatcaccaggcaagtccagagtgtctgagaagagcataaggaataggagtaatctgatgcttccagactggagagcttttagtacactaaatttaaaggttgattagttataagaagcacttcctatataaagataaataagtcagagagactcaaagtgattatttttcaatccccaaaatgatcatatcatgaaggagcataaatgattaatgaaaaaagttgaaggtctggaatttacataaaagaatataccttaaattagtattataaagataaaaacagttgtaaaattaagatattattccttaaattcatctttcatttttagctggctcttcattctcaagaataaccacaggagaaaagttataaaggcatagtcaatgtatatttttatggttctgccctctcttcaggtagaaaaaacactgagcttaattattctataatcattagagttttttcagtcttattgctctttgaccttctagcagattctatatggatagcttaatatcctctaccatttaaaatcaaatttcccacattgcttttatttaaaagtgtcacatagccatagatataatcacctgattaaaaaaccttcagctccagtgttaaaagcatacttcttttatcttctaatgagatgagttcagatgatcccaagcaatatttttaaactgtcacataatccttcacagttaacaaactgtcttacaagattatggtaattatctacaagtttgtataattcatcctacagaaactttttcttcagtataattgatgttaacaaaattcaggagtctttaatacaagggtaaattaacacaacctttaaaatggcactttattataggatacaaaacaaaattttaaaagatgtattttcagtttacatttaaataaagcaaacaaacatttctgaaacatcagtgcccattttgctatttgtattaattgctaagattttattgcttttgatcaaagaccatcacctgatattttatggaaggatctgagtataagttgatattttgatgaatcagcaaaacagtgatttttctaagaatagagatatataacacatcagagataataaccttataggaattatcacaacactgtactctgtaagtttaataatattaatttaactctgatttttaaacagcagattaaatatggtagatgttaaatattacatgcatatcttgttaagagatggcaacatctttccagaatgttgttaatatttcaatttactgttatcccctaccaccaatggatccagaaataatgggataaaattggtatgaaagacatgtggcttaaatatttgtgcatgctaagttgcttcaatcatgtacaactctttgtgaccccatggactgtaggtaacgcggctcctctgtccatgggattctccaggcaagaatactggagtgggttgccattttgtgctccatgtggtcctcctgaccaagggactgaaactgcatttttcacatatcctgcattggcaggtaggttctttaccactggcaccatctgagaagccccaaataattgtttgctgggccaggagagtccaccttgaatcgtggtgaaagggagggtctagcagaactccaaggaagtattgatcttggtaagttacagtttccaaaagatta

SEQ ID NO: 42926 - DNA, 1823 bp, Bovine  19866880922323
gggtataattgccccttcattttgcttgggaggaaagagagtgatttatttcagaaacctaagagcctaggggcctgcaaagaaagagaatgagaacactttggttacagagaaatatcaggaaagctcttttgcaatcaactcaagagatgataagccctcgctttctctctatgacaatagaaatgaaggaaagtctacaattgatgttctaaaactcctacagtctatgatttctcaaagggaaagagcctgttagccatctgtatcagctgctacccttggtcaatgcttaacacacacacacagacatgtttacaaacactcaccagaataaatgtaaaaaccagtgctgattttactgagatgataagaatattagtactcaaatcaaaagtatattttaaaaaaacttccagattctagaacttgggtaaattttaagccactcttacaactagttaactgaatatcaaacatatgcatagattacatcaataaaattgcagaggtctcatttattgtaaatattaaaattggatactgttgagtttaataattttaagactcatatatcacagcacaaacccatgcagatgtttgaaaatataaactttcaatcttttatttatgattctactatttgagcatatcatattttggttattgtcattttttgaatatagtcccttaacttcctaagtgggttgaccctaagtgggttgaccatatgaatctggaaaagataaagaacccattgtgaaattagctgtcttttatatttgttgtgtctacccaaaaccaaagtacaaaatttagtcagatattccactattttgtctatacaaggacacccatcgggctgtgaagtctgcctgtatcacattgttcttctcaaaaggaatattttgcttgataagaataaaagattatttttatcttccattttgaaaacactggaatgccatctagtcttttctttgggcattaatttcaactttgtcctggaaaattatgataacatttgattctcagtttattagaccaaattaaaataagtaagaaacaaaactggtttttcctttgaccactttgagtgctccatgcaacctgtaaatctgaaaaactggcataagtattctgctgaggcttgctctgccttgatctgcctagctctgcccttgatatgagaaaaaatatggaagatgccctgtgtcaagttacaaaaattgacatgagaaaggagaggaaattagatctatgttagctatgaagactgaggaaagcaaagtgtgaaattggaaaaggcaaattttctacagcccatctctcttgccaagtcatctgtctgagtgaaagaagacctttaagtgaactcttcgaaggcctacgggcatatttcttagtctgttcctaagaactgctcatctccaaagaaagccaagtgcatgctcagtcgcttcagtcgtgtccaactctttgtgaccctatggaccatagcctgccaggctcctctgtccatgggattttccaggcaagaatactggagtggttgtcatttcctactccaggggatcttcccaacccagggatcaaaactgcatctcttatatctcttgtactagcaggtggattttttaaattaatttattcatcttaattagaagatcattaatttactatattgtgatggtttctgccatacatcaacaagaacaagcacaggtatacatgtgtcccccgcaccccgaatccctctcccacctccctccccatcctctagttgtcctagagcactgactttggggtgcctgctacattca

SEQ ID NO: 42927 - DNA, 706 bp, Bovine  19866880941036
tgggtgtttttatttgaggtctgctgactcacttgtgttttgaagtgcattctctgtcagttctccaatgtggtctttcagaatgagaggaaattatatttttaaagataaaacttgatatttctgtgagcttgaggtacctcactacctggctgtatggttagtcagtgtttaaatgtcaaggagaagcaatcagcaaaactttctccaatccttattccaggtttgtttttctgccacagaagatttttgcagtatacaatgatgacactctccaaagatctttgagtttgttatggtcaccagtattataaactgcaaaatacttattacccctgctttatcttggtatattttaatcctttgccttttagaatgtaaagaaaataatatcatgatccctttgactgtatactctgcacgaagcactgtgcaggtcactggagtgattgacagatgagattctttggttttcatagatgttatagttgttgctcagttgctaggtcatgtctgtctctttgtgaccccatgggctgcagcacaccaggatcctctgtcctccactatctcctggagtttgctcaaattcattttcattgagtcgtgaagctatccaaccatttcatcctctgctgcccccttctccattttggcttcaatcttcccccagattagggtcttttccaatagtggcacttctcat

SEQ ID NO: 42928 - DNA, 1184 bp, Bovine  19866880975372
ccagatccctgagtacttttgcagctaacaatgcaaactctgaaaaatccccacatggaaatcctagtctcccagtcacccacaccacccactgtagagtgagggccactcagaataaatcagtgctgtaatttccatgatgacagtcccccaaacagcattttgttattgttcccttcacatccctagaattcttcccatgtgctgtcatgtctctagataactgtgcagggagatgaaatgtgagtttaaacgaacttttacgtgtgcctctatattttcttctcggattttattatttttagaggcaagtgatgaaaggctattccctgcaagatttagccagtgaaacgtgctcatcaaaaacccgaagccctgcagtgggacccagaagagagcaaagggggaaaatgttccactggggctgcagcttttcagaagagcgtgcaggaatgatgtcatttgtttttacaaaacccagtttaaatttgttcctgcctttcaagaactgcagcagagtgcatctgtggagacttcctgcatcccatatttcaggacgttagagtgtttgctgcatcaaaatccagccaatcgcggggtgtgcaggcttgccctccccaattttcctttgcctgcccacctgaagcaagcgtgtgctgcccgccttagatcgctgctcagcaccctctagcccttagaacggcagagccatcactccgtgcctcgaatggtttaaaggagaacagtgccccaataaaaacttctttcaggtcacccaaacgcattcatttcattgacaaataagctccaagaaaaggtctgtttgagacgtatgtattgtttgtgtcaaatcttagccctttgtttttgcagcccctgcagcagcattggaaccaacacaggagggttaggggactctcagaggcagaggcaagacctttaaagtcactactcacaattatctttttacagagcacacctccctttgtgagtatacatacatgatggttgaaaaataagcaatgaagcagataaagcattttacagtgatgcggtgatggagggagattatggcattggtgtttacatacaaaaataatggttaagatacagagcaaaaaaggaaagtgctggctagtgagtgtgtcattcctccttcctttatccccttcatctgtaagtat

SEQ ID NO: 42929 - DNA, 2216 bp, Bovine  19866880985633
atgaaatgcctttacatttaattgcatcacagctgattttggaataactacatatttttattgtttccaaaaatattagtgtgctatgaaattaatatctttttattattctttccaaggtgaatactctaaatttattagtttttatttagggatcaattatttgatagtataagtctatttataacccacttcagtattcttgcctggaaaattccatggacagaagtgcctggtgggctgcagttcaaggggttgcaaagagttggacatgactgaggaattcagcacattcataactaacttagaaaagcatctgagtattccactctcctggtgtttataaatcatgttgaatatttttatgtttgggcagtgtttgtatgagacgtgtcttctttccaaggcatactttccccatgtttatttcttacccattgcttgaaatgaagtggaatgaggtacataaggagaaagttgcttcctttccccattcctacctatgccaatagaaagaatagtcagaactaccaacactttggcctttgaggaaggtgtggttggcagaggtaggatgaggtatgcagactgagaaattatcttccttttctcttcttttcctgaacccttccctcatgtgtggggatttacctgcattctctatcaccctttctattacagaattactggatggaagccaatgaaatagagagagggtacaaggttaaaccagcaaaatctgtcctgagccttgagtttttaaagctttattctacttggactagctggaaagggagatgtagtctgtgacttccatcttccatcaccatcataggttgagtggctctagaagtacacttaacttcccattgacaaataggtagagtggatgataaaaatgctttcagtttgcttaggactttatcatttattttattatttttacaatttactcttaataaatttataaagtaagcagaacccagactgttagttcaactttacccatgaggtaactgagctgaaaggattattaagcaagttcacacagtgtgcaaatggcaggagcacatgtaaaaccggtgcaggtctccaagggtgcggactttggattcttctattattaatagatagagctgcttttccactttgcaaccagcaattcacttacctgggtaattgcaggtttgaacttctaggggagcctagtactgacatctatatattctgctcttatatatacatgtgtgtgtatacacatatgtacatatatgtatatatgtatgcatatatatacacatatatacatatgtatatatatgtgtgtgtgtgtatattagcaaaatgactaaaagcagagagttttagaagaagaataaaagccgtattggatggattgagaagaaatacaaagaaaaatcaagggagaaaagaattcccaagtgcttttaatttttctacttgtacctttttctttggtctcttttaagatctcaactctgtttggcagttttactatcagttcttgttttccatatcctgaagtcacacatataattaccttgttgtttgtaaattcactcattcagcatctattgaatcccaactgtatactaaccactgtatttggcctaggaattaaaaaataatttataagtatttcctgcatgcaagaagtatgtgtaacagcatagtaagcaggacacaaaatttagcagagaacatagtccttctattgattacaaataatgatcacatgcaaatgtaaaaaaaaaattaatttttccctccctctgccattgtcctttcccattgctgcttaacctaagaattctgttttcttgagtaaatggtcttttagaaaatgctcttttagagcctattcattctgaacgggctttgcaaaggcacatggttctatttacttattttataaacccagaaagagtatgactttcagtcagagaacttctacaaacactgtttatcctcttagaaaagattctaaacaaggacctacttacttatggcacatggaactatattcaatatcctgtgataaaccattatgaaaaagaatgtgtatatatatacatatatatataacagaatcactttgctatacagtcaaaattaacacagcattgtaaatcaactgcatttcaataaacaaattttaaaaattccatatctttctctgtgtaaacactgtctag

SEQ ID NO: 42930 - DNA, 1162 bp, Bovine  19866881054357
tatgcacccgtatgtgtgtatacacacacgattccagaataggaagtgaggatatactgtacagaaatctctcttgctgtaccgtggaggcttcccaggtggttcagtggtaaagaatccccctgccaatgaaggagacatggattcattccctgggttgggaagatcccctggaggaggaaatggcaacccactccagtgttcttgcctggagaatcctagggacggaggagcctggtgggctgccgtctatggggtcgcacagagttggacatgactgacgcgatttagcagcagcagcagcagcaatgagttcattttaaatctcattcaatgaaatataattactaaaggaacaaaaggcattttaatctgtgagactgtcttagaaaagtaagtgagaaaggtgaaaagtgactctttcacaaagttggctcttattggcataacagggttttaagttttgaaaagctaattgttgtaatattttgaaattaggaacagctatcctcagtgataagagtcttattagcctagatatctagtggatctcttagaataaatgatattgaggattttgaaaaagctgataacttgatatcaaggtgagaggattaagacttaaaatgggctgttttaaacaacaaagagcaaaatgaagcaacttttgggagtccctccaaagaattaatatattcttaagaagaacgcgcccatatctgcttttttggtggtaacagcatgtataatgaacatgcatgacccttccacagtgaaggtgaacacaggtatcttgcttcagtgacaggctgggtacatcagtgaagaccacaggggtggaggaagctcagtttttgtgcctaaactgagaactttccacttgtcttgagagttctcttgatgggttttacaaactcaagactatttccccttttattatattgtgaccagttcttttgattaacctcttgtgattcaaaacaacctcaggattcccaaaccaggcagtgatagccacaggagaagccaggagttaaagcaacttgtgtaatagaggaagtgtgggtcatgctcagagtaaagtgcttcaaaattcaaaataaaccaacatgaaagagaaaatcatccttgtttcagagactataaataatgcagcaatctt

SEQ ID NO: 42931 - DNA, 1257 bp, Bovine  19866881094607
caaacccaattatgctatacttgcttatatctgaacatattggtttatcttacatagagtttaattgatgcaaacttgaacttcagtatgttagattttctgagaaaacaccatgcctgtggatttagattgctgtgtttttctctgaacaaagcaaagaggagccaggcaattacaccttaggtctgttcctttcttctggattcaccagccattacaaaaatagtgtttaacctcttgtcggactacctctggtgtcctttactgtccaattgcaaaatttcttccagagccaacatctgcctccttggacagatcaacatagtgtgcaaagtcggtgttagctgatcaagcgtggctttgtttgcgcttattcacagcgcaaccagcactgcgtaagtggttttgcatattaactaagtgcacagtaaccttcctttccctcctcagagctccaccccctcccaccaggcctcctcgggaaatcaacactgttactcactgaggaagctgccaagaggttgccatggcaactgttctgctttcagcagctacttttctggtttgaaggtgggggggcgggggtgaggaaaaaaacccgaggagaactaggcagctttctgatcatagttcagataaagagggtcacagtcatttgcgggcgccgcctaaaataaccccgcggatttgacagtgacagaaaagaagcaaatagacaaatccaaaaggtaagtccagtggaaggacaatcgtccaggtatttggaagtgatcttaggcggaagcattgccagcagatatcagtgcatctcatccaggatgcagttttatgagtcttttcatttttgtccagagccaaacaaagataatgggttgtattagattataaacagcaagggggtaaaacagccccagaatgggaatgtaacatctgaaagtcattttgtaaaacttcattcagcacgggaacaatgccgcattcaagcagcatgagcgaaggacgcgtggtgcgccaggtcaagccggtgacccctgagctcttctctccccgagtggcttgccaaggttggcctcagaacagtctcctttcaaagaaaggggtgggattagccagggaaaggtgtaaaaagtcaaaaaagggaaagctgggctcacaggattgctggatttcagcgacagacagacagctgtgctgaaaactgctccagacacctggttcctggggtctcagcaactcctcgtgaaatagcccacagtt

SEQ ID NO: 42932 - DNA, 1458 bp, Bovine  19866881141386
tactcttgcctggaaaatcccatgggacagaggagcctggtaggctgtagtccatggggtcgctaagagtcggacatgactgagcgacttcgctttcacttttcactttcatgcactggaggaggcaatggcaacccactccagtgttcttgcctggagaatcccagggacaagggagcctggtgggctgcagcctacggggtcgcacagagtcggatacgactgaagtgacttagcagcagcaactgtatctgtatatttgcatattatttgtactttgatttttgagttaatagacagtgtcacacctttgtattttgcatcaatcgctgcatatttgtagtatataaggaattctttagtctcaggaactaagtagtataatataggggaataaatatatggttgaatattgtattttaactcactgagagagaaaaattagacagaatcataatattttcattctcacattatgcctggtacttttatgtctgcgtattaagatgataggtgctatagaaagggcaaataaatacaacataggaagtctgtttagttattttagagctgttatattgaaatactgtcttgtttacaattttcaactccacaaatcctcatcaattattaaatatttttctcattgaattaagcaagttgactgtattttctcaggaaaaacatcaggtaagacacaaggcttactcttaacatattaaaatgttcccatatgaatgaaattctatagctctattacacttctcagcccacccccacactaacagaaagtatacattctatttgctacataaaaggaaaaagaatttaaatttcattatttctttgaggctgaaagcagttctttcctactgcagtgacaaaataaacaagatattttctagaactgagccactgtgtatcaggcatcatgtgtgggaactgtcctggatgactcctgggtggttacagtgaagacaagtatagacaaaagtcagggagagaatgggacagtcacatcttacagtggaaaatgctatgtggtccttcatcagacacttgacaatttttaatttggggtgattatatatcatctatctgtttatccaaattactcatcaaaaaagtttggttgagtactattgtacaaagatacaatttgctattagcatccttcttcatttcattttgagttatgttcattgtttatatggcttcttgcctgctagaactgctatccacatgcatgagttcgctgggcagccgcctagacaagaaacatatggccaagtcggctgcgaaaatcgagacacacaccattcgtaattctatctctttgtgtgtgtgttgacttgtgtccattcatgcacgtctacatttaggatctgtatctcttacaatcgtgtgctaataaaaatatttatatcattccaccccaacaatacttataaataccac

SEQ ID NO: 42933 - DNA, 3960 bp, Bovine  19866881178022
gcttgagtcatcaggatagagttggttaggaatggtgattgaggtctcacttctctatatatcccaaaacctgggtcctaccggcaacggagttttaggttttctcaacgtcaagtcagatgacagagatgaggaagatggggttgtaaatgagaggtgggtgtctctgaaggacttggtcttagaagccagccttgcactcagtcccatggtgcatttccttcctgagagcaggaaaaggggaagcatggtatgtttctgtagtggttaatacatgcttactgtgttgatcatctctcctgtgattccctacagttgctaggctattttagagttgactttacttatggaataaagagtgcttagaacaaaataataaaatgtccctgtgtgtgcatgtgagcccaggctgtgttgcatgtatgcatgcacactcacacatacccttaaatatatatttaagagtgagaaaacagtagcagagtgcttcccaggtggcccaggtgaagaacctgcctgtactgtgggagatgtgggtccagcccctaggtcgggaagacctcctgtagaaggaaatggcaaccctgcagaaggaaatggcaacccactccagtattcttgcttggagaatcccatggacagaggagcctgacgggctacagcccatgggtcttaacgagtcggacatgacttagtgactaaccaacaacaatcactgctgtaaaacaaacaaacaaacaaaataacaacaacaatacaaaaactcagttaattttagcgtttccagcctttcagtatatagaaaatacctcgtgaataagagtaagtgggtgtgtgttgctggcttttgtatcttgcagtggtgcttatgatgggtttgtcacatgaggcaagaaagaacaatttcaaagtttaacaaggcattcctcctggttgaatctttgctgccactcttggcattattaaatttatgtatgcaatagtgaataatggtatctggagttgtagcctgccacatgtttttaggaaaatatttgaagaaatgcattctgctttactttataaatgaaatgatgttttgttgtcaagattttccctcacactgtgtttccccctcaacttttatacttttttatttgggctgtttggcttatttattttgttttgttaagagtttattctctggacaggtgtggattggcatgtgccttttaaagacttttgtttgttggggagctagacatataccaaaggagcttctgtgtagccgcctttcaaacaaagcttcctaatttcagtgtcattgagtcagcagctggtgcagctgaattcagaggaacaaacatacttattgagtgttttctctaaaaaacagcctgaacaaagcatttccttaagcaatgctgagcaggatctggaacttcctattcctcaaaaaagtctcagaaaggtttgcggaagtgtagaggtcaacatgactgcctataatacgtctcctctacacccaatctgtggtaattgactccttttaaaaatctcgtcttttaaagtcgtaagatcagtatttgtaaataaaaagcaaacagaaaaacaaggaaacctactttaccaaaaaaaaaaaaaaaaaataggaataatcagttattggtaataatcagtaaataccatggtcatatcagctagatcattgttagtaatgccagagaagtgcatgacacatatgctggttaatttaaggagaatatttaaaacattgtagcttatactatggtgtgatattttcacatatgattgatttattttcttgcagatagttaaggtgattaattgtctacataatttatatttcttctataaagatctttgaaatggtagaaattaggagttaggcaagaatccattcatgcatttaaaaaaaataagcattctttcattttatataaaaatcatactttcagtctttttttttttttttttttttagggagtactctcatataccagacactctattagtacttacaggtagaaaatggtattataatatgcaaagagttaagtaataataaaggtaaaataataaatgtaaaatataatttgggggacaaggtaagtggcgtagatatgctttcatccattttatttccagataaacttctatttcaaggtaaaagttttttttagcaagaacttaagagttcataaggaggagccagacatcctggagtgtgaagtcaagtgggccttaggaaatattactactaacaaagctagtagacgtgatggaatttcagctgagctctttcaagttgtaaaagatgatattgttaaagtgctttagtcaatagcaaatttggaaaactcagcagtggccacaggactggaaaagatcagttttcattcaatcccgaagaaaggcaatgccaaagaatgttcaaactgccgtacaattgtgctcttttcacattctagcaaggtaatgctcaaaagcttttaaggcaggcttcaacaatacctgaaccaagaacttccagatgtacaagctggatttagaaaaggcagagaaaccagagatcaaattaccaacatctgttggatcatagaaaaagcaaggaattccagaaaaacatctatttctgcttcattgactacagtaaagcctttgtggatcacaaaaacctgtgggaaattcttatagagatgagaataccagactacctcacctgtctcctgaacaacctgtatgcaggagaagaagcaacagttagcactggacatgaaacaacagactggttcaaaatggggaaagaagtacgtcaaggcagtatatcgtcaccctacatatttaacttatatgcagagtacatcatgagaaatgccagacagtgaatcgcaaggtcgaatgaagattgccagaagaaatacccagcaacttcagatatgcagatgatactacccgaatggcagaaaacaagaagaaactacagaacctgttgatgagggtgaaaggagccagtgaaaaaaaagctgtcttaaaactcagcattccaaaaactaagatcatggcatccagtcccatcacttcatggcaaatagatggggaaaaagtggaaacgatggcagattttattttctttggctccaaaattactgcagactgtgactgcagccatgaaattaaaagatgcttgctccttggaaggaaagctatgacaaacctagagagcgtattaaaaagcagagataacactttgccagcaaaggtccatagagtcaatgctatggttttttcagtagtcatgtgtggatgtgaagagctggaccataaagaaggctgagtgccgaaaaattgatgctttcagaaactttggagtgggtaacctttcccttctccaggagatcttcccaacccagggacagaacccaggtctcccacattgaaggcgggttgttgaccagctaagccacaagggaagcccaagaatactggagtgggtagcctatcccttctccaggggatcttctcaacccaggaattgaactggggtctcctgcattgcaggctgattctttaccaattgagctactagagaagccccctttggatagcaaggagctcaaaccagtcaatcctaaaggaaattaacctgaatattcattagaaggactgatgctgaagctccaatactttggccacctgatacgaagagctggactcattggaagagaccctgatgctgggaaagattgagggcaggagaagggacaacgggataatggcaccactgactcaatggacatgagtgagcaaactctgggaaatagtgaatgacagggaagcctggcatgcttcaatctatgggggttgaaaagagttggacataatttagctactgaaaaacaacaatgaggtttgaatactgcccctattttctgtactttgtatctaaggtcaatagac

SEQ ID NO: 42934 - DNA, 1208 bp, Bovine  19866881222020
cttctaaaatttgatggttagtgcagttgccactctgaaactacttagcctgttccatcactgtgtgaattattctgtctgtaatgacatttataactgactgttcttcatttagaatctcttgttatatctttgtttattagcttctgtgggagagagacatgtctttaattttcatggttattttcctgaactatgccccaaatgaccccccaattttttttttttaaaggaattcaacacttctttggatgtactataaaaaaaaaagaccaagttttctaaacctttgcattaacataaggaaaaccttgcagcaggctgtctcatcttgttaaggccacctggctctataatacctaactaaagtgattgagagagtgaaagccttgaaggcagtgttcatgtttgtaggcagtacatagataatacttgccacacgctacatagtcggcatatatttatagaatgaactttatagaatgaacaaatgatcctacaatagagcgcgttttactaattcacagtcacctgtgtgcccatgtgttttctgatgattcctttgtgatgttttggttggagctggtggagaggtgtcacgtcgtcatggctgcgagacggcagtgctgtttggatgttgctggtgactgtgacagaggggagaggaattgaggggcaatgggagcagagtgttagtgcttttctgtctttttggagcaagttcctgcaccccttttagtggaaccatcttaaatcagtgaactgcattatttcattagcccggtatccagagagtcatacgggagctcttcctctgggcataaatcttgtgtccatagggcactgaagcagttaatctaaatgctctgttttagaatcaaagtgagtgcagacctagcactgagttatgatactgggatgtcagaggctcctactttccttctagaatagtctcttaactagcatgtattcaatgaaaagggaagtaaaaaagctctataagggaacatgataaacattaaaagaaaatttggtaatctcatacaaaagatcaccttttccactgcatgaaataccttgtgcttctttttttaattttgaaatctgtttgagcattcatcactaaagcttgccgtggttgcagaacatgctttgtagaggcccttagtcagctttggttgattaggggtagtggtgattaattctta

SEQ ID NO: 42935 - DNA, 1503 bp, Bovine  19866881273615
ctgtaaagcaactatatttcagtaaaaattaaaaaagaaaaaggggctcctagccatctcctaaaagatcctacgtgacctgcttcactcccccggctgaactcattttctctcatgtctcttgctccacttccactggccttcttgaaaaaagggttcccagcacactgcatgcccctggcactcatggatcctctggagccctcttctcaacagtgtctcccttgttgatgcagggtttcagttctgtctcactctatcagacaagccttctatgaacaccccatctaagtagagacgtcttttactctctggaacctctctggcctcttatcttttcttttcctgatagaaaatctcaacttcactccatagaaaatctcgacttcaatccagtgtcactgtgagagtaagtctgcaaaatagttgaagaccttggctgaggaattatgagaagaatgtaacagagcaaattctggatattctgggccagaaatatttttgaataattaataaaagttttgcacctctgtgacctttttatcattcattcctccttaattttgccttcttagaacctctcccaaagcatgtggaaatgagaaagtctgtttttatgtgagaaacatcaaattttgaaggttaaattttatgcctatttggcctctataggaaaatgtaaaaaggactctccctttttttattagcctctgtataattttatgtcattattcatatatagaatgtgattttctattgtgaatagaggttgtggagtacataatttaattaaatttactttgagtttatgcttttccaaaaccagatataaagtcagtgttactcttaaaactcctgaggagtcttaagattcatgggagagatccattaacaccttttcaaatttgaaggtcaagagaaaatgccagtcgagttattattgtattattgagaagttctttatgacagctaaaatatctaagaaaagtagcaactaaatgatatatagcaaggatttattaactagatacacatctgtttgtggaaaaaaaatacccagaacaggaaaggatatatatcaaacaatgattttgtatcaactaagctgctgtatgttttatcctaggccacctgactttttctgggacacaggctaaggtgtaagagtacttcaggggagaagtgaattaacacaggactattggtagttattcctggttaacagcctagcaaacttttctttgcttttggccatgtggaatctcaagttacccaaccaaggattgaaccgaaggcactcagcaataagagtgcagagtcctagccactgaactgccagggaattcccaaactttttccttttttaatctttgcctctatccacatatcacacagtaaactgtgatagggaaatgtttgggggagaatatgtcagcagcatatcactgagtatgaagtagtcatttttttcccaactttattacctatgttacataatcatgc

SEQ ID NO: 42936 - DNA, 1674 bp, Bovine  19866881298614
ttgaccaagatagggtgaaaaatatcatgctagcatcacatgtctcatattagggaatgatacagtggagctgccctggaggccaccaggcaccctgcccagagacggggctggaggcatggaccactggcggaccgaaagaacacatggctgccctgccttggcaggtcctgtgagaaggtgaaacaaaagtggacaccatccatatggagaactccacgtgactgagggcatgagcagtaggagctagcccgagtcagatcaaactgtcgagtgcctctcatgaccatcttctctcccctctcacccctcattcccacctattaggtggagggaagggtgcagaaaccaacactgccctcctcctcatttcttgagacacattccaaggagaggaataagatgaagttaaaaaaaaaaaaaaaaatcttttttttaacgattcacttccctccaagagaagcacttacagttggatatgaggttgaagtatgaactggactgtaaatttttactctttgagtaaccaaaagtagtgactatactaagttataacttattatagttacattataactatatattatattataactatagtaagttatagaaaacattggagatgagatgtcaattaaaggatacaaaggggaaatcaacagactcaggaaaaaatgtaaaataaaatatcaggtttatatataccaaattcagattgttcagtaaacatgataggaaatctcagtcatcaaaaagtaaaaccatctaagataataactggctagagtggaattgacacctaataagaccacatattaatgacaacatttatttaagctattccataatattcaattgcagaaggaaatggcaacccactccagtattcttgcctggagaacctcatgcacggaggagactgtgggctagaatccacaagatcacaaagagccggacatgactgaagcgacttagcacgcacgcataatactcaatagatgaatcattctgttgccaaccacctctatcttcagcaagttttattaaatgctagtcacaataactattgaaatagatgttcaccaaatatgagaacatggcttaaacattttaaaatttttttcaatttaatgtattatagaatgatgtaaacatcagtgaaattctttcagagttttatgtcttactgggatgattacatggttttcaaatactataaagtcttaagcaactacattagagctcatgaaaaatctcacttaagtacatagactcatgattctgaaactataattgaaaactatagtttttaacttctaaaaaactaatcatacatggtaaaaaaaattgccttttgtaacatttcaactgaaatctcattcttggaaaaaaaaagtgaaaatattcaattgtgcagccaaaattaccaaatttctacacgtctccccttttgtaaaaacattctatcggcttactagatatactgctcatgactataaatgcaggcatacctaacacttcacacatatcctaatcagagtgagatttttgttggcccatcagctttaaactgcatgccaacaatcaagaaaaatcttggaagttctaagtcctggttgtaaaaacagaagataaactctgaatcacagactgttagcccggaagaaaatgcca

SEQ ID NO: 42937 - DNA, 1047 bp, Bovine  19866881519681
atttacagttaacaaggcagcttgttaggtagaaagtagaaatgtgtcgatcacaatttaactctgattctctctctgaaagagagaaaataaaaacatggaaaggggactcactacccaggctttgcttagtaggactgaggttgaggcatttgtagagttggggcatgggtgtcttgtattttgcatctgtgctattttttcaatattacagtacaatttaatctattgatatgatattatgcctaggtgacatttagttgttctatgtcccatgacacagaaggcaatggcaacctactccagtactcttgcctggaaaatcccatgggcggaggagcctggtaagctgcagtccatggggtcgctaagagtcagacatgactaagtgacttcattttcactttcactttttactttcatgcattggagaaggaaatggcaacccactccagtgttcttgcctggagaatcccagggacgggggagcctggtgggctgccatctctggggttgcacagagtcggacacaactgaagtgacttaggagcatcagcagcagcagcagcagcatgtccaatgaattaatttactattcaaaacaatatcaatcatttttagcttatttacaagtcaaatggctttttaagaaaagaatagagcaacaaatttacttgaaaataaaagttgggatgatgtcaaattctgagtgggtctgactgtgctctgagcactgggcattttctgaggattgatgaccagtttgaaggagttgatggtccttggatgaagctcgggccattaactccaaccagtcattaattgcctggaaatgtcctgggctgaggtcattattgctattataaactgaattaatgccctatgcttcagccaataagattatttaaattatctttattctccattcagtttataattataaaaatgtaccacaggcaatcagaccagacaatagattaatcacatgcagaattatattttaaagaattgtttttattcatacagctacccaaagcacgggagaag

SEQ ID NO: 42938 - DNA, 858 bp, Bovine  19866881595568
ttgcccagaggccaggaatacagcattttatcagagccctgctcagtggagtggaggacgcatatccagatggcagagtcacctgcttccaggcaatgcatagaagcaattattgctctttggcttcagtccagagcaaaaataaagagtttaatatattaggtccaatcactatatcccagttgatccaggaagttttagataaatcatataatttttttaagaaagggtttcattttgaactatgatggtaaaaaataccatcaatacttttaataataatcttactacattattattttgaaatctggcaattcttcaaaaaaaacccctctaaatcagtgttctctaatcatagtttagaatatgtctttgtgtcaataaagacaccaaaaatgcaaacaagagactgatctataagacaaataactgttgttagcatgggtatgtccacatttggaaaataggtcatttcacctgagccaagattcatgctccttctcagtcatatctgactttttgtgatcccatggattgcaacctgccaggctcctctgtccatgggattttccaggcaaaaatactgtagtaggttgccatttcctcctccaggggatctggccagggattgaacctgcgtctcctgcattggcaggcagattctttaccactgagccaagagccaaggttacatgagaataattcgacatttgtatagctataatccctgtcttactaagttaattaatgacaagtgaatggaagtttttcttaacagaaaattatttctattagacttacaaccatcaattgcttattgcttcccacataaagtataattctttaacataattaatg

SEQ ID NO: 42939 - DNA, 997 bp, Bovine  19866881605350
gagattagctctggaaacttgaatagatttaggtacacagtgttttggctgaagtacttagggaaactgtgggctatgtgttatatcttatcagaaggactaatgtttctcgttttctgttttcaattgggtagccagaaccctccactggaaatttccaattgaagtttcatctaatggtttcatccactgataattgttgcttggatcaattattttcttaagggttgcaaaatgtagtttctattaatatcttcttaccatatattttagctgtagttcaacttgaaaaataactttctcacatcatttaggactatttggttaccctgaaatacagtttatgcagaaaaacaagacaaataactatttctttatcacctaattgctagttttctgaatagtaacaagtgctgctaaatccactgttagtcttaacttttccctccagttccattgacaaagcccagttgcactattgccataacgtcaataggagtttctttctctaaattgttctttcactctccattttttttttaaactactcaaatggtgcttctaaaatttgcaatagattcaaaagaagcctgaaccttatgttcagaagaaagatcacagtcctttgctaagacttttggaactccaatgattgctcatggacctgcctttctactttctttctttttgtgtactgaagtgaaagttgcacagtcgtgtccgactctttgtgacccaggccagaatactagagtggggtagcctttcccttctcccaggggatcttcccaacccaaggactgaagccaggtctctcacattgcagcaggtttctttaccagttgagccacaagggaagcccaagaaatactggagtgggtagcctatcccttctctagtagaccttcccaactcaggaactgaaccatggtctcctgcattgcaggtggattcttttaccaactgagctatcaggggaaggccctttctttttcta

SEQ ID NO: 42940 - DNA, 1223 bp, Bovine  19866881916653
cttgatagaattttgatttgttttgttcactgataagtctgcaactcctaggacagtgcctagcatatggtagacagttaacaagtatttgttgaataagtaacagcatgactagaatacactaattaatattcttgaaagtgaaagtgttagtttctcagtcgtgtctgtttgcaggactatagcctgccaggctcctctgtccatgggattctccaggcaagaatactggagtgggttgccattcccttctccaggggaatcttcctgacttagagatcgaacctgggtctcctgcattactggtggattctttaccttctgagccaccagggaagccatcataatgcactaattatctaagaattcagtacacaaaacaacagaattatgttaaaccattctttctcttcttattatttcaaaaatacacccagaccttatactacgtcaaagggacagcatggtaaacatcatgtttgttatatagacttttttttttaaggaataactgtcattttagtgagctcattaaaaattcacaagtattacatttcatgagcaatgttaagtaattgaattttcttctggctacgccccagccttcagcaattctcagcaccttaggactgacctggcttgggtctgtcagagtctaaaaccataaactgtgtcagagttgggatcatgtcaaagtcagatggtgcccaagcagcttagcatatcactgtcagatgccagaatgagggtttgctgagtcatcctggcacctccagggagcagggaaatattatacaaactctctggcccccagtcatccctggggcaaatcaaacttgggcaaattaattaagttttatgtccattcagtcattcattaaatatttacttactgtctactatattcccaatggaaggctgagtattaaggctttctgtataagctccctactaacaaccaaagttcatcagtggttactatgtacttagacttctgcaagaattttacatgatacctcatttaacctcacagcaaccctccaagatgctactctgttgacccattttacagataatgacaggaaggcatatgaggttatatagtttgcccatggccacagtaagagatggcaggcttttatccacattgactaactgctgagcctacagtcttaatctcagcagtaatggactctgccctccctagatataaacacatacat

SEQ ID NO: 42941 - DNA, 1702 bp, Bovine  19866880437220
ctggaaggtcccggttcctattttatctaacattgaagcagaacttacaaggctgaggggagaggcaaaaagagggaggaagaccagcatgtcagacgagatgtcctcatacctgccggtcccacccaccatcattactgccagacactgaactgaggacaggagcctgcctacagcagggcatcccaagtcctgccaaaggaacacacgtccaagagctgctatggaagagggttgttcagatcaagcccagcgcttctggtccaaaatctggccactttacccaacaaccagccccagcctctacctgagggctatgtattcacatgccaatgatctcccgcagcccctatgtctactggagtctggccagtacagcctctgttcccagagcctgccgtccccacccgctctggtgtctgcttctgtctacccccgtctctgctcacctctccagagaagggccagggtacgtgagagtcagaggagccaccagggtggctataaccgacccttccctatttacatgccttgagaaagcctgactgtaccagactggtgccttaatcattttgagaagaggcacattctcctgtaaaattaagccataaaagttccctttgtacttttattcttgttcaaagttaagccattttccactaaagataaaaacaaggcatttctgagcagggagaactgtggctgtctaataagctgggattgatggtcctgataaagctgactgcatcgatccctgcacacagaggtggtatggggacaggagcctcccaccagagctccccaggacggttttgagctgttcatgaggcaagtttatgtcaagagctttagtgatgccattacctgcgagaggcagagaggcagtaccagactaagagaggccaagtcaggcacctgggaactgggtatcagccagggcagcagccagacccctccacagtggagggatggattcttcctgtgactcaggcaaatctatgagctcccagtgcatcaaagcatgactcgtggaggctgattgaccccttccagtgtgaagatcaaagtagaatgtgagctgggggctgctggccagtgtgtatggggaactgggtctaactacgcctgggttctgggagtgcaggagggacccacctagaccaagcagagagaagataacacgcccctgaatacccacttccctgagtgtccccagcccctcctttctcctagatagcgtcgagggtctcccctatactgcggtcagcacacgatggttcagctgtactgttgacctcctaaggatggcaccctgggatcagcagtgtcttcttatcccttcacggccatctgtgtcctcaccctggcctccaccctcccacctgcacccacaggacttgtttgatcctcctctgacttcacttggttacacttctggcttcttccagaacttttcagattagacaggttcccagcctgccagcattcagtctgctggacttaatgagacccaaggatgagagcagtgtgggggttctcactgggcacgcatgcaatcaagacttccactcctggtggctggcatctctatctctgtaacctctggagctcagagactgcaccgtgcttgctacccctactgcccagggactccatacagaatatcttaagtaacaacattaataatttccacctactgagt

SEQ ID NO: 42942 - DNA, 2290 bp, Bovine  19866880522721
tccttcctatgtgccgagtacagtcctctatctgaacatccccatggaaatctagcagtgatttaataacacgtcataaggctaattccatagcaaataggattaaaatgctatgttgctggctccaagtgctgtcctctttctagtaccctaggctcctgccaggaggtgtgccaactgcctcctgccctttcctcactcctaatgggctgcctgtctggcaagacccaagattggacaccaagggacacgcagggctcagcccacctgggtctgtcccagagcctgggcatgggcaggctgggaagatgggaggcggggcagttggaaatcaagtcctagggaagtgctgtggttggaagtgggtgaatgcggcccacttaggccactgtctgggaggaggggaggtgtcatactgtgttgcctgagcagctatggaaaacacgatgaacgtgctgccctgttctgctgctgtggggtcatatgcggttatgaagatgcaggggaattggatgttcagccaggcccagggacacccagcaacaaattgatgccagccacttacacagctcttggtcatccacttcctggaaagatggagttctaggcaaggagtgggtctcaagctataatctttgtatatggagctttctctggggattggggaggactgatggagaacactggggaagaaggaagaccctgaacagatgagaaagaatggggcttctgaggtcattagacctggcttgaactgaacgccaactcataacttcagggtgttggacaaactgatcaaacttcagagctggattttcccaagggcctgttgtgaagattaaatgcaccgtgtgtgaagcaggtgaccctcttcatgttgctgggcataataaatactgttttcacctccgtttttctccacaaagctgagctgtgttggccatcctggggaattccaaggaagacccggggaggggaccggcccctcctgcctctctctagggtcagctcaccctggaagggtgaacgtcgtcatcatgctaacagtgcattttctccctcacagaggagctgaaggagaagctgacagagtacgtggacaaggtgaacggccagaagccaggcttcatcaaggtcgtgcggcacagcaagcaggaaggcctcatccgctccagggtcagcggctggagggccgccactgcccctgtagtggctctctttgatgcccacgtggagttcaatgtgggctggtaagtgcccgttgggagctgaggaagttgagtcccagtgtggtccagggtgcaaagcccactgggatctctgtcatgatggggaaaggagtcagcatctgggtgtgcaggtgcccaggcaccatgctggcccttcagggtgggaaagggtcagggatcaacaggtcaaaacacagtgtctcaagggttggtggcataagggccgacgtggtcctctaggagacatgatgggggagaagagtaaatgcctggggcagagcgagagttccagcccaaccaaggaccaggctgcaacccccgggaaaggggagctggaccagacatgaattgaagcccagcccacagacagggccaagaccaagagagcaaagggagctaagtaccctgggctccctccagattccagatcagaggtagcagaaaatctcagattcattccactggtaaaactaggtcttagagcacctttctttctctggccagggctgctcaggtgctgagtggggcaaagcctcagtggcttcagccaagaagagacaaggtacctgatgctgacatccctgcaggccaaagggcatgctgtgtggtccactgggtgtggctctgcagagagcctgggggtgggggggcctgggtgctggggatggccaagtgtaccgccctcttagccactatgcctggtagcattggggtctgctgtccctcttgaactctgagcaccaccctctgcctccccagagtagagtgaggagggtcctttggcaggagggaacagcaggcatgcacacagcatactttgacataacaggtccgaattaaggctgcaacgcagtcattttttatagctgaagtccctgcttgccatttgtgactgtttaaaaagcattttcattggatttatggccaggagaagagagggacacttactatttcaagcagatttgaataaacaattatgcaacaaatgcattattaatgagaagcttatcattcctgtctgcaaacattttgctcgcctggtacccaggggggctcgggct

SEQ ID NO: 42943 - DNA, 958 bp, Bovine  19866880626084
ttggtgtgtctcatcctgaatttgcaggaaccacagtgtgggcattgagtcaacaacctcctgcagtatttccgtgagctgactttcttaaaagttgaagggtgctgcctttcttccccaattaaagaaccagactatcccaatgatggggatcacatttgtgaacatggtgagtttgttttgtcattttctcatccaaaaataaaagtcatcttaaaatgccaatgaagtagcacacacaattattacagaaggtctgcttaaactttaaaagtaattgacttgaaaaagaaagtatctctttttagtcttttctacttctacactttccataacctttactcttttttgctgtaaaaagaatcaattttctttttttggccgcaccaggtcttagctgcagtgtgcaggctcttagctgtatcacatggcatctagtttcctgaccagggattgaacctgggccccctgcattgggagtgtggtgttttaaccattggactcccaggggagtccttgaaattttggaaaaatacaaaacaccataaagaaaaaagataaaagaagtcagtaatctcattgcccaggaaaaataaccaaaacctttttctatgtactccatacgtatttctttcattttatgtatttctttcacttttatgtatttctttcaccagagagaaatatatttatttatattggtatatgtatattcatagatacatgtattacataaatatatgatatatatatatatcataagaggggggaaatacatatacaaagaatgtttttaccaagttgggaatgtgccgggtacatttttaagcctgccttttttacttagcactgtatcataagcagtttccaagggctgaagtttttcttccaaattgcctgaagagctggctcatcaacaaactgataaatttacaagctgatgtcaaacataactaat

SEQ ID NO: 42944 - DNA, 1270 bp, Bovine  19866880632413
attgccatgatcttaaatttccgccagagcatttcagttgacacctgtactccctgcattgtgattcttgcaaaagacttaattatcttgaggtgccccccaaccgtaaactaaggatggagccaagaatcacctacttctgattccactatggcttttctctacataaaaaaaaagaaaagaaaagaaaacttagcacagaacctgtatttcactctcagaggcattttcaaatcaaaagtcacttactggtctgctgctgggtgggtaggatttctctctacacctgtagataatttgttgaccttgaaattctccagtgtgatgcagtcaaatcattccagtaccataaagggacaataattattattcccaggtggctttgcaattaatggatttttactaagtaaatgtccacatgagtttcattcaatggaactgcaaacagaaaccaatgagcactgtctccactacggtggttcaccaatgagaggtaccagactgtgagcaatgaaatatttaaaccccttcaagattagataggtagatagatatatatatatttttttcatctcaagtctaaatgtatttataaaaccatattttaattttctttgtgttgctttctcaaacagatctttctgagcttaagaaattcctccctccacccctagtcttgcatgaccccatcaagcaggcatctgcaataggctaattcctactgcttgatagacactaattattatctatttgtttgaactgtgaaaggtaaaaagcctggcaaagtcaggcccccctggtcaaagacagactgaaggctccctatagtcaccactgcccaaaacactgacatctctagtgcaaggcaggctggtggctgagtatttcttggactctttctacctgccggacactgtgctaagcactttacctgggctgtctcatttaatcctcatgacaacccccatcaggtagatcctatgattgctgctgctgctgctgctaaatcacttcagtcatgtccgactctgtgtgaccccctagatggcagcccaccaggctcccccgtccctgggattctccaggcaagaacactggagtgggttgccatttccttctccaatgcaggaaagtgaaaagtgaaagtgaagtcgctcagtcgtatccgactcccagcgatgccatggactgcagcccaccaggctcctccatccatgggattttccaggcaagagtactggagtggggtccattgccgtctccgaagagt

SEQ ID NO: 42945 - DNA, 1457 bp, Bovine  19866880646068
agttcctgcataagatcaaaccagatatcagcaagatcaggaaatggagatcttccccagagtcaagattctctgggaagacaagagttctaagtcatcatcatgtcctgtgtagagtccgccacccatgcctgcaggcaccaaagagtaatatcgaaatgagtgtgtgactctccacgtctaaatgaatgtgttgagatcactagagtgaaaaactgcttaaattagtaactgcgtcagttattattttcatcaaagctctctcctcagtcttatgataattatcattgtcactccatctccacccactcaattttgcaattcattatgtgccaggctagatgttacatgcatcatgtatgccatcttatttcatcctgaaaacaccttatcattttatagatgtggaaacatctataaaggatcagaagttggtttgttctgctcaagatcacacagccaataattgatggggttagaatccaaacccagattctgtgtggtacaaatcctcttctcactacagtatgtcgccttctttccctctgactacagaaattgcattgagagatggagtagaagtagagatggtagtcattttttaagttttcaggcagaaggaactcctcctaatggcatttccataattagaatgcatttttttctgatagttataattcaggcaattgcagtgacattcagctgaaacctggcatgcaagatgttcatttctcttaaaagttcacttttaattggcctcagttctttccaactctggaagaaatacagaatgtatacttctgacgtttccaacattgaaggctgtttgacataaggactcaatccctgaagtttatgctgaattccctagtaagagagggagaacttgatgaaaggcagacaaagaggaaaggaggaagggagaagaggaggtgcttggtcagagcacactatccccaaagcgattctagaatctggaatacattctttaaactatgtggagtaggaaaataccctgcaaaggagaccgcactctctcactccccacagacctctagggatgtgtgggctgcagcgagaatgaccctagtttaacagtttgaacagtccgtactgggtcttcttccaccatgataaagtatgtaccttcaagagaagctgagctgtgttcagtcaagtgagagaagaattaaataagactcttctagaattctcagtgcttttctgagattaaggaatagcccacattccaaagagctctgctgctactgctgagtcgcttcggtcgtgtcggactgtgtgcgaccccatggactgcagcctaccaggcttctccgtccatgggactctccaggcaagaacactggagtgggttgccatttccttctccaatgcatgaaagtggaaagtgaaagtgaagtcgctcagtcgtgtctgactcttagcgaccccataga

SEQ ID NO: 42946 - DNA, 1520 bp, Bovine  19866880695588
tcgtgaccctacatgaaatatttaaccactcagagtctcaaattcttgatctatgaaatgggataataatctctcctgatatggtcattgtgaaacttaaatgagtttcacaatgtggattcttggtgtggcagagcaggtgcctgcatagagtagctgaatatgtcactggatgttaatgcctcctcctgcccacgctggcctgtcctctaactgcatctggctaaagcagcatcttgtagttcatgtctttggagaaaaccattggaatcatatgatgtgccatcatttagatttttctcttagttattccaaacccaagccatgaaaccagagtgaggctttacctggaacccacagcctggtgagcagcaacctggccaaagaccccagaatcactgccctggccccaggttacatgcagtcacggcaggaggagtgtggtgttagagaagggcagcatgtacttacctacccaggctctcatacatgccaggtatcctggccttccagaaagaaagagaaaacagatagccagatggttcaaaagaaaagcctgaagtcctgactatctcttctttccgggtgatactgggttagttgctgcacatgctctgaaccatagtgcccacttctgtgaaatggaggtcaggtcactcctcccagtgttattctcagtaaactgatattgttttcaatatttgagactgatattacatttccattatgctggtaacttattttctctaggatatttgatgacttacacaaggacccttaattccctgcgagattcatcttcccgtcttcttttctttctctttccattcctttcctcccttccatcatctcatagcatctgctatttgccggacacattgtgctggctgctaggaaggacgtgaggaactcgtgatctcatagaagataacacagggcatgagttccaaagggtgagaagtacattcaactttcgcctgagaaaatttgaggttatcttaccaaatgagacttggattctggaaagagaagagactgggcccagggtctgccatctctcatctagcctcttcatctacccctgcttaggctggagaggcgagagggatggtcttgcctcagatgatcaggaaaagctttagtggagtaagtccttgaactgggccttgaaggctgttgagaattttggaaggcaaagctgtgggatagagagggcatgcagacacagcttgagccagaggtgtggcagcctaaaagcagaggctgattcacgcctagcaaatggctctggagtagaggagcagtactttgacggtcccctccccacccccacacagactctgcatgactgttcagtgcctcacggatgcagtgaattggcttccaccctctaatgccctgccaggaattaattgtattcatgataatgagcttagaccctggacaccaggctggcttaaataaacctctcttaaatggggatttatgatgcgttttgtagaatagtagcagtaactcga

SEQ ID NO: 42947 - DNA, 793 bp, Bovine  19866880732148
agaggagtctggcaagctacagtcactggggtggcaaagagtcagacactactgagagtgcacacacacacacacacacagaataccttggcccctgcaaaagtccccactgaagccatttctaaatctcacctagataaggtgcctgtatgtgaaatccatgtcagacacgattctggaaaaccttagtcattgccctttcatgggtcttggcctcatttgccagaactgctttagaaaaatgttgaaagtggagaacaataactccctgttaacagacattactgttcaccagatttcagttcacacgtctgatgatgatctgcattgctgcacaaattttgacaaattttagagtcactgtagcagagtcaggactggacagggcctcatttgtcaggctaacatcaagcaaggaaaaatgaaggaggcagtagcagctgtagcagatgtccctcaggaaatcatttctattatgtagcaataataaaaatagctgtctttttacagaaacagactcacagcagagattgaacttttggttgccaggagggaagaatgaggggaagggttagttagaaagtttgggatcaatatttccacactgctatatttaaaatggataatcaacaagaacctattgtatagcatgtgaaactctgctcgatgttgtatggcagcctggatgggaggggagtttggggagaatggatacatgtatatgtatggctgagtccctttgctgtccacctgaagctatcacattgttaatcagcctatactccagtataaa

SEQ ID NO: 42948 - DNA, 1448 bp, Bovine  19866880807736
cctttgtccatgggattctccaggcaagaatactggagtgggttgtcatgccctcctccagggaatcttccagacccagggattgagtctgatcaagtctcttatgtctcctgcattggcaggcaggttctttaccactagcaccaaggcctggagtcctggctccatcacctccttgctgagtgactctggtgtgttccagtcagagggaagagcatatgcagaggcctgtgtaagtgtatgctagcatgtggggcagagtgaggggctggaagggtcttgaagaccataccaaggaatttggactttttctggaaggcaatcagctcccctgagtggattataggctggggaggatagaatctatgtgtatactgctccccctgggtactgtgtggaagatgagctagtggggagtgtatggatgcagggagacttgtgaggcccctaagcaccctggtagcaggggctagaggacttgcttggacacacaggatcctctgtgttatatggagaaactttatcttaactcctcctgcctttttagttgggtattggagaggagtttccctgtagcttgggatgtcagaggttgcctttcttttctttctttttttttttttctgtttttctttttgtggaatgggagcatgcctggcaactttgcagaggcctgagccctgggcacagcctgaagctgcatgagagccctgggccttcaggtggagcaggccctgctggagagagccaccccgagctccctgtcccccaggcctcattatctgcagttggctttgagtgctctttccatcacttattgtctggagccttgactgagcctaaaattacacaaagtaggccaggcgctcctctgtggctaccctccaccttcactccagccttcaggaaagattcatctcaaccagaactaggggaggctggggcacctggctcttgcccactgggaggcaaaggagcttacacataggtgctggttccagcagcagcggcagctactgtatattgtatactgactatgtgtcaggcacagggctaaatactttgttttctcatttaatcttcacaacagctctacggtgtaggtattgttattctcatctttcatattcatcagtttaaaagtagaggccaagcaacctttctgagaatgtctgatcaggctacttgcctcccagggacacatcggataaagacgacaagagcagataagagattcctcatccatctgtctatccatccatcacctactcagctacctatctgatctaaaatttcactcagtgcccactctgtgccaggccttccaggagtttataagacagagggataaagacctgggaagaaacccataacattcaggatatctactgcagtagataccatgaaccatttggggaacagatgtgtttacatggctagaggttgga

SEQ ID NO: 42949 - DNA, 1626 bp, Bovine  19866880817666
ttttttattttggcaatcatatatgctaatttcccaagagctctttcttaatctttgagtgttttctgtcttagtttcctgctgtttaatgtgcttgtttctttttttttttttttcccctgtatctgacagggtaataatttggagcaaatcttttcttcttctttgtattatctgttagataaagtgttttttccctgtgattgttttgatctttcacttctatgttagaggttgttctcaattatttttgatgagccttggctcttcatatttaacagtaagacacaaaagtgtgtgtgtgtgtgtgtgcgtgtgcgtgtgtgtatagcgtgtgggagtgggtggtggggttcacttaaaagatagttggacaagttgttggtcattttactggttctccccaaatgccagagaagagacctccaaaagccaaccagggaagtgcctgattaccggcattctgcctggagtccagatggggacaaaagaagacttggatctatcacttcattttacagactttcaattaatctttttgtcattaatcctgctttctacctcctaggtgcctctgaaacctgaacttctgttaattttgccaaagaagaaaactcatatcttctacctggcaaagaagtaagtgggttgggaaccaaatgccttgatctaggtgttctggttcccctgaattcttagtctttccagggttttatcgaacaaattgctctttttttttttatcccctcctctggttttcctttatcttactaagccagtaactattcctccaacaatttgtagtcttctaaaaatttattatgctctctcatatactgatgttccctttcccattccttttgtggccttaaagagttttcctttctatcacattattggggacacagaagaaataaacacatactagcaaacagccatttttgaccaaaattttagcttatgtaatttttattgatattgcaataatgaaaactttcttgtgtctatagcattttttttatccttttgcatttatggattagtatagaatcaaaggcataagtaagaaattagatttaaatagctagaaggacatttatcccacttttctgaagctgagaagagttgtagagagaatttgagcctattgggaagaaagaaagctctgtatcacatgttttcagctccttctttttctttgttgatgagctcaccagtaagaaacagaagtgtgaatgccttgactcttgaagtaagtaggagggtctagagcacttttctttgagaagtaaggagctttataagggtagttttgtcaaactcagttcttggcctggggcaggccagttggcagtccagaagacttaactctccaaggaaataaaaactctactaagaagcccaacgtgttagtcctgagggccagacatctttcagagattacacctgtgtacgccaaaagtctatcctcccagaccccatccccagtgggccatgtgtctgtggagatcccacagggtggagacagggcttgcagggctcattcagcaggaaggaactgctccacaagtgctctgtgtttggggtgggaccagctacctacacaagtcttctttcaatggagaa

SEQ ID NO: 42950 - DNA, 1859 bp, Bovine  19866880828235
ctgctacaagaaggaaagagtatcttgaagagtctatgtgaggggctagaggtccttgagagggtctttgtggcacaacctttgatattacccatcttttatattgggtaggcagcttccttctttatgtgattgagtagggggcaagtacaacccattccagtattcttgcctagaaattccatagacagaggagcctggtaaactacagtccatggggtcacaaagttgaacacgatggagtgactgagcacagcacaacacagcaagtaggacttcttacccccaagtacagccaatcttgttgtcgttgttcagtcactcctttgtgtccaactctttgcaaccccatggactgaggactccatgcttccctgtccatcaccaactcccggagcttactcaaactcatgtccattgagtcagtgatgtgatactatccagccatctcatcctctgtcatccccttttcctcccgccttcagtctttcccagcatcagggtcttttccagtgagtcagctcttcgaatcaggtgaccaaagtattggagccactctgccatccccccaatactaagcctacattcagaatgcttttgataccagggttggaaaaaccagtcattaatggatcttaattaccagttgatgaccttctgagaagggtatcctgacctgaggactaaagaggagcaggagaccaatctccattaatggcgagtcattcatcagagtgctgtcagtggtcatctatacccaccagatggcagcaccatgcaacaccttggtaccaaaggtgccaaatgggatttgggggctgcagggggaaaatgagcctggacagtggaaagtcaatttccaggcagggtacgtgggaagtgggttttccaggtccctgggagaatagggattactagggcttctggcagggagggatgcaaggttcagacacaaagactgtggagaaacaacagatccaagactggattctgccaaaccacaggactgagatgttattgacagaaaaggcactcttctggaggagggatggtgaacaaagagagaaatgtttgttcagtgcttacgttgtatccagtctagtatttttcacatgttgtctcttgagcaaagactaaggaatccagggagctggattcatattccaggcctggcacttactagtatgatcttgggcaaattacctaaactctctgttccttggttttttatctgtaaaatggggatgataataataatatctcctcctaatagggatgttgtgagcattagatgaactcataaagcacactgaaggcactatatgtgcctagtcactcagtcgtgtccgactctttgcgaccccatggactgttgcctgccaggcacctctgtccacagggattctccaggcaagaatactggattgggttgccatgcccttctccaggggatcgtcccaacccaggaatcaaacccaggtctcccacattgcaggcagattcattaccatctgagccaccagggaagcccaaaggcattatgtaagaattggctattgttatttttaccatctctgggcaccaaagtatttgaaagttcacccagaaggaactttcctctatctaggagcaaaaggtcctagaaaccagctcttggcttctcctctttcaccttgttgaaggacccaaagcaactcctagaggaatcacagtgtagcagatcccaactgaaatcctgcaactagagccatctaacgctctgtgtctacttattcacctacagagtatttttgagtgcctgctctgtgctagacccagtgcggctgctgctaacacagagatacttatagacatacacc

SEQ ID NO: 42951 - DNA, 2181 bp, Bovine  19866880867562
cagtaggtatagcaacaatctgtggtatttgagccacgacctactctccccttgaacacgaactcagtgagacagatctcttctctgtgcagatgtggataagaagacagggctccctttcccctccagcttctactctaaggctacagtttctccctaggagagtcaagccactgtattttttatcactcccaattttgtgttacagaagctttattgcatgcaagcctggccaagcagtctatgactttctgccatccagtccccatttgtagagagcaagttctatccttggccacgaatactgggccctaatcatccacaccctagtccacacatagggtgaagtttccatgccaggagaggcaatccaagatgagcagtggtgccatccaccctcggtacaccgctaagggagcagcgatgtcaccgagagaagtggactgccactcccactcttagctccagcgttgtggtacagagatcctacctggggggagaggtgggctgtaagagcacagagttctgtagctgtccagtttatttggaacaaagtgtgaggaatttcaagacaaaaagcatttggtgagtatttaagaggaggttagtagctccataatggcgatgagagagacagcagcccagctagacattttacagagagaaccagagaatgaattatctgagaagaaccctcttgggagggttctttccaaagcaagctttgaagacttggctccaagacagcccctgcataggagtctgaacttaagtggatcagactgtggagcaacttatgcctcaaagttctgttgaaaataatagagcaatcagatagtaattagtggaagctaacagcttggtgtaataccaatagggtagtccatccggaagcttaatagggagaaaagtaaaagagatagttaaaaagaaaaaaccaacctaagaaaacaactgtcatcccaagagattaaatagcgggactcacagggctaaggcgatgcactccaaggactcacatcatagactgcacactgtgcagctaaaagatgtgaactactccatttatgccactgaacaaataagcaaataagtaaacaaaaacgagtcctggaggggagggcagaggtaatcgtcagtgttcgaagaggctaacatgtattatctaaaatgtctggttttcaacaaaaatttataagacagcaaggacagaagaacatgtagcccataaagaggaaaaaagcagacaacagaaattatctttgagggtacctggatgttggaattaccagatgcagacttcaaagcagttattataaatttttccaaagaactaaagaaaacattgctgaaataattaaagtataatgacagcaggacttccttggtagctcagctggtaaagaatccacctgcaatgcaggggactccagtttgattcctgggtcaggaagatctgctggagaaggcataggatacccactccagtattcttaagctaccctcatagctcagatggtaaagaatccacctgcagtgcgggagatctgggtttgatccttgggttgggaagatcccctggagaagggcatggcaacccactccagtattcttgcctggagaatccctgtggatggaggagcctgggggctaccgttcattgtgttgcaaagattcggacacaagtgaacgactaagcacttgatgacggcatcttatcaatggggaatataaataaagagaaaaattatgaaaaagaacaaactggaaattttggatttgaaaatatgaaaagtgaaatgaaaagttcactagaaacatttaaaattagatttgagttgacaaaagaaagtatcagtattagcaaacttgaaaatagatcaatagagattatgaaatctgaagaaaagagaaaaaataatgaataaaaataggcagagccttggagaaatgtggaataccattaataaaaaaaaaaaacccaccaatggcatatttaatgatagaaaatgaaaaaattttgaaagcagtagcagaacagaactacttgtcacctataagagaaacccagtacaattaacaggtgatttctcattagaaacaatggttagaaaaatggtacagatgaacctatttccaggacaagagtagagacacagaagtagaaaatgggagatgtgg

SEQ ID NO: 42952 - DNA, 1217 bp, Bovine  19866880922829
aaaggaggatgcagatgcaacaaaattccagttgtgggattccatgctcatagtcaatatcagacagctggaaggcctcctaaaccagtgccagacccagcaccaggcctcgcggtaaagggcacaggtctctgggattctcctgtcctgaccgtgctcaggggagcattgtctccaaaacattttcagccagtccatatatccgaacacctttcattccttcaatgcaagcccacttctgatactcatcttgctagtaaacaggctatagttttcaccaagaagtcccatttgtggcatgcaaatatgcaaattttcagagtctcagctgtcgatggaaatacaaataatagaagtgttgacaacagttgcttgtaacacatgggctttctcttgggtgtgttgttagcagctgtccccaggtctgggggttcctgattagggcaacagttctgaaaactgaattctactctaagctgaagtattggaaagtaaattacacacatcataacaaggagccacaaacgggagaccttgtgaccctgccaatcactgagtttggagagagaaagtaatttactaaatcgtatctcatgtagagtcctgatcccttgctagagattcagtccctgactgagttcacaatcccagatacggaccccaacccccatcacttgctgaccactgaccctggcacagatggagccaccatgctctgcagagcctggacccccggcaagtctaacgccagccctggaggcgagctggcatggagtttagaacagcgtgtgattgtaactattcaggccacaggataagccttcaagcctgaaagtccctagtaaatttagcttggtttgaatattctgtcagttgctttcctgggagagatgtggattttcacctccttaggatacaaaccactaattcaggcctctgggagttatttcattgggggctttcacttcctataaatgtactgcctagatttttggcacatctggggactcagagtcagtttagcattttaaagaagctaaagaatatgtaaaacgtcctaataaaaatatagttagagcccaggcgggaggaatacttattatattaatgcattgggctcctattcccaaaggcaattttgcttatttaaaatctgtccccctcaccttccaatccttgttaactggtctcagggaatgacaatgtatttacatttt

SEQ ID NO: 42953 - DNA, 750 bp, Bovine  19866880985131
ctttctggacacacagttgcctgacaatcttctattcaagctattgcatcccaaacttcccacagcaatccaggggtgttctgactcaggttcaagtgtcatgaaaaggtcaacagactttctctgagaagcagcttccaccatccatgacctgcagagacagactccatcagcctccaggttaagacccacgttaggctcacttgtgctgaaatacatcagcaagatgcttggccgggaaaacagtcttaggtgcttcagggactctggtgatgggagagtgttggagaactgcaggggctgaaagagagcgagactgtatctgtgcataatcagactgcctccacaaatttatgtcttgggggagtggttttgctatgcttgtagcttttgctagatggtaacaaaacaggtaagccggaggtgttctgccactctgcacatcctacaaagactgacccaaagaacaaaggcctcactttacatttggctgttgggacaaggccaaatgatcaggaggtgtattgtcttataccatcaagaacatagtgaccttctggtcggcactggacaatgatcgggatggggaatctgctgctccaagctaccatgctaggtagcttgcttccttccctgaatcctgtccttttaagagtcagtcttttctgataggcctggagccagcaggctgcccttgaccttgttgtcagcagagaggaaatgctgaaagggtaggcctgactctcccag

SEQ ID NO: 42954 - DNA, 938 bp, Bovine  19866881033378
atgggcaacgttcatgaacagacaatttaccccccaaaatattgaatggttctgaagtttataagaagtcattcgactcataaaaagagaaatgcaatttaaaactacactgaaataccatttatcttctatcaaaatagcaaaaatttaaaacttggcaccacattgtactggcaaggctgaggagaaataaaccctttcatccactgctgataggaatgcaaaattgtgcagccttagggaggggaatttggcagtatttaacaaaactatatatgcatttacctttcgttccagaaatccacttctaggaatttactttaaaaatatacctgcaacaatacaaagtgatatatgcacaagtctattcactgcagtattatttgtaattgcaaaatgttggaaaccacttacatgttcatacacggaaggggagttgaataaactaaattgaattcatacggtggagtactgtgtgtgcagtggtaaaagacaatagacttgctctctatgaagtgatatggagtgagttccagaacatattttgtaagtaaaaaagcacacagcaaaaggctatatatagtattcttaattttgtgtgagaagaggaaataagaaattttcttgtgattgcttacttaattgcaaaaggaaattgagaaaagacaaaccagaaactaataagagctgtcacctacaggggtggatgggaaccacctggataagcgagtaatacttcagtgagagtaattttttacgtagttttggagtttggaatcatgttaatgttttaaacattaaaaaaaataagtccacctgtggtggattcattttgatatttggcaaaactaatacaattatgtaaagtttaaaaataaaataaaattaattaaaaaaaaaagtcaaatcatatgggatgtcagtttgaaaactctaaa

SEQ ID NO: 42955 - DNA, 2716 bp, Bovine  19866881068876
aacacaacattataaagcaactatactccaataagaaatttaaaaaaaaaaaacatttttctgccctgcctatagtttcgcacacacacctccttctgaccaacatccatccaaaaacacacgcacacacacaactaaggccgaactgaacgaaggatgaccacctgactccaaattagccagtgtgttgaaagctaaaaaagtgaaaatgttagttgttcagtcatattctactctttgtgaccccatggactgtagcctgccaggctcctctgcccatggaattttccaggcaagactactggagtgggtagccattcccttctccaggggatcttcccaacccagggatcaaaaaccaggtctcctgcattacagccagattctttacagtctgagccactagttgcctagaaatctgactttgtgtgaccttgcaccaagagaagagcgaggctgaacagattctatcttgagaacttaatatgagacataagattgctgacagttggtggtgaaaaagtcttgtaaactgaaaataatggcaaacgtttgcaagttgatgagtaaaaggcggaagctgttctgcagagaaaggaaaatggagctgacaagaaggaaagagcagagaagagcccgtggcccaagagagagaaatagaaccagtagccagctgcttctgttcctctccatctcccctgatgctcgactgcacttgatttcatgtcctttgattctgtgagagctctgcttccttgcaataaacactattctttacttgagtaactctgagttttgttttcttgcaacccaaggaactataacttgaacaatttcatgtctttttaattgcctcccaacattgcatggtaacttctttaatgttaatcagtgtcttttatttcatctgtataacacagcttatagtcacatgacttgaattatataaatgctgataaggttcacaatgaattaattcattaatctggttactgacacctctaccaccatcagaatcatgaattgcttgttttgtctgctctatcgagtcctttgtgaatctttttttttttttttccctctactccctttggctctagtgggactaagaatctcaggcttccaaccccctcccactgaagcaggcatatggctctcggtgtaggtcagtcgggctctcatttggaatctcagtcatccgatagtagtttcctaaagaaatgttgatcacttgagaaccccggagctcccttgacaactggcctttcgggcgtctgattgttcagctttttcttcagtcctagggctgttcactatccttccaaccccccccttttctagtttaagtagtcagagtccatttctactgcgttcagcctgattcctctctgatacaggctggttcccaaagaggtcagtttcttccctggctatatagaataactggaagaaattcttctttttggaaagagcagctaattttgaagcacgctatctttgaaacaaataaaatatttctttattgatcagttgccccactgctgtcttcttttatatatcaccaactcagcctctgggttgccttttctgcaagaggcatcattagttttgcctcagttgtttatactcaacctcatcctcatcttctaaagctgtctatgagtgaatgagtcatgaacgtgaccctttagaggtgtcatatgcatttgggaaaccaggcaacagaggctaacttcacttagccaagttagcactttttctacagcaatataaagcagagttcattctttgggtctgaaggatctgtaatcaaccaagaaggcatctcccaggcttgaatctggtgtcccagtttccgatgatgaacccactgtggccctttgaaccaacatccctccttaaagagaagcaacacttagggtgttggctctgattcttccaagacctcaagttccaaggcagtttgtctcctctcaacactctgactcattatcctattttactgaagtacttagaatgagagctctggagaagtgctctgtgcaattacataaatgaatagacacatttatttgaaacattttcagatttcctagaaagaaattttatggtctttccctgacactaatttctgaaactgggtaacagtcctgggggtctccttgccctgcccagggacttgcatttccaaggcaatataaaaccctgtcattagctgttcattcattttgcaagccattgttgagcatccactgcatgccaggcactgtactgtgagtggggtatatgatggagaagaaaacaaacacaaccctgccttcaagagaacacagtccagtggaggagagagggaaaaaatcatacacgagtaattgcatgtgtacgtgtgtgtgtgttgctcagttgcttcagtcgtgtccaactctacaacactatggactgttgcctaacagacttctctgtccatgggattctccaggcaagaacactggagtgggttgccatgccctcctccagagaatcttcccaacccagggactgaacccatgtctcttgcatctcctgcattgcaggcagattctttacccactgagccacctgagaaatatcaatagcattagaagggaatattagatggcagagggcagaagagtctccctgaaacctgaagaataagaagtgaggagaactagaattaagtagacggagtagcata

SEQ ID NO: 42956 - DNA, 2280 bp, Bovine  19866881114369
ataacgtacagcaaaatctagaataatgtacagcacttcaaaagtgcttaatatataattgctgaatgaatgaataaagaacgggatggattgatgtaaagccctgagcacagtgcccattatatagtgagtgaagggaagcacccacagaaccacagcctttctgccttggccactggaaccagtgtgcttggctgacctggaccgctgctggctgatcatactttccagtctttgcacatctcttctgaacttaaagtcagtatcatcaggtgagtagcctgaaaccagctatgatgggagagtatttaaactacagacattggaagatgttataaatcaggttttcgtttgttgagagggagagaaaaagaaaaacagagagagagatggagagttacacattgactggcacccaacacacatccttgactgtccaagggaccatttatacatcatccacctcaatcatctttagaaaccagttctgaccattttgttgcaagatccaggatctttgggaaaataagtcatttaggagcagataagagactgttaatggatgctaagagccttgggtttggagacctcactaagtgaggagtacatatttcatgtgggttttggtgatcactcatgcctggctatgatacaaaagagtagacctggaaacaaatggctgggtctattaataggtggtaattctgggacttggaatagctgaattaaagcctggaaactcggaagattgtgacaatctgcctggaccctgtgaccatattttatatgctgtctgtgtggctcctaggtggagcctttctctaagtcctgagtaaggagaaccattaaaggtcattccagagctacttcagtatcaattgactttgaataagtgaagctattaaaggagtatatgggagagaagagggaatggcatggaaggcatttgtaaactgcccagggtttgaaagcctgtccagagtgatcttaaagaaagagcaactcacaaaaaaggctgctcttgggctggagtctcaggctggtctattcttctagggttgaaactgctcaagcccagctcaccatcattaatctcaggaccgtatgagtccacagtctccctctatattctttaggggtggcgggggaggggggtgggctggcattttcttttattttttagatcccccaatgagtggatgagcagctaggtacgacaaccattgcatccaaatgaataatttctcttttaaagggttttgacacatcattggtgtttcaatggccctaaatggctttagaggaaagccagttaatcttctgatctgaggaagatcagctactgttcacttttggaggaataaacagaaatgtgctgtgcttttaatcttcagattagcatcattggcaactagcaattattagcacttgtcagtggggtgttcaccacccctcccaggcacctggagggagggggtggcaactctaatctaggctgggctttggaggacattactgagctagtggcaggactgggtggcatgaaagggtgcagatggggagagggggcaaacaagagtgtgccttgtgcagagggcagcaggggacctacagaggactgtccaaagcatttgatccaaagatgactacgcagagaaaacaactgccaagtgaaaggcctgccgtcggaagcagccaggtggagcccatgggtttgggagaatgaaaaggacaactaactatccagccaggtcataggggagactctttcagactctgaccctctattgtgggctgaaaccacacataattctagaggaggctcctttcccacctgttatagccaatcttcatttatttcagttgttaccaatcttggctgcccgtcagaatctcatagggagtttatacctgttgctgagccctttttataggagcagctcctacttggttccgttgctgccaagcaagattgccttgcagaccaaagaaatacagatgtaggaccagagctgccagtttgaaaactcatgcacgctcggatttccagaatgggacctccgttcattaagagccctgcagggtttctcaaactcagcactgctgacactgtgaactggaaaacttttgattgtggagggctgttctgtgcattgtaggatgttcagtggcatgcatgcctgtagcaccctctccagatgtgaccatcaaaactgtctgcagacactgccaaataccccctcaaggggtagaatgggcaaaaaaccacgggctccgaaa

SEQ ID NO: 42957 - DNA, 1523 bp, Bovine  19866881155921
ctttgatcactaagaagagctatgtaagctagcttcagtttaggtgggtaaggataccataagctctcttacaggcccaggaactgaagtacagctggacccaggcactcgtgctgggaagccacgaaaaccacagtgggggcaggatcatctcttgtctctaaatccgtctgcctcctgcttcatccccacttcatcacagctggatttctctgcttgcacaagcccaacagatctccatgcccgatctaaacggccccacaatctgagaggccagcacccactgagcacactgtttggtctctcatcaggactcctagggcagaataagaggatgatgagattgtcacattccagaaagagaaggatggggagagaggaggaaagaaagagaattgtccattcattctaaactaagagttggtgcctgccctggtctcctcagctgtggcgtgtaagcagggccacgtgaaccacaagctgccctttccaagggctgagagtgggctaagccagaaggggacgttgacgatcagctttcctacccagatatgctaagatattggttcataggacttttgtactgttgactggcatgtgtttgtaggtgaggataagagacacctctcccctctcctattccctctctggtccccttctctcttattcacccaccagaccttccttccactctagggaaacttcatcagctgggtccccactggggcctggccagccaccactggatctggaggagacagagaaggcctgatcccaggggacatcccaggcccccaaacagctgacatgttcctcacctcccccaaccctcaagaacaaagtcttctatccagggacttctgttggccattatgccacccttgtgcaaaaggagaggatgagaagtgtagtaccatcttgtgtgtgtatgccatatttttacctagaccctctcagctcccaaaatccagcttgctgtttaacagcgtccaaaatcttgtccttctgaggaggctgctctgccttcagcacctttaatgcaaggccaacgctgttggtttcttggtattagttggtacttgttgatttctgtagtattcagggttgacgaaagcagagttgactatggaagcagagcctgtctcagtggaatgattgtttctcctgatttaatgcttttatttctctgcctctcctatggtgttcagttgcagaactccctgaagagtgatttgtgtcttgatcagggtccagagacagaaaatgttcctattgtgtacatctgccacgggatgacaccccaggtgagtgttctcacatccccgtgccgggtgtgtgcatgtgtgtgtctggtgggaaaagagaagctcaactctgtcgtggctactctgggcccatggaccttgggggcttttcattagaaagtatcctcatgagaagaaaagacagtcatacttatatgtctggaaggagtctaaaggagcagaggctgggatgccaggatcccctgggggggcacaagg

SEQ ID NO: 42958 - DNA, 2466 bp, Bovine  19866881300916
ttttagaacacattctggctcttaaactcctacctcttagctatcacctctaattttcacttcctcccagccctaatcaacactaatctatttttgtctctatggactgccaattttggacatttcatgtaaacagaatcatataatatgtggctttttatctggcttctttgatttagtataaatgtcatccatgctatactataaattggtacttaattgctgtttattgatgaagaatattccactgcatggataaaccacattttatttttccattcagttgatgggcatttgagttgtttccattttttggctattatgaataatgccacaaaaaaaactattagaaataataaccaaatatagtaaagttgaatggtacaaaatcaatatataaaagtctgttgtgtttctatacaccaagaataagtcagcataaagaaaacataagaaaacaatctcatttaccatcacaacaaaaaagaataaaatgcttaggaataaatttaaccaaggagataaaagacttgtatactgaaactatgagatattgctgaaagattaaagaagacacaaaaaaactggaaagttattccattctcatggactggaagaattaacattgttaaaacatccatcttacctaaagtgaaagtgttagtcattcagttgtgcccaactcttttcaaccccatatactatagcccgccaggctcctctgtctatggaattctccaggtaagaaatattgtagcaggtagccattcccttctccagggatcaaactcaggtctcctgcactgcaggcagattctttaccatctgagccaccaggggagcccatgaacactcctagctcctcccttggcttttaaggtaaagtcaaacctcctgggcttaattttcaatgaccattacctgcctccaaactgactctgtgtcccatctctctcataccccaattctaaattccacccacagcgacactgaatttttattcctcagacataccctgcctttttctgcctttgcccatgctgagcctctacataggctgttcttcctttctacacctgggaagtatcctgcaactttcaagatccagatcaaacatgtctcgaatgtgaagccttgcctgagctgtgcagacagagcccgtcaccctgggcttccagaacactgtatccatccccctcatttctgctcttgccatccagttttgttatgtgtttatacacccaagagctcctccagggcagaggccgtgtctgattcatatctgcatccctcctgcccaaccactgtgctcaataaatgtttgatgaatgactgaaggaaagaatgttcatcattggaaaattgctcatcagagccctgtacatcagcgttgctgagagatgttttcatcaaatgtggtttctcagtgtcagtatctaatgctgttttgattcatcctgaagcactggaaattcagaagagcgtgcaggggttagaggacaggcattttatttgttaaacagaaaagcaggctatgagatggagcactaagatatgcaaatactatcttctttgtaggagaaactgggagaatcacactagattattttggaattaattcagcctaaatgtctgtggagtttaaatgcagccctcaggagagtaaataatgcagaatgtgaaagtgagaagaagatttgaaatgcaccagtaaaatctttcagcccaacttctgcaccagaacattttagttggtagaatcccattgtaatttgcaaagattaaaacctgttgcaagaaaattagcccaggtcataactttaatcatttaagaggcttccagcttcctctggcctcatcaacagtagttcctaaacagtaagggcttgaggacagattccaggatgcttgataaacattgatcattttgcatgaaacaaaaatttcacaaacattaatttttaaatatcaagtgagagtggctgctctgggtttgcaaattagggatttaaaaatattatttccaaacagtttccttggtagaaggatcaaagaggtgatgccagagtgccctggggttctaattagatttatgtataaggagcaaaaaactgcccggtcctcagggctgcacatgctaacatggcctgcttttgtcagagtgtccctttcaagcatgagtgtgtggggctgcctgttcagggctgtgtatatgctgagatgagtgaaggatggagctggattttggaggaatattcctctctctgcccaagtcagaaaagggcagatgagatgagggccagctggggcaccaaggcctctggatctgggcatgggtgggaaggccatctgtctgcgagggctggaaaggagctggacatgcctgtgtgcagagatgggatgtcaaagcagtccaagttcagattcaaactgcatgaggctaggcacagagaggccgaagcccca

SEQ ID NO: 42959 - DNA, 850 bp, Bovine  19866881314070
cccagggcagctgctaggttcgtgcatttacgtatcacgctcactctctcctcaggactttttttctttcttaattaatttttattggagtatagttgatttacaatgttgtgttagtttctgctgtacagcaaagagagtcagttctacacatacatatgtacactctgttttagagtcttttcccatataggccattacagagtatagagtagagttccctgtgctatacagttcctcaggactttcctgcacaactctctgattttttgctcaactgaaagttcaatgatgacagatgctgtatctgctttgttcgcaatctttattcccggggactagcaaagtgtttactatacagttagtgcccaatacatgtttatggaacgaattcatgagtcaacacatcaatggaaacaaaacagtttcaaagaactttccacccaaccatggtgagcacctgtgaaacattctgacctacaacaggaaggcttctctagatcaagaggctctgtctgcctgattttcaggccctcttccctagatgatggtgggcactgagtaacaaacctagtcataaggggctccaccctgaaagttcatcgcagaccagctttctctattagcaaggctccttcaagcatcgagttgccgttagattccagctgcagccaaggtaatgcacataaagaaatgagattttccagcctggctgaggcctgatagacttggtactctgaaactcctttttactgcctgccttttactaactgcccattttatgaactctcaggacatttctagagagcacagctctcattccatgatattttcattcttcttaatttca

SEQ ID NO: 42960 - DNA, 1187 bp, Bovine  19866881327789
ccttctgcttgggtgatgatggggtgagggccattgctaggtggatagagaagaagctggttttagaagaaagagggattccatgctgggaaaactgatcttaaggtgcctctgggtcaccagggggagatatccaacaggcagggcctgggtggctggtctgggttggaattcagcagtggtcttaggctggagcaacgtgccacacagctggaggggccaggaactgaaaggcctttcctagtaagcatgattgcggggctcatggctgtgtgcagacacccagctcagactgtcacgaggaaatttacattaggtgaatcagcaagagaccgagtgggttgcttctctgctgagagcatcatcttacacaaataacattaaattgttccattgcacactgctaccacgtctagcccctgtgcagcatcttatcagctggtggctgagaaactggaggagaagagaaagaaaaggagaaatgaagaatactcagtgatgagaaaactgtcactcaagtgcaaatggactcatctttgaaattggaaactcatcaaggtggagaaacagctattttgcaggccatttctttggagaatgctgatgcaggagactgcttaggtagagactggtgctttggggtccctacccctcctgctttcaaattcagtcagtcagttcatttgctcagtcgtgtccaactctttgcgatcccatggactgcagcgtgcctggcctccctgtccatcaccaactcctggagtttactcaaactcatgtccattgagtcagtgataccatccaaccatctcatcctctgtcgtccccttctcaaattgcagccttttattctgaaaggactcagcttccgcatgaaggcatccagggcagtcagtacaacccaatccattgctcctttaggctgagttctggtggggggtacttgacctgcccttagaggcgactgctaggggaaaggttccccattctggctgtgcatctctgaaagaagttccctagcctccctgaacctctgattccatatctatcaaatagaatcaactataacctcacaaggattaaattaaataatataaagcacttgaaaacctctcgtacataactggaactcaaaagatcatttttaaaagatgcacttgtacactaagaagcccagagaatcctct

SEQ ID NO: 42961 - DNA, 1995 bp, Bovine  19866881390878
tttccctgcacgccctgggcttcacatccagaacctgctttgggtcccgtccttgccttggtttggcaaccttgttgagttcttggtctacccaccacagttctttgtaaactctgggccctgctctggcatcactggtacctttagacttagatgatgagacccttaggagagaccctccctcctgtttcctacagccttttctgatgctgtgaaatcccagctccttcattcccatgccttggcctaaccaccaaaggggcaatgcctaaaaatgactagtgcttctcctgtggtaccttttactgaacatttaggatctcttgcatatctggaatttgaaattagccagattcctaggattccaaaaagcttaaagatcaagcgttaaacctctcaaattgtggttctgtaactacctgcatcagagttaccttattaacaatatggattctaagccatcatcccagacctactgaattgaagtagattattagattaggcgcaacaaaaattttaaattactgattgaatttaatctctcagattccagttggtatcccatctaagctattttaagcatcaaagaacccatctggcctagctgaacttgaaagagggaggttccataagacatcagactgtgaaagaaacagtggtgctacatgtatccactattttcacaaaaaccatcaatatatttactgggaaaccactttgcatagaactctttccaggcacagtaggggtactagctgactaaaacactcacacaagcagtggctctaaagtgaggacacattttcacttgtgtctaaggtaaatagagacagtcgggtacagcttgcaacaagtctcaccttgtcagagtgcagctgccaactttggcaggtaagtctgttctgatggctgtggtaagtgaacgtccgtgtggtgaagaaaaagtgggtcaccattttgagattccaaaattggcatacaattttatgtgaaagtaaatctctgtaggggtgggcagtacccataaaattaagagaagttcatggaaattaagtaaaattgaaatatgtaaagaggatagggaagatagccagagtattggaagaatctgtgtagactcagagatttctgattgtaagggtcctcagaaatgaaattttcaattttgtttttagcctttggacccatttgtcaaacaaaatcttaagtagaatttatgtatgagagtgtgtgtgtgtgtgtgtattagtcagcataggctaggttacgtgcagtgaaaatcagcctcctaagtttatcagctgttatgaaaaggcttttcttgttcatgctgtatgtctgacatagatgggcttgggctcaggtcataattccactccaggacaccagaggatgaagcagccaccatcccagtattgctggttgccatagcagaagaaaagagacaactttgaagagtattgcattggtaattaaatgctctgatatgacagtgacccacaaaactttttaggtcacatggatcaaaaccagccgtgtgatcctactcagccacaaagaggcccacaagtgagatactgccatatgcccagaaggcattttctagtaaaattgtttggtggaaaccaccactgattatcacagtgagtgtgtgtgtgtgagtgtgtgtgtgtgtgtgagctctccctcatctccagtgttatctctagttacctccaaagaacgcctagattccatgaaaagtcatttgaaaactatttgagtcagatcccttattttataaatgaggaaattgaggttaagttgcttaattaaggtcaagtaacatcaaaacctggtccagagtgcagatttggctctcagttgaagactatttctatttaagatctaaagatcgtttatgtgtgtgtgtgtgtttgtgtgtgtgtgtgtgtgtgtgtgtgtgtgtgtctgagagagagagaggtgactcaagagttaaatgtagataaagat

SEQ ID NO: 42962 - DNA, 1105 bp, Bovine  19866881398345
tggtcctccctttacagggtgaggcccttccttgcatcccagatcacacttctgtcaactgccaaggggtcgaatgtgtctctcagtcatggggaaggcttccttttggagttaccttttcacaggcccagagaaaggggtcagtgccttggaaacattcctatatgatgagaaaataaatgctgcctagtgtggactcacaccacacattgagagctgcaaagggccctgtactttggggtaggatggtggatatctctggagagtgatgtgaggcatgtacgtgcctgagggtctgaaccacgttgggggtcaggaacctgcatggcgtgagcctggctgtgctctgctgtttatactccgcgagtttatttctctgtggcactctcttgacaaagtctttaggaaggttctgtgggccactgtggaggagatggagaataacagaaaccccgaggggaggtaacagtgaagagaagcggctctgagggtccctcttattcacctccctgttcctggagctcccttttgctcactccctgtgaaacctgcatttggtttcaaaacaggggtttatttccttgatttgggagatcaactctctcatgtttccacctcagcaaaaacagtttctgatgttcttttcttcctgaaaattctagaggccccaacctgtgtttctatcccatccctagcagccctgatcacatatgcatgggcctagcggccctgatcacatatgcatgggccaaggttagggacttggacgttcagtatcagtccgccaccgtcaagcctaaaccaaatttctgcaccccctggactcattcacccactggggagctgagcgaagccttcctggtgagaaaccctgctcaccctgatcccgagctcgacattttcgcctccgtagacctccatgccttcatccagcaggccgatctcctggaagtactggcggtccacgatgaagcagccgatgagggcagggctcctgcagggcatggagagatggagggcagttagcagaggggccgtctcatggggggtcaacagaacaggaagcacagtgctgccttcctgccaggagggtctggccttctcc

SEQ ID NO: 42963 - DNA, 729 bp, Bovine  19866881777101
cacacacacacacacacacacacagaatctgtgaatgaaaatctcttaaaatctgtgggcaaactagaaatgtcaaagtaaggtatggtctgcatccctctgggaacattatgaatcaccctggggcaaacactgtacttctactgctgactaattgtcaatctggacccacaggaaggaaaagaacaagtaagaaacacagcaacaggcacatcagagagataaattggtctgctatgcaagcccagtggcaggtaccaaggagagttgcgaagcagaggcgtcagagccatgaacttgttttaaagtcgtcagtcagtcaggaagcaccatggatatgtatacctctcctgcactcacctgaacctcccccctgggaaggaacttttgtacataccgggaagcaaaccaaatgtagagagcagctgtccccaccatggcaggggcagcagatgcaaggctggattctgacaaccatgtgtaaacaaatgagagtgctcctgggagagaaacagtcaaccagatacgtgccaaagtctgcctggttgacaggtgaactaggctctgctggcgctgtcctgcccttaaaaagctgacaagcctggtagaaaacagggcgaacagaagcaaagaaaaaagaaatgtgaacgtgagagacgggcatgtgtatgcacactctgacctgtggtgcccagccggagctctctatctgctgcctctgacagctca

SEQ ID NO: 42964 - DNA, 1304 bp, Bovine  19866880699230
ttaaaaacttacccaaacccaatatgtgattcacttttaaaataatcatggaagccagtttaaggggggaaaaatttctcatcctagttgctccttgggaagaaataaatcttcatagcattgatgctaaaaggaactagaggattctaaattaaacatcttttaaagtgatgtctgagatcaaagggaccaatatcactctcactcactcatgagagacaacctaaggcatgaagaaaagaaacggccagcctttccactgggctctcacaggggaagaggactactgctcctcattgcaaaagataccaggactgcacagcagttctcagtctcagcactgtggacatctggggacagataatcctttgttgttggaggctctcttgtgcattgttaggaatgttcagcaatattgctaccacctccatccactagattctagtggcaccttcccagttgtgacaaccacaaaacattgccaactgtctcctagaaggctaaatcactccctgtagagaagcactgcttttagcacaaagtcaaatcactaaagcaacagttatttgtaagcacaacgacacctcttttcaacccatctgaaattctagccctgtgctcctgacagatttgattttgaccctactcagcatgatgaggaaaattttgggccatctctgcaaccacaggaaagaattaccaaattctcagcaaatcagtcacaaagcaggtacttctgagcaaaggcagagagaacagtaaagtgaaaaccatttggaatgctagttgagtttctgaataagatatagagagttaatgagaaaacataaagtgaatacttggctttactaaaatcttacagacaaggtaatgtctagaataacttcacaaaatcagaattttaaaaatctaaattaaacccaaggatgctgatggaaaccacattctgatctttaaaatttgcctctcctatgtcttctcacttttacactcatgaaataaaagactatcaaacaatatgaaagactgcttaaacagactacaataaaatacagaatttttttctaacaacaaagagcactgtgagcaatgttgagataagtcacagaccagatgctattaacaacataaatatcagtatatccagaatacttacacaaacacttaaacatgaaaagcatcattaccacagtcaaaactggcatcattacttcagaaatctgagctgactcttgaactattcccccgctttctgcaagcactcaacttcattattccatattccaagaaaacatcgactaaca

SEQ ID NO: 42965 - DNA, 1248 bp, Bovine  19866880811909
aactcgaggttaaggctctgcctggctactgttggcctcccagaccaggggcccccgagcagcagggtggggttcaggacagctccaggcctcagacaggtatgaacattggctgtgaaaccttcacaaccagagaggctgaggcttggggatgactgttttacacacacccatgactcttgcccccgccatctagcgaagcacctcagctccagccctgactcctggccatctcccactcttgtccgcagccccatgaacttgatgggcaccggccgccattcatcgtcctccctctcctcacacgcatctagcgaggctggaaacgtggtgatgctgggcgacagctccatgggcgaggctcccgaagacctgtaccaccacatgcaggtaccagcgcggcccaggaagagcgggccagggcccgcacctggaggactcggctctctgcttgctggtctggcctgaggactggtgttgctgcctagttcttcagtttctgaattcagaacacccagagctagcagaatggccttccctccacacctccctgtattgcacttcccaggccttatttcccaagaaggaaatctgcctttagtcctggctgctcttagagatcccatgggaaagctcctctgccaaattgccctcctgcctggcattcctgatggctcagtccagtctcctctgtgggtgccatcgctagagtctacccagcaggcctgtaccatcagggttatagctgacccttagtgctggccatcagcctggccttcatcagggcaagggtacagcatcagacattggatctgggcacctggtggcatgaagaagccaactctgagccagtcctaccatcctggccgtttggacctctatcctgctaatttttctccctttgcagctcgcgtatcccaaccccaggtaccagggctcagtcaccaacgtctctgttctgtcctcgtcccaggcaagcccttcttcctccagcctgagttccactcactcagcaccatcccagatgattacctctgccccttccagtgcccgaggtaaggacggcagggcgctgcttgcagaagggagaggagagagcctcatgggcgccccttgtcctgctctcatctgtggctatgtctttcaaagtggccctgagacttagcaagtgctcacctatgcttttagcatcagggactcaagggctcctacctccagatctttttctctggcttcagaccctgctcg

SEQ ID NO: 42966 - DNA, 2137 bp, Bovine  19866880923023
ttcccaaactgtgaagggtatcagctgctgacagactccaagggcttgtgtgtttgcattagaccatgctactgagttcatccctggataaaggaactgttgtaaactttatgtctatgctttgcctccatccagagtcaagtcacttgtcaatatttcatagtaatacactatactgttttccatttgtgtaatctttattaatcatatgagttaatcagtatcactaacactttaaagtatcattaacacattaaagtatcactaacgctttctggtgtttgatctggcctacctttccacaaatgtgggtctctgcagattgttgtccctaacttactgcggtgaggccagcctgtcttctcagagggatgaacttgacagcccttaaaatgagccataagttaaccagggcctggagctcatatccaggtcaagcaatgcttgagctggggtgtagagcttgaaaatccagtcctgactgttctagatcattttcatcgtatgtgtgtgtgtttgtgagagagagaaggacactaaccaattctcaatcagaagcatcattcccttactttttaattaaatgtttgtttttatcacagcagtatgtatatataattttaaaagccaaagcatcttataaagtgtgtaatataaaactggttccttggctcaacctgaccacgtctacccactactcccgcaaagcagccactttgaactcttcttttgttcttcaagtagcttctactgccatttaaatttttaaaatttttagttattgtttattttcttcttcccacagaaagtgaggctgattctcctgagtcagcaagcctttcattaaccagtctttgcactattctcattgctttcatggagaagcacatttttggagatacttactcatctgtccctgaagtgcttctccagtccatgtgttcttaacacccaagaaaacaagttcttacaatcaagtgctcaggggccatcccccacagattgagaccagtggactcagttgtcagttggatgccatgtctgctggacctcctctgttttggcctttaggcactgggctgagcaggtatagcactgcatctcttctccccagtttgggactggcctggggcagtggccagacctcactgccacgcagccctctaagagaaaagcaactcatgaagggagccagagtatcacccactggtcccctccattctcatgatctagaggtcagagaacctgttgaggaggtatgtgctgcagtggtagaggtggcgcctcacatcagattttcctctcggcccaggaattcctgttgaagattttctgcgtgttccggaacctgatgaagatgagtgtctttcctcgggactggatggtgatgagacttcttacaagcaagtgagtgtggaagggccctgtgccagcctccatgcagctgtccccagaatattacatgtgagagaagaagctagatggaaacttgtcaaggtcaaagctgtagggacagagaggagagggtttaaatgtgaaagtgtttggaagcgcagtcagcaggactttgccatttaccaaagttcaaggaggagaaatagtcaaagatagttcagaagtagagtctaagtgcccggcagatggtgtcatggtaagggtaggaaaggaacttttatgaatgtgagctgtgataccagaggagggctcctgcttgaggagggcctgatcattggcctctgttgctctgtggtttcaggcagcatcccaagccctcctcttgacttgatttgtcttttctgccagacactgctcatcccccacagctagtgctaattactcacccaagactgtgaggctctgcccacctctgacactggccacagaattcactccaaggttgaccctgcttgtctgccccattcatatttctgccctgtggctctcactggcaaagcgaacaagtcacgtgggtggtagggtgcttgttgtcgggtccccttatgctcaggagaaggccacttagcatccactctctagcctactgcctcctccctctgatcggccttttacatcggcattatgcagaatgtagtgaaattatttgtgttagatttattagcaaggtgtcaggaggtct

SEQ ID NO: 42967 - DNA, 897 bp, Bovine  19866881038984
tgatgtcaagctctgttctaagcagagtgcatatatatcaagtttaacctcagggaaactctaaagatacacactgttatcctcatattacaggttaggcacagagagggtaggtaatttgaaaaaagtcaaaaacagtagaaaggtctgaagtctgctgttttgagagtagagagtccaaaatagtatggtctggacatttctggtcaagacttaaagaaatgattgaagtcaggagatattttgttaggtagagctaataagaagtactgcaatggggaaagggagaaaaaggaaggatttaaggatgtctcctgggcttttggcttctgaggggatagtagtgctgttttttgagacaggagagttggagagaagaatgaatttgggagtggaaattgtttaatgagatggttggttagatctttatgtttgtcaggacaacaccctctttctaattttttgcttttattttgtaccttgacggttgcgttgactattgtaggtggtggtacatctttttttttcgtatgcttgtttagcattgaccttgtcttccctttgtattaggatgtctgaattgattgaaaaagaaactgaagaatatcgtaagggggatccagacccatttgatgatcggcatcctggtgagatctgtgttttcttaattctggctctaattttcttacaaaagaaaactgcttactataaggactatttttcagttgaaatagaatttcttaaaatattgctcaagatgggggcagcaaggaaaaatacattcctggaaaaatggaaatatttttaatatttatcaagtacttaaaggaattagattatatagatatacctcattagttgaaatgattacaaagatttacaaggaagaaaaatgtt

SEQ ID NO: 42968 - DNA, 1661 bp, Bovine  19866881044694
tgataaaaaagtaaatcagaaactatctcaaccataatctaaactagaaattagaactagagattgcatctctgcccagaccccagagatgtactgatactccacagaagatggacccatacgaaaggaaaacattagaggcagaacagaagctgtagattccaggtaagagtgaatatgcgcttagctggttgttgcttcacactccttgctctttcaaagaaataaaaacactgaagacctttagtactaacacattcctactgcaacagaatgtgagatttggataaaaaaagaaaagattaagaaaggacatggaaaatattgggggaatggaagaacatgctttagtcaaatagaagaaaatagaaagagagagggagagacagagagagaaatagaaaaggcaaacccaggccagacaactcacttggcattccctgcccctggtttctttcttcggaaaatgctgagtaaagtgttggagcggcagggcagcttgccatcgccaacatgcatgcggaccacgtccgaggtggtgaaggcactgcggacattcctctcaggtttggcaataatgatgtacatcttgggggtgaacatgcaccccagggccaccgttacactgaggctcactgcgaagcaggtagtaatgatcttgtagttgctcccaaagtaaatgggcacgaaagccagccagatgatgcaggtggtgtacatggtgaaggcaatgtatttggcctcgttgaagttggcgggcacattgcgggtcttgaaggcatagtaggtacagctcatgatgaggagcccattgtagcccaaaggggccaccacccccaggttgctggtattgcagataaggtagacttctttgatgctcgggtaggacaggatgggcatgggaggctccatgatgatcagggttatcaccaaggttagctgcacgctgatcagaattgaggcaatgatcacctgggcccaggcgctcataaacctgggcttccgggtacagatcttcttcttgctgccagccaagatgcgtgcgatgcggttggttttggtcactaaagcggagtagcacatggcagaagagaggccgaccaggagacgctgcaggtagcaggaggtggtagtgggcttggcaatcagggtgaaaggacacacgtaaccaaggaagatgccagctaggatgatgtagcagagctcccggctggaggatttgaccacaggcgtgtctcggtatagcacgaagatcagggtgacaaacatggtgacaaggatgcccaagcaggaaaagacgatggctatgatggactctatgttgctccactcaaggtagcggacaggaatgggttcacatcctgcgatgagaaagatagttttaaaatgaatccaagattttgctcatcagtaacaacagtgcttactggttgcaggggcatagctatattcacagcttccatgatgtatggtgtttacttcctttttaaaaatgcctcctatcacacaaataaagatataccattgttttctctggacagtcatgctcccagatctaatctcatctcaagcctaatgtgacatattttagcctataaaaatagtattttcttaaagtgttataagtggatgctgctttgcggatggaactcagttctaca

SEQ ID NO: 42969 - DNA, 1118 bp, Bovine  19866881265917
caggggaggagggtgtggggatgaagcattttaaggactttcttcctttatgcctgggtcaccccagaggagcccttacccatccccaacttctagtggctcctgagccccatagcaggaggaggggaccatgggagcattctgctacctgctggggagccctgagatccatccaagcctgctcctcccatccccagtacaccctccgggccaggtcatctgccctcttctggagcagcctctcaattcatctcctcagaccagaggcaccaacaacggctgggggcggcaggagaggcagagagctcaggcccactgtgtgtaggaattcagaccgacagagggtggacatgcctcccttccggtgggagagggagggggcagcagtcaaacatcacagaaggtgaggggtggaccagcttccacagatcctgtctccatggtgatggagccccaagcccggcacagctggggactgcttggcatttggacttggcttggaactttcactgagcctcagctggggctcagggtgggtatgtgtagggggtctgcttcctaagcctcctcagcccccagatgactctgggccctactgcaggggtgaaatgagccctgcaagggccaggttgctggcccagggccctcatcttgctggggcctcagtcctggctcccagggtggaggcattcaagagtgagccaggacagctccctgagctgtgggtggttctctgtgaccctggggaaggacagcagtccctctttctctccttaaatgactggtgacccagaggctgcaggcctgtacggagcaagagagggataatttctccctggccccattgttaacctgcccacacagccaacggctctctagggacccaggtgtggggacccgcctgcttgccagctgcctgcctcctccctctcccagccccttggctatgggtgatcagaggaggagcccagggctgccccttcaggccagtctgccaggggagaacagcccctgggcacaagtggacatcctaactaaggagtgcaaggtagggaagggacagccctccagctccatcggggtctgtgcaggaccaagtctgagtcctgggcctgtgt

SEQ ID NO: 42970 - DNA, 1562 bp, Bovine  19866880140020
ccatgaaattaaaagacgcttactccttggaagaaaagttatgaccaccctagatagcatattgaaaagcagagaccaccaaaggtctgtctagtcaaggctatggtttttcccgtggtcatgtatggatgtgagagttggactgtgaagaaagctgagcactgaagaattgatgcttttgaactgtggtgttggagaagactcttgagagtcccttggactccaaggagatcccaccagtccattctgaaggagattagccctgggtgttctttggaaggaataatgctaaagctgaaactccagtcctttggccacctcatgcgaagagttgactcattggaaaaagactctgatgctgggagggattgggggcaggaggagaaggggacgacagaggatgagatggctggatggcatcactgactcgatggacctgagtttgagtgaactctgggagttggtgatggacagggaggcctggtgtgctgtgattcatggggtcgcaaagagtcggacacgactgagtgactgaactgaactgaactgaactgattctaagtttgtcagtggactccagtctgttttaaagcctaaatcaaaacggcagcaaattcaccaccgccatttagtttcaaagaggaagtacagccaggccccagatgatgaattagcttaataactagtcattattacttgcctattgaatttctttgggactttagctaaacataaaccagaacaaattgttttaatttaggagacagagaaataaacaaaccagagctaattttttgaattgcttttcaaaaatggcaagaggaccctgtgactggcagaataacaactcttctccttccccctaaaatgtccatgattttaatctctgaaaccaaatctctgatcttcaggatcttgagagagatatttttctggattatctggtgcagtgaaagaggtttttcttttttaacttttgtttttttcttcccattttgaccgtgcagcaatgtgggatcttagttctccgaccagagatagaatctgtccgtgcccctcgcagtggaagcatggagccttaactactgcaccaccaggggggccccggtgacagtttctgtaagaggaaagcaggggtctgcatcagagaggtgatgacagagccaccttggacacagaggaagggtcacaagacaaggaagttcacaggtccctctagaagccggaagacggaaggaagtagacctcccactggagcttccggaaggagcatagctcggctgacgtcttgattttagccaagtgaggcccatgtcagtcttctgatcaccagcactggaagatgtaaggtaacacatttgagttgtcttgagccactaagtgtgtaacatgtgttagggcagcaaaaggaagccgacacaagcctgcatagcactgtacaagactcagcctgaaaagtgaagaccctctgaatataccctgaactcagacttaaggtagatcgagtttctcctcctgtccatcaccgatgccttatggagactccgagctaataagaacat

SEQ ID NO: 42971 - DNA, 1667 bp, Bovine  19866880657800
ccacacacactgcaggcggggaagcggagcggctgacttgcccacgcatgtcacccgtccagaaggggcagagccaggactggagcccggggcagccagggactccacaacagaagctacagggcaggaagggctctagaaaaagacagaaagaaagcccctggtctggatactagcaggcctctctctgcaaagctccgggcttggggagagaggttcacgctggctgggggttgaggagggaattgggggcttgggggctcacagggtggagaggcccggggatccacgtgttcaagagcagaagctccaaaacacagggaggaggccacgtcctggaggacccgccatctccttattcctcaaccccacagcggcaaaacacgcactcgcatggtataatcacttgattacagccataatctggtacgatttgactacactgccagcttattacagtgcaagaaaatacaggaaacgtttcaattacgcctcgtgtaacccatgtataaaggaattgctgtccatcatggtgaaccttaaacgcctatttcttttaagataagcttgcaaagtctttgacttgcagagacttaaagactataaacacccttgatctcttaagcgcacagatgcggtctccatgtgttaggagtgtctgctcatcttgacaatgtcccagaaccagctagtttgttcagggaaaaaaccctcaagctggttcacgggagagccccacgggtgagtgaacatgtacagccttacgtttcatgaaacaggagaaaagtcaagctcagaggatataagagaaggtgcctttcagcctggactggcaggcagccccttcctctgcaaggagaagcagcttaggttcaaacctgtcaacagtttttaagtcaaaggcctttgtttccaccttaatcactaagtcaattacagctctaatccaaaaaaggtatttaatgggcctttatttaagttcacagatactctccccaattactgaattagcagtgttgtctttttgtatcctgaccagacaggcagacggcaagggcctcagaaactgcccggggctgtgatgagggtcaaagtcggcgcagcagggagcctccaggtcagtggaggggaagcccgagataaggggtacctcactgcacacctggatccactagggagagttcaaagcaaccccaacatgtcagccaccctccactgccccaaatcagcgcaggagatctgtaagcccccccactgcccctcaacagctcctggcacaccccaacccccaggggttctcaaagtcactgttgagagttcagaattcaagacacacagaaataacacccgaaatgctggctaggaccccacccagcttacagaggcctctatgggccaaaaggacacagaaagactgtgtccaccccaagaaagcaaactggaaagtggaccaaggttatacgatgacgagggcggcccagcagcatccagtctggggacagctcaccttggtggcctctcccctcccacggcctctccacggggcctggaggccacaggaacagcgcattttttaaggcagcactcaaatcctgtgtgccgtgagtctgatccataacttctgtgacttttccgacaagacaaaggaactctgagtgggggggggg

SEQ ID NO: 42972 - DNA, 1539 bp, Bovine  19866880841861
aaactccctaactatcccttcctccctccttccccctgcctcccccagcaaccgaaagctctttttctaagtctgtaagagactccagctttctaaatagttactgtttgccccaaagtcccaaactgccattttaggcatgctgagcatcaccatagggattaaaaattataatggggataaaacttttagtattttaggagacagggggttgggaaagtagtttacaatgaaaaggctttgtagtatttatcatcctcagagctcaggcatcagatctggaagcgagggaggtgggagatgggaagcgtcaaatggggagacatgccacatggatcatttggagcaaggacccatttcactggtcatttgtgctccctgtggtttctagcctgaagagcttcacatttagagcaggaagaaaagagaacagttctgaatggaccccccaaggagcatttggggtgaagagcctgtgcccacccagccccctgcaaaaatgcttcttttttcctctggagacttcattgtctcatgggagtggattgcacaacagggaatattttcccaaatatgtcttcagaacattttgcaaaatagcctcgagctggttttttgacagatgctagctgtttctttgggggtatttgagagtccagctgcctttgagagagtcctcgctctccatgcaaatgcctggacctaactgaaagatgccagtggtcactgggaaaacggaagaacgtctacagtgggaacttcaggcctttacctttcatagtggtggcaactgaaatggctcctggacttccccttcatgaactgcttcacaattaaaatgtaattatactgtcaaagaataattccacagtgactctaacagagtgatttgcaaaatcactgtattgtattcttaagagaattctgaaagttcttctccacccggccttgctaaaccatttcataattggtgcctttctgggcatctctccagaagcttctcagttgtcacatttttaaggtcaactgtacaaatattagcttatcatccagtcggggcttctgaaaacatgatattagttatccagagagatctaattatggctttgtttggaaatagataataaattcccagtgcttctgagatgctgcacattccaggagctctaaaccttgtcataattcctcaaggatggaagattaccaactctcccttgaggttctgaagaatgaaaaactaggaagaaagaaagaagttaaaatgacagaagaaattaaggaaggcaggaaggagggagggagggaaggaaaggaattggctttgctttcctggctccagggtcaggcttagatcctcctgggggtaatacgtgcccccttctttgccccctcctgttcccccagttcccccttctttgccccctcctgttccccagttccccctgcctccagtcccccagttcccatctttggcctcctcccttttttccttcctgcatgtttctcccttccttcctctttgccccttattaaccctga

SEQ ID NO: 42973 - DNA, 1776 bp, Bovine  19866880923034
ggacgggggagcctggtagactgccgtctctggggtcccacagagtcggacacgactgaagcgacttattagcagcagcagcagcccagcaagttgtcctagtttgaagatgctgcctgccccctgctaggacctgagggatacagcctgggtcataatatttgaaagagtgcaaattcaagccacatgaatatgttgatttgataacttgcacacggcttttggaaaccatttatatgttaatgactcctgaatttacatctctagtccattcctttcctctgagtttcaagatcatatatacccacttgaatactggctattaccttttggatagttccatttctgtttcgtttcagaggcacctcaggctttgttcttgtggcagatcccatctcttctcttgtcctgtgtcccacctgctccttctcaagtcatcctggccacagcaagtcacaccaccacccacaagttcactccagctgtcacttctatatctcaacaagcgccccacacccaccgaaccgctcagtgcagtgtccctgcagagtctactacctccagttcattactgtgggaggcaggttccactccacagcagatgtggaatctcttctgttcttcccattcctgctgacacccacctagttcaaggaccaccgtggacctgaatcacagcaacgacctcctgaacacctcctgtctctcctctccagtcctctccatacaaacatccaaagagagagtttgcacacctagcttggatcacatcactgccgtctaaaatctgtctgtactctcaggggcatccttgccctcacccagcactttgtgctgagccctttcccacctccctccttcccatcgacgtcccctgcgcctggactgatcttttccccagagcttcacaggtctgggttgtttgtgtcttttttatccagttctcagttcagttcagttgttcagtcatgtccaactctttgcaaccccatggactgcagcacaccaggcttccctgtccatcaccaattcccagagcttactcaaactcatgtccattgagtcggtgatgccattcaaccatctcatcctctgtcgtccccttctcttcttgcctttaatcattaccagcatcagggtcttttccaatgagtcagttcttcgcatcaggtggtcaaagtattggagtttcagcttcagcatcagtccttccaatgaatattcaggactgatttcctttaggatggactggttggatctccttgcagtccaagggactctcaagagtcttctccaataccgcagttcaaaagcatcaattcctcaacgctcagccttcttcacagtccaactctcacatccatacatgaccactggaaaaaacatagccttgactagacggacctttgttggcaaagtaatgtctctgcttttttaatatgctgtctaggttctcagcagttttcagtttggtgggaagttcatgatcccatctcttaatgggatgagcaggacagtcatcttgtgaatggtgagaatgtcaggaggcatgaaggactgtggccactggtgaaactcccatgtggtggacaatggtagaaacaggctgacctgggtaaacggtctccctaggaacagaaggaccttccaggtcccgaagtcattctgggctggcgaccgctcctcctgggttccgctgagaagtgactgggctgttcctcccaggatgggaggcaccggcctgtggggtagattctatcagcactgtgtccccac

SEQ ID NO: 42974 - DNA, 844 bp, Bovine  19866880967899
acgactcagctagaaatttgcatcccaaagaaaataggactagttaatgcattagagtccagctggaggtgggatgggcatgtactgttttagaagagttgatccaggaagtccactgcgaggaggtgaggaggagaggtcagagggcaccacccaggccaaggtcctgccggaggaccagctccatctctttgggaaacagcaaggtttgtgtggccagaatgtgcagagccgcaggagatgagctggagggccagatggtggtcagggtccgtggggtcttagaggccgtggcaagctttgccttttattttcacggtgtgggcagccctttggagggcatgctgtagtttgtatttggaaatattttctgaagtgtccttgaatgccttattatgtaactgagacaaaagccagaaggcagaaggttggagggcttcttttaggtcacaagcttttaggggcaggctttgactaaaatagacatctctaaatcctcctcttgtcaagccggaaggcagagacctgccttcctcctctcctgggatgctgagaggggagcttggtaatgcatgcagtcttatgtacattctgtatacggcgggaggcaaggttgcatcatgtagatttgtaaagctgaagctttctcagtgcaagatcatgagttttccaacccagactttcattcccctcagcatcctacttgggcttcctaggaaaagaaaaaaaaaacaaaaaacgggtcacacataggaaacaggctggcatccaacagaaaatctgtttggtttcatccgatggcccatgcgtcacgtctgcagtagctacatccacaatctgaaat

SEQ ID NO: 42975 - DNA, 677 bp, Bovine  19866881059971
tggattggatggagtgaagtgaatgaatggagagtgagaacctagaggtgtgtgtgtggacacgtcttttgaagagctttgccaccaagagccatggggcaagggcagactcggggtccagaggtaactgggcatgttagaaccgtttggagatcccacccctgcccagcctactgcttgtctcctcgggggatccgtatggctcatgcccacggaaacttgacctagggcaggtgctagcgtgcatccttggacttaaatgagtgcctcgttaaagctgacacagcagcggttaatgatgcctcatgtcccgattcaaaacccctgactaaaaataacaacactgccaagcccttgcccagtgctttgccagctaattagctcatccgtgccccttaatggtttgatttatgtgtttcctccctcagcgaggtgggctcccaggtgaggaaatgctgagatgctggtaatgtgcacaggggtgtgcagagccctgggtttgccaagccaggtccagccctccatcgccttcctgctgacggcttcttgggccgcagatggcccctgtccccaatctgtttcaggctggatggtcgggaagccgtccttactggggagcgggaagatgcttggacattctgggtgctggagttgcaagggcgagtggggcagagagg

SEQ ID NO: 42976 - DNA, 1195 bp, Bovine  19866881060111
ttttttgaatgttgagttttaagccaactttttcactctcccctttcattttcatcaagaggctcttcggttcctcttttatttctgccgtaagggtggtatcacttgcatatctgaggatatacatactttatatgtatatacatatatatgtatgtatgcatatatgtatatgtatgtatacacgtatatgtatatataatatatgtacatttttatatctgaggatatacatatactgcatatctaagcatatacatgttttccacataggtctcctttaaatttgaagtagctcttttttttccaagatagcctgctttgattttaatggtagggtcttttcaaaccatactgagaatatgtgtgtgttaattgctcagtcatgtccaactctttgcaatcccatggacgatatagcagcccaccaggctcctctgtccatggaattctccaggcaagaatactggagtgggtgtccattcccttctccatgggatcttcctgaaccaggcatcgaatctgtggctcctgcattgcaggcagattctttactgtctgagccactaagaaaaccctgctgagaatatagtagagtttaaaaaaaatgtgttcttctccttgcagcaattcttttactgggcttaactctgactgacatggttgtccctttggaactggcaaatctcttaatatgctcagtaatcgtcttctctctgttgacacttgttggggcttagtggctgagatgggctccatcagagactgtctaggtcacggctctcatcttttaggcactgtcaagagggaaaggtttaggttggttgtatttcaccttgactgtttaaacaaccagccgtttttcctaagcagggggcagagctgtaggagagcctgccaactgtgctgtggggagcctgccctcccagcaggctgagcttgcctcctctagcagtggcacatgggtccactccaccacatctctgctctgcttggagcatgagggtcatccctgcctcttgcagccccagggagcaggcttcaggctgttttccaggctctcaggttagcatacggggctgaaccaacatgtcctcaatttgcagtctttccaccttcaactgtggatccgcccttattcctccttgtcattcgcttcatttgcaatcctataactgtagacagtcaggctcct

SEQ ID NO: 42977 - DNA, 2711 bp, Bovine  19866881127918
ctcttcttcatcagcctgccctccccaggtccccgccagctgcgggagatggggttctggggtggtccattcctacgacccaccctcccagagagcctcagcgctctgcctgtgtcccacagtcctccctgtctggtaacccctctgcccccatctgtctagcccactctggaccagtgcggcctcctgggctagttcccactgccctgggagaggcactctgggggcacccgtctgcctgcaccccagaagcaaaagacagcgcccgcccagtccgcacgcgatagcatctcacctcccaggctcctcacacgggctgcttcccacgcttgctgaacaaagtgaggggaagcccagccctcccagcccccatccctcaaaataaatatttgccttggtatcgccactggagacttcacagggcacacgcccctctctctccagcccccgggtccttacacacttcctgggttgagtgtggccttttttttgggggggcaggggtgcagggcagctcccaggacaaagtaagaggaacaaagaaaacaacctcttgagaataacagagagctggcaacacttagctttcttttccttttgtgtctccacataattgccacaaacagcagagactgaagagcgctaatacgtagccactcagaccgtacatcagtttgaacccacagtcgcagaaggcgtttcccttcagatagcaacatggacaggagggcacccgggtgtgagatggactctaggggcaggaggggcggtctggactcagccaaaagagcccccactgaccactgaggtcaagcaagaaccagggagagccgcggggaccctgggggttgctccgcattttcaaggaaaccatttcctgctgaagggttgcaccctcactgctccatgtataaagctgcaactattccactaaccaggaatgaagagcccatagacaacgctaagtctaaaatctaacgtctgagacagtgccggaaacgtatcaggcacttgactgtttctggcaaacagctggaaagaaggcgagggagggaggcaggcagtgatgcggtgtaaaccctgaacagcaaggaaaggtccctccagacagggccgccgacaaagtgggtttgggagcagcttcgctgacctgggggaagggctaacaggacactaaccaccgcctcaccaacagaacagggacaccagaggtgtcctctattaggtgtcctaataggcaggcctattcccatggccccgaacaggaaaccacccaaatgcccatcgctgggacagcaggtgaccaggcagaagcagccacctccagccacacacaacacagaggagtcttgccctgtgctgaccaacttcgctgttctgatctgggtgtgggacataccgtcagtttgtgagaacaccctcccttaggacctgggcatccttctagatctacgttctatgctccccccccccaaaaaaaagagtcccaaaaagctaccatgtctaaagtggtctcaatacctccaacccccaaactcctaacggtacaataatatacagaaaattggagatccaggcttgacggtccaaagtaaaactgaaacaactgtctgtctgtctgagaccaggttcaccagcctgaactaacaggagcggtgtcgggacaggagacaggagaccgaggcactgctcacggcagcacctggatccacagaaaccgcagcgaagggcggggcgggcaggcgggctggcccacggaagtgccctccctggaaaatgggccaatcctcccctccagacaaggatccctggaaacacaaacagccgaacgtcagcccactccactctctccagacccacttccttttatctcattacaaaagcgtgcccgtagtcaccacatctataacatcaactcttgctgcggcagcagtcacgtggagaaggtgaaggaataaactcaggaagtgaagggatgccttgctttgctgcaggcactcatgcaaaaaatttctaactccttcaagtatcctcagtagacctggtatagcatgtccatattaactaaaaacgtattgaattaaggctaaacccacttcctaaaagatcctgttaccctctttaagactattatctgagaatctgttaacaggagctttgtgtgctaagctggaaagcaacatggttctatttgcaagagcctgctggatgttgacatttctaagaccaaacataaatcgtttgtgaacatggccggtaattatttggaattcttctcccagaaccatgaaaagtgtttcccaccctttcaaaaaataaaataaaataaaaggcagcttcgaagcatgatgctaatgacaagcagacagagtgagcagtttttaagatcacacagttgcttgtgtagaaacactgcacaaatactccaacactgcagcccaaaaaaagacaatccgaatcaaacagcgagaaaagtgtgaaaattgcaaatgagcccctggttaaacaaacacaccaatctgttcccagagagctcagggtggccacctgttcgggctggtggcaagttctgattaccagtgggagagacaaaatgggagtgatgacagccaccccaccccagccctagctcgggtcctgggccccaccctccagcctatatttagtctgctctttaggaaaatgtcccaacctcgcacacagacagctat

SEQ ID NO: 42978 - DNA, 1092 bp, Bovine  19866881226400
ttctttatagttcttcctgcctccctccgccaagcgtacaaaataccttcccaaagcactggtaagcaagtatggacttgtgagttgagatttggggtgttgtaatgaggatcccttgggcttcccaaatggcacagtggtaaagaatctgcctgccagtgcaggagacacgggttcgatccctgggtgccatctctgggtcaggaagattcccctggaggaggaaacggcaacccactccaatattctcacctgggagattgcgtggacagagaagcctggcaagctacagtccatgggatcacaaagagtcggacacagctgagcacaaacggggattgcttgctaagggtttgtgatggacctgatccagcgtgcagactttaaaatcctcacaaaaaccgtgagggtttcccttttacaggacaactaccagaactgaagtcgctcctccagccttattgtccagtaagtgctcgagctgggatttaaactcggacctgcctgaacccagagctcttcatcacatctccccgtgtgcctaaataaaagaaacaagtcacacctttgggagcgtgaagacacaggcatggaaatagcagagtgcctacctcctttacacagtgataacaaaaaggtggtgaaatcttccaaacctgagaaatctttgcagcctaaatggaaggcagtctgtttgcacctttgtcccccagagggccatgcccttgcaccctatctacaaggtaaagtttgatgtatttggaagatggtgattttgaagttggggacagctcagaatctgctctgaagtttgtccttgtaccatgaaaagagggtattctgggcagatgaggtcactagaataagattaagattataggaaggctgttaagtaaatgtaagataaggtccaccttccactgtacaatcaaataaaggacatactaatgagattattcttatctgctccacgaagcctcgtcttcagggaactctgagctgatgcctggtagcccagctcttctgaaccaattgaaaagaatcctttctggaaagagtttttgggttccaaattcttattaaatcaccctt

SEQ ID NO: 42979 - DNA, 750 bp, Bovine  19866881334658
tctatatttggaaaccaagtaaaattgaagaacagaaaagcagtccttctgaggggctgttgctttgtgtatattcagaggggacagcaaagggcacagtttgccaaatgtattcaatcctaaagtttaacagaacccctgaagatattgtagcaaataatgtataaaacaaacaaacacaaagcaccagtgcaaagacgcttgtgaaaatacacggcaaacgtgttgagagaaaaacaaaagtcggtaaacattacggaaaccctccttgcagatgcctgaacagatcctttctaaatccgttacttggttttcatatgatccaggagaagattatgtaatttcaaaactgtctgtaaactactcattttcatctgatttctcaatgtctaatttgttcatcagtcacagctatgtgtacaaaaccagctttttaatcagctcacagagtgtatagaagcacattatatcttgcattttatgggagaagaattcttgtgctcagaattattatgcattttacactcaggtacacagaagaatgatttacacacgtgtgtttctagcttgtgcctctggaaacatccagtttaaaacctgctgcacacccaggctcggcgtcctgcattctcacacccccaggagctgacatgcacacgaaacagggttttctgtgacgcgcatgcagaaaagggctggagcgggttgctggggagaatgaggcttccttgcctttcatcttcatttgga

SEQ ID NO: 42980 - DNA, 5191 bp, Bovine  19866881351692
ataattatatccataatcaattacgaatatcatgcaataatggtattgattaccgacttctccctttcaggtctggaacttgggagtgggatggagaagttcccccagactggggaaagtggaagcaaagcaggtgggagtcgcctgtggagactcgtcatgtagttggtgaccatgaccatcgtcgtctttccccagcttgcttctcacagctctgggagcacgcgcctctccatcccttgtgagcttcggtgtgtgcaggcctcttgtgtgtgatgaatagtttctattgctgtttgtctctcggttacttgattgtcctcctgtgcgttttcctcgtctcttcctcgtcggccgtgccgatggtttccaagccccccttgctcaggaatctgactcagtgtggggagtggctccaagccccgcccttggggccgggttgtgagaaagcccctctgttgctgtgtcatagttagaacactggtccttttatgtcgtgggaagcaattgttgtaagtcctctccagggacctcgtatttctgtacccatatgctggagctggctctttgctagtggttgtaatagctgcaatttagtgggcatctactgtgtgccaagaattttatgtacactggctgcctgttataatgatctataaaatccccgctatcgtggcaggtaaggagtaagagactcagagaagacccatgtcatgtcaggttctacagatggttgatggagaaaccctaggcttggtatctgggtgtgcccgaccccagagcccacggggtccactgcagatggtacccgtggggcccagggcagagatggcacagccagcatcccactcggcagctccgggcagtgggcgccttaggtttgagagctcgagttgagccctcatgtccgagggctggaagcggatgatgaccctccgcattcagcttgttctcattattgtgctaacccgtctccacctgggatcccctgtgtgaggcactcatacatttgcacgtgtgtctgaccgtcacgcgtctgacctgtgagtcggggctgtcagccatagcaggagtcgaggctgagcggtgagggagagaagggaagctgggcagacggatctccggtccccagctgcctgcctgcctgagcaggtggaagatcatggaactgtggtggttgcagtgatggggccgtgtggaggctgtgtgtgccttactgtatgatgggctgggtttcaagaatccctgtcctgtagggcttgggaggcgtgtggcatccttgcactaagcctctgtgtgatgttgggagtcaaatagggctgtggaggtgagactctgcacccaggtactgccggcagcccactggcgatgcgctttctctgtccagacgtttatcacttctctctgaagtgggcagagccagaagccttgaagattgtgtcagagaaaggatgtgagctgtaaagtacctctgacataaatctcactgaagtactaccggggcttccctggtagctcagatgggaaagaatctgcctgcaatgcaggagacacaggttcagtccctgggttggaaagatcccctggagaaggaagtggcaacccactccagtattcttacctggggaattccatggacggaggagcttggtaaactacagtccagagggttgcaaagagttggacatgaagtgctactggaggagggtgtccagaagatgcaggtccatctacaagacgcagtagcatctgaaagatgcagttgtgggccaaatagctgccaggttaccgagctgtctgcagtgagtgtggccggttctcagtgttggtctattggtcttcatgactgaggtcttctgcaaagttacgctgtgctttactgcacggagcgagtcgttgccaggactctgacggggcccctcgtgatcttggtctggtattagtttcctgctgctgcagtaacaagtcacccctaacttaatgacttgacaacacaggtttatcctcttacagctctggaagtcgaaagtcccaaattaaggtgtcggcaggctgtgccccgtctgaaggatctagagaattcgttccctggtcttttccagctcctgcaggctacctgcactgcttggctcctggctcctccctccttcctggaagccagctgtgtaaaaaccttcagatctctctctgaccccctcttccatcctcacatcacatcttctctcccttttccgagttctcaggaccctcacggtcattttgggctcatctgggtaatccaaaataatgcccctgctgtacgattcttaatcacgtctgcagtcgctttgtccccgtcaggtgacagtctcaggatgtgggcgtctctgggggtgggggggggcggtttttctacccaccacagccccctgctctatttcctaccagggtcagcgttcctgcaggtgattcttttcctgttgtgcagaccgggcatcaccagactcagccttcctggggctccgctgttcacacagggtggggtgggggcaccactgagtgtcaggcttcctggctctctatgccagctttcactgcagttctggaggcagggttagaaaacaagcattctgggcatccgtgaggacctgtgagcacgtggggaccatacaccttgactcagcgtgaagaggctggttttggaacctgagcttgtccttgttgtccagactgaagcttctgactgtcctgagctgactgggggctcccctttttgctggggagacagcgttcatcttgcaggagcctcgatccccagctcctcagtgtgaagagaccctcttgcgagcccctcccctggtccctaggggccaagactctggacctgctcccgtcccctcccccactcctacaggaacatctcttatcctttcggggtcccccccgggggctgtgtgtcttcatctcctggacggtcttctcttctcaagtcctgttgcttgtgactgatcctctccacttgaccactttctgctcttgagatccgtaatgacccctgcatgtgtcctcctgggtgggacagggttagagaccttggttctagcgggggagacctaggtcctctgcccacctttgcctctaggtaaggtacgcaggagccctgaccctgggaagtggtattgttcacctggcggatgcttgcctgggttttagacttttcaacaggaagaggagaaaatggaaaagagagttgatcaccaagaagagaattcgcatgaatgaaccaaccctttttctgattattaatgtgttacacgctcagtatataaaatggggaaatgataaagaagaagaaaaaaggcccatgatccctccatatggaggcagctaccgttactttggggaggtttcccttttccccaccttggggttttacaggggttgatacgtgtcacctgcacagtggtgtgtccaggaatctttgttacgatgacattgtgctgtgtcctcaccttttctaaaagaatctttttcatggctgcgtggtatttaagtacatggatgtattggaattgactcatcccagagttcatcccaaagagctgggtttgatccctggtttgggaagatcccctggagaagggaatggcaacccactccagtactcttgcctagagaatcccatggacagagcagagcctggtaggttacagcccatggggtcgcaaagagtcagacacaactgagcgactttcactcactcactcactcatcccaaagtagcttaaaaaaaagttttgagcgtgttaagtgaaaaatgacaacaattaatattttaaatcaggtaaagagaaaccccggagcccctgcccctgtttacctgcctgtctgcgggggccaggctgccccctgctggccccgatgagtggacagggagccgtggtcctcagcgtggcgtgtggacggcgggctctgcctgccgctcagagctgctcctgtgagttgacagacgacgtcgctttccttggtgcagttctgtcactggtgctgcaggttagtcatggcggaaattgaagcggaggggaaagaaacatctctggctactgatttcacaaaggaaaacaaaactgaacaaaaaatatttgtggggcacccgtatagtgagaacgaagggagatacagatgagcagtgagtgagcatcagaggcagaacttccctggtcgtccgggagccaggactctgcactcccagtgcagagggtccaggtttgatccccggccaggaaactggattctgcataccgtaactaaagatcctctatgtggcagctaagacctgggcgcagccaaataaagaaatatacatgaaaaacaaatgagcatcaagcgaatggagtcacagccttactttggatgtctttgctttgaaagaattgtttttcaatctagtaatagtctattaaatatcagaaatggtcaagctcattaaaaaccaccgtcaagtcgcacgctgatgagaggggttttgcctctcttcctcttagaactaatgaagatccaaaagtttgttgcaggctggaaaccaggcggattttaataggaaatgatgtaagaaagcttcacgcctgcttttcttttctgggtgcgccgagtggagcgtggtctccgggctgtgcgagcgcccgctcctcatcggtttacgctgttgtgattcccgtcgtgtagaagcatggcgggtagttagaaactgggtggccgtttgtgctgagcatcacttcaaaggttctgcttggaatgctgagcaaaaggacgctctggctgagctgaaacacatggcaagcatcctactccagtttttaaaaatcatcaggcgggctttggtgtattttttgggtctttgttctttggtcttttgctcgaatgagaagctcagaggatggccctgggaggccggcacggaggccgctctgggactttcttacgtgtgggaactgatcggccccaatgcttcctcctctccgctctttttaaaaatttaaaaacaaaatttttttcaagtgtcttattgatttctggctgcactgggtctccgccgctgcacacgggcttcctctagttgtggtgtgtggtcttcttatcacagtggcttctctggttgccgagcatggtttctagggtggggggcttccgtagttgcagtggggctctaggg

SEQ ID NO: 42981 - DNA, 782 bp, Bovine  19866881361516
ctgctgctgctaaaagggcgtttccctaagaaggagagcgatctgttattagcagcttaagagggctgttgggggccctggaggaagtgactcaggagggagctgcagcctccacggcggagcctggagccctgtttactgccacctgtcttttttgtccaaagctggctttttattttgttaagactgaaatcccttattctgcatccttttttcccctgtgtgccctgcaggtgtttatcgttggtgagtctcactagggctggttttaactactgatttggtcccatctcttgtttctcagcgttcaagcaaacccctgagcccctgccccccacccctggcccaacactctggattctttgaggcctaagtgattgagtttggcaaagccgatcaggcttagttatttttaaaatccagagtttggggctctgatcgggtgcttagccacgtaattcctccgctctgttaagtaccttgctctgagaaggaacacgcatcctgtagatgtttgtctctaatctctgcagcatctgtgattgtcctgggggtctgagcaccaggcctcctccatgtcacgtccttccgggagggccaagggggcactttccctctcctgttttgtggtgtgggaagcctgcacacggggctgcagggatgacctgtccaggggcagggctggcattgtggtgggtcccgtccctgccctgtgcctgtgcccatgactgacccaggccaggaggggcttacttgcacctgggagctaaggagggaaggag

SEQ ID NO: 42982 - DNA, 689 bp, Bovine  19866881617369
gataggataagatcttcccgcctacttttttttccagtcacaggctccaggaatacaaacaattttttgtttccttgacacgtctcatgaaagtgtcacataaaaattaaaaccaaatgataattaaagaaagctggccggctattaaaatcttgttagacttcctcaaaagttatatccctattacattcctccagaataattcccttacagtaatatttttttaaattaaaaaccaaagctattaagcaggatgtagcctgagaaaatgtatcagtgcaaatgaagaataaaatggttttacttaatattccaagctttcttcttaggagaggagtggctacagacttcacttaaggatgaggctcatttgatgggagaccgcaccccttccagtcgggaccctgtggaggtggaccgaggggtgagctcccttctaagacctgcctctttatcagtcgagtgctacagacacctggggacaagaggctgggacttccattaagtccgatgcaggaaaatccctatcgaattccatcttaatgaattctggagagtgctgcccagattcacaggtaccttgatttttaatacaaaaaaatatccctgggtgtcaggaggttcaacttactgaataatacatttcctacccttctgcctggttctatataggaaaaacattatcaggt

SEQ ID NO: 42983 - DNA, 1110 bp, Bovine  19866881663975
tgggtggtgttttgcatgccttctgcagggccgagatggagagagaagccggcagtcagctagaccactggctcagaggggattggctgtggtttgggttccatgccttgtaaaaatgaaggtaatgattctcaatctgcttctcagtgcaccataaaaattaatgggtggtttgcaaagcatttctacatccttgcatggacagcggctgtacttttaggggctaggaagcatttcattcgtgtcctttgcttccatcatcaaataaaacagtctacctgccacctggtcatcccgactaggaaacgggagtgtccagtggagtctggagaaggttcccggctccctgctcagcactgtctttccaggccgagtctctcaggaaatgggggggggggggggcggtgctaggcttggaaggagacagaacccccttatcccttccctatctgctttgtgcacatgggcaaatgcccagagtgaaagggggctttgacattaaagccccagggttcacaggcctgatgccgaggccacgctgatcttaggggaaacagttagttctgggagaaggactcagacagtgaacaaccctggcttcctaggcatttgttttacggcactcttgtttaccaaatgaacaatgacccgctcagatctgtggtgcctgagaagcttctgtgagctttcatttttttcctgttgtcccaagactctggcaccatgctttaaggagcctttgaaagcaattgggagggactcggatcatttgttaatttcggatactaaaagctggagccagagccatctgaggtgccacacaggttgccttttgttcccctggcaaagcagccgtgacggaagcgcctctttctgtagtaggtctggagggttcctgtcatttgatagtttcatttttttttaattgtcactcccaccagcactttgttctgcccaagggctaggagctgagcacagtccagacacagggggcttttcggaaggacccagaaagtgggctggatgagttactgataagaatccttccaggctcctgggctcttagtgttgtgcccagaatgttctctgagttgggaggaagggggagtc

SEQ ID NO: 42984 - DNA, 1456 bp, Bovine  19866881907101
tcctcctcaggccttactgaagatggactgccagggcctggtggtcagactcatccaagacttcgtgctcctgaccacggcggtcgaggtggcgcagcgctggcgggagctggccgagaagctcgccaaggtgtccaagcagcagatggacgcgtacgagtctccccaccgggacaggaacggggtggtggacagcgaggtgagcccggctgcccttccctccacctgtcaaatgcagtggtgacagcgtctacattagagcatttttaggaggacagatgatgaagtgtgaaggcaagtgctcagtgcagaggaggctcgcgatgagagggagcatgtccatccttatcgggatccttagttggcagccaggccctgggtggtggtgaggctgctctgctctcaggtgggacattggaacggcatcctcggaactgccagtcccttgctgatcctgatcttaaattacctttggcctgattggaggacgcaggatgatggggctctgccccacacagggaggggtggacagatccttgtatgttgccggcttcagccaaggctggttgggtccctgctcagagagtctgttttctcacttgttttgtggaggtcactttaagcttctggaaagacagaaaggctctcaagacctaggaagcaggaagtccccaggataagggcatcctttattgacgtggcgagtttctaaataaatggaaagtgctatggggttggaaggaaagaggccccttctgttggcttggccagtacgtggtactgatagcttacaatgaacggtgttggattcataatctccgaagaagaagatttagggaccaggcaccaggcttgatcactcaggagcttttgtatagcaaagttttattaaagtatgaaaaggacagaggaatcttctgacatagacttcagaagggggacgaagagcgccccccactcactagtcttaccaaggccatatatacttttaccagacccactcccaggttaagacgagagctgacaacagcaaggccttaaccagacccactcccacaataaacatcttaagagaacaagattagtcagagggttcttgttaggaagaaacatgaacttgagcaggatactttgttatattgactaagacaaagcaaagtagggaaaaaaaaggttgtccttttctcctagagagcctcagacccctctctctttctcggggaccctggacttcttatcaacctacctaggaattgactctcagcactgcccacctgctctcacgcaaagtgccttcttccctctgaaatgtgctggcccaggacagggtcgactgctttggggttcatgatgcttggtgctaggagaggtaactcggaccagctctctcgctggctcctaatctctgctctctctcttggttttcgacgaccgcaccatccaggccatgtggaag

SEQ ID NO: 42985 - DNA, 2694 bp, Bovine  19866880036926
tggtgactgcagccttgaaattaaagatcttactccttggaaggaaagttatgaccacctagatagcatattgaaaagcagagacattactctgccaacaaaggtccatctagtcaaggctatggtttttcctgtggtcatgtatggatgtgagagttggactgtgaagaaagctgagcaccgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggacgacagaggatgagatggctggatggcatcactgactcgatgaacgtgagtctgagtgaactttgggagttggtgatggacagggaggcctggtgtgctgcgattcatggggtcacaaagagtcagacaaaactgagccactgaactgaactcaagtaatcatttaaagccaccaagttagaaagttggttgttccacagcaataggtaactatgacatcactgtgagcaactgtagaaacagacagggagtttctttcagcctggatgtcagggcaaggaggaaagagcagcatccctcaaaatacatactaagaataagagatcatcctttgtcttttaagccactgcagttttgaggttgtcctttactacagcataacctggccaatcctgactgattcagaaattggtaccaataagtgaaattccaccctaatagaggaaaactaaaaggtgaagtcagggaatagaccaaaggaaaaacgaccatcagaggctgcaagaatgacaatctctaccacacagtgatatagtatctagtaaaatgctcacctgtgaaaacttcaaaggcaaaaatgtacaaaatgaatatggagctccaagactgatgaggtcatggaacaaagtcccacggccccaccctccaatgggcacttagcctgagcaagaaatagacctccatctttaagacactaaaatgtttgtggttggctattatcaggacatgtcctgacaaacacaatctctgagcccttcctaacactaaagtggggtctgtcaacactgaaagaggaaagacacccagtcagagccttaccgtgatccacagggaaaagttcaccaacaaagtgagcatgggaaatactgaacttgaacgttaagtatttggctccataatactgggaaatggaaacaaccagccaatccttcaaaacaactcaaccttcttgcgtaaaaccatcaggtagcctgtggagtacagagctgcaagtagggagaagcccagtgaaaggagggaaaaaaggtatgtttgggattttctcctcttttaatagtcttatgtcctgacagttgggaattctttgttacaagtgacatcactggagaaaacatagcccctctcttctcctccccaaccccacaaaaaaagcctaaacctttaattttttgtatcagtgtgtaaggctggtacagtcaaacacataggtattatgtagaatgtgaatcagcataaaagagatggttttcttttttttagttggattcagagttagtttttgagaaatgtgatttttgcaaaactgcaggacacagaggagctggtaaaattttacagtgattctttagacctacccaaagctttcctctgatatttttatagacctgacctccacgcaacctttcttctttctggaactgcaaccaccatacttgaagtgtgcaaaagaggacttagatatcagcaggaactccaggtgggagagtgagattgaagtgtaattgatatcaggcatcagataaatctcaaccaagggaatgagtctgtcccttctcgagcagcaggcttgcacatgcctggatctaggattgatagatgtgtgccgctgtttcatatacaccaaggtgacctcattcactcagccagccattgcagtgattcttgaataaatgtccccaactgagaaagaagtgaaaaaaagtgattctaatgagccagactcatcatcagaatcaacattctgggttccaatgactgaaccaacccaggccagccctggggagcccaggacttcatgcagcaacaaatgagaatttcccctccaaagccctgcagatgctcatggaaatggacaccccaatataaataccagctgggcagctaataaagcaaatctcagtttttctaagaaggccattagcattggctacaagtagagaaaagaggcaagaatgaaggaaataaatccaagggagggaaaatgtaacatctctgaagaacaatgagcagaattgtcattatttacttgttcagtcatgtccaactctttttttgacaccacagactatagcctgccaggttcctctgcccataggatttccaaggcaagaatactgccatttccttctccaaggaatcttccttcccaacccagggattgaacccacgtctcttacattagcaagcagattctttaccactgagccaccagggaagcccatgagcagtatacataaggctaaatcatttgaacattgaactgggaaagagtgaatcaaagatta

SEQ ID NO: 42986 - DNA, 2394 bp, Bovine  19866880168968
gagagtctccggactgcaagaagatcaaaccagtcaatcctaaaggaaatcagtcctgaatactcatcagaaggactgatgctgaagctgaaactccaatactttggctacctgatgcaaagagccaactcactggaaaaagatgctgatgatgagaaagattgagggcaggaggagaaggggatgacaggggacgagatgactggatggcatcaccgactcaacagacatgagtttgagcaaactctgggagatagtgaagaacagggaatcctggcttgctgtagtccatggggtctcagaaagttggatgtgactgagcgactgaacaacaacaatctgggtcaatacagtcactctatatttcttttttaaatttaaatttttttctatattctctacgtccaacgttagcactacattcattacagcttgactggcaaccaacatgcaagctcagtcactaggttgtgtctgactctttgcaaccccacaggctgtagcccaccaggctcctctgtccatgggattttctaggcaagaatactggggtgggttgccagttctatctccaggggccaacataggcttaaccaaagtcttggccctctgataaatagatggaaagatacatgatagataatgatatgtagataccacttcagaaaaccccagaatcaatcatttctgtattatctgtatggaagtagatttggcctctcttccaaagccaggccagagtatcaattcctaatagtggtgctaatttcacttctatcacttaaccctgaagcagcactgtttgtgcctctatttcactcttacagaagggaaatgaagcagaataactttaaactgttaacagtctatagctaacttataatattgttttgtcttataaaaaggtggccctctcttacctgaggtcaaggcatgaggaatccttgaaaaccgttgtgaatcttctgggaagttgaaaatacaaaatgtcatttacctttgattcttaaactttatttctcttcctctccctcgtattgaagaattccagttcctagccctaatgacaaaggagctaggggaaatgcagccaactatcgccaagtaaaatctgaaagctttcaagttttcctatcacagagatggtactcaccactaaaagaagctctagagataaaatcatcaggctgatctaatttaattaataaatggcataatctggaagcccattagagaagtcagaagggccagctatacccacaacagtgttaatcaccatccagccaactcagtgtaactctagacattgaaccattaaagtacagactggaaaaagcctagttcctgatgactctaataatctaaatctggttattgacctctctccttccatttctccctcaccagtccccattatactttataatggccaactcgttggaaaagaccctgatgctgggaaagattgagggcaggaggagaagggacaacagaggaggagatggttggatggcatcaccaactcaatggacatgagtttgagtaaactctaggagatggtgaagaacagggaagcctggcgtgctgcagtccatgggattgcagagtcggacacgactggacaactgaacaactaaagtttataaaaatgtgaaaatactaatggaaagcatttgcagtgttttttaagcccaccaaaataccagcttttattaaggttaaaagaggcacctgaagccaaaaggggctgaactagagcaagtgcttccagccgcgtcacgcctctcatcccaaacgctctccctcccagacttttgaggctgcctcctgtccaaaactatggcagaaaatgaaacaaaagtgaaggccgcaatattttgatgtttgcatttttattacaatggaataaaaaacataactaacccacttcataaaaatgaaaatgaatctgcttttcaagcatcaccttgctcctcgctcctgacagcacccatctccgcccacctcagctcataacaaggaactgtgtttgttagtggcgcgccagacagaaaattaatgtagtcagccattcgcttgccaattaatttagtgaagcagcaactaaataaatccaattctctcaagtctgaacataaaaatatcagctgcatagttgatcctagacataggaggaggaagagaagtaactagcatttgtaaatattcataccttccacgttttaaataccttcaaacacattggtaggccctgacaggcattctttcatgtccaaccttacaagaactctgcaaggaaagaattactatctccactttacataaactcgctttatatagggaatttaaataaccgtcccccacgtcacagaacaagtttgtggcaaagctggg

SEQ ID NO: 42987 - DNA, 1185 bp, Bovine  19866880279736
ttctgtgtattcttgccacctcttcttaataaattctgcttctgttaggtccagaccatttctgtcctttatcgagcccatctttgcatgaaatattcccttggtatctctaattttcttgaagagatctctagtctttcccattgtgttgttttcctctatttctttgcgttgatcactgaggaaggctttcttatctcttcttgctattctttggaactctgcattcagatgcttatatctttccttttctccattgcttttcacttctcttcttttcacagctatttgtaaggcctccccagatagccattttgcttttctgtatcattttctacttcacccaaaactctgtctctgaggtttgatatggcattggtgcacagagaggctaagctttcataatactattagtaaattaaattctgcctccataccccgccccacctgcccctgacatgtcaactgccccctctcctttttccctagcaaaactgtgtgttagcacttaggcaaactaaacaacctgattttttgctggcattagatcgtcaatctctgagctacttgtcagtgtaaataataaccaatttatttcattataatcaaactttgctgtagtttgataagacctctgtgtctataccttagaaaaaggaaatgtgattttttttgtgtgtaactgaatctcctcctcatttgcatacccacccctcagatgtctggaaccaatttgatagtactccaagttgtattcttaaactttacattagctggtataataattatagggaacacacacaaaaacaggtaattctaccaaagctttatttaaaacgaatcacagccttcaagcagataccataatggaatgttaccagccacgagaagctctgaaatgaaaagttccacccttgaaaagtctatctgcaggacactttgtctggaagcttagtatcaaaggaactgctgggttataaatgtaatcacgagttaagactgtgtgccttcagggccacatagaattatttacatcagaattgagatccttccttgccaatcagcagatttccttaaacctgtgtgaactgactgggaaattatttttcgtagcagcaaatacaatattattacatagggattctaggaaatgggattaccagccattttcaaacattttatact

SEQ ID NO: 42988 - DNA, 1236 bp, Bovine  19866880344577
aaaactggtttagggcagtggttctcaaagcttggtccctgtaccagtaacagcatcagcatcatttgaggatgtattagagatgcaaattctcagacccctcaatccaaacctactgaatcagaaacccagggggttgggcccagtgggctgtgtttcggcaaacttcggtgattctgagatgcaggctaatgtttatacccactagtgaagggactgctgctgctaagtcgcttcagtagtgtcccactctgtgcgaccccagagacggcagcccaccaggttcccccgtccctgggattctccaggcaagaacactggagtgggttgccatttccttctccaatgcatgaaagtgaaaagtgaaagtgaagtcactcagtcatgtgtgactcttagtgaccccatggactgcagcccaccaggctcctccatccgtgggattttccaggcgagagtactggagtggttgccatagtgaagggacagagtgagacatttctgggcaaatgaatgcagattggaagctggaaaacaagtttttgggtgaaaacgaactactcctgggttgtggtttgcatagaggtgcaggagaccaacagagagagcagatgagtacaggggctgagaaccggcttctgtgattggccaaggtacaagatacgcatctgtttactctggaaataaggggctagagactgtgtcccagtgtgacattggcagcacctagagttatttttagtgctgctctttgtttcacaggtggaaaaagaaaattttagaatgtttccaaagaatgcagtatctaacacttcttagaattcaggttttcttctcatcatgcgagtcagaaataaagggtgcagcgtgattgattgcactgcagcccatcttacagtggaggcgccagcctcacctgcaggtggcctagcgtgcaaagctggggggtgtctagggagcctcacctgatccccctgagacggcagctgggggtccatgtgctgtctcacactctctcacgggcaataggattaccttatcaacatccacgacacccgagggccaagcaactcaggtcacgttttgctacataactacttcttatcttcgttaagcctggtgacagctttcctaccagtaggaaaacatgccttagcccacgtttgaggactccttgctaggtcaagttaagcaaaatctggactttcgaaaaaatatatagtagagcacgtaaaa

SEQ ID NO: 42989 - DNA, 2808 bp, Bovine  19866880359946
tatgaacatttgtagactaatgtaatctaaatgataatgtaggatcttccaagaagtgtttcccagatgtgcaaaaggtactcttttctatacagatctcatttctaccaattcaccaaacagaaactgctgtagccatcttataaatattcctttcctttccttcccaattatttttcttctccaaaacctacatatatctgagatttaaatgaaatatttattatcaccacaagaaatgaacctgatccaaatccactaaaaggaaacatatattacagtaagtcataacaacctttattcatctgtgtaggttctagatatcaggaaaattaaaatttatttagattttaactcatgtaaaaacacattttagtctttaagaaaaaacataatccagctcaattaactgattttaaacaaatctatgtatattaacactcttattaagttactatgagccagagcatttttaaataaattagtatattgtagtctccaagttctgcatgccttatgatgaataaatatggagtgttctgattatacatgtatgagcaagtagttttcattctgaatttggcattgcttttaaaaaaagttatatctgaatgttatatcttagagtgttgttctgtaaagagagccaagaatagctacactatcctcttctatatttttagaagtaatatggatttcagaagtaaaatgacttttaaaatccatgagacagaatggaattaaaaacaaaatgtaagatgaacttttcagtacttttagtctgtttcagtatatttattaaaatttccttttagtgttgaagaaaaataaatctaaaaaatattatcaagtattcaaaacctactttcataatgccgttaaagtaattgttcttttatccagactttgtatatcctctttttcaatattataaataatcacttttttttttccaattatttttatttgaccgcactgggtcttagttgcagtatgtgggatctagttccctggccagggatcgaacctgggccccctgcactgggagcacagaaacttagccaccggatcaccagagaagtccctaaataatcacttttatctctgtaatgcaaattatatcatcacccctcagagagttcaagaagaaaataaaatctcttaaatggattatattcacttcctatttggattctttttgccatattaatttaaattaatgaactgttgaccattaactgtataaccagtaagatctggtaaacaggctctggtgttttaatgtgaatttaaatttctactgatataaatttggcattgtaattttcatttttccaagtttacaatttactaccaaaatcatagtttttcttattttttttgatcaaaacattttccagaaatttcaatcggttctattcttttttattcaacttaaacaatcacattttttctgttccattagttctacttagttatgcccctgtaataaaatcagttacaatatctacttcaaaatatcatcctgcataatactttttataagtgctcttcttttcctcaagaggaaaattcatctccgccactaaacttgtagcttcagactggaaaactctccaaactctcaaaaaaaaaaagtatcttcctgccacttgcactgtaaatcaagtatcactccacactatagccacgaagtctttatgaatgtttagctatctgttttaataaaatgacttgattaccactgtacacagggtttgccggcacggctgtcatcactgtacctccaaagagcaaggtaagtttcaatccctcagctcaacaaaaaataaaagtgtggaggaagaacagatttaagctggaggaagctaatagtcctagggaatacaactgggcctcaacaagcagaaagacatcaaataaaaatttttaatcatgagattctgctacatttaaagaaatttatccaaagtactagaaatttttactaggactgtaaaccaaatacaaggatttcttttcctattaactaataaagaaaaattttaatgtttattttataaaactgtcactataatctttctggtaaaaaaatccttttttctttagggtcaatggcaaaaaatgaaaaggtttctccaagaattatacataccaatgcccaactaaacatacagttatctcaccacagacttattgaaataccaaaatttctaagaagaccaaaaagtaaagagaaatttgatacactactacaaagaacttttgagctagagaagaagaaatgatactgctctaatgctactggttaaaagaaactctactctgctatggaatgaggatactttatttttttaattaagaaaaatcatatactggtctactgatgtctacaaataaataacaactagtcaatattgccactcccaggaaaaaaatgacaaaaatagttttattattatcggtctgtaatttttctttagaagtcaatgatatgagattgttgtacctcaaagaattattatgtagaacttcatatataaactctcttaagaaatgtttcactcgtttccaagctatactaaatagcattaaaaaagagattttttcagtatattattcaattggcaataattatgttgacacttacaaaatgagaaagttaaaaataatgaacattttatgagatgtctacctgtttccacattctccgtctcaacttcttgttcttctgccacatcttgcatcatataagtctcatcatcataaaccagaacctgggctgcatagccctgctctaatctggca

SEQ ID NO: 42990 - DNA, 1232 bp, Bovine  19866880406837
tagattattttgcctttctcattctacctccgaatcttatcactgagaatgtatggcagttggcacaaaggaaagagtaaaacccaaagggaccagcatgataacttggagtgggctcagggatatggtcctcagagttggaccttgcactacaaatttgaccaccttggattcagttcacggaaaagactagaaacaataaaatacaacccccacctaccctcaataagctgccaacaatcttccctccaattcagtcaaggcagctaccaacatttgctttgctacaccttacgagcttggtagaatgattaaatcctttaattcctgtttctgctggatatttaaattcatagcctgggcacgaatgtttcctctcatctcactgccagtctgctcgggattcaagatcagaatagtaatttgaggattatgagaatgaggctggtcagtgttatttttcagatgcttctgggatttctttcaaatcttatttggtttttctcagacagggcaaaggaaaggagtgagatattctgctctttgggtgaaacaaaacaaacaaaaaatcaagaaggaaaaaaatacatgtagttgtagtccatcctttcactgctactattgtttgccctttcaaagaaaggttgtgtaaatcaagtttcttttttacccataagattatgatgggttgccacatgctgcgcatcatgcttcatcatgataaagaaacaggtagcttcaaatgaaagcatttgatgatatttcaggcatttggcagttgatcaaccccattgtgaagggacagtaatatccttgctttgctgaggctgtttaaagaatgtgaaatgtggatcatggcactgaagttgttgaaggtaaatcagatttgatttcccctctgagagcacaaaatgaaccttgtcgttatcaggaagagaaatgaaatctttaaatatttctcagtgttttgtcatctctgcctgtcgaagggatttaacataaatttccccaaagtaggaagtgcaggtattatttcattttatttcaagagataaacttcacagttttttccgtataaattacttgaaaagcccccaatttacaattgtggaggtagtttaagatcaatggcattttaaaataaaatattattagtcaaaaatgtgtttcatgttttgtctcctccaatagcctacagtccctgaatataatgatatcttagcatttatgag

SEQ ID NO: 42991 - DNA, 1267 bp, Bovine  19866880411401
attgtatcaacttttagagacaaagaattaaatgactttcatttgttatccttcaagtgttaaatgcaatcaacattaatcacattctgtagaaggaaatttcatctgagcttggctcaattagaagggaaggacagagatgggggaaaatctagggcagagtgcagaaggtggggatgtgcattcacaagatgaaaaataacacatgttgacattttgacaaaataaatacatctcaaacatctgctggtttgggaatgttttgagtactccacagtcttgttgacacagttctagaagtaaacaagaatccaataccaactgactccagctcctgcctttcaacaggggccagaaaacagtacttttacttgcttgaaaattaaaccactttaaattccttagctgcaatgacactccaagttttttttttttctctccattatgattgtccagtctttactgcctacttggagaataattaatgaaccacaggaaatatcctttctcatgaatacatagcaagaaatttcatcaggcaataatctctcgttcttggtatctcactataatccaagtagcacagggtttgaaaacataacttctaggtttgaatccaatcaaatcttgtggcataacactatctcctttccctctttatttttcaccataatatcactttctaacatccactatcatggatttattcatcttgtttattgtctttctttcccattagaatctagaatataagttccaagaaggctgggatatttgtctatggattcactgctgaattctatgaagtagcacaatgcctgccccatagtcagtgcttactaagtatcagccagacaaatctcactgttacaagcctgtaacatgttggtgcctagtttactagatggtgatgatggtgaaaatgataacacatgtgatcctctggaatatctcagtaacctgaactcagaaactttctttagggattctaacacctgcttctatccaagcagaatgaagttagagtaatataggtcagaaataaagcattcattttaccttttctcaggatttactattctgttacttatagttctttgattctttatctacagcattgtcttgggttggaatccagtgagaaatttgtactaagtagggatttgggaagaaccttttgctgcttgtcaagtcaagttattcagccagtaagcaaacagaattattgttgcctggcattcggtgcaaggagaccagaattcaagat

SEQ ID NO: 42992 - DNA, 1305 bp, Bovine  19866880431176
actacagtatagcacagggaactctacttagtactctaacgagctatatgggaaaataatcccataataataataaaaaaagtggatatatgtataactgattaacttggctatacaacagaaactaatgcaacattgtaaatcaattatactccaataaaaattaacttaaaaatggatagatatgtgactggtggagagagggacttgacttcattgcctggtaagacctaactggctccttgaatttgggaggaaattgtccccgttagctataactacaggaaagtgcattgagatttgaattccagattctggagggatgcacatgtttttgttttgttcttaacttcatatagaacatggtaaccaaacattggacagccttgaaaatcttgtttgcagtgtgacaactattcctaggcagctagggttcaggattcattgagaaatctacatcttgcattgtgccaattgtgtaacttctcaggaatttatcttgggagctgtgataagaaatcacaactgagactcaaaacattaatttcaaatgcaaagaacaactatttcagagctatcttcttgaggaatatttgactttctaacattttaaaggaagctaaaatctctaagcaagaagttagcacttacataaattttatcaggtcatgcaaaattgtgttatttttgattttttgaaactctgggggtagacattttttctaggtttacatttttctaggttttctaggtttacattcattttattaaaatgactactgtttcaataaatgataaataatattttctgttttcaactcatccctaaaagacaccctaagggatctctggttgaatgaaattaacctaaaaataacattcttcccattgactcattatcttgatcattgttgttcagttgctctgtcgtgtccagctctttgtgatcccatggagtgcagcacaccaggcttccctgtccttcaccatctcccagagcttgctcaaactcatgtctcttgattgagttgccctttattggtttggcagagtcatctttatcttgggatactgggaaggacttttattcttggtttgaaaatctcactgatttacagaacaaaccttcagcctgatctttttccttttgtcagttacgtaagtcgtgctgtgtgaactaacatcttgtcacttattgtcctaaagcaagagccagacgggtgagaaaccacctactgtcgaatagaaacaggtgccagaaggcaaccgctccttgctgttcagctgtgccccgaggtatcaaac

SEQ ID NO: 42993 - DNA, 1566 bp, Bovine  19866880434549
ctcctccctagtttggcttcctaagcagagatttgatgtgtgcacaaaacacatttaagttcaattggcaaatcttcacccagaggtctcagggtcctgggagtaaagacagaagccttcgtggcatccagggtcagcctttatgtcccattttagatgaacctccatttcacgtcaccccgccccctactccttccttctcacaagaaaaattcctcaaggaaaagggaaaaggctctcattttcccaccaccccgacactgcagcagaaagccctgtttatatagggtttgttctcaggagaaaatgccataagctatatttatctctaactaatccatttctctctagtccaagattaaggaattaatgactgctacagctgctgtccttagcacattaattactataaattggctacagcctcaaaaaaaaaaaaaaaaaatccactcaatgacaatggtgagagggcaaggtttatgcattagatatctaacctaaacagtagatcagtatagcatggagcccaagaagttatataccagcttgggcactgggtttccacccgcaggccgtaagcatggagaaggggtagaggtgggcaagagagggaaaaaatacattgtatatacacaaactttcctcaagacagatcaaatactaaggaaaattgctcttggatccataaaagcctgcatcatcataaatttccttaggtcatttttcgaaacatggactatttagacatttcctaaaatccttgcagacgggacaatgattatagacaatgagcacagatgttcagaaagacttgtctgccctggtttccttgaaaatccccattccaaggctcacacaattccatcttcaaaatcatctcatcttccattttctctctctgtgacacatcttccccttctctgccccttccccatccagcgtttcacagctcttatcaatgtcacctcctctgggaaactgttggagttcctctagctgttacaatacacttcaaggagcttacattttcgttccctagacccaaggccatgagcaccctgagggctagacttgggtcatttatattaacacacagttgctcctcacaagtctcaacatccccttgccccacccagctcttgtccttttcttcatcgtcaaactccccctcacccactcctttcctacctcactcctctagattctggcttcttgagcccatcactccaaaaaaaaaaacaacaacaacaactctaataacagcttgctaaatcccaaggcccaccacagacgcaaacaccccaagttataaacctagtgttaggccgcttcagtcatgtcagactctgcaacactatatacaggctgtagcctgccaggctcctcggtccatgggatttcccgggcaagaagactggtgctgtgtttagtcactcagtcgcgtcctactctttgcaaccccatgaactgtagcctgccaggttcctctgtccatgggttctccaggcaagaatactggagtgggttgtcatgccttcctccagggaatcttccccacccagggat

SEQ ID NO: 42994 - DNA, 981 bp, Bovine  19866880459408
gacattaaactgtccatttcaatgcccaagatatatgaattttctacttcatgtttttagaagatatctcagtaatattcatataaactcactttgtaaactattacatcatatttaaaccttattcctaaacccctttaaatgtaattagcttccagtcttatataaagtcatactaccttctgaagaaaagaagaaattctgaaactcaaatatccaatcctatcttggtaaagaagacattattctgtgcattctggcactattctgtgaccacagcactagacaaagtgcataatttacctcacgatacagactcacagttaaaaagaaaggcaaatctgattactaaacaccagattactgttctatcatcactggattaaaatttaaaccacacagttgaaataaatgttgatgaacacaagataggaggtgaaattcatagttgtacaataaagtgttcacctcttctttcatgaagtacgatgaacttaaaggctattctgcagcgtagctagctcctacaaaaaaagagcccaggatgctggcacatgagaaacgttagaaactattcaatctagattactcttggggtaatggagtattttctccgtcctctattgacatggaataaaaatgctcaagtagagaagggactcggctgcccagctcgcaaagctgctcaggcagtcagttccagccctagccaagccttcaccgtcctcttgccgcgtcccccccaccctccaatacccaggaacacggtcccggagggccagcttcgcgaagagaggctccataaggcggtcactggacgcgcgtgttacagagcccgtttttgttttgtttaaaaaacagattcctgtcagagcccagcctccccactcccgcgggaacagggggaagtggcagcagggggccggtgtggagtgagagaataaaagaatgaccgagtacaacctgccgtgccagctagca

SEQ ID NO: 42995 - DNA, 1050 bp, Bovine  19866880505793
cgcaggtccggaggaagctgctgccgtggatagtgctgaaggtacaacggagaacgaaagcccctggtgaatgtgctgaactggaagaaaattctccagttgagtcagaatcctctgccggggaggatttacaggaagaagcctgtgcaggttctgaagccgcctcagcccaaggctaatctcatgctgattgacacctcagcaaaaaaatgccgtagaggggctgataggtgtttttgtagttttagtaaccttagattgaaaacaaaaaaaaagcttcttttctggaaaatggtattgtgccttgaggatttttgtttttgttatctactgatcgatttcagaatggagagatttgagattttacatgtctgaatagttttctgctctctgggatcagagtatgacatagcagaaaagagcttaaagaatttcatctgtgaatttaaattttatgtgacagagattgagctatctttacaacctgcattcacattaattttgttataattctacctttctttaatgtatgtaaatctaggttcttgagttttaatttgaactctaaataaatttggaaaatctttagtgcttctattattattcactcacatctatatgtatgaatagtatatattaacatgcacacatataacatcacatgaacattgcagttttatcaaagaaaacataatctatggaaaactctgtgtacggcaatacgtctatcctttctcccatctatgttacatggggactgttccaatattttccatatcagcttagttctctttgagcaatgtttattgaggacttacacttcgtgctagggatcattcattcattcctatattcagcaagtattaactgagcacgtataatttaccaggcactgtttaagtgctgagattaaaaaaaaaaaaaaagcaaaaattcctgcccttcccagctcatgttctagggtatatatattaataaatactctgtgctgtgcttagtcactcagtcatgctcctctctttgtgacatcatggattgtagcccaccagg

SEQ ID NO: 42996 - DNA, 1547 bp, Bovine  19866880516022
atgatatttgataagaaaagtccctttcatatggagtgttcttagttggatacccttgatttagggttacttagggtcaacaaacctagatgttatagatttataaggcgtgattcctgaagaagatcatgttatctatacacctacccgagtataaaaatgaggatgtttcatgacctaaaatccccttgatgtgtgaactgacacgtcagcctcatctagagacccccatatatcattattctgtccagagggcatgtgtctgatatggaaagaaaggacctggggtaccaactagggttggttgatttggggtaaactcttggatttgagtgagtataatttgacaacctgatcctttaggctagctcacttggtttgaacaagagattacagggcaccctagccctccgagcatcacgtgtttttgtgacctcttgctctgtgtctttgtgtcatgagatggggcatgttgcatagaaggaatttttctagaatcccactgatgactagacacagagaggaccaataacttcttgggtggtgctgatattgccattctgagttccatgttttgagaaccagcagtttaaaaccgtcagttggactctctgggtcccagtcccattttggggtttttctctgatgacagtctgggaacatttgaaacctcactttccaaatactgcttacggttgcttctgggtcttgccttttagtacttaagtataaatctatttgattccacagaaccactgaattaccagttttctagtcccagcctctctcaatgtcttttagcaccatttaagtcagagacatttaatttccaggggccccagtgggaacaagtacttgacagaccctcagcaaacttctgctgtttagaaacactgattgtaccacaaggctgttgaagacacagaggacccaagaaatagcacccttttccctacagccctgttgttcagaacatcattttggagaaattataaggaaattactgatgccaagatctagtaataaaatgccaacctcatagagataccccgaaatggatataaagtttctcccatgatccaattcctagtgagaaattaaagttcaacaatcaaatcttgaaatttcaagtccaagtatgttaaatccaaaggatataaaactagaaatatatatctgtcgcccttgagttaaacattctgatattaaattggagacaaatcattgtctcccgtttctaattctgctgagtcactggaaactccattccacccagcacacataccaagtacaacccagttcaagaggcaccacctctgctgagaccgtcttcacggttcagagcttcagctgaaggccaagtggactacaccctttgtaaccgagcaggaccctatggggccttcccaggggagatccctcctccatagtctctgctgtatcgcctctctgaagtaattagataacagtatctggcccccatttcctgagtcattttacagatgctgaaacccccaccaaacgtaagaaattaactgcggaggatc

SEQ ID NO: 42997 - DNA, 2000 bp, Bovine  19866880524116
gtggggggaatgagggaacagagcgggtgttgggagtagagactatccctgacagttaaagtggaatcaatacccatttcttcttgggacgcaagtgcatcatttaatttctgtgcatgggcagatcccaggcattccaattaacagtccgtttttttttcccccatatagagtgtaataaagtaaacactgtatatttgaaaagagagagacaaaaaagaaaaatcatgaaataaaatgtaaaaggcagaaatcctgttgccctaaggctagttaggtgcttttattcaaaacaaaggataaggtaaccacaatatccaaagtctaaaatgaggctgcttttagagagtcaccagcttgtgagaggatgctagggaccagagagggaagtggtgagtcagggactgggatccctggccccagaacttctctggaagctgtcaggaggactcagtgtctcactgggacctgttattccaaggccaataatcctaatttgtggatacccactaaatgctggtgactttagtgacctctaatccttgcatagtgacctctatatcctgtgagatgggtattattttcatcatttcataaggaaggttatggaggctcagagaagttaagaaacctgcccacttaattgttaacaccaatggagcccttatgcaccggttcaaattgtaggcactttgtatgcagtttaatcttcactctatcgctgtgacgtgtgtgtgtgtgagtcagtcattcccaactctatgcaaccccgtcaactgtaacctgccagactcttctgtccatggaattctccaggcaagaatactggagtgggttgccattcccttctactgtagacagattctttaccatctgagccaccagagaagtccatccctgtgataaggccactcttattctctccatttcacagatgagaatattgaggcactagatgtaaagggactcttcccaagtcttgtggttggtaaatgggagggcagggattcaaaccagccttttttatttttccttcctcaccatgtggcagctctagaagctgagagagggaattccctggtgatccaatggttaggacttggtgctttcactgttgagggtccaggttcaatccctgctcagggaactaatgtcccacagccgtggggtatggtgggaaaaacaagtgaaaaagaagctgagtgatactacaaacctcatgaaattcagaaaataacgaactatttttattaatttattttctaggatacttttattttttcctcctacatttttgggcagcacattttgattgactctttatataacaataactttgtaatatcaatgtctattgtgacaacagaaagataattcattccttcctttagcttgagtgatcaaatcttttttctaaaaaattagagttgagaatgcatgaatcatgtgatgtcacatatagacaaacttgtttagtacagctatagaattttggcctctgataaaggaattatgatacattctgtttcgcgcagttcttgaaaaaaaaatctactgcatctatagttgtataccatgcattgttgcatctattcctgacagaaacttttgttttgactagccttcaagcgaattgaatcttccagttacaattttacatgtctgaagactaaaataattttccacagactagcttctggttccctacatttcaaatcttgtttctcttctgcaacccacgtactttcagtgctgggtgctatagagcaggtgacaatacattctggtttatttaggtcagtcccagtttatagctgctgtcttggcgtaattactaacagggcccctttttgttagccctctcaaaagtgccttggtgggggaggaaaggagttaaatcagctcatttgtgatctttgggtcctctgattcctgggggaatgcttttggaaaagaaaggaagtggcctggttttatgtgcctgtaaacatgctcttggg

SEQ ID NO: 42998 - DNA, 1097 bp, Bovine  19866880529536
tcttatgaggagagcatcctgcctctcactttacagatgaaccagctgagtctcagacacacataataaatggtggagtcaggatggaaacccagattttttggcttatacccatgttcttttaccaatatcatgccatccaatcaggttgtcacaatgataaagtatgatatgacagaactattttttattttctgtactatatctcaaaaattggagctgctcttcagtaattgaaactgaacaacaaacaaaaaaatcaaaatctattattataaacacaatagagacatacggaatttgtcctctcttggtttatgtactatctttagctgttagggaatttaatttttatatgagagaagcagcacattcaaccaaagggatgtggattacatagaaatgagctatgcttaaaagggacccaaatagccagagaaaagggaagaagaggacaacattaatacccgcagcttcagtaatcacctgcatcatttattatgactactgtctattgctgtgtaaatatatcacatatgatcttatacaagggggatttctgtaagaagtattctgcttaagcacaattggatttcagataaatcccatatatctgtttcatatcaccctttgttacaggatttcaaaatgcttgtgaaacactaaggaaatgaaatgctatctagtctcttatcaaaagagcaagagtattgcattgatggttatgagaaacaggagcaaagagatatttcaaaattgcgtgtatgccactcagaaccacaaccctgggtttcagaaatcacctattgttagatattttcctgggaaagatatatttccatgatctgttttgctgtactcaatactgttttaacctcatttttattgttcagagtaagcattgtattttttatttccatgataccagattttgggaaactttacaaagtaaattgaatctatctccataattccaggtcttggtttttttctttttttccctataggatgaaggtaatggttgtcatctcaaccctggaaaaatgccaaagtcaagtggctttcagaataaagagagcctgtttcttgtgactgat

SEQ ID NO: 42999 - DNA, 816 bp, Bovine  19866880828346
taaatgaatggtaatgtagtctgtatatatccttgcatgagaatgaggttaacttgaacttattctaataaattcacaatgaacttgaatttggaggcacacattcagttccaagagctgctacatcagtagaatattcagtactgctttttgtgataaaatttgacattggagattacattaaaattgatgttagtgtttgtacagatatttttcaacattaatcaaacacatgatgggaaaattttgcaacaagttaagaaattaagtagttgaggagtgataatacaaccaaagcaagtaatagaaaccttagtatgtgttcagaggggaatatgtattcaatataaacaaagctgctgaatctactttcaaattatcatctaccttctagaaccataaattgtaataatttacaagtgacctaaaaaatcctcaatccaacctttgaacagcataagaattcctataataatatctagtaaagtggtcctttagccacaattttcattcctaagaactatttcaacaccttacaatcattagaaaattcctattagtaataataatgatattaatagctatcttaccctgaggttctaatctgtgctgagcactgtgctggatgttaaatatacatcctctaaattagctttcagagaaaccataggaagtaggtgttagttatctatcttcattttactaaacagtaatagcatgcagacaagtagccagggcagagagaaattaaaaaaagaagtccaatggtcagtagctagcagttacattctttacattcttctctcagtgactgca

SEQ ID NO: 43000 - DNA, 3387 bp, Bovine  19866880835883
aaacttgaaagagcagctcctactctaaaaaatacatgagtagaaaatactgcgttctgttgcataaaactggaataaaagattctccctttctgaaatagctatgtgctagggaaaagggtgactgctggaaaggggcagaggaattcatcacccctgaaaacctttcactttcacagcacaccatctcagaacgcctgtatcgttatgagatctcgaacttagtatttttttttaaaccatggtttccactgaaatgaatgggctgcacaaggaaactcaaaaatgtttaaagacatacccaaaaagcagacaaacttctaccagagtcactactgaggccgggaaacatgtgcccataaatgcgttacttacttgtgcctgccagcatatcacctacaagtgctatctttaggcggggaggggaatagatacagaagaaagggtggctgcggttttacccacatcagtaaacaacaggaccatctaccagaaccgcacaccccagggctcccggataattgtcagaccaacttttggcagctcgttatcaattcagtgtgggtgctgttttgtaaacacatctaatttggttttaaattttaatccataaagtcattactaaaggactccaggctgctgaaatgatgaaccaactgcttccaaagcagacagaaaggcaccagcgccagccagggctgcctgtcctcccttctttgcctccggattcaccttgtctctcacctccttcacagcaatgtgcatggtctcctactcaccgcagattttctgttgctacccaaatgctctctctccctgtctctctctgtgtgcatgtctgtctgtgtgtgtatctgtctttctctatcagtctctgtctttcagacagacagacacacagacacacacatatatatatacacttgcacacaagttgtttgtctctttctgatgcagtattccaatccctgcctcctctactcttccagtttaatctacttctctaacataaaaattgttctttaacaaaaagatcagtctgaaggaaagaaactgtcttaaagagttaatggcagggaacatagctgactgacagatggactgaccaaccaaatggccccccagcatctcagatatcgccctcctttgagaattggttctcatgggtacttacccacaagaggagagggttttttcaatgtaaagatcaaacactgaatctttcaaaacatggcatatgataaaatctggtttctctaacagattatgtaccaaacctagttctttggaactcatagattttaacctgtatgttcacccttcataacaaccttgggaggacggtattaaagctcctcttccctgtttcatgggagactgaagcacatggaggtcaagtaacttgccccaagtcacacaagcagaaagtgattgtcaggatttccacccagataatttgtctccagagtctgcttttaaccactactctctgctgcttcttatttgaatgactgcatttttatctaattaacagagaggaaattttgcattcactttttatgcatctatcattagattttctctcattagttttctctagcgaagaaaagagatgactgatttacctagtggcgaattattaccctatttaccctattaaataaatatttactctgttgtgcagatcagtaattgctcaaaactcctgtttatgactccccaccattaaccagagatattctagtaaaccttttaccttccttcacctcactccttttgacagtccatatacctaaccatggggattccctggtggttcagatggtacagaatctgcctgcaatgcaggagacccaggttcaatctctgggtcaggaagattccctggagaagggaatggctacccactccagtcttcttgcctagagaattccatgttcagaggagcctggcgggctatagtccttggggtcacaaagagtcggacacaactgagcgactcacacagacacacacctaaccatatccaaatccctttctgaaaagcagcctattaaagaaccactctcagggacgtcgctcaactgctcagtgggggttaatagcatgtcagagcaaccaagcaaatattgccctggagacccaaaactcaggccgggcggcttccctggagaagaatccgtgtggatctagaaattcttcatgcgctgtgctgctctgcaatagcctacctcacttccttgaattcaaagtcaaagtgggcaaaataaactctccaccacttgggaaagccgggagacagaatacattcttttctgtaatcatattttcagggcttccctggtgactcggtggtaaagaatccacctgccaatgtaggtgacacaggctcgatctccgatctgggaaaattccacatgcctcagaacaactaagcccatgcaacacaactactcagcctgtgctctagagcccaagaaacacaactaccgaagcccgtgttccctagagcccgtgctcccagcaagagaagcctccacaatgagaagcccacacgctgcaatgaacagtaatccccgctcgccacagctagagaaaagaccgcgcagtaatgaagacctagcacagcccaaagcacatacataaaattataaataataatgttttatgttctgcaggactggtgtttttcgtgctgtttttcccaaagtatgcttcgttttaggatctgaaaacccaaaggccccaggatttttttttttttttccttctctttcaaaaatggatggttctgcttttcatttaaggtgcagtttagaaagaagcagcctgtgaaaccaattaactaattggaaatcacttaataactgtggcagcatttcggatttctggcatgggttcacagcagtcaagagaaattgctttccaatattatgataaggtaagctgtggaggtctcaccgggggtggctgaaggctgctgtgagcaacaatcagctctaatctgcccaccaaaataatggagacattataacacggaatccagtgattggaaaggaagcacgacataaaattccaaagatatgcggagatctgctgagaagaaatgtgcagctgaagttcctggctatgatgtttgagagcttccaatcttcatgcagatattatgcctttgaaatggctctcagagagacagccagacatgtgggggaggagacgtgacaggaggaaaggaaaaaaaaataagagtaaatgttcaccctagcacaattgtccaactaattgttttagtatggagagaatcattgttcacattgaggaaataatccagttaattgctcaagagttaacagagccagagaaaataaattaccccaaacacaatat

SEQ ID NO: 43001 - DNA, 793 bp, Bovine  19866880923276
tcatgtccaaatctttgtgaccccatggaccggaccaggctcctctgtccatgggattttcccagcaagaatacaatattacctgtaataagtcaaattacacacaggaacttcctccatagccccaaatatgtaaatcagagacagaagtaaaaacaaaaatcattaaatcttttaagaatctaatcacttaagagagaatattatcaccccaaatattcagtggaaatcatccaattgaaagacagaatgtgtatatgtgtgagtgagtgtgggtggtggcggggggagatggaggaagagaattcggagacagcatcagcaaaaagaaatagaagtggttttcatgaataaaactctgaaaacacttcactccacttgtgcaagaattatggagagcagcattattttgctgacccagcaagatacttgcttagcaaatctcttgactacctaagaacactctgtcaaattatttaacttgttaataacttctaaaaacagaaaattcttggcagcctcttcgctaagaggcatcgctctcatttcagagccctcttcgctgctctcgctgcagttactactcaccctcatgctcttcagtcttcctcttgccaccgtgggctccaaatcccagtctacctacttctctctgttcaagaacctgcatcacagctcttcattctcatgtgtccttgcccagactgaatatattcagtggttccctccaataagcctcttatctcgccccctataatttagaagaggaattctgtgcaggtttaaatgtagt

SEQ ID NO: 43002 - DNA, 1471 bp, Bovine  19866880956911
tctcagactccaaagtgcatacaaatatcctgtggatcttgtgaaaatgcacatactgattcaacataaggcatggaggggcctgagattctgcatttctcacgagctctcagggggcactgaagctgctggtgtatggattacactttgggtagactgcagactgctgtctgcagcaaacctctgaagccatcttcagttgggtgatgattttggagcctgcccctctgattctgccagaattcatggagaatgcctccttgtcattttttggtgaagagtcattatttatgactactgtgtatctcttttctccaaagaggaggtctacctgcaatctataaagcccatatatagcaacgcatctttttctcagagtggtgctaacattgctggtggtgaagccctaagtacaaacctgttttaggaaagaaattcatcttgttagagggagctgagtacttacaaggcagataacgttctgcagttgctgaattgatgaagagaggcaccgggattcagacttaactatttttcattctttgaatgaagtctatcttctgaattacatgagctgtgtgaagcggggaaggagagcaatggttctggaaacaaaaacagagttcttatcttttaatacaggagagaatgcctcaggatattattatttgtgatttatggggtgcatagcaatatgaccggtgtctctccacagcagacagaggactctgaccctctgcctttgatgaactcttgtttcttcccaggggcaattttccactgtagaatagctgccgcatcacaaaattttggcttaaaaaaatcatactgaatgagctgcttggaaacttggtttttgttttcagtcctgctactgactttttctaactttgtctaaattccttttatcttctgccctgttagtaaggtcaatcactcttgctatcaaacatttgcttttgaaataccctgagatgtttattagctaaattagtctcgagtatttgtgaaaactcgatttccttctgaagatacatcagattcctctgacaagatcaaactgtgtaaatgaataaaaccaactaaacaaacaaagcagaagactcctggaccatcatttgtgaggaaggagtagaaggcaaggcaagtttcccccctccctttcttccttccttctgtcttttttaaaactttattttgaaatatttcagatttatagaaaagttgcaagaatagtataaaggttgcccaaatgttaacatttttaccatgcttgctgtcatctctctctttccatctatatctatgttttgttgacccaattgagagtaagtgaaagacaaaatagatgctccttatgcttaaatacttcagtgaatattctaagcatgtacgtaaccacagtacagttattaaaatcaagattaaactgacaacactattaaacctatagactttattcaattttgaa

SEQ ID NO: 43003 - DNA, 1331 bp, Bovine  19866880970842
cagcatcctgcaggtaagcctaatgggatttgactgccagtacgcctcagtgtccacctgcagccctttgagaagcttctgattgggcttggtgtgctcttcatgggggtgtcaagcctcactgtaccttctccagcaatctcctgtggttctgaggaaaaagaaacatcccttgaaaatggaggcacattttacacttaatattcctcaaatcactcttggcggcttatctgcttttccagcaattttatgatagatatcactgattattttgttaccagctacctacagttggtgattttttaaaataaagatcataacatgagtgacagtatagcgttcactatcttgtctccaaaggtgttcacatacatctatctatagatagatctatatgaggatgggaaatagaccaagttgacttgtgattcctttcctcaaatttccctgtgtcatggctctgatcttaaatcttatttggcaagtcacagaatgtgccagtttatcaaagagataaaaaagtagactttccccctgccttctgaatttcaatgaaaggagtattcgtctttactattgatctcttccattgagtagtccttgtgatgattaccacttttctgtatttatggagaatcagcacttcataaatgtcaaaaggcactttgctttacagaactgtcagtgttctaacatctcacaaagttagcaattatcacgagaaaccacgtgtggaaactggaaaataaataattactaaggaaagtaattttttccttgatagaatcaggaacagagcaagcccttcattctctgtcttgttttgattgtccttatccatggaggcattgtgatccaggaactttcttgtctccctttcccacttgcttctctgcatcagagttcttctcctacagggtttgaatatcaagtgggctataaaaatctcctgcaatgggggatgcttgtattgcaacagaggaaattacattttgatcctaggaatcagaaagggcaaacttttggggtccaatgtaattattttattaaggtttataaagaaatttctccatacttttattgagagcataagtgaagatttctgacagttttcaaaattgggggtggaggttctctaaatgaatgtcctgactatttaccctccactgaattggcttcctctttcatgtcctgtagacataatctgtgcttggaaggtggctttttatttttttggtccctagtaatgctacttgaaaagttgtcatagcaacactgggcacggtctcagataatataacaggggaggaggggcctccacggacttcagg

SEQ ID NO: 43004 - DNA, 900 bp, Bovine  19866880977699
cctatcaaaattctaatcagttctatttaaattacattttttgcactgcattgttataaatgctaatttatgcctagaatggaacagctttatttcgtacctcctgaagaaacggatgaataaaaacatacttctacagggcataaaagattatcaagggttcaacaactattggatttgcacttgccaaaacacatcctgaaactcagagctgaagctttaggagacaaggacatttggatcctcccaccacaaagctgtccccgttatgaggcagaggattgtcacagcagcatctgcaaccacgaccagggacttcctgccattggggacgagagcagctttcagggtgaggaatgaaaagaaggggacattgtcactgctgagaatactgatctcccacatcttaaaagcagatggttatttcagaatctctgggtaacttcctcgaattgagtagaatttctccaaacctggtaccccatctgctttttaaaagatgtccatctccaccagctcgcaagaggtgactgagttatcatagcaaatggtaactccatatctccttttacaattagtttggcctcccaaccttagtacagagtgccactctaagcagtgagacgtgctccagccaagaggagaggaagcacagttttcagggaaaacactaaaaccacctgccctggctgggcaagagagttgccacttgcatgaattattgttgcatgaaactgactattgttagtttgttactccttgcatgaaactaacagctaccaccaatggggaagaattcgggaaaggtcaagaggagagaagaactgccagcccacatgtcctacagacctcccagattcattctcgctggcatccatcttggctgagcgatgcgtacac

SEQ ID NO: 43005 - DNA, 2445 bp, Bovine  19866880979860
tgattcaaacagaaaaaaagaacccactcaggatgctggagatggactggagcattgtgttcactccccacccccccaacccccaggatcagatgaacacaggtttcagcaggagtcaaagagtaagtggaaatgctctttacccaatggtgagtttagtctcctcagaattccctatgggcaatcttgatgttttaaggccaaagatagtggggaagaaaattgggctttttattttaatgcccacaaaagagtaggaagataaggttatgaaaaacagagtcaagaatacttttaagttaccaagtacctaaaaggatcaggaagtagaaaaatgtgcagtgactccctgatcttccttctgtgttgttcagtcggtcagtcatgtctgactctttgcaaccccatggacccctttggtgtatcaagctcttactataatctcattttggggcaactacttttagggctcaactactaactcctttaaacactatgaacatgttaaaagacacaattaaaaatctcaattttttgagaatatctaatcagtataacattgatcataaatatagcatatatttcccatctcccttgatggagaaaaaagatactagaaacaatttcacccaatttcccagaaatttataaatacaccctaccttttttctttttcattggttcatggctatccggtgatgtaggaataggagaggtatccattggttcagattcttcagttgacacctccactacagtttctgtaatgacatctggcctcatagcagcatggataaattctggagttgatacacaaggagggacaaacacttccactataaaaaaaagttgaaaaattaaaatttcccacccctatcaatgcctcttagcatggacaattcaatttttagcaaaggtgaggttactaagaattcatcaaagcagggtaagaacttgaggctaatttgttgaatatacgatatgatctaaagtatgtaagtaaatagatgcaaagaaactcgacctgaaggaaatgttaatcttcggggtaaagagggagatcatgagagtcaaccctcttgcttcacactttaggtactttcaagttcactgtaaaagactgtatcattttgacaactgggaaaacagttgaaaataaaacagtataacagtgagttaataattattttccttctacttactcatcattattctctaacaaggtaaaacatacacctggtataacattaaaataatgaaagcgtattcagtgaaagtaatcacttatggctctctctctctcttttttttttttaaataacttttggctgtaccctgaggcatgtgggatcttaagtttgcccaccaggatcaaacctgcaccttctgtattggaaggctgagtcttaaccactggaccaccagggaagttcctacagttcattttaaatatgaaaagaaaacctgctcattatagccaaatgaatatcatctttcaatcttttatgtaacagaacagtccctaatattttgggtcactgaaatggcgcatacatatttttagtattctattacgtacaataatgttactctggcttcctttcaatgcgcctgagtaactaggatatgacatttccatttcaattaatacatactactatagattaatacactgaccaatgtgcactaattttcttctcatattcctgaataacacacaggattactactctaattaaaaagtacagttgatcttagtatttactgtaaatccctaaaagaagggtcaatcttaccgtattaagtcaaattaacatttggacattaaaattagggacaaaaagattctcaaaggcaatctgtaaagagagaccaaaaccaatggaaaacctgaggcctgaagggagtgtgaagagaggtggacagtgcctcctgtctcttccagggagtggtcccagaactactgcccgttatcactgaaggaaggactcgatgtggccatgggtggcaacagctcccatcagccattctccagccatgctcttaaggtttcttattcacccaaagttaaggaaatgagacacaacagtaggaacagcaatttgacatttatctgtctacagtgggcatcttctgactcaattattttgaaaattaagtatttaaaggatttaagacttgtgaacattgacaggtaaagaccagttactgctgtcatagatatttatgtacaatagactctgagaacaacaattcccttggattaaaaaaaaatttttattctagatacatgaaatgatatatctttaatataataaagaacagttcacataccagggcttcttgaatctctcaagcaggtaggagattccatatgaagcagggcttcagcagcttcaattgtcttatctgtacagtgtgcattactgctatgaactgatgctt

SEQ ID NO: 43006 - DNA, 814 bp, Bovine  19866880993069
caacatgagttgcctttcatgtaccacataccccaggcagaagcaaaaatgcccagcacaggagagactgtagacagtgtaactagggtttcagtttagttttgcctgcaaatggaaaacaatttaagctgctgctctactggttcatgaaagtggtcagagctactagcacagaacatagtctcagatttgctgggtctaagactctagaacagcatttttcagacattttgtaatagaatcctttgttcagatggattcttaaggagagctcatgacaacagagggaagaggagcagctttagttgaaacagagaggggaggcctgcctgctgctcatctcccaaccagagagagtttttgatgaagggcagtttaaaagccaccctcagattttaattcactcagaaagagtagctcattcattaactggccaggctgatatattatgaatatattacgaatatttaaaaacctaagaaacttttagattttcaaaatatgagactacgaccttaaaagatgaaaagaaagttagctaagcagttgtcccaattatttgctgttcttttgacaagtgatcccaatactttaatggcttgagataacaacatgcatttaatttgtttctgaattgcaatttggatgggcactgctctgctccagtggcctcaggctggggcaacttaacaaggactggaacattcacttccaagatggtttactcagatggctggcaggttggtgcgctattagctgggagctcagttggggctcttggattggagcctgattagttttcacagaaatctct

SEQ ID NO: 43007 - DNA, 1564 bp, Bovine  19866881002329
caattcatgaaagtgaaaagtgaagtgaagtcactcagtcgtgtccaactctcagagaccccttggactgcagcctaccaggctcttctgtccatgggattttccaggcaagagtactggagtggaacatagcactagcttttaattttgtcagattccttccatacatcaaatagcaggacatataaagagaatttttggaacaactcccataaattctacatagctgtaagttaattagaaaaattttaaatattaccaaaagtgaataagactaaagttcatgaagagtatactgagaacatgacaacattcagagctgtcacattttataactgtgggaatgacattcgtgaaagccatgtaagcgtcgccctctggagttgtgcagtgtacaatgtgcgtgaccatatgttgaggtcctgatgtcttctacagtgttgtcgcctacagtcttgttccaatatgttgtgtcttgacaaacagtcctactttggttttggttttccaaagagccttgaagaatctaataccttaaattctttcccaaactgatagcagacaatgttgtcacactgataagcattatgaaattcagtcttaaataagcacaattgatactctcattctatttgctagaaagatcagtgtctaggcctgtatatgtaaattatgttaattgaactgggaatccacaaaaacagctgaatttaaaaactgtatttacttgagaatatcaaaagagctagtcaactctttcaaaactttgtagcaatatactgttgttgcattatactttgtgtgtttgctgatgtctatgggggaaaaaaaaacataatattttcaagaatacaagaaagaaaaaccacttcatcaactccaacagcgtcctatctcaatctccagaaaactgctggtttattcctctccttccaaagcacctcattattggtcccacggcatccctccactacagctattgtgtcttaattttttatttctttttttcaattctctaacccacccagttcagcaagccgctgttgatcttgagaaatcctttgttgcaaatcccacagagcttccttctgcagagaactgccccctttgaagacttgccccaggggtctttgtgctagctgcttcagtgaaggaagaaagaggtatgccttaggtaagagcgtttgcaaaaccatttcaaacggtatttgtataccttcgtagtcatcatagattctctgctgaccgaagagatttgcagctttataaaggctgctgcagatgcttagaatatttgttaatcttttttttttcttttgaaacaggcccaaaaagaaatgacttgtgggcaaatattgatttcttttccaaagatcaactattaagtacaaaggacacctaaacgtgaaaccaaaaggtttacattgtcagaccgggacagaagatggggaagcgaaggctgtgctttcctatttcaaaacacaagggctgaggtacaagtcacaatataatgcctgtggcatgccctctgagagtctactctggaagctgaagggaaataaat

SEQ ID NO: 43008 - DNA, 1451 bp, Bovine  19866881033205
aattgatagttggctaaaaactggttagttaattaattattcaaaagactggtctttagtaagaaaaattacaaaaacaaagcattgaaagccttgccagaactctgaaaggaattttcatgggctgaatacaggcaggcagtgggcatccaatatgcagaatatgaatcccctctactttttttgcaattttctttggatggtctcaagattcagttttgtatgcagaccaggagtgattaaaggcagacattgggattccagggatgggaaatgcactaaatctgacataggaacatctgagtcataattctgtgtttcttcgggcttctgatctgtaaaatgggtaatatgcgtgctgccagctatataaaattgttaaaaaaaaagacaaaatgaactactatttcaagagcatgctgaaaatctgttagagacagaaaaactagagtacattgtggtagagtaggtacaggcaggggaatgccgagagtaaaatgcaatagaaatggatccaagttccttgaggtaagtggttactctaggccagcagttcagtcctgaccacacatccccagtgaatgctttaaaatatacagatacctgctgctcacctccagggtttctgctttaaatgttctgaaactaggcccagttacagatttttttttttttttttttgcccaaattcccaaggtaattctaaagagcaattgaggttaaaaacccctgctgtagggtttctcaaacaaaatgtgcaattggggcaaaatggacacattgacatttttagtttgaaaaattaaaactctcttcttacaaatgggtctaatgtaaatgcaattcatgaagacagtgttgacaaaaagaggtgaccgctaatcagaaatactgtcatacgtacagaaaatgtctttcatagttggaaggtccaaactaaaatgaaacaaatgtacttattcaacttttacgataatttttcacattaacgagccttaaaagtcaggttcttggagttccaattactgaaagggcttcgaaagtgtgatatcatacatcatgagaaaatataataactctattaaaaagaggaccgaggtaataaaattatcataaacaacttgattcagttatgctacagaacatctagtgattaaaaacttctttccctgtagcctcacaggttaaattcaattcacttatatttctgccctgttgctaattgtactatttgaaaattcaatgatatgtaaaatataaaggtggcaatttaaaactaaacgtatagctgctctaggatgtctcaacttgatgcttaatttgaataatttagggactgttaggaagttgctaagaagaattagtataaaaacatttggggctattttccctcaaatataatgatgcttaaaatagaaaagtgatcgaagttggtaagttttatgttctgg

SEQ ID NO: 43009 - DNA, 1049 bp, Bovine  19866881066069
cgtgtgagtggccaagtgcactcagatggaagaggagcaaaggctttaaagaatttggggcatcagagagtatcctcgccttgctcccaccccctgactcttcccatgcggaagctctctcacccttttaacagcactctgagtgtacggcgcactctttcagtgcgctggcaagtggagtgggcaggcccacagctctatcctcggatgctcggccacgctcagctgggcattgtgcttgaaggagctattagcttccaggcacttctggagaggcacccttcctcacttccatcgctgactcagaaagggcaaaaagcctgccaagagatcccaggctcagtacttggggtgttcgtatcatttcctgccatgttcatccggtcctctctgtgtactttgccagctagaacaaaacagcgctgctatggaaactgcaaacaccaggcaatcctggcccctgcacttggcagcccagccgagagagagataatggcttttgttgttatctattggatgctgatgctcagtcggttgtcccctcaggccctaactagggacacactgacactgcaccatcagcttctcttgttaactttcgcagcctccggatgcagcgatgcaggtctgagataagcaatgcagccattattctgacgacaacttggggctttacgcttccctgacaacttctgtggtctcctcactcgggtgacctagaactctcaaaataatctgcccaattctgtaatttacccagctcaactgattggcaaatcttctgtcctggtgttctttctttttttcccaatactaataagtacattctcctggggacagttgtgactcagaggcagtgtgtcaacccagcaggaacaactcatggcactcagaacaggtgactggatgtttttcttcccagaataaacacaagtcccagccctctaaacacatttaatatgaaagtccaaagattatcaaaacttctctgttggctgcaacatttaataagagtcaatttactatgtctgacattaattgtgatgatg

SEQ ID NO: 43010 - DNA, 1279 bp, Bovine  19866881085868
aggcagtgaggccttcctcttctgtatttcccaggaccttgttcaatcatgattctatatttattatcggatgactataaatatttctgtttatacaatgtctcacccaccaaactgtgagcagactttgttcatttcattatttagctctgtcgtgaagactgacacataatatgtactcaacaaatgtttactaaatgaatttgtaaacatttttatttatttttggctgcaacgagggtttcatcactgggcaagggctttctctagttgcagtgagcaggggctactctctagctgtggtgtgctggcttctcactgcggtggcttctctcgttgcagagcacaggctctacggcactagggcttcagaagttgtggcacgtgggctcagtagttggagctcccaggctccagagcacaggctcaatagttgtggcgcccgggtttagttgctcccctgtatccctggcaactcccgggaccagggattgaatctgtgtctcctgcatttgcagatggactctttatcattgagccaccatggttggctaccagtcaacctggggatttagccaccaacccccctaaatgaatttgaagtgaataaagtttttatttatatttttctgattgtttaaagtatacagtatttagcatataccaaaaataatgctgctgacccagtttcaggaaagcatgctctttgaatcccttttaataatgacagtttatattcaaacagtacttttaatttttcaaagcacttttatttcaacaatttattatgatatttccaaacatatgcaaaagaaaaagaactgtgagtgaattcccatagaccctagattctaattcaacattttgctatatttgcagaacactttttatggactagtttgatcatcaccttttatttgacctaatgactaaggtatgacttttatagataaggaaagtgagacttagagatctaatgatttgccaaggagggtgtctcccagtagttatgagcaaccctgtcagctgacacatccacaccctctgctcttaaaaatattttgaatatccttagtaatgaaaagtttccaattccacaagacagcagactcagcaaaatcatgggaaaaccaacaagaaagcatggctaggtcataaatcattcagagaggaaccgagtcttgggcatctctcccactcaccccacttcctgttctggttagtcatcatttcctgcccaagctatctgagatatttcttccattcattcttttctagt

SEQ ID NO: 43011 - DNA, 701 bp, Bovine  19866881098849
catgtgtgggcattttgctctgcctgctaggagacattagcagtaaatattcattctatttttgcagtgactgagaacaatttttcatttctgaggattgctttccttgtgcttcatttttactcgttagttcacttctcttttctggctcgtgactgctctacctccacaaatggaagttcaggactttataaaagaatccagtattgcttacccaaagccattctgaagggagaaaggagggaaatcatcttccctgagtgcctgccccatgctccatgtaaaccttaccttcttagatgtcatgattgccattatcatggagagggatgtggggcttggagagggtcagtgtcatgctgatggtggctgcaaaagaggtggggagtttgggaatcagtcttgggtctggagatttctaaaatctgtgctttccttccctcccttccttccatctctgtaatacttaaggacttattaaccactttgggttttggggtgaagttacatttttcatggatacatgagctttattttgcactcaagacttcgcttatattctcaaataagtcccagcctctcctctgggattcttatttaatttatttattttcaattgaaggataattgctttgcagtattggtttcgtttctgtcatgtatcaatgtgaattaaccatacgtgtacatgtgtcccttcc

SEQ ID NO: 43012 - DNA, 698 bp, Bovine  19866881104569
aatttcttttgtgtgcactagtcgctcagtcatgtctgtctgactctttgcgacccaagtggcttcatagtgctacagccaatcaccacaagtaatctctgcaaatgtacttgttggacatttaggtgatattcaatttttcactttattagataatactataatgagcattttttaagcttttccagtaattaaggttattttcttagaattgattatgcaaagtgaatatttttaaagctcatactaagttttgccaaattaatttaaaaaagttcttctatcagtatgtgagggtattttctttatctcacccttattagtgcaaaatcttcctagttacaaagatacaagttttagaggtgaaaattatgtttcattcagttttccctgattcccaatgatgcttataattttccagcactcatcattattcatttgttgagtgtcctcttttctgaattgtttgcatgtatctttggctacttatttatcacaatcctagtggtttctattttttacagaattgatttggcagactcttcatatgttgaacattaatctttgttatatgtattttgaattcttgcctgttgtttccctttttacttgggttatttttttcttaaaacacaaccttgtaaactttttggtagtaagctcataattccccaactttcttgggaattaaaaatatt

SEQ ID NO: 43013 - DNA, 1156 bp, Bovine  19866881134221
tagatacatttagggcccagaattggaaaataacaggcttaggagttggaaagaccagaagtttctgcattcttaatctattactaaagacttgggtctctaacttggcctctcttaacctgaaatttctggtctagtaattggtgttaacaagcctgatctcagagacttgtttagagaattccatgaaataaccaatgggataatccatctcccatgatgattgctctgtaattattagttcccttcccttccttactcaacaaagtatagatcatcaaaaattggaattagcagaaactagaggttacagccaacaaattctagcctaagaatcccagatgataagaatggcatatgaaagatgctatatttaactacttttcccactcatttttattaatcacacacttctaccaaaaccttttgatacttcaatgaaaggtgaaaaattgtaattagatgggaggagttgtacatttagaattaagcatgaggaaagcttgtaagagcacagatggatgaatgctaaggatcctgtttgctaagtgattcactacgtgagctttggggaaatggctcttctataattttcagtagtttgtgatttccccttcaaagcaggatcttcaaggggaacagaatataacctctgtctaattccactcagtatttcatttctcttttgtttgcaaggtattaattattaaatgtggctcatattgataattatactgcatcttatttattaatgactcactattaagcttaaacctaatatctccagaggttctcaggtctctatttatgcaggtcattgcactttttcactttcctggactgaatgctgagaaggtttcaaatgtgggggcttaaggtagatggatcttgatggtataattacccatgacatagttcattcccacgaatggagtcatccatgcagccaaagacagagaagtgggcctacagaatagtgaacaaataggcaataaattattacaccagggagggcaatcatacatatgagcaataagtgaccagagcacaacagaaaggcacacactttttattttgcacgaagtatgcatgttttcttttggttctttttcagaagaaagatttcattttcaaatacaaaggtttttcctttttt

SEQ ID NO: 43014 - DNA, 732 bp, Bovine  19866881140954
ccttgaagggtgaatgcaaaaatcctttcactttgaggggaaaataacaaagcaatcaattctgggagtgtggatgagggaagaacaatggttttgtgaaattaaaaaactatagtggatttcaaattcattctatgtaggatgtagagaattcgaaatggaatacccagtttctaacttcttagtaatcaggaattaataaagactcttaattcagttttgttttcaaagatcatttatatctccctcccactattacctattatctttccatcctattgctccttaggtccattctgatagttattagtttacaagaaattgtactttctctttctcacaagcagtaaagtaagtcaaggcacaaggaattagatactgcagaaaattcagttaactcatcactgtacgtataaacagaaatgcaataagcagcatgcggagggaagaaagatgggaaggaagaagtgagagcgccccattcaaagcatctcactggttcttagattactgcacctgagataacacttctgtttcttgtcagcttcctgcttcattcaaatatgccaagattattctatgttagtggtggctcagttataatttgcttcctcctccctccctctctccaaagtttcaagtctatatctcttgaagttggagttccagtaaccatgagaaatacgttgagtttaaatctcagctctgccctacaataccaagtcatttaaa

SEQ ID NO: 43015 - DNA, 1114 bp, Bovine  19866881166387
tatgtctcctgcattggcaggcgggttctttaccactagcgctgtgaatatataaattacctaaacagcttgattcggttaatatttaagcttatatgcctatctatctggctctgtacataaggtttcctaggtggtgttagtggtaaagaacccatctgccaatgcagggacgctcaatgcctgggttggaaagatcccctgaagaaggaaatggaagctcactccagtgttcttgcctgggtatatatatatacacacacacaaatgcatacatacatatatatataaatacagatttatatcagtatatatatatatatatacacacacacatatatacacacattcactcatgtttatattttttacaaaaatgatattcaactctatttctgtagcagcttttgagctctcttccttgaacgtgttggtgctggtagagatgctgagtgtcagtattctggagtgagttgaggtcatggtcagccatccagaagacatggcataggttgagaagcaaagtgagaagtgaggagaagcctcagctcggggccagggacgaccagacgacactgcaggcccatctgcgtgcagtgtgacagcagtcgggctcttaaagggggtaaagcatgggttatagattcagtagtttaaggcgacgatgccttgcgattacttgggataatatgagtaattttctttctttgagagttgtggttctaccagagtctctcatttgaaaaaaccaaaattttgcctgggcatgagtcctgaggatgggtccagagctggctgtattcttattttcagacacagagatggctgctgacaaagacagctgatgcccaccctcctctgtcttccctgcttccttctttagttttagatcttgtgtctcttcaacacccaggcttgtaaagtcagacactcagcagtaaaattcatctctttggccatgtctctgaggagagcctatcagagtaatgcacaagacctcagtggtttatgaatgaatacaaatcaatgagtagattcaaccgacacctgaggttggagctcagtgaaagtatcaagtttttcagaatttcgtccaagtacaacattaaaatga

SEQ ID NO: 43016 - DNA, 1590 bp, Bovine  19866881175816
ttgttttctgtgtctctgagtctgtttctgtttcataaaaaagttcgtttgtgtcatatttagattgcaatgtaatatcataatgccatataatatatggtgtttttctttttctgacttactatgcttagtatgatcatctagaggtccatccatgttgctacaaatagtagtatttcattctgttttttacctatgccacttattgaatgatttatttcccccaccaagttgaaataacgtgattataaatcttacagataaaatcctcatgtatgtgtgggtaaacttccagactctattctgttgccttgtttttgtattttgcatgataccagactgttttacttcgtggaatgttttaatttgttttgctatctataaggttttccctaattcgggacttcagtgcctagctcggtttcaggtacatgagataggggttcttaacccagagttaatggctcagagaatctgtgaagtccctaaactgatagtatttcatgtgtttgagagtatgtgtatatgtcaacagtatatgtcatttttctaggaagagggtccatcaaatttcttcagattctgaaagtagaccatcaccctcaagaggagggtaagcacccctgatggagatgttgaacaagagtttgttgaatggaattgacaatatccatttgaatgattaatttttcctcaggctgacacaattgatgactaatatgtgttggtgatagacagagaggcctggcgtgctgcaattcatggggtcgcaaagagtcggacacgactgagcgactgatctgatctgatctgatgtgtgtaagaggggataaaaccaaagtagctcatttagatgagagaaagagatgctcattgatagctttaattgcatctccttattctagtttccgtgggaactgatgtatatttcagaatagagcaggctaaaaatactagcacatgtcaaatatccattatagaacaaaactttgttttgtatttaatacagagtccctgataattgactttgttcttttccccacttagtgtgtggactaacagaattgattattttgattgacttaactctgttccagatgaatagagcaatccaattggctttttccaccacttcatggattgaatgaactggctattttggtcctgtgagaaagcctcactgtctttaatccttatcttccctgttggagtatagtctattttggagtttcagttcaggaacatttgaattttgtgtcagtgagttttctggtttcgttgccttgggacaatctgcctatctatgctccagtgattcagaattatctggtcagtcttggctttttcatagtgtgctgctgctgggtgtcattcagtcttcctgtgtagagtgtttgaaaaaattagtggttggggtaaaaagtgaaaagataattagaacaagcaaatcaagtaaataggttctgcaaggtactctcctgaatgaattctttattaatattacatatctaaatgtaatttatcagttatttcatttaaatttaaaaactaataggttttaattaaaatttatcattaaataccaacacc

SEQ ID NO: 43017 - DNA, 1482 bp, Bovine  19866881299905
tagttttggtttactaataaacttgaaagtggccttgtgccctgggagggaacattctttgttcatgcacgcaaatggaatttggagaataaactcctttcttttgattcttggctctttctgctcttctctttcatggtatcctcagatgcttaatttattggctcatggaggatgtcgtcagggtgtttttgcctgggaagacttgattcacaacttggaaatatagcttatattatatattatgtatgtgtaatgttgactcatttcaaaggtcaaaattaaatatgaaacaaagtttaaaatgacactttcaattaatgaaatctgtctcttttgtactgaaacagaattcaggattacatgacataaatatacacacacaaacacacaaacacatatatatctccataccatgcatgcatgcacgcattttgtacaatttctgtgttcacgtatctgggcatcatcccctgtgggtgttaatttctaactgtttagatgctcttttatctgtatcccagattagaagtgcagctgttctccagtcttagacatacttgcttgatcttggaatgacattagggggtttcttgcaactgttttgctgagatcattaagaaaatcagtcttaaagattggtttaggctggttttcctttggttcttaagtggaatttctctgaacttttctgacctttaactctattcattctttgtttatcctgaccttaaggtgcctttaaaccttagagggcaactagtcagtgatgattcaaagttatttatgagcttgatggctgtattagtggttttcccattttgcttctctccctgaagcctttaacctgaaagcactttggaacagggtctgttttcctctaactgccttcttgcacttgttgggcaaaatcagagcggtgattgagtcctcaacacccggtatggcactgcagagtaataacatttatcacacttcttgtttaagccctttagagaatgacatttcacagtgtaattttgcttcacagatttttcccatgtgagttttaactttcagggtagaattctctcttatggcttcacctttttcctattttgtgtatttgggagaagttgcacaaatcagcctcctctcagcatagcaaatggaatcaggttacgatcccaagtgccctttacctccagattcctgatggttccttccttgtttttcgtgagcaggcccaaattgcctcacctctcgctgccctttccactttatgaaacaagcagctaatagtaacacaactctaaaaattcccggatgacctgcattttgctctttttattatcccttaagaaatgtctcagaaattgaaatctagagtagcaagttttgtgatcttgtcatttagcattttacttacgtttggtttatttatactgtgcctttaaactccaagcggtcacaatctaagggacctaaagaaacgaaacccag

SEQ ID NO: 43018 - DNA, 1563 bp, Bovine  19866881327508
aacaagaaccccttaagggtggtggtcccaagacctccctggtggttcagtggttaggactccatgcttccactgcagggggtacaggtttaatccctggtcagggaactaagatccagtaagtttcaaggtgtggtggaaaaaaaaaaaaagggtggtgatcccttggttaaacccctcctccaccaaaataaccacatttgtaagacttaaaaaagacctggtgcttatgaggggctgaacaaactctggttaatctcaactcttccgaaattgcaatcagtgtacaccaggcctggaggaaatctagttgtaatttttccttatatttcgtttcgggaagctgtcatggccaagtgacagaaatacctcggagcagagagtctagtccttgactgacatgtcttccagctggcctgccatacctgctttgaacaaatttggccttttcaaagatcttccctttcttgtccgactctaccctgcagtcctgtgtgtgctgctatccagccaggagacgtgttttgctgacatctctgtcttcgctctctgtatgggatttatagcaattatcctttgcttggtcccggtgtctgtattttggcaggccgccctgccttccatgtgataagtgctttgcagacagtgcagccggagctctgccaagcctaatgtcacccccatcagatgccgcctgggtctaggggttacctccacctgccccttcctttctaagtctgctggtacaggttcccctggtactatgtttaaaagcacaaagtgatgtgcaagtctggctctcatccagtgccttggaacaatgttagcagtgaacctagataattccggcatctctgaatgttttttatagcccgtactacctggattggtttgtctgactgtgtacagcaagtaaatgaactggataatcgccatatttctattccactccgtgctgtgtggcctacgcctctggaaacaaaagttttctctccaacaaagtcagtcctcaagaacaatggtaccccctgggggcgaatccctttgtcagcgtgtgccaaggtatgactaatcaaattggctcaaaaaaaccacccttttcccatttgactttcatttgatattttcactgaagagcaagccacaaggacgacaacagagaagctctaaaagcaaacaaaactcaaaccagcttccctctccctccccccacaaaacaaccatctcgcatttatgtgtcctgttccaggtgtgcgggtcaggctgtatttattctctggctgctttgtgaatgtccatatctgagagcccaggaatactacggatggctatttctcaaacttgaacatgccttcagatcacctggaaatcttttgaaatgcagattcctgtccagtgggtctggggaggaatcggaggtcccgcgtgtctgatgaagcccctgggggacgctgttgtcactgatccctgggtgaaccttggagaattgagacggtggcctcatcctgtaagggacccgcacaggaaggtccagtcaatctacgtggcctgttaggccctcgg

SEQ ID NO: 43019 - DNA, 1414 bp, Bovine  19866881559729
tggttttattgatgttgaacttgaaagagcccttgaacttggagcactaggatttggggcaacttggagtgatagtagatgaacagataataattaggttaagagagtgaataatggctgaaaagttgggattggaggtgtgtctctggaggatgaagactgaaccgggaagtgttagtcactcagtcgtcttagtcactcagtttcgagcccatgggctgtagcccaccaggcttctttgtccatgggattctccaggccagaatactggagtgagttgccatttccttctctaggagaacttgctcacccagggattgaacccaggtctcctggtactgtaggcagattctttactatctgagctacaaaggaaatccaaagattgagatgagagctgaagcaatgaagagaaaaaaattttcattgagacagtcagagaagagggaaggtaagctagcattcactgagcacctcattcgaccaggcattgaagtatattttattttttaaaatatatgttatgtaatttaatacctgggcttcccaggtggtgctagtggtaaagaacccaactgccaatgcaggagagttcaatgtaagagacacaggttcaatccctgggtagggtcacaaagagttggacactactgaagtgacttaccacacacacaatttaatacttttaacagcctcccatttaaccattgtgacatagtgttggaactgtttttgaagatgataaatacagaatcagagaaagtaagtaactatcccataacctaagagccagtaagtcctcttctacgccatgtgcatagttaggagaagccaagaagcaggtcaaatattactcataaaagattagccaatcagaattcagaatactgagtgatacttcaccagaacccagcactgggtattagcaatactcttttgaggtaggtttcattgtcggtggtctcttcagttatgtaagggcttcaatgaggtgtctattctgtgatgatgatgatgatgtgtgtgtgtgagagagagagagacagagagagaaacagagtcagaaaaagagaaatgacatcactgttctcacaggcacagttagtcttcctgactagaaagtaagcatatagaaaatgattttgatttttaagatgccaggccttcccagaagtactggttataattttagtgacaaccattgtgggaagtatttgacttttggctcggaagtttcatggaccagatgaatcaataatatatgacacatcttttcagttccccccaatcaggtctataaaaggcgtgcttgcatggctcacccacattcaggcagaatcagatggtctattaattcagatttgaattaaaaactctcacctctctgttttagctgttcaggatgccgcgtgca

SEQ ID NO: 43020 - DNA, 789 bp, Bovine  19866881775526
agatttgtttcctgtctattatgaataccttgactacagataagatggatgatattcattaatgtgttttacccagattttgtcaaacgattaatgtcagtcattttgtgtttctaattgaaaagagtctctctttgaggtcccatggatgtttcacttgagatgtgcagtgccagctttcacctgtcattccatgatggctttcattgttataggcaaaaattttaaaaatattaagtttgcctttggcaaaggcccagttcagtattcaggctccacatatccgaatacccttgtcctcactctagatgacttgcttatcagtcctgatttggttctgaacctgacatttccttttttcctcctcttattcccttcatgaaaacaaaatttatcatggctagattataaggagctctgattatcaaaacaatgcaaatataccagggaatcaaatacaattgaatgtattatttcccctggatgtattagtaggactaaggtgtctcatttggaattttaggcaaaagatatttggggactaggatagaggaagagtccctagaaccctgtcttggtggctacatcttctgctcaccaattagattgtctgtgggaataataatataaatcaggtcaggttctgttcagccatttttattcttccaattgctcttcaatccagacctctaccatgtggatttggtacaatcatgtttggcttttaaacatttgatttccttctttctatttctttctttctttcttttttttttttacttacaaaat

SEQ ID NO: 43021 - DNA, 1394 bp, Bovine  19866881851950
gcctgacaatttgtagctgaatacaagtagaaaatccaaacctgggggaaattgaatttgattcacttaaatttattctttcatttaagatagaatctcaagcacaaattcttcagacttgctggtcttgagttttcaatagacataagatgttttagttttgaatgtagtttttatattcgttgcttgcaggaaaagaaagttgcctgtccttttattgtaagagagaattattaaaatcgaggcataagactaacattgtaatcagtaattctcataattgggagatattcatgatgcctatcggagaagggatggcacccgactccagtactcttgtctggaaaatcccgtggatggaggagcctggtaggctgcagttcatggcattgcgaagagtcggacacgaccgggtgacttcgctttcacttttcacttccatgcattggagaaggaaatggcaacccactccagttttcttgcctggagaatcccagggatgggggggcctggtgggctgccgtctatggggtcacacagagtcggacatgactgaagtgacttagcagcagcagcagcatgatgcctattagtctatgataataaaaagtttataaatgatgtcaatgagctatatctgaggaaactaggtaggggatgattaatattgaaaagctggaattaaagggggatgcagtgactgccatatatttgaaaagttattacatggaataggccatagtcttgtccagttttgttccagaaggtagaaatggaaaatttaagttcaggtttcaagaaagtaaattttaattcaatataagggaaggagttcctagtaatgtctctaaacacaaaatgtttgtacctctgttaggagaattacagaaaagattcctgagacagagctgctgggaatttgaaccccatcatccttaaggctctctcaactctaaagttttggcagttctctttaaatttttgtcctttactgcaaaatcctatataccagacttgagtagttcccaaagtatgtcttcctccatttttccaagtttattgattaaaatgacatttcttcccatctctaagtatcaaaatgttcaagtcacttttctctttcatatttatctcccctaaaatctctcacagctcatcagtcactagatcctacagatccatatttatcagtgtcattctcagtcattaggttatttattctaatctccataaactaatcaaggccttcattattgtcgacctgtattgccacaacaatctcttcacaagtatccctgacatttgcatattcattccttaatctgtaattttcttgtagcatcacttctatcatgtcactctcattaagaatacagtatttcctttgccctttt

SEQ ID NO: 43022 - DNA, 1160 bp, Bovine  19866880470808
tttcttcttcctttttaactcacagatactaaaaaatctgaattctgaaataagctacttttccttggggcccagaggtgctagttagaaaagatttgctacctctgctttctctacactgtacattgctctctgtcaagtcatcagattttgtacaaatttcatactgtcgcttagcaatattaggaagcaatttagggtgaaggactttttaagagaaaacacttaatgcaaatgcaaatacattttaaaaagagaacaattatttcttaaatgagagtaagagctactcaaatagtctgtaagaaagaaaggagttgaaacctcagtaacctgaaaaaagtcattctgattctgtattaaatatgaatttttttaaagttttcagaggtaaggcttcttttttctttgtattatctacatagaaaagctttgttccatatctgcaggtttttttttttcagaaccttgtccactaaaaattgaattcctcctatgtgctgggtgagctgtcttattttttaaatccttatttagatacaggggtgaaatctgttaatccataactgattctatggcaagcatatagaaaattataaagaatagttcactatttcagaggttaggaaactttccttggatggctggatgggggtcagacataccaaaaagatttgtcatagaagtctaattactttatcctccttcattttttttttcctcatataataagacaaagtatgaagaccactatttcaggagtgagagttaagtttccccatgagaaacttaagaagaaagaaatttcctagaatgttccagaaagaattggggatattcccagtaatttaaattggattatagacctaaaagtataagttggaaccataaagcttctagaagacaacatggaagagtatattttcagttttgaaaaagcaaaaatttcttaaagaggacacagaaagtgttaaccttaaaagaaaaaatatatagaaattaatttcatcaaaatttaaaatttttttgtaagtcaaaaggcatcaagatatacatcagagaacttgaatctggtatatatattccagcaataaaaagcaaacaatacaatgttaagatgacaaatactgaacagacactttaccaaagaaagcagagga

SEQ ID NO: 43023 - DNA, 3229 bp, Bovine  19866880541675
ccatgaggtataggaaggtaagaatgctgactatgtactatgtgccagaaacatgctctcatttgactgtaattacccactccagtgttcttgcctagagaatcccagggacaggggagcctggtgggctgccgtctatggggtcgcacagagtcggacacgactgaagcgacttagcagcagcagcagcagcagacatgaagagtaacaacctaccacatgttcagagcattccatttttccctagtctcctcactttcaataacttccagtgaggctgtgggctgtgaggctgcttgggaataggagccgcagttaggagcttcagtttctgatccggatcgaagctgttgggtaaccttgggcaagctccagtgcctcctggaacccggcccaccttatcgccatgatttatgtctctgtttggcattgctctgctgactcactgctgaggggagcagggtgctttggggacaaacaccgtacagcggtcaagcaccttaaggatgcaagggcaggaaagcagaggttcaaaaagagcagcagcaaaggacagagtaggagaaaggaggaacagtagagaaaggagagagaaaggtacaggctggcagaaggtgggcgaccaagaggagaagctgaaggggctagtacttcacatggtctctcctgtcttaaaacatcagaccagaaacactgctgggcagattaccgtcctgatgactgtaaattgctgtggggaacaggacagtcatggttccctgtttttcagtatttattcagtgcttaatgccacgtgctcttgtgccaaggccccattccactgaatgctggcagagaaccgtgtgaatgctcgctagcattagagtctaatcagagtgttcgtaatctctaaaggtgtctggtcccgtagtacttgttgaattattatttgagtaatatttcccaactcagtaaaagtctccttgggaaatcctgtgacatctttaagaatttaatcctgctgtagctaatcggtgccatttctaggtccattatcttaatcttgcttaattggcttattttaaatagattagtaacatatttccataagttgtttttaaccatgttcggcattcttatggtttactaactccgatgtctgtggggattcacactggtaacgtaaaccagtgaaacaggctgaacgcaagacaagacggagcagtggagactagggcaaactggagactgtcttgtgagaagcaggtggctgcatgctagtctttctgagactttttcttaaagccagagatcaaaattttctttaaaatctcctgggttctcccccataactctttattttgaaaaaaattatacacacataagtggaaagattaacacaatgaatacttgtgtatctttaacaagattcattaatgtagctaattctaacagttagaattccacttcatttctacctctatcacacacacgcacgcacttttttggctgatgcacacacatttttcttaactatacagcatgaatctcctagaacaaagaaatttttctatgtaccacaatatgatttccacattctagaaatgttatcattgattcagtactattatttaatatatatagtctgtgttcaaattttttgtattgtctcaataatatatataatgtgtttatgagaataagcatatatacatgtatattatatgtatattttagtacatgattaataactgagcacacattgcatttaattgtcatgtttttgtaacctcctttaatctaaaacagtattcttttccttttttaaaaaaatatatttatttatttggttgcactgagtcttagttgaggcatgtgggatctagttccctgaccagggatcgaacctgggccccctgcattgggagcccagagttttagccactggactaccagggaagtccagtattcttttcttaattggaagtatagttgatttacaatgttgtgttaattactgctctacagcaaagtgattcagttttacatatatatgttttacatattcagctttacatatatatatacacacacacacacacattcttttttatattctcttccattatggtttatcataggatgttgaatatagttctctgtgctatacattaggaccttgttgtttatccattctgtacacaaaaacttacatctgctaaccccaatcctgccccactcctcccccaataccctgccccttggtaaccacaagtctgctctctatgtcagtgattctgtttccgtttcatagatatgttcatttgtgtcatattttagattccacatatgagtggaatttgtctttgtctttctacaatgtgatcatctctagttgcatccgttttgcggcaaatggcattattttatttttttttataagtagtattccattgtacatatgtaccacatttcctttatgcatttgtccatcaatggatacacatttaggttgtttccatgtcttggctaggcgtccctggtggctcagagagtaaagaatcggactgcaatgcaggagacccgggtttgattcttgggtcaggaagatcccctggagaaggaaatggcaaccaaccccagtattcttgcctggagaatcccatggacagaggagcctggaaggctacagtccatggggttgcaaagagtaggacacaactgaacaactaacacacacacacatcttggctattgtggatagtgttgctgtgaacataggggtgaaatatctttttgaatgatattaatagttttgtccaggtatatgtccagaagtgggcttgctggatcatacggtaattctatttttagttttctgtggaacctccatcctgtcttccacagtggctgcaccaacttgcatctcctgtaacagtgtaggagagttcccttttctccacatgttcttcagcatttgttatttgtagacttttcagtgatgaccattctgactggtatcaggtggtacctaattgtagttttgatttgcatgtctttataattagcaatgctaagcatcttttcacatgcttgttggccatctgtatttcttctttggagaaataggtcttctgcccatttttcaattgggttgtttgtttctcattgtttagttgtatgagttatttgtatattttggaaattaatcctttgttggtcacatcatttgcaattattttctcccatt

SEQ ID NO: 43024 - DNA, 873 bp, Bovine  19866880596963
taaaaaattaatacttactgtgcagcagtctctgtgctttaaaatataaatatggtttctcatagaaaaatgttttgtggctgccttgttttttagagaaagacaaatttttacttaccttgataattctgtcttttgcttgtgctcggtttaatttagcctgcttcctggattccatggcaactctggggcttgcagcctatggctatggcatccgatatgaatatggaatcttcaatcagaagattcgagatggatggcaggtatgtgactcatatttttaattttgtcagtaaaattttgccttgatgttctggatgatttataatttacagaatttaacagagggcgttactaatgtctgtagcatttgattgacatctgtgaattctgtcagtcttcccactttgcgatataagctccataagagccgagagcctgccagtgtcaccagtatcattcaccaccagatctatagcatcttttacagtgccagactcataaggatgctagagagtcatgaagatactcgtcaccgagtacctgaatgcagaccacctgtaatgggcagtgtcctatctctgcagcatgcaaaatggaggagcatgtcttttgactcatgatctttgccagtagcccttgcaggtaggaagcatgtcaccatttttgtaggtgagaaaactgaggctcttaagaggtgaagtcacctcagatcacacttttggtaaatctgcatccccagatttcccagtcacaatcagttttcttttccacattcagagtcttgccctccttagtatgcctttgttgttcagtcgctggttgtgtccaactttttggacaccgggactgcagcataccaggctttcctgt

SEQ ID NO: 43025 - DNA, 1148 bp, Bovine  19866880635469
atgcaggaagcttctacagcagtaagtagtcaaggatcatcgatgccaatctaaccttcattaagtgttagcagagtaaaatgtaattttgtctctctccacttactctcattttatctaactgcattacagaaccaattaacttgcataatctccattaatatacctatctcctttaaatgatagccctaatcggaaaatagtatgagtatacatgaggatattctccactctttattatttcagttctctctctcgtagggaaacagatcctgaaatagctctccaccaccatctctacatctcagatctagagtgtaccagatttttctagtcacacagtatttgtgatggtattctataaaagatttccacattaaggacaaattgaaagaactcaagacagaaaacaaaagacaacctacaacagttttacaattaacagattttgaaggactggtaaaatattcctttagtttctttattaaaaaaacagcattcaatttaagtttacctgaaagtgtagagccactgcaggtcttggccatcaacttactaaaattttcattaaactttggtgaaagaatatcctgggataatgtttcataaggatcaaatgcttgctcctatttttttttttaaaaaaaagaaaaatatgttaggtttaaaagaaaatcttttctactatcatggcacagattatttaatggcaaatttttagttaagccctccattaggtttcagaacattttttttattctggggacaaataataactatggactataacttggaaattttttaaaaatgtaagtaatgactttaagtaatagatgacaagaagctgctagtcttaaaataggtcactgacttgtgatcacaagtatcaaactattaaatgcatatgcatatttatcccagctaaacaaaaattgtattattagtaaaataaggctgggatttgaaatttcagttaggtttgctgctgctgctaagtcacttcagtcgtgtcagactctgtgtgaccccatagacggcagcccaccaggctcccgtccctgggattctccaggcaagaacactggagtgggttgccatgtccttctccaatgcatgaaagtgaaaagtgaaagtgaagtcactcagtt

SEQ ID NO: 43026 - DNA, 914 bp, Bovine  19866880846834
aacactggagtgggttgccatttccttctccgtgcatgaaagtgaaaagtgaaagggaagtcgctcagtcgtgtccgactcttagcgaccccatggactgcagcctaccaggctcctccatccatgggattttccaggcaagagtactggagtggggtgccattgccttctccgtttcaaggcatagctacctggaacgaatgctgtcaaattcctcagaagtttcaaaactgagaaatcacttttgtatcccttggtaccaaattttcacaaatccacagttgtagctagttatgtgcacaaaatcttaagtggaatcactaataaaaaatgaaagaaacttagacatgtacgtagtggtttcagagttgtttctcagcataggcagtccccattttattaaatgcagtttaagtttcagagtaactttacgatacatgtatcaaccatgttatggatgagctaggctgtagtgggcaaaatgggaaatccggacgacacggcaaacatttccctgagggctgaggccttccatgctgaaggggatgagaatacagcagtcgtctcccctctggttaaggtaggaaacgccgctgtgagcttggaaaggcaccagtgaagaaacactcgccacgcctggaggctctgtgaggcagatcctattcaggttccctcgctccccaggctaggaacttagtccagccacttgtttacaagtgggtgttgagcattcctagatgctgaagtgttgacagctccacagaagtcagggttacactaatttctgtttagcttcctctccagtcccagcgactcccatcctgcagctggaggactgctgcacccacaacaatagcgccacgctgtcttggaaacagccgcctctgtccacggtgcccgcggaaggatacatt

SEQ ID NO: 43027 - DNA, 1142 bp, Bovine  19866880860832
acggaaccggggcccccggcaatagaagcatggagtcttaaccactggactgctcccatgtccttgtttttaagcaggagataaaagtcatagtgagatttagtaccttgcccacggtcatgtaactaataaataacagagtcgtaatggatatttagagcccatactcttctgcagcctgctgctgtgccctcacagacagtctgcatcttcagtcaccagcatctgcaggggttatctgatgtcagttctagcatgaagggacctggaaggattgagttcacagatgaacctggatgcccaacccagagctttaggacatgactgctctctctgaagtggcttgtttgtatccacgttcagtgttgttttcctttcatccccagcttggattggatatggaggagttagaagaaattgaagaagatgctgggcttggcaatggtggtcttgggaggcttgctggtaagcgacatcgtgaatgtgctgtgttgtctggctattgacaccttctcagatgccaagcaagactattcctatagaaccagcagactgtataggagaagtgcaaggtgtgacctagtagtagatgtatttgtttttggctctgcactgtggttcgaccagttctagacagacagtcagagaaggcgatggcaccccactccagtactcttgcctggaaaatcccatggacggaggagcctggtgggctgcaatccgtgaggtcgctaagagacacgactgagcaacttcactttcacttttcactttcatgcactggagaaggaaatggcaacccactccagtgttcttgcctggagaatcccagggatgggggagcctggtgggctgctatctatggggtcgcacaaagtcagacacgactgaagcgacttagcaagcaagcaagcaagacagacagacagtagagaaaggaacttgaacaaaagagacattgcttaaaaagtttagagacattgcttcaaaccccaaagctaaccagatgcttcctgtgccctgaagggtttccacagtgggcccttcacttcactgttcccaactgctcaattcacatacttgtgtggtaggactgaagttgtttagccattgtgttatccttttgtgcattggacattttg

SEQ ID NO: 43028 - DNA, 1850 bp, Bovine  19866880873715
aaatatgtttgccacaccttttaacaaataacttttgatatatagtattttgttttagtttcatcaaatgttgaaccttgtttattcggatactaatttttgtctgcttggcttctgttacatattaatatgcgtgccttctgatactgtctacttagtgaactaataaaatgggctccagatccagttttcttcttgttttaaaggtgtttgcattctaaccaggaatgcttaaggtgtttatttaagttttatattcagaagtactgtatccttaaagccattgccctgttttcttctgttttgaattataattgttcttaaaggagccatggttttagacttggcgttttttttttgtttgtttgtttttgaactgattcaacatttgtgtgtctctttgaaatgagattaaaaaatttttttttaattttcatagcttaatttttagtttttccatcttttgagtattgtactgttgctacataattccaagagtaggaatgccagattaataattttttaatttttttttaaaggaattcaccctttacatgtttgagaacagcattatgttctgtttcattttttaaattgtgttttacttaagagtttggggaattttggaaatgaagtacagtctgcaaaacaaactaatgttaagttatgctggtaactgtatccatttgttagattgtttactatttttatacatttaatcatgagtatttcattaatacgtattttgtagtttaacttactgatgtttcattatattatgtttggtagtatgcagaatatgtttgattctgctagagcatacttataacacattcatacaaattataaattcatttgagtgggaatatggcaatcagcctcaatttaaaatacccagatactttgctaaagtttttaattgtgttttcttaagtccattgaaatttttcattttggggtaagatgtaaataaacaactttggaaaagcatatattatttactagtcattttattcttttgttttattatagatcttatgccttcttttatccggcacggtccaacaattccaagacgaactgatatttgtcttccagattcaggcgctaatgccttttcagcttctggagatggaatagtttcaagaaaccaaagtttccttagaactccaattcaaagaacacctcatgaaataatgagaagagaaagcaacagattatctgcactttcttaccttgccaggaggctagcagatgtccctagggaatatggctcttagtcatttttaacaaaagttaactttatttcctaaaatggagactctggttccaaatattattattcagataattattctgatggtcagagaaggctcccacttggagatcatgcacacaaagaccataggtattatgaatgcaaccatggtatcttccaaagaatgccactgaatcaggggaggcatgcttctgcccaggtctcaggtcaaacaacagggagggaacacagtcccgcccaccaacagaaaattgggttaaaggtttactgagcatggccccacccatcagaacaagacccagttttccccacagtcagtctctcccatcaggaagcttccataagctcttatccttctccatcagatggcagacagaatgaaaaccacagtcacagaaaactaatcaaaccaatctcatgtaccacagccttgtaccacctctattcagctctaattcctcttgatattccagtactggatgatgtagcttctaaaatgttcaactattctttctcactttccatgtacttaccatttttaaaaatctctttaacagttggctggcttttt

SEQ ID NO: 43029 - DNA, 2929 bp, Bovine  19866880892057
aaattcccagggggtgctggtttcaaaactaggattctataaagcctgccaaaaccaggggctttctaatgcaatgttacttgctcttaaaacacacataaaaggcatttacagattttttaatttgggtattaaaagtgtgggacatttaccctacttctattgagtcagccagaggtcagatacgctagtagtgattctcaagtgagaatctggggagcctgtgctcatatgtatttttacaagcacacagctgggaagccccaccctaaactggtttcagaatctgtgcagggtgaaatgcaagtagaactctgaaagctttctagtgattttgatgatgtgaaaccctctagagagcagcaccgctaaaaggacaaaatacttcagtgagttatttcttaccatagtaaatgatctgcacttcatatcaatgtagcagtattgctaattttccagaaaaggaaacaaccttgcttatcagcagtttctccagaggttttcaaaatcatggtgactagcctgaaatgatcttatcaaagtaaaccatctactgattttgagagaaactttcttttttttcaaactcaactaaaggttagcaaaacaagatttggattctcagatggaggatcactcttggctcttttttcaccaagacatcaccctggctcatcagagttttcttgaagtagtttaaatgttatgcttatttcacaaagctcttaattcagattaattttttttaaaaaccaatataccaatcacaaatatgaagatttatccaaataaacctaatatcaagaaagaaaaaatttcccatattaaaagtataagcacttaaaatcactttttaaggaaatgcagttacctcttgatgattatatccataatatctctggcactgaagtcaaagggtctgtagccctctcgtttaaaggcaagaattgcattgggccctagccaaatattgccatccatccttggtgtgaagtgaactcctaggaaaggaaatcggctatcggggacctacagatttaacagagcaaacagagccccatttcatactgcattttattatacacacaaacattgaactggtaatagaaaacaccttctcacgcatttacttgtgatctgtgctcagataatacttttctacgtacatgcttctgcctagaaatgccacacaggaaacctgatgccatgacaatgaggcacactgtcccatctattcctctttctgggtaaagaaaaaaactgtcctactctaggttactccccactcctaccgtccccaactaggaatctacgcagctgacaagtaaaatcagagctgccaggaaaaaacccatcttcataacacaggcttttgtcaagtgggaatgtaacaggttggaaaagatgatggaagtcttggcaaggtcaaaaacactgaatagctgaatactcgtagttcaacccagtaggtccagacagaagaatgagcttttcatttaaatgcctatgtcttctacaccatgaaactacagagtggccacatcccctttcttgcacttacagataagtgaactaagaaagaaggttggcatctgggcttgttaaaaggaaaagttctcttaggaatactctttccagacagaagtgggagaatcaggttctttcctcactgttcttcctgtggtacactcaagctttccaggacttgtgagcaagtactgtcaatttagggcttcccttgtggctcagctggtaaagaatctgcctgcaatgtaggagacctggattcgatccctaggttggaaagatcacctggagaagggaaaggctacccactccagtattctggcctggagaaattccatggactgtatgggtagccacaatatcaaaacaaagatgtagggatttaacccagagaaacaggtggaatgcttgaactaaaaagccctttaaaatagctcttgtgtctaactctgggaaaagtttttgtttcattcccttttgccacaagcgtcttgagaaagcagaggtatcatggtatgtgtgtgtgctcagtcgctcagccgtatctgattctttgcgactctgtgaactgttacccatcaggctcctctgcccatgggattttcctagcaagaatactggagcaagctgccatttcctcctccaggggatcatcctgactcggggatcaaatctgcatctcctgcgttggcaggtggattccctaccactgagccatctgggaagccagatgtatcattacttaccggataaatatttccttttacaagatagcgcttttctggcttcaagactaggtaatctccccggaatggtacaattcgaggattgggattgcagccactcaactcggaaatacggtctgagtaaagtcccgcacatgtcacaacatactgacatcggacctcctctccctagggcaagagaaaagaacagcgacttgtgggaagcagaaagaataggtgatagcaaagacagtaaaggcacagatatggatccttcattcattcatttatggctgcatcgcacagcttgcaggatcttagtcccctcaccaggtattgaacccaggcccctgcagtgaaaatgtcctaaccactggactgccagggaattcccatctttttattctttttaaaagatgagattaaatacaggtatcagcaaaagaagttcttcagcatttagttggaaggtagaaacttagagcaatggcacacaagaggatatcaccttaaattttgtactttagagttagagtggttgacctagcgaggatacctaacaagccacatacagacagctctttttcacaaagacctaccgtggaacttcttcactacttattgcaggaagaacccaccttcatttaggggctcattggcctcaacccattggcctc

SEQ ID NO: 43030 - DNA, 2596 bp, Bovine  19866880923363
actgagtcagtgaggccatccaactatctcatcctctttcgcccccttctccttttgccttcaatctttcccatcatcagggtcttttccaatgagttggttcttcacatcaggtggccgaagtattgaagcttcagcttcagcaccagtccttccaataaatattcagggttgatttcctttaggattgaagtcttttcatgtacacacatgaatatatgaaatatatgtgtatatatactttatatgtatatatacataaaatgccctaatcatgatgacattgttcttctagagacgttactgtttatggaatgcttttggattcagtaaaaataaacagcctgctaaataatttgtttcatcgaagctctcaagtttcaggagctgcattattccttgtaaccctcatcctcaaaggtgttgttaatagcagaacaatttgagaatctacatagtagtgttttgtggtctgttatgtgtaatcatctcattgtaacttaaatctctactcttgctgaaacaatcttaaaattcattttatgaattaatacttttttttgtttgtttcttcaactccatttgtccctttctgagtaaatatcctttggctatatttttgaaagtcagtctcgggtgctcattcaaatgttttctctgtcattcatcaacttctactgttagaaaagaccttaatagtttaagaagaaataatatttccttttaatttcagttgccaagagacagtttcctaggtgctatgtcttttgtctataaaagcttcagtatactcagagttagtcatctttcggggtttgatttttgctggagagatgaagtatagagtttacaattaaagttagaaatacacaccacagcattttcagtatattgaaatgattattctctataagtttttgaagttccttttcaacatatcttaattcagtagctgagtggccagcttccattaatttaaaacatcacatagaacagaaaagtccctaaaacccctttactgagtataagattcaatatgtaaaaaggtgaaatgatatatacttgttggttctctccttgtaagctgtacatttgtattactcatagtaaatgctgagtcccatctgatttgcttctgacctgtttcctgccttttaaagatttacatagtactctgaattgaaactaagcttagttcagcaaaacatatttaagagggttgaaatctggtgctaaagagacttggcatatattccagaggacttttgaattctttcagaacaaggataatatttattgcttagataaaatatagttgtgaataataaatcaagtgtaaaactgttgttcttgcttatactatatattctaatatcttttggttattttctatcaaattcataaaaatgtttgttgagtacctactgtgtaagcttctgttacaagtttttacgaaacgtaagacaatctctgctgtctagataatttcaatctgttttcaattttgacctctttttttctttcacagaaacctaagtttttctaaatagtttttaaaatatttccagacataattcatatgccataaaattcacttgtttaaagatgtgtaattcagtggttttttagtgtattcagagctgtgccttcattaccacaattttagaacatttcattagcccccaaaagaaaatttgtacctcttagacatgaccccctaatctgcttccaaaccactttctgcctctatagacttgcctcttctggacagttcatataaatggaataatagagtatgtggtcctttgtgactggcttccttcatttaacattgtgtattcaaggttcatccatgttttagccttttttattgctggataatatttcattgtgtgggtatccacactttttggatccatttatcagttggtagacatctgggttgtagcctatctgaatagttttatatgtagatgttgattaccattaatatatatatagattgtacagtagatttcagctaggaagtctttcttaactttagatgagatacaaactaatgattatatgtttatgactacacagattcatttctattaataacaaaatatttctatatttttaaaagtttcctaaccaaaaaggaatatttaatatggcaattggcttacattgtaatgagacattttcccataaactgcctcattattttaaagtcacaactcagatatttattttattttacagcatgcttacatcatacttaatatataatctccttcctcttcagtaagcctactggtagctcttcaaagaccttggacatctaaactacaagttcaaagttatatatcacatccatacctacacgttggagaggataattacatacaaacatccactgatgccttttctctttctctcaccccaatatccactctgtccaagatcctttcagatcttatgctatgctatgctaagtcacttcagtcgtatccgattctgtgcgaccccataaatggcagctcaccaggctccccgtccctgggattctccaggcaagaacactggagtgggttgccatttccttctctag

SEQ ID NO: 43031 - DNA, 944 bp, Bovine  19866880927065
tacgtttatcataaggcttatcttctcttatgttctaagaacaaaacaattgctgacttttcaagtaggtaactagtagattaatatcacgtaaaaatttttttgtacttctggtatatagttctagatgaacagaaaagatattaacctacttacaagaagcatttttatttttgttgacatagtcctttgacttcaaggatcttaaagctttcatgagtttagtctagctaatttgaattcactgcaaagaagtttcatttgatttttgtccgaagtgtgcttgtataactgttgaaaagaggcttatcttggtagctgggcaaaaataggatgaagacagagataggataaggataaatcagtaaagcctagaaagaaagagaacactgaggcagatgagaacctcaaggcttcagaaacaggtcctctcagaaggaaatctagcaatatgagattacctggagcgagaaggtattagttgtttcctctgtaagaaataaagcaatagaaatggagtatggtagggaattagggttaaatgaaatcatttaggaaattgagtcacaaattggctcaccctatcagagtaaagcaaaaaatatgcagatgataatcacaaataaaatttatgagaaaacatagcctaagattagtagtctcctagtcattaaagcaaaccttgaccatagtgtgcattctcagtaaatgtgggttgaataactgagttttgaaaagtagcctcactttgcaaagtagatactgatccgaagggagaccttggttgctgggtagattacaggtggaactgagcaagggttgagtgtgaagcaacctgagagtaacaggataattacccctagataagacaggagaagctatttgaaatacagaggaggccaaatgggttgaggccaaatgagccacctaaatgaaggtgggtt

SEQ ID NO: 43032 - DNA, 1449 bp, Bovine  19866880983646
tgaagtgacttagcagcagcagcagcaacagtcctgtggatgagatcagtcacacccacaaatgactccagcacagacagagagcaagtttccaggagaagtttgcccatgtcattagagctgtgagaagggcaaagttacttccagctgaaggggtcacagagagcatcatggaaaagcaggcattggaggagcccaaactttgggagacatgtgttgatggtggtgtgcattcttgcctgcgggaagtggccaggctatgagggaagaagagggtggtcagcactgtgcaccctagtcttgctctatgcagttagtcatagggaccgatgggtgttttctgtttccatcacctgctctgacattactaaaaagatgatcactacagcccttcattttagcacctttcagaaacccagaacctttattgttatagtggaacttaaaatgtcatttgaaccacagacagtatctaaactcacagctgtctacgggtaatgagccggacagctgggattttccctctgatagtggaccagccgttttaatgtgtagccataaagttttaactttttcgttaaagggcatctcttttgtgaagcacggcagatgcttccctgacatctttaaacagaacacggttaacagtttgtgttaagtcacagggggactatagtggtgactcctggttttctctacaggagagatgtaagggcaacaatctggatagatgcggggagccaggactgaggaaacaccatttatcctaatcaaaaagtacagaggggcatgaaagccacccagcctaggctgtgccatggatgcaagtggagatgattcagggacagctgtaacgcattgcggggacccctgtggccagtgtcggtccatcagtgctggtggcctgcgtggtcagggacctctgagcagaggcagctgcctgccctcattccaccctgcctagggtggagttccctgccctagatcccaaagggcgacagaaaccagagacaggtggctggttgtctcccacggcagcaaagccgttctgtcttctgccttctgtgatttgtttctctgctgttttcagctgattgtatctgtcactgcttctaaaaacaggcagtgcggccgtcaccgtgactgctgatgccagcctccacatctccctccctctgcttttctcctcctgcctctttcctttcttgtcacttcagttgctactcagatttgtgagaaaagactggccttttatagacatcacttgccaggcacagtacttctttttgtctttgttggctagcccatcactcacagtccggaggggataatcttatggtcttccgcttccctttggcagagttctctgggggcctgctttttgctgacaaagaggagagttgtgtgtgtgtttttcaggcaactttctcttctgagccatccaaaagg

SEQ ID NO: 43033 - DNA, 707 bp, Bovine  19866881013554
tgtccttttctttctctgcaaggaggcaacaatgagtgtcatctgtagacaaaggtcattacagacccaccagtgggctgttctacccggcacaggggggcagaggtcaaaactgggtggcatgtactcccctctctccacctggaagccgggggccattcctccatacactgccagcctccctctcacagggcactggagcccctggggcactttcaaggccagggtaataggaggggaacggaagatgctgcagctatccgatccatcttcttttgatccccagatattgaagccccaactgagaaacttgaaacagtaggaaaattaaagtgtctcttcacaaaggtgcaagcagcaggtagcagacagttttatccaagaaactcttgtcacaaactcagagacagacatcaataaatctagaccccaattaaacttgacactgacggtgactctagctctcatctcatcttacatccttattctatacataggaagcctggatgtccagagaagccaagtgggttgcccaagaggtagacacaaggtcagaacaggggcctctatctctgtgtctcttgctttttctaatatacttggctgccacttttctcaattcccagtggaccctctcccccactcttactccatgttattatttctgaaattggatgtaccttgtaattctctttaaaattcttttt

SEQ ID NO: 43034 - DNA, 1410 bp, Bovine  19866881022614
attgcaaatacaaggataaatctggaaggttgatgatgtggttataatggaaaaacatgctctccacccctttttgtgcgatcttgggcaaatattactaggaacctctatgaaaagctttcccaattacaatatgaggtaatgcttaagtcacagtcaccagcttccaagaaggaaacttacacaaagggcccagcattcagtatgaacaccaaaaaacttgctccttacctcacaaatgttctgaacacacaagcaagaattaaaaatgcaaaagattcagtaggaaaattagagtcaaatacttaaattgaaaataagtaaagtctcagcgaaatgcactctattaaaaaatgtttataaacacacacacaacttttttcgtaattttcccaaaagtatgatggaaattattttgagtctttggcggatttctaggaggttttatttgaagaaattcttatgaacacagccaaacacatataatttttggctcttcaaccctgagatctacaactgacgagactttttgggcagcagctacaatagcgacggtcagctttcacctccggacgttatcatccaacagagctggactaagaattctactcaaacgttcgcacaacttcgagcagggcgagtgacaactgcagtgtttgcaaacacaatgcaaatctcgacgtaacaagaggaaaacgtgtgccccagtgtaatccctttaattcctacagaaccaggggatgagcaatttgttttctaaagaatatctttcttccagtaattaaaaccaacaacatagcttccagaagggaagtctgtggattttgaggggcgggacggggccgggagtgcggggcggggggggaacggagggggactaacttaagtttttcactctttatcagctttcaaacaacgaacatcactccaggcattaaaaaaaaaaaaaaatcacagaggccaaaaggaaacacaagccgcggggagcggcgtcggacacccagcccgggtcccccgcagcccgcggccgcccaggccaggtgtgggcgcaccccgcccgacactcactccgcagcagaggagacgtctccttcttcacgtacttcccctgcacctcggccggcttggacacttcgtttttggttttcttccgggacagcatccttgaccacgaggccccaggccacgtcaagcagccgccctaaggctccgcgccgggcgccgggagtccccgccgccacctccgccggcgccaccgcctccttccctcccgagccgccgccgcgtcgccgccgccgctgccgcctctccgcagcccgggattgcccacaaggactgccgcatgttcggggcgctaagcgcgccggtcaccgctcaatcgcttgtcagttccttcccggaagtcagccg

SEQ ID NO: 43035 - DNA, 942 bp, Bovine  19866881045526
cagtgcagttgtctatttttaatgtcctatttttgtcttttcaatcctctaatatctgtttaacatttccctgtgttaattcttttaattctcctctagtaaaatacctactggggtttcctgttatgttgcctagaccctgactaaccagattctgagcctaggtatcaaggtgcaatattttaaaacaattttttgcctagactctgaggctagctacctaggctctatattctaaaactcacactacttccctcattttcagaaaacggacatatttttctaatgtttctgcattttgtaggagctaggctacgagctaaagaaaaattttcttatacccatgaatgagttacactcacgagcaggtaaccccattactgacaacacaatgttcatcgtattgttgtctgattcaacaaacatttactgctcactgactatgaggcaggaactgttagatgctggggatgcaaacataaatgtcattgttcttatccttaagagaacagaaatgcctaccgattacttagtattagtaatagctttgatcaaggatgcacagaggctgtgggatcctggaggttttggaagtgggcgttaaggaatggaattggatactggaacccactgtgagtttttcagaaagcataaactgagaaatatatattgggcagcagagtcagtgctttgtatggagcatttaaatgtcaaatggctgggatgccctggcaggtgctcagtgactaatagatacctggattgtctgtgtcctctagtcataacaagatgatcacatcgaagttagtaatccagtaagatttagatttgagaaacatgacaaggaggaagttaaataccctaaattaaatgccatatttagaatgtgctaaatcttatacttaccaaaattactgagaaaagagctagggttaagatcat

SEQ ID NO: 43036 - DNA, 972 bp, Bovine  19866881047345
tgtgtctgactctttgcgaccccatgaatcgcagcacgccaggcctccctgtctatcaccaatttgagtgagttcactcagactcacgtccatcgagtcggtgatgccatccagccatctcatcctctgtcatccccttctcctcctgcccccaacccctcccagcatcagagtcttttccaatgagtcagctctttgcatgaggtggccaaagtactggagtttcagttttagcatcattccttccaaagaacacccagggctgatctcctttagaatggactggttggatctccttgcagtccaatggtctctcaagagtcttctccaacaccacagttcagaagcatcgattcttcggcgctcagcttaggtgttaccaaaaccaggatataagatgggttttccattttatcagtagtgcttttctttagcccttcatgcatctataggcgtctcgtttgaacctgagttaaagtagtcctgcctatttgtttttcattgcttaccttgtgtttttatgttgacaagtaaggttggcctcttagctgttcacatgacatcatttttctttgtttcagagggtttattacctctctttggaattttacatgggccgaacattacagaacaccatgatcaaccttggcctgcagaatgcctgtgatgaggccatctaccaggtacgttatctctgtatttctctcattctctccctttaaatttcaagtgcaactcaggaaccttggggagagagcatcccccctaagaaaaagaaagaaaaaagatgaaaaattgtttctgtagacatggctgtttcaaactattagaaatgtacactatagtactactgatctatggtttaagaggaacacagttagggaacacagttaaagaacttggtttgccccatgagaattttgttctgcaatcagtttttgacagcattccacaacaaatgcattttagaaa

SEQ ID NO: 43037 - DNA, 768 bp, Bovine  19866881071590
tttcaatattgtttaagtagtaatgcaattttcttgaaattgtcagaatgcttgaaaaatggaagaagtttatactagaaattctaaagctcattttgcctactggtaaagctaaaactcagaacttatttttacatatgcttctaagccacttcaaaattaaactaaacccaatcatttgcttataaggaagtcatcagaaatgcacagaaaaatttatgcatgaggagtggataataacacataattataatagcaaaaaattagaaaccacctatgtaagttactacctatatggaaattggtgaaataaattctggaacatttcatctgatgaagtacaatatagttaaaatttgtattatttaaagtaaaccatacagaaaaaaattaatattttcaaaaggctaaaaatacctatgttgtgaccccaatttcgcaggaaaaaaattgtaataatgtatatgtgcatatgttcacatacatagttaagacactggaagactgtcccaatagtaaaatgttgacagtgcaatctctcattgtgagattactgtttttctttttgcactttgttagatcatctaaactttctacttaaaaacctatgtttaagtttagcaaatactttttcattaaagacagaaaagttattttgttagatgtgagcacagatatgttaaaatatattattgtccttgaaattatttttgaatagactttaatccaatttatcgctactttttctccgatcatcaaagttttgtt

SEQ ID NO: 43038 - DNA, 1344 bp, Bovine  19866881198327
cctctgtcctggggattctccagcagaatactggactgggttgccatgccctcctccaggggatcttgccaacccagggattgaacccagatctcctgcactgcaagctgattcttttatcatctgagccacaaaggaagcccacgaatactggagtggttatcccttctccaggggattttcctgacccaagaatcgaactggggtctcctgcactgcagattggagaaggcaatggcaacccactccagtactcttgcctggaaaatcccatggatggaggggcctggtgggctgcagtccatggggttgctaggagtctgacacaactgagcgacttcactttgacttttcactttcatgcattggagaaggaaatggcaacccactccagtgttcttgcctggagaatcccagggacaggggagcctggtgggctgctgtctatggggtcgcacagagtcagacacgactgaagcgacttagcagcagcagcagcactgcagatggattctttaccagtagagctaccagggaagccccagctacactgtaacttggggtaaaaattttcttctcaagaactttttcaggagcccaagggacaaagagagtctcatttggaacagagggcaatagaatgacaatcatgttctaaaggagacataatgttattgtgactttagaattcactttccctcttttcctgaatgagtcagagtttgctgggctaccacagttttcttctccctttattgtaacctatgccttagttatcacatttggaggtttgagtagagaagtcagattcattcaactacacaaaattagagccacctggtttcttatagtccagccttggaattcaaggcatctgtataatataagttagacctgatgcccaataagaattgttgatcaggtgctggtacatatgtagaaaaaaattatactatagtagacaaagagtgctggcctcacctactccctgggttttatagcaaagcagtatgtaaactgcaaaactcaatttattttcagatttcctccctttgtgtctatattcaggccttcttcctggctaatgattgttctggtatttgatctgcattataagataaatatctagaaacttttctcttaagctttgccaccttgtagaaatggagcagcagacaataaaaaatcctggaaactatttatcactagaaaatgctcttctaaggatttatatgtgtattgcttttataggacagtcttttgatcatgtttataagccatatctgatgtaaaagaacattattatttatttattttgttttctcaggagcatttaaattcctg

SEQ ID NO: 43039 - DNA, 831 bp, Bovine  19866881221031
aaagaaatttttcaaggagtgtcatacacttgacacggcaaagataacttcccaacggcagaacctgcatgttcaaagagatacctctctaggtcaggcagactcatcgctgagcaaatagcctttaaaactgctttcccaaatgaggcaatgagtgatgctaagtcaattataacttgattctgtatccatctttgtctggcatacttgctgtcattagctcattgtctttcagcaaccacttctaggcttacccgctcagggaaaagagaatcagaacaagagaggatctgggttcaaatggtgatatctgctctttagaagggacaggtagagggtgagcaaagatggtgggtggctgtgtcacagaacagacgctgcaactgcacctccagccactcagtcatttaacagaccctcccatgacctctcacttagagcagctcccagagaggggagtgatggagacctgtgacggaaccaagatgtcccttgaggcaccaaggtaaccagcttcccagaggtctaacaaccgtgtgcctttctgatggctctagtaagagccattatccaatctgtcttccagagccattgttcccagcagacactgccacaaaatattctcataaattgagttccactccatgatgctcttggattctggtttgaagaagttttccaaagtcctagtttgctttcttttctacactctgccactttgggaccattctgtcgtcttatcaatcctaggtggttcgagatcagatctctcactgcacagtgaaattgcgccagaccacgggtctcatgggagtactgcctggaggtgat

SEQ ID NO: 43040 - DNA, 1533 bp, Bovine  19866881507907
ctgtagtagctgctctctctcaacaacccatactattcaaatgctccttgtatgttttctccagcatctctctctcctgggtgaggaccaaagaggttgctttctccctctggagagtctctttaagctgctcctgggcttctgcacattcctgggtgagctcgtccttctcaaactcccactgggacctctccctcacattgttgatccaggagctccttcagctggtggcggtagtgcacctccaaactccgcagggcgtgttcgtatctctcagtgactttctgacaatcagcctgaaactgggcttctatctgagaggttcttctattacactcagtttccattttttccctaaatgtggtcaacatacagcattactgaaactgtcatcaactccagaagcaaacataaaaacattttcccatgcatagaagaagcagccaagcaaacaatgtaaatgttttctaaaaaatggtcttcacttatttctatactcagaagggatctcatttctgagtgccaaacaatggcggccataattaatttaaaagactcacttacctctctctgcatttaaaaagaagatttagaaaccaaattctctggcatattcccagatatttatggagttttagccaaaaacttacaatgctttctcattaaatgttcaaatacatattaccctaaaccctaaatgggaaatacataaaattctttcattttaattatgtataccctggtgcctcagatggtaaagaatctgactgcaatgtaggagatccaggtttgatccctgggttaggaagatccctggagaaggaaatggtaacccactccagtattcttgcctggagaattccatggatagaggagcctgacaggctacagtctgtggggtcacaaagagttggacaagactgagtgactccctgcctgtctatatgtagttatataaaccatacatatatgtttttctttctatttaatgaagtaccaccaagataaagtatgaagcaccaaagccctcaaaagcatctgaggtttcacttgaggaaagtaagcacaaaatagtgtttcataactccgagagaaaatgtaactttgcccgaatctaataacttataaaaggcctttctcagaaaacaacaggactaaacgaagaagaaatcacatttgtgataatcttattatcctcatccagaaccttaaaaagtatatgtctgataaaaaaaaatgaaaaactttcctcttaaaaaaaaaagtttcaacaatcccaaggtaggcttatatctaaacaaggacaaaacaagttgaaaaactaaaaaagaattctagtcagtaagtgggtgcttacaccttctggtttttcaaagtctcctttattaactgggacttgtggtgcccctgaggactggtgtcccctcctctccttcccccactttcttaccttccctcatgtagttccctttggtgtttttccaagagctctttttgcaattctctttctcaagaatgtgtttctccaccagg

SEQ ID NO: 43041 - DNA, 942 bp, Bovine  19866881542290
tggtagggctgaaatgcctttctcgagctgttctaactttttttttttcctctgaagctgccttctcagaaggaaatatgagaggaggcagcacttctcccagctgagcctccacctagctgaaggctacaatctgtgtccaaatgcgtgcgcaccagggagtgtggatgccttatacgtactgctcttcactgagagtgagggccagcagtttgctgatagcaggttttaggagcggggttggggagtggggggagtgagagagacggcagaaaggccctggtggggaaaagcagagacactaagaacaaatataatgcataccacagctccctggagagcccctgaaactgtttggccacatgtgcttggggggagggctgtagaaacttgtaaagaattcccagaacagaataggagcacattcttgcttacaagtacttctgaccatctgtcatcacgatattcaagggtgtacccattataataatatttgaagccaggagtaaaaaagtggagatctcaggcccattaattgctgagaaccagatctgttgtaacaaaataattcagaaattgtcttctcccaatttttccagaataataaatacccgtggggaaacactgacacccgggtctcaccctgaagatcctttggagtgagaactaggccaggcataagaggaacctctgtcctagctccaaattttagaaagtcaagaacaccccagggtatcagccctaagccagagagggtctctcggattgcagaagcctctaacattctcctccagagaggaaaacaccaagaagagaaggttattagaaacttaaacagtattttgaccccactgttgtttttatgtaattgctaattggttgttttttattgttgttgaagatttgttccttaccaaaaaaagcactatttaataggaaaat

SEQ ID NO: 43042 - DNA, 1339 bp, Bovine  19866881868424
gaaaacttaggtccacacaaaaacttgtacatgaatgtccatagcagcattattcacagtagcccaaaagtggaaacaacccaaatgtctatcaactgataaatggataaacaaaatgtggtatatcgatccaatggaatacaaagaggaatgaggtactgattcatgctgcaagatgaatgaactctgaaaacactatactcagtgaaagaagccaatcacaaaagacaacattttgcatgatcccatttatatgaaacatctagattttgcaaattacatggatacaaagaaagaaaagccaggtattttttaaatcaacatttaagattaataagaaaacactatttataaataagtcaagggcctagtaaaatgccataccttgccacattgcttgtaggaaattcccttttggttacagtactcgtagatgagggctgcaccttgcacacataatttagctttcagagattcgggtttataataaatcccactatgtagtgacaccactattgtgtccggtctgatgaacagctatggaacaagagaaatacctttaacagaaagtacacacaagattcattcacaacccaagaagtaggggaatacagttagagttgaagctattagagacactatttaaaactctgcctgggtttgttcttccagctggagcactggtagcttccccagcagccaaccacagtatgtgtgtcaggtccctctagcccatctctgacttcagctatgactttggggtacaaacccacctctcaccaccagcaacccacttcaagggcccaatacggctctctgccttttgcctcagggtgttctctaattttgggggagagggacttaacatccctagggacaatcctcaaacaaagggacagaagttgaagggcacatgagcacaatcctgggagatattaggcagttcctcagaggtctcggtggaatcaagctcacagcttcaacctggataacacaccttcccaagattttccctccttccctgtttactctccccacccactgactcctgcttccttggataacctcacaaattacctatttttttttttaagtcactcagtcacgtctgactctgcaaccccatggattaatacagtccctggaattctccaggccagaatactggagtgggtatcctttcccttctccaggggatcttcccaacccagggattgaacccaggtctcccgcattgcaggcagattctttaccagctgagtcacaaggaaagcccgtatccaatatccagtacccaagttctagtcccaggctctgctttttgaagaatccagactgg

SEQ ID NO: 43043 - DNA, 1765 bp, Bovine  19866880782548
ttcccgaatctccttcgtactgctcagaataagagatcattttcaagcaagccatgaaggaaaggaaaggattttctcattgacggttgtttcaaggtttataggtatataaagtataggtataggtaacagagtcaccacgtgacccagcaattccattcccaggtcgatatgagagaaccgagaacatgtccagaaacttgtctgtgaatgttaatagcagcagcattcaaaatagccaaaaagtggaaacagttcaaggatccatcattcccctaatgagctgcagaaatctataccttactttcttctccagccagggcaaatgcaaagacctactccacgggaacacgcttagttcatattcaagactcctgacgaaagcaccagaacaatgcataggtgatcatatggaattgagttacttctcaccatcaggtattttttctcctcttggtcctggcacatggagatggcgtcttgaggtgggatcatattccaaagcccatcacttcccaagataatatacttgtgcttctgggggtcaagagtgtggacgcttgtgtctggttcaggtgacaccacaaactcgccactgaagaaatcatagctccacaaatcacctggggagcaggaggcagaaaaagccagaagcatcatttccaagagagtagtatcccatcaacagattaaagaggaaaatctacatgttcatctcacaagatgcagaatagcatttgataacattcgaaatccattcatgactttaaaaaagaaaaattcttagcaaactagaaattttaaaagttaactctcttattaacctgataaaagcatgtcttttatcaccacttttcttccagttctatacgagggatccttctcaacacagtaagaaaataaaaatatatcatatatatgtattagaaaggagaaaataaaactatcatttcttgcagataattttatttctacataggaaatcaaaaagaatttagataaattatcagaacaggaacacttagcaaggttgctaaataataaataaaagtcagcagtatctctatataacagcaagaaacagaaaatataaaattttaaacaattccatttacaacaatgaaccaaatgcaaggtactgaaaagtttaacaaaaggcatgcaaatctatcatggacaaaattatacaattagattccagtatctaaatacacagagaaagaaattataagcaaagataggaagatcatgaagatgttaagtcttccaaaaataacctataacgtcagtgtaattccatctaaaatcccaaaaggattcttgtagaatctgacgaactgattcaaaaatgtataggaaggaactactgtatagcacagggaactctactccatattctgtaatgatctgtatgagaaagaagcactactctgtaatgatctatatgagataagactctaaaaaggagtggatatatgtactaatatatgtataactgattcattttgctgtacagcagaaactaacatgacattgcaaatcaactatatttcaataacattttaaaaatacattgaaaagtagaagaaaaaataaataaaatgtatagggaagagcaaaggccaagattaactaagataactgtgaagaaaagataaagtggggagaacttgctctataagtagggagttctagtggctaaccgaaaacctgttaaccccccaggtcaagacattatgatgtaacctcctacatcaaatcggaa

SEQ ID NO: 43044 - DNA, 908 bp, Bovine  19866880810870
ctcccacttaagtactcttgggattccctggtggctcagctggtaaagaatccgcctgccatgagggagacctgggttcaatccttgggttgggaagatcctctggaggagggcatggcaacccactccagtattcttgcctggagaatccccacggacagaggagcctggtgggctacagtccatgggatcgtaaaaagtcggacatgacctgagcaaccaggcacagcacagcacaggaggctgaggaatttactgcccattggcctataccttctcagtgaaatagaagtgaaatcagctgagagcaagggagagcttgatgggataaggagctgtaaatattaggtgcaggcttatgactttctaattagcccttctcgtaacccaaaaagtcaatttattttgttactgattaaaggaacatttttcaattacttcatccagacaagctgaccagaaagttatgtggtgcagtggaagaaagattaagattttattaagattttcctgtggctggtaactagaagcatctgctttggaaagggccaagcctgcaggcagattcttaaccactgagccacctgggaagcccataataatggttactatttgttgaaggcctatttcatgctagatccctagtatactatagggttaatataatagctctgcaaaggtaaatagtaatacatcctttaacagacaaaaatctgaagttaaaattttgtttgaagtgaggaattccctagcgaaccagtgcttaggacttggcactttcactgccagggccctgggttccatctctggctgaggaactaagatcctacaagccactgaaagtgaaagtgaagtcgctcagtcgtgtccgactctttgtgaccccatggactgtagcctaccaggct

SEQ ID NO: 43045 - DNA, 825 bp, Bovine  19866880893511
cctaatgataaatctatttcactaactcctcctttgtttattgggttttgatttttcatttaagccagtcaagttgtttaatgttgaggtaatattcaaatttgagaagttgtaacatgtagcaattcaagaaacaaaaaaggtctgttgccattacctcagttcttattatagtggcctgtttggtgcctctatagttaagaatcagggttttcccccctattttcaggggttcatgacttggctgttaagagttgttgctcctggctaatgcttggagtggtctgtgggtgggtggatgtgtgctgaatttaggttttctgtctaacaggcgtgttgggatgggaggggggaacatctagactgcccaccacatggagtgcagaagaagtaattggaaatttcagatcaattcagttttaaacacttttttggccttcccaaatataaccttgtttaaagctgttatttgccatcttgttagttatgatcccaccgtttttaagttcccaggaggggattctctaggggaggtggaagaaatgaaacaagcccagatgtctttaagatgatagctgtgtgatttcgaacgctgggtttaatcctcatactgaattattttgaattgaaaagagcgcattggcacacctgcgcctccccctcccagttaattgcaatctaatgccgaggcacctctttattaattaccaaatagtctgtgtgaccaaggactaacatttttaagttactcagctctatcctcatgggcctatatatttaatacctccaaagattttaaggataggctttgtatacttttgttga

SEQ ID NO: 43046 - DNA, 1025 bp, Bovine  19866881096162
agaaattaaagggaagtatctctaaggttctggtctgagctaaaaatggaaactggaaattcccatttcagcttccaggattaagcagtttaacagccatcagtcggatgctccaaaagtttataaacttccaaaaggctttattttgaaaagtatactttaatatctaacttctcctaagaaatgggcagaatgtttcttctcatttatcaaaaaaaaaacttctttacattttgaacctagatttttaaataaaggagagactttaaaaaaaaaaaaaaaaagaccgtacctcgggcaagcctcagttcactggatctatgtcacattgatttataacagttatttcttagggggaaaaaagcacacacagatgcaaacaattactctatttttgtaggcaacaagtgaggtgggtggtaactgagaaatttttttaaaatcctgtcacaatattctgctttttcttaagaaaccctcctcacacaacaaacgtttgccacatcagagaatttccagggcctgaagcaccactttgattccagaccgctgcaggcattagcaggaggtaattagggtaaaaagttcagccacagttccatgtctagagtcctgccagaaataaatttcctctctattcactggtttctactgtaccctccctaagaatcatattgaaaacacatttatctttgtggagtttgttcctcttctaattaacgttatggcgtttacagtgtttaataatttaaaacgtccccccatcgcagcagtttttaacagtggaggggtgcattatcatttttcctatactgcggcttcattggacaagtgactcacagaagtatgcagtgcagctgttttcctcaagctctctggtcatcataaactttacttttatttccttgtttgaaaaaggtgcatggacgaaactgacaacagatgcgttcagtatgttcagtgaaatttttcagggaaatgaagactaataagggaatatatgttactttaacacaaatttatta

SEQ ID NO: 43047 - DNA, 778 bp, Bovine  19866881189963
cgttagtaataaagtgaaagcttattttcttaccagtatattgtagcacaacacacgtcctttctgttatggggcttgcatactgctgatgttatggaaagctttctcatcagcctacccatgaggaaaattaagattgtcttgctgtgtcccagggaaatagtcaaggcttttacaaagagagaaaatagagaacaaaaggatatgtcaggcgtgtacgcaactgtcttattggcagatagcgtgactcctttatgaatgtgtgactttctgaaaactgattttaaatgaattatctttttctattaggcattgaagaagaggtttttttccatatataaatagaatttttagctctaccacgtcttgttcactcaactctaaactgaaccttcatagcatttgttttgtctactattgaaggctttctgcaggaagactctcagttgtgacattgtatggatgccagcaaaatgatcagaatccaagtttctagtgtaccatggctctaatgagctgctaattgaaggtgacaagctgttttttccttcccagttggtctggcaaaatgttaaatttcattcattattaactcattgcttctcagcagaggactggattaattagttgggaacattaagaaaagaatttttgccttgtgtccgttttggcgttgggagtttaggttttacaagatgctccccatcttcagttttgccaattgtgtgcagttgtgtaaatctctagcacaatcaagacccagcagcgtttctgtcat

SEQ ID NO: 43048 - DNA, 1916 bp, Bovine  19866880400754
atgagcatatgtccttctactctgccatcttgatctcctggttatcactcaggtcacaatctggagccacttcccatttccccatcacaccgccatgtccctcttcacacccagggaaaccatgtactgaccgcatcctgctgtttctactctcccacctggtgccaggccttggctttctgcagaggaatgccacctgtccctccagttcccaaggcccctgctgcagccctgccccacctcactgtcctggctctttccaggccaggccccgccccagtgaccccatccacctgactcctccattgcaggccccgccccagtggccctagtggccagctcacctgatgggcgccgcctcgtcgccgcgatccagccagtcctggggcgggacgatgtacatgcaccaaaggccccagttgtagccgtgggctgcgctggcgtattgctgcacctcgaacgtgtcgtacttgatgttgtcgatggctggcaggacgatccgccggcggtcctcccggatccgcgtaagggcgggctcggccctgcaaggagacgcaggtccctgaggaagggcacggatgccagggacccccgtcccgtccccctagatagggagccaggacccaggcggccacacccgcatctaatgttgggctagaccaaccctgcggagggtagatccaagcgctgcacctctggaagccccggagtcgtctgggccgcacacccggctgcccgaggtctcgctctgcctgaggcagcccgtggctaaccagcgattgacactagggatctaaacactatccaggcccgatctctgacatctgatgagctgtcctggctccagagagctctgtgagtcagcttagtctgacagccggcctgcctcacagcctggcttttctggcaagtgaatcctacttcctggcaggccttccctccagggctggaaggtacattcatttacaagcaggaatggaggcttgaatgtgccacaccctcttgtaacgcattggcgcacacccgtgaactagaaaagaaaaaaaaaaaaatccatgcctcggggagcttaggatatactgaagggacagaaaggctaacaagcgctgttgtgcagtgcacaacctacacaacagtatgtggtgggcctgactgagtgggtatggggggacagacaaaaatgtataagtaaatgatatattaggaggtgatatgcattgtgacagaaaaagagggcaaaataagggtgatttggaattgctgttttaaatagggtgttcagggtaggttgcactgggtgatgagcagaggtggtgtaggatgtagcagctggttgttaggggaggcaagtggggtgctgcacacagaaacagcagccagcactgagcccctgggatgtgctggtgtgcttgggaagcaggccaggcagcgggagtggagagatggtggccgtgcaggcaaggaaggcggagaggagagagaccagaggacaaaggctgtgggttgtgaatttccaatgcaggagtccccaggggcaaacaggtagcatttcactctggagatgaccttgtctcctgcaaggatgagatgctgcccaaggggctggagttcaacagggtcatgagcagcctgctgactgggggaccagagagatgaacagggggacaggggccgagctcagggagggacagcgggggctggggtcagggtgagaggtttctgaccctgcctgcccagattcaccttatagccagcctttcttcccatccttccaagcaagagcctggtatttacctgcctttcagcttcatgaggaggattaattaattactgttagcaaagtgcttcagagatgaaaagctctctgcaaatgccacatgcgctaataaggcagaatctttatagaggcagttctg

SEQ ID NO: 43049 - DNA, 1944 bp, Bovine  19866880598660
acataggcaaggctcatttcaggcagactctccacccaccgtcgcagttcctggacaaatgtacttggcagagcctgatgcttcaagcttgtgtcacttgtcacttgtgtcatctaaagcatcagctggagcatcagctggtgaggcccagcctcctgggcgggtccagactcagtcctgtggtaggcacccgcaggggacacccagggcacagggggcaggacgccgagggcagagaacccggagaaggcagatggggagggcccaaccagccagggcgcccttgcctccgctctgctctgtaaatgtctgggtgccaggaccccgggcctgcaggggtgctgcttggaggtgcctgtgggagaggccacgtactcactttttgggcctgtagtccgggatggtacggtccagggagatgcggtcgctgagctgtgcgttgtacccgtattcctcgaacttgccttccgtctcctggctgtcatcccgcagcgtggccgccatgccgccctggcccaggcctcctggcccctccaccagaccaatgggcttggcaagacctggtgggagaaaagaaggggtcaggcaggttgcaggtcctaccgtgtccctcccccaccctcctcccggcctcgccctgacagcccctttctttcggatgcaagcgcagccaatttctcacatgttgcagaattccaactataggacattgcaggaaagcaaagctatgggaacagtataaggaccagtgccaaggtttcagggtaggaatgaacagacagaacccagagaatttttagggcagtgaaactttctatgatgatggatacatgttaacatacatttgttcaaacccagagcaagtaggacaccaagagtgaaccctcatgtaaattatggactttgagtaattaggatgagtcaatgtgggttcattaatcttaacaaatgtaccacattaatgcaaggtgtgaataacagggtaaactgagtcaggggaggggctacatggcaactctctgtactttctactcagtgtttctgcaaacccaaaactgttcgaagaagcaaacgctactgggtttttttaatgtcaaataaaaataagtgaactttaaaaatgtaaagcagctgctcccagtccttaatattgttgatcgtcgtaattccaactaatcgcacatccacacaatgcaacgctactttgggatggaaaggaaggaactaccaaatatgcaacaacctggatgagtctcaaaagtattgttgagcaagaagcctcccaaggcacagaggaaaacataagtacaattctatttaccgtcaactacagattggctatggttttccagtagtcatgtgtggatgtgagagttggactgtgaagaaagctgagcgccgaagaattgatgcttttgaactgtggtgttggagaagactcttgagagacccttggactgcaaggagatccaaccagtccattctgaaggagatcagccctgggatttctttggaaggaatgatgctaaagccgaaactccagtactttggccacctcatgcgaagagctgactcattggaaaagactctgatgctgggagggattgggggcaggaggagaaggggacgacagaggatgagatggctggatggcatcactgacttgatggacgtgggtttgggtgaactctgggagttggtgatggacagggaggcctggtgtgctgcaattcatggggtcgcaaagagtcggacacgactgagcaactgaactgaactgaacagattggcacttgccacaggcacttgccatctacctctacaagggattaagtcatgtgctgctgtggctgccaaccttccacaccctctgaaggagctcagggtggagagcagaaacaaggcattctgttgagtcctgtcccaagaccatataagcaaagc

SEQ ID NO: 43050 - DNA, 1072 bp, Bovine  19866880717490
ttggggtgttctctgtggaggatatgggcccttgtgtcacttcctgaagtaaagttccctcagggctttcactcaaggagaggctggaggttaacgtggcttttgtaacagttacatttaatgttcaaaaagaactcaggtgggccaaattggggtcatattttagtttgaaatttgtaattcctcacttcttccactgataaactgcatatctagtcagtgagtgagtggtttatctcctgatcctgatctttgaaggaacgtgggacactgatgttcccacgaggagacagttcacatgctggtttccaggaagtgagtcgtaaccccagacagagccacagccattgataatagtgttggggagaaaagctgtggagacactagcccctcaagagaggaggaaggatttgtgagtgaagttgggtccacagttcaaaagttaaaagaagtaaaacctgggatcctcttggttattcaagccagttggtgccggatccttgctgccagggcaccagtgacactcgttgggttccatgaggacctgtgagcagtgaagtaacaggaatggagaagtgggtcgcagatgtggttaaacactggtagaagcagctatttataaatatctcatcattcagacaaaaggtttccttatgcttttatttgacaacaaactgttattattatttaagaaaaaaatatccaagttgcattatgcttgaagttttttgaattcagactattgcatctctataagaaggcctctggtcacgttatacagatgatttaaggaaagaatggaattcctgtttcttgaactgtgtcgtggtagcaatattaagagcctacttaatagaataaaaacattagagcttctttaatcaaaataaaacccaagtgttatctggcatagctcatggcccataattctgagatgggcttttttcccagataacttgaaatctactggtaacagcctcttcactttaaagaaatctaatactcatagccaccgctaaatggtattgtatttcaaagttacgaatttgcaaacattaaaaactaatccatt

SEQ ID NO: 43051 - DNA, 1114 bp, Bovine  19866880777581
agggagcagacaaacagagctgtccaaagataccccacaagacacggcccccccacttagggtctgtgccagccagaggactcccctcctgtgtctgatgggcccagccaagtggatttcttcctggaggctacattagcatctcgatgggccaatgtcatcaggggtcctgtgaggaggtggcagggtgggagggagagaggtgtgctctgttgtcattataggctcaggggtccctcccatccgcaaagcacccctgggcagctgcgtggacacgtcagcatccatggatgtcctagagtacagattcagagagcttcgagggggccaattgtcattttgggggttaattttaaagaacactcaacactcattgagaaaaagcatttctcctacaagctgtcccatacccctgaacccattgattccacctgcagcctggagcctgcacactccactggcctgggttctggacagtggcatggatgtttttaaagccctccaggtgactttgagctgcagcatggtttggcaggtgttcagctctaagaactggtggttaatgtgatactgcctgggcttgtctaccctgtggccactgttcaccttcatcttccacttcagtccacacagcagcctgagaagtaggtaccatgatcatcccatccaatggatggggaaactgaggcacggatgttgggtgatttgctcaaggcctgtttggcaccaaagctcttgctcttaatttatccagggcctgaactcagccactgtggcatcaggacaccccagccagcctgaccccgttccctgggcactacttctggctatggtctgggctgtggtccctgagagacatcaccatcctccctacctgggaggacatcccgtggcaggggtacaggatgggcgcggtcatcgtcctccgctccttggtctaagcagtagccgctggctttgctgtttctcacctacgaccagaagccaaaggagaagccccatcacaaggacccaaaggccaaagcaggctagaagggctttactcacccgtcccctgcccagggccagcagtctcaggaaggggtagtcctcccaggatgagaggggaagggaa

SEQ ID NO: 43052 - DNA, 1755 bp, Bovine  19866880827541
ttaggaaacagctggtcccagtgctgaaaaggatgctataagagcacttggagggcagtcagggaaacgtgctgccttaaaaagctacacctcaagaaaaggccaacgagctgatactccctgggaaagaggatggcaacatgcacacagatggaagaaacactcacaccagatgggggggtgggcgaccaggcgtcaggcagggacagcagggccctggtctaggtggggcatgtgctggggcaagtggacgcacagcaggatgaggccgtgggtggagggaagcatggggggcccaggccacagtctgtaggataaggcctaagaagtctgctggctgccagggctgaggcccagatgggaggcgctctgctttctgaggaaccagacacctgggagacgcctctgccctggctggggactggaggccatgagggtggtggagtgggggctgggaagagccggccagctcacaggccagccggcatgatcccatcacaccggtgcgctaacgggctgcctgcacagactgacagcgggtgggggtgagcaagcatgagcttgtggcagggtgtgagcggggtggatgtacagagtggtcagggaaggtcctctgaggaggtgacatccttcaagggcctgacagctggggaagaggcagcagcagccctgtgggctccagaccatcaacctgaggactgctgcatggttgccctgcgtcggcatctgggaacctgggtttcaggaggttcctcaccttcctctgataggaatacctcactcacatgtgctcagattgtttgtgcaaacagtgtggtttgtgctgagcactcgctttccttccgggagcctgggttttggtccaggcacacacaggtgcctacatgactggcccccagtaagaagccggggtgctgggtccccacaagcttccttgggagacagcctcttgccctgttgtcagggctcctttccggggaataaagtgcatcctggggctcctcaggcagtgctcaggagacacccgacttccaccctcctccccttccttgccgacagatgcgtgtcccttggctgcaaggcatacggctgggggtgtgtgagacgtaggccgagtcctgggagtgccgcaagcctaggggtagtcctagggacccaacacagtgaggctgtggtgtggctgctggcggaggtgaacacgggacagaggctctggagcaggttcccaccattcggacaacagccgaacacgggccagagcatgggcggggtcaggtcagctgtggggacacctccagggggcgagggagaagcctgaggcaggcaggactgccagaccccacctgctacagctggagaaacaaaagcgccgcccaagcagccggagccctcctgagcccacaccagccagaggagaaaggcgagaccgcgtctgctgggccatccccaggcctgcacgctggcaggggccgccagctcccctgggccaggccgccttacccgagctggagaagaggggccgggccaggtcctgtgggtagtggaatccggcgaacacacccggggcagggggtctgctgaacaagtccagcttggtgcccacgtccagcttgtggggctccagctgcatctgccgggacagagcgtgtataggggccggaggccgggcctctgtcctgctcgccaccaggctgccgatgagctggacaacaaggtgtgatgccccctgctccgctggcctcgctcagtgggcgg

SEQ ID NO: 43053 - DNA, 1133 bp, Bovine  19866880912101
tgtaggaggactccgggagccggggtgccaccagcccagggtggttgcagatccgctgtagcctcaggaggatgctcagcacgtccacaaagtgcccgctcttcagcgcttcctgggtcctgcgcacatgcgggaagagataggagcattgccaggggtgcaaacatgtgccagctgggcttctccccgtctgctatccccactctatgaacgcacaactggtgcatccccttgacctggtgagtaaatctgccacatgccaacccacctccatgaggttgtggttctgagactggctcaccaccccatgagagaggacgggaggccagagagccagggtacgggttagacatcggggcaccctccatggcatgcccccaaagagcaacagggcaggtgtcccaaagagcccaggggtctgtctgggtcggggaaggaatgccctgactccacacgagtcctctcacactggcggcatgctgtgctcctcctgggccggctatgggcagagcctctgacaggaccagggaggaggtaggactgttgagcccgagaggagcgtggcctccagctccaggcacccacctcccgaaaaggagccttctaaaagaccagaggaggccctgctccgtgcgggcagagagggtggtggggggcacactcacccaggctgcaggatgacatcctcgtacaaggccttctgtcgattggagaggcggcacttgaggacatgctcatatttcttcgtcagctgcttctctacgtctctcttagttctccgcaaaatgaagggctgtgtcacctgaaaagagagagctctccattgtttcctttccaaaaacagtgtcacagccatgctacgtcaggggcccgcgggcgcgtacccggtgcagccggatgaccactttgtgatagtagtcctggttctcctcgttgggggccttcagggggaagtgcaggtagggcctggagatgccggggatgaggaagtgcaccatggtccacagctccaggaaggtgttgtgcaggggcgcgtcgatgaggagcaggcgctgctggctgagtacaggcggagagacgactcagggtgggcacagaatcgctctctctgacaatactcaaggagagggaca

SEQ ID NO: 43054 - DNA, 1618 bp, Bovine  19866880923661
tccttgcctgcactcgcaggatccctgcagccctcagttaaatacagagcctgggcggtgaagccaaagtcctctctgggctgttgcagcctcatttagttgcttctgctggctgtctccacctgttgcattgcacaggggttttgaaaatacaaaattcctgccattacggtttctaggtaaaagaaacgtgaagagcacattgccttgtgaaaaagtcagacagggaagctgtgttgtggctctcgctttaagttttccccactggcacctatgaggtgcctttatcatttctgctgtttcttgttacctaattgtgcacgttgacttttcactctgcttgactcttaatcaaaagagtagtctaatggactttgtgttagatataatttttctagtccacattcatggaaacctaaaaactgccatcacattcactcctgaatgttgcctaagcattgcaggggtagaggtaccacttttgtgtattaagcacccctctccctgtccttgatgagcggctgcttcttaatactgtatttagaaatctccctatttaaactgcccctgaggtgggaagccctctgccctcaggtggccctaggtccccagcgcccatttagggggccctgccttcgcgtctcagcagtgtccacgtctccctgcccgtgcacatgggcgtccaggttgttccagcctgtgcagtatggccagaagcctgagggccgcaccgtggctttccccaacacacacccaccccggacggccacccctgccacagccacggccacaccacagggccacgttcgaggacggccacccattgccacattctctgcaaatccggatgcaaaaggtatgcttctcagggggctgtgctcggcatcacaaagggtttttgtggaagaaattcctctcgcactttccccggccccacggggatgtgtgaccactcctctgagcaggagtgggactgtctgctctgattctcccaggagaccatgtgtagttcttacatgagtttagtttttttcatgtctttgaattgtataagacattacattcttcgttgagtcactgttgatgtgatggtgaaaatgtacctcagcagaaacgttctcttttatgtcgggaaatacacgtcaaaagtcatttaagaaacttctgaggaagtctgctcttgtgttcagtgccaccacttcaacgtaacctgcttactgtgaagaaggatagggttaaacagcaggaaaggtaataaatagtcttgtaacccttatctgtggggtcacgtcccatgtttttctgagatcttcataaatgccagagcagcttgttgtaagagctctttgggaagccagggggccagtgctgcctaccttctcgtgtggtgaggacatggctctcatgatgtatctaagggccgacttttgacactccgtttactccagaagcacaccatgtagcaggatggtgaacgtaaagtaaaaatagttaacaacatataaaaaattagattttctcatcccataggccatcccgccccccttttagggagggcttctcattggagaggtggtgtgaaagaaatactgtttgttttatttctttaaaattcgga

SEQ ID NO: 43055 - DNA, 1497 bp, Bovine  19866880948397
gggaggtggcgtggtccctggagggggtggggcagtggcagtcctccgtggagctggacacggccccccggcaggcagggtgctgtagtaagtggcaacgtcaacccctggagggggaggtgccaggcagtaggtgccgtctggcagcatgtagtagctgtagtacatggctgccaccgttgctgtgaagagacacattttgagggcatgagagtggcaaatgatgggccagttggctagaatacacaatgcagggagaaaagggacacttgctcaaatgcagtgtcccttctgtccaatgtcaatcatgtattttctttatttttctgatataagaaaggatgcccagggggcaacacaatttggaagaactggacaatgtccagacacacacccaggaacaatggaatctgaacatgcatggggacattcagagaagctcactgcctacacagactgcagaatggcagattaggacaaacttcccccgtccagtacaccagctctcctccttgtgtgtcttgtgagacgaccatctgaggactaaacccctccactggcttccctgtttgacaacaactctccactcttcacacttgttactttcctctcttaaaaatttgtcttggcataaatccttttcttaggtctcccaaggcaacagacacaaaagcaaaaacaaacaaatgtgacccaataaaagcttttacacaacaaaggaaactataaatgaaatgaaaagacaactcacagaacgggagaaagtatgatgatgtgaccaacaagggcttaatttccaaaatatacaaaaacttcatatacctcaataacaagaaaacaaacaacccaatcaaaaaatgggtagaagacccaaatacatttctccatggaaaacacacaatggccaataagcatacaaaaaagatggtcaacactgctaattattagggcaatgcattaaaaatacaaggtatcacctctcactagtcagaatggccatcatgaaaaagtctaaatagtaaatgatgaagagggtatgagaacagggaatcctcctacactgctggtgggaatgtaaactgatgctgccactatggagaacagtatggagattccttattccttaaaaaactagagccaccctatgatccagcaatttcgctcctgggcctacatccagagaaaaccctaattctaaaagacacgcaccccaatgttcaaagcagcactatttacaatagccaagatatggaagcagcctaaatgtccatcaatagatgaatggataaaaaagatgtgatatatatgtacaatggaatactattgttgttaattcgtgcctgactctttttgtgaccccatggactgtagcctgccaagactcctctgtccatgagatttcctaggcaagaatactgggagcggttgccatttcctgctccaggggatctttctgactcagggatcaaacctgtgtctcctgcattgtggggtgga

SEQ ID NO: 43056 - DNA, 1375 bp, Bovine  19866880952562
ggaagcggcaggggtcgaggtcccccacgttttcagtctcaccccaccctcctcctgcctctgataccaggacaggacctaaggggtcgcggcgagagaaaacctccctcgggaccacagggtcagtgttcatagcctacccctggcaataacactcagcacccaagaggtccgggcagactgcctctgacctccgggaaccgtgcctgtgggcatcctctcccccttgggtcctcctgtctccacctcctgaccccactgttgaggctaggaaggaggtgctggcctaggatcaggtggttcccaggaaggccaaccaaccatctgtccagggagtctcaccttcagatgaacgaccttccacttgtctgacagctctgcaaggaatgcaaggggtcaccagacatgcgacccggccgggcccctcctgcccgccctcccacccccaacactcacctgtgtgcttcacatagaagctggagagggtgctctcctggcggggcaggctcacagaggacagcagcatgaaggcattgttccagaaagtgaggggcacctgtcagaggccaggctgagcaccgggatgctgcatgcccactgccccctccctccctgctcccagggacctgggtggctcacctcagggcgcccatcggtggtccgggccacggtgttggaggcggcctgcatcgtatggtagcggatgtcatcatgttccagatactcccggaactgggagaggagcagggagcggtcctcctctggagacagcaggcctcccaccaccaactgcacatggggagcagggcagggcactgagcatctctcccacccccaggacagacagccctgaggtggagctcacaaaccagagtctagaggagctgcgagagtcccctcaaccccacaacccatagatggctgggggagaccccaagactcaccatgaagagctggtgggggaacagatagttgccttcccacttgggcttctccagtgggtgctcaccctccagctgcacaaacttcatgagtgtgctgagggccagctcctaggaggaggtatggcaaagggaccacgctgcacatccccacacgttacccctgcagaccggtgcttagacctgaatgcctgcaaaaccacactccgggcagagtcaggagacagaatgaaaccacaccctcgaaaccagccacagaaagagagaacatccttacctagcgaggggtctgcagtcacagccccagacccctgctgtgcagagaaggtggggcaggggccgtgcaggtaagaggcaaagccaaccaccccagctcaccttgacctgaaaggaggggtgagccaacagctcccccaggcggttgcagcagctct

SEQ ID NO: 43057 - DNA, 507 bp, Bovine  19866881145295
tggaaggcccacccactgctctcacaggtatgaaatctctcttcctgaaaacacacaaaaagttgttcttaatcacagtttaaaagaagcatttctggtcccagtgactgggacaccagaagcaagtgcccatgagttgtccaagaataacagaggcattaaaaggcaattatccttttatttgtgtaaagatccaatttgttttgtcatgacatttgggccacaaatctaatagtaacaaaattttaatgtcatctgtgacgcgtagcaagcgtttaactagttaagttatagttcaccgacgacgacagctatttctttcattttcttaacgacaacacaaaaatctcagggtgatctctcatgaattgaactgccaagtccctgccaagtctattacagctgtaatgatttttttattattgctccaagttccaaaataaacttcacctcacaaggcgacggtagcagagtcagctggctctgaatttatttgcatgagaaatt

SEQ ID NO: 43058 - DNA, 2923 bp, Bovine  19866880372436
tgacagaaatgacatgcagaaggaaagctagaaacttctgaagcatctcaaattcttagtatcataattctaggtcttaaaataggcacttgccctccctgtaactaataatccagttcagattcaatcctggcaagcagaattcacaggaggaggaatcacacttcccagccctaaaaataccagggagggatctctaagaaccctctggggttcttagagaaaacacccagttcacagactttgtgtttgtttttttttttttaattatttcctcagggcattgccacaggcaacagaacacacactccacccaactctatcactaaacaggtaagaggggcttttccactaccctaggagttggtgggcaaatgcaagatgcaaagactctgtcctccagggacctgagtgtgcaggagcctagagcagaaagggttaaggaatctgctcttccaggagaggctgtatgttgcaaaaagtctggctaaaacggaaatctgcgaaaacaagctggtatatctagttttcagtctccttgctctccaaaacaaaaggaacaaaacccaaagacagcccttggctgattaccataattaacacttattctactgtaatctcatcaattatttcatactgatttatgataagttctattgaaaacctacaagagaaaataataaattgatccataaaaccaattctccaatttttgtacaaaatatccaccaagccaaggttttggtgaaacaagctgtgctttcctctagttctcttataaaacgtgaccagtttactttgctgtttcaaatgacattctagttgtggcatcaggtcttcatttgacagtaacatatatatattttttgctctctaaataatgccttgttgttaaacgttttccaagtttattatgtttctacaattctgtttagtcatcacttaaaaataagactagtcatgtaactcggtgagtcagctaaacaatctgagttagtaatctccccaaaacagtttttggcaagacaaacttaggatctctctactctgttgtgatgcaataccatgagtcaaaaaagtctctaactggatggactggagtataattcaactgtctggtttccagattcacgtgtgaagtagcaagtttcatgtcacagctaactttcagttcctacaccaccaccattactacacaggattaccagagaaactgatactggtttatacaaccatttaggcactatgaaacctaaaatgatactctccgcaggattatacttagtaggactatcttcacatctcaatatttaggactagcttcccatctcatggactgttttttggagggtagtagctagtttaatctcacatttagacttaattttggccttatttcccttccttttttattttctaaacctttttttatcctctcctaccacttaaataaagcaaaggcaactaaacctaggcaaaggtcctcaaggatccaaccagatatttcagatgtagcaacatgtattttgtatgttgttaaaatccaatttaggttcctgtatagagttaaataacttacttgagcacatttcatcaacatgctctcctatagataagatggctgccagatataaacttaaaacatgctccccctcaccccccaccccccaccaaagcagcaggcctgtattgggccttgagctgggcaagaatgtgctaaaggaagacactggtcacttccaaaagagcatgacatttgcttggtattctagtacaaaagtcaaagtcgcttagttgtgtaccacttctttgcaacccccatggactatacagtccatgaaattctccaggtcagaatactggagtgggtagcctttcccttctccagagggcttccctgatagctccgttgataaggaatccacctacaatgcaggagaccccagttcgaatcctgggttgggaagatcccttggagaagggataggctccagtattctctggattcccttgtagctctgctggtaaagaatccgctggcaatgagggagatgtgggttctattcccgagttgggaagatcccctggagaagggaaaggctacatttctgagttgggaagattccctggagaaggaaaaggctacccgctctactattctggcctggagaattccaaatacagtccatgggctcgcaaagagccagacacttctaagcgactttccctttctagtacaaagtacaaaattcttttagctccactttctatttgtaaagcctccaggcctttttttctctcctaagcctctgtttgcccagaagcaatccaaagcctcattttctaggtctaatcaataccaatccactttatagaacccttcctatttcagtctcattgtcccatttttgaattctcataacactcatttcataaattactaatatttaactgttacccttcatttccctatgccttttcactaaaaatcattagtttctagagaaaagttggcaatttctttgcaatttccttctcatctaacacacaagtatgcaacaaacttctagaaaaagattacaccaagacacttcgcatctggcaaatatgtaccctggatacactgcatacattttgggtcatctttgttggaacacagcagctacactgtatgtgcgactgcgcaaagttagctaatactctattatcctcagttgttttcactagcaagtctaactttccgaaaacacaaggccagcctgaagattactttgttttccatctgtcaaggagatctgcaataaaaatcctcagactaccaacagggctctgtaaacagaaaaaatttaaaaataaatgagctgttcaccttcccagaccctccctgaaacagaagactagtaaatgtcgggataaaacagat

SEQ ID NO: 43059 - DNA, 968 bp, Bovine  19866880410077
atgcatgggacagacatggaattcaaagtatcattttataaataatagcagagaatcaggcacaggaaatagagacccataatggaggttgagacaaatgtgcctgagcaaggtggtggccaccattctgagtatcaagtggggaatcaacactctaagagcagccctggtgagggcaggccctccctctcagagacagaaatgacacaagctgcccagggcaggtgttggccttctgatgagtgtggagaaaggtgatgcttaagcacaaggcaaagagctgacttttctaaagcatgtattagcatgtggctaaaaatagccacctgttccaggtcggattccaaattggaagagctcttcacatattaaaaaagcatctgtctcctggtagtcatggcaacaggcatccctgaataaatgtggagagatgtttttggaatggggctgggaaaggaagtggacataacagcctctggataagaggtgagtctttctgttcttccctgacttgaagcctcatcttgctttcctacttcctagcccttctaattttgcacagcccctggtttttctctgaagaaataccttctatagttagtgcctgtccagtgggctggacagggagaggagatggagagaagggtcagacatcccattggcatgaagagatgggatgggaggccaagctgctcgggctcagaatctcatgtatgctatattgtttggctgtttgtgtatttcctttgtcaatgatccccataaaatatatttgtcacttcatgttaactatattaagtgccaagggtctgcttgtttcttttgcttagtatgctttgtcaactccttgaggccaaggagtcctttctaattccactcatagcatgaaaacactcctccaatctatccatgttgcttgtactatacagcagaagaatattctcttaggactcagagtgctaccccat

SEQ ID NO: 43060 - DNA, 1619 bp, Bovine  19866880587582
ttttaacctgtaccttttggcacaaattttctagagattataacggaatctttaactgctcacagagattaaatatcgcacactgaatgtaaagactttgcagccgtgattttcttcaatctgctcctccctctgccattctttgactgtatgtgtcatgtagcatcctggcactgggtcagtcagtttcaggtatcataggcatttggtttattccaagatgccagctcttcctggctgtgtacatgctaagtcacttcagttgtgtctaactctttgcgaccctatggactgtagcccaccaagctcctctgttcatgagattctccaggcaagaatactggagttggttgccattcccttttccatggcctcttcctgactcagggatcaaacctgcatatcctgcattacaggcagattctttactgctgagccactggggaagctccttttcctatctagtagagatcaagtaaggcttctccatggagcagggggtgcccataagtttgtattttcaggtaaagaaaaaaacatagagggacctgggagatcatcttgaagaccccccaaaatatacaggttcctcagagtctaacaataacctctgaagggctgaggacgcacatctgaaagttctgaagaatgtgcacaggattaggaccaacctgatcggatttacggagaaggcaatggcaccccattccagtactcttgcctggaaaatcccatgggcagcggagcgtggtaggctgcagtctatggggtcactaagagtcggacacgactgagcgacttcactttcacttttcacttccatgcattggagaaggaaatggaaacccactccagtgttcttgcctggagaatcccagggacgggggagcctggtgggctgccgtctatgggtcgcacagagtcggacacgactgaaggtgcttagcaagtcggatttatgaacatccaaaattaaaaactaaaggataagtaagggggtgattctctctctgcagtaggattccccatagggttcctttaagcagtgaactcctctactgctattgaaacattatttggtttgcaaaattttaattagaccttacatttccagaacacatttacgtgcccctgactactttgatttaatgtagattttatttgtatttatttgagcatttaatgtcagacactgtgctgggcattgtgttcaagaatactgaggttcataagacccagtccctgatgtccaggagatagtgcttcatggaggagctgggtgtgtgcacagctaggtagaatgcagcaatgcagatgtactaaaagggctctgaggacacagagaatgaagcagtgacttctgcggtggtgaggacatgtatactgggaaccttaacagaggagacgatacctgaaaaggagtttcagtcaactatcaaggtcacaaatatttagtgagtcccttccttttgtcaggcagtatgtcagggtctacagcaccacaggaatgacagtcagagttcctgccttcatggagcctacactgcagctgtggagataatgaacaggtaaacaagataattatagactgtgaaacgtgctaaggaagaggaaaagaa

SEQ ID NO: 43061 - DNA, 2557 bp, Bovine  19866880669718
cctacctgaggaatgcctgaatttggagctgtggggtccctggaccacatgtccctaagtcaaactacctgcctattccaacctctaccaacccactgccctggctggtcagggcctaaaccccagaccttaaactctgcatccctcttcagctatggtcctcccacctggctgttctccatcctcacactggcctcctggactcaggagggctgatttgccctttccagagctcatttcctcccttcctgtcatccaccaccactctctgtacatccaagtccggtatcttgctcactctgccctggcccacctggatctgcccgagctctgggtcctgtaactagaaaggatgctactgggtattatgccatttggtctaatgaacactgcagacaaagagcactgaagaggaagtggtgaccctaggctggcgtctcagggaggcagcacactgaaatggggtttcagctggacttttagtggatgaatacttttgcatattcagtagagcagagtgaagtcaagtctaggatattcttgtcaaatgtctcctgctattacaagtactcctgctaccactgttcctgctgataatcatatgtattaccagtgaatctctatgataagcactgcatatctgtgtatgtgtatatgtatgtataatttatatatattatttgagacttttgacaagcctacaagagaggtgtggttgtccctattttacttatttatttttaatgttttcatttatttatttatttggctgggctgtgctgggtcttagttgcggcatgtgggggttagtttcccaaccagggatcaaatctgacccctctgcattgggaacgtggagtcttggccccctggaccaccagggaagaccccatccccattttagaagtgtaggaaatgaggcacagaggagaaatgttcttccagaccccaagaataccaagtgctaagaggaagactggcagcccagtctgccgactgatttcttttttccttgcagtttgctcctgctgcttccctgtaattaaagaaagcagctctcccctctgggagcagcagcctcctctccgtcttcccagggagacttttgcaaataaaactcaaatcaaatcacactgtctccccctgcccgccaccccctcagcacgtagacctgcaggcaggctccttcctcgagggcgtccattattctggtaggtgaactgtggctaatggtgatcttggtaattcggcggccctgagagttgtctgaaagcccggttcactctacaccctttttcattccccgtagctttctgagacatttacccggagactaaaaacattcatggttcgatgcagccccagatctgaatgactttgtgaaacttactaagtgctttgagagttaggcaagcaagaaaagatttgacttttgttctaatgaaagcaatttttatcatttaaaatatggaaaacaatcccacttttgcacttcagacaccaatatttgctagcatgcgtagccctataagtgcacaatccatgaaaatcttagatttgcagaaaagttaaactagaggagattacgtatgtgtttaccaggatggctttgtgcaggaattgcagtaatttgaaaacctgaatcctaggtcaggccctgccacttcctggcataacctctctgcacctcagtatacatctctgtacaatggcaagatgtcaggttatgccatttcacctgtccctcgaggttgtcatgagaatccaatgggccatagactgtaaaccaaggcatatttagaaaggggaggcccctttgatagaaggagaggactggggcgagggcagaaggccatcctgtccagggatggtaccccaggttgttggggaaccagtccccttcctagtttgattaacttgtgaacaggctcccaccacagaacaggagccattccaagtcccattatcctgcacattctcaccctgcagccctgctattcacttaaacaccgcagctcccgagtacattttaatctctgatcattagttacaagattttcttgttaattctgattcagcagattttgctgagacaacgctcttttttcccttttcattttggtcacgctgcacatagcctgttcagacagacaataaatctggtggctaacctccctcccgaggatgaatcatccaaaactctgcaaaggacacagccacgggggtggccacagggagggggcctcctctcaggctctttacaggtgactctgggggaacttcgtgactctggccccgggacacaaacctgcctgtggtgattacatgggatgtaacaagattaccccagagctcaatagcaggcaaatcagggaggaagaaaaaaaaaacagaacagcctaggacaactcagcagaatcagttcctgctgcttttattagatcacaggtatcatgcattgaatatgctgtggttttatctaacctggagataccgacagaattttgcaaccagcaagattgatttggggccctgcacttcgttcccttttccttcc

SEQ ID NO: 43062 - DNA, 1591 bp, Bovine  19866880672128
ttagtgcataagtgtattaactatgttttcctattttctctattcttgatgctctggcatatagggcccaggcgatcttgcagagactgcctttcccagagacaggaaatgactccccctgtgaatgtgcctttcctatgaaaacctacctctccagagcccagagctgcccactgcctcctttatggagctgtcacaggttgaccactatcatctgccataatccctcgagggtcaggtaccagacaactttaaatagtccctacacccatgagccccctgaaattattcaaaagagtccattctagacctgtgtggccagctgaccctgtctcacccattccttcccaggaaaattgcaataaaggctctttcccatgattttccctcactccttctgcatcttgaccaactctgggacttccctgtgtggtcctgcatggcatggagtgcccctccctcttgagaactgtaacaaactatcttttcatcagcaatcatctcccagtctgttggccccataaaaccagaataataataaaaaaaaaaacatgttttaaaacaataagagctcaaattctggagtcagttctcctggattcaatctcatcgccaacatttactggctgtgggacacagcctcaacttttcctctctacaggagaaacaataatatctaacctgttgggctattaggaggattcaatgagataatttgtataaagcacttaacctccagtaactgccatatgtaaatgctaaataaacatgagatctagatttatatttgggaggaaaaaggatgcagggcccacatctttttgaagtctataatcagatggagctttctagaatctcctgagtcttcctattcactacccaaatggtcctgatagctctgagaaagtggatgggtaggtggggcacctgtgtttcacagacaaggaaattgagactaaaagagcactagctagtcaatgaaaaaggttggactaagatccagctctcatgacaactagctttttctcccaggccagatgtggcatagatgaggacttggcagtcagacagaccaggcttaaaagccagctccaccacttcttaacccggtgcatgctgtggcaggttggagatcactaagcttccattttattaactgttgaaaaggggaaaataattttttccctcatagcttgagactttttaaaaagaattgaatcaaagctggttcaggcaggaaaaaatgagcagtctcctatatactaagagctctcttattttccaacaaagaaaatctctaatacaggaaatagctttatacacagggctgttcatcacaacatcactatctaaatataattagaaagcaaatgataaattcaataacagggaaatggataaataaattgtagtatattcacaggatgggataatatacagccattaaaagcaatgtttgcaaagtttatgacaaaactgtatttactgttaggtcaataaatcatgcctcatattgtttcattttcatcaaagtaacacaaagattagagagggaatcaggtgacaagccttgcgggaaagcaacagcggc

SEQ ID NO: 43063 - DNA, 784 bp, Bovine  19866880718106
atataaaattttgcccactgttacagagttttgtgtgagttcctcaaactgtttgctctttatgttacagctaatatcgcagggtaggttgttatcaggtaaacaatgaagtgatagctaattcttttagtttctactttgcagtcaataaaaaatttacttgttttaaaaaatatcaatactgcattgtccagaaaaaatgtaacaggtttatttataattgttataaagttgaactgctaaaacttattcactgaaacattttagaagtttttcatttgtttttttaattaatttttattggatagttgttctctatgttgtgttagtttcggctgtacagcaaagtaaaccagctgtgtatatatatttatatatatatatatatacacacacacatatattcccttatttttggatttccttcccatttaggttactacagagcactgagtagagttgcctgacctatacaggaacttctcgttaattatctatttaataattccatggactgtatagtccatgaggtcgcaaagagttggacatggctgagcgacttttacttcttcttcttcttctatcaatagtgtatatatatgtcaatcccaatctcccaattcaccccaatccctcatatatggatcaggacccacaaaatgcaggccaccccagtggcctggcccatgttacagatcaaaacctaagtcagtctgcactttatgggaaactccaatcaaggagatctaacatcccccagtcacaatcgtccagctcagcttat

SEQ ID NO: 43064 - DNA, 1567 bp, Bovine  19866880732550
acagagcttcctggaaggaagtccacagctgcttctcttacccaccctctctccacactccagaagcactcagccaagccgataactgtggcaggtgcttgtgaaacggctctgacaccacgggagccttcagaggggccagtctgggggtgtctgcagaatccagagctcccctccacccccacctttggaagggctcctcctgccccagcctccctggctcctgcacaaccagcggccccatagcccggactcccagctgtcagcaccagttctcctcactcaggagctaagccttggcacttcccaggtctgcaagaggccaagattccttccagagaagcacttggtctgtctccgagcccagggccttgtcccccatccagtgtcttcatagttcagattcctgtagctatgaacggggttggcacccgtgaacatgagccttccagccgagttccatgagaaaggtgacgccttttccataaaacaccaggccctggagtgctttggcctattacagaatttgaagccccttaccgcaccccaccccgacccccaccaattctggtgacctctgatctaacccagacaccccaggtatccccggtgatggggagcagttggatttccatcctcggcaaagatctagggacaaggatgagaagagaacagaggaatgttggcagcaggtgaagcaggagctggggatgctatctgagggagccacgtcatctatggggttacactcgaatcagtgcacaaagaggggttgtgccagtctcctgactcctctttcagaaggtgccatgttggagactgccaactgtcttaacctggtcccaccagccggtgttcccagaagcagaggaacagtgctgtgacttgcggagcatgagtcagggtggctgacttacatttagggaccacgtcgtatgaaaagtttgtagtttaagcactggacttgcgctcacccacaactcaggcacccagggtgcataggcactaaacagacagctgacctgtgccctcacgactgcgccaaagctaaacatcacacgatacagttctgcccagcactcccaggcttgggtgtgtctggctgggcaaatcaggaggatgggggtgaataacaccaaagagttggggggctgcccccaaggctggaaccctgcgcacctagaccacttttgctctgcttttcagaaagtttctcattttgaactgcttcccaatagctgtctcttcacattatacctgcaggagccagtctttgggtcactttctggcataaaacagtgaagtttctctagcagaatgatactcttagagctgcttccctctgtccccttttgcactgagagttatcatttgtttagggcttaattgatcctgcagattggaggccttccagctgttgaggaaggatgtgactgtgtggggatggaaggggtgcaggcagagggtgctttaggatggccaagcaacagtagggagagaagggctgactggggctgagatgccccagtggcagagtgaagggcagccccaggactaaggcagctgt

SEQ ID NO: 43065 - DNA, 1578 bp, Bovine  19866880761987
ctgtaagatgggaatgagcattaatcccaatttataaataaggaaaggagggggggtgggcctccacatctttgagcctattgggtaccatgctggcactcaatctgaagcatcatgtaatccttccaacaatactgtaagagtgggaactccttcctcattttacttgggaggtagctgaggctcagggaaattaaaatgacttgaccccagtcatagagataataagattcagggactagggaaaagccagatctttcagactcctggtctacctgcgggagtggaaattttccatcgcaggtttgaggttgatttttttttttcccctcttcagggagggaggaggctcactgtgtggttttggatgctcaggcagatccctcttggagcctcggagagccacctggttattcatctcaggctctatcccacctcccatccttcccctcccaccccagcatgcctcttccttctattcctctccagcaaagaggaactggatggccaagctccctggatctcagcttgcagaactggtaattacccctttgtgtctagttaaccacctttcatctcctctacttgctggtgtccactttcccttattagcatctttcaactctttgccaagccctccaccctgtttgtggccagctcgggttgtggttgtttgtcgcggtgatggctgagggatgagtgtacatggtggggtggcggaggggagggggagctgctccaaccaaaatcactcacattttccatcctcggtgccaggcatctctctcctgtcccaccccagaggcagccaggtttaggtcacctggcttagaggcagacagttgatagctaggcccccaaattttgggcctttggagcttgggtattacctttcagttctcttgcatgggtgaaatgggagccgtctgaccggcaacttttatactttcaacaaaagcctgctgactaattcctcatctccaggagctcaccttcaaccccagatttccctgctctgaggcagcccgtgttggcccatcagccaaacatcctgagctttcccggacagtcctacttccactgtcctcatatttaaccatttacttgtgtagcaatttatatttacttgactttacatatttcatatgtttatattaataaaaattaaaggaaattttaaacacttagcctcaatttaagtgcctaagagccacatgtggctggtgccattggacagtgagagtaaaaacatttccattattgtggaaaacatattccaatatactgtcctattagacagctccgatatacacaggcaaaaattccagcatccaaagtacagctcgcagatcgtttgttccttgaaggtcctaaaacttctctgacctttcgagtgaactcatttgagttcccaaaatgtcagagcctgttgggattggaggccacccggcaaaggatgcctttgaagaaatgtcccttttgaagttcaccattatcaagtttggaatgcctgctgttcctccacagtgagacaggtggggcctgggatgttcttggtgcctggatcgccaagacttc

SEQ ID NO: 43066 - DNA, 1108 bp, Bovine  19866880777528
ataaagaaacatttacacttcaatacttcttaatgctgtaaattttgggctcaaataaccccctgagtcaaatttgatccctatcaacttgaagggaccaagtacagttttgatttcaacacctaaacttctgagggaagatctgagaaaataaggctaggagatctaaatcctttgatgtaactatcaggctctacagacttgtcaaaatcaatgcaaaactgaaaaggatatgctaaaatgcttattattattaaaaagataggctgcttcccttccctccgtttaaaacacatgcagaagaaatgctttctgcatgaatgcacatggacattctgttcagttgttttctaaatgcaatactgtggatttaaacagtatgctttaatttaaacaaagtatcttatatacagtcaatttagtttaagagatgaaaagaaacactactatgacaattacttatcaaacactctgctcttttgaaaggtgattttaaaagcaacacaggaccaaaaacatccaactattactttatttatattactatgcttaagttacatggaaaagacaaccaagcagttctgccccatatcagggaaaagtttccaatcaacaccaattatgtggtgacaaataactaggaatggtgacatctttgggtcaagactgacaaggaagaatgggctctgatgctacggttcatctccaacaagaatatggcacaacggccagcacaagcaatactaacactgaacctttagcgctggtcacaaattcggatctcttctctgaagctagcaaatcaagtgaaataactgggtttttttaaaaagtcttaaaatgaagcccaaataaatttaaaaatcatgctcttgacacactttcctttcaaaatttacataaaatactttccactcttaatagcccagatttttttcctcacatagcccaccatgtagctgcagatagactatttctgcctcaagatgtaaacacagggggaaaaaaaaaaaaaaacggcatctgcataatattctctctacacactgctgttggatggaaaatagaaaattaaaaaaaaaaaaaggaaagaaagggaaggttccat

SEQ ID NO: 43067 - DNA, 752 bp, Bovine  19866880780670
ccccagggtgtagacaaatactgagtgaacacgtggattccagactttgaaacactgtagcagctggggagtctggaaatgaattggtcaagtgagtcagatgtggaggggaaaaatatatatatttgcctggcttttttccccagaggtcacaaaacaggagagtgggggacagaatctggtaggctgcctagcatcctttttgggatccctgcaactcagaattacagcctttcagcatccttcctggatctgatttgacatctgaattcttccctctctcctatcattgtcaggtagagagacgttttcctaaaatgaggctgaagctgaggggtgagaacaaggctctctcagaattcctgggtccaggtgacaggcttggtgacaggagcggcaaacgcagcgctctctgtctttccctccccttctatttcctgtcagccgaggaggctgagaagagctgccatgtccctgaaacacaagcaggatctgtgagctcgtgtctgaaaagcagagagagagctctttgtctaaacactcagccactgctgggacaggaaacacaggcatcagggagacgtagcgagaggaggctgctggccgtggacccttcccctttcgtttgatgtctctgtgatggctgctgagggtaggttgctgacatcagatacaagagtcatatgtgtgtaagaggttgctagcatcaagagccacacaggtgagggacacatcacagctaggaatcaata

SEQ ID NO: 43068 - DNA, 1814 bp, Bovine  19866880793051
gctgtggcttgggacagaaggaaatagcagcactcctgggcttgtgctcacaaattctaggcaaggttctctggagaaatggttgtgacttcatcacttcctccccagtgcctctctgttcccagggcatgagttaggccagctggaatgaaagccactgcctggtccagatcctggcctttcagtggaagcccctgcagctagaagtctcctgattaagcatccttccctccctcccccagcctactcccaggtcctgctgcccaggtttcttatttttcctggagaacaacaatggattggccttgtgtgtttattcctccctaggaggggctggtttataacaatgggcagatctctaccagcatcctgctctgccaaaggctgagtgaatgagaggcagctaattaaaaaaaaaaaaagtacaccctgcttcatcatcacttgcattttaccaacttttcaaagtgaaatgtggccggttaagaacataaagaattagagcttaggggcacagtggccactgatggatgcagggaacaaggaagaacaatctcccatttccactgggatgcttgtgacgtcattctccatccttgagacgtacctcgctcgaatctcccccggacagggttatggaatatccacctcaccctctcctacacttccctggtgactctaatcctaaaggagacttgagtagagattcggggcttcataacaactattggatcttcttcctttggattaaagatgcttaagcctctacccttgaaacttaaaagaaaaggaaatcctctggataaacaccatctttcataaacatctctccaacacacacccatcctgcaagtcaagagttccaaattccaattaattagcactaattgctgctgataattctggatccagtgagctgatggggcttttggaatattaaagaatgtctctcaaagttccccagggtggtaagaaaacactgcagctatcttgcataggataatttcacatacccacatcctatggtgtatagcgttattgccctttgaaaagaagacaagcttctcagtcatctcagagttggggaatggcctctctgtctctcccatttgttctacccaagtgtcccacagccacacaccccctttctcagaaagcccagactgaaagggctgctgtctccaaccatttcctcaatctttgttttagagacaaaaatcttgaatatttggcctggtcccatagccttcccattcttgtctggggctctgctactacatggcttccaaactcatcattggatggaaacaactttcaggtctccaaggactttcttacagcccagctccagggcctctgcttggccttcagtcatcatcaccacctttgcagcacactacaaagccagtctgcttcaggactcactctctcctgattctcatgatcttgctcgggtttgcctgacctgtctaacgtcaccttccctgtgccctctctggactcagtatccccccaggtttttctctggactcaaggcagctttctggcttcaactacccgtcttagactgaggattccccaatccatggctatccatctctttccacaatctgtgaaaagtgtccacttggacgacatccatcacttcccactcaccttttcccaaagtgaggtcatcagctaatgtatgtctttaaaagttttctgccccctcccaaacaggaagcttgatagtaggtccaataaaagagatctggagattttagttgatcataactacagtgttgatgcaaaaacattgaaagaaacagggg

SEQ ID NO: 43069 - DNA, 1689 bp, Bovine  19866880807054
acctgctggaggagcgataggctcccactccgtattcttgggtttcccttgtggctcagctgattaagagtccgcctgcaatgagagagacctgggttcgatccatgggttggaaagatcccctggagaaggaaaaagctacccaatccattattctggcctcgagaattccatggactgtatagttcatgaggtcgcaaagagtcagacaaaactgagcaactttcactcttagggttagcaagaggtgcatctcctggggacaacctcagcacttcccatctagttcagggcaactccacaatctgatggatcctattgatagtaccttgacctaaagttttgaccttttattcctggtacatttttgcttgattttttcataatattgttttagaatgtgatttctcttactgaattcttggcacccctggaaatttcatgcctgaggtgagtgactcactctcatcgtcctagttctagctcagttttctaagccctcaccctctttctcagaagcagctcaatgggaaggaagttggctcagcttttattttcctgccagcaattttaacacctcccaccctgcacctttctctggcgtatttatcatgcaagcacagaggcatggctcttcaccatctaatcgttctcaaacgcagagaggctggaaaaccatcagccatcctcagaaactggcaaccaaggagggcttcaaaacagacagactctcagaaacttggtgacaagccccactctgcagacccaaagaatctggctgaagtgccctctgtcctttgtggggaccatcagtagtcttaaagaggggtttctacctggaagagataaaggaaccaacagaggtctggccaccggcagagaaaaaagaaaaatgttaatgaagtgcctttggtaagcttttaactccaagccaggtagccactggcatgtgaacctggcacagatttgaatgcctttatctggcttcctctgaagccctggcatactttctgatgcttggctaagtaagatgccctgtgaaatcagagcctggacttgagaggctcaaatccagggaggagccccgaataggtaaggggattggggctcggttctatgtgacctacttggccactcctgtttcatacctctaagcctctgtgataaaatctcctgtttttgtctttcggtcactaaattgtgtccaactcttttgtgaccccctggactgtagcctgccaggctcctctgtctatggggttctcctattgggtcttccttatcccctactgaactctgaatcctcaagggcttgaatttgtcttaatcaactttttaaaaatcttatctgcagcacgcagcatgtggctggcacacagtacacccttaataaatttggggttgactgaaattttgaatgatgcctaagatttaaaaagaaaattagcaatggtgacataaagtcctatgccaaggagggaggggccaaaagcaccctggggcccctttaaattgtacttatcccatcagtccttgtcttctactctctgccttctcgactggatttattcttactaatgaactcttcctcccatcagagtctagattggaaaatttttcattggtcttgaagaactttgaataatgtctcaagtacatttattatactggagggaaggttggagggaa

SEQ ID NO: 43070 - DNA, 1217 bp, Bovine  19866880807707
aagtcgttggcttacccagttcccaccaactgggtcttgtttggtggggatgcccatttttatagctcaccagccgtgtgacccttggcaggttcgtggacctctctgagcctcagtttcctcctctgtgcaaagaggctggtgatgaacatcatacagggctgctgtttaaagcagttcaccgagtcatccatccatgacacctggtcagtggtagttcccccgtacctgtccatcccctccctccttgtgtgtggtgaggtgtgggatgcagccacacgagacccactctctgcttgggccctcgtgtgctgaagctctttggaggagcagagattcaggcgcagggagctgcccttccatccctgctgctttcaccacccacccccctccccccagccactctcgcccactccttcatgatagcgtggatagcgagtgtggatcatttctttcgttgcttctgtgactaacttgcttcacattttctggcctagtgcttggaaagttactgccttctaatgagttttcctagcaaacatattgattttgcttttactttttctaatccaattttttaaaaagccagcaacaatacctggtaaggcaattagttgcagctctcttcctccttgagaccatgaagtcaagtctctggatgaccctagccctgtggtgtcaacatttttgataacactggaactcctgatactgttgctaggacccagggccttagtcggagaatcccgcttaatcctctcccctctccgactctccagcaatggaccaagactggctcccgcatcgagcacatggcgtcccacctctgcctggacacagacatgtttggcgatggcaccgagactagcagggaagtcgtcatcaatccgtgtgagtcctcactcatgagccagcactgggacctggtgagctcttgaggaagcattcggcacgagcaggggccatggggcggtgcttccctgggtgagatgcagactggagaccaggctgcacgtggccacatgcttagcagaagccctgaatggggagatggacgcagagctcccccccaccccccaggacgggagcggttgtctcagggaggatgcaggcaaagatgcaagccaagaggaactcggagacagatccccgtgttctcaatgccattaagttccagtccggctgggtgtgccccggagtggtgtcggagacagaga

SEQ ID NO: 43071 - DNA, 1245 bp, Bovine  19866880846735
cctctgccctgctgccttttcttaacgagatgcgatagaagggctttttgtgcaattaagtcacagctggtacacaggggttcctggctggcagagtcctagactgtcttccacatgactcaggttagaaaagttcattcattcattcactaaacatatcatcattttgcatgtacaaacaccgtgagctggtgtgaaatggttcagtggtgagcccatacggcctagtaagggaggtcaagacaagtccagaaataaccatgacttgagacagaataagataagccatcaagaaaggcgtaaaaaggccctagtctgtttatgcagggagggcatatctgggtggacaatcaggaaagaccctgaaatggagaccatgttacctggcctcctggtggggcaaggggaaaacaggtggggctggagggtagggcccaacatggatggagcagaagccactgcaaaaagagatgacgagagtctcacctctggaacggcagccattcagctcagccttagagtttgcgtagggaagacacggagagcttaggagaaagagaagccaaggaaggaagaaggggaggagagggtgggcaccgagtggtgcagtcatcagaggcctcttgctcctttttacaaattcctttcctttccagctactcctagatgatggctaagagggaggttggaggacctcaactcaaggcacccaaagcttcactctgctcgatctgggctgaggcctccgtgcatgtttcacgccagcagcagggggttcccgggagagctgcaaaggtccttccctgggcctccggctttttgagcccactgccttgggcatctgagcaggggcagtggctctccactcaggccacaacctgttctgcataatgacgcacctgccacgatgctgctcgaggctggcttctaataaaccccatgctggtgggtgcagcgctcgaggtaataatcgctcttcctggctccctcaagccatagtcagaattataaagacacatgaatcagagatggcagcctgtaacaaaagctttacctccagctgttttgttcattttctgaacaacagaacattccctccatctctacccctcccgcctgttcctttgtgtttgggaccattatcagctaaatgcattcgtctaagctccaggctcacacaagtggagggagggaggcagaccaggaacggctggatcacaggggctaacctctgtgccatagttt

SEQ ID NO: 43072 - DNA, 711 bp, Bovine  19866880879358
caagctgccggccccccctgcctccaattactgcctttatatattgctagctgccaaggctgctttaggatcttggcagacagattttatttttttccaatagcttaataaagcagaggattatgtgggagtcataaatccaggagggaactaaagaacacctgctgagctcactgtacattaaactgactcccagtgagttttagagagagcctcctggcccagccagctggtcgacctcagctgtccctctcaatgcccggctcttcagggagtagcagatgacagtgttgtaacagggggctgagacctcccgcttgggtgggaattaactggaaagagttgatgagactagactgggatctttcaaaggaagaggaaaccatttgccccgctctgtgttaagctaacaagtttaaagattggttgtaatagggatgtttatttctcagtggatgaacctggtgatgtacaactgaagccaggagaagaacaggcaacagagcccaggtaagacatggcagctttggaatcatttcctcccaagggctcaatgtgtctttccttccaaaaactacacacaagactctctccctgggggcagcctccccatagattacagagccctcatctgtgtgagtcaaggcttacaagatgcttggcctgtgagtttcaaagccaatactgcagatttcatccaagtctcatgta

SEQ ID NO: 43073 - DNA, 889 bp, Bovine  19866880881257
gggttttgttttggttctcatgagttattttctgacctctgccctctgcccttctgcgttgggtccgctgagggagaggatcacggggcctgactggtggcacgtggtccccttctccaagaaagagagaagggccatgggggtggggtggggccttctatagaaagcctccctcaagcgcattgtggggaccacagggttattgctacagagaactaggatggactgggagcaaactaggcagttataggcaaatacaagtggacctgtggggaaatgcttctgaggacctctggggcttaaggctcaccctaaggggagaaatgcgtgtgttccctggtgcagaagcagggagtgctcacaaggttgctgcccagcatttcctgaatagacgccaagcctgcaaacgtacgctctcttgcctggttgctgtcttcttggtctctagggccaaggtttgaatattgaccagagactccatcgtgctggtttatacacaggatcataactcaacaccttatcaactgaagtcaactttttaaggacaagcatcttgtggcttaaaactgccattatttgacaagggtgggcctttcctcctggctattccttactacccctcggggatactggacagatcactttgtttatccagtgtttcctgctttggaaggaagaggagtgcagctggactgtaggacctccaagggggagacgccccagggagttgggggtggggggcaggacacttaggaggcaagtcagccctagatttgatttgtagatttgggagtgattgattcactgtgagttgaagcttgaagttgtaaaagtggaaataaatctttgaaaaataatgtattggaactgcaaattcctctaaggatta

SEQ ID NO: 43074 - DNA, 1448 bp, Bovine  19866880923675
cagtggtattgcttctgtcctgctgagtaggggcccagcctggctattcttcttggggatcttgaagccatgcaggctgacccacatcccagcgagccatgagcagtcagacgctccccaggccgtccttgattgcctttgctcataagtccctgattctcaacacagtgttggcccaaagtggatcctcagtggatgaataaatgaatgtgcctggatttctgcctttgaggacagttttaatatgtgcctctgtctcttttgttttgtcaactctctggccacgtatctcgtggctgtggacttagtttcctgaaaggggcatgactgtgctggctcctcagtttggatgtgccctgatggcacatgggagactcatctgccccaccacccacagctctttaggcccccaccagccaggccaggccttggcccttcactcagggggatttgaaattcagacaaaacatatggtgtttgcccacgaccttgctgtttttatgtttttaaataacttgtttttcatattattacaaaataacacatgtttgcttggaaaaaccaggcaagcaaaaattaagcacaaatctttcataaatccctaagtcttagagaatcactgtttagtgttcctagttttgtgtatgcatgcacacacacacacacacacacacacgtgcatgcacacacacagacatatttagaaaaatggggtcatcctgtacttagtgatttgtgacctgctttgttcacagaacaatgcctcgctgccttaaatggtcatcttgaattattattaatccccacccccaaggacccacttctgtggtcatcaattgcttatagttatttacaaaatgagcaacataagtccaaacaacccaaatcagtcagcaacggggagagcatttctcactaactgatgcagtggtaatctgtgctttgagcagtggtgtctgctcagaaacaagccctacatcccatgaaatgtttgtttcatcaagggctccagggctcaggctgtaaaagaaacaaagagtttactgagcagccataaccttaaaattgctacagtttctatgaaactggaaaattccatcgctacagccaatgtcaacagcccaggcaagaaaggaatgtaggaattcaaaggaagggaagaatttgattaagagagactatgggtaactggcaaaaactcgatgaaaatgaccagaagttactggcttccagcatctgcgtccagaaattagattacaggcactggccctccccggagtgggtaaggtagcaggcatataacacgtatttgtataaagaatgaacccaggctaggattcaggttctggcaaccatgcagctggctaacagtatcctgagaagcccctccccactgccttggggcctggtctcctcccctgatctatggagctcttctgccaagtcca

SEQ ID NO: 43075 - DNA, 950 bp, Bovine  19866881037066
ttctccttaagccgaacaaacattttgataggaagcccttcattattcatgaaaccttggcatttagccttgcactgaccgagacatcagaaaaccaccggtgcccttttctcacgcagaaaataagacctagacgagtctcagggagcaaccacaggctctccactcagaacccttagtttaaatttttaaagctcggagttcaaacaatttagttcttcacttctgtgtacctttgcatatttagcacttgtttcattacagcttgttggcaggtgtcgcttttctgcattaacaatggtatacatcaaagtcacttacctttttgagaacagtctggtattgccgtcagaaactcacttttgaagttggtgtctcggttgaaatatttctttaaaacctgccacaaaaaggaaggttattgcattttctacatgtgcatatgtgtctaacctctgccactaaaaaaacaaaaacacttgcagacagggccgtaatggtttaacctaaattattcaacccttgtagccttgacaaattttattaaaatcaaaatggtcacaaaaatgaatcctttcttaatgatagggatctcttttttagtctcaggcttcctctttcactagtaaaatttaagcccacttttaaccaattgttctcctaaatattcctgtcgtttggagtcagtggaaaatccagcaagccaacagtaccaatctccttctgaggcaaaagaaaaaaaaaaaacatgtgggtcgaggtttccactccactggagccttgcaattactttttaaattttatttatttattttgtcctaatgggaatgctggtcagagtagcagaaaagatggggcaattaaaagtcttgtgctgaaccagcctcaaacactctttctggcttggtttactcttggcacaagtgctttctccttaatgacgtcttatt

SEQ ID NO: 43076 - DNA, 1786 bp, Bovine  19866881046902
accacccttcctgttctgttcctggtgatgtgggcattccctttgtatgcttaagttacttcaggttggattcatggattactggtatgacctggtactgacagttttgcagaagatgtaaattcttcatatgatcatttaaattcttcacatgatacaaaaatcaatcctcagtaaaagttgagggcacactaaacttaaaagtgcttgtggcaataaaatttatctttatcagttttctggttgctaaacatacatattataaaataagtttatgaaaactagacagtgttcaaagtgactatttcagatttttgtctgtatgtatataaatacatataataattctcttcccaaaaattagatcagactttgcatcaatcctatagcttatgtcttccacctaataatgtattttggatatcatgatacattagtttacatagatctacttggtggtattttaaatgtttatgtttgaaatgtgtcctcctaaatgactatcattggtaatggtggtcactaagggtatgtgctatttcactgatggaattctagattagagccaggagacctgtgcaattgactttttgtgtgcagacaggttttgcaagaaatcgaatggttgatttctcacttccatgtcaggctgttggcagtatttcaagtactcttttgattcagggttgaatcatgggacaaagctataagacatttgcctagcaatttgcaaggtaatcatataatgtgaacagtacagggaaaacaacaaaacctgctcactctggactcacattcataatcaggagttatgaaaataataacaactaacacaacagcaacttttatcaagcacttaatggggaccagggacactggctaagcacttgacatccgatgtattatttaatgctcacagtaactctaaaattatcactgctgctgctgctgctaagttgcttcagttgtgtctggctctgtgcgaccccatagatggcagcccatgaggctccctcatccctgggattctccaggcaagaacactggagtgtgttgccatttccttctccaatgcatgaaagtgaaaagtgaaagtgaagtcactcagttgagtccaactcttcacaaccccatggactgcagcctaccgggctcctctgtccatgggattttccaggcaagagtactggagtgggttgccattgccttctccgaaaattatcactattttcagtaattaatttgaagttcttgcctatagtcagacagatcggaattgtcagcactggtatttgaccttgagctaaataaccataaagcctgtgttcctcatcaccagttattctgctctccaatttgctccccaacagcacctgacttgggacgtttacctattgttacctcaaaactcagattttgaaatgtaaacatttttattgttaggaaagtttgtggaaattttactaacacttttgtgctgattttaagataaatttagaggaggatattacaatatcctcttggttgacacaacctgatgcaaacaagggttggaggtttattggttgagcttctgttccctgaccacttcaacctttgctaagtcagatttctggaaataatatctaaagtaagacaattaaaaccaattatgaatagcaccaggtaattcataaggaaatcaatataaaatatgactttaggaaaaccagatgaagtattagtttcctatggctgctgtaacaagtgatcacagacctagtggcttaaaggggcttcccaggtg

SEQ ID NO: 43077 - DNA, 768 bp, Bovine  19866881061499
attgtaaaatatcattagtcagtctattttgaacagaatgcaagctcttcttgctatgtactaaggacaaagagcatgggtgctaattttacaggcaggccaatgtagctcatgcgctggggctccttagccctcaggattttagtatagaatttacagagcaaacatagacagcgagggataaaaccacaccgtgctatgatgggaaaaggacgagttctagtttcaaactgttttcattcccaggatctactaagcataactgctacttacactggtgcatctgtagattgtgtttttgatgacacagacttattttgcctattctttcaaaacttcatactctttgttttcattattctttaaaaaacaaaaaaacatgtgctagaatgtttagagaaggcattcaaaattcaatgcaaaaaaaacaagagcaatataatttatcgtactgttggattcaacaaatttgtttagatgttccaaagcccatggacatgaatcaatactggattaaaagatcagaaatgttagcatatgcatactctactactttgctagtgtttgaattaaatgagatcggagacaacacattattatagtctctgtgctctgaggttaggattgaagatgcctaatgatgcacttggacattactatgtattatgtgtgtatgtgcttaagttgctcagttgtgtctgactctttgtgactccatggaccatcagactcttttatccatgtattgagtgcttactaagtgccagg

SEQ ID NO: 43078 - DNA, 1486 bp, Bovine  19866881069776
atggaagagctaaggtggggaatatggggaaaggagcaagtttaggagcaaacaggaagagttcagttagaactcattgagtcagaggagactgggggcatccaggcagagatgtccagttgctattcagacataaggactggagctcaggagaggtgcaggatatgtttaatcgctcagctgtgtccaactctgtgacttcatggactgtagcccacccaggctcctctgtccatgggatttttttaggcaagaatactggttgggttgccatttccttctctaagggctggagctcagaggagaggtgcaggagagggatggaaacatgcttattggcagcacagagggtggctgatggcagggaaaacctggagtaagacaagggattatgacaggtcctcggggaagaccaacatacaagggtgggcagaggaacctgagcttgcagagtgggcagagagggtgcagcttgcatctcaggatgagagccaagactttagttctagaaaccgagatcagaggggtgcctgaaggggtttgggtggaagaagactcatatcaatggagtaatcgaggaaggtaagggtcccagggggccatgggtgggccaggtgggagtgatcataggggatggaggccttggcctcagctcacagtcagaagcagggaaacagggagccacagacagcgatgtggcagctctttcatgaagcttggctctgaaggagcagaagacaagttaggcgatgagcaacgtcggattgagggagagttcttatagtttctttccttctctattttattttttaaaacatatgtaagatacagaataaatttaaatactaatgggaaccatgcaattgagaagagagttgggtgatcagggagcgtgaaggcacagggcaggcgaaatcccctggaacaagggctcccacactgtctgcaggttagagtcacctagttgggggggcgcatcttttacaaattctacagcccaggacacagcccagattcagtctactctctggggctggaatagaggcagcagcagtttttgaagctccccaggtgactgagactgcagagagtctggaaaccatcaccctggaattctgctccttgagttgaggtcctcaggccagcagcacagcaccacctggggctcgtagaaatgcacgcctactgaaccaacatccacactgttacaagatccccgggagattcgtgtgcacattaaagtttgagaagctgagaggcaggaggagatgaatccaggcagtgggaacttgatcagtgctgatttatgaatgaatgcaggagagaagagtgcatctggggaacaggtagagggctggcctgccacagcgggaggcaccccttatccttccagataaaagagacaggaggatagtgcaggtacagggtggtcgggctcaggaagctggtgctgtctatttcatccataaaacagaggtgtcacatg

SEQ ID NO: 43079 - DNA, 1554 bp, Bovine  19866881124223
cgcctgcccagaaaggccctcctgccaacgcttctctggctgggggccttggaaatgttcccacgggtgggtggtggcgtctccctgctctcgtgtctgtttatccttgtcctctttctgtagcatgttctaaaccctttctcaaacattttctttgctccccagcactgggctccctgtgcatcttcccagtgggaagaagttagaccctgtgcttcccagatgttcagtctccaaggtagtggctggtgggcgagcaggtttctggccttgaaccggcctgcccagctgatgctgattccacaagggactctcagagacttcttccatttagtgactcacataatcgctctccccttggaacagccagttctgaactatgccgtctcccagaaattgtaattccagtctcaggctcatctttacaatgtccctttggctttccaatggtgttccaggaaactcgttcatgccgggtcctgtcttgttccctttttgggaggccaggatgcaaatgcaatttcggctcacatccaggggtctgattttaattcaagatgcagctggactacttcttaaatccaaaattcttaacaacaacccccacccacaagttgcaacactcacaaaaccacccacatggtacagttttaaagccatgtaaccattaatgaaatacagtgtattgttctactccatttagtttaatggctgcatcatgtaccatggatgtaccataatttgtttaactaattccctattgaagaacattaaggtaattattattgttattagacgagcagctgaaccttggaaacatactcttaaatgctttccctctgaggaaaatgaagaagctgactgtttcttatcaacccagccaagcccttggagattattatacccgaggctgagattcaccggcagcctcagaggctgttattgacaggagtgggccactcggggtgttggggctgaaaaaggttgacagccagcacagcctctgaagactaaaatttcaaatcaaggagagtgaaggacaaagttcttaaagatccaccgatgaaaaagtcaccaaacttccttgtattttcctctgattagaatcctcaacaccttcctttacccagttatgcaatatgtcttctcggatatgcttatggctggatgtcacttcctgttaaatgttcagaaaggactgcttgctgtcaaggagagaagcggagagattcatggtgtgtgcacagccacagccctcctcagggctgaagatgggctccttacctgcagtgtgcccttttgtgtcctgtaatagcgctttgcagccaagagcagccacattgaggaagacgagagggaaggcctgtgagagcgccccattcaggagaaacactgccctacactgagacagagagacccaatcagagtccaggcttggcagggagaccacagatagatggtgtcaactacaggcacttgccaagggcatctgcctctgcggggattgaatcctgtgctgctgcagctgttaccttcaacccgccctgaagggcg

SEQ ID NO: 43080 - DNA, 974 bp, Bovine  19866881182152
gacagaaatgacatgaaaacagcaaatccttaagaggagtcctttcacagtcacttctaacccatcctgtgtactgctgtcagaatcatttttctcagagatcactttcaccatgagctctcccatctcctgtggtcctgcatgtctcatgtggacgagtacaatacctgccttgcctgtccccaacttttctcctctactgtccagtctaacaggcccactggctttccccagcacgtcctcagcaatcccgaggttacacggttcctttccactccatggctgtccttcccctttctcctttagaatccaagctgcccatccttttagacccaacttaatttcacatcctctgcaaatccattcttggctttaccactagatgataaattatctttcctttcattaaaaacctatctatagagactatatttctgaacccaaaatggggacatgtggatgtggaattttctactgttgacagatgtgaaagacagtctgggaagtgttgcttgaatgctcaaaaattggactctggagaatgttttcatagttaacggggccagcaaacagaatgtttgaaatggtgataggatagggcattcaggatgcatggctgtatctgtccttcagcttttggcacgatctacatacagtgcattattaaatgcttttatccatattatttttcccaaagtaagctttaatttcattgggaagcggcactatatcaatacctagatttactcccaacacctaggtagagctatagagcaaaaaactggttatgaataaataattccaaactcttaatctctgtgggaaaataattcccatatggtatcaccatcattcacacatccttatctattcttctgtgaacaacacctcacacctgggatacagctcgtatgagtgatacagagaagtagagtcaagaattttcggggggccccaagagtagacacaggaat

SEQ ID NO: 43081 - DNA, 1137 bp, Bovine  19866881339111
cagaaaactttttcctttttttggctacacggggtcttcacagctgcacgcaggctttctgtagctgtgaaattcaggcagctcattgcagaggcttctcttgttgcagagcacaggctgtaggcgtggacttcagtagttgtggcgcatggattcaattgctccaaggcgtgtaggatcttcccggaccagggatagaatccatgtcccctgcattggcaggaggattcctcaccattggaccaccaaggaaagtcctcttcagttttagtttttaagtagatctgatgcccttttagtattcctgcttttctaatcttctttcataaatgtcttccttttctatagctttaagaggtttcaagtgcatgaggtaagaaattggatttgattttcttgggcaccatccaaccctgaattcaatgattctttgaaacttgcaacatggttaacactaaaccggcaccactgaggaccactggcgattaaacccgcagcgatgtggatggtaactatctacttaatgagaagaaacaagcctaaccagtaagttatttatctagtgttacgattattgagtttctctgacattatctaggttgaatattcaaactgactacactcctagtgtgcattggaaattctgtcttagtaatgacaaccatagataacacacaataaacttggcactgtcccaagtactttacattcattaacctatttatttcttgtaataatgctatgagataattaatactttcatccctatgtgacagaagggaaaacaggccgagtaaggttaagtcatttgcccaaaattgaagttggtaaacgatagacttgggattcaaactcagctcagcagaatggcttctttcccactctgcatacttcctcctgaagctcagaagaggttattgaacaccccctgtatataattatgctcttatgtttcctcatatgagactactggaaccctttcctttgcctcttgtcattttgtgtatgggttttaccttttgcacaccaggaaaagttggaagaattaggagaccttcgaaggaggtaagaactgcaagtacaaatcatgaagctgcaataagaaataagaagtaagcaaggaaatgcaacccactc

SEQ ID NO: 43082 - DNA, 2226 bp, Bovine  19866880257247
tccaagggactctcgagagtcttatccaacaccacagttcaaaagcatcaattctttagtgctcagctttctttatagtccaactctcgcattcgtacttgaatactggaaaaaccatagctttgactatatggacctttgtcagcaaagtgatgtctctactttctcactgtctagatttgtcatatcttttcttccaaggagcaagcatcttttaagcgtctgcagtttgagaagctagaaagctacaaagcaagggcatggatttttgagattaatccacctaccaagggggtccatgtcagtgtagacaagtcgggaaggaaatccatggaaagagagaactaaaattggacctccagggaaaaggagggtttggccaggagcggcttcccagcgaggggcgtggcctgaccagagaattagcaccaggcaggaacctggtgagtttgagcaaaagtgggtgtggtggtggctgtggttattctaacaaaaccctgactgaacctgggctctgtagatccaattgcaatttacacttttctgtcaggacaaatgaaaatgactgtttgatctttaagtgaatataattttgcagcacccataaggtattattgattaaacagaagagaggcgtagtaaatttcccagcaggaaacagtgccgttattcttttctatggaaaataaatactaagttctaagtggtgttttcggatgcatccactgagtcgctgaatcagcccggcctcctctccactgtgtctcgagtgggtgacagacaaccgctgaattaccgccggcaactggtaattttgccatccacggcctcactctgctcatttaacgttaggaaatctcaatacttttgtaaatgacttaaaatatttgacatgtatgtctcgattctttgaataccatggagactgtggaaagaagtctttgttaaaaactcggcttttgaggaacattgagaatggagcttcagcatcaggagaaaaaaaaaaaggtgcgaggagaaaccaaggcagcaaagcctcagtgccagcgcacctgtcctgtcacgccaagttcagcatcacacgcctggacatatttcgggaggttaatgaaataatgaggagactgctgcctcctaagcccctcatagagagaaaaccttttcattgctgagaaatgtgataccatgatttccactaacaattcccatggaaggccagtgaaattcatcacagatgtggtcaggataattatagatattactggccctgcaaaaccattccattccaaaggaggcatcgctttctgccagcagttttaagatctaggaggtgaagggacaccctgagaagcagagttaatgggagttagaaagaaatgtctttagaatttagaccctgagatccccgaggtacccagaaggatttcagagaatgagaaatctgtctggaagctcagtctgaatagaaggaagactcagtgatgaacagcgtgcctttctgtgcaatcctgccagaccacaacactgcactccaacctggcttcctactctgtgggtgaagctgagtggggtgggaggtggcagagggaagcttctcggtgattcgtaaaggcacggacgctctaactccgtcaggcgggttgtagtcacaataccaggacgcttaggatctctgagttctcttccttaaccaggaggaagggaggaggagctttcccaaggactcccaaaattgtgcctttggctctaggttacttgctgcttcttatctgatctgtactaaaaatccaactcaaactggtgcaaaccattcggggagattatcggctcatgtaattgagaagtctgagtgggggactgactgactgcagatttgttcatacgaggggtcttgttggggacacatgcatgttgggctgctttatcatgaacgacagtaagtttcatgttggcataaagagggggcttccagatccctccattgtgtatttatattttcctctattaaccagcaagtaacctgtgggaaaagattgaaggcaggatgagaaggggatgacagaggatggggaaagattgaaggcaggatgagaaggggatgacagaggatgagaggcttggatggcttcactgactcaacggacatgagtttgagcaagctgcgggagttggtgatggacagggaagtctggcatgctgcagtccatggggtcccaaagagtcaga

SEQ ID NO: 43083 - DNA, 1398 bp, Bovine  19866880422213
ttaaaggtaaggtcttggctacacaggggatgaagcacaaggctgacctcatgaaggtcaagttctaataaccagatgagctgggggtgctgtgaggtcaggatctacatggggtcctggagatgaagaacccacaggctggtgaggggagagaggtaaccaaggtaaaggatcatgtgatgtgtggctgattaggtgcatgtgtcaatcggtagggaacaggataagcaggtggactgccctgtctatgggtgtgtgatggggatgaggggacagacaggccaccacctggatatggaaccagaagaacttgcatcctgtcctgaggcactgcccacggcctctcccctgcagtatgcgtagcggcagtactggttcccctgacccctactccactcctgctcccataacccactgtccgcacacagcccctggtaaagaccctccaaagccttcccacttgcttaaaatggaacccaggctcttcaccatggccccaacctctctactcacaaaccatctccttccccgacccactgtgctccagacgcaggaccttcttgtccctttaggatttcctatccgtccctgtcttagttcctctgcccttgctgccctctctaccagaaacagccctgtggcttgaccgaatccacacccgcccccgcccccagagccccagcaagcactcaatctgaggcagcaggcagtttcagtcatatcatctgctctgcttccttcatcatgccctcctgcatgaaatcacctcgctcaggtactacctggtgtgttttttgcctctaccctgagagcatgatccccacgagggaaggagaatttagagctgaaatgaccagggaaataataggtccagagcaggtgcctgaaaatgtactgggtagaaacagtaccttggacagcgccctggacagcactccacacagttcctgcccttcaggcaagcagggcatccacctgcccagcacagagcctgtaactcaaagcacagggtctcctcctgagaactgggtggtagatggtccttaaacatcctttcctgcttccactcaggtgctgagcacacggacatctacctaactctctcttctcccaactgcagttaaaggtgacagcgagcctgacagtttactccacacttgctcagttggataagatgaataagtgatcagcagtgtcccagttaggctgccttctgcggttattatagattcgacacccaggcatcccacagaggcacggctccttcatcaatgcgggcttcttttagcccacgctatattaagctgagtaaaaattaaacactgactgttcaatgaaacattatattcccaatgaaacttggctagttaattacagggactaacactgcttttaaga

SEQ ID NO: 43084 - DNA, 1245 bp, Bovine  19866880537928
ttttatgacagcttatggcaaaggcactgaagtgtcaccaggcttccctacaactctagcctgccctgtcccagtgcagaagctgcctgatcccagaactcagtcttgctggttgagatccctgctcagttttgagctgtgtgctctcgagcaggttgcttgacttctctgagtttcctagttctcatgagggaaaagagtgtgaaatgatattccttctaaggtctgtgcaaggacggcctgtggtctatgagttccagacatgaactaaaacaccgaatattctcagctacttaatgctatatcttggtagctttgattgatcccctttcaaagtttctaaactgggaacattaaaaaataaatgacatttcagggccacggggaaattgcagtgttatagaacagtccctaaaatcttttcagaatgatttctggggctcacatctctcatatacagaagctctttcctgctcaggacatgcttagtagttcttatcctgcttccttttaaaataactctaaaatacatgaagtgaagcgacagcacacaccgagctccacctcagggtggaggtggttggggcctgatttctgatgtgcttgggctctgctgagcatgaagcccttcctgggccccagcaaaccctcatgttttgatgctaattttcaatttgcatctttaaaaaggtaacatttgatccagatgagctggtctggtctgaaatatttatctgtgaagaacacattttagttccttctggggagggagggaacgcctttcgacgtggaaggtatttaaagggcattatgggggtgtggcgtgcttctctctgaatcccagctgtttcaatgtctctttgcttgttctgactctggtactggatgaaggataagctgaaggtcagggccatgctcgctgtggtggctacagggctggcatgggcttctctgaggtcagtgatagactgggaagtccctgttgggggccagcccagctgggccctggaaaccaaatgcaccatgcaaatatccacggtgctgccttctgacacaactgcctggcagttttctaagctgctcagcatgcagaaacttaaatgtcacactcgggagtgaagaagcagatggacacactctggatggccccagtggacctgtccctctggtagttgtctgagggcaacctgaggacacgcaagggaccagggcaccagtggtcacagagagcttcatcccatagat

SEQ ID NO: 43085 - DNA, 1724 bp, Bovine  19866880608711
agtagtgagcggtggggtgtgtgtgtgcacgtttcgattttccaacactcatcactcatcacttccaaggcaggggccaggaggctccaactggggtgtagcaagctgggccacccagcatttgccccccagcatgcaggtcccctgggctgcctgcactttcagagcccgggagtgagggctgccacacacctgcaccctgggcacctccctggcctcacctggtcccagtcccggccctcagtgttggactcatggccctcggattcatattcatcccaactgcccgggaggagcccctggcgtctcccacacccaacccaaaagctctcctgggtgcatgcagagaaggtgtggagccccaggagaaacacccggtcaaagaagcctcaagggaggggcttccctggtgctgcatggccatgactctgtgcccttaatgcaggcggcctgagttcgatccctggtcagggaaactagatcccacaactaagacctggcacagccaaacagataagcatacatttttaaagaagtctcaagggaggctggacttggagggagtgaatggtcaaactcaggccaaatccaggtcagctcaggtcagtgcagcccacaccaggtcaattcactctgagtggccttcagcaactttgtcatcaagtgagtaggtcactgagttccaaagacaggggaaactgagggtgcagcccaattctatcctgtctgaggatctctgactgctcacaaagagtacatcttccccaactaaatgctgcctgctgaagggtctgacagagatgggcgcccagtaaacgccaaaacaaaggccccgctgggcccataccctcagcgtggctgtttgacagcatgtctgccgcagcatcattatgctgccagcaacttgacatcactttcaaaccacggctttatttcaataattataaagtgttctggcctctgacaaattaatgggaggccttcctgcgtgccagcagagcggggagaggcagtgttactagggctgggccacgccctaccacccactttctgtttgtcctaatttgtgtttgcccagaaccacgggaaacccagagactggcagactcgttactcagttttcacccccatcaatctcggggaggttttacatgattggatatgagtttggggtgaactattcagatctcatattttgatgaatggggaaaaaattgcccgagagaacacagaatcgtgtgcgtttgcacatttcaggaaaacaaacatcaccttcgccaatccctatttctacctgctgcaagaattttctgcaaatcttaagtgtttggtaagcaaagatcaccagatgtgtgtcctgtctgccccgagctcacagggagagacttgtccatctctgagcatcatctgcctcctcactagtaaagaatccacctgccaacacaggagatgcaggtttgatccatgggtcaggaagattccctggaggggatgacaacccactccagtaatctagcctggagaatcccacagacagaagagcctggcagggactacagtccatggggtcacaaaacagatacaaccaagcatgcatgcatgccctgaactgtgggaaggttatttacaacgtgtgccctcaaggacccaggcagaccatctgcctggtggcggggcagaagcctcccctagcactgtaagggtaacaaggtcttgatgctgaa

SEQ ID NO: 43086 - DNA, 1140 bp, Bovine  19866880709320
accaaggtttggcataatggagcccttgaacacagcaggccctactaaacttgggttggatgcagtttctatgaacctgtgttttttttaacctcacttatttccattctcaggcccacaatggggatcttacagccagggagaccctgcaaggctggattctctgaagaagattacacagcattaatctcccagaatattctggaaggagagaaggtcctcaaaggtaaggtggatgtgggaatgaattcgcatactgcactctggactagggagaacattgccacctgcagaacaagaggcaggactggctttgagccaggctgtatgcgaagcgaaggtggagaggtcagtggatgtgcagatcagtcgacctaaatggccttttgcatcacaggtgaatgattcagagtccctgtcatttttgagtgaggtgaatcatttcctgggcaacaaattggaattcggatctagtgtcacccaaataatgtgcagagagagactttcttaccaagtatttttgtgtatgaaattctggattcttaaattatccctgctttgcaatgcatgataaagcagacgatgttgttggggatgcggtaaataagcccacagacgttctgttcacagacatggcatgcgttctcattactgtcccactgacaacacggaaacacatatgcaggagggagctgccattagctccattgtccctgcagctcgacacccacgcttgtgacggggaactcaggggcagcttctgaactccagtgacgatagatcctcctgcatagatatgcttccctctcaagacaaactaaactttttattcacgtgggaggggaaattaatcaattctttcttccttgaggttttaaagtggcacggcgaatacctcgaccctgtgcctcccctccctgcatcagttttccagaagcagatttcagccagtttcaaagtgacggagggaacgaactttagcagaagcatcaaagctgagttcagtacccatgactaaaccacactcaggctgctgactttgtccccagttttccgtttcagggaattcagagtttctgcccacccccagcagatcctttgttgggagggactctcacagagtgggggaattcttcagat

SEQ ID NO: 43087 - DNA, 725 bp, Bovine  19866880720935
caatccactatatgtatatgcaaaaccgactacttatacatgtgatccaccgaatatacacacggtccactgtatatacacacaatccacttcatatcagcacatgatccacatcgtgtaaacacatgatccacataatacacacgatccacaaaatacaaacacacaatctacttcatataaacatgtgatccaatcatataaacgtgatccactttatataaatgtgacccacatcatataaacacatgatccacaccataaacatgtcctccactgcatatacacatgatcccccctcctccattcctctggtgggagcagcagcgggcatcaccattccgcccaggcccacggtgacttccctctgggtcaacctctcccacacagactgcagtgggggagggttgtgccccagccccacggcgcccacctcacctctcggtccaggccagcagccactgtcacaatgtcgcccgtctcactgttgatggtgaacatgttctgggaggggctctgcggggtctgggtcacgatccggtagcgcaccatcccgttggctgtggtggcgtcatccgcgtcgttggctgtgactgtcatcacgtaggtgcctgcaacagagacggcagctatgtgggactcgcctgccacgcccgccactgtccctcgtacacaccccagcagatgtctcccgcagtcatatcttcctggaggctggatgtggt

SEQ ID NO: 43088 - DNA, 1509 bp, Bovine  19866880781861
tgggtgataggtacaagagggggtcaaatgaaggggcagagtacagggtagagagagcaagggggctgcagagagaggagaaggaggatggaggggaaagtagggagatggagggggaagtagggagatggagagggaggagaagcagggatggagagggagatgacgaggggggagggaggcgggaggcagaaagatgttggaaggagacaaggaccagagcaggtcagtttaacttgatctggtgactatttgcacagcagtgattgatttgatgatggtggagagacacaagtgttggataagaatattccggggcttctctggtggtccagaggttaaaaatctgctggccaatgcaggggacacaggttccatctttgatccaggaagatcccacataccacagagcaactaagcccgtgcactgtaactgctgaagtctgtgcgccctaaagcctgtgctctgcaacaagagaagtgactgcaaccagagagcagccgccgctgcaactagagaaaggccgaagcagcagtgaagacccagcacaggcactcaatcaattaaaaaaagagaatattccaggccacatgtcaaccgctagaattaaggcaacagtccagctcaggagagggtctctgaactcccaggttggaggacaggtccctgggttgcagacctggcttctgagactcagttacaactcattcagcaggtcctgtgttctgtccagttcttggtctgctgaacttagatatgacctaaatgaaccactagcaatatcgaaagtaaataatagccaaactgatagcccttaactaaccggagttaatttccttttaagaaagtgggtgcgtgcttagtcgcttcagttgtgtccgactctttgtgaacccatggactgtagcctgccaggctcctctgtccatgggattctccaggtaagaatactggagtgggttgccatgccctcctccgggggatcttcccgacccagggatcgaacccacatctcttgtgtctcctgcattggcaggcgggttctttaccactagcaccacatgggaagctctgtaataaaggaccagaaactacaaaatccaacctcaaacaacacccccacacccctcccatggtggcgagggggctaagcctttttcctggaaaatatttccatgctccagacgctcggagactatagactgcatttctagttttcaaataaatgctccctcatcaggtgctcgaggactagcagatgctccctgagataaatgctacctgtcaagttgtccctctgatcaggctttaagggagaaagaatttccaaatcatttacttgggaatttaaggaatcttaagtgaagtttgtttcccagaaaggaaaccctcccctatttcacattgtcaaaactatttttaaatagagttattctttgtgcttaaaactactcctaaaaataactccctggctggtggaattacagcaggcttgctggttagtgggt

SEQ ID NO: 43089 - DNA, 1958 bp, Bovine  19866880787999
cctatgcactgtagcccaccaggctcctctgtccatgggattctccaggcaagaatactggaatgggttgtcatgcctcctccgggggatcttcttaacctaggcatcaaatgtgcatttctttaagtctcctgaattggcaggcgggctcttagcactgtacctcctgggaagcccttcattctcctttggtcagtgccaatcctgtgcccacaataggtcctcactatgtgttagaagtaagccaatgcctgccacatccagccttttgtgtgtataaggaccagcttctttttaattgaaatggagcaggttgttacttagaatttccagtccttgctgcagaggacaggtggcccaaaagtccttgagaatcagatgggaatcagtccttgagaatcccagccctgtgggcctggggagtttctgtttgccctcctccccgcactggaccttccagggatgggtctctcttccttccctgactctcttcatggaaacaacacccagtatagaaacacatcccctcacacagggcagtgaggacaggcactccgggtggcagttagatttcagccttggtctggctgattgggacaaaccatggtccttctccccacgaggctcgtggcaagagctcaagaaaaacaggtccaggctggaatcctgactctgtgcttcttggccccttgacccagatgttactgtttctctctgagtggcaggggctttactgtaaagtagggggtatattcggagaaggcaatggcaccccactccagtactcttgcctggaaaatcccatggatggaggaccctggtaggctgcaatccatggatcgataagagtcaaacacgactgagcgacttcactttcacctttcactttcatgcattggagaagaaaatggcaacccactccagtgttcttgccttgagaatcccagggacgggggagcctggtgggctgccgtctatggggtcgcacagagtcggacatgactgaagcgacttagcagcagcagcagcagggggtatattcttgaatgtggctggcagagtgggttgtcaggtaataatgacaatgatgcaggtagcgatgaggaagaagatgatgatggtgaagatgatggtgatgaaaagtgttgatgaagatgaagaaaataatggtagtgagatgatggagctgatgatgatgatgatagtaatgacggtgatgataatgatgaaaaacggtgatgataaagaagctgatgatggagatgataataatagaggactgatattagtagtgatgctgctgctgataagaacgataaggatgatgatgatgatgataaggaagagaggatgatgatgatactggtgatgatggccctgggcagatacactctgggtcgagtccttaaagttctccagtgctcacattcaggagtctgggtggtttgctttcaaagccttctccctgaggatgtctactcgcacactcacaccactcgcacacccacaccgggctgcctcgtcctccccatttggaagtttgacatcccgttctgtgacctttgtcatctttaagatttctctgtcttggagctgaggttttttttctttactgtgcttgcttttcctgctttcaaaatggtgccgtgctaccgagccgcaccgctatgaagatagaaatggcacttcttccttccttctcctggtaattttgaaatgtgtgaatttcttccccggagtttttagttttctcagacagcagggggttaattagtttggttatttcacaatagcatttacagtcttcttattaactgggcagatacccaaggacgctttctcctcgatgaggttctagtcccagggctgggcagcagggccgtgggctcacagatcctccagggagggggagagattcgaacctccagaatcactgctagctgttcccagagaatcat

SEQ ID NO: 43090 - DNA, 804 bp, Bovine  19866880844948
agagaacagagacccagggacaggaagaagatagattgtcagataaagcaccaagaggagacgagggaagcattgtattttccttttctaataaacttagttaatatgcgatgatcaatcacaccatcacgggcatttttatctcccctgagtatcaatatgaagtggcgctgacgtgttcccaatacagccctgaaaggcgatgggtgggtacttgtctctgaaagccttggaccttgatggtggatcaatgatgtcaaaacctcctgctccgtcgtgaaaccaactctgatgatggtaattaagctgtgagagttggtctggctgaacccagcactctcctgctgcaaacagagttctcattgatcagccattttttatttttaatattcatggattagccacactctcaaagtaccccattaccatgtacatgtgaaatgagtccttccccaagacccagaggtcctggttcactggccccaacaccacaccgggaaggtgggtttccgagtggaccccatggcttctgcaagtagatgctggcacgtttgctggagctttgaagtagccagagggctctgcgcgccggggtgaaccctccctccctctggggaagtcagctctgcctgctgtcccccaagagatggaaccactttgctgaacagacgctgagttggaggaggccatggagacacctgacatgtcctctaaccatcacggtgtgcacctcccagacacccactgtgaggtcaggcactgggaccgtgtaaacatccaggcaatgggtccatagtgcgcccg

SEQ ID NO: 43091 - DNA, 1226 bp, Bovine  19866880850278
ccagcttaattatttcccttccgcaaacactgaaaaactcagatgaagaagaaatcactcctgattaatttgcatctgtcttaaatccaaatggagcctttttgttttaacatcacttaatgctgaggcagagaaagacttgtgtttttaaagacaaatgatttgagtcttatttttaagtctccacgtagcacagataattctaagaagcttgtttggcaaaagttaatcagacattggagattaaatttttcctttatagtatgcacacatttaaagttatgaagagaaattctaagtaaataaatcacgctttataaattactaatacccaaggaacagataaagacatgtggtgaagtcgcgttccagtctcagatgtgtggggacacgcacatctctgatctactgtcaaacggctctaaataaaacaattagagatgtttgcatatatttatcttcttgtgtgtttgtacgagcgggatgccaagagtgtgctcggagctgcacaaaagatgaaacaggacgaggtctcagccctcagggcctacaatcaaagtgaggcagataaaacaattcagacatgaaatacatcagttgagaaggctgttaaaatttatgaggtgcaaggtttgttggcttttccaggaaaggcagaactgagaggagggccagcttactgagaaccaccgtggggtgagtgagctccaggaggaaagttgaataaaagatacaggtgcccggcactgggagagagaaagagtgggtgggggtctgcgtggggcccggctgtgggtggaagagcagggcccccaggagcagagccccccaaggtaagaaagccaagaacctgcgcctcaggtctaaacggatgactcagtttcacctcggggggaagtgccattgctcaggtggccactggcatctgggactggtccctccacgtagaattcagggtcctctctctgcacatctcatcctgctgagggcctggaactgcccgagagcagggctggtcctcggtgtgagttgaagagaacagagccctcccgccctggtttcctgcccagactctgcttctggaaacaggctgacacctcagaccacagaaccttggactgatggctacaggaaggagttggtcctctctcgggtcctggggttcagggttaactttgttaaaccacttggaaaggaacttaaaaatctagagctttcccagtttg

SEQ ID NO: 43092 - DNA, 705 bp, Bovine  19866880861744
tttcccccatttaagttagatgacaattttgtttacttggttcaagtgaaattccagttgcattgtgagctttttagaaaaatgagacatttatcttctctctgtacagcatggagctcacaagctcctgtaatcttgatataatctttacagaggtccataaaaaggctgcacagtatataaacctgtgatggcagggcagcctgtttctcccagctcatggaccaaatgatactgacttttctccttggcccattagggaagaattgagtgttagtcgcttagttgtgtccaactctttgcaacactatggactgtagcctgccaggcttctctgtccatggtattctccaggcaagaatactggagtgggtagccattcccttcttcaggggatcttctggagccagggattgaactcaggtctcctgcattgcaggcagattctttaccatctgagccaccagggaagcctttagggaagaagatgcaactgatatcacatgtacacttgatcaagagtcctcaaaatcaaatgtggtcaggcagggcatatacataagtaaaacacacttgatgtaaagaaagaaaggaactcctcccctaccgccactgtagctctagcatcttctggtcacatgggaagggggcaccatgctgtcagatcttaatttcccaggaaaatccaggaatccatacacttta

SEQ ID NO: 43093 - DNA, 872 bp, Bovine  19866880868411
tgttaaaccagagtgacaggattgctgccttcatgagccttacagtttaagtaagagagaaaatataaattcagataatatacattctctaataaggaagcagagtatggttaaaggcacaagatggtcatgaactaacctggacatgggagagggaaggcttttctaaggtaattgcattaaatgaagccaccagaaacaaagctcttcgttctgtattatctgaattcatgggataattttcagatccccctcctccgacccagcagacagcattttcactcacacgtggccttcttctccaggagcaaagagagatatgatccacatgtgctgggttcccactaagccaccccttgctctcccatccttgggggattttgctttgaagggggtctgggtttttgcagaactctgcccgccacgagagagcgacgcaggtcagtgcatcagctgcagcctcgagcccagctgaccattcattattaacaaggctgagaaaaagacaccggcttagctcctaccccatgctaaactatggcatggagaacacttccttgaagccaaaggaaaagggcttaacgatcctattttagatacgaccatgcacctgtgatcatggccatcagtgaacaatcctggagacgaatctacagagtaagagtgtttgcagtgacccctgagtgctctccagagaaggcacggactagaaccatgaggtggagtggatccaggaattacacagcagctaaacagatgccccatgtgccccatggagcactcagcccgccattcaagaggttctcaattccatagtatttgctaccctattggggaaaactattttaagcctaattagcataaatttttca

SEQ ID NO: 43094 - DNA, 1213 bp, Bovine  19866880879599
cctttaagccaggacattggagcatcctcggatcgctggacacggcccgggcgggctgaaggctggccctttattccctgggcactcaacacctttctgtttgcactaaatgttgggtgactttcggagcccctgggtgccctcagctccatttctggtcctggaacaaccatcagaggggaccagagatgtgacctctttgtgcaaagccaggatggagctgcacggtgcctcgttgggcttggcttgacgccctggtccagaacgaggaggccatgtccagacagagcagggcccacctcctcgatgcaggaggctccccgggatatggaaacagtctctataagtccttttctcaccccagtaaattacaataatagaaggttttacacagtgcctttgtgggataaggaaaaactaccgccagaaattagtcattattctctggaatgataggctaatgaagggtttcagatgcatgttctaatggaaaacaagtgaaaagatatattcagtattgactcagccgggtaggagtcagctaaggtctgggaagttgcagtggggacgtcagccagctgctgggggccagatcccaggtcaccccacatcttcactgacccccaggcccctccatgtcatgaagccctctctggctttgctgagtcgcaggggcctcacacacaattctggttcatacagctgttcagttcagtcactcagtcatgtccgactctttgcaaccccatggactgcagcatgctgggcttccctatccatcaccaactcccggagcttactcaaactcgtgtccatagagtcagtgatgccatccaaccatctcaccctctgtggtccccttttcctcccgccttcaatctttcccagcatcagggtcttttccaatgagtcagttcttcacatcaggcggccaaagtattggagtttcagcttcaacatcagtccttccgatgaatattcaggacctctttcctttatgatggactggttggatctccttgcagtcctagggactcttaagagtcttctccaacaccacagttcaaaaacatcaattctttggcgctcagctttctttatagtccaactctcacatctagctgagaagctgaatttctcgttgtatttcgtataaaggccacgtgggggcagggttgccgtgttgagtccccacccgggggggccacagcag

SEQ ID NO: 43095 - DNA, 1171 bp, Bovine  19866880924220
catcatatggattattactgtttgaatgattcaccttattctagaaagttagcttgtttccactttgtattagggagaatggcaatcctatgcatgttttctgtgagtttctgatcatttccctgaggttgagtcatggtgctaaagattcagaatatgtctaaggattgtcacacctgtcgcacctcaggtgccctcagaaagcccagtaggtgtgaacattcactaactgtaggaatcccagcatgtcgggggcacaggtaggatacatatccattaataaagatagacccacttctgccggttcactaggggaagacctgtgatggaagacaaaaggtttgtttacatttttatgtgccatcattactgaagatgtattgccactaatttattgactatttgttctttctttgtaaattaggtatcttttgggatttgcttattttttcccaccaaagtacgtgtgttctcctgtttgatttgtgtgacttcttcggtgctgttcacgagcctttctgcctccggtgcctcctgcacatctggctccttctttctctggtctttgggctttagtcacgttttctgacttagagttgcacttattttgttgtcccatctctccccacgtcttttcccaggtgcctttttctcatttgcccttcatcattcagtgtctttaatggtccccgtttcattctccgatctgttgcgtcgcttcttcttttacttttcatcactgtttttttccctgatgttccacttccctcctttttctacttcccttgttttgtcgtcaccaggcagtaaactcctttttctgaaatcacccgctttcccgagttttctgtcctcattctatgttcataccccttcccttcacttgacactgatttccctgtgtagccaatttagcaatggacctgaagggtctgaaaagtcggtggtccagtgcccatccctgagaagcctggcacctgacccctccatgtgtcccggggcgccatcactgaggggcttgtttcaccttccgccgactctgaagaaggtgctttcatagtttccaagagaaattttttattaaacaaacctgcactctcccagaccagaaaggcattatgtgaacgttttatgagccgaatgtagaaattaatggaggaaaaaaagaaat

SEQ ID NO: 43096 - DNA, 1584 bp, Bovine  19866880992662
aatgatggatgtggtattatgcaccttcttgtggaagccggttagttctcaaagcacagtgtgcatgtcttgtccccctcccatcatttccctgttgtcaccaggagaaaacctaacccccaagcacatcctatgggaccccatgatctgactgtgcccaaactcccaccatgctgggccacgcacagcttccatttctgatcacatccttcgtttcctggagtcctgtgttttccctgtgttttagccaccccaacctgcctacttccactgttctctgagaatgctccacatctcaggactaacacaggccctcccccattgtctgcgtatgtggcagagtttttgacactgtttttttttcagtaattatcagtctgtctccccagtaaacacagaggtccttgagagatagttcacctgtcaaacacaacaatggggacagaacagatgtcattaagttttactgagtgaatgaatgattcaactattgtgcacagatctagtagtccgcttttcatgatcattatggagattgttgggttagataaacaatacttggaaataatgaaacctgggaagttctgtttctggagtgcaggagtagtgtatatcagatgaatactcctcaaataacagttgtaaactttggggaaatgtttttgctaaaaactatttgaagttgcttgagaatgatcaatagtaggcagaaactgctggggactccacccttgaaaagaaaacagaactgagtgtgacctgtgtttgtgtgtctttaagagcacccccaatctgtccttgcatcaaaatgtagctagagctcacccagaaaaccagtctttctggccagaggagttggaagatgggatttagaactgacaaagcagctggaatgtgaggggataaatcctgtaaaatatgtagccagaggtggagactcccagaaatactcataaattctgtccagttcctcagctgccccttgaaatgtacatgcacacagaagattccagagaatccagagaaaagcaacagctagatgattgaaagaatcaagaagagactcaccaggcaaggtaaacagatttaaatttcagtccagccaagtcaacaccctttagaaaaagacagcagagccagcttctctacagtgtatcatctacaatgattacaatgaccagaatacaaacaaaaagtactagacatgccaataaaggaaaacgtgaccgaaaattaggcaaaaactgctcatagaatctaacccagatattggaattagcaacagggcctttaaaatatctctcacaaatatacttcaaggacttaaaggaaaatatggtcagaatgaatgaacacattgagaataacaacagaaaaatggaaactccaaaactacaaccaaatggaaatggtaaaactggagagcgtggtgtctctaatgaaaaacttactggatgggcttacaaagtagattgtagagggcagaagaaaggtcagtgcatcaatcagtaaaaattattcaacctgaagaatggcaggagagagaggattgaaatgcacagagttttgataggataagatcaa

SEQ ID NO: 43097 - DNA, 875 bp, Bovine  19866881005346
aatcccatggacaggggagcctggtgggctacagacacgactcaagcaacttagctcaatcaccatccactcactgtgctttggggagaggactcagttatttcccacctaccctttcatctgtagcatcacacggtgattagttaagagtctatgtgctactcccgaaatggaataatagaacctacccacacatataattgaataagaaatcaattttatgccctaactgtaatataaaggtcaagggaaaggaaagcaatttataataaaatgcgtatttctaaatgtaaatgtgcaggagaaactgccctggggaacactgtggatagttagttggttcttcccatgggtgaacacagcatctaaaagctgaacagatgcaaactagctatttggaaatgcaaacctgtcagtgttgtgggtgtcagagacaggagtctgtaaaatggagagaaactcctggtgacacttcccccaccctgatgaaaaaccgtgccatcttctctaggtgagaagcataactttcaacacatggaagttatgctcctggaaaactcagtgtgtcttacaaatgtctgtgctccttgcaaactggtatgaagacacaaggctcagtatctggctgcacgtatgaacactgtggagggtagtgcacaggccttcactgtgcagggtggcccagcacccaggcacacagcatgatgccggacatccctgagtcctgtatgccaccgcacccctccactgcccttacagtgtcagcagtaccctccaattgctgtgatgtccaaggtgcaaattaaggcttccctggggctcagtggtaaagaatctgcctgccaatgcaggagatagcttctatcttcggtcta

SEQ ID NO: 43098 - DNA, 1482 bp, Bovine  19866881009139
tagatattgattgagcaaatgaattaatgagtgagtgaatgaataaaagccaaaaatcctaaattgaagaggggagtttgaggagcccctgtgggcccttcagcccaagttggggtacctaccctttgtaccttgagttgttcccagatggagctccctggagccccttccccatcagagaggggccttccaccccagggcctctggactcatttcctctctgctgtcccaagaaagataagccagggtgtgactggccaacagggtagactcgaagtggatgccccagttcaaggacccactgtgtctcctctctgggtctcccccaggcctggcctcctggcagcaagggacctaagcccccaccccccacacatggcctttctgcagctgctctaggtagacatgagtcctcagcatcagtggtgcacggatgggtgtcagcgtggaccctcgggtcagcctccaggtcccatggtcgccctgtttcaccctcccaggacacctcccatttccacagacgagagaacccaggctcatgacatatcccaagcccaccccacagtccccaggctgccccttgaggggtccctgaactgctctgtcgccccaccccagggctgtaggtcacaggagatctgctcttggtgcttcacaaggcttcgggtcaggcgcatccccactgggggcagctgctggccctgacagcatatgttgctttctttctagctccgagcacatgctgtggacatgaacggcaacaaggtggagaaccccatcgacctatacatctacgtcattgacatgaacgacaaccgccctgagttccttaaccaggtgtacaacggctccgtggatgaaggctccaagccaggtgagccctgagccccgagagagggacattcccgaggagggacacgcaggccccgccgccatgatgacacctgagactcatcgcctatgagtttattttagctcccactgcatgccctagagagtgggcatccctgctccacatacctcacagtccaggccaggcacagacagaggggctgaaacaagggagcagagcccctgcagtgacgatttggctcaggagccccctgggcgctgagtcatggggacggcagtagattaggggaagtctcctctgcagaggtgacctgtgggccaggagctgacttgtgatcagaagcagcactcagaagggcagggagggagtctggtggcagggagagcatgtgcaaaggtcctggggccagtcagggaggaggctggccatctgaggcctcctgggcacctttgggcacagcgggaagcacctgagaagactgactccctcagcctgaagaagtgagctgtgtggctgaggcccttggtccccctcagagctgacctaagagctgacccgtcttcccaaggactcctgtccagcataaatgataacaaccgctttacaatgtctggtctctggatcccata

SEQ ID NO: 43099 - DNA, 1700 bp, Bovine  19866881046554
gcttggggctcctttatcccccaacctggatgagaggccagctcttcagtacgggccacatggggcttggttctgacccagttcccacactgtggagtgaccctgactccagcctcatgtttctgaccctgtgtcagtcccatccactttgccacggtgcccactgcccctacttggggtcacgtagtgggatgaatggtgtcccctcaaaagataagtcacatctggatcctgtgaatatgaccttatttgggaaaaggatctttgccagtgtgacaaagctgaggaccgtcctgattggggtgggccctaagtcctgtgacaagtgtccctataagaggacagaaggtgggatgcagagaccatgtgacaatgaaggcagagcttggagggatgtggccacaggccaaggatacctggggccctggagctggaagaggctggaaggaccctccctagacgttcaaagcctggccaagccgacacctgggtttcaggtgtcgggcctccagaatggggagaggatgccctcttgttataaagccactcacttggtaattggtcatgaccctagaaaaccaccactgtcacgccctccgcctctttatgtggtggcgatggagaccctggcaacctgctcagggggacatccgtgcctggggctgcctctttccacaccagggtctcctgtctgcttgctcacctgcaccccttgtagagcctccatctctctttcttattatcatcctgatgtgaaagtgacctcacaccccagcctggcctttacacagtaagttagaaccaccaagcctgaaaattccattcagcatctagatagttaacaagtgaactctgcttccagttctcatttcttagttttttatttgcgcctctaattaaaggaaagatttggccagagggatcagatacgccttctattagacatttctgctgataatggccatgtttttaaatagttctctgaaagacatcttctgattgaggttttcccattacttgattatgtaaaactcaaactggggggaaaaaaagaagaagtaaataacttacattcctttgagtgggtgggtgggtggctcaaattttcaaagtgggactttccagggtccaggccctgctggctctgttggactgccccttagtaacgatgccactttgttctgagcttcagtccaccttgggagggatgttgaagcacactttcccctcctttctcctcctctaaaagatcttctcaccagtgaatgtttttgtttatcatcatctgctggttcatgtgcgatagactaattatttccgcacagcctaaaacaagcccagagtaattgtctacaattttctgcacttgctttctcccaaagaatgtgtttttttctctcttaaatttcaaaacccaagtttctgattaggctctggtgatgtcatgtataaaacgagcaggatttcgtatccagtgtcaatcacaaacgtcctagtgacctttctgccctcaagggtccttggaaggataaatcagagggagcctcatccagtgggcgtggtggtgtgggggctgggatcacagaccctccttcccctccacacttaagatgctccacgctgaggcctgcccaaccttccgctcacagagagcaccattctaaatctccatctgccgccttcagacggtggcgatatca

SEQ ID NO: 43100 - DNA, 721 bp, Bovine  19866881094866
cccatgccagctgcaagggccaacgccgtggctgcccctgtccaggggattgttggtgagcttatacaagtgtacaagccgtcccaccatgaggaaggtgaaagtaatctctcgatgcgagtccccgtcacaacccaggggaagatgagggatgccccgggggagagggatctgaactgctctgtcagacttggcaggtatctgcaggcagagtcatacaagagccttgaatccatacgtgtttttcctactgatagaaaattctgctttcatcacccagcaaactcagcgcagattaattaaacatgagatggtgattaatgtttgaagaggagcgggagtttgggctatgctgttggtctgtctccgggtgagtcttggttctgctcgtactaatgactccttacgctgcaggtttcagctccgggttcagggacaggggtgagagtccatgctggacaccaggcaaagcagccactcagggggatgtttcctgtgcatgtccatctccacaaggagctcggcgggcagccttgagtctgctcccccgaggctcacaggttgtaccaggaggtccatgtaagtgggtgttcaggtctgacttgcctcttgcctgtgcttcattttcaggccactcttcttgcttcattccattcctctgagactggtgacatgctctggcagctgtgatggaagggggtcctgggagcgggtcctgaag

SEQ ID NO: 43101 - DNA, 1844 bp, Bovine  19866881143917
ggtgtcatcccagcccgggcagtggagacttaggcccctggggtggttggatcatccagacaagggtcttgtgtctccagtggggctgcgtgtggagttttcctcccgaggagctccaccaagacagggaagaggttctgtcagcaggagagggggagccgttgagaacaatgtttatccaggaaaaggtacaaagcgcttgcctgtgtgcgtggaggccgatggagctgctgaggaagagccaggctgtgcccgtgtccctgccgagctgggctgtcttctcagctgggtaggtgggaggtgaggggccgaggagtgagtgtgcagcccgaagaggagagggttcgctgtagggggtggaggctgcgaggatgtgcgggaagaggcagcagtgtggtggtcaggactgaggggagcagaacaggtgcaagtcacccaccttgcagggaaggagcgtctcagtagttatttccctcaggttattctggtcttcttggaactagaaataacccagatggcacctaggcgttgtgtccagactcaagctcaatgtggtactcgtggcgggcagaacaagggcactccaggaggtaaatctgacccccagaacccgtgatgatgtcacctgacgtggcaaaggggaccctgcaggtgggagtaaattcaggagatgatcctgaattatctgaaagtgcatgtgttactcactcaggtgtgtctgactctttgagaccccatggactgtagtctaccaggctcctccgtccatgggatcctccaggcaagaatactggagtgggttgccatttccctttccaggggatcttcccaatccagggatccaaaccgcgttccctgcattggcaggcaggttctctaccactgagccacctgggaagcccaagtaaatactttcaaagtcacaaacaatgtagataaacattatatgccatatattgtggtggacgtctcaacatctagtagccaggaaggagccgttcagtcgagcagttttggggtctgtatgagtttttcctggactgacacatggagcgttcctctcctcaccgctcagcctggtcacctgtctcccgggggacagttcctctcatggagcctcagcatatgcttatgaaggaccatggcctctgggagttggggagggagcaccctgcctctggtgccccccttcctgccccacttctgttggaaaaccagcgggtcacgttttaggggggggaaatgtacttgatgtgaagtggcctctgagacccattcaacccgagcatttattaaccaatctcttggccatgagactgaagggagagaactcagacccctaatgtgctttaaggagacttcacagggtggaaaaacacccaccctcacatcctcactgcttttcccctctttgagccacacacagccaaatctgagactgtggtaattcactgggtgtgaattacctacacattatacacagcacttcaccactaagtagctttctgcagggctcaggatgcattttcccttttgtccaaatcatacgaaatactctttctgaattgttaagattttctgccacgcataaaaatgaggcttaaatcacccaaaatgcagccaaaatgcagtagataattctgagaactttacacctgtgcatatgatttgaggaatctgttagtctcccacccctgaggggataacggggtactgacctgggcgtggaggaaagccatggtctaagcatccttgcccagaggttcagggctgtggctgcccctacagagccccccaaaagagcctcatgggtgtaaagaaggtcagggcccttcgcagcctcg

SEQ ID NO: 43102 - DNA, 1324 bp, Bovine  19866881160137
acacacacacacacacacacagattgtaagtgatgccttttcctctgcaaaaacctaaccaggctcctctgcctcttttctccctttctgcagaaaggaaagaagaacacagtcccggaccccgtccagcctccgaaagacacgctgctgccatggccacagcaccagagctccaatgggctgagaaggcagaaacgggactgggtcatcccacccatcaacgtgccagagaactctcgcgggcccttcccgcagcagctggtgagggtgagtggagagcctcctgccgagggggctgctctcagctttagtctaggcttcttctcccaggatgtcaagaattgagcctgataggcatattcctggagcttgggatggctgtgcactgggtgtctgagaagatcaagatttcgccttttcagtaacaagatcagtattgcacagaacagaaaaaaatcagaagggcggtcgcatcctccagggtggacaggcctgctcgctttgggtcctctctctccggtcactgtcaagtgacaactctggtgcttgggaggagatgggacaggaacttgggtcgtggcccttgacctctgacatcttcctttgatctgtttgttcacacttcttccccattatgactaagatgctaaatggagaatgatggcttctctgtgctaacagtgaccttggtgaagtcagagagcctgagaatgagcctggggcgccagggggcagttctgtgtcttttccctcggtgtcatctgctcctgacagccaccatgaggttgcttttcctgaaggagggaaagactcatttcacaaattcatgtttcaataatcaaggccatcaactagcattttcttcttccctttgaatgaaaattgcaacccaatataagcaataatttgataaaatggtagtgagaattccagtagataatgccatccatggagagtgccttgccccactctgttattaaggtgttatcttcatttcttggcctgatttgtctgttttgtttcctattctgtttgatgcaaaaagggagggtggtgtttaatatgcagagatgaagctgcaaactttgcagggaccccaggtcagacaccccaccacacacacatcacagccacagtgacatgtcatgaacatcatcctgccttctccacacgtgatgctgtgacttaagaaatatatagtttggtgttcatccccgttattcaccagaacccctaaagcctatgcagtttcctaaaagataagagtgaaaaagatgtctgcagacattcatagcaaaccctgtctagcacagctgagtttatg

SEQ ID NO: 43103 - DNA, 851 bp, Bovine  19866881229029
tagcacacacacacgcaaacccaaggtgtggggttcttctgaggattaaatgaaatcatccaaataatgttttgctctgagtgttgggcagacagtgagccttcagtaagcattcatgttgagggcctcctatccagggaggtttcagtacttgcaacagaagaaaagaaggaaacagagggagaggtggtgtcctagactagcggaaagagcagaagctttcaacaaggaagctcacactaccccttaggaaatattctttgttctgttgtggcccccggactcctcttcatcctctagcatcctccaggagatgtctgtccttgtcagaggttttcagcttttggtgggaacttcatgcccaaggagaaacagaaggagagcagttactacccttggaggaaattctgctgttaagcctctgcttaactcttttggatgtaaaagtcctttaaagctatttttgaatctaattttatattaatcttttaatgtgattggatttaatcatgagtcttaaatctctcacgttgaatgtgtgagcatccatcaaacttgctcttggaaatgccttcaggtgggtttaaggacatgtgctcttcctgccctggaggctgaacgagtcatcctgttcctagagatactgttcctccttgcacatggagccggcgttgagtccacgggaaggatgagctgattctgataccctcgtggaaatgtgcaggatgaatgagttagcctgggtctcctgcacaatgatgctaaagcttcctgggcatgaaatgggtctcttgggcagagtatccacggtctctctgcctgtctttaagggtacttggggtccaggttcc

SEQ ID NO: 43104 - DNA, 1305 bp, Bovine  19866881303496
ataatgtgccattggttgtcttcctaagggcatggttactcctcttctgactttaggaaaccccattcctgttcaggcagcttcatgccttgagcagccaagcatcaccatcttgctctcatgccacccatttgctgcaggctaggtgactcatgggcatgaagtcattcctggccagtaacacatgatggggagactgcggaaggttgaaaggtggtttatgtcctggttgaaagatagacagcaaagctaatccttccttccttctgtcttgaatatggttatgggtggaagtgtcactcaaggacatgcaaacacagggctataagcccaggattaacagccccaaagtgccaaagatgacagaggaagagaagaggatgggtctgggtccctggtggaccactgcaccacatctgagagtctctctttccaaactccctgctacaggagaaaattacatatctttcctgtttgacaaattcttagctggtgattctgttgcttacatctgaatatgtcttaatggatagaatcgcacaactaacccttagttctgtacccaggcagccctttctcatttcccctttgacctcctggaattacttctatgtgcaaagccagagagataagattgtggttcctacagagcgggcccctgttcatccacaataactgggggccaggagggtgaaagacagagtcaggggtgagaaagtaaattaagaaaactcagctagtcctgcttctctaggcgatttcttcccagttgaactctctgcacctttttgatttttgccttgttcttaatgaagtccttacttgggcaaactgcctagcaacttcagttggcaacttgaccctggaaaattccttaattaaaaataatgtgattaatagctaggcgtatatgtgctaataaataaactttagctgaaaataaaatgtttgagactcagggggaagggttaattttttgctttgcccaggaagtctgggtgcatctcctcttttctaaagaggaggacagtaaagatgagtagcccagggatcagctcattagggtgcttaataagtgcttcatgaattaaggagtagcaagatagacacattttcaagatatggagacaattaatgaaaaaagaaaccaggaggaggacactggggtttcccaacttggggcctggggtggcactagggctctcatcatcaataccctttgtgtattgaccattgttccaggacaggggggtgtcagatatgggacgagctgaagcagagccaagggattaatggagcaggttg

SEQ ID NO: 43105 - DNA, 723 bp, Bovine  19866881399859
ttctgaagcaggctggcttcccttgtgtcagctccttggagccctgacaccaggactctccttgcagagcgcttgatggagatcaaagcttgtgtgtgcatcctgttatcctggagcctgtctcccccctgccactttcaacgagatttccgagtcgttctgggcaccttcagaggaagcagagctctcgctctggctggctcatatggagcagctcaaagagaagtgtctttgaaagcttcctcgcctgtgtactgcttccgtgagcgcggcctgctttcctgggctcctggctctggcctgcaactctctgatcatctcatttccaagtcctttgtgcagagtcctagcagccggctcaaatgggagcaattagcttcagtgggtaattaggcttctttgctggcactgggcttgagctgcaggacataatcgacgatttttacttcaagtccactttgtatcacctctcccaaacctgaatcaaatggtatggtgtttagaaaaaccaattacattccaggagcttccaaaacactcacaatatgttctaatgaggcttcttgccgttagctttaacaatgaatctcttccctatctttgttattcaacatttgcctgcttataaggacttaaaagctgatgcttcaacactttggccacctgatgcaaagagccaactcattgggaaagaccctgatgcgggaaacatgagggcaggag

SEQ ID NO: 43106 - DNA, 1543 bp, Bovine  19866881469727
tctggtgattttttacgttttttcccttgggctgtgcttttatccccaatatcaattagtcttagtacttattttcacaaaaccttaatgtaggtaagtggtggggatgatctagggccggtcaattatttctgtggtaagtataatccaagattaattatttttgcagtcacatggcaaatgcatttcactccagaatctacatttcattggcaaaacgttgtattaatattttaaagcagagaaaaaggacaagaagacggaagacttattgctgctgcctggcggggaaattgtcactgccacattcaaataggctctagaactgggcgagattccctcgcaggattaaagggatcgggaaaaatgaagcagctcaggggcagcctgcagagcacgtgtcacccgtttgtgtttgtacagtatttgcttttgtttctcagggagattattctaaatcctcacgactcacttgcatctctgcatcagtaaaggtaaattcctctttaaagaaaatcagtattattggtttaaccttctagcacgatccgtgtgcagaggcccttctgtgcctcccggagaagaccctgcttggtcccgggacacggtaatgagacctcgtgccaagcagcttctagaagctccaggagcaaacgtgacttttcataatccttccacgggaaccggagagaaatcaggaggattttctccaggcctcctctgctggtaactaacctctgggcagaaaactggagccaaatgagccttttgtcatttccgtttgaaatgagatacaactttcaaaactaatcctgagaagctggagatgttagtgtctacccagcacattgtatatgtaaaatcagaatcatgacagaaggataatataatcacactgctatagtgtgtgtgtgtgtgtgtgtgtgtgtgttgaaacagggttgagaagagctgacttacgaaatgttctaacatttaaaagtcatgacagcaaacctcctacatacataaggcaaaccctaacatacctggaaaccgcacagcttattttcagcaaggtaaatagtgcttcggaatttgtgtgctttgcttttcaatgaaagcagtggcatgttctaagtcactttagtcatgtctgactctttggcaaccccatggactgtagcctgccgggctcctctgtccatgggggtttccaggcaaaaatacaggagtgggttgctgtttccttccccagggatcttccaaaacaagggactgaacccacatcttttgcatctcctgcaccggcaggcagattctttactatttgcaccacattttaattctgtaatcactgttttcaccagatagggtttctcaataaagggtagttttctctctcttctgaggaccagagtccagacacatcatcagaactaggtaaaaatttttcatgttccccacaaaaactgggcagagaaacaatggatgaaactgattcagattcttccagaaaagtttaaatataaacatgtgagtcagatacttagtaacttttcta

SEQ ID NO: 43107 - DNA, 622 bp, Bovine  19866881525875
tttctggatctgcacggggaccctctgctgccttcatccagcttgaggcctgagcccacagggggctgggaacgcccatcagtcttgtacttttcgggtgtcttcccgctaacccagaccgacctcctggcctcgcaaagtctttggcctctcaggagttagccttgagacccaagtggatttgaaaagcacagagggaggggctccaggctgcatagacccccagggtgaggaaaagctccaggtccgggccctggctgtgatcaggaccaaggaaggggcctgtgcgtgcatcaaaatccctggttaggcctgagaagccaaaaaagacatcggaggacttgagaaggtaaggcggaaattccctctcagaagagctgtcaggacggtcagccggactggtttgggtgatttctgaattgaggggacctttctttaagggctcatcaagtgaacaacaggtacagcttgaaaagtgagtaaatgtttctgcacattccctttcggtttggagattgtttgctcagatattgcaaatgttctttgtcttggtttggagggctctgtgtccagaatacattagttctggtttaagaaatacactgccaaggaggggaaggaa

SEQ ID NO: 43108 - DNA, 1434 bp, Bovine  19866881656324
aacccttcacccacaatgctccttcccagcaaccgaagtgtccactcgcatgtgcagcatttaagcaagaaggaaataagatttcagaactgataaagagagaaatgcagtaagacagtgcttaggcaactgcaggagagatgccttcctgatagaataaccacctttcaaagtgagaaaacaatgccattttctgcccactgagcaaagcagctagacgaggggggagctgcagcctccttatttagggagcagcccctctgctcccctggggctggaggaagtgattaattagtgcctccttgaaactgcaacctcagaccaactgggggactttgtctgcgcacagcacagaatactatctttccagaagcctcttagaactcaacaatggagcatgtctcctacagtcctcagtgccagtcagggcggccagaaggacggaggcacagcttgaaaagagctctcttcttggtgcctgttttgtgtggagaggaaaggccactcaggacacaattttaactgaagaaggaagccaccaaatcctcaagtccactcccaggtcccttctctcctggtccctctctctctgcctggcaccccctcccatccctgcccccagtcagctgcctgatttaaacacagcctcccaaacccccacctgcttctaaaccaaacctgggcacattgaggcgacatctgtcatccttcaagttcatctttcaatcaggaaaaggcaaaaccaagactccctcatgccatgatggaaccagcttgcggaaaggcacaacctccaggctgatggtgctggaaaatccaaattcctattttaggttcaggtgacctcgcccactgcgtgaggctgacaggtgagcactaccgatgctgtgtcaggtgagcacggaggattctcaggatttaaacgcagacacgcgactctccaggctggagtctcagaatgtaagatgctggagcaggcctatggcctcacgccagcccgtggggaactcaatcctgcttgcagagaaatcagaaaggcagcccttggcccctcccttttgctgagtcagccaggctggacgtgagggcggtcttccctcgcttaggacgaaggagaacccttatcaagggctgcgtttaatcccgcagaagatgctggacccagaggacactgggaaattagcacacaagggatggttctttacttgtttcctctaagtgcagggcatctgctctgccctcgcaaacccgcctaccagacacagcacagaacacctggagagaggtggaggggcacaattcagagggttttcccctcccatccctcagtctgtccctgtgaaactctagaaagttccagaatctctgtgtgctggaattccaaaatgtggaaacaaccccattctaaccccaggggctgcaacacaagcctgt

SEQ ID NO: 43109 - DNA, 1308 bp, Bovine  19866881987005
gcacagagccttacacatcccacccatgaggaggccctcctcctctgaacttgttcagtcacaaggatgtccaggaagacaagcctgacagcagctgtggttccctgcctggcgcctcctgacttctggactagagccgtcaccagctgcagccacctttccaccaggcatcctggaaagtatgcgggaaacgcccaggaacctgcagtcgaggggctccctgctcttccacagtcctgccccagcaccacgccagcctgtgtcttcttagagaaggttccatctgagatgttccttcacacagaaacttctgcggcccccaagtcacacagcccacccctctgtcgcgcactcggcttttggttgcccccgcttgtcgggtctctgaggtaccagtctccatgggacgacagagccgtgcgtgtggggcggtggccatggggacaactcgggatcctcccctccaccctgatggagatgctcgagtcctgcactccctcggaaaggagatggcccctgagtcagccagaaggaggggcgatgacacaggagccatgatcaggaaagatacagtcccctgatttgatggaccacacctcaccatcaccctgagtctggaagtgcaagctgcagttccctcattcttgtgcacactgatccttaaagagatcgttaattcttccctacattaatgattacaaggtctgttgggaaacgtagagctggctgggcccagatacatgctttttccttaagacactgcaaagagacaagaggaaacgcctaacggaggatcctcagggagccgacaggcagtgtcttcagcagaaaattttccaactatctgccatccattaacttatttttctttacaaaatattaatactggaaacttaaaagttcgtacatcagctgcacttgagcactttgaggtttaactgatcataaatgttttccattgtgggaagttgctcacttatgaaaacacacaaaatatgtggatccatttccagagcatggaattccagcactgtggaagggcttcttccagcaagaggtgggtgcccattggctcttgcacactctgggcaggcagaagtcagcgttttcttactgaattggtcattagacagcgcccagcagtaggagttctcacttgagaaagggcggggagggacagtgccccaggtggggtttgggtaggtggcccatccctggggtctgcgagaacagcgccccctcacaacatgagaacctggcactcgctctgctcacctccacaaacaagagggtttaatttttccgtag

SEQ ID NO: 43110 - DNA, 751 bp, Bovine  19866882095381
ccacaacctactacctcatctggggaggcctcaggctcagcaagcaggggaaggagatgaatcgatactgtgttatcagccaagcagtttgattcctgcacatttaagcacacaagtacctcgaagcttgatcccctcaggtcaatacagttttacagagatgcccccttctcagcagtgcaatgatacaggaaacaaagcagaagtctttggtgggcatccttggcaccctgacccccaggtgaggaaccgccaaccttgcaggtgcctgctcagtagttcaccagatgacagcaaggggggcttttcatccaggttccaacatggagaagagggccaggagctgaaatgtgaaggtctgtgggcctaacgggcacccagtgtgcagttccagtggggactgcagctggagtggtcagccctgctctggcttcatcaaaaggcctgtgagccgctgtgcagaaaaagcacaaagggagaggctagccagcactaaaactcccggtgcaataattgtcattgttatccaattatgctcaggatacctgaagctcacatggcccacagaggggcaatttcattagactgagacccacttgtctcactttactttgataacggcttaataaataaactgagtgagtcctaacaccgaggtgccaaatgaaaaatactttggcttttccattttatgcccctccttctctaattatctcactttcatattttccttgcttgtcagctccagcct

SEQ ID NO: 43111 - DNA, 4856 bp, Bovine  19866880415951
tctgctgcgtggaggcatctgggtctctgacatgtatgactcgtgttccagtgctgttttaacactttgtttctgtaactgtttgcacttctacctgctttagtttagttctgttcagtcgcttagtcatgtccaactctttgcaaccccattaagtaggccaggcctccctgtccatcaccaactcccggagttcacccaaactcatgtccattgtgtcagtgatgccatccaaccatctcatcctctgtcgtccccttctcctcctgccctcaatctttcccatcatcagggtcttttcaaatgaatcaactctccacatcaagtggccaaagtattggagtttcagcttcaacatcagtccctccaatgaacactcaggactgatctcctttaggatggacaggttggatctccttgtagcccaagggactctcaagagttttctctaacaccacagttcaaaagcatcaattcttcagcactcagctttttttatagtccaactctcacatccacacatgactactggaaaaaccatagccttgactagatggctacacagaagcaatcattctgttctcaaggcagcccacccttcatgatttagatggaccagtaactgcctaaaacgagtgagcttgcttggcctgggttccgtaaaatgctcagcttggatatgtcctccttgtcagccgagagcaccagcttagcctctaggtgctcacccgtgcatgctttgtccatgaccgtgtcaaccccttcccatgtcattgcccagatgagtttttataacctgtgtgttttcgttcacttttgtcttaagaaggtatgtgactaatgaaagcataacaagcatcctttgtaggacacaactgatcattcccaggacagcattctatccaactaactactttttgctttttgtctgttaggagtttcttaaaaatcctactataaacatcgtcctccatttagaaagtatttccaaaggagcaaacatgtttcctccttggttgagggtgccagtaggcagtcctcatggggagaaatggatcaggaagaataggaaactttctcacaattgttcagagatccacacagtgggagataatgccaattcctgtatgtagtcacatttggtcaaacagaatgaatctgtccacatgctacatgcccaattgacatgaaagttagcatatagtcaaccattgtttataaaataatattatgcagtagattacattaccttgggagaccttaacttgtttggcttgagaaagattactctgggtttatgctttctcattaaatcccacaacaaaaagtataatcatgcatagaaaccacttgcttaaaattcaaaactcttctttgaaaagtcaataggagcacagaattacaatctgtattgtgcttatcttgacaccaaacaaccaccaaaataacccaatctgaaactaagggcagtgttggcaagtcagcagtgttaggtccttgtcaccagcagatatgtacatatatacattcagagctgcaggaggctggagccaggtgttttggggaatgccatggccatttcagatgtcctctggtgggcacatgctatgccattccaatctgctgattcctgaacataccaggattcacctgaatccctttggggccagacctcatcacaaaccatagagagcatgcctgtggtaggttatggtccctctggaagttagaaccaggtgtggggctggctccagtgatttgaaaactgtgtaaccagtcagtttcatggccatgtctaatcaaggtaagtctcagccaaaaaacatcgtcttggcattccgagagcttaatgtgctgtgcacatgtagggccaaagccttggggccactgaacacccccaaattaggatcaagagttcatgcaagtctggctcttcagtctcagggctcagccagatgctttcattcattcacatgtgtgcaccagtgtccatgacaagaggaatgggtacagactgcacctttgagcatctcagtgatatgaccccaactactcccacatgccattcagggagcagcaccttctcagatgatcacttctcagcctaacagatgaccactgcacacactgtacacttgtcatctccaagtgactttcccccctctttttggccccaggtgtgttgaggtacacagcacagcagatgggccttgatctgatgactgtggctgctgtactttcgtttccagtgtttcttgcatgaacctgtcagggagagttagaaggagaggagagatgcataagggaagacagaacacagaagtagagtgaagaccagggcagaagggctcctggaaaatgaagctggaagaggagctggtagtgcaacaccactgggaggagagagtgggagggcagtcagaggggagagtgggggcagccccaggagagaccctggggcagagagtggtgggtggggcttccatgtgccaggtggtggggagccaggaaaaggatgagggtgagcgtccacaggtgtcagaggcaccagtgagaaaaggcacaggatggaagtgcagggaggagacagcatgaagaacaaagcaggctttatcttgccaacagtcaaccattctgggcctcctcttaagggcttggggtctgttgacagtagagtgaatctcagccaagacctgtggacccagccagttgtgatatctccttttcctcagcatctttccttataatctgtgctctgggaggtgagctgtgctcactctgtcttgaccagaaataaacagtgggccccgtgcctaagaacactgatgggactgaaaagctatgcatgggagggtttggtgctctgggacctgccacccacacccttcccctgtctctgcacccagacatgattatccagaaggagcaaagcagatggaacgtggggagtgaagggactttcccccaacatgcctgggtgtttggtgggtgccatgggaggctcgggggttgctgaggccaggcggcaccctccatgtctcccaacagcgagcccaaactgtccacgatgctgtagttgtgccaggggaccatagagaccatcgaggaggtggaggctgagcaggacgaggaggcacccaagcaggcccaggaagctgagtccccacaggatccaaagaggatggcgacatggaggccctgctgtcctacagcaaggccatcagctttaaacgcctgtccttccacctatccaggatgacacagcaggccagacccacatggagggcagctcagatgacagccactcagactggctggaggccagcatcttgccacccctgactcaagagtggacaaccagcaagctgctgatgatcaaataagaactgtggccacagcaatggagctgagagtgacccttagtgtccactgggctgctgggtgcaaagaccacatggaaaaggtctcctccacatttagaaccacatgcgtgctcatgtctgtctgtaacatgataggaggttgacagcacaggacacctggggactcaggcagcaaggaggggtgggcagggtcttgccacgtggaaccagtgcccaggaggaactgaggccagtattctggcaggatgttccatgatgacgagctggaggagtcggagaagttctatgtggggcagtcatgcttcctgctgctcttctatgcgctgtacaacatgctggtggcccgttccaagatggtgtgctactttctcatcatcctcaaccacatggtctccgtctccatgatcaccctcgtgctgcccatcctcatcttcctctgatccatgctgtccatcccctggcccagcaggcacttctggatgatggccatcatctacacggaggtaggcttccctttagtgcacctgcctgacccctgcttcatgtaaatagtcaattagagggattgtcttaggtcagcacgtgattatagccagcagttgttggtgctgagaactctagctatcttttcacatctcacacctcacacaacataggaggtaatatcattgtgtataacaggaacaaggaacaacctttatgagattaaataattggctcaaagtgggcttccatggtgtctcagatgttaaagaatctgcctgcaatacacgagacccaggtttgatccctggttcaggaagattgcctggagaaggaaatggctaccccctccaatattcttacctggagaatcccatggacagaggagactggagggccacagtccatggggctgcaaagagtcagacacaactgagtgactaacactttcactttccccagctggtgagtggtgggggaggctttttgaggtctggtgtctgccctgtgatattgaccagcaagacagtaagtgtgaggcagacacaaacatggtgccagggccagtgcatggtcactgagtggacattgggtcaaacaatacagtaagcacttgaaacacagttggatgcaattaaccctaatgatgaaaacattggaggggtgtttcaacatcaatctctacaaacatctccacgtttacaccctgagctggcaaagttttgtttcatttgcttttatttcttcttgaggagaacttacagtgagcaataaaatgctgagaagaaagagaccagaataaagtgaaaattgtctatagtgcctgtgcagtttgctcctaaagattatgaactaaagtcatatttgcagaatgaagatcctcctgttcacattggtcctaatgacctcatttaatagctgaatatttgtataagtatctaattgaatcagcacaaactagcccttgcatgcatgctaagtcacttcagt

SEQ ID NO: 43112 - DNA, 1728 bp, Bovine  19866880625894
ttcaggagaaaaaagttatctatgagcttccctggtagctcagttggtaaagaatctgcctgcaatgcaggagactggggttcaatccctgaatcaggaagatcccctggagaaggaaatggcaacccactccagtattcttgcctggagaatcccatggacagaggagattggtgggctacaatccatgggtcacaaagagtcggatacgattgagcaactaaaccaccaagggctttgaagctggttcccgactgatgtccacacacacgccattagtttggaacattgcatcccccgggacacccagagtccagatgccatgttctcactcagcaggccaagtgcgtcccctcccaggagcccggccagtctcccccttgatgttttggggggaggggggcaaatgctgtccagacccaaaaagcagaagggattacagtcagagatcattttgaagtttaatgtcttggaacgttttttctttcaaatctgttattttaagcacacattgtgatttaatgactcttttggggagttcagtctgtggttggggctcggggccctgaggaatgcatgtttaattttttttttcatcctataaccagtatttcatcttagactaaatagatgcacattttagaaatcccacagaatcactgaaagaaacactgctgtttatagaaacgcatacatgtttgggcgaatttagctaaaggaaacagccagagctggttccagaggcatttaggggcttccttcatctcctcccagttcctcccattctgtatccttacaggacttacgcgcatgcccagccctgtaacttgtctgcatacctggtgccaccattgattctggtctctgtgacataaagaccaggtcccgtgcttctagacccagcagccagcacagggacaggtccctcgctgcactgggtgggactctggctgagtttggacatatgggtgaaattttcatcctctctgaagacatggtgaagtgaactggtcagcgaagtggacagagtaagagagaactttgcagtgggaactctgacaaacagaagtccctctgcttattcctctcctgccccctaactcctccaacagcagcacaggaaatttcctcaaaacttcagctgccacctcttcaccacatcgacagtatcactgactctgcctaacccactgaaaaccaaaagcaaaaggagtcctaaaatacaatgtgcaatcaacacatgagatttaagaggtcatgcatttctgctctttgtctttcaaaaatgtttgagtagtcataaaacagatatgagggcttccctggtggctcagatggtaaagaatctgtctgcattgcaggagacctggcttcaatccccgggtggagaagattcccctggagatgggaatggcaacccactccagtattcttgcctggagaattccatggacagaggagcctggtggactacagtccatggggtcacaaagagtcagacatgatatgactcagctaatgaagtaataatgaaatgtatagttagcctttctttggggcctctttctctgaagtttctggcagccacacggtttatccatgctacatagcatctgtaattcagcactaccgttgcaaaaagagcactataggtaccataaaatagccttggtctactgagtggaactgacgggacattattagcatcctaggtgttcagggggtcag

SEQ ID NO: 43113 - DNA, 744 bp, Bovine  19866880798719
ttggctttgcaagtctggcttgttcctatgacactctaagtatcctctttgaaaagagaggtatttcccagtgtagagagcaccatgctgaggcttcttctccttgcttcttgggtttaactcccagaagtgaaacaccaagcacttcactgggtgggactggattttaggagccatcagagcactgagctgtggggaattcctgcgtgtgttgggattgaaagacatcaaccttgttttctgggtgcagagtttcaggatactcctttcccatttgtttttcagataggagcgtgtggctgtattgaaaaattggttcaaaaaagttaatggttgatccaagcattcagcctggcctgcacagtcaagggatacacaaatgcatgagtatgaaaagcagatttgggaacagagggacagagaagggagggcagaagtagtgttctaatttaaatatctgggtcaaagcccctgaaggaagaaaatgaagggacacccaactcagtgtcttcatggagctgtgggatggtgcctccagggtatctgtggtcagaacacccctacccctaagataatctttgatcttcttctacaaatatcccatccctcttcccaagcaggtatttagcaactccctgaacttcctgtatttatgatggggaaatgtcacagatgcccatggacacctatgactgctgggtggatcatcagaggagctctgcctgcagagcccccaccccgaag

SEQ ID NO: 43114 - DNA, 1522 bp, Bovine  19866880848123
aaattaaaagacgcttgctcctttgaaggaaagctatgacaaatctagacagtgtgttaaaaagctgaggcatcgctctggtgatggtctgtatagtcaaagcaatggtttttcatgctttggatttgtcatgtatggatgtgagagttgaaccataaagaaggctgaactggggtgctggaaaagactcctgagaggcccttggactgcaaggagattaaaccagccaatcctaaaggaaatcaaccctgaatatccactggaaggactgatgctgaagccgaagctccaatactttggccacttgatgcgaacagctgactccctggaaaagatcctgatgctgggaaagatggaaggcagaaagtgaagagggcaacagaggatgagatggttgaatggcatgatcaactcaatgtacatgaacttgggcaaactctgggagatgatgaaggacagggaagcctggtgtgctgcagtccatgggggtcacaaagaatcagacatgacttagcgactgaacaacaacatgattattcaagggattttttcaaaagtttaccatacatatgtagtccagcctccagagtacccctgaaaggagacaggtcccgtagaagcagcatctaagtatggaacaggcatgtagacccaagcagcctccacgacacatggcagagctgagccctccactcgcctgcaggctgagctctgggctggggagcccttgatgcagcaaatggaggtgattccagcttggacatgtggtcctgacaacatgtgtcacgaacaaagttaaaatgctttccacccgccaaggggaggaggacccccttgaaaggcacagtttcgaatattcaggaatttaaagtaaaatgtctttctcccacctgatcccttaaaaccaggggtttattcagcagaagctttggtcccttggtccacaggtctgcccccagcaaacccacagagtccttttaaggaaaaaaccactcaggccccagtggaccctgtaggggtcacagagcaggctcctcacagcccagcattgctgcctcccttgttccagggctgggactgggtgcattctgaacagattcaggactcagtcccaggcagactttgtggtcatagtgcccgcctctcctggggacaccacctgagcatgccaccctcccattgcagaggtacccgcagccccgggggcagaagaagaagaaggtggtcaagtacgggatggggggcatgatcatcgtgctgctcatctgcatcgtctggttcccgctactcttcatgtctctggtcaaatccgtcgctggggttatcaaccagcccctggacgtctcagtcacaatcaccctgggcgggtaccaggtaaccatgcctccctccaggtctcccatccccccacccctctgtgagtccttgccgagcgcagccctctccctgaccaccggatgacttactgaggttctgtggacccacatctcctgtctgaatattgacagttctgcaaatatgt

SEQ ID NO: 43115 - DNA, 1791 bp, Bovine  19866880896255
cgtcccagtgcaccagtcccaagcatccagcatcgtgcattgaacctggactggcatctcgtttcatacatgacatttcacatgtttcaatgccattctcccaaatcttgccaccctctccctctcccacagagtccataagcctgttctatatatcagtgtctcttttgctgtctcgtatacagggttatcgttaccatctttctaaattccatatatatgcgttagtatactgtattggtgtttgtccttctggcttacttcactctgtataataggctccagtttcttctttttttaagagaaaaaaaaatacaatcttcagtggaccaacacttctaaatattacagtaaaaagtattactagaaaaataaaaaatagaaatataagaatgataattacattaataataaaatataatgtactattattaagttcaaagcaatataattagtctatcaaaatcctgagcatgagtgccaagtcgcttcagttgtgtctgactctttgtgacccatggactgtagcctgccaggctcctctgtccaacgggattctccaggcaagaatactggagtaggttgccatgccttcctccagaggatcttcccaacccagggatcgaacccaggtctcctgcattgcagtaggattctttaccttctgagccaccagggaagccctggtggggccaacccttaagcctccagtgggttcctcattcactgcttatgtcacttctgtgggagccccaggtaggatgtattgacaagactctgcacactatgacttcacttcctctgagtgatcagcatttatggtcattagtgtccctgcctcagctgatgtctgggacatctcttcatccacacaagggagcctggggtgggcggtaaggatgtcatttgaacagagaaccaagcctgcagcatttaatgcaatgctttagcaatgaagttagaacatttgtgtggctattcccacatgtatgggcttcccggatcataaagaatcagcctgcaacgcaggagacctgggttcgattgctgggtcgggaagattccctggagaagggaatgacaatccaccctagtattcttacctgaagaatttcacggatgaaggcccctggtgggctacagtccatggggtcacaaagagtcagacacaactgaacaaccaacactttcactttcccacgtgtcaggaagggaaggcaggctatgcacgtggcttccgtgggggagacacatcctcgcccatagacggcgcacaacgctgtcctcaggacagggctgatccagcagttcaccagagccagggaccaggccgtccagccctgagctggcaacagaacaaacaaaccctgccgccttgggaatcttgctacaggagctccaggcaccaaaccaaggagcgagctcctccgaccattgtgttcaggcctctcagagcaaagatccgtttggggcaaaaggaagttttgaacttaacaggattttcctgaacatacaaaactggaacaacctgacaggctgggagcaactaaccagccgcatacaacccttcggggcagcaggtgggtgcacggggccagttcgtctgggcctgcagtggtgccgactttaaacctgcaggtagaacgccagcccccgacagtgaccacgaggctgggatgagaggagggggtgggggatggattaaagccagcgcaccagtaccccgatgtgcgccttccgagctctgacactttgatggaagaatctgctacaggactggaagttccaagg

SEQ ID NO: 43116 - DNA, 2186 bp, Bovine  19866880925101
gaaatagcgaggaaaggacttttctccaggaggaggattgtggtgtgtggggtcatggaagcaggtgggaatctggcacattgagaaacccacaaacaaagttgaaaggcttgtaacccagagtgaagcgaagcgggagagggagggaggaggggatcttactccagcccggcacagggagacctgacggaggtgacatgtctgcctgagactagtggctccatacaggtggagcagggggctgaggcgagagactgacatatgttacctgccgtcacagtgataaggaccaccctgaacttcatatgttacgactcctgtgagtccatttatagaactcatttcccatagatcatatttttcactggaaatggcatattgtcataaagacttcaaacaggataacacaaagctagaacaataaaggcaaccctaaattttatttttagaaagccatataactgaactgatttttaagagaaaataaaagaaaggacctcagccttgggaactgagagagctaagttatttaccatttttcgactgttcaatttccgctgatagaaacaggaaggaagccgtaaagggcctgtccattgaaaagagaccaaagtaagaatgcaaataaatactgcggcccagtggttatggtaagtgacgagctccaagggtttccacatcctctccagggaaaagaatgttttatgctaatttttcaatggtgattgatggcacttaacctaatacgtagatcccaatgagaaaataaaaatttcctcgcagaagatatttttccactccatgccagttccaaggcctcagaagcttaaagaggcagaagtgtttttgttccagtcaaacttgattgagtcttaaatcatcataatgagattttcagcggtaacagcatgttctctgcttctatttcccttgtttctgaggcttccatgcaagtctggttctggttgtggggagaatgaggccgtgttattttctccgggagagacaaggagatgccctggggtctggggcttgttgaatgtgtcctttgttaatcagcactgagtgtccacgggacatcagcaaagccccgtgggaagccagcagcggtgcgtggacccgtctgtcatgccaggccagcgtggcagcgccatcaagacagctgttcctgttgggcttctcacttcaaagactcccgccttcctgaacatgcatcccgagttttattttccagggctgcaaaccaccccgttcctaagggcacaaaaggtcaagctttcatcccaggccgagaggaatatgcacttggatcctttccttttttgttttccttcagggaagtcataaaacctgctttgataattagtaaacagccagcatgttcccaacactcataaaacataaaggcgacatgaaaacccagctctgctttcaagttttgagcaggctcccgttttgggggtcccacccttccctcaaacacaagcgcatcatccaagccgcacgactgggtcctgagaggagcggaaccagggtcaagtttctgtccctggtcttcaaggtcagttccctgaaggtggaggagaaccagcctggcctgtgactgaccagaggccacagtcacagctgagaaagttactgaacttttcattagatagtggagctccatttttttttttctctctctctttctggtaaactcagtaacatcactcagagcacgtaggagaatttttaagctgtttcaaataactttaaatttctcaacccagcctcttcattaactcaaggaaatgaaaatattagcagccaaatttgaatccctactgtgtggctgcctgctgccacatcataaggattagcaagctgatcgcctgtctatccactcagcctaatggccccaaaatgaatagaaatctcctacggcctcgtctgcgtgacatgccttggccgtggcagtcaggccacttatgggccactctatgaagaatttacacacagattaaaacaaactgcaaggaaataaggaaactagagtagaatgatgtgcaggtatcattttcattcttagaattgctgttaatatgtttatattatccttccaaaaaaataaggagtccttggttgaatatgccaaaatagggtcttgacacagcactattgcgacataaatatcccccttccag

SEQ ID NO: 43117 - DNA, 1452 bp, Bovine  19866881004945
ttctcataaaatatggaactatcaggggaaagatcaaataatgaatgatctcatgcaacatttatctttttcatttagacattttgaaaagtctaaattgcaatttagtttggttagatttcatctgcatcttcagtctgagataatagtttcatggaaggtacaatttttttcttcatttttccctcccctttgatgtgatcttggacactttgcctgactttttcagattataggcatcgcctgcttggcaccctttaggactggtctgtggttggttgacagtgtgcctgcgtgggctttctcaaaagcagcagcatttggagtcagagtgacagctctgctcattcaagcaggaagcccagccaactggcaatgactgccgacaataaaatattaatatgaagaaacagtctttttatcgtctaaggtatttgtagcagattctctgaggcactttcttccctgcctcattcattcatactgtgtggaatacactgaattccatctgcttatagccctggagggagaagtcatgctggctttcgtccagtgagtcttggcagctcccactgtacgtcgctatttgatgaaggatttggcatgtgcgccgaggtaagcctttctgtggcgttatccagaatgagcttgctagtggaaggcactctcctcaaaggttcttcccaaagacactgccacagtgcttactgtgggtaaaagttgccactttatctaggggacatggcagcattccactaacccctcagtgtctcaccaggcgggggttggaccccctggatgagggggtggacatccacagaaattctgcaggagccagagagtggcttggcagcagctgctgtcggcagcagtagacagtgggagaatctacaggaagaagcagaaattccgtatctgctgggcactccctacttccccagtctgcccagactttagatcggccatcatgatgggaggagaggaaaagtcactagaccagctgctgaccatggcgaggctgcaaggaaggctggggagcctttgggaagcagaggactgttgagtgacacgcaaggtcacaggattctgcctaagaggctgcagtgagctttcaggactctgctggctccagagcccttcaggcagccacgcaagatccggctcatggccatggagccctaagtgctggggaagacaccagcttccctgcacaggacccttagagaggcggtgccagaagacagaccccaagtctggcctgaaacaccaagggactggctccacttcctgcccccacccaccttcactgccagtgcctgagtgcttcctctgtttcattaagatgagtgcttcatccgagactgtctttaccatcagggatgaccttcccttctgcaaacgaaggctcatgggagagcatctcagtccaaggggaggcaagggaagaagcac

SEQ ID NO: 43118 - DNA, 1557 bp, Bovine  19866881028397
atgatagatctttaaggatgagaataaggccgccatatggatcatggcaggtgacaatgtagagatctgcatgaacctagacgcggcctcattcagccagcacaaccctgtgcccaactccatccactgcaggtaaagcagccacccgtggagagcccctgagaagatgtgacccccaaagtccatgcctccagctcctctgcctttcctgggcactgacctgcttattgcaccatgaagccaagaatcccagggccagatggctcggtgatctggaggccaaacctccttgttatcctctgtcctccatgaacatgcccagggcagttctggggagcagatgcccctgaaccccaggacagccaaggacctcatgtgctcccagcagccctggaggtcctccccattgcgtgttggctggtgtttgcatgctgttcccacaagcttagttttttgatttctgaacccaaagcatgtcaggctgaggaatgagggctggggctcctacagggggattcacagctgcaggcagggaaggggaatggatggaaagcccacagtacacaaacatgtacacacaagcacacacacactcacactcaaacatgccagcagcttagtttcaccaacttcaagtcacacacatcaagaggactatgggtgttcagatcccaccaggactgaatcatggatgttgcctgtgtgaccgtgggatgctgagaaacactcacatcttatgcactctcccatatgtgtgacatcaaggatgagtgaaacatagtttagagaaaagtcatggaactattcaaaagtgttgagtattttagtctaagaagagtacagtccaaaagtccacttctgtgacagtgttctcagttcagttcagtcactcagtcatgtccgactctttgtaaccccatagactgcagcatgccagccttccctctccatcaccaactccatcaccgtgtccatcaccagcattcttctagggaccacttattctctaaccacactgagaacagtgtagcacctattttatcagagatgacttaagagctcccacaaaataacaactcagttatcaagtatctgatagcacaattggtgcttctgtgcttctcccaaaacttgggaagagaaacaaccaaagcaaagcctccaaagccgagagcctctgagcaaatgaatccagacaggacacggcttgtaggaatgatgtctgtcagctgatacccagcgggggaacctcccagagctccatcactgggggaggatggggcctgagcatttgcctgtctgcagagtgaggagtggtcccacagaagggatcctggctcagcccagggaagtgcagagagagtgctcacagagcctgcaaactccatgtcggtgtgtaaaaaattgaaagtggtagtcgctcagtcatgtctgactcctcaggtactagacagagaatgtttctcttgtgggaagtttggccccagtttgatgataaaagtgcacacagtcttttcacaaagtactgctctgtccatcactaactgggtgaggatt

SEQ ID NO: 43119 - DNA, 1972 bp, Bovine  19866881056931
tattttcatgtctaactgcatgtgctcatctttgaggctacttgattgaatcagcgatcatgccttttatttatgaactatggactgcccgaggtaagaataagccattgccacacggagggaggtttttcaagcatctgcgtgtaagacccggttttccaaaggttttcatctgcaaagtactggggacaataggagtcttttcttagcagcctggctttggagaccgggttccatcattgttgtccaatagctaagtcatgtctgactctgcaaccccatagactgcagcataccaggcctccctgccctttgctatctcccagagtttgcttaaactcatgtctattgagtcagtgatgccatccaaccatctcattctctggtcccccctctctttttgccttcaatctttcctagcaccaaggtcttttccaatgaatcagctcttcatatcagataaccaatatattggagcttcagcttcagtatcagtccttccaatgaatatatagggttgatttcctttaggactgactggttttatctccttgctgtccgagggactctcaagaatcttctccagcatcataattcaaagcatcaattcttaggcactcggccttatttatggtccaactctcacatccattcatgactactggaaaaaccatagctttgacaatagggaccttttcagcaaagggatgtctctgctttttaatatgctgtctgggtttgtcctagcttttcttccaaggagcaagcatcttttaattttgtggctgcagtcaccatccgcagtgattttggagcccaagaaaataaaaatctgtcactatttccacttttccccatctatttgccatgaagtgatggagtcagatgccatgatcttagttttttgaatgttgagtttaagccagctttttcacttaacacgatattataaagtaacaatacctcaatttaaaaaaaaaaggtgtatgtatatgtatgtataactgagtcactttgctgtgtatcagtaattaacatattataaatcaatgatacttcagttaaaaatttaaaaataagtaaataaataaataataaatgtcacgattgtctccgtttttcacagggtgcctctctgcagtgaatagatcctgacaagtacaaggtcccagtgacctaaagcactgcctccaccccgctggagtgagtcctaacccatcggtggatctgggtcccaccctcacatgtttattcagagctgagtcctttgggggcctaaggggaagcgaccctcgcaggacggggaggacaggcaggaccagggaggggctggctgggctgaccttgcctgggccaaagtaaacaggccctttgtggccattattttaattagataatccaatcagtcttgacaggctttctaaacacagacaggagcacgcccaaactgccacagggtcagtgatcctgaaaagctgatttttccactccctcccggatataaaaataacgaaagctgggaagagttttattaacttttttttccccttcacacagtaccactgaattttttcccaaaggtctagagaagaaaacaagccatagaaccaattttttaaaggaaattatttgtgtctcctaatctttgtaaagcagtgttagtcactctgttgtgtccaattctttgcaaacccatggactatagtccagcaggatcctctatccatggaattctccaggggaaaatactggagtaggtagccattcccttctccaggagaccttcccgacccagggactgaacctgtgtctcctgcattgcaggcagattctttaccatcgaagccaccaaaaaaaaaaaaaacccaaggtgatgccaaaagacccaatgagaaaactggtatccacaggctccaccctccccctgctctgccccccaccaagcagaccccggttgcagcagctgggcctt

SEQ ID NO: 43120 - DNA, 2016 bp, Bovine  19866881067536
tgtatggttagttgaggggaaggaagcctgagtcccgaaatcatccagcagcttgtcactaggcagaatgctgggaagagggggaggggatcagaactagctggggaagccaggtgcagggaaggaatgattccagttctgagagggacaagggctctcggtttcattcctttactgaacaactgttctggggacacagctgtgaacacttagaaggagaaaacataataatcacatatactgtacttcagatggtgatgactgcattggaggacaatattgtggaaaaggtgaggttctggtggagagggtttagaggaggtttactgtcttatagagggtgtgtcgggaaggcttttctaacaagatatttgtacagaaatctgaggaaagtgagagtgacccctgctgttatatgaggggaaagtgttccagacagggacattttcagtttgagatgcctgtaatacattcaagtaaacatgttgaattgagaactgacaacacagtttgaggggcttccctgtgtttcagatggtaaagaatctgcctgcaatgcaggagacctgggttgggaaaatccctggtgaagggaatggcaacccactccatatctagtattcttgcctggagaattccatggacataggagcctggtgggctacagttcatagggttgcaaagagtcggatacagctgagcaatttacacacacagaacactagtctgaagtttatggaagaagtttaggctgacatatttaaaatcatgagagtggatgagatcacccagggagagagcataaatggagaagagaagttttcaagtcctagacattagagttgttttttttttttttttccaggggaggggcgggtaaggaaggatttattacttgtagcaagttaggagaacagcagggatctttcccaaagcagtgtctccacattatggtgttaagaggtcagaaagatagggatgaccagcaaggaagacaagaacaagccgctagtgagatgggagaattatgtcccagtgtatttgggaaccaagtggaagatgtggccaagctgagatgaagtcattaactttgtcaagttctactgatcaacatgaagatcattggtgaccttggtcaggtcagttttgatagagagcaggggccagaagcccctacttgaagtgaaatttaggacagaacaggaaagaaggaattagatagagactgagtatagatgacttggagtgttgtgttaccctgagaagcagctggagggagatgcagtgaagctagaagactttggggtcaagtgagagttttgttttttaagatggagaaataacagcatgtgtttatactgacgggaagaatccgacagaatggaagagactgatgatgtaggaggtgtaggaaaaaggagagatgctggaattatgtccctgagcagacaggagagttcagaggatggagcctttggtcagtctctggggagagactgggttggactgagccctggtacagagttgggataactgtcctaacactggccttggatgaccaccagcaagatggctctgataggagacacccagggattggcttggattggctgagctttccctctgcttacaaagagctggttctaatttagatttgaacagatggcccagaggggagagagcattccaggtggagggactagcataaccaaggggcaggtaggcccaatgggctggaggaggtgaatgcagctgggtgggaggggcggagtgagactgagaaaatgccagaggtagaaggcagatagaaggtagtgagaccccctaacctttcatcctggcagctgaggctacactgtaccaaattcccagtctgggcgggcgctgagcacagaatcatgagtggggggcttaaggcttacaatcagaagctcatgagctaaagggatttgaggaaccaccatctacgtggatgtaagagacttcctcctgctttctcccagtccagggaatgga

SEQ ID NO: 43121 - DNA, 1188 bp, Bovine  19866881125366
cggcccattcttccaattttaattttcaggatttcaaaactctctatagcggaatgggctgctccagctgatatgaggatgcaggtgtagggaagagaggactggcatctgagctctcagcccacggctactccatctctctaagttgctttctcatcagaaagcgatggggagagcctgacgggtctcaggggcccttggtgttcaatgcctgacacggggtactttcagaaccatgtctgagggttgcatggtgctggttctcaccctcagcgctttgacctgggttggggcagacgggggcagactggagacagagctgggcactgggcagtttgggattagcagcagttgttcactcctgctggttctcacatgagactctaacatcacagcttagatgtctagagtgcagtgtcgtgtggcaggagaatatataagatacagcttatatataagatcttaatataaaagatacagattttccccctcaaatttccatctacccctttgccttctcacccccctccattagccagggattcagtgccccagaagaggggtgatggaagaaaagggtctcccagtgtctctccttgggttttggtgattatgccagctgggaatagagtctgtcacctggagaagagttcagtcctccccagacatgctgggcagagggagtgggtggagagcaggtggggctttgatgcagcccatctggggctctaagcacaggctcactagagtcacccaagtgagcaggtcgagtttcttgcccacccatgtttgcagaggagactctgcaccagatacacacgcctgctgtcactgtgttaacaacgatgaccaactcacacgggcgtcctggagctttctgtgtcgccgccagctatcattttagcaatattctctcgtgtcgcgtttttaagagggaaagaaagcttatctgttgctatttctgcttttgcacccagactcatgtttctgtgaaagaaaaaaagaagaggtcaaggtcagtggttattcacaaatctgcaggtgagattaaaactcctgaaatactcatctcaccaagtttcactgggtccacaattgtcaaccccaacctctctgtccacctcacctggacatccagcctctcagatatccaaggaggctgcaagcaccttcaacaccgatcacagg

SEQ ID NO: 43122 - DNA, 1064 bp, Bovine  19866881395979
cgtgtgactttccagcaaatctctgagcttatctgaagcattactttcatggtctccatctcggtccaacgtaatgctgtgactttggttcgttcttgcttattcttaccttatgttgaattgcatttatttcctcaggcctgggcccagtcctctgggcttggttccttcttcaaaataaacataacaaatcacagtgcttctgttcaaggatataaggcccaattcattcattctgcatcttcatggatgaaggtctcagatatgtctgaaaacatgggcaaaattactcactatcatgtttggtgatagcaactaattttcaacaagccaaggtttcctgtgaccttacagtggataagtccagaagatacctaaagacatcacgtgatgtcatccaaaagatacctcagcatttgaaaattctaatataacttggaaatatgcgtatgttttcctgcagtgacagtgcagttcttgtcgcatcagaaatgcacatgctgggtctcttttctctgataaaatagtcataaaactgataaagattccattctcaaactttttgagctctctgaacatttcagctctctagactgtctccgtgcttaagacacaatatgtctttggaagggaaatgccaggcaaggactatccatatggtttgtgctttgtgtcttgtggtcagtacagttctcctcaaatttcagcaagcaactggggggcttcttgttgaccagaagcctaacagtgctaaaccgtatggatcttgtcctcctggctccttctgtcctagcctatgagtagaaagagccagagtgtggtggtggtgtttttgtgattgtgctttcttttttttcttttctttttttttttatgttatttgcccatttcctcctcatgataatgtgtgatataaagaaaaactctttttcaaatgtcctgcggcctgtgttatggcctgtgtctgcacagtataaagtgaagcagaaggtggtgacacgtgactcctggtccctaatcatccctgttggctctgccatagcaatttgtacccattcaggcaa

SEQ ID NO: 43123 - DNA, 935 bp, Bovine  19866881410990
tactataaaaatttcaacatggaatacaactgcttttcattatcagtccgttaaggaatggtatttgccttttccttttttttttttttggctgatggttttaaaaaacttttataaatacatttgaaagtgtcttcaatttctttaagtcttacagttatagttttcttcgtataaaacttaaacttctttggctaaatttatcttgaagtattttattatttttgatgctcttgtgaatgggagtgtgctgtgtgctcagctgctcagtggtgtctgactctttgcaatcccatggactgaagttcgccaggttcctctgtccatgggactctccaggcacaaatactggagtgggttgccctgcactcctccaggggatcttcccaacccagggattgaacccatatctcttgcatctcccacaatggagcagggaggagagggggagagtctttaccactagcgccacctgggaaggctcccctcctgccatggccacagaatcactccccaaccctggctgcccccccatactcctactgcccccggccccccatactctgcgcgtggccaggatggcaccgagcaccctcacccctggaacaggaagaggttgacgtagttgtagctcttggtgaggaagttgccgaggacccgagttgggtagccgcagcggatctggtaggcggacagcccgaagtacacgcacttgacgaagtaccacagctgcgcaaccaggttctggctgaacttcctgggcgagaaaacagaaaagtacagggtgggatgctcttcgggtacagaaagacaccagttagggtgagagaaaagcctactcttccctctggcttctaaaggcaggtccttatcacagacgtctcagccgcatttggttggcaggagtcattcctaagctaatacatcctccaaag

SEQ ID NO: 43124 - DNA, 997 bp, Bovine  19866881477020
agcaacaggtggcagaagactctagaacagaagatactttgtggaacagcgttttaaaggcattgaagatgcagttctcgatacaggtactcattttgtgtcaggaggctcatctgacttaactccagcttggaaatcccagtcctgggcccgtgggtcacatgggtctttctaataatttatgattgatatctgcttctctctgcttggaccaggggcagcgatgctctgctgggccatgtccacggagacagcccagagcagctgggcactcccaaggttctgattagcctgcacctctcccatcacctctcacctctgtcatccctgtggaaagcagcaccactgtggagcatgtgacctacctggagatgctgtcgtgggaatccaagctgtccatcctgtgggcagtctgggcacctgcagcagtgccagcgtgctcgtcgatggtgtccagtcccgactccctggacaggttcatgatgtggttctggtagtacatgtggatgctctcccgggttgggacgttgccctgcggagagggagacactgtcacagccctgtgcagacatcaacgcttctcagtacggacagccctcccccatcacacacaccttgagcaggatgaaaagccaagttagtcaagctgaggattgacgtcaactcactgaattaatggtgccagatgctactgggtcatgctgaacagggaacccctcctagtttaaggttgaagatggtcaaatgtacaacttgcagttatgaaataaataaaccatggggatgcaatggtgactagagttaacgatactgtattgcgtattgaaaagttattaagagaatagatcttcaaagtcttcttcacaataaaatttataacaggtgcagtgatggaagttaactagatctactgtggttatcattttacaatatacataaataccaagttattatactgtaagcctgaaatgaataaaatggtatatgccacccacat

SEQ ID NO: 43125 - DNA, 1363 bp, Bovine  19866881779640
ccggacagcagaacccatcccaggtccttggagaaaagcgcctggcgggccttcaaggaatcccagtgtcatcacatgctcaaaccccctcccacaatggagccaggatcaccgtgcagatgccacccgccatcgagggccactgggtgtccaccgggtaagcggccgggtgcaagggcccggcaagtgcacttcttagggtttctcaggtgcacagagactttctagaacccacagtgatcctggggttgtctgagttctcactcagagccaagcgactcttggaagcctgggttgatgaagaaacagagctcggtcctgcagaaatcttagcctgggcagtggggatacggtgccactgtgaagccacctgggagtgaaagcgtccttgtttactgaacctgaggaccactcgtgtatgaaaagaaccattagcaagtgaaattagcaaggagtctgtgtttcaccaaccctgaaacatgacgtgcaagcttctgatggtctaaatagtctagcggtattctggtaagttgatatccagcttcagagtctgagagtacgttaaaaaggacccacactgcctggaccagccagggcacagctcttggcttcttttccaggctgtggagctgagatttatcccggtttgagctctggcttatcttccattagagcttttaaaaatagcccagaggcagacctgtagtcttcaccctgcccattaaattgttgcaaattcacatggctaactaggctagggaatagtgagatctgacgccttctgtgcagaccctgcccaggtgcctcaggaagggttcacaggcatccggagaagagaggaaaaagcgaataagacaagggagacccagagggtttttgtttttgtttttgtttttcccctaaaaatggggtttctcagaataacctcctcatcagtattggcacagacaatcttaatgcagtgtacttttaaataatttatcattttgttcaacaaatatttctgaagtgcacaaatgtttactgcgcctgagcacagttctagactgtgtgtgtagcagagagtgaaacagacacgtcttcaggaatttcacaaataaacacacgaagtgttacaaggagggaaaaaaaacaacaggtgctccaggagaatatcagggctcctattttaggacgggctggggtgggaagggctaccaagatgaggacacttgagctgagatgtccttggccatgcaagactgggaagagctcttgctggggggcaagcagaggctggactgaagaagcaccacggtagcccttgtgcctggggcgggggtgggacagcccccagcaggccaaggaggaggctaagccggct

SEQ ID NO: 43126 - DNA, 1126 bp, Bovine  19866882026325
tattacagatccaataacattagtcggtgtctgtcttgtgacaatcaggctgaaatgaataatttattgcaaatgaggaggactacctgcattatctgtaataggccttttcctaatgtctactttattgcccaataacattccttcaaacattcatttgaatatgaataaaaagatatgctctttaaaaattgaggagcaagatcatactcattactatttgctatgaactaagctggacccccgagagtcactgagctccctaaggctacagccccctcagccgggctcccgcactcttcgcagatctggtctggcagctcacctggtgcccgaggatggggtgtgttgcaggcttcttacccttggaaacatttgcatccaccacatatgcttcagatggccacaggatgaaattagtccatgcaaaggttgcccgacattacacgttatttaagaattaaaaaaaaaaaaaatccctcgttaaactgtgaatgacttgattcctaggggatagtttgccgtgtttctgagaaagcatgacctgacttgcctcagcagtctctgtgtcctgcccttcaccactgcggtgccatccattctcagattagctgctcagctcagggctcccagtcaaaacacactgtggccgccatcctggaatgcacgtggtgttagggcccctgcacccagcgtacagtagatgactgtagcatgatctgtgatctctgactctccttataactcttctgttctcatctccttttttttctttctgtttccattactttgagcagcatcaagaaaaacttaccaatccaccacaatgagtaagtccccctgtgaagccatgaaatacttgctctacacaatgctatttcatgcttctccatcctaaactttgaccattttctcctgcgggaaaaaatgtcaagtttaggtgttgatagctctcatgactgactcttcactagaatctgaattggaagagctcaccaaacctgagtttacagttcattttttagaaagagctttaaaaaaataaaaaacaaccagatgctaaaaagcccacatgccaggctgtgtaggacttccattttgttcatcctcttccacgtgccactca

SEQ ID NO: 43127 - DNA, 613 bp, Bovine  19866880516821
tccctcctcattctcttcaaatgactgctttctgggttctgcccaaatcatttcagagaaactgctcatgccaaagtcactcatgacctctgactaccaaacccagtagaatttttctcttcttatcttgcttgtcctttctggatttcccatatcactgccactccgctccttccgaaacactcttctctgggctttctgcaatgctactctcccctggttttcctcgactctctgatctgccttcttcagagtccgacctttaatgtaatcaaagcttccagacttcatctcactctcttcactgtatgtccaccctaagttctctctctgggtgatagtgagagtctgcagatctctgcatccaacagacttttctctctcagtcctgacccaactggctgtcccactggaacctcagattcaaagcatcacaaacggaatttatcatctttcccttaaagtccctcttcctctttatatccccatcagtgctcccattacccccaaaactgaaacaaaggatcaccataaggctcctctgtttttagcctccatccacacccagtcactgtatctcaactatctactacatctctatatcaactatcta

SEQ ID NO: 43128 - DNA, 977 bp, Bovine  19866880629442
gcagcttttgcttgttgcccaaggaggcggctctgttcaagcccccctttcctcttgggcagggtgggcaccttgatggcctgctgcacctgggtcgtaggtagcaggatcccgggaagacggatctggacacagaacctttccgagagcagcagccgggacccgtttgcagtccagagcactggcctgaccaacgtggggaccttgaccgcactgggcatttctcccatctgcagaattaagggtcttctgttcccttatgaccagagtgtgttggcatccccaccccggcaccccgagtggcagggaggcagcactctgcccgtgggtctctgcgcaccctgccccttggctactggagatgaggctgggccctccacacactccccagagttcacgagggcccttggctcgggggagcctcacttgttcccagagagtcgctcccccatgactcatggccctgatccccgccccgcaggaggacttccggaataaagtggaggactacattaagcgctacgccagatgatacggggagaggactgcagggccgcggactgtgcgtgaaaagatgggctccacccgcaaccagaggagcctctccccgatcctcggctcccctcagtcccgccggctcgtccgggtcctgtgaccgtgttgtcctgaggaagaacctcttcacgaccgcccattgtagccggagagttccacataaatacagccagaaaatgtgtctggggttctaaagagttgtctgcttcccttaacatgtttacttttttgaaactgtactgtataggctgttgatgagaatgaactcagcgtcgaggctagagctgcttctcccctcccccgtcagtcccgcgcaggtgatgctgacgctcagtgtagcccgcagattggccgtcagaaacccgctacaaacagactgtgattggtgcgaagtctcttagctcctcccacgaatgtcggcc

SEQ ID NO: 43129 - DNA, 908 bp, Bovine  19866880861353
ctatgaaaatagcctaaaatctatacctgtgaatgcctcaaggctatgaaatcaaaacctagagatgaccaattgctttaagttaatcagatcttttaaagccaatcaaataatttcctttctttgcttccagactttccctacagaagtcttctcccccagctcctgttggtggagtgcctctaactacttccagcttggcgctgccaattccaattgactgctgtttttacatgttaaatcgatgattttttaaaacatgtttaataacaagaaactttaagtaaatgttagttactcagtcatgtccaactctttgtgaccccatggactacagcccaccaggttcctctgtccatgggattctccaggcaagaatactggagtgggttgccatttcctactccaggggatcttcctgacccagagatcaaacctgggtctcctgcattgcaggcagattctttaccatctgagtcaccactttgttgaattacaaattttaaaatggctcacttaatttaaaagtggatccaaccaatttttgctcacataaactgttaaacatgcctcgtgctatcttgtaacagtgctgacatcatcacctaaagtttctttattaggtatgcttcttaggctatatctttgaaaatttttctttcacaaactcttgccctcattgtcaacatacttactagaaaattccacttggattccccgaatgtcaggttaaacttttcataatgttcctggctttcctctttcttctctcctctgctcatccatgtctacccttttggcattttcattattatagacgctacttcatatcctaaaccatcaatccaaaaaacctgagcttcttcttgtatgccctttctcatttatctacatccttcctacacttt

SEQ ID NO: 43130 - DNA, 797 bp, Bovine  19866881251056
gagagcctgggcaggggcgggggtgggtaggaagtgctgggggagctaatgtatgaggacaaagttggaacttgtgagtggcagtttccttggccggtgcccagggtctattttgaggccttgtcaaaactctcctgacagaacctaccacataaccacaatgtgtcctggccccactgcaagtcaggaaggcttgcggtttaggaagatggcaacagaagagggagcttataaaggacctttgccttcggaagattaaggctcagtttgggggtgaaaatgtgcttagcgtgcatgtctaagatccaggttccttttgttttccctctgtgtggggtgagcttgattaaggaaagctaacgagggcagcattgtggaagaatacgcaaggaagagcgcagtattgatgtcatgtctggttctgagtgtttggcaagaatcagtctaatgctctacaccaggggaaaagacgttactcttaccccagtagggaggccatgtcccgagctgaaatagtagtccagttcagagaccttaaaaaggattattgagtttatacagaggaataagcttcttcctgaattctcattctcttcttcccatagaactgtgcagccccatgtataatatcagaaagttctcgctctaaatttttggtttattaccagatgctgtgtcccagcatagctgcctttctgtaccagatgctttctcatgaaaccttggtgtttctgtacttagtaaagtgcttgggtttgacgttctttaacagatctcagagcttcttaggccagaaa

SEQ ID NO: 43131 - DNA, 1490 bp, Bovine  19866881331226
tggattctttccagtgagccactgcggaagcctggagataaacttcttaatgcgcgatccatggccttgcagtctgctactcctgtcatctggcctaatgcttaatgtagtcttcaactttgttccggaagtcttccttgtcccacaaatgatgttctgcagctccaatatttagtggatcatcgaaactcaaaatattagtaaacagtttaatccccaaacaacatccttccgtgtcctcgtgggagtccagccagtgccccaaaaatgttgagaacattgaattttctctcagtaaacttaggggtatttcacctgtctctgtgatgttgggggtgccaaatcctggacaagcatttcactttgggaggcagcatgttgtatgcatcagaaacttcagtttcaaactgaaatttgccaccctggtagtaacccttatccggagtgacagctgaaagcgatgaaacttgttcagattaggaaaacgcactttgcacgtacaaggtaaattagcttcagcttctgccgcctctttaacaagcagcctgtctcacggacacccaccgagtggagtcagaggctgtaagtggcacccaggactctttgagaccaccaccctgcttcaatttgcttggtagtgaaacatcattgttggtttttcaaagctgagcccagctctttgtgaccctgtggactgtagcatgacaggctcctctgtcctacactcttaaaataactgaggacaactcaagagagattttatatgagttatatctctctcgcgtagatgtttatgtgttcgaaaataaaacaggaaactttaaacttttttttaagctacactgccaggcacatgggaatcttagctccctgtgctcttcaggtcgttcagttgtgtccagctctttgtgaccccatggactgtagccccccaggctcctctgtccatggacttttccaggcacaaatactagagtgggttgccatttcctcttccatgggctcttcctgacccaggggtcaaacctgtgtatcctgcgttggaaggcagattcttcaccactagcgccacctaagcttcctgagaagggatccagcttgtgccccctgctggggaagggtggaatcttaaccacaagacaggaaagtccctatttacttatttaaaataagcaacaatatagcagtagacctgccctacaagaaatgctaaagggagtctttcaggtttaatggaaaggacacaatgtaacttgaaaccatcattgaaaataaagtgaagtgggtcccactctttgcaacctcatggactgtagcctaccactctcctcctttcatgggattctccaggcaagagtactgcagtgggttgccatttccttctccaggggcatgttcccaacccagggattgaaccccgggtctctcgcattgtaggcagacgctttaccgtctgagccaccaaaacctcactgctgctgcttctgctg

SEQ ID NO: 43132 - DNA, 3246 bp, Bovine  19866880195559
tttttcctgtggtctgtatggatgtgagagttggactgtgaagaaggctgagcgccgaagaattgctgcttttgaactgtggtgttggagaagactcttgagagtcccttggactgcaaggagatccaaccagtccattctgaaggagatcagccctgggatttctttggaaggaatgatgctaaagctgaaactccagtactttggccaccttatgtgaagaattgactcattggaaaagactctgatgctgggagggattgagggcaggaggagaaggggacgacagaggatgagatggctggatggcatcactgactcaatggacatgagtctgagtgaactctgggagttggtgatggacagggaggcctggcgtgctgcgattcatggggtcacaaagagtcggacatgactgagtgactgaactgaactgaactgagggggaagtattccatcattaggcttggcttagaacattttttttttttaagtaagatgatctgctgagacctgctgtgtgtttactcgtttggtaagtatatgaatttattaatttccaaagctataatgggatccctttgagagttgacaatatacttatatcatggataaaaaagaattcccatagggttttgaactcatagtgagatgttacaaaaactgggcttctacttctgtctgaaacctgatttacttagaagggcagagaagaggcgccaggaagtaaacacacaccgtaaaggcaataaacactctggagacagaacggagggatcttttctaagtgaaagtgaaagtgttagttgctcaatagtgtctgactcttgtgaccgcaaggactgtagatcaccaggctcctctctccatggaattctccaggctagaatactggagtgggtagccgttcccttctccagaggatcttctcaacccaggaatcaaacctggatctgccctttgcaggcagattctttacagtctttgagccaccaagtaaggtgctcataaaaggctgcttagaagaaatggtggtacagttgggtcttaaagaatcaaaagactttagatagatggtgagaaaggacccagatatttaaggtaaggaggtcaatttagcttattggtatatgcaagtctatttaattctaaaacagaaatagtagaaaatactcaaccttccttattaggctatcactctctctgttttttcccttctctgcttccctgtcctgacttctgtttactctgacttctgcaatctgtcttcctgaccttggcagtgagctgaagctggccccactaaggatacagatggccccgttgctattggcagtgtcagcccttctctctgcatccctccccctgtggactacccctatttctcctcccttgggcaccacaactccattctcttgcgcttctcacatcctgtagatggctcccttcttttctcctctacatgctccttctcttcaggccctctctccactgcgggtggcattcagggttctgctttcagctgtctcgtggccctgactctgtttacctcctacttttgactcaaagtttggattgggatgtgggaaacactgagcagagttctgggctctagtttgagtagagataactaaaataataggggtttgcttaaaagtagcaaagtaaagaggaagaatgacattgggtggggctggaaaggtattttttgttctgttttttacattttcttggctgcaccacataacatgtgggatcttagttcccagatcaaactcacgccccttgcattggaagcagggtgccttaaccactggaccaccaggggagtccctggaacgggtgtgttttaacctttagatatatgtgtctggtcacaaattggaaaagtacagaatttgtattcaacgtattatcagtgaaatctatggaggagctgagactgcaaagtgagaaaagaattggtctgaaaatagaatcttgaggatttaggggatgaaccagtgaagaacagaatagttcaggcagaggaggaaaagatgtgatgtcaaggaaataaagcgggggaaaaaatgcaagaaaatcaaatgtcaaatgcccagagatggtaaaaactatgcattaaaagtggctgttctatttgatgtttgaaagtcgctaagttgtgtctgactctttgcaaccccacggactatgcagtccatggaattctccaggctggaatactggagagggtatcctttccttctctaggggatcttcccagcccagggattgaacccaggtctcccgcattgcaggcagattctttaccagctgagcctcaagttcatcgattagcaatatttatgaagtgttttgcagtttaaataatacaagtcaaatttttgcttgtcttttaatctacttaatccaaagctgaaatacaaagtgttttgctcaacagcaaatagagatccagttaagtgtggtggtaagggggcaggattctggctctgggtttaaagaccgtcaacataaaaagcattccatctactcaaatcagaagtgacctacaaagcagaaatcaactgttctaaaaccaagatgccaagcaagacaggaatctttgtcttatttgtctggagggaaggatgcttacatactcgtgtgtgcatactaagtcgctgagtcatgtctgactctttgcaacctcatggactgtagcccaccaggctcctctccccatgggattctccaggcaagaatactggagtgggttaccaagccctcctccaggggatcttccagacccagggaccaaacccccgtctgtctcctgcattggcaggcgggttctttaccactagaaccacctctcatacccctaaatgaacagtcttgtgacccttgagtacatatagggagatcagatttacaagttttgtttccttggtttttggccagcatctttcctgcaccttaactacaaaaataatattgtctaacaaagtgatttgcggataactcctttctctttcaggggttcggtccatcagaattttgttgacttcacttttgccactagcaaaataattggctacctattcacactgaaaggagacatcgattccaatgtagccatcagccttagcaacaaagcttccttagcgttcttacaaaaacatttaggtaagatacggcatcttctttcccgacatagacaggatgattctcaggacaaaactatctatcctaattcatgtg

SEQ ID NO: 43133 - DNA, 1922 bp, Bovine  19866880358668
tgcattcctttttatggctgagtaattttccattgtgtatgtgtaccacaacttctttatccattcacctgtcgatggacatctaggttgcttccatgttctagctattgtaaatagtgctgcaatgaacaatgggatacatgtgtctttttcaattttggttccctcagagtatatgcctaggagtgggactgctgggtcatatggtggttttattcctatttttttaaggactctccataccatctcccatagtggctgtatcaatttacattcccactgacagtgcaagagctttcccttttctccacaccctctccggcatttattgtttgtaaacgttttaatgatggccattctgactggtgtgaggtgatatctcattgtggttttgatttgcatttctctaataatgagtgatgttgagtatcttttcatgtgtttgttagccatctgtatgtcttctttggcaaaatgtctgtttaggtctttttcctactttttgattgggttgtttgtttttctggtattgagttgtatgagctgcttgtatattttggaaatcaatcctttgtcagctgtctcatttgctattattttctcccattccgagggttgtcttttcaccttgcttgtagtttcctttgctgtgcaaaagcttttaagtttaatcatgtcccacttgtttacttttgtttttatttccgttactctaggaggggggtcatggaggatcttgctttgattcatgtcatccagtgttctgcctgtgttttcctctgagagttttatagtttcgggtcttacatttaggtctttaatgcattttgagtttatctttgtgtttgatgttacgaagtgttgtaatttctttcttttacatgtagctgtccagttcctagcaccgtttattgaagaggctgtctttgccccattgcgtatacttgtctcctttgtcaacaataaggtacccatgagggcaccttgcgctgcaaatgcctgcacagcagagcaaccctgaatggttggcccagccgacaggtcttaccagttagcgcggatggctcaaccagagaacatgtacactctgaatggatttactgtcagatccaaatgtgttgtgtggtcaagtctcagaaacatgtggtctaaacgtgagattttggaaataactgaagagggcacaaaggttttggacctttcaaatggcatagaggaggtggtgaacactgagatgtctggaatggtatacccaaattggataagagtccatctgagaaaagaggcctggagatgacagagatttaactgtggatctgtacgtgtgatcagtcagtccaaagctgctctgcaataagtgccatctttaccagaccaacaaaaatatttgagaaaattgagaggtgtagacacgagaaattgtcatttttgaaaactttgtgttgaaaacaaaacagatcttagactgcctgtgtggtgtatttatagtgctgtttctgtatatgtggaggtgagatgtttcctctccctttaaatatgtcgtctttctaatcagttgggaggatttattttgctaaacagtttgctaacacattactcccattgcaaaaaaaaaaaaaaaaaaagggtattttggtttcttctgaataatagtgtttaagatagaaaattataggtttctgacaagcatattatatgatactacttggggggatggctttgttagcagtaactcctacaaaatttttgttttgtttctgaagctttgctgttccagtttgactaatactctgaatttagaagtatactaatatgacacaagatttaaataaagtttgtccttaaaagtttaaaaaaaaaaagatactcataggtgcgtggatttatttctgggctttctatcttgttctgtggtcaatatt

SEQ ID NO: 43134 - DNA, 2140 bp, Bovine  19866880371686
aacataaaactggatgaggagaagagggtttagaggctggtgctttagtgattacttgcacagggacttccctggcagtccagtggttaaaacatcgtgctcccactgcagggggcatgggttcaatctctgttcagggaactaagatcctatatgctgctcagcaaggcaaaaaagaaaacggacacagatgccatagactataactcactagagtcacaggaacagtcctcattggaatatactttcagagagctattttattattcgtttattttcatatttatgtatttaaatatttatttatttgtctgtgtcgagtcttagttgtggcacatgggatcttcttgagtcatgtaggatctttctaggtggcacacagactctctaactgtggcacaggcttggttactctgtggcatgtgggatcttagttcccagaccaggaatcgaacccccatcctctgcattgcaaggcagattcttaaccacttgaccatcaggaaagtcccctcttagtagtattttaggcttttggctcagcttcttgtagggtctcagcagaagaactaccttggtttcagtggggaatgatgacgtccaggaattaccatgtgcttttcaagtacatgcttgttctctgagcatgtagagaaaggtgggctcagggatgaattacactaactgcctttaggcaggcactgaaatcatgctgggattagaccctgggagacaaagatgcaggtgatgaagtgggtgatgtgggattgttactgacctcacttatcagaaaagcagctactgtccaggaaatcctgtttacattcattcatgggaggggagtagactgaccacagcaaagaggatcctggagcttctgaatcctctggaaagcataaacatggctgcattacctttcaggaaaagaatgtgctctcaaacagaccttgcaaatatcatgcagccaccattgcaaatgttcctagcagacaacatacaggttaggatcgctcaggagaagactagcagtccttccaggaagcttgcttttcatcatagaatcatttgcaaatcagaaagaaaacaggaaacttcaagatatgccgtagtatcatgacagactgagattccattctaggttttaaaagtcactgtgttctacttgtaaatacatgtttatatggaagaaacagcttaagaggcatttgtaattttaagaaaatgtgcacagacatttttaaagggttgagttagttatagcaagttgatgaatgccaaaaagaaataattctcaacaaggttgataagtaaaaccaaactcctagaaaaacagagtttacacctctaagtggacaaatactaccattttctgcaataaacatttatcagttggagtttcccatagtaaatgtatttcattttaggtttgcacataaataatccttggaatatttaaaacaaatcttacaatattatgagagacattctttgcccttttagaaaacagatatagaattttaatgttaaggttttagatttatatataacatatcatgtatatttatatattatcattttatatatcatatatattattttaaatatatatagtcatatatatgatatatcatacttccagattttacatttttgcagattttacttatattttaaaaggaaaaattttacaagtattcattaatcttttccttacttgaccagcaaaataaaataagccacaacttgtcttctcaaggcatctgtataaaaagattctcctattctctaaaggctctgcattagctaccaaccaagcccatggcttctgttccagttatgtatttcagccaagagtgaaccacaggttctgtctatgacaaaaaggtgaatctgagactcaactcagaagtcacaggtttaacaagaatctactggacatgaatttattacgtgctgggctccatgccagatggagtgggtaaggccatgagaagtgaaagaagcagtttctgcccctaagaagcttacagccagtgttccagatgtgatgcaacagtggaaaccacgaaggcaccttccggtagatctattgtctggcttgtcctggtgtgggaagcagacgcatctagaatgccttcca

SEQ ID NO: 43135 - DNA, 972 bp, Bovine  19866880389865
agttataagaaatgaataagcactgtgttcaggatctggtggagtgccgtgttattttccagaacttgctggaaatcaattgttcttcctgaagcttcctgaagctagatgcaagtgcctctcaagtgatggctgagaaagctaattttatttgctctcttgtgattatcgtctacaggattctgcttcccttgttgtttagtcactaagttgtgtccaactctttgccaccccgtggacagtagcctgccgggctcctgtgtccatgggatttcccaggaaagaatactggagtgggttgccatttccctctctagaggatcttcccgacccagggattgaactcttgtctcctgcattggcaggcagattctttaccattgagccacctgggaagccttgctccctttagctggttgctttttcagtccttactggagcttgagatgatgtgtctactgagacccaaagcgggggtcagtgggtggggggcagttggtcaaggtttattcagataacactacacacagcatgtttctatgatttttttttttttttgcctcttatgtttttattgtttcatttttgtcctcataagcaactctttctctaggagaaatattttatagtaagtccataaaatatcagtcaacacctgtttatttgaatgttgacagttctttcctttactgctcttttcttccctgaactttatttctttcagatgctgaaaatttcttgccacttctgtatttcaccgcagccacagtctccctccattctgttctccatactctgctatagggttcttgggaaaatgcaattctgataatgtcacttttcagtgaaatacttccattgcactccactgcttatagccttgcttcctgtaaggttgtccagggactggctgcctcaggacaagctgcaggggcagcttgttagagatgctagttttccatcccttcccgg

SEQ ID NO: 43136 - DNA, 1130 bp, Bovine  19866880421329
tcctgggtaaaagaagatggggagaggcagtcaggaatgagcaagcagagtaggtgtgcagggaggggtgggatctgaggatgccaaggaggcagggggtggactggggggtacctgccaggggacagagcagttgagacttgaaacaggaggcagtcaggagccaggagagtgatctgatccagggaggggtgagatgaaagcatttttcaggaggattaggctggctgaggcacaggatgtcttggtcttaggcaagttcaggccaaaggttgatgagaagtcccgaaggaggggtcctagtccgacgttgggcccccaggtgcagtgacagcagcctccttaggaaggatgatttccccggggaccccgactgggtgtgcctgggactcatcctaccgccagctttgcctccaccctgtcccctcacccgccacttccaggtcccaggaaccaaaggatccatcaggctggagtgttcagaggccattcccagaacttgcctggtccggctctccgcccctgccgagacgagacaaggcattgttcaacttggcctctgctatcatgtgcccagtgttgacctcagcttccttgtggctcatctcacaccccttctctctgtgcagcccttacttcctcctgttctttcactgccctcctcaaaaccgtctctaactttttctggctccttcacatggagccacagaggagaaattccactgccagcttctaggggcaagttttggaaagacgctgtgtgctgccaagcctgggagggtgacttaacgagagagtgagccacatgcctccttctctcagtcattggtggtgtcttagagatgacaaaggcccctggtgggcatctctaccccaccccatgcaggtcaggaacagagtctgagctgactttctcactcagtcagagtctggttttggctcagtgtcattgtgcctgcctgctaagtcactcagtcgcgtccaggtctttgcgaccccatggtctgtaacatgccaggcccctctacccatgggattctctaggcaagaatactggagcgggttgccatttcattctccaggggctcttcctgacccagggatcgaacccgtgtctcatgtctcctgca

SEQ ID NO: 43137 - DNA, 1594 bp, Bovine  19866880582854
ttaacaaaatttagaattatatgtatttataaatagtggttatttgtttctattttcccttgccttctctatcagcatgtaagctccatgtaggcaaaaatcaaatctgtttgatctattcctacagacctaatgtcacccccacagagtaagctctgagtgactgaacaaatatatctcatttttctttccacatcatcactgtagagatggaagcatcgttgttgggtatgaagttgttggttccagtggcacatctgagctcctgtcgggcattgagcagatggttgagaaagctaagacatatctgcgccagctgtatacacttgaagaaaattctttcagagtgttcggagaaggtaatgctgaattctgtagaattaggttacctgtatatgggctcagatcctcagtcatgtgggactctttgtgccccagtggactgtagcccgccaggtccctctgtacatgggattttccaggcaagaataatggaatgggctgccatttcctcctccaggagatcttcccagagcaaggattgaacctgtatctccttcgtctcctgtatcagcaggtggattctttatcactgagccacctgggaagctccagggaagtaggttgtgggagcctaattagtagattatgtattggagatgttcccaaaacagaattgttctaagactgactttatcaagcagctgttccctcccccgcccaactcccgccaggatgaaactcaatttcagctgactatttcagactatttcagactcttgctcatgggtgatctgacctcttattcttaatgtaaatgtcatgcaagactgattcactgcaggctctgttggaaatgactcagcaatagtttactggtgtccatgttgaaagagccctggggctgatgacattcctaaattataatccaagggacccaggaaagaatgtttgtttttttttttttcaggtctttcacatacacaaacacacacagaaatacacaggcacacacaccccacttcatttcttcaaatgtttgaaaaattctttacattcaatttcaatctctcttaccaagatttttgccactttcaacatctatctaacaaatatttactaagtgtacaaagagcttagacacttacgacagaacagtggggaaaagaaacaaaaatcacagcccttgtggttctttcttctcccagtcacgatcatggtaagaacctattatgaagggcctggtgcaaggggagctaagtggttggtcatgatgtgaggggaacagagtaggacatgtcacccccaaatggcaactgcctatcttttaaccttatcatgcctactttgtcccatagtatcttgaagcttatctggtattctagcatgcccttaaagagggtaaatattttctaggagcgatcacaccttggcttgttttcagtgaatacttactatttgatagctcactaaaagtcagattgttggcctagactacatacctggagggaaagggggccagccttggggagggcagaacatcaggaaagaagaaaagggactgatgggggtaaagatgggcatcaaaaataaa

SEQ ID NO: 43138 - DNA, 1384 bp, Bovine  19866880595714
gactgattagtaagtagatcacagctaattctgaaggaactccaagtcctcccaggactcggaccagcctgacactccaaaatctgctgtccccctattttttttttaggaggaatgcattcagtcattgatccctggaggctaaaattgttcagcctcttgacactttacctgaatgctccaagaccatgagaaaaaataattagtgggtatttttccccagtcctcagatgtgcattccaggctgcaggagttgtcattgaacctagagagcagtgggaggtgataattagtgtctttttctgacttgaatatcgctggttaatttaacctacatctcctgagtataaaaacctgacccatggaatttattcttttatgcatcaatagtaaattcatgtaaaaaaaaaaaaaagtctcctactaaataccaccaagcatgggcatgaaccacttgttttttttcttaagaccataggatcatgaattatcagttctcactgtcagctctgaacttgaggtgagacatttcctactgagaggtgtattcaggaaggctgctccttatcatcaatcacagatcttggcaaaacttcaaagggaatattctgaaaccaaacaagtaaacctcaggagcattaaactgagattcagaatcttcaaatgggaaactcctcccactctaatttaatcaaggtcaagagaaagatagggagaccttagccttcaccctcagatgtggctttggatgaagttctgccactgagttgctgctgaccttgtgcaggtcaagagaactctctgagcctcagagtcttcttcagtaaagtgatggaaaatatagctttctcatggggggttggtgagaatcatatttaagtgggaatatatgtagatagcatcactgactcaactgacatgaacttgggcaaattccgggaacagtggaggacagggaagcctggcgtgctgcaggccatggggtcgcgaagagtcagacacgacttagcgactgaacaacaacaatatgtaaagcacacctatccagtcacatagttaagggctcagaatggaggccgtggtcttttccttcacttctcacttattatggtcatcattatcatcaattatttgtgttccactttctcatcaacacagtggagatgtgcccacagaaaccgaatgtaaagattgctatagcagtgacctataaactattcagcattatgctgctgctgctgctaagtcacttcagtcgtgtccgactctgtgagaccccatagatggcagcctgccaggctcccccgtccctgggattctccaggcaagaacactggagtgggttgccatttccttctccaatgcatgaaagtgaaaagtgaaa

SEQ ID NO: 43139 - DNA, 695 bp, Bovine  19866880605406
caagtctaaaccacaggtctcatactggcaccctcagggccccatctggctcacagatgtgttttgcttggcccaggcaatgtttttaaaactattgatttagttgctaacatttaaacatcaggggatttcagatgcaaattcagatttttgaattccggcattttttgaaatgggcatgtctgacaatactgttttgctattcctgccttggtgacatttaattggagctgagtacaggctgcccatattcttgtagctttctttcatcactgccgagaatgtactgtttcagtgaatttttggtaagtttcgcatgaacagagtaaaaaactcaaacttagaaaaatatattcattggaaaattagtttccaacaacttgtgtttcacagcccacagatcctcatctacaaaagcacacactctcaccagttaaacagtgtataaatatgtatccccccttgcaacttacactggaattcatttcatctgggttaaatatgtcaaaacaaaatatgaaactataaagatactagaagaaaaaaggaagatgttgctcttgtatcccttactttgttgatttaatgacaacatcttcccaaagtaaaaccttaacccagacatgacccaaaggaacaataggtattcaactatataaaaaagatggggacgggggcggggggggggcgggggg

SEQ ID NO: 43140 - DNA, 1944 bp, Bovine  19866880744296
gaacactgtgggactgccctcgtggtccagtggctaggagtccacctgccaatgcagggcacacaggctccatccctggtccaggaagattgcagatgccatggagcaactaagtccatgtaccatagctgcagagcccaagtgcctagagcctgtgctctgcaactagagaaagcgtgtgtgcagcaatgaaggcctactgctaccaaaaattaattaattaattaattacaagggaacagtgtatcagtgatactctgaaaccacagccaacataagctcacctaggaagggagaaagaaaatgaatgatatgccaaagctgcctggaaggatacatttttatttgcaatcctggcatcatgaatgctttagggggaaaaaaaatcatgtcttcatgagacagttaaaaatgatcatgaattaaaatcatcaagctgtgttagcatatatggaaagaatggggtcacatgatcgtttgactcaaacatttcattgaccaaaaactggttttcaaagacagactgtgttaaattgagagtgaattagtttttcatggatattttggaagttctggtccatttgcgcacatttcaaggtgctgatgtcacacagaggtaagccaaatggtttgcatcagatgagagatgaggaagtggcctggcaaaggctgttgctcttcagtgagacagggctattcatacggtgggtgccccaacataggagacaagactaaggcagcctggaattaaaaggttgaaaatatctacatcttcaagtcagaaaaccagaaatgcttctggaggacagtgaatgccttacatatctcagtttcactcccatggcccctgtttcctggagctctgaatacccgtggatgggtttcacatgtcctggtttttaattaagagggtcagtgaccttaaaggacttcacatgtgcaaaaagttatactgtagagtttatagattgcccattgaggatagttgttatgttattataattttatgtatacatacatgaattatactattacatgtacctacatgaacatacacattattacatatactgctgctgctgctaagtcgcttcagttgtgtccgactctttgtgaccccatggtctgtagcctgtcaggctcctctgtccatggggttctccagtcgagaattactggcaagcaactgcagtaatttgccatgtcctcctccaggggatcttcctgacccagggattgaaccctggtctctgatgtctactgcatttgtgggcgggttctagagaaggaaatggcaacccactccagtattttgcttggagaatcccatggacagaggatcctggcgggctacagtccatgggatcacaaagagtcggacacgactgagtgactttcactttcacttctttaccactaaagccacttgtcactattacatactcacgcatacacactatttatacatacgtttcactattacataaacatatatacattattataattactgggactaatttcattaataaatcagactatacctcagtctgatcaggagattagccctgggatttctttggaaggagtggtgcttaagatgaaactccagtactttggccacctgatgcgaagagttgactcattggaaaagactctgatgctgggaggggttgggggcaggaggagaaggggacaacagaggatgagatggctggatggcatcaccgactcgatggacgtgagtctgagtgaactccgggagttggtgatggacagggaggcctggcatgctgcgattcatggggtcgcaaagagtcggacacgactgagcgactgaactgaactgatacctcagtcaaacttcggagacaattttcccagtctttttgattttacagtccataagggtgggcggaaaaaagcttttcttctgtcggctgt

SEQ ID NO: 43141 - DNA, 1455 bp, Bovine  19866880752332
atgggatgtcccaggcaagaatactggagtgggttccaacccagggatcaaaccccgggtctcctgcattgcaggtggattctttaccattgagccacctgggaagccataaagcttggcacaggtagaaaacaacgtgctttaattcacttggtcttcctcaaagcctcatatgagatactgttaatgttcattatttcataacagataaagcatggaaacaaaacaaaaaggataagtaacttgtccaagacaagcccactgcacctgcagagtaatggtatcaggattcaaacaaagaaagttgcattctaaggcctgaactcttaataatattctctatcacctcagtgaaaagtagactttagttctaacacaaaagaattctgagtattcagtcatctcctaggattttcatgttggtcttcgtttttactgcgatccagatatttcattaagggaatttgatcactcagggaatcttttgacatatcttttgggaatgggaagtaaggagacctaggggcgcagtctgcccagtgtaagataattaaatgaacaaatgtcatcatttcgcctacaccttttggtgtaggcatgccacctcttctcttcctcaacatacctgctcatttcgtaaaggaaactcctcctctcctcgcttcagggttctgagatagagccaagacttgttgcctatttctacagcagactggtccttgaaatagtatgtcgagcatgcagagccatctctacaatacaaacagaatcaatgacttgtatcacgcatgttcctcactcccatccttgactctttctgacttcccttcttccaactctacatttttttttaaaatcaaagaggcccccaagggagttctaagaaaaagacattgttgcctgtaaagaaggcactctgtcttcacaattctgggagaccctggagtggaacattctctcccgaatcagatcccagcaccaccacttactagctgtgtagtttggggcaaattacccttccttggcttcatattctgcctcccttgaaacagtgatagtaacatcttaaaggattgttaagaagattaaatgagatggtatatgaacatagcactcaatgaacacaatgatgagctcaataatggtatatgaacacgaactctagaaatgttagctgtttttttatatacatgacaatctaattcagtctccttttcttcgcagtcatgggtaaccatagttgacaactgtatcaagtattttttttttcctgctgagtggcacagcttataggattttcgttccccaccaggcattgaacacaggtcctcgacagtgagaatgggtcccaaccactgcaccaccaaggaattccctctaacagtactttgtataaacctttaagaaaggtagagctcagccacataccaagtgacgtacctgtgttctacagca

SEQ ID NO: 43142 - DNA, 1263 bp, Bovine  19866880763209
cccttgctccatgctggatcattgccaagggccatagcagccaccataaacaccatctcttaactccatctgtccctgaaacactcaaaaagtacaggctagaacccaggacaactaaactttgggtttgccaacctgatcaccaagcacactgataggtcagacagactctcagagtttgccatcatggcatgaaatggaacagaggagtttccaaagagatggcttatgcatgacttagatttcaggagtcagagaattccctcaacctctggatagagcactcaaaaaactaatgcttttcccaatattaaaacaagtaagttgctttgaacaggagctagtttattgagtaatatgcataatatctggtatgtgcccttccattttcttcagaagcgattcacttccggtaaaataacaagtggtgttcgcggtctgatgatggactaatcgcgctaatgatagactagcttgtttccccaaggctcagtcatgagcctgcgctccacatctctgggcttttaaaagcacattcttcctgctccccaaggagctgaacttcagaaacgttgatggatgaccatttgtgcttcattttccatcttcatcactcttccccccattttatgcttctcctcctggagcttattttaggccccttcttggggctggatttgagagccattgttgttcacagacacaggcatcagcccaaccttttccgatttctttcagaaacaaatgttgtcattgtgcctgacataatatgtattcttgaaagagcattttaaaaagaatatatcatggctccgaagaactgagggaagtggaggtggagagacccgactgtcagatgtgaagcaaccttggagcagggactcagatggaaggcaagaggtgtccctggggagcggccagcttaccacagggatggccttcgctggttgaccagaaggtgatgctgacctagtgatgttacccttgtattgtaggtcttgggaaatttattgagtgtctcctatgtgctgaggatttctaactctaccttaaaagttattttctctctttggctaagatggtggactgtctcctgcccaccaccaactgtcccctgctccccgtgtaccccggtccacatagggggactcctgtagccttataaatgagtgggggagcttggtgggttcagtgtattagaagtcaaaaccactccgtgtctacgcccttgaaaattctggattctcctgacagtgtataatc

SEQ ID NO: 43143 - DNA, 1496 bp, Bovine  19866880775874
tttgtgacactgaaaaatggattgcatctgaaaacttatcagctaggtaaatatttaagatttaagcttagtcaattttcttaactcaaaatgtcataaaatatccaaattattttcaaaatcccaattttatatggtttatacttttaaaaaatactgacatattaatacacatgaacactcaattttcatagattttaaaaaattatatatagtgtcatagcatttaatttttgctaccaaaaataaatgatttacagaagatccattttcatcattttagaacttaaaactataaaaaacagaaaactgaataatctgtttcttacttacttggacccttagcaggtggtgggtggtttctttggtttctattaaaataataattgtgaaaacagtaaaacacttacatattaaatatttatagttaaattctgatcataaataatctaagttacataaatacctctccttaccccatccctgctagaaattataaaatggtaagattcaagcaactccacaaaagattacagacaaaaaatttatcctattagaacaaatgcctctttgatcaaaattcaaatatttcaaaaattatcactgacttagatgaatttaaaaaagcttaatgatgagcagaaacattcttccgtatctctcctattttaagaatcctatgcaccattttacctctctttacctggcagggaaagaaagatactttatttttaaaaaagaggaatacctaataaatacagagagctttcacttttgattattcaggactctcaaaaagaacaaaaaggcaaaggtctattttttaatttattaaaattctcttgggtttagaagcattcattcatttttgccttaaaaaacttgaagcacatttctaagtttgtgaatttggtttttccaaattaaaaataactgataatcaatactccatgaacatctaataaaagccaaaaaaagaaaatgagctcattaacaagagtataaagtgtgtaaaaataaagcacacctgaagcctgttgaattagtaatgaatgaaatttagcaaaggaagaatctcagacagtgtaagccttcatacattatccttttgtaatttactttaaataaaagactgcaaaggttagagatttctgcactggcttaaattaaatatggcttactgccttgctggggtttgccagctctctgtgtaaatcttttcctcttgttgaaaaattcattaatccctccataggcgaaaaagagggatcaaactgtataaaactaaaagatcattgactcactctcacattattcattgtgagaagtgagatcaatacattaaatcctgtaaggaggctaaataaagccttctcactgtcccagaaatgcagtgacagagtaacagtacccaacagtaccttaaaataaaaattttccacaaaattaaatataatgacttacagtcaagtgctaacttgtctgaatagtacagc

SEQ ID NO: 43144 - DNA, 1140 bp, Bovine  19866880841887
cctgagcctggatgagatggttgggctttgtcagcaggtggatggccggctgcccctgggcccacagatgcaggaaaaggtgttctagtcctttggtgaaaaatgtgcaaatgttagtaaaaacacctttatggattgttttgtttgcaagtgtttattatcagacactcctcaggggttcacagggcaggtcgcgaatgtccgaagtagggcctgggaatttccttccaccaaggctgtgcttcctctctttgttactcctcaaaggacaagtggaagcattgctcgagagccttatttaaccctttcttctgtccgcctgccccatcacagacaaatccatctatcagcctttgaagaagcagaaagattgcagacttgggttgtgtggggacacccacaggtgcatatgcagacaggcttgtatatatgtgtgtgtatatgtgtgtatatatgtatatgtatttgtgtgtatatatgtgtgtatatgtttgtatatatgtgtgtatatgtgtatatgtgtatgtacgtgtatatgtacatgtgtgtgtatatacgtgtatatgtttgtatatatgtgtgtgtgtttgtatatgtgtgtgtatgtgtgtatgcatatgtatgtgtatatatatgtgtgtgtgttagtggagaggagatagataatacagcataaaacttattttttttaaactttttcttttatattggagtatagccgatcaacagtgttgtgttagtttcaggtggacagcaaagggactcagccatcatatacatatatctgttctcccatcatatacatatatctattctcccctcccattcaggctgccacataacactgaggagagttccctatgctgtacactaggtccttgttggttatccattttaaatatagcactgtgtactgtccatcccaaactccctaattacctcttccccccaacctcccccctccacacataataaagcttgcttcttttttaaagttctctttcagtattactacatacacccagtcattgttcagaccagacaaaatttctactttatttaccaaaacatattttcatagtaaaaatgctcacccaattttagttaccctgtccccattccctgttcccagagcaggcc

SEQ ID NO: 43145 - DNA, 1550 bp, Bovine  19866880849261
atgaggagctgttgttgtcatcagcgtgtatgtgtttgtttacatcacacctcgctgggggtcagtgatacctgacctacagctgtgtcggccctggcatccattcgaaggcttggccatagtgggacccccttcacttccttgaattcattcaactgaattcattcctgataatccttgtccttcagtttttggagaacaatcattagcatttgctattatgcttctggagacagctgcccattgtcttctcagtcttccagttatatatttatggatcagatttcatttatttatgtcaacagctgtctccttatcaacagtggtgctgaactgggactgctctcacctacagtttccagaatttttagcaataatctattcttaggcagaactgaactcgggcggctttcctggcatcagtatttatgggattgtgtttctccctctataaataaaagaattcccagtagaatcgtcatcctcctctctgccttgaactcatgtgcatgcacacatatgcgcctgtgcacgcacgtgcacacacacacacacacacacacgggaagagcagatctctaactgggatatgaaaaaaattatgattcaaatagaactggttaacaggtgagaacttgccaaaccttgttttcattttattctttttttatgagttttcagtcatgttttcattgggatctgcctttgtataggaatccctgagccatttgcctttgagaatgtcttcgtgtttttcaataggcagatacagtagagaagccaggtggaaatataggcgggaaacaaaaaagataaccaatgcatcacacttggaaaaatatttggtggtttggtcattttttttgagctagactaacttctggaaggactataaagatatttaaaatttcagtgagtgtctgtgttgtctccccagtacaatttaaacacatattttatatattagcatgtttttagtatgttaatatttaataaacttggtcggaaaaaacctagatgaattagaccctaacctcaactttgtcctttttctgctagaatttgtgcaagctaaaaagaactcttgctggactcagtttcctcttccctaaagtaagcaagaaaataagatgcactcagaactgttctcattcagatttcattattatatgcgcatttcacagtttctatgtatataccatttatgtagttattctttacattagtgcctatcagtaactgaatctgagcttggagagattaatttttttttttttactggactctaggtaggctgcagtccatggggtcgctaagagtcgggcacgactgagcgacttcactttcatgcactggagaacgaaatggcaacccactccagtaatcttgcctggagaatcccagggacagaggagcctagtgggctgctgtctatggggtcacacagagtcggacacgactgaagtgacttagcagcagcagtagcagcagtcctattttctctagttattatcattcctgaacatcttttaaggggagctgagaatcta

SEQ ID NO: 43146 - DNA, 1714 bp, Bovine  19866880881868
taaatatagccgtgtatacatgttcatcccaaaccctctaactatcccttctccccatccttcccccttgcaactataagttcattctcaagtctgtgagtctctgttttgtaagttcatttgtatcatttctttctagagtccacatataagggatggcctacgatatttctccttctttgtctgacttacctcactcgtatgacaatctctaggtccattcatgttgctgcaaatggcattgttttccatggctgagtaatattccattgtacatatgcaccacatctttatccattcttctatcaatggacacttaggttgcttccatgtcttggctattgcaaacagcgccgcagtgaacactggagtgcaaagatccttttctctgcatatatgcccagggtgggattgcaggatcatgtggaggctctatttttactttttttaaggaaacttccatactattctccatagtggctgtaccaagttacactcccactaacagtgtaggagtgttcccttggctctacaccctctccagcatttattgttagtggatttttttgataacagccattctggctggtgtgaggtgatagctcattatagtttttatttgcatttctcaggagtccttttttgccatcgaactaaacaccagctcagcaacctgtagttctcactgccttcaactgtctgcctccttcctcctcactttcacctggctgactcctatttaattttgagggttgaatttttttaatatttcttttgggaaatcttccctgaattcttcagaccagatcaaccactcctctattctcacagctccttgtgtttccccttcatagcaggtatgttattttatattaacttgtctgtctccttcatgtactgtaagttccttgatagaaggaagtgtgtctagtcagcactgtaacaccagtgcctagtaggcattctgcaaatagttacggaatgaattaaggacctgatccatctcaagcatcagccctgagaagtcatttatgtacatgcatgtgctgtacaggaacagaataaaatatgaacggggaaaatttaagcttctgtgatcctgaagaacagaattgtgagccacgaatggcaatgtatgattcttactatattcagaaggtattagaattatggatgaaaaatgtcgctgccatatcagtcaacaaaagatgttgcagtcatcaagtcatcaaccaactgcagacacctcctgaaaaaccacccccccccaccccgaaacacacacacaggatattggccccaggtagctgaggtgcacatcaaaggaataatttcaatgagcccagactcttgcattttttccatacatagagaaacactgctgctgctgctgctgctaagtcgattcagttgtgttcgactctgtgcgaccccatagacggcagcccaccaggctcccccgtccctaggattctccaggcaagagtactgaagtgggttgccatttccttctccaatgcatgaaagtgaaaagtgaaagtgaagtcgctcagtcgtgtccgactcttagtgaccccatggactgcagcctaccaggctcctccatccatgggattttccagggcaagagtactggagtggggtgccatcgccttctccttggtacgtacggttgtctttaacactaatcttttgagcttctgactaccctgat

SEQ ID NO: 43147 - DNA, 2713 bp, Bovine  19866880927448
gggggaagggatgggaaatgcatctttaagaaattaagggaaaaaataattccatttagaaatcattcaaatttctttctgacatgtcacacttaatatcagttacccattttcctttctctttgtgcttgcctcagaattcttcctgactcagaagctaactttaatcttctgctttattattaaattaaccttttttttttcttttcattgggaatgactgattaccaagcagacattaaatttaaaaattccactctgtgaagtggattttcccaaacccactagaccttgctggcaataggaacagtatgtccagtaaaactgggttgtggttgccagaaagacgactatgtcttggaccacacctggaataacagataccaggagctgttaatctagtcttctctccctggagggtgagatttcagttttcttaatgtccagggtcttagaaagaggataagaaaatttcaaagtcctgaggacaaaggaatttggtaagaaagaattctgataattgtagaattcagaactaaaaggctccaagtatataatctaactccttcattttaaagattaagaaaatgagatgcaaagttgttatggctgcagcccacaggtttatacaggtctggctaggtttcccgtaagtactttctctaatgcactgtcctctgaatgcaggcactggaatgtataatccagttttattcagcttgttcgggatgtcaattaattgctctcccttactgggtgttccattaagtgtcccccaatgccacagtccattcctttctgacctctctttttcatatcttcctttccctcttttatgctttttttctctcattctttttcttttcttttctgggccttgctgcagggcttgaaggatctcagttccctgaacagagatcaaatttgggcctcctgcagtggaagcacagagtcctaaccactggaccaccaggcaattcctcctatttttttcatttctgattacttttatttattaaaacagctaaatcctgaataaagaaccaggcaatagatttataggtggtgctagtggtaaagaacttgcctgtcaatgcaggagacataaaagatgcgggtttgatccctaggttgggaagatcccctagaagaggaaatggcaacccactccagtattcttgcctggagaatcccatggataagaggagtctgatgggtttcagtccatggggatgcaaagggtcagacatgactgaaacgacttagcacaatagatttaaggttcgtgataaggaagatgatgttggtactgttaacaatacctacattgttctttccaggttgcaaagctctctcagttccatattctcttccccttacaacctagagatgagttaggtcaatattatttttattatttcatacggaaaccaagggtaaggtgagtgaacctgtatgcctgaggaccttacctcaggaaaggagacgaactcaggcataaagcctgaggtttaggactcagaacccaagagtcttaaactatttagaactttagaactctgcctgtctggagtgtggttcacttagagagcaagtcaaaaaacacagccaggaagtacaagatgataaaactatcacaaaggttttgggtaaacataagggaaaaacaaattgttgactagtcaataaaagggagaaggcaatggcaacccactccagtactcttgcctggaaaatcccatggatggaggagcctggtaggctacagtccatggggttgcaccgagtcggacatgactgaagcgacttagcagcagcagcagcagtcagtaaaatatgggaatcatttacaaaaggagattgtgtagtaactcccttaatagagggtttaccctgatgaagcaggttcctagttattccctgaagcattcccaagtgtgttttcagaagatgttttggcaatatgtatcaaaaacagtaaagacgtgactaacagcagtttctctcaggcaaattgctcattatcttctaaattgtttcttcatctggtaataacagggtttgggggaggattaaataaagtaatgttaaacatcctggcatagtgagggcattcaataaatattgacaatgtttaatcatgataatattttcacttgtatgaggaaataataagcattaaagatttagtgataaagactttcttagctatgtttttataaataatagtgaaaagttggaaagaacctaatgtccagcaatagggaattggtaaagcagggccttctggtacagctacatgctaaactgttaaacagtcacttaaatgattacaaaatataatattacatagtaagatgttcatggtttattgtatttttaaaaagcaaattataaaatattaaggattataaaatattataaatgttataaaatattaaaatcaaatattaaattgattttttgtttaagtgtatatatatacttaaacatatatatacttaaacatatatatacttaaacatacttatatatatatatacatgaaagatgttttgtttagttgctaagctgtgtctgacccttttgtgacgccgtgaactgtagaggagtctgccaggctcctctgtccatggaatttctcaggcaagaatactggagtgggttgtcatttccttctccaggggttctttccaacccaggaatcaaacca

SEQ ID NO: 43148 - DNA, 1042 bp, Bovine  19866881148034
caaacatctcctggaaccttgtcctctactttgcaatcctctcctctctcctctcctctcaatgtcctcttgttctaataatcacaaattgcactgaatgctttatcaaaattctgatggatacatgacaattatatgaaggaaactcatgtggaacatacagaattgtaaggaatgactaagatgaaattattatatatgcctgctaagttgcttcagttgtatctaactctttgtgaccccatggactgtagcctgccaggctcctctgtccatgggattctccaggcaagaatactggagtgggttgccatgccccactccaggggatcttcccaacccagggactgaacccatctcttacatctcctgcactggcaggcaggttctttaccactagcgccgcctaggatctattgatttgtttgcttaacttcaaattgaagtactaaatgaaaactgcccattaattagaatttaaaagatcaacagaatgttttaattgcttagtaaggtagatttcataatccaccacatagtatttcaggtccaacatacaggcttcaaactttcttactccaaaaaaagaaaacaaaacaaaaataacaaggcactgatttacctcataaacttgttcaggtctgtggtcccgtgagtacctaaattctgcaactgttcctgtaattcttcagtcaattgtccagtgaatttgtataggttgaaaatccccattttccctttcaccgtgatataaagtttctcgtgcagttttaaaaagatattctttgcgatggatgctataaacagagaaaacacttttcaaaagaagcaaccccttcttgaagtaaatagtcaatatgtcttgatcagcaggaactagagccaaaggtgaagattcaacatagactgtgagatggtgaaagccttaacaaagtttacgagaccttctaccctctttccagctctccaatggtatttccagtgtcttcgccctccaaatatatattccgggtaaaagacactcttttttacatctcaccat

SEQ ID NO: 43149 - DNA, 993 bp, Bovine  19866881216545
tgtttaacctaatttctaacaattatttctgagtattatttcctactgccagaatggaaggtgcaaacaaataaaaatacgatcaaaaggaaggttaaatattatgacagaataaattaggatttatataattaaatttcactccatcaatcaaaatttataactaattactaggaaatggaaagccactccagtattcttgcctggaaaattccgtggacagaggagcctggcaggttatagtccatggggtcgcaaagtgttggatgcgactgagcacacatacattgtacgtaatcttaatagttttatcttgactgtaatttcagtatcggggttcttgaggacctctgtcttaagcataatccatgtccagtaacttgtctattagaaatgcttactaatctgatctctacttatgtgttttctttcagtatggaccagtatttacagtcattgttatgggcacccgaatgacctttgttactgaagaagagggaattaatgtgtttctaaaatccaaagaaataaattttgaactagcagtgcaaaatcccgtctatcatacaggtaaacagtattttcagataggccatttgaaatacaacatggaatcccaagggcagttctaggtaacaagcacgtcttcactcctctagcaaaaatgaggcagacccactattttattctttagagtagggatagaaaagagtttgtgatgagtttggcctttgaaaaacaaattgtgtgcttagtcgctcagttgtgtcaactctttgtggcctcatggactgtggcctgccaggctcctctgtgcatgggtttttccaggcaagaatactgaagtggtagccattcccttctccaggagaatcttcccatcccaggggtcaaaggcaggtctcctgcattgcaggtggattctttaccatctgaaccaagccctaaaaatgaattatttggtagtgtcaaacatttaggatctccacaagg

SEQ ID NO: 43150 - DNA, 724 bp, Bovine  19866881243286
atgcttttttacagcacctgtaaacaagtcagtgaagtatactgttctgagtttccccataaatatatattattattttttttttttggaatgttagaataccacaacaccaactgcattacataatagttactgaaggcaagttaggctataacaagggtaaaattttatggctaaaaatattcatagcagcaacttttaaaaagatgattttattaaatcaagtcattgcacttggtcattttattgctacagcaatacaaggccattaaattttaacacttctcattgctgatttgaactgattgtctcattctattcatacatttcaagtttaaatgcaagcataaaatgtttaccaacatcgagagagcacttgggttgttgttgttttctgtgatcacggtaagaagcataaaaagagaattctctgttacaccaggcccattctctcttcctatcttcagacttagattttgtagagaggtaacagctttacagaatgaccgaagcctagtggtcgcatacatacacacagtacatctaacattaaaatataactccccaaattagtaatatgacgtgtttcagagaatagcaaacctgaacaacacattcactaacaatttggcaatgacagatgccaagcagttcacctccactctgtcatttatactcactcattattaaaaaaaaagagaaaaagatttatccccaagtaaaa

SEQ ID NO: 43151 - DNA, 769 bp, Bovine  19866881328491
ctcttatgttgttgcaggaaacgctgaaatagacactgacagtggctgcagcagatacaccctcgtggccaatgggactcagtgtccgagcgggtcgtctggaacgacagtggtctacacgtgtgagttcatcagtgcccacggagccagaggcagaaaggacatagaagtgacattcatgtctgtgggtaaggactctttcactagcatttttgggcttgcccctcaaaccaggggctgccagtaaactgggaacatccgtgagcagtgaagccgggccttccctggttgtgagagggtggttggggtaaatcacacagtgggatttgcatctctgccagttaaattcacaggaattccttacaaggaaaggtaagagtaggaagcagtggttgcagggaaggaaccgcctacgttgtactgagaaggcaaaaagctgaagtaggtttcacactcagattagtcactgaataaggaaggaatcccatggtctaagagtcggacacaatggagcgactttcacttcacaaggataatgccccttatatcctactttttctcccataatcccattctccctctcttgaattgcaatagcttggctcactccccaccatccttcattccccccttttctctcccattttatctttttcagagagaatgcagcagaaagctttaggagtctggtatttcctggttatcttacagttgtaacaagtgtgtttgttttcaattaattctaggactcttaaaagtatcgtttcta

SEQ ID NO: 43152 - DNA, 1101 bp, Bovine  19866881424928
agaagatgggcattattatagggcccttgtcaccagtatttgtgaagattatcttgtgtccatcaggcttgtggactttggaaacattgtagactccgtggaccctaaagcactctggaacatcccttctgagcttttggctgtgcccatgcaagcctttccatgttgcctctcaggatttaatatttcacagggcgcatgccctcgtgagggatgtgactacttttacgaaatagtcacagaagatgtgttggagataacaatattagacatcaaaagggacgttggtgatatccctttagccatcgttgacttgaaaagcaaaggtgaaagcattagtgagaaaatgaagaaatattctaagattgatatgcgtagcagtgatctgaggtatgaaaaaaatgatgcagaagtaaagggagctctcggggtccccagtcccgatgttggacttaagaaatcaagcagtaaaactggacgagagagaatactccatgttgaatcccagacagctgagctcttggaaagactcaacaaagacttaaacatccttgaaacgcaaccaggtaaattctatgaccccaaaactgataacatttttgaagcttttgaaaacccaggcaaaaataagattggcaccgagttgctggaagaaaaagtcaagggcctattgggtgacaaaacgaagtttgatgataagtacccaatgccaggatttaacacattcttaccacatgccaccgaggcaaaggaggtcctggaactgaattctctcgaggtaccactttctcctgacgatgagtccaaagaattcctggagctggaatccattgagttgcagcattccctggtcggggatgaggagaaagaagatctggacctggtgcctccaaccatgactcttcccccaaggctgtgacccagaggtcaccctgccaccattgccagggcagctgcccctcaactgtgaagacgagaaacagcctgaactagaactgcctacagcccagctgtgtctggaggacagaataaaccctttgtctttaacagctagtcagaaagcccaagaagccctgtgcactgaagacatgagaggatcca

SEQ ID NO: 43153 - DNA, 1271 bp, Bovine  19866881456306
aatgaattgctaaaggtctcttttattttactttccaatttgccaattttgcttttgttgagtgtctatcatgttctggacaagggagatacagagtgagaacaaagagtccacagtgcgtgcacaggctaagaacaaagggaattaactagtggctttttccagaggtcttcaaaccatgcatccttgagctctcaaaacacgtgcatgaccgttgagtgatgtcagaaatgtactgactcattctggtgagtcaggactctggctttgattgtctagacagttgccaagttcccctgctgggtctccctgcttctattcttgtctcattagagtctgttctcacacagccttggacatcaaagaggggttatgagaatggagaggacggacaagttctcatcttggtctgtgaagctctcaaatgcctggagaccacagtgctgataccagttagatctatttcatttctcctctaaatagcaaaatcatagagagtaagcccatgaagggaggacttggtggtgattagtaaacaaacttctctttctcagtaaacaaacataaaataaaaatgtttattagaaattcttaaagggtgatgagttcttaaaggcatccacgtgtctccatcattggttttttaaaaatgttttatgttggtgtatagttgaccttcagtgttgtgttaatttcagatgtacagcagagtgattcagttatacatatacatatatccattctttttcagactctttccccctatatgttattacagagtattgagtagagttccccgtgctatatggtagagtccttgttggttatctactttatacatagtagtgtgtatatgctcatcctaaactcctaagtttcattggctttaagttctaaaatgtcagtgtgttctctctcctccccacatggtatgtgctcacagcctttgtctgctttctttccagttgccataagcagccctgcagctcaagagttcaccgtcgatgttgagatcagttttgaaaatgcctccttcctggaacctattaaagcttatttgaacaacctcagttttccaattcaagggaatgacactgacctagctactgacattttgagcatcgaggtgtcaacaggtgagtaaaaggcctattgcttgaaagaggaggattgaactaatcagaagaaactactctgggctgcttgggaatgtggggtgtggaaggggagcaccctgggaagagtgaacctcagacaggaggcaatggatg

SEQ ID NO: 43154 - DNA, 1037 bp, Bovine  19866881634155
aacttctatcttgtggtgctccactggaagcagagcagaaaagtttctcattggcagtattataatttcaactgttttcctttcagagtgactaaaggcccacataggtagcctgggaagtgaggcaaaaaccacctgtgctgcttttactctattgccaaggttggattagatagtcacccttgctgtctttcagatcaacctggccttggacacaagggacagagactggtaagatctggcattgcattcaaatatattttcaatttcaaagaatattaaaaaaaaataataattttgtgtttaaaagttcctcaagttgataaaaattgtagtgattcatcttcttcttaaacttaaaaaacctgttcattaggaatcctttcaagcatacagcaaagtagagaaaaataatactctatgtctatcagggagatttatcaattactaacattttcatcttacttgctttttcttttcctcaattattttagagtgcgttagaaaatatcatgacattgggacagttcatccctaaatacttttgtatgaatttataaagccccgaggctataattccttaataagcattggtggttaagagattatatattcatttatctcattattagaaggaaactagctggcttttggacacaactcaacaggaaagcagaggagacaaacacagaaatcatgacaagctcaccagctagaatcaagataaatacctatgtgtctgtaaatggcaggtgtcactccttgccagagctttagaaagccttcctcctggacaatccctagggccgtgcgtaccatgcccctatatggagcagactctgttgcaccatctcccaaccgagcaagggcagcttctccttgtatttgaagtcgagtttttgtgaggtcgaggggaaaggttgctgataacaacaaagacaagaaaaaaacaaaacgagggggaaactcataacattcagaaaagtgaaccaaattttttttagaaaatcacaggacccagattttagtcaccacaa

SEQ ID NO: 43155 - DNA, 895 bp, Bovine  19866881821001
attcgaacatatcatgagtcagaaatgtgcactatttcattttactaacccagtgacttaaatggaggacctgagagagtattagaatagtgaaattacttgtcttggtgttgtgggccaaaactggacatatagaaggcattttacatgagcatgatatataattttgtaaatcttcctttcatttaccttttaaatttcatttagcttcatctcttcttgtgtttttatttctttttctttttgcgtgttgcttaaatatgcatttgaaaataatctccataggcaaaaattactggattgtgcttttcaagattttttttgtaggttgtcagtatgtatgtatcagtgtaaaaagcagtttctaacctttcaaactatagcatatttttaacaccttttaaagactgttatctttatttatgcagtaattaacaaatgagatatttagatatatatttaaactcaagatctctcacattatataatgcattttccattaaagccgctgtgtttcttattatgctttggtgtatattataattatttgtgtacacttaccaaacaattcaagacagaaatcaaaccaagcatattagattgcctgttgtgatatattagcctagtgactagatccaagatagaataaagcaaccccagaacatgagtatggaaaagaatcaacagaggtcaacaaatacagttattacagaatgcatattgccaagtagtagtaacctctgcctgttttacctttgtgtcttccagccctttaaaaaaaattctctaaattatttagaatatgaaaattgattaagttttaaaggcaataatgataactgtctttggacttcttttaagaaatagcagttctttgaatctgtgcatgtaaata

SEQ ID NO: 43156 - DNA, 955 bp, Bovine  19866882070315
acctaaaagtcgcagctgagcacaaatatgaacaagtccaattagcagagactctgccaagatatacacacaaaagataagaatgagcccatttgtatactataaaactgcccaattatttgtcggttccttccttgtgtaaggacaagtcagtgccagaagggaattttcctggcctcactatagtaaataccaaaagagagcggaccctgggccacattgggtcaaaagggttaccaacatctggttgtgaattaaaaggaaaaaaaaaggctcctctgtcaaaatgtggaagtatattttgcaagtggaggcttcgtggactttcgtatacccttctgctgggtatatactaatattgtggctttcttaactttgcttgcatgttaaactttcaaatacacttctttaatgaaacaaatagatgtctctgccttcagggagctcccacagtagtggaggattggaaggtggagacaaccagtaaaatattaataaataagtacattataggttattgtagggcttcccaggtgatgctaatggtaaagaacccacttgccaatgcagaagaaataagagacctgggtttgatccctgggttgggaagatcccctggaggagggcatagaaacctactccagtattcttgcctggagaatccccatggaggagcctggtgggatacagtccatggggtcgagaagagtgggacatgactgatgtgacttggcacacatgcacagtgttttagaagtgatatatgatatggaaaaaattcatcagagaaggggggttgggagggctaaaatgtgacatatggtggtccgggaagccctcactaagaaaacagtgtttggagcaaggtaagaatgaaggtgaggagtgaaacaggaggatatctgagctaagagcatccaggcagagggaacagccagtgccagaactctgggat

SEQ ID NO: 43157 - DNA, 2203 bp, Bovine  19866880135078
ttaaattcaccccattccagtctattttagtttgctgattcctagaatgttgacgttcactcttgccatctcctgtttgaccacttccaaatttgccctgattcatggacctgacattacaggttcccatgcaatattactctttacagcatcggaccttgcttctatcaccagtcacatccacagctgggtattgtttttgctttggctccatcccttcattctttctggagttatttttccactgatctccagtagcatattgggcacctaccaacctggggagttcctctttcagtatcctatcattttgccttttcatactgttcatggggttctcaaggcaagaatactgaagtggtttgccattcccttctccagtggaccacattctgtcagacctctccaccatgacctgtctgtcttgggtggccccacacagcatggcttagtttcattgagttagacaaggctgtggtctgtgtgatcagattggctagttttctgtgattatggtttcagtgtgtctgccctctgatgccctctcacaacacctaccatcttacttgggtttctgttaccttggacttggggtatctcttcatggctgctccagcaaagcgcagctgctgctccttaacctaggcgagtcacctctcctgaccttgaacgtggagtagctcctctcggcccttctgtgcccgcgcatctgctaaagcagaccagaaatgtccaaaagtgggtagtggcccaattcctggaaatccccatcccgtccccaaaatagctagaatactccttccactcattaacctctgaaattacctagccatataaaaactgataacttcataccctggggcccctctcaccttctgagatggcccaaactctgtgaagtgtgaaaatcactcagtggtgtccgagtctctgcgaccccatggaccctttatgaccgaaggacctgctaggctcttttgtcgatagaattctccaggcaagaatactggagtgggtagccattcccttctccgggagatcttcccaacccaaggatcaaacctaggtctcctgcattgcaagcggattctttaccgtctgagccaccagggaagcctgataggtaagaagtggacttacgcagagagaaacactttgtttctgaattatttctgcgatgagacattaagaacctgggctccattaagtcctgggaccaggtgtgtgatctcagttaaaagaccatgggttcaagttacatgatttcagcagcatgtcttgaaacccaccacacctttcactcttctgcttccccatctcttcaccagtctcttctggaagcactttgttcataaatcatttgttcccgaattctcctcttgacatctgcttttgaagaaaccaacttaaaatgggcagttcttaaaatccaggtgtccctgagaagaatagcacctttgagatacaaacgggccagttcattatttgacaagtgcagtcccattaaaaaactgaaaataaaagtcactctgtcgtgtctgactctttgtgaccccatggactgtagcttaccaggcttctctgtccttggaattcttcaggaaagaatactggagtggatagccattcctctctccaggggatcttctcaacctagggatcaaacacaggtctcgatttaattaaaaagtgcttgctccttggaagaaaagctatgaaaaacctagagagtgtattaaaaagcagtgatatcactttgctgacaaaagtttgtataatcaaaagtatagttttttccagtgtacgaatgtacgaatgtgaaagttggaccataaagaaggctgaatgtggaagaattgatgcttttgaattgtggtgctggagaagactcttgagagtcctttggagagcagggagatcaaaccagtcagtcctagaggaaatcagccctgaatattcattggaagaactgaaactgaagctccaacaatttggccatctgttgcgaagagccaactcattggaaaaaaccctgatgctgaggaagatggaaaacaaatggagaagggggcgacagaggatgagatggttggatagcttcaccagctcaatggacatgaatttgagcaaactcggggagacagcggaggacagatgagcctggtgtgtgtgtgctgcagtccagggatcacaaagagtcagg

SEQ ID NO: 43158 - DNA, 570 bp, Bovine  19866880282481
acccgactgagaggctgaattgaacagaactgatagtgaatgttgctgcctgccataaaattaatgtcacaaagcaatgtttgccatgaccacatctcaagaacagattgttttgcatatttacctgagggccaaatacacttcctagtctactggcctctcctcgtgtgtctgaacggcgaatgtcaaggagttcactgacactgtgggaaccctgcaggttcaaacctacgtgaactctgtaggcttaaacctgcaagaccaaattgatgctttaccctgtttgacgtcacggtcttaaaatcaaatttgcttaccctcattcttccattgttaaacacactctggttattattctgctgtttccttaagagaaaaagataaagaggctctaaaattttaggctataaaaaaaaaactcagggtggctgcaaacctgccatccagatgcccttgggcaattggtggacaatgaaacctagggtcaagtaggtcactcaacccgttaaggctaaaattggtagactgaaaattctgaaagagatgggaataccagaccacctgacctgc

SEQ ID NO: 43159 - DNA, 695 bp, Bovine  19866880345266
acctgtcatgatgctataaattccccaccatgtgagtcacatttacaatcctgtagaagtggtaaggctgtgtcccctttggttgattagtcacagatgtttattgatgctctttccatgcttctctggctttgcacctgtcgcctctgtttagacaactgccacatttgcctgatgatcaggcctcttaactgtgtccggtatttctgattgccagcaggacagtcgtggctgagaatggtataactctgttgttaaggacaagggttctggagtctcactgtctgagtttggaactcagttctgcctcctccatgactttaatgtttctttgcctcaatttctttatctgtaaaatgggaataggaacatacctacctctttgggctgtggggaaaagaaaatgagctcatatacatcaatctctccaacagtgcctggaacacagtgagcccacaataaaaattagccataagtattatctcctttcagaagtcctgctctcaggtcttcccaggtggctcagtggtaaggaatctgcctgccagtgcaggagacttgagtttgatccctgggtcaggaagatcccctggagaagggactggcaattgttgctatggacagaggagcctggtgggctacagtccatgggttcagaaagagttggacacgactcagcaagtaaacgacagagg

SEQ ID NO: 43160 - DNA, 1451 bp, Bovine  19866880391339
tgagcagtcataattcccgctggatccatatcctaattgagagtttttagttattttgatttagaggtactttcttctcttgctgttagagaaaaaatttcctctattgagaattaaataatttcttatagaaataaggcatatgtatgtatgtatgtgtgaatgtatgtatttatttatcccatataatttaatttgcattttttatattaaaagactatcctgtgctatgctgtgcttagtcgatcagtcgtgtccaactctctctcaccccatggactgcagtccaccaggctcttctgaccatggggattctccaggcaagaaaactggagtgggttgccatgcccttctcccaaaagactatcttgctgctactgctgctgctaagccgcttcagtcgtgtccgactctgtgcgaccccatagacggcagcccaccaggctccgctgtccctgggattctccaggcaagaacactggagtgggttgccatttccttctccaatacatgaaagtgaaaagtgaaactgaagtcactgagtcttgtccgactcttagcgaccccatggacttcggcccaccaggctcctctgtccatgggattttccaggcaagagtgctggagtggggtgccattgccttctctgaaagactatcctactagctgcaaaattaacaccaagttttactgcagtgcttcaacatcctcttgccttagccacctcctcaactgacctagatacattttgatccctggatagggttagcatgctgccctggggaggattctgtagtagaaattattcaggaggtctgggctgcttgtcaagagtctgctgttctttacttacagaccttggttttcttactggggttgggaaggcaggggatataggaactagagttaatttacggacatgtatgtaagtcttgttattggacagaaacgtttctaaatgtttataaatattaattcatcctcacaaccaccctaagaattacaattattatccctattttatagaggaggctaaataatttgttcagattccataagaatttgggaactcttggaagagacctctgccaagattagcatggttcttaaacaagaatggcctctctcttttggtggcagggggcgctagttgcaaagaatctgcctgccaatgcaaaagatgcaggagactgggttcattccctgggtggggaagatctcctagaggaggaaatgacaacccactccagtattcttgcctgggctacagtccatggggtcacaaagagtcagacatgactttcaagggattccgttgagaatctgatgaaagctataaaccccttctttggaaaatacagctgtgttaataaattaatctgcattccaaagccatctatggagcccagacagattaaaaacccttaatataatagaggaaaccatcagtc

SEQ ID NO: 43161 - DNA, 1672 bp, Bovine  19866880580065
aactttgtatttaaggaatgatttttcttttcgatcctcttattagtctgttcaggctgctattacagaatacaacaggctgagtggtttaaaaataatacaattttcacagttcttgaagtcaggaagttcaagatcaaggtgccagttgattcagtctagtgaggccctacttcctggttccatagatgtcagtcttcttgctgtatcttcacatggcagaaggggtgagggaactctctgggttctctttcataggggtactaatcccatccatgagggctctacttaattaactaatgacctagttacctcccaaaggccccacttcctaatactctgacagtagaggttagaatttcaatatttgcatgttttgatgtttgacagaaaacaacaaaattctgtaaagcaattctctttcaattaaataaaaagaatttcaacatttgaatctgggggttacacaatgtccatagaagttgtttaagagcaattcacacatagtttttcagacatgtgcagcgaagcatttaataaacatgtgaccacaaataatctcattatcctcaggtttatgtttgcaaactatctcaacagtattttctttttcataaattttaaaaaatgtcctgttctcttaagagaattggcttgtcaacgagtggctaaattttactaaaagtccttgaattataaaaatctcactttcaaaaagtcttggcacaccagaaatagttcaatgattaaaagagatgaagttaacagctaacctacaattaaagggaaaaaaaagcaagtactacgtcgttttgttctttatttccttaacttagtatgtaattaagaagtgactcctgaattaactaagagccaatcaggcacagaagggagtaaaagaacgagttaacgaaatgcatactgagctcccattctgccatcttatgatgcagttctgtttcccctcctctcacttgcaaattactgaagtgtgttttgcctcagagagctggtgccaggtgcggctgatgtgtagcagaactagggtgcagggtctcctattttcccctcctgaacggatggttacttatgaggctgctcagtgtggactggaggcctgggaagcgccgggtagccattcggtcggctccggcgccgatgcttcccacccggacgacggagccttacggtcctcaaggcaaaagaaagagactcagaggaagcagagagaccgtcaaagatgtacccgtgctcagcaactcctgcctcccttttctttctctaacaactctttcctctggtgctggccgctgaggcaagccacaaagcagcttctccgccgctccgcccgctgtcaggtgcccttggcggcctgcggccagggggtcacgagtttgcgacgcgcccccgaagctccagctccgggaggcggggaggagcagaaccagcagcagcaacaacagcagcagcatcggcggcgggcgctgtggcgcgcctgcgcacagcccaatcacgcgcggtgcagcgcggcgcgggggcgggtcggcgcccgggggggctgtcattcgcagcgctggtcgccgccctcagctgcgccggtcggttccggctcctccctctcctgtgcctgggtcccaccatggtgctggagtcggtggtcgcggacctgctg

SEQ ID NO: 43162 - DNA, 1861 bp, Bovine  19866880714597
ctcgctctggattcttgttgagcaacgatgttgcctgtagcgccccaggtctacagagtgaggtttgaaggaaaacctcttcttgaacaggtcagcatctttctgaagggcccaggcagagggctgtaggtacccaaatttctccctgagccttggtcacagtctgaggggacttgtggcaataaatgtgcagctttcccccttggacaagggaagtgtgttcatttatgtatatgtctaaaatgaacattaaaaagagacctagtttaatagtatcaaggttttaaatctgccatgaacccagcacagccccaggggtaaatgcctagttaagccccagcattcacccctacatatttgtggctataatttgaccgcacactgatatattaaacatgaaattaggtaatgacataattaggccattgagacatgtgccgaatcctcaggacaccagaacaacccccctccagggttgagtaactacaactgtgactgtactgcttgtttgatttctcagggtttgtgcccagaaggaccacatgttgtctcagactctggaatcttgaaaccaaacatcgacaagtggcttgtttgagtttggttcaagtttagaggctgaagggatcctaagaactcagcaaataggaatttgtgcggctttcttcagcctctccatttggacgaatgtgcgaaggggagaaagaaagcatgcatcatttggttcttaggtactgagaactttcccttgtccaagggggaaagctgcatgttcattgccacaagtcccctcaggctgtgaccaaggctttgggggaaatttggatagagatagaaggaatgagaaagttctagaataggagacttgaaactgatgggtagccagttctttggtccttgtcaatggttttggtgttactgttttcttggatttcatttctgctgaacaaaatgtttgggataggaatgcacagagggtagacctgtccaggcctcaggccctgaccgtggccgcaagcacatcccttgccgtggatcagagggacagtcagggagcgtctccaggaagggacagattgctcttttagctccagttatggtgatgctagtggtagagaacccatctgctaatgcaggagacctaagagatgtgggtttgatccctgggttgggaagatcccctggaggagagagcatggcaacccactccagtgttcttgtctggagaatcccatggacagaggagcttggcaggctatagtccatggggttgcagagtcggacatgactgagcaacttagtacatatggataccaaattcacctgtgattcagaatcatagcaggcctcatcctggtatcatagtggctgggctgtgtatatgtgtggttaattaaaaaaagtttttaacactatgcctttattagatttttcataagagaaaattgctggaaaagaagtacataaacattaaaggaaaaataatcctccacttgaagagaaaatgagtttagagtgactatgaggaaaaatcagaagcagttagaagtttctaaaagtccctaaagtaatgtttctgagctgtggagtgctataacttttgtaatccgtctgtacgaaattgggcctgagatgttgctttactttcttgtctcacgtttctggaaaacttctacttttcgaagataaatcgttcttttctgctatttattgaggaggctactatgtaccatgcagcatgcttcggccacacttactttgggctggaagcatacagggtaccatatgtatcacgtgtaccgtgtacatatgagaatgtgtgagagcactttgaaaagcttgcagagttgtgctaatgtgt

SEQ ID NO: 43163 - DNA, 1267 bp, Bovine  19866880747589
cattggaatccatcttggctgagcgatgcgcgtgccactaggaagaaccctgagtcatagtaactggccagagacaaccccggaaactaaccccattaccataaaactcaagggccatgtggcagagacgttctcctgggttctcttaccctgctgctctccacccaggcaccccttcccaataaagtctcttactttgtcagcacatgtgtctctttggacagttcatttttgagtgttagacaagagcccactctcagaccccggaagggatctcccttcttgcaacacaatgacagcatcattcctcccaatggtgattggttctcagatgaactaaaacctggtttggccaaggaactgggaagaagtgtctgctggggcatcagcctccccaccctgcatcagggttggatcaagaaacctcttctgaccacaagtaaaaccagcctctggatggagccttcaccaaggatggcaaagataatcaaagaatctgggtatttggtgacattgttgatcaacatgtctaattctttcatacatcctagtccctaaccacatacattcctgccatatttaagccagcctgagttgccaacacagtgtaattgatcccaggcagcagtcacgtgcggaaaggacagcaagcatctggtcacagagtaggcattcagtaaagtttcctttttgcctcatgcctacataaatgcaatcttgagaatgtgtcccaagaaaatcccatctcttccactttcaagagttaaatcctgtgagcctaatatggtgctagactcatggcaggtcttcagtaagtatttgaatgactcttaacctgggactcacctctaaatggtgatgttggccatgcctggactccagcttatggctggctcagtgggaatggaagtaataatagatgtgcatgtgaagagcagaggtctcagtcccatttcttgactctgggacgagcaccaggagcacaggtcctccacttcctccacccccagtctccatgcctgctctctcagacatctgccactggtaaggtggtgccgtctgtggccaatcacctacaaagcaaaccatccgaagaatgtctggtatgcagggttatgtggtatggcgtgggtttgttttttctgttcatcacttggcaagggaatcctgaactattttgtctggaggcacaagcatagagctgaggaccccaggggagtggaaattagagggagggagcgggacggttcggcctctattcctgcat

SEQ ID NO: 43164 - DNA, 2430 bp, Bovine  19866880762157
aaaaataaatagcctatcagccttttaatgacctcaaagacagagtttttttaacataatctcataggccagtggatgatgctaggggctgctccactgtgccaaaaaaatgcaaacacaaccataaacctacatgagagatattaagaaaagtaagttcaggttagatagaagagccaaagcatttactttaaaatctaattctgacttacatttataagaggtatacaattctagacttaatttctcgattaagacacaaagctggggatgttcttagttttcatacagcaaattaaaagccatcaggacttgggcatcagtaaagaaggaccaggtgatgtagaatacagagaagaacccacagcccattaccaaaagaagaaattatatggatactggaatgcagttcttttttctttttattttcaacattaatatgccttctcaacttagcttatggttatattaagctgactatggggtctctggcataaaatcattctcaggaagaaaaaaaaaaatcatcctgtgataaggtttttgagtgacctgtggctacttgagttctgggtggctgcaacttaaggacagaacttcgtgaaatcatttcaaagtcatcaacccaaagataaggctagacctagacacaagcttcttcccatctaaggatgcaggagccattgattcataggagggcacttccagaaggagctgagaaaaatactaataggctgtgagtgactcacagtcattctaaacagccctcctaacaacccaattaaagatccagccatttagcctaatttttttcacctccataggtttaatcttcttagaatcaagtactacgatctccaatagaaaacaaagtaaccctcacttgtgatgcccagatatgttggggaggaagtaagagaaaaaaacacaagtgcagagataccatccacagacagaagaaataccagaactcctctgtgctcaataaacactcattcatttattcccccaaagaactttcactgaatcccaggtatgccctcgacacaggggatgcggctaggaataaaaccagtgcctcatttttgaaaaccaaaatttcaacacagtgaggaagtgcgggaacagtccaacactagagaaaaaatcatagcccagaggaggagcaagtcacctccatgtgagagaaggagacagagtcagaggttgcttcacatcatggggaacacaggcaggaataatgaaaatagagcacagagaacccttatttggctacagaacattgttcattttacaagtatatttaaatgaaacattaatgagtatgtgtgtactcaacaataacaggcaaaacaactagacattagtcacaatccatagaggtgattcacataattaaaaaaaattagacctatgcaaatcacagccccatccttaggaggaaaggcattagtagactaaatacacaaatgtatagaatcaatattccattgccagggaacaatcaagcagcgatcacacacaaccacatgggagcagagcttctcaaaccttaatgtgcacacacacaagctggaagctggggtggagcctgacagtctgcatttctaataagctcccaggtgatgcagacagggctgggcccgtggcccactctgagtgatgctcagttctgactgagcatccttagacatctacagagggggctcataaacgagacaaattccagtcctcatctgaagcctgatgagcaagaatcttaggagatgaggttccctgtcatttctctctaaactataaggtggttctcaagtgcagccagacttgggaaatcagtcacatagactttttgtatacctcaccccaagaaacaggtcagttcttttctgtacatagaaaatgccagcagctgtagaagatatccatggagataatgagtcagaaagaggaagcccagctaacctgaccaggctgatcaacttgaccatcgtgatgcctagaatcacagcctccacaggctgacacctgtcgtagaatctatcttgccccttttcatccactataactataaccaaactataaccaaagctagtgcttagatcattatctctttagcttcataaaacacaccaaagaggaaaaggactttttctttgtttttgcctaaaaattatagataaggggtcatccatgatgaaagactggaaagaaaccaaaagacaaacatgcaattaaccagcccaatgcctccaggctccagtcttgaaagggctcttcagccacacacaccctcactacaaagtgcaattcttttaataaaagggactgagtggaatgtagtctttcaaggctttcatgcacaaaatcgcttctagaaaaaaggaaaagtaatcgtttaccatctccagggaatagggatagacccgggtc

SEQ ID NO: 43165 - DNA, 3710 bp, Bovine  19866880800799
tgctctgccctgtctggccagtgattggggaatttgatgcccttctccagatatcaaacaaacatttcattttctgcttgtgacatctttttaaagaatgcatggactaaaattagcacagactccattttttcttccttcctctcttttggcctccttcctaaaggatctttactaacgtccaccaagcccatcctcctacacaggtccctgggcatgcacctggcagaggaagagcatttccgcctgtggtcctcttttttgcccttgtctttgtgaattacatccctgaaacattgtgtcccttccccgatggacttgacagtgaaggagctgaagacaaccataggagatggcctaagggtcactagcctcatttctgcctccctccctgaaaacctcctctgagggatcaccttgctgagtgctgataagcatcatagtcatctctctcacagctggccactaaaaccagactacaactcactgcactatctttccagttaggaatcacgctgtgtttggtgttactgaaggccttgtgcggctatcgctgctaagtcacctcagtcgtgtccaaccctgtgcaaccccagagacggcagcccactaggctcctctgtccctgggattctccaggcaagaacactggagtgggttgccatttccttctccaatgcatgaaggtgaaaagtgaaagtgaagtcgctctgccgtgtctgactcttagcgaccccatggactgcagcctcccaggctccttcgtccatgtgattttccaggcgagagtactggagtggggtgccattgccttgtccgaaggccttgtagacacttacagttaaaaacaaggtcataaatcacatcagaaattaaaaaaaaaatttgggtataattttcttaaagtgtgaacatctgcatataatttaaatgtcctccaggaaaaaaacagaaggcaaacaacaagaacttccataacgtgagtgaagcattttcctgccaggtggaaacctgagtggaacaggcagtcccaggttcctctcttttggtagtgagtctggccactagcggtttgcttctgattttgagttgagaggagctggaggggagaccttacctgtactcaaagacctgaacagtatgtgagccaggtcagcttctcttctggaggaccccaggtgggttgtctttaggactaccacgcttactagtcctaataaaagggaaacttctcagaaccacgggaactgccaagagaccagagctggtcagctggcctggtctccccaggttgatctggtcccaggggaaactccagggaaacagtcaacagacaaagcaggtgccagagagaaagcgttgccaaatggttatgccagccacctgggaagggactggcctctgcacccagatgtggaataactgcatgtttctgcaacatctgatggacaaagtccaagcttgtccgattagtattttggggagcagttttcccacagcagccaccactctttctttaaataccactggaataatcttttaactatttctgttctttttttcctgtatgtcattccagatttatgttacagatatctatccatccatctgtcctttatcagtggagaaggcaatgtcaacccactccagtactcttgcctggaaaatcccatggatggaggagcctggtaggctgcagtccatggggtcgctaagggtcagacatgactgaacgacttcactttcacttttcactttcatgcattggagaaggaaatggcaacccactcaagtgttcttgcctggagaatcccagggacggggggagtcttggtgggctgctgtctgtggggtcgcacagagtcggacacgactgaagcgacttagcagcagcagcagcagcatcctttatcagaatctactaattgtgctttctatttgatagaaaaattcttaaagataatgtcaaactcttaaaaaaatatataggcactcgagtgtctatctaggaagcatggatgaagaacagatgacaggattttcccaaagatttaattaggtagaattgttacactgtaaagccatgtgacatgaatcctgtgtgtgtctgaggagggtctgagagacccactgctctatttggtggggagtcatgtgggaatacatgctgactaggggccccactcacctttactcttccgcgcacctcacatctcctggcctggaagcagctagtggtacaggagctcaatgtccactgcttggtcatagagaaaatgctgtatccttctccctgaacatctggctgccttttcccatttgcccaactaatcagtagagcctgctggtcaacagcaaaatgtaccctaaaaagatacatcaattctaatgtaggggcttcaaacttcaggtccttttaaactgagcttttcattattcagaacagcttgctgttgcttttccatgactgtcattttggccaaacaactttaactgggcctaaaacccaaaacaacgccatctagctgcgtgaaggtagcattgactacggcagcatcttggctggcgtatagctcgcttctcaatgaggaggatcccagggacaggctccacttcctgactctggaagctggggccccaacactgtactgacctcccctgtgtcaccacttgtctgctgctgtgacctgtcactaggcggtccctgccagcagcgttgggctggctcttagacccaccagaagaggctttcctaatccacctgtacacacttctggctcactatcttcatagagtagtgtttgtatgttcaggagtgacctttacaagagcacatcctctttgctccaaaaatcggagccattagcacaatacttcccctttcagaaagcggagttttaagtcttttgttgaaagagatcagaatgaactcacatatccttcacaggctcttctagggggaggaggtcagagctaacccagttaggctgttacgtgccaggaaaaaatgtttcacaatcccgaacttcctggtgcacccaattaggctatggaatcactttctgattgtcggcatattctaaatattatcaacctcttctgacaagttaacctgcaacaggaaactcaacagacagagtatattccacactgcgttatctttattagatatatttcgtccccaaggtttatataaagcccagtgactcaccatccatacatttggtttggctgatttggtttatacattttgttactgtgggtggaaagcaacgttacagagagttgatttgtgcttgaattttttgctgaaagcttgatcgtgaaaattactaatttctaaattgaagatcaggataaaactgaattaaaatgaaatgtaaatctagatgtgtctggaggttataatcctgaccctgtatcacaaacatgggttttattcccccacgttgagcacagcctttaaggattcatcattgcacaaaactaagctatacataatacctaagctcttatgaaacatcattaattatgatttgtttctataataaacaaaataatctagcagtacagatacaggttttaaatgctacaagaagaaatggaatataacaaaagagatgtaatgagtaatctacctctgattctaacatattctttcctgttgccttataagctatattaggaacccccggagacagggcaagaca

SEQ ID NO: 43166 - DNA, 1603 bp, Bovine  19866880849926
gcagtaaatagcccatgtgctatcactttgtgcctgtggcagatattgttagaaaatcatgacagtttcctactgatcctaggagagggagccactgccagtccctgggagttggcaggtgtgatgaaacctgtgtttcattctggacacagctagtcctgaggcatgggccatttgccctgtcctgatcagtctttatgtgatgggtcagcatgccaccagcctctggaaggcctccagtgggaataaatatttatttctggtgaatggccagagtcagtgactctgattgtaaaagcctctggtcagtgttggtcttttcccctttgggaatgagttgtcatatgggaacactgagattttggcctcgattccagtgaacttggcattttaaaagttgctttgggctgaagtcaggagcccttagcgaggggacaagaaagtatttggtctcccttgctgtggtctccgggttaaccaggatcaaggttattctagggacaggaactcctgtacttggacaggagtgctgacagcatgcaaggcatggctctgagtcctgtgactagacttgagacgtgagctgaacagctgggatggtctcttcattcactaggttcagacatgttcatatgtaatcaacacatgtttataaagaacccactgtgtgtgagacactgaactctctgtcctgggttccttctcaccacctccccagcttcatgcgccttgttgtccttcaacaaggacaacagtttagacctctcatgaacttgattctttccacttcccagaggttacatataacctagactttagctgctgctgctgctaaatcgcttcagtcatgtccgactctgtgcgactctgtagacggcagcccaccaggctctcccgtccctgggaatctccaggcgagaacactggagtgggttgccatttccttctccaatgcatgaaagtgaaaagtgaaaatgaagtcgctcagtcgtatccgactcttcacgaccccatgaactgcagcccaccaggctcctctgtccatgggattctccaggcaagagtactagagtggggtgccattgccttctccagactttatcatctaatcactgccacattaaaatactagatgtatggtgcacctttgcctgttcaaactccttattcctgaacttgagatagagaccaagtcattcttgattcttatatatcttttgggtgttgtttattgttgttgagtccctaagtcgtgtctgactgttttgcgaccccatggattgtgtagcctttcaggctcctctgcccatgggatttcccaggcaagaatactggagtgggtttccatttccttctctgagggatctttccaacccagggatcaaacccgcatctcctgcaatgacaggcaggttctttaccactgagccaccaggggagaaggcaatggcaacccacttcagtatttcttgcctggagaattgggctgctgtctatggggttgcacagagttgaacacgattgaagcgacataacagcagtagcagcagcagagccaccaggaagcctgtatcttttaggtaggttaggcctaaaggtagat

SEQ ID NO: 43167 - DNA, 1418 bp, Bovine  19866880872514
agttattacagaatgtcaaatctgtccctgtgtttgggacacatttctgtattaatacctgtttggcctctacaaatgattcatgtggggcagtggaatgactgagtcactgtcagaataatttactcacatccctctcatcattattgtacattctttcctacagccaaacattactcacatgtctctttgacctacgttaatatgaatgtcactgataggctgttttctctctgctgagctgaggtgtggtaaacaggaaaacaagatgaaaagcatttccaatgatagttatggaaccctgtggttaaagggtcaacccacattttctagtcatggaacaaaggaatgatgatcaaacttggcattaacaaattctacctctgtccacacctcagctatttcaaagggttttctagtgctgcttcagtgaagtcaatttccccctcctacccacaggcatctttttgctgccccaggctcaggaagcaactgtgcaccatcctctttgttcagacgccttttcctttaggcaaaaagaacagaaatcttctccaactagctcagcaaaaagcagggactatatggacttccctggtggtccagtggctaagactctgcgttcccaatgcagggggcccaggtttgatccctggtcagggaactagatcctacatttgcaactaaaaattctgcatcctataaataagacccaatgcagccaaataaataaacattaaaaaaaaaaaaacccaaaccaacagagactgtgttggaaggaaagtggggtttctctcaggaagctgagctagtgaggagataggaaatacttgggagagctagagttccttctctaaagagatacatttttaaacaatttaaggagacatgtgggtaggagggtcactgagctcctgttgccaggttagaggaagaagtatgatgtcaaggggtttgacagtaagtccagccccacctgacgctgcatcatggggaggaacaactgtaattacatgacacaagaaacccacgcttcatctatttctacctgtgccaagtggcccttcttctgttcaaatcagagcatggactgtgccccacgcaccctgttatccatccgaacacaaggactgcaggctaaattccaaatacccaagaccgaaatcttcagttctgcctaagagaatggctcgatctttgaaattttattgtcttgtacagggcattctctgtactagtttgttgtagttataaaacagttagcaagacagcttacatttccatttaatcaatattttctatcctatacatctctgctcccaattttttttctcttcaaaatccattctttaaaagaaaaaaaaatcactggagaaatgtgtgttaaaaaacaacaataaaaaccatctaacaactga

SEQ ID NO: 43168 - DNA, 812 bp, Bovine  19866880921201
atactaatgcatatatatggaatctagaaagaaggtacttgatgagcctatctgcagggcagcagtggggacgcagacacagagagcaggcttatggacaccaggtggggaaggagaaggagggaaaagtggagagagtagcatggaaacatatacactaccacaggtaaaatagacagccagtgggaatttgctgtgtgactcagggagctcaaaccgggctctgtgacaacctagagggatgggatgggaggcaggttcaagagggaggggcatatctatatctatggttggtttatgctgatgaatggcaggaaccaacacaacattggaaagcacttatccttcagttaaatatagaaataaataaacaaataaataaataaaatggcattatctccaaaaaaattttaaaaagccaaccagaggaaccagtgcatgggcagtggagaggaagagggggtaagacagagctggggagatacaaaggcgaaactcttgctttactgtgggtttgaaaacagaatccacagccaagttattctgacaaaagcacacacagaaggccaactacaaaggaggaatatgtgtttgaacagatgccaagagaaaaactgacttaagacttcgtactgtgtcaaaggctttgtttgttgacagtagaattatcttgagtttgtgggggaaaatctcgaggtcctctctgaagccttcctcagagactcataccccggctgcagtgttttctcagtgaagcactcctaaggaacacggtaacaggacgagggtaaaccaaggaggagggcggttcc

SEQ ID NO: 43169 - DNA, 1462 bp, Bovine  19866880928521
caatgagaaacccacgtggctcagctaaagagtagcccccccgccccgcttgccacaactagaaaggcccacgcagagcaacaaagatccagctcagccaataaatggaaaaaagaactgctcagcaggctggtgcggaccagcctgggggagctgacggaaggcttcaactagaggcaggggtgtggtgaggagcagggcaatgagcaccgcatcactcgcctcagccccgctgatgaccaacttctctggaacctggtctcctcatcccttcacctactctaagggtccttttctagacaaaacagcctcacgtctaagtcagtgtcccatttcctgcaaggatttggcactctatccctgaacatgtaatatgaagcaacaaagcagaagtcatcaaaattggcaagaaatgggtgatgccattaaattttcacccacttctgatacttgaggacaagatcaaataacctgtacattaccacagaaaaaaactggactatccttgagtacaatcctgccaatgacctgagaagacgagcctgggggagagcgggtagggaggtgccaggggacctagtgaatgaccccatttcagaagcaaacgcggggatgtattcaatacattctagtagcaccaagtcacatgaatctggatgcacaaattaaccccaggctggttttaaatcatctctaagagactgttacacatttcagggagatctgagaatgttgtgcacatgatcctcgctttgtgcaagaagatgcctgcctcattgaaggacaggtggctgcctttagcaactttgtaagtagattaaacacaccaaagaagcagtgcagagttctggataccaggatgagacctgcagctagatggaacagcacaggagctgcgtaaccttaaccaagtgctgcacattccctaagcctcagattccttacatggaagactggaacagcagcagcatcctcataaagatgtcacaacatgaattaacacacagacaccatgctggtaaccatggcaacacgacaacattattcttgtcctatctagctaactttacggcttgaggtcaatcatttgaactctgtggtcctcttttctccccctcgagtaaaaaatgaagggaggaagattctttccaacttaaaatcctttgattctaagctcctgtctgctcatctgcttaggagatgcatcatggagagcagaaacaacttgaacttctagaccctaccagtttctgaattatctgtaagaatgacagaagaagagtcaacatgcaatggattatgaatgcaaccccaagtgactgcaaattctaaagctaaaagtctcagtcagtgaagttgtaggtaactattatcccaacaggtatcatttactgccacttactacttgatggacatgggtttgggtggacttcaggagttggtgatggacaggggaggcctg

SEQ ID NO: 43170 - DNA, 1500 bp, Bovine  19866881031159
tagtttcaaaagtagggaagaaagtgactcagccggaaggttggtagcatgactggggagtggagaacagggcaccctttgaagcatgtgagccgggagttgatggactgtgaggtcggctggcctgtgaaccatatgttgcgctttattccttatcattgctcacttagtcactctgcttgatggcggagatcctgctcgtcagttcttattcattgtttatgaactcaccagaccttttgagtattcccattgaaccttttcactgggcggtgattgccgtggcccaggagtgatctctgcatttgcccccatcaggccctggatggggacttctccgaggacaaccgcaacaagtgtcgcgtcgccaccgcccccttgatcgcagccgtggagaacttgacggcattcgcctccaaccctgagtttgtcagcgttcccgcccagatcagctccgaggtagggagtcttcacagcaacagtgacattgaggcctgtggctagttttgtgtgtccctgaatggaatgaacagttaagaattccaaaacccctgtctgtcagtacatagggcactgttattttgccagtgatgacacatgcagttaatgaaactgtgttggtgtatctctcaaaaggtgatatcttggttttatatgttgagaataatctctgggcataggtttggggctgattcttggtatatgtcaaactcaaaaatgatacttaaagattggacatggccccaagttctccccatccaggctccatgtgagccagcctccgtggttcccttccctctgtcttgataaagagcatgaccttcctgggtcaaactcattcacttaatctgtgtgccctgcacttgacttccgctgtctggtcccagggctcccaggcacaggaaccaatcctggtctcagccaagactatgctggaaagctcatcgtacctcatccgcactgcccgctcactggccatcaaccccaaagacccgcccacctggtctgtgctagccggacattcccacactgtgtctgactctatcaagagtctcatcacgtccatcaggttagtgtctccttcagaaattgcttgcagcctgcatctgacagggcaggagggggataagcccatcgggacttttatttaacagcagtgttattgattattgtcatcattttttcttctttgcctctttgggaccaatggtagcacttgtcacaacaatacaaatactaacaaatatttgttacgtgctcgatactattcaaggcattttacctgtattaatgttatgtttatcataacaaccttgtaaagagatgctgctattgtctcccttttcctgaggagagaattcagaaagaaatttagagtgacagttcccaaggtcgtctccaggtctgcttgctttagcctcagtccttctaaccattgtaccgtagttgtctatacctaggagcttaggcagagagcaccactgtatatttagcaggatt

SEQ ID NO: 43171 - DNA, 1749 bp, Bovine  19866881049322
actcctcccaccccactaaggaccagcgaaggtaaagcacacagaacacttttcaaacaggtatggaacgaagacgaccccaggggagtcatgcgcgtcacaaacgacatcttgaattcaaaaattaattcacaaaaagaatggttaaagtgacaagttcccctggcacattttttggagacagattcatttcagtattattatgtacagtaaatttcaccctttttaagtgtagagatcaatcgattttgacaaacacatgcagtttctgcagcaatgttaaaaatagattattcacctctaactttccaagaatatgtgacatgaagtaaagagggcacatatggcttgatgacacaaaactaactctagcttctctttctaaaagtaatggtccccattctgccagaaagaagaacctagaagtgaaaatcttgtctttgggggaaaaaaaatcaatttgtagatgcatctacaaagcaaggaatggaaactaccaagatatactggtcaatgcagttgaatttcctttactaatgggagagtccctccccttgacaacacccctgctcatatgaaagcatttaccttttttttaaaatatacaaatggagcccaagaatacaaacctatttctaccataggtcatctttagccacttgtgcagtttaaaaccacaaagcctccttgaattcattccaaaaatctctaataagtttcacatgactatcaatgctccaaaggaatttacctggacaaggagcataactttcattttaagacgtatcttaaaatgaattgcatgagcttatgtacaaaagggagggaggtgattattcaactagaactctaaaaatctgttaaaattacatcccagctgcagaacaaggtcctggtaacttcagactacaaaaagaattacaagtcggaaaatggcaacaaatgccactgtaaacaatctaacagtgttttgttaattttatttttatgtatttattgttggctatactgggtcttcgttgctacacgtgggctttctctagttgtggtgagcagggacttctctctggttgcagtgcatggcctccttgttgcagtggcttctcttattgcacgttcgcaggctgtagagcaccggctcagcagttgtggcacacaggcttagttgctccatggaatgtgggatcctcccagaccaggggtcgaacccacgtctcctgcattggcaggtggattcttaaccactggaccaccagcaaagtctctaacagtgtttttaaccttcctatttggctggactctggtaaaaaccacagggttttccaaaccctggctgagtggcactgaaacctcagtatccctaacaatcttctgattatgaaaactccctattcttgggtcccacacagatctaccaaattagaatacctggggcctgggcaactacagtatttaaccttcatcctttaaccttattcctgggtaattctgatcatacttgacctaaggaccacattctaagaaatacactaagagagcatgtgttttgttatacagtcatcaaaataaagtcaagttggtgaaataacctgaacattgatcctgagtataagttatataatctacaggctaacggccaaggcttaagaatggtttttgtgattcagagagaatgtcattgtaatatcaacagatgaactacacagggataatctttcgttaatactgtgttgccagttctgtggtccc

SEQ ID NO: 43172 - DNA, 1032 bp, Bovine  19866881126351
gaagaaaagacatgaaaggatacttttacacttgtagaaaggagtaattttctgaaggctacttgcttagtgtttgtgtgtgtatattcttgtttgggcttatatcctcatttatgattgaactttcttcaaataacccaaatgtcaaatgtcactattttcccatggctttgttattgtagaaattattgaggctatcggctgggttcccttcctagagagtgaatctggcatatatttactgattcatgtggtgcaaagaacctagaaatgtatcttttttaaaaatgcaaatttttattttatttatttttggccatactgtgtgggttgtgggctccctcttccctgaccaggaatcaaactctggcccttgacagtaaaagcatgaagtcctaaccactggactgccagggaattcccctatgtaaattatttttaacttgaaatctaaataattaaaccatatgcgcaataccaagcttaagaaatagaaccgtatcaatatctttgaagcccaatgcgggccactcccctcccacattctcctttcagacatatctttaaaggaatatgaaatcttgaccaggaaactgtttgagacttgtgactgtggatagtgttttcactatattttcttgctctagatagaacttcagggaggacaatctgggaggtaaataaatggctgagattctgttggatttgtgtttctggaccatggtttctgataccagaaagaagggcctttgctagggctgaagtatttaagaggcctgggaaggttaagattgccctgagctaaccggccttgtgaagaggaccttaaactcagttgacaagttataagtatctcaattcatagattttggagaatagcagatatgactcagaaagaaggatccacagaaggagcaggaatagtattcaaggccttgaatgtccacagtgacaccttgagggtccgaagaataagaaaatgaaacttgagatacagtggacactaggtggaaaggcgaaagggggcagagg

SEQ ID NO: 43173 - DNA, 1351 bp, Bovine  19866881227755
cttaagacattttcatacagcatcttatttcttattgctcaggtacagttctagggactggaggtggggctagctctattctcttggatactatgttttactggacgaacagacagaaacaaagacataagtatatagtacatgatagatgctatatgagatggttggacggcatcaccaacccgatgaacctgagtttgagcaagctctgggggttgctgatggacagagaagcctggtgtgctgcagtccatggggttgcaaagagtcagacacgactgagtgactgaactgtactgaacctgatatactatattataccatatcatatcattccataccatatcacatcatgcatacatatattttttgatgtgaaccattttttaagtctttattgaattttttacaatattccgtctgttttatgtttgctgttttggccatgaggcatgtgggatcttgggtccctgatcagggatcgaacctataccccctgcattggaaggtgaagtcttaaccactggaccaccaagcaagtccctcatacatacattttttaaaagtgatgccgagtctcctccctaagggaggagagaaggtgggctcagagaggtgtctcttacacattacatcttctctggcttagagcacgaattccctgctatggatgaaaacctggactggggaataagttttcctttcagtaggagtcgcacaggaggcaggaaatgtgggtgagttccttgagcgatacttcttgctctaagcaaggggggctgctgtgttcctaatccctgagactggcctgacggatgctggataatccatctgttgagcgtggctggctggcagagaaccatgctagcagtcagggccagctcagtctcttcctatcccactctgacagcttatttatcttattcacctgggtaacagttgtagcaaagtggagtgtggggtctctgccattagagatgacattatgctggacagcagagccatcctgttgtttagtgaaaagacaatgaccctggccttgcgctcagccagagggacttcatctctggtgacctggctggtgatgactgggggatctggggactctgatttagcagggggccggaaagagaaggtgaggggtcaagcaagtctaggtggtgttggcacacaggaaagggcatggagagtgacagccagcaggtgtgcagttacgttctgggacgagaaaaatgttttaggatgagagaggggtgacggttccacaactttcaggatatactaaaaaccactgaattgtgcccttttatagggtgaattttaggcttattaactttatctttttttacac

SEQ ID NO: 43174 - DNA, 823 bp, Bovine  19866881252133
gagatagcttggtgatttcaatttctttgaaatgcttctacctgaatggtgacaagggagttggcctatgggctctgttgttgtgctcagtcgctcagtggtgtccgactcttttcgaccccatagactgtagcccaccaggctcctctgtccatggaattctccaggcaagaatacagagcagtttgccatttcctcctccaggggatctttccggccgagggattgaaactgcatcacccatgtctcctgcattggcaggtggattctttaccactgtgccacctgggaagcccagcctgtgggctctaggtggaagttaaaactactgacctcccagcttgcagctgggattgacttagctgaagaaagatagactgttaagacactgtattcattcaagttttgttgctgaaataaacattatttaatgttacacagaagttgttttattctgttgatgttcatgacagtcctttagaaacaaacatcaaaggcatcagcacgtccccaggctgttttctggagaggaaaggccactgcctggcggacaagcagggggacacctatgaacaaggcaggaaagcggctgctgcaaccatttgtcagcgttgccttatgtgaggccactttactatatgacgtaataaagataatttataatgttttcatgaaagcaggagtgggtggtagtgggcttttctttgtcttttcttggcgtgtaattgaaatggagcttggaccaaatgagaaacatttgtgttgaggggaaaatagatcccagaggcttctgactggggtcaaatattgcctccttacttta

SEQ ID NO: 43175 - DNA, 844 bp, Bovine  19866881314664
actgatagtttgggggaatcatatttgattagtttttgtatgcttagcatcaagcccagtaacaagcatgtggaatgtgcttgagaaatgtgtgttgaactgctgaaataaaaacatcaggttcattgtcaaatcaatgaactcctcccaccagcccgtggtctgtacctggcctcagggcatcatgaaggcgagtctcacctgtgtagtgctcattgccttgagcagcacaggtcaggagctgcgccatggaggagcctactgctttagatgtacttcccaggtcctgagcacatttttccagctgtaagaatatgcaacagggagaagaacttagaagaaccaaatcatccacaaaagtcttagtccccaaataatgcaaatcaaactctgggcttcaattctttcccatctaatataccaatggccctacgaagaaggagggtgacagaggggaaagaacccaggtttcagggtaaacaaatctgagttcacaccctgccctctgctcccctcctctacttgctacctgtgataggtttgggtaattcactgaacctctccaagtctctgtgtcctgagattatagtatctagctcaaaggttttcagagaattaatgtaggtactcaacaaatggtagctattagtattatgcctttaaaagctaattcagaaagtctgcaaaaaatccttagtgagaattaattatgccttggcaggaagtgggcagacatccagctgttccaccttcctggcacgtgggaccattaccattgttcaatttgatcataatacttttatggaattctaaccagaaggaaatgcaatagaaatagaggctg

SEQ ID NO: 43176 - DNA, 918 bp, Bovine  19866881348510
aaatttaaaaaagaagtattaacttatttcacaattctgaggtagttactattgtccccatattatacaaaatggttatgtgtcttggccaaggtcatagagctataagtggtagaactgggtgaacttggtctgaagcttccagagcccacagtattgaccacagagctggggattttaagccagataaaacgcttctctcctgactgtgcttttttgtatgaaagataaacatcacccaaacagttggggatgtgctaacccagcatccctgggtgaggataaagtatttctcacttagttggtaaatatctcccaagtattgataggaaccaagtcaaggaattcttggtgtgggcaaggctgatttttttttttttcctgttactgcttacatccttacttaaaactgcatccctagtggctcataaatgagacattgagggtatttgcttcctgtaccttttcagtaggaatcattagtaggagatgataatagcgtattaaatatgcttaaccttggaaattctgtctgtttgcaaaatggagaattgggaactgatgactccagtattctcctatttccaaaagctgatgcaggatatgccagcccctagaatcaggccaggaggcaaaagggatgaaaaaaagggaagtgtgtctcgtcagtggtgtagaaggagtataatttgtggcagtcaagttccgtttggttgaagactataaaactggctgcacaattctcaacaaagcatagtctctagaagggagtatgttatgtgctcgtgaaattgaaattgtatttctaagaaaatatccctgtagtttctctttaaaagagtctttagtgtctataaaaaaggggggtggggaacgagccaggaactgagaaataaaatgccatctttctttggggat

SEQ ID NO: 43177 - DNA, 1377 bp, Bovine  19866881379578
cctaatgatagtttaggctatcatctctttacagagatacacaccaaccaatcttctctaaattagcaattaaagaccacttattatcctgaaaaaccacgttagtgtattcaccattgacaatggacattccaaaacacagatgaagtctgcagttcttggctatgctatcagagaatggcaattagatgctgatgaagagttgttcattctaatgagcagcaagctggcacgactagggaaggattccttgaggacagagcacaagatactgtccagtcatcctttcctactgacccaactcaactgaagggtcactggagaagaattgatacctctgacatctctgtctgctgttctctgagggttttacacttaccatttcagtggtctctgcaacgggttagatgccagaaccatggggagatttttttaaatactaggatccatgttaaaaataaataaagtaaaatagattaaattaaaaaaaatactaggatccaccaccccacagagattccaaaggattagggctgggagagagtcgagggatgtacattctaaaatgctcccagggattccaaaggagccattttgaagaccagcacttgggaatcacttcattacttcattttagagtttgctccctacaacaactctatgagatgggcagggaaggtaaataattacttccatcttataagtgaggggaccaaggatgccttctccatttttcccctgtgtaaatgtggaaggaaggcttacaaaagtaatgaatgagtaataaagaataaagagtatgctggacgtttgatagaatatttgtacattaagcagacccctcaagaaaagaggaggcttggtggtgtcagcctggactgccagctctttagataaaaacctctgggaccaagttcaagggagatcttggaggaaatggagttaaggagtgcaggagggcgtctgggagcccagacccaccttgctcatggcttctgcgatggcgtcaacccaaacctcccaccaaccccacttcactggcagcttcattcagtgtcaccatgatgtcgtccacggcctctttcatgagctgggcggcctccgtgatggcatcgtgggtgtgctgtgcctgagaaggaggggtcggaagaagaagataattgtaagctgtttccataagcagaagacaatggtgcttaatctctttaagaattacttcactttttaaaaaagataacgttaaaaagcagaatataaaactatattctcactatgtaacacaaaaatgtattctctattttttcctttccttttattatatttgtatacatttctttgccaggtaaataaaagccagaaggacaaagagaaaaaaat

SEQ ID NO: 43178 - DNA, 1185 bp, Bovine  19866881502811
ttcagtaaagtcatagtaaaattaaattgttactttggttaaatattttaatatgtttagtaaaacagaacataatttaaataaactaatcatactcatatatatacacacatacatgcattttacatatacatacatagccacattttatataaagtattttatattgttgttggaaagagtaatttcaaccatttgtgaaatctattatattctctgtgaataattattttacaactaagtcttctgttgagatgcattagacagatttacttttgagaatgaaagtaaataaattttgaaaaatgtactgtcatgttaatctacagattggaaatttttttcccattttgttgcttctgattttgagtgaatgttctttcaaaagcatgtataaagtaggtaatattctcattatacattatagtattttaattttcaatgaatgttttaaagtagtgatgtttttcaaagcaatatctttcactattaattttattaattttttttcagtttgagatcaatataatgttaagaaaagttcagatattttagggaaaagttacttgttttatcaaccataaaagacagtttgtatttttataacttgttttccagtctttactgtatacatgcttgatttaacatagcatttatcacattatatatgtaacatggatccagcttctttgcttagtatgtgtatatatattttttccaaacttaacttatttttaattgaaggaaaattgcttcacaatgttgtgttggccactgccatacatcagcatgagtcagccataggtatacatgtgtccccttcctttttaacctctctcctacctcccacccctctaggttacagagtgctggtttgagttccctgagtcacacagcaaattcccactggttatctattttgcacatggtagtgtatctgcttccatgttgctctctctgttcatcccaccctctgctttcccccacccatgtctgtaggtctgttttctatgttggcatgtccactgttgctccgaataggttcatcagtaccatctttctagattccatgtacatgtattaatataaggtatttgtttttctctttctgacttaagttccctctgtataataggctctaggttcatccatctcattagaactaactcaaatgtgttccttttt

SEQ ID NO: 43179 - DNA, 1301 bp, Bovine  19866881544526
caaactttcatgtgggtgaagcttggtttaaagagcatagcgctctcatggagaggaatcgggtgctgtggggtgaacgatccaaaaggacgtcaagaattgggttttcccaccacttatgccgattatagctcaactcttttttagcaaaccattatcctgattgcctgtaagaagggaaaggtttttgtcccccccgcccccgctactttaatatttatgtatttggctgctctgggtcttcgttgaagcatgtgggatctagttccctgaccagggattgaaggcactctgctttaggagtaaagagtcttagccaccagaactaaggagtgaagaccaccaggggagtcccaagaaggaaaagtttttagaaataaggatttttttaagagacagcatgacatgagaaatagaaaagtatggtcttcccacagttgtatgtaaacacagaaagagagagcgagggtctgtgctggcttcttggagagagtgccttgcagaaagaatctccatcctggctctgcaggccgagcaggcaagcaaagtctgtggaaagcagaggaaacaagcaagacagattgaaacaggcctcagagaaacgaggacaggtggtggagaagagaggcaggcctggatttctggcccaaaagacaaaagaggacaacacatttgtcttagaatgttatgcagttaggaaggaaacccccaatccaagatggtagaagttggcaaatctctgtttataacctctgtttcaggctaaggagacaaatcccacttctacattttgctggctaaggtcttgccttggctttcttttttccacaatagattcattgacccacactgaagccggtgggtgggtggggtgggggaccataaacttggacagtcccacgactgagtaaacattttctgtgtgcaaactagggttcctctgcttcctctcaacatacaggtttgggtaattaactaccagggcttccggtgggtgattagccccaggcctccaccaaatgtcctggggttttctccctttcgttttttgaccctgtgcattttggctggagtatagaagaaggaaaaatctgaactgttttctccagctctcaaagtcccgattactacaagggagaactgaaaacaaaccactcttggactctgagcagaagtggcagcaatatctctgcttagaaatctgcaggtgaaggatggagcgagggtctgtttctcattagagttcttggcaaacgttttgaggcgcatcggaaaagaagggtgagtgactgtcggtgagg

SEQ ID NO: 43180 - DNA, 1210 bp, Bovine  19866881584705
ccttggtgaacgcctgcagttccctccttctaggaggctctccttgccacgctgtggtaactccaagactgtgtgctgctgtcttattctaaatttgtttaatttgtagttttgtccaaagcctctttaattgccatttttttctttttcgatttttaaagctgattcagagtgtaacttttttttggccaggtgtcatgaatgtcacgctttgcccctttgtgttttccaggcactctaagtgagggtcctcaaatctcctgggaaaatggtggctctgtctttaaagatttgtgtccgccactgcaatgtggtcaagaccatgcagtttgagccatcaacggctgtgtacgatgcgtgtcgagtcattcgagaaagggtacccgaggcgcaaactggccaaggtaggtcattggttatttgctggctgcttgaagtgtgtttgtatattttaccctggtagctaaggaaacagaggctctgcatatgtgcacaggtcagctagtgtatatgtttcgaatgaaattcttatcctggaccttactcgcctcgtatgtaaaacttgtaatgacatcattgtagttctgccagtgaaccagcatcatcatcatgtccctttcatacttcagcaacgtgttctgcagtttacaaatcactttttggtataaaggcctatagagtacagatgaagttgctcaaacagttattgcttttgtgtatcctgagccctgtttcactgtttctactgccagcagcctgaagaagactggaactgccataaggacccagggcaagcgtcatatttcaagtactttgcaggggcttctaatctttatctcaaaccttaaaaaaaaattgtgatacatgttttgcttaatgtttggttaaaccactggccacagttaatctgagtttaaacaagtcagtcatacaagtttattttccatttccctttgtcttctctctacatttccttcctttatttagtgtttgactgatgcataagaaattgaggttactcctgaattcataagcctttagtgtgaaaatggaataaaactttccttgaaaattggaatcataaaaatcaaacattcaaagacagttattgttaggcatgggtcttcatgaaaagttctgttactctcaaaaccacgaatcttttggtccaaaagcaatgtctatattattcaaaacacaatctataata

SEQ ID NO: 43181 - DNA, 902 bp, Bovine  19866881599941
ttgtggacagtggggactactctgctgcggtgctcgtgcttctcattgcaggggcttctcttattgcagagcacaggccgtagggcacgcagggcttcagtggttgcgctgcatgggctcagtagttgtgacacatgagtttagttgctccaaagcatgtgggatcttcctgggccagggacagaaccagtgtcacctgaattggcaggcggattctttaccactgagccaccagggaaacccctatcaacccttctagattccttattctgtgctaagaaattgcagacattacttcacacattttggagttttcttgaccagttgcaggctgagcccgtcactctctactgaggctggttccattcctgggaaaacaacccagaaatcactcctttctttcatgctgtgcttgacagatgtgtgagagtggttttttttttttaattacaaattaattcattctaaaaagtagcaaatgcatttattttcttctctgcattttaatttcctctctgaatgtgttcgatagcaaggaaaataataaaataaaaatttgttaagtgtgttctcagagctcgtagctatatgccccactctttttgaggaaagaataatcatatgctaccttttacatgaatcagacctttgctggaatggagccatgtgtatcagttcagttcaattcagctgctcagtcatgtccaactctttgtgaccccgtggactgcagcacaccaggcctccctgtccatcaccaactcctggagcttacttaaactcaggtccatcgagtcaatgatgccatccaaccatctcatcctctgttgtccccttctcctcctgccttcaatctttcccagcatcagggtctttttcagttggtcagttcttcacatctg

SEQ ID NO: 43182 - DNA, 1450 bp, Bovine  19866881666414
ctgaaagtacctcccattaagtcgcttatacaaagcatagttactcgcctactttgaaaaaatgaatgtcagtcattataaatttaaattgccatctcttaagaaataactacaaagttggtgtaacaacagtcatgttctgtttccagggagtttacttcaacagtgacaaatctgcccccacctacactaaatggggtatctgggtctgtttccccaaaggtccgttattatttataaggatgaaagttagggtttcttttgcatgaagtggaatttaggcagtgaggtcatttgttttgaaactacagcaaccattccagttttttccccccattttagcatttcagttactctgggtcaagagtaaaagattaagatttcagagaaaatccaaagcctggtaggccacccacagaatggtcaaagattctgccctggacagtccagggcacaactaaccaagggggttccctttcccaagttaggcaagttcactgataaaaagtcagtgcagacttgcacacacacagactcatacatatttcaaagaatgttcaacagtcccaggattcattttttaaaaataaacaaaaaaacagaacctaccatactgaccacatggttcctgatccttacagggcaggagggtccataaactcctctggaaatatgatgaaccctctcgcccagaagaaggacatgatagattcagtttcaaattttcacagaaatttctctgtacctctggctaaggaccctggcttaattaaaacaaggaatcccttttcatctttctctctgaaatttgtacaagctcttggtaaagagggtcatgagtgacagtcccatttacaaagtgatacacaagggcagggaccggtgagaaaactggcttcgtgcagctcttaggatggagagtatgactctgcagccagcaatgctaacaactgttcttgaggccctggctgtgcctgggagcctttgccaaacagtttcaacagggaccttcccaaatctggttttgcacttggcactcagttcttcaaaacaacaaagaatagcacagaaacatatataataccatatgtaaaagagccagtggaatttgctgtgtgactcagagaagtcaaaccggggctctgtgacaatctagaagggtgggagagggtggtgggtgggaggcagcttcaagagggaggggacatatgtatactgatggctgattcatttcaatgtatggcagaaaccaacacaatattgtaaagcaattatctttcaaccaaaaataaataaattaaaatggctgcaacaacacaacaacaaaaatcaacaaacatctgcatgacttaggaatgcatactaaggtaccaaggatcagttaaaatgaaaaaccgagatgcttatcataactctgaggtgatagggggcgatttttttttgttgagat

SEQ ID NO: 43183 - DNA, 908 bp, Bovine  19866881811750
ccgtttctcactcattgaataactgtgtgaactgtctccctgggcagaaggatgtggatgtggccttgaagagcattggggagtcaagcaagaagctgctggtggactcggtgagaggttttggctcgggaaggggtacatggggccctgggctcacctcaggtgcaggtggggtcttctcccctccagggaccctttgagtagctcaccttcccttagggggttggttttcgtgcctatttgccttttccttgttttgctttccaatcagccgaattcccaggtagagcatctaaaatttactttttccttgagcccacgttgccctccgatcttgggttatccctgtgagccaagaatggggcaggctgttgacggggagggtttggatcatctgacctctcatcaggactcactgaaagagtgagtggtctgtggaatttcacggtggagcttgttcccttctttttttgtaaaccccctttggggggacttggccttcttcatctctgtttcttctctgctgtgtgcctgcacatagccaggtatgcagacagtgggtgtggtgtgactcatataatctagcttaactctctagaactttttaccaacagttacagttctgctagtggcacttctgagggaaagctatattgttagcagagaccaactgatgaataaaattggtgactattagtttggaaaaataggatttaaagattaatagcatctgccttttagtaccagaaagctaaaactttgcaagtttccatctgagaatgccaagatagagcatggattcagaaagcagatcccagagtcaggttgtccaggtatgaatcttggctgtgcggcttaggagaccagaagccctgtggaaagccgtccttgctatttttagatccact

SEQ ID NO: 43184 - DNA, 452 bp, Bovine  19866881820857
ttctggttccattgatgacttgagtggacttaagcaaataattaaacctgcctgggaccgagttttctttttttccaaaccaaagcaatagttgcctcatttttcttatagtttgggaatattaaatgaaataatagttatcaaaaagtttaaaaaatataaagcacaatgtgaatagttatttctaatagtaatataaaaagatgttttaaactgtgttagtttctttttttctgagcaatgttcatactctatatctgaagggttttgtatactttttctcttaatggaaagcgagaaatgtatatcttcttgagcatccaaataagaaagttgaaatcatgtttgtttagataaattaactttgaagattccttggaagaacctttatggcgaagctgttgttgcaactctagagggattatacctgcttgttgtcccaggagcaagta

SEQ ID NO: 43185 - DNA, 1108 bp, Bovine  19866880730005
agagtgcctatttaacctggagttgacagctaaatcataggccaagaaagcaaaactaagtgaccagagaattaaacctaccatacctgggtagccagtaacataaacaaaccaagaaccacatatgcccatagaagagtctatataaatgaagcagtagcagaatgaggctgtgtatttgaaacttacaggtcatacataacttatatccaagatctctacaaacagcagtaacaaatccctatacacaggagacgatataatttatcattcaaactggaacacttttaagatgtaaaagggtgccactaataattaagctggtacttaattaaattaaaactgtctcagtcaaactgagatgtaaggtcaaccttattacatattaaacccctgtgttataccagagaaacactttgaagaaagggcaccaaaggtgaaatcttcagaggaaaaacacaacttctttgaggaggggcccaaaagtttcccaagcaggagagaactgcagggccttctgctagttgctgacctcgatgaaagtggatattattgggcatacacaccatctgtgcaagctgtaaataacatctctgaaatttctcagtgtttacatgcccttccactgctttttcctacgttgatgacatctatgaaattttaaggccctaaatgtcaggaattttgtttcaatttcctgtatatagacttagtctgcattgattttgcataatacatacaggagaatatgaagattacgtccatctctgaagaaatatcttgttaccgctcatggattaaccaccatcattttcttaagcatggcacattatgtgacgatgcagtacagatgtctttggattacatataggtcagagccccaacagcacacagatgacacactcaaaagtggtgaataatctcagttcaatgaagggtcacttacaaaggtgtgggcaaaataaaggaaaccataagggttgacaaaaaaaaacccaaaggagactgctatcatccctaggcttgaaagggcaagagagaaagccatcataggaacatggagaagtctataactgtagaagcctgccaggcaggagtggccaaagga

SEQ ID NO: 43186 - DNA, 563 bp, Bovine  19866881152389
ataggtataaataattaaactcaagatggtggcaagctgcatgcttgtgtgtgtgctaagtcgctttagttgtgcctgactctctgcgatcctatggacggtagcctgccagtctcctctgtccatgggatttcccaggcaaaaatactggagtgggttgccatgccctcctccaggggatcttcctgacccagggatcgaactcacgtctcttatgtttcctgtattgacaggtgtgttctttaccactagctccacctgggaagccaagctgcatgagcaggtgaaactgcttggggtagggaagtgcgtttccaaactgttgctctgaaaacattcacatcactgcacgcacagggtggttgggtgtatttgtgttttgttttgcttttatgtgtgtgtgttttacataaatcaaatttcttgctcctctaagaatatagcacacacatagtcacacatatttacctatcatgggagtaaagtgcatgcttatacaaattttgaaacatgataatttcttgaaaaactaggtttcaagggatatgtacagtaagcttggg

SEQ ID NO: 43187 - DNA, 787 bp, Bovine  19866881275033
tgctgactctgaagagggagaaagagatcagctacaactcaagaaatgtggggcacatacagaagctggttcttctgttaaatttggtccatgtattacataacaaatttgttccatgtattacagaaggaggcttcccagatggcacagtggtaaagaatccacctgccaatgcaggagatgtgggttcaatccttggcttaggaagatcctctggagtaggaaatggcaacccactccagtattcttgcctggaaaattccatggacaaatgagcctggcaggctacagtccacggggtgcacagagtcggacacaactgagtacagatgcaattgtattatggattcatgttgtcttagtataatacacgattttctttccttgaaaaaatcaaaatgatgtcccttggcagactgtcttactgtgtaaacttgccactgagctattttgcatctcattatccagtctgatttgccaatagctaattacagtcatcactgacttaactccattctcacagcatcataacagtaaaacaaggagtctaatggcatcagttatatggaattcattataatagaagtgaatatcacattgttacacacttatattcacatgtatgcatttattcctctaggttttcatgcctgaaataaatttactggaatcccagcctctactatatgttaagcctacaattcaagaacagccaggccaaggacacagtgttccatctttacaatcaaatacagatttcccattaaaaggaaaattctctatttca

SEQ ID NO: 43188 - DNA, 1084 bp, Bovine  19866881892620
tcctttagaatctgtgtggtcactctctctcatttcctttgctttggttggtctctgtttggcttttttcttgttatattattctgccgtctctattagaggtaaaatatttatttattatccattttcctgtggatatagtattaactttttctctgaaaaatggttaggattatttcaatgaggtctcttttaaagctaaatctctaattttaagaacttttacctggtagctcagatggtgaagaatctgcctgtaatgtaggagacctgggttcaatccctgggttgggaagatcccctggagaaaagaatggctacccactccagtattcttgcctggagaattccatggacagaggagcctggtgggctacagtccacagggacacttttgctttagaatattatgctaaaacctctgaaaccatgatagataaatagatttatttataataaataaatagaaacaatagtaagtggagagatatttcttaggacatgtcctataggttaggagaaactatgtgaagttttcttacctcaattttatgttactgcagttaaaaaaaggacattggaggagtgttgcagaactattgcaagacaaaaatatttacatataaaaaagcaaaatgaatttaacgtcctctcatgttttatatctatccttccttgatgtcatccaaatttcctattgacagaattatactacctttattttaaatttggtgatcaagcaggaagcctttcctatcaatgtctgtccttgctccaccaatttaagaagactattctctgagaacaaaggacatcccgttcaaaaagttgccccctgtaaccctaacctgatacctgtttgcctttaaaccttccacagtagatcatccctcaagcacacaaaggcaccccctttccaagctccacatttatcagcaggaaaaaagcaaacaccaccatttctcaggtacacagtgtctccacacctattacagttgtgagcagtggtgaccttgcactggcccaaaccacccacgagtagcctttgatgttcctggagcctcatgttttaatacagtctaaa

SEQ ID NO: 43189 - DNA, 1752 bp, Bovine  19866880569244
cttatgtttacgagaatacgcacatatatttatgtgctgtataaaaagtatttgagaaggtgatttaggactctcaattataaattttcagggcagaagacttattttgctgctaggacaggtgaatgggccaacagcggaatgaaagcctttacttggtaaatcatcattgttaaaggagagaaacaggttaagtttgttctcccagagcatgatttttactcagttattacaacattaccacaaaagctgcctagtaacattagttaaaaacaacacagggtagggaaagagcaggaaatttgaattagatatgccccggggcaggtgggcgtaaccccttctctcagtacagtgagtgctgtattctgaagagcgtgaaatttaaaaaatcggaacaatcgtttagaatttcagttaggatattgctgcagttaaacccataacgctgtgccatgttctcagccgcaggaggcagggcctggatttcttactcatttgggcacttttggttgtttaaagaacactaccattttaattattccggaaacatttattaagcacccttctttggagccaaggcacactgctgttttctgcagctctaaagataaataaaacttgattctcaagccctggttgggagagaagccagacaagtaaacaaagggtgttacatagtccacgcaggggtgtggtgaaaagtctggagcagggaacatctattttacatggaagtggagaaagtcaaaggattcttgccctgagtatcacttttaatgatacttaaaaaaaatttgttttcgtctttcccccagtcattctatacatctggtgggaatttacctctcctattctgtgtgaggacctgggtgtgaaccaagaaatcttcccttcccattgggaatccacaccctttttgcccccgctgattttaagaatatcccagtttagggaagcagagaggtggcaaggttaagagttgacgaacaaggagtattagaagagttttcacctccaggaagggggcttcggcagagggttgcgaggttaagtgggagacttctgtatcatttgaactaataatattgagagataaaataaaccaataaatatgtaagtaagggtcctattatcactcagaagatactgagcacctaagccgtatcatttactttgctgacaaacgtccacatagtcaaagctattgtttttccagtagtcatgtatggatgtgagagttggaccgtaaagaaagctgagcaccaaagaatcgatgtttttgaactatgtcattggaggagacttttgagtcccttgggctgtaaggagatccaaccatccatcctaaaggaaatcagtcatgaatattcattggaaagactgatgctgaagctgaagctccaatttggctacctgacgggaagaactgactcattggaaaagaccctgatgctgggaaaaattgaagacaggaggagatggggatgacagaggaggagacggggatgacagaggatgagatgatcagatggcatcaccaactcgacggacgtgagtttgagcaagctctgggagttggtgatggacagggaagcctggcatgctgcagtccatggggtcgcaaagagttggacacgactgagtgactgaactgaactgaagccatatcagaatactgcaataaacaaaaggaaaggtccttatactcaaggacctcattttctagaacggaatagtagttaacaatca

SEQ ID NO: 43190 - DNA, 1785 bp, Bovine  19866880911172
aatccgcctgacaatgcaggagacacaggtttaaccccaggggctgggatgatcccccagagaaggaatggtaacccactgcggtactcctgcctgggaaattccacggacagaggagtctggcgagctacagtccattgggttgcaaagagtaggacacgacttagcgactaaacaacaatacactttggggtgggatggtaaatacatttctaaaagtattcaggttatttctaaaaggcctcccctttatcaccagcctcactcaactctcagaagaaactttagctctcggggcattcatatgaaactacaaacatcaacaagttagaaatatgcatatacatatacaacacaaatatacataaagagaatagtgtcatacaattcatttgttctagttattctatttccattcaaaaacgcttatcaagaaatattttacaacactgtttttgaaatagtattattaactatggggcttcccagatggcaaagaatctgcctgcaatccaggagacttgggttcaatccctgggtcaggaagttgtcccctggagaaagaaatggcaacccactccagtattcttgcctggagaattctacggacagaggagcctggcgggctatggtctatggggtcgcaaagagttggacacaactaagtgactaacacatactttcacattattaactgtatccatactttatttaatcattcctttattgctaaatattaacattctcaatttatctgtatatgaatatttctttaagagagactcctagaaatagaaattctgggtaaaagggaatgtgactttaaaatgttgacaggtgttaacactttgatctccgaaaagacattgtcattttaaagtttcaccagtaatgcgtggaaactttttttttactgcaaccccaccactgttgaatatgataaatctttgcctttattgacttttgctagattaaataccccaacaagctaatagtttacactttctattctgtattatctttctactggttattagcttaaaatttcagtacatctgcatttatagttttctagcatctgataataagtgttacaaagcaaatggcttaaagaagaaaaactacctcctgtaaaacttcatttgcaagaaaacggctatcaccctcttcaacttgtggactagagatccttgttacatgtccaaggtcacctagaagtattgaaaaaaatacagtcaagaattaaaacaaaacagcctctattttaaggaaataatttggttacttttctttcttacctattttaaacataactttgttggatgcccagtcatcttcatctccttcttcagaggcagcatttgggattgaagttcgagatatgaaaatattacctgtcaaacagttatttaggtaagccatactaacaattaatagaatcaaagttcacaaacaagtcatacaacgaatcattcagaaagcgcttaaatatatagactatgtgttctacccaaacccagtaagaaggaaaggggactgtattttctagatacagaaaatacagaaatgtactttctggtctagcactggtcctttaacacttgaaaaccactgcattagactcttgtcagctacacattgatcttcagcagttctaattacttagaaagtaatacaaagggcaattaacatactaattcatgatgctgctgctgctaagtcacttcagtcgtgtccgactctgtgatgctactgaggcacaaattttaatctaatgctacaagg

SEQ ID NO: 43191 - DNA, 1356 bp, Bovine  19866881031989
ggttgccctaatctaaaacttcatatgattcataggatccagttttttggcttttcttgaaaaagggaagatttggcaacaataaagctgcatttcctcaccatagcatcacctgggtttgagtagcaatgctgcctgtagatgggagcaccattccctactgcttcatttccactcattttccttcatgtatggaccctgcctgggccctgaaggcatttgaactggggactcctggtctgtgaagtcccctttggttgttgataaaagagcatagctactagtgatctgttcctttgggctctcaaacttcttgccctacaccagaaaccagtgtttatgattcctacagataccagcagaaatcagttgtttgggattccttccctgagtttataataaacatcacaggtacgtgtcatgttaccagtaggtcctcatatgaggatcaagggcatgaagctgtcattgcaatttgccttgccatattatttctaggttcttcagagtccaggagatttctttctgtgcagagaagcattttctacaacttccagtctaattgatgttcagtttatcaaatttatatgcctaatcaactgacaaaactaataaatttttaaagtttctcaaaatacaattttacatttaaatcctattgtaaaatgtttgttttggctggaaataacagaaagccctgaagtggggtgggctgtgggcacggtgcacctgggctgcagctccacttcgtcatgatcctcttggttctgcccttctccgtgtgcgggcaccacccgcaggcttgtagcattgtggctgctgcagtgacattgtcatatccagacacaagtcagagaaagcaagactcttacttccctttgtttgtaactgtggaaaactcccagaagctctctgtggactttaactcccatctctttggccagagttgtgtcacatgcctgttcctaaaccagtcactgctgaggagaatgggatggccagttggcttttactaattatcccagagtggaaggactgttgagaaatccatcctaatgatcaccacatcacttactgaaattcccttaaacaatccaaatagtaaacacaaatccagtaagactaattcctcaaacatttgaaacgtcccaacacaccaaatagcagacagaaacattaaaacaaagtactcacaaaggctataaccacgtttaagtctgaattgttaaaactatggatttaatttctttttcattacttctatacttattcatggaaataatatttatttagataccttttcggttacagtgattttactagacctccaattaaaataatactatttcatacggc

SEQ ID NO: 43192 - DNA, 2177 bp, Bovine  19866880447246
acagggaagactgacatgcttcagttctggggttgtaaagagcagacatgacttagtgactaaacaacaacaataacaacaacaacagatacatgtatataggcttccctggtggctcagccacctgtcagtgcaagagatataattcgatccctgcctctggaagcaattttagttttttaaaaccaaagtttatagtttctataaatcattcccaggagccacctgaaaacaagtcatcacagaactgatacctgaatcagaaggcgtgattcttcctgggctgaagcaagtcaggcccgtggttcctgattttgcttcacatgaaacagagggcaagaggggtgcctgagggcctttgttatggtgcaggccaggtcagagcaggtgtcccctcctccaggctagggcagcctgacatcccctgcctcagggcctcagggtcccaagtatggcctgaacgtttccacacctggaccaaatgctggaaactaagttattaaactggaaacctggagagttttatgggaggtgccaactccaaaacaccagaactgaaatctaaagaacttttcactcatctaaccagaagagttggggtgggggatggggctattctataacctgtcagactgttgatttcattttattaaacttaggtatgaaatcagtgcttagtgaaatgtttggcttctatatttttgcattttctttacttccctttagttttataatgaaaatacttttcattttaaattcaccgggagtctttgtgacttcactctcctaaggtgatttctgttgaagcaaataatcaaaacaggatattcaggtaaaaataaatgtatacttggtatattttcttatcaaaactggagggactgaagaaagctttgggggacaaaagaggaaactattaactaggcaatggaggaatgctaattaaaagcaccaaggggttcactgctgtaaatataatccagagtggaatattctataaaatgggatattcaaagccaaatcagcatttcaggcaaatgtgacttttctctcttgtttttatgagttggaatccagaaaagcacatgtcttccaacatctttaaaagtgtaatcatttcttataagtactcagcattaagtatgattttaaagttgtatttaaacacaaaattcaagccattacacctgtgtgtttatggaacttttcatagatgtatatttactgggaaactactgatattgtcttctagcagtacatgctgttctgtgccaaaaagttttgctgcctctgtgtggtggccttaaatgttaagactgctgggtcagcagccctcctaccccagaggtctgtgtgcaaacccatgagaattaaaaaagaagcaaaatctgtgggaacagaatgcagatgctaaggtgtccttttatgtacaaacattgtctgcgtggatgctggcctctcacacagattaaaatactaaatgccaattactcacactattgtcgaaagatccaaagtcattgtataattactgttgtgttcaaaggaattatcatgtagttactatgaacaacatgttctattttgtggaaactatacaattaacttgtcttaggctaataaattaaatgtagcataagctcatataacagctgcttggatggaggggatgactggcaacacatttaaagatatcactttgaattcactaacctctatactcaatgcagtagtaggtgtctcctcctttggggaagttatgcacatgcccacttttactaaatacatattttaaggaagtttaaacatattttggttatgggagaaaaggtgaggcagaaggaggaaaaagagtaaaatgataataaatttttggacactaatttggagttgaactagaatggcaataaaatgcatgaatctattatgaggtaaaggagtatgtcaaggctgattattgtcaccctgcttatttaacttatatacagagtacatcatgagaaacgctgggctggagggagcacaagctggaatcaataacctcagatatgcagatgacaccactcttatggcagaaagtcaagaataactaaagagcctcttgatgaaagtgaaagaggaaagtgagaaagttgacttaaagctcaacattcagaaagctaagatcatggcatctg

SEQ ID NO: 43193 - DNA, 1523 bp, Bovine  19866880628060
aggttggcttacacatataaatgattttatacaaagaatggtagattcaatttcataggctacagctttcaaatgactttaagcaacatcacacacctcatggagcagatgcatgtctcagggggaattatccagaagcattccctctaaaggtcctagggaggctaaaatgggctccatttgaagaaccatctccatcagtatgggcagacctcggtgtgtggtcctttttgtctgagatgatcaggacgcgtaagcctctcgctcctggggatgccgtctgggattgtttggtggctttctggctgtgagggttttggacattacccccgattttcgtggaaaaactagtcctcgtgtttcatgtcaagaatagttgaaccaaactgcctttgacatcctagagttatgtgctcactcagagtgttggcatttgcccagtgccgacagcaagggttccaggagttacatgagccactagggccatcccatctaccatctgtcactggcttatcatgccaccttgggtcactgacttccccactctgtgtcatctgtgaaatacgcataatagcaggtcacagccttctgtccctcccctctcctctcctgctgatactcactttccctccctcccaccctttgttcctctccttcttcctcctcctcctttgccatcccctgcccccttctctctcccctgccccttgtcaccccccttgtctccctcttcccttccctctgccccacagaagaagataatgtgtctgtaaagcgctttgagttccttggagatagagagtctataaatataagctgttatcattgttaccatgggaaatgttcacagagaaccatacttcattcctgcatttgctgaatataattctgcctcctcgccctgctggcttcttgaggctattaaacaaccaatggttttacaaagcactgtagccaggtagagagtagggactcagggtagaacttgttagctacccaactgttcttcatgtcaattttcagaaactaggtttctgtctaaaatagaggagagtacaagactggccagagtcagctattagtccaaggatgcaaattaggacggtataggtatgccacatgaccaatgaccctgatctatagcaaggtccagcccagggagaattccagtgggcttcagaaataatattccacccatttcctaaattctctttgatgcctgactcctcaactttagaaccatggctggcaaaatgttggggtacagagagttaagagtttctacctttccgccaggctgtgtcttcttcgttacagtctctgcagggcctagtacagtgcccggagtacagtgcctggcataatgctgatgctggacagaggtttgtaaaagaaatgagtatccacagagggggcagcagaggaagaaagcgacttttttaattcttttacaaccgtattacacaaacagagaaataagcctcagcaaactcttcaggaagaccttccaacagtcattgaac

SEQ ID NO: 43194 - DNA, 2051 bp, Bovine  19866880646542
aaacgtgaaaacttaaacttttaattgaaaatatctgaaaccactttcaacctcttgtatttaaaactcaaattatcactttcaggattaaaggaaaaataaaaaggaaaaatagcacacttagatcaaaagtagcaaaacagtgattcattattagatctttctttcttagattagttctttcttcaggaaagctattttcagttctccgagcttcgtatctcaattttgtcaacttaatacaaaataatactctaatactatgccctaaattatgtaaatttgaaccctaatagaatgagtttccagatagtacagcagttaaaatgaaacaacagcctttctttttcagagttactttgaagaggtaactctatatttatttagtacgttcaatataattataagctaagggaaaacattatggccccaaacaaaggacaaccatgcacccactttgctagggatggtctttgtttagtcctgttgctctgacattctctcagcttagcactcctccctgatggttcatctgttaatgaattaccatcatcatcatcatcattatccacaaaaacagttgtgttaaaaggagttgggatgctttctatctagtcacctttctcccaaggacatagctttcaccttcacagctgtccctgagaaactaaccaaattgtccccggaagaacagctatttcgtgtatggtaactgtttattcaagaaagagtatagattcgtttaagctaaaaaagaagtttcctatgccatgtttccacacacacacggtatctttccatgcagtgaaaacaaaagtataatgaataaataattttaaagcaatttttatcatttcatttacacggtaaagttgctgatccagtgcttccaattctttagctatttgagtcaaagtttattttccttcagttgcctctccctcaacactaactagcattgtaatccataagttcctttaattctaatcaaagctaaattatttttacattcatgcagcttattttgacactacctcaaatatccactaggatatttatggatgattcaaataatgtatgtgtaaaagtcagctcattatatattccctctatattccaaatctgtaaactttagttccaagaatggcatcaaaatctatgcagttgcccaaaccagaaaccaatcatcaagttagctaagtatgtttcatataaataaatataaataaaagtgttcagttgtgtctgactctttgtgaccccatggactgtagcatgctaggctcctctctccatagaattctccaggcaagaatactggagtgggttgccttgcccttctccagggatcttcccaacccagggatcgaacccaggtgtcccgcattccctctcctctctttacacgcattggctggtatttagaccattttgcatagagtgtggtcactggatgtataaaagttcatggatgtgccaaaggtcagaactgggagaggaaactccccatcagggtactgaagaggctcccaggaagccacaggcaggggtactgctgacactcgtcctctgggatatgaggaatccttgagaagctaccaaaaggactgctactgagttactagcactcttcccacaataaaagagagccagcagaacttactgagaggtaagttacctacatggaggtggtgctgaaaactgctggttttgatctgtccacagggacacttgaacctggcagggcagctggctggggcaaaggctggatatccccagtaggaatccacgtgcaaagatatcactgcaacttgctggaggtgagcactactggatgaccctagcaggaataagaagaaaacacagcagaactaggaaagaagcacccacttgtctcattgccctccccaggacgtattccacagtgtggctctgaaacggaggcagattgtgggccttcccaggaagagagccccaggtttcccaactcttgtttgtagaaaaagctttagcctcctaggtcttcccccagttccaaagagcaattttat

SEQ ID NO: 43195 - DNA, 949 bp, Bovine  19866880930275
tttgtataaataaatatgtgcatgttctacgagtgaaacaggagggaagggggcagggaacaacctttaaaagaaagacacagcggtagggcatgacaaaaaccggttagaaccgccttttttcctcagcgcttggcgctgaccagttgctcgcctcttttcctccactgcctcccagttctagattagccatcaccatgggttttgaaaagccctgctggcctccaggtgctcaatgactacttggcggacaagagttacatggaggggtgtgtgccatcacaagcagatgtggcagtatttgaagccatctctggcccaccacctgccgacttatgtcatgccctgcattggtataatcacatcaaatcttatgagaaggaaaaggccagcctgccaggagtgaagaaagctttgggcaagtatggccctgccaatgtggaagacaccacagaaagaggagctacagatagtaaagatgatggtggcattgatctctttggatctgaggaggaagaggaaagtgaagaagccaagagctaagagaagaacgccttgcccagtatgagtcaaagaaagccaaaaaatcagcacttgtctccaagtcttccaccttattagacatgaaaccttgggatgatgagactgatatggcaaaactagaggaatgcgtcagaagcattcaagcagacggcttggtctggggctcttctaaactagttccggttgggtatggcattaaaaaacttcaaatacaatgtgtagttgaagatgacaaacttggaacagacatgctggaggagcagatcactgcttttgacaagtatgtacagtctagggacgtggctgcattcaacaagatctaaaatccatcatggatcagttcccttaaataaaagtttgaaagacaaaaaaaaaaaaaaaaacccaaaaaacgggttagaaccaa

SEQ ID NO: 43196 - DNA, 955 bp, Bovine  19866881206845
atgagatggctgaatggcatcaccagctcgatacatatgaatttgggtaaactccaggagttggtgatggacagggaggcctggcctgctgtgattcatggggtcgcaaagagtcggatatgactgaaccaactgaaatgctgaactgaacctgattctgatttcactacaatttttataagaagaacaaacagatgtcttaataaaatgaccaggtggcttataaacaaagaagcatcatcaagttttgtgtacagattaaaaactatacaaaacagctatagaccagcaatgggttttactattttttccattttgtgtacattcttgtttaatacacataattaaatgatcgttttgttactaaaatcttctgactcactcattaaaatcactttattttcaaaattgttgaactcacatttcttaatatgtaactcacatttagtaatctgttgtttatctcagctttcaaaatataattaatctgtactgatctacttgacacacaaaatgacttttggggaactgtcatcattaggctggcattgccttcttcccactaaaactctactttggatttaatttttttaaaaaagcttacagacaaaaagagcatatctcttgaaaaataaagaaatattaattctaataataaagaatgtacaaggctccccaaatcttggctcattttgacattggaaaaaatagatcattagagcacaaaggctacattctaaaatataataaattcaatgctaaggagaagagttaataaatatttccccctagtaaccacccccagaaaaaaacatttttcctcaactttcaatcaattatatcattagttcacactttagatatgacatctctgttaaacttagttcaaatcaagaataaaatagcaataacatttctcaaagtgaaaggtgaagtcgctcagtagtgtctgact

SEQ ID NO: 43197 - DNA, 1784 bp, Bovine  19866881426146
catggtgatggaaagtgacctgtttcctccccatttcttggcctttgtatccctgtctgatggccctggctcatgcaaaagtgaaggattagagaagctcagcttgttccaagctgcatgtgtccctctttctaaatcataaacagtgtttgaatgccaaattatggttacaaagcacctagttaaatactttgactggtgtgatcttttctaaaattaacttccaaaatgcaggatcttgatttttaagtaaattcttcattatcttgaaaggatatgtgagtgaaaggcttatagataggatttaaaaaacaccacacttcctttgttctgaatttgaatttcctatggagcctctgagttgctcagtgctgaagggcacttgagtataattaacgtgacagtaaacagactatatggcaagctgcattcagtgggatggatgcctttggatacacctcattcttggcatactcgcgggtcccagacatcagctctgattacaagttccacttaaagtttcaactggcaaacaaccactctgcagtccaagacaacttgatatttttcactggacggaagggccatggcagagtccttgatcttgcttagcttccttaacagtacttgagagattctcagggactctggctgtggataagtagacacttgcctaggccagcctccgcctgtctgctgctcaagcctgcacctcatccaagatgtgcagcagcccttggcaccctgagtgctggtcactccaggccacctcttataatcagggaattgtaattcctgccagcaagtgaagatacagaagggggcgagtcacacaagatgtcagcttaacaattggccctgtcctatttctttccatttccacagaaaaggagagatgggaaattctcagaaggaacacattttatgatgcatcattaaatgggaatggttgccctcaaagaaaaccgtccaaattaaaggagtaagaaatcaagaatgtttggggcctgtgaccatgtactccagtgccctatgattggtgggaaagcaacatataagctaaatttgcctgcattaagtagaaaccagttatagacatgtggaatcaaagaaaaacacatatgttttatccccaagtcagcaaataaatagttaagcatttaatcatttatcttctctgagctcacggtcctcaactgtgaaatcaacatgtgtcaccagaaaataacctttctcatcagtgattctatcatgctaactaactaacacatgttaacacacgggtaacacatgctgttcttttccgctcactcagtgcctgtgtctatgttaacatgtgtctgaaaggagcccacactcctagggtagggtggtgtatagccttccccacctctgaggggatgagggccccttttctcatgagcactttcccactcccaacttggcaggagatgcctgtcagagtagtgaagatagcagcctctgggcctgaaatgtaggtttggatctgatctctgccacttaacaaaccacaggttaagttacttcttgtctctgtccctcagttttttcaccactcatatgggcataatgctggtgattgcctaacagtgctgggaggactgccgtggctcagacatggactaatagcagggagcacctgccccacacacggtagtctgcaatgtctccaggaggccttcttgagccacctccacagagcaggtctcacctcccccatccatggtattctctacctcagcctcttgcttatttccttcaaa

SEQ ID NO: 43198 - DNA, 1257 bp, Bovine  19866881526667
taaagtcatatcagagccaaggggaagtcctaacaggaacataacttgtatctccatgcaatgtaactcacaaatgattttctttatattatctgattgcatctattactgattgtaataaggtattggaaggagagttggctaccccatcttccataaaaagaggttgaaacacttgtaactaagctagtaaaaactaaaaccttctcccagactcattatttttctcagaaaatcaagatccacaggttaaacaaatgctcaaatatcctctgaggctgtggatatcaaactctttagaggcacctgggattctgattcacaagttaggatctgtgaatgctaaaagctcctacatgcggctgctctagggtagcttatcattaggcagagtgaaaccatgtctttggtagtatgtcacacaggaagacaaaatcatctatttctagtgcagtggggcccacaaaagtccctgtggttccaagaattatgattgcagtagcagctcagcaggcataataatatttctggtaactgaaatttctgaggcccatgccacttatacaaattggtatctgaagagacagaagagagggggacacaatttcaaggattttacctcctataggtctaaatgtgctttaatggtatgaagattgaattcttaaatgctctgatttccagttaattctccaatgttcatatttttacagtgaaaatctgacttaatcctctaatggtggagatggttgctatgatgagtcacacctgtgtcttcacctgtctcagggcagtttcttaagatgttctgagttctatgcagtccattttctttgctaagacaactgtgttttccactgaagaaggaagggtcagttagcaataactttctattactagaaatgagcaattgttctgggactggaaagatgaaaagaaatggaggtctgagttttctacgaatacttggaacaattactgctttgcttggctctgttctgatatcagccacatgttaacatctttagcagaaaccataccatatgtttcagaactgcctgtgttgcctctaagaacagtcttgtccttggatggatctgacaaaagtttctgtgagcatttactatgcactgatctaagggatggagatcagggttggtggggggggggcggagactaatacaactgtgaaaaaatgctgtcctcaaaagtcacccctgtgtaaacaattacagtacggcaagacaaaatgtataa

SEQ ID NO: 43199 - DNA, 936 bp, Bovine  19866881558112
gggcgtgcgtactacaggaatatgtctactcattgaagattgtggcctaaccatacagccggtcccgaggcggcggcggcggcggcggggcaggggcggcggcgggggtcgtgcggtggcggcggcttcgcaggcggcaggggcaccggagtcggtcctgcagtgagcggcccggggaagagcgcgcagcctcgccgcccgcagcccaggcagccaatgcgcgcgtcgcggcgcccttgcgtcatagggtcttccatttatacgcggcgtgacgtaagggccccggtgaccaatcgcggccaggctccaggccgagcgccggcgacagggggcggaagcccggccccgcggacgtcacggcgcggcggcggctaccggcgtgaaccggttgatgaatggcggcggccgcggtcggagtgctggccggcgggggaggggcggggaggtccgggaagggcgcgggaggaagaccgggggcgggaggggaggccgggaacgggaggagacgctcaactgcctgactaaaaccccagagggctgaggacactctggtcaccggagcaggcctgaagctggcctcggctcagcacgcagtgcccgcggggccggcaccgagccgcagtcccggcccgggctccttttgctgagagtcagatcacagtccgctctgcccgcggtttcctcgggcaccgctccccgcgatccctatcgccagaaaatggttctgcgggcgagccgaagcgggcgctctcgagcaggactggcgtgattcagcgagcagcccacaggagacgggagagtgccttggatacgcataaacgctcctgctccccacaggcggctttggtcccgccttcacacgatgcatgcgggtgactgcagttggttcgagcgtggcatttggaaatcgcatccgtcctttgtacctctgctcat

SEQ ID NO: 43200 - DNA, 1120 bp, Bovine  19866880533365
tcctgatatcttgcaattgtcgaaataagattttgctgacaggtagcaggatctcattaaatacaactacctcaccatcatgtacagagaggtgatgtagtgaaaacttgagcatcaaaaagaaaacaatggcagctgagtggatccagatgggtctatgtcataagtttgtgatgctctctggaatacacagatataaactatactagaaataaactgatgttcctaattcttgaagtaaatatgaggaacaaatcatttgaatgataaataaatttgaaaagttgtaagttataaaaccatacagtatctttcttacatgagaaagttaaaataaatattacagtgaaatgataatatatttaatttgttttcttcctacaacacatgaagtaataaattttagaaacattctctaatatatatggtcttgtttcattttgtatttatttatatagtcacttatatttcagctttctcatctttgctagtcagttgcaatttttcaactgctttccattttcagaaattttgtggttcttcacttttccatttttctttcctatctcagtaaacaaacaatatcatgaaattagtgtataatgtttctgttttatctgttttgttaattatgtaataatcttaaataatagtatatcacctcctgtttaagtacaaaaggttttctaggacaagtgtagaggaaacagaatgatcttttcattagtataaaattttaacaagatatatagctgccaaagctagagatagattttctatctcttttgtgacctcatttgggcacgaaatatggactagagtaatgcatgcaaatttcttgtttaaaagaacaccagttggtctagagtccttctcttctactctttctctagccttttcatgtggcttgtctttaattaatgctgcttgcaactggatgggcaaggttgtccagtttagagtgtgatagtccatttgggtgcacacgcaagtatgcctttcatttatgttttagtagtcatttctctgaatacttaaaatatataatttgacttcctgttcagacttttggtagggaagaaagaattttacactgatctctcaccctatgtggcaaagt

SEQ ID NO: 43201 - DNA, 1971 bp, Bovine  19866880661261
ctacctggccccatgctaaggggaatcttgactgctgccccctccctgctcaccccagcaaggctgcctggctcctgtgtgggaggtgggtggaggaaaagcagctaatgagttaacatcctgagagttggcaaatagggcagagatgagatggtttctccaaaggctatagcaattctggagagcacatagtccaggtgggctaactgtgagatggacaaagactggctaactggactggaatgttcctagggagaaataagccttttttgtgctaagtcattgagagttggaggtctacttggctgctagcatttaatgccttgatgaatataatcatttacatcaaaatagccctttcagttacataatatcacttgcttttcagaaaaaccctaggaagtttagtttccattcttcccattttgctgctactgctgctgctaagtcgcttcagtgtgtccgactctgtgcaaccccatagatggcagcccaccaggctcccccgttcctgggattctccaggcaagaacactgggagtgggttgccatttctttctccagtgcatgaaagtgaaaagtgaaagtgaagtcactctgtcgtgcccaactcttagcaaccccatggactgcagcctttcaggctcctccatccatgggattttccaggcaagagtactggagtggggtgccattgccttctccattctgtatttgtatagtccttgctaaatttggtaattctgtctcctttaccattttaaggataactgtcactgtgattcactactgaaaacctcgcttactgcctttttgcctcacatatccttaagataaatgcacacttcagtgagagcagatttccacatgatcactgtgaatttgaagatttcccattaatttgtatgtctcctactcttttatgtgtagttttactttgcaattctattttcatctataatcggaaacacaaactcttacaggcatttaattgaaaaactgaaatgcttttaaaatggtatcattctgttttgttattttttattacaaaaattagcagtgttaaggttttcattataaaatcaaattatagggcaaacatgttctttacgaggaaattactcttactttctaaatcttaggccaaataattttattaaggggtacaaaatataaataatattttattctataaaatgttttaatatcaacttaacatttatatattatttaatcttaataaaactttagaaataaaaaaatacgatgtgtttagaggacacactactccaaaatacggcaccttggcatactgaacattttaagttaaagtagcttgagaaaatagcagaagcaagaaggccactgtgccctcccccaggccctccttctgcctctgagaaaagtcacagaaccctcatgtgagaagctcctccatataccctgtcctctctcttccccagaggaagaggattcccaagggcatccttactttcaaagaccaaaggatgtcaagaaggaccctaagaaacaagtattgctaagtttcctctgctgctgctgctaagtcgattcagtcgtgtctgactctgtgcgaccccatagaccgcagcccaccaggctcccccgtccctgtgattctccaggcaagaacacgggagtgggttgccatttccttctccaacgcattaaagtgaaaagtgaaagtgaagtctctcggtcgtctccaactcttagagaccccatggactgcagcccaccaggctcctccatccttgggattttccaggcaagagtactggagtggggtgccattaaaccccatactccttaacctattgaaggggagcagaatttgtcaccccaacatacgtcactttggcatagggagtattttgagctaaaggcaatcaaaaccctacagattcaggaaaacatgttactgccccctcaactgactaaatttacaca

SEQ ID NO: 43202 - DNA, 1775 bp, Bovine  19866880725806
aatatcttgaacagatagataagtgagtagttcagtgacatgcttgatggtcatgcaaattctgagatcaccttctcttatttctcttatcatattccattgtggatgtatactaataatttttaattgaggtacaatagtgtaggccattatataagtgctgttaatgtcgtccagttgctaagtcatgtttgactctgcaaccccatggattgcagcacaccaggttcctctgtcctccactatctcccaaagtttgctcaaattcatgttcatttagttgatgatactctctgcacaacattgtaatttgacatctgtacccattatagaatggtcattcctaaagatcaagttgccaaccacctctgtacatttgacttccttgacctttttcattttcccttcaataattagcattcttttctctgtatctgagtttgtttctgttttgtcttttgtttgttttgttttgtttctgtctgtctaaatttcacatatgagtgaaatcatatttgtctttctctgtcagatttacttcccttagaataatattctcaaggttcacgcacattgtcacaaatgggaagttttcattattttttatgactgaatagtactcacatatatatcatatatgtgtgtgtgtgtgtgtgtgtgtataagcaaacatttatagagcatattagagattcccgtagtttcatgtaacttttttttttcatgtaacttttaaaaatatgattttaacaggaagcccgtgaaaaagaaaggaatttttattattatcttatagctaaggaaactgaatctcagcatttctataacagtcttacagccctacaattgataacaaagcagcaaggatttgaactagagccctcatatagtttatcaatctattacactttccataataattcacagttctatgagtatttgctgataacatttgaaattgagattagagatcttccaaataacatttgaaagagagatttagagcaatttttatcatatcctactgctttcagaatccaaactaaacttacctttattgctacttatgtagtataattttactgtggtacctttttcttcttatgattacatattattttctcctagcaattgaaacactttgcagatattacccaattaaacctctcaaatttccctttgaggtgatatgaaataactgttaatcatttttcccttctatatttatatttctgttaagaactatagaaagcttagtgaactaatagtttatatataattagacttcttagatttaaaagggaacaaattctcatatcaccagggcagcctccattaaacttatataatagtaatagaaagggagaagcttacaaaagatgagaaagctggcatgtggagaaaatgtcactgttatttctggttataatagtaggtttttttttcatactgttcatggggttctcaaggcaagaacactgaagtggtttcccaatccctactccagtggaccacagtttgacagaatgctccactatgacccgtccatcttgggttggccctgcatggcatggctcatagcttcgttgagttaaacaaggctgtgatccatgtgatcattttggtttggtttctgtgtgtgtgtgtgtttgttgttgttgttgtttttttccagaggccatgggattgtagttcttgcttttgtctgccttctgatggatgaggataagagggttgtgaaagctttctgttgggagggacggctgtgggaaaat

SEQ ID NO: 43203 - DNA, 1042 bp, Bovine  19866880859389
tttcttatactcacttgtatagaccaaaaagttaaaatcttgaaagaaaacaacatattaacatattttactaatgtatatgtcccacaggcatacctttacagtttgtgtctttactgaaatatgaaccagcctatggttaaaatgactaatttgagggttatccaaaattaagacactatacatcaggcaaggaaaaactagaaagtatttcattcatctgagtaatcaaaaactcttgtttgtgactattgactggaaaagtgtaattatatgaataaacattttatgatggggaataagaatctgcttgctccttatcatccttatagctgttaaatgctcaaaaaggagatcatctcattttctgttatgatccagtaaagtaactatagcgtatggagttcaggaagagaaattctgctgatcacttaggtgataaaaggtagattgaaagtctctttctcttgatactcataatattggcagagatattcatcatgaggctgaaaaatttaagggcttcttattgagagagatttcataatgtggtaattatagttataatgtctagagtcaaaaacacatttttaatgtgttttcacagatatttcactagttgcagtagtttgtgtttagtcggtaagtagcagagaaacagtacatttatttgttgaaaaatttacttttgagtatatgaggtttcatctttattttctcagatatttaatttcatatttataaatattaaacaacaaaattttctgaaactaaaccaaaggtaacaaagagtttaattttaaacttactaggtttccgatttaatttctctttatataagaactgacttttaaataatacaatatttgataagttactcttatactttgagaataataagaaattcctggtgattaagatgactattggaaaatacagattggagtggaaatgtaaaaaggaattatagttttctagaaatacatttttatttaattggcatttataatcattaaatgtaaaattgtttcctgggcatcta

SEQ ID NO: 43204 - DNA, 890 bp, Bovine  19866880870929
aaaagaatacatttgaatcagttctaatgagatggatgaaactggagccctattatacagagtgaagtaagccagaaagaaaaaccccccaaatacagtatactaatgcatatatatggaatttagaaagatggtaacaataaccctgtgtacgagacagcaaaagagacactgatgtagagatcagtcttatggactctgtgggagagggagaggttggggagatttgggaggatggcattgaaacatgtataatatcatgtatgaaacaaaaaataaataaattaattaattgattaattaaaaaaaaatctgttgaagctttggaatcaagccagagctcatttattttccctcatatgtttttacaggacctctttcttggtatattcattttatacttaggtaattaattttaatactcaatcagcaaaactatttctcctataagaatatcattgtttacatatgaataatttagaatatgattcctcaaataacacttctaaatacacatgtatttccagtgatgttacctttatgtaaaataagcaataatatttatgtaaaaattccatttatgccactatgaacagaataaatgtgctttgttgagatttattatctctaatgttgcatatatttcagtcactcaaacattactttggcaattgaacttagaaaaatatctgtggacagctgttattctaaatagacaaggaaggtaagccaaatagaaaggcagagggctatgaaaatccttaaaggtttctcagttgattcttttttcattaatgagtggctggtaatgatttatatttggagttattcaaaccaaacaaacaaaaaaaggaacatgttttgcccaataggaagacagtcatgtgcaa

SEQ ID NO: 43205 - DNA, 1753 bp, Bovine  19866880930286
tttttattttatttttaaaatttacaatgttgtattggttttgccatatatcaacatgaatccgccacaggtatactgaattgttgtgttggagaagactcttgagagtcccttggacagcaaggagatccaaccagtccatcctaaaagagatcagtcctgggtgttcattggaaaaactgatgctgaagctgaaactccaaaacttgagccacctcatgcgaagtgttgactcattggaaaagaccctgatgctgggagggattgggggcaggagaagaaggggacaacagaggatgagatggcttgatggcatcaccaactcgatggacgttagtttgagtgaactccgggagttggagatggacaataggcctggcactctgggattcatggggtcacaaagagtcggacacgactgagcaactgaactgaactcaactgaaacagctattcacattaaaaactcaaaaatgatttattttcatttgatgaataccacgacttagaacttgaaattactagcttaaattagctacaaagttaagctgaattaactaaatatagtaacttcatgccaaacatcatatttgataatttaaagatccttttattgccttagtttcatttatggatcctgggttttacttgagctgtcagaacttggaactcattttgttttcaatatattaccctctactaatgtttgattttttattttctgaatgttacagtggatcttgttttatttttctatgatatgaaatgatagcccaggttaaaatcaaacaggacacataatactaaaaattaaattggtctttgtctattaaggaaaactcaagtacaggtatgaaaaaatatgccagtacccacgccaggattcttagcctttactatactctataatacctgacagcagcttctaggagagactggattgacaggttaattatagaatatgtaaaactatatgtacagaaaacatatcaaacaatttacctggcactccaccagaaaacagcagacaacttttatttgaaactatttgaggatacagatcatataatgcatgacattgaaaactcccataacaaatgcatagtgaggctgccagcaagattactgattcacattcaaacaaaaatttatgggaagaaaaaaataagcctctatttacttcaaagtaaatgaattctcctattaggatgggctgtactactagtatgctgcacgatattcttcaagttgaatgagatcaccttcaagttttaccattatgacactgatgtcttgacataacttgaaaattatattctatcctttatcattttgcaccaaagagatgcatatactgacaaggaatttcttgatctactgtctttggtccaaggaaattttttttttttttcttctagatatctacagaggagttcaccttaccttgaaatcaatctgaacctttaaaagtagtcataagtaactcctgttagaataaatctatcttgaaatgataaaacatccaaaggacaattatatcaatacaagactctgattttcctgaaagccatgtcttcccagctatgttgttaatgtgtctggctaggcatgaccttgatatttcatgttattttgactataaatgagccttaaagaagtacaagacatatttcacaagagtaagaattgttctgttcatcttagccaaaattatttctccccactgttgtgccatatgttctgtgcagattgt

SEQ ID NO: 43206 - DNA, 1208 bp, Bovine  19866881091961
tttacttttctgcattgcttgcatttttattaatacaaagaaagcatctaaaattattttcagaaaaaaagtcattattcctgaacacaaataaaagttttcttttttttttttttttttaaacacaccttaattctaaaccaaaactctctctgtatacaaatctccttgaaggaagaatgtggaagacctgagacaaaaagaggaagaggagaagatccttctcctcactcaataaagtagaacagtcaatgacaggagatagattttggagttacaactcttctgaagttattagggagacgatactgccccgagcacagccaaggtagatactgacagggctattttcataccagtggggactaagtagtcatcaggaagccagcctaccagctgtgtaggagagattctgcctgagtgtggctggctggcatctcagacctcattaacagaagagggagagctgtcccctacacctgaagaagttaagtggctaattaaatccttccctgctgacaccaggaaacaagccagagggctcactttaacccctgtgcacttttgtaagcagcaacactgacatgagcaaagatcttgaaatcaccacctaaagcaaagagcatgagtgaggtttatatgcttagcagagtaattcttggaagacaagaaaaactaaagataagaaacttgtattaatgaaacagaccactttcaaagcatttaaaagaccacttcctcttttaaaaatagtaacaatcaagctatgtactctcagaaaaaagttactaaatatcttatatatgccaagtactgatgaaaagtgcagacaataaataagttaacaacactcagtatctattctgtagtagattatggtccagcaggagagacagacttgtaaactaacaaaactaacaatcacagtaatcacagagatgttcacagtaacagcatggaaggaatataagcacaaggtgatctcatggtatctaccaatctaatgctgccttttgaggacaaaatggagggtatacttgacttggacttagactttcttttgaaggcacccttccattcctatttttttactgacccccccctacccccgcttaagagtctcctgacccttatctgcccctttatcctaaggctggtttatatctaagtgataagaaaattcgggtgattgtacattaagaaactac

SEQ ID NO: 43207 - DNA, 1425 bp, Bovine  19866881178960
aatataagaagccattagaaatttttatctcagattgagaagattggtgtgtaaacagagacaagagcttataaacaaatagatcctagttcaaattgatcctagttctttcttcatataagaagatctcgggtaatgcaatgctatatggaatggaggttagacatctataaatgtattaaaatagataggcattcttgtactgaagacttatctaagaaaaaatggaagtgcttatctaaagaaagctaccatatgtaaactaataagtaaactttatttttaaatttttaagatttaaagttttacttctgttttctaaactatttgtttaacttccaatgttttctgttatcttctaaggaagaacttttttgctagacaaagatgttgcagagggtgagcacgagaacctcttagaagtcagttatgtccacggcttctgtgagcataggcttacactatgagcagcaaaacagccaaataagagctctctctctcacaccacttaatggatgcagttgcagatgttatcaagacatctacaaagtaggctatgttctttagtgttggtaactgaaacagctgttaaattaattaagtcagtatattttccaagtctgattaggatatgtttatttctgctttcacaaaacagctgcgatgtaagtagtaaaactgatgttttaagaaacctaaaataaaatcaaaatcatcgtaagttgtccagttcaagtaaaagcttacttttggatcttcatgttttatttacttataggaacactagtgtatatgggcaaagcaaaattttaatgtctttgtaagtattttcacatttgttattctttttaacatatagtatagaggactgaaacatcaaaacagaatatgatatgcaaatgctgaaagtggctttattaagcaaagaaggcaatccaagaaaaaggactaaacttgaattgagtattgctctgggtttccctatgttttatggtacagtttgttggaatataactgtagttacggtctgttaacaagaatctagaagcttatttgagtcatatgaaaggagagaaaaaaaagagggcacagtttaaagaaaaaaatctgtaacaaaaataagacaaaagctcagaggcaactcaactgctccagatgttctgcatctgctcacttgcccactggggaccacgagataaagagattaacacatttacacaaagatggttagacaacaagctcagataaggaacatgacagctaggtccaggtaccctaaccagagtatggagaaaatgactcactaaacctcttaactcacttacacatgatattttaattgatttaatgttcaaatgctaccatggtagactatgaactggttattaaaaaaaaaaaagtcactttcattctaactagaaacat

SEQ ID NO: 43208 - DNA, 1279 bp, Bovine  19866881486454
gctgataggtttctacgggaatgttagcagatgggttacctttagatttctgcattttcttacctttgaacagagcagttcgtcttttatctgttcattcattttcatactttcacacagaattgcttgaagaaagaacacccagatgaaaaataatgtttgaaatcatctcctttaaaagattaactttcttgtttttagcatgcacctgcatcttaccatatcctagcatggaatgatcagaggcttgaaaaataacagcttccacttggcttgcagaaatatcactaagttcttaggatagaattttcctgatataacaaactcattaaacaaggtacagaaaccactacagagctttttaattagaaaaaaaaaataaacaggaaataaaggaaaaatccttcagttatatttccatttttatcataattatggagaattcctgtgttggtaagatttctatataactaatgataaaggcttgatctgaaaaaaaaagaaaaaatctaagaatcttttagatttatgtccaggagtcaaacttgctatagatgaaacatttcctttttttgttcttccagaaagtgtgtaaattagcaaaaatacaactagattctgcttacatttcaataagagaatacttatttttaaaaattgattacacataaatattatgtacaaatatcaaagaaacaataatcttgagactcaatcacaaatcatgaaaaaaagtttttctttaaagcaaaaacatatatgtaagataaatagagataaatatacagttttatcttgccagcatatctgttcaatttattagttgaggccattctatgctatcaaaataagcaacattcatatcttaactgaacgctcagccatctatggcgacattatatataaagctcagtcaagcataaagaatggcatagggtaagctctttaattagttgagaggatctgttcgggagttctggaagacaagcatgtcagctgtagaattaatgtggcacctgaagcagctgataagtttacattgtagctatatcctaattgacagaataaacacctgccatcaacaggcgtatggcatcagaaacctgtgcaggtgggttctggccttagcttggccttttaatgaagctagagagctcagtatcagaaactgttgattcctgaccctgtgaacaatagcatgctatatctcacatccctactcaaagaagcacagtcaataaaccgccaagagaaatgaagcaggtttttgacctcaatt

SEQ ID NO: 43209 - DNA, 772 bp, Bovine  19866881858939
ctgaaaagatagaaaattactaaaaattaaaaaatcgttatttacataagtctgcctttaaaattgctttgtcaagtaatgtaccatgtattacagaaacctacagcgatattatatgacaaaatgagcgaaagagtgaaaagctttactttcctcagaattcctgaagcattttctgttctctaggaaatattgccttgatatgctaagtagaaaagcagtatgtttaagagtcattaatctcaattagctttattttccaccataaaattgttcaaatgaccttatgtgtgtaaattaggtataattacttccagtaaaggagctaagttcaatcatctgatatcttggagtttagccagtgcattttgtcctaaatatttcaaaccttcaggaactaatttaacatttcttttaacaaaatgccctttatgacacccagaatctatagaactggtgatacaccttaatttgtaatttattgtgttttgccttttcaacatatgttaatcatggcttcagttcaagctaaactggtataataagaggtcctgccaaaagaagcagcacaagttcacttcaaaactagaaaataatacaatggaaatcataaatgtgactgcttataaaagaaaagtgagaatttttaaaagtcatattcaatatacttctactatcttacttgtcttaataccagggcacctgtttacatactgttaagaaacttctgggacccacaacagatttcccaacatgggggatctggcaaaag

SEQ ID NO: 43210 - DNA, 711 bp, Bovine  19866882112951
tttatgaatcacatctaattaattacttagttgacgtctttttctttaacataatttttccatagaatcatacaaataagaagtatgcaaagaataacctgggcaattaaaatagagagtgtctgaaattttttccattcctattatgagtcaaaatctttgcaaaatatttcctatgtgcttgttgtcatcatctcttaattctaagctccctgaaaattcatcgtatgttggatttatatcactaattataaaaataaatatatatttctctcaatcttatcaatctatattttatacaaagaaagtttagaatttagagtaactcagtaacttctgtcatcattttgcatctaattttatataaaagaaaatattatcaaatacagtaagaaatttaacatcctatttcaagacatatttcccccgtggaacaaattccctcttttttttctgagtcaaggtagtcagaagggtaaacacagacatatgtatgcacacaatggtacacagatatgttaaaaccagttttatgatagattacaaacaggttgtacaaaattttatttttaaattgtccaaaaatcttatattaataaaaatgaactgtgactcaaataagtgattctatagaggtatatgctatttggtgtacaaggtcagtggcattcagggctctctgaactaaataaaaagaaaggatttataaat

SEQ ID NO: 43211 - DNA, 1069 bp, Bovine  19866880413156
taaatgtggtggatctgggttcaggagaaaaggggatattgattgattcatctctccctaccctccaagaaaaaaaagggagaacatttaaggtagggcaagatccactataaggcagggagcattaccttgggaagagcatctttcaaggccacccatcatgtcctgaacatctaccagcatgtgggcaatcagggaatttacacatcttcagatctgctgtactgtctgggacatctcctaccatttgtacctaagatgttgaaaatgactcttctattttctcaggtagctgtgggatgatttcaaacttgaaaaaatatattgaaggtaaaaaattacctcctcttcttcctcctccttctgctcatcttcttcctcctcttttttcttctcctcatctccctcttcctcttcttctcctcctctttcttcttcttcgccttctctctctcttttttttccctaaaagactttccattccaaatcagtggagatagtctgtaaaattctagattttgtttgaatgttctcttccatgtagaacagcattctttctctgttggcagaagcagcccttcatctaggccaaagcatggccataattcaggccaacaggaacaatgggtttggaacatattgttatttgttaccaggacggcttatagcacacgacttaccctaaacaaatgaactctaaaggtttggattaccgagggccataaatttaaatgcactcagcttatctttgttggggcttacctcttcaaagacagtctcctactttaactcctactattatctggttctctgttttagcggagatttttaaaaagcctggacagactgatgcttgggaaggttcagatgctgaacctctataagggagagagatctgagagcaggagcagcatctctgccagcaggggtcagccctgctggctgctcacagcaggtaagttgcttggcatcacagtgtcaagagtatggccttgagagtaagtagacttgggttgaaattcaggaacttcagcgctcacactttagttctctttttcattattttctt

SEQ ID NO: 43212 - DNA, 1645 bp, Bovine  19866880457262
gcatgctatcaatgggctcagaatgttaaaattaatcagctcgactctctgtgtttagctgggctgattatataggtcctggaatgtgaacatgtggtgacagacctgagaaagtaaagtaataggaggccaatcccagcaaaggccagggagacagatcaatttgcaatattcttttctgcacccatgcaacaaagcagaaacatgaaagcagaacattaagggatgttccctatgaactggacaaatcaataaacatcagtggtaaagaaaaaaagtcgctcattctcttgagtaccccaagggcatttccatcttgggaagtgatgagtcgcggtggcctctgtcatgttcccttcgcctacatggtgtcatcttctgcttgctcaaggtgaacattgctaagcatcagctgaaagagggtgcagggggaagtgtttaaggaaatgactgcctcctgttggagatgtgctgtgctggctggaaggcggttggacgactgagtctgtggcctcagggggaacactgaaggcagggttcaaatagtaagatggtgggttcccctcttcctcagacattctgaaagtaccaagtgagtgttttctcctgtcagcgttgatgggctatgtaatattgagggtcctctttattttcttggacttgagtcagtgatggagagctggaaaaatagcagacaaaggatatgcatgaagtggcttagagatagaagaatatgcctgagtctaacaaaggctattaatgacgtgataccagtcttggcttcatatcacagaaacccagatttcagcatgggcatgtgcaagtgtggcatgcatgtgtatgagagtgtgtacatgcatgtgtgtgtgtggatgagaaaaaataggacaagcaagaaagggactgtcagggtaagcactttctgaaacttatgagactgtcagaccaattcttttctcttctaaatcatttcccgtgaaacaaggagatgattatctgactgctagaggaaagcgggggtattatatttcatttggggggaaatgtagatttatggcagatggaattttttttaaaccaacaacccaacaatggcagagttcatagagtgagttaaagcgcttgcctatattttgtgtttcaagctgatgggatttacacacatttgtagtggtttcaggggctgtgccattggagggactcttgttcaagaagtacaaggaagtggaaagaaaccatcttgtacctgtttaacaaaggcagtgcttttccaactatttgcccaagataatctgcaattagagacatctgctcactgggaaaatgactgaagtggattttgcaaagaaagaagaggttcatttattgacttatttattaacagggcatctattcagtgtcagacagtgtgccaagcacttggaatggaacagtgcaaccacaggtcctgcctgcaggaacctcccagcgagtggtgaatgtgggataagtcactccattgtaaagtgaaatgtatttcccaatggaggcccatgccagatgccatagagcccagggaagaaaggggtaacctctcttgggtggtcagagggagtgagtcaagaatgcgaaatcaccacggcagtgggacaattctggaaaatgg

SEQ ID NO: 43213 - DNA, 796 bp, Bovine  19866880463185
cttctcctgcaatgaaagtggatcttctacaatgaaagtgctgactgtagagattttgttcatttctggtctttgtgacttggctggctcatgggaaatttaaaaagtagctgcaggctaggatgtgtgtgggtgtgcatgctaaggcacctcagccatgtctgactcttcgccacctatggagtgtagcccaccaggctcctctgttcatgggatcctccaggcaagagtaccgaaatgggttgccatgcgctcttccagcagtttaggatacagcttttcaaatagctggcatggagagtgaataatgcagccatgctgacatgggagatctgggcccaggtggagttactatatattcgcattctggtgtctacctcaggcttgggtccttttcagtagaatgaagtcatctttcagccctgctcacccctcagtgagtctctttaaccgatgaaaaatcctcttggtggtcctatccttatctactaggaagctcttaggccaatggccagtaactttttttttttattgaactatagttgatttacaatattctgttagtttcagggacagtgaattgatggccagcaactttttacttctaataagtgaaacattggatgggtcgagttcaccccatgcaagttccctgagttgtatccagctccagtacactggtcctaaccctgtgccaccttctttcactcaggggagcatattaggatgtatccatacagaggaaatcctgaatcttctcttcagtttgtaacgagaagaatcaatctttgcaaag

SEQ ID NO: 43214 - DNA, 1336 bp, Bovine  19866880464578
tgacataagctgttttcctccatttcttttgggtaacccattcccttcccctgttaaaaatggttctcaggaaaggcccacctgtggttttgccccacattatgcactgattgatgggttatctttccacagtctacttgcttcttaagccttgtctacggtgtgacatggaagagctgtctttggtgagaagggctattaggtgtaattttttgggagggactctgaggctgtcggtcccttcctgggcccccagacctattgagcacctaatctgctttgcttacactgaaggccagccctgataatcccagctccacctgcatcaccaggctgtcagcaggataaagtgggatgatggatggaggagcactttgaaaagttaaaagctcctcacaattgtgagttgttattgttattaatccacagtgtcagagagacactcctcttgaaaagagtcccattcctgaggagactgggggcagtttgggaggaggtatcactcattggtttcttgttcttagagcaacaaaatcacccccagtgcacatggagtgaataggatgaaaagttgttcttaaaatcagcacggataaggggctcccctctcccgccccagagcctctaaaacttgtaaactttgctttggcaggttcattgccaagtgacagggagccaatagccttccttctccctctctgttcccacatctctttctctaccccctctcagttacttcagaacaagtctcagcatggagctgatcatcagcttctggaaagctgaactggtgcctaagtatgtggcttggctgagtggggggaggagggcttgcttctgcaggaagaggacgggggtgcaagctggggaactgggagggaacgggggccttggtccaagtttgtacactcactccctggcctgtgcttctgtattctgctcacagctcatccaggggtggggctgggagaggatgggggtggggggaggcaggagggagggtccaaggcagtcaggtcctggggctgattgggattctgactgttggtcagattttgttagatatgggtccagctgctggaaaataaatcaggatgtgggagagaggccagtgggtatttatggtggtgatttgttgtcttacaggaaagagctgtttccgcatctctttttcaggtgggagtggggacccctgctgcctttccctcatcactggctgttttcataggttggggttttggcaagaagacatgtgttggctggagttcctgggactgggttgggcagcacaaggggggcccctgagctggggttgagatgctgtcctctgccctca

SEQ ID NO: 43215 - DNA, 756 bp, Bovine  19866880668031
tacattttgaaatgcatctagtgttatgttccatgaatagagtctcactcttttccttatggggagtggtgccccgccatctacccaggtgctgcaaaagttccaggtggtggagaggctgacaggatctcgccacgcgcttagacaagggcagggtgtccctttgctcactggagcatatggctctgtacaagctcttttgaacagcccatgccctagtttccagctcagatcactgaactggaaatgtgcctgtccacggagactttcaccttagatggcagtcagatgccttcttgtcttttacatctctccttttctctgatactttgcccttgaaagcaggcttctgagtggctcggttgttgaagctgatgaactggtgggtgcccagatgctccaagcagtaggctttctgttttttttttttgcatgtataaatatctttacatgtaaagtgactgtcagcatgtaccttggctgtttgcatgacaatgtgaagtaaaagatagcagagactgtgagaatgcctgcctggcatcacactgctgtggcctggcctgagaagtggtaccatctctaagacgttccaacatttcaggctgtgggaaccatagttacaagcaccttttcacaaacaaggagactttttctgtgaggaggaggtcagtaatcaagaagctgcgctcattttgagcacaaaggtgtctccttgacatgaaaaaactgtctggattttcgctttttctcctcctg

SEQ ID NO: 43216 - DNA, 853 bp, Bovine  19866880757145
ggactcacttctgctgggagctggtctagcttgaagccctcttaccgcacgcttgggtttgtgcttcttaacttctgcttttaaactggcagccgttttctactgcatttccaatgtgcctctgtgtgtatcttggagagagggagaaagagaatatatggatcaatatacgcagacccttaaaagcttatactttatcattgtaataatcataatatattttattttacagccactcataactgaagcctctgggcaccctaacaaaaatagctaaaagaaaaaaaaaaggaaattatattaaacaaaggaaatatgactataaaaccccaatagccagggaactaaatgaacaacataaaacctccaaacaacaaaactacaatgaaaccaaggggggaaagaaaccttttcatgagctttaccctgaaggattccatgctgtgagatcacatctgtttaaagcaccataatttatcgatatgacatcaaaccaggagccagccattgtaaacctttcccgcagaaactctcagaaaactaaccaggtggtcaatggggtgcgggtgggggtgtctgtagcacatagctggggcaacaatggctttaaaattttatgttcaaatacatctatgtgaagttccagatctgagcactgagatgcaaaaattagttcattccataggtaagcaaaatttacaaacaggactttttttaaacagcaattttttttttctgagatagttcatctgttaatactcactgatgacttctcaaagtgctgcatcaaatggaccattttcaagaacagatcctctctagaatgagccactgagtcccaagttatgacagt

SEQ ID NO: 43217 - DNA, 1035 bp, Bovine  19866880832343
tcattgttgaggcccattccagacccattccagaacctagacgagggtggtattgctgccgtacagaagaggaatgttttaaggttaccatttccttccccaggggaccctcccaacctagggatcaaatccaggtctcctgcattgcaggcggattctttaccatccaagccaccggggaagcccatgttttctaacagcaatggctaatttacaagttgccttttcttgtactgctttggaactactttgggactcttgtggactagagagatacacagcccctcagatggggtagggaagtaaggggtgagcttaagagggcaattgctatttatatacttttgattcctgaaaaatttttttaaatgtcaatggtcctaattgatgtcaggatgttaggagttcatattcatgagttataatatactctgcacttttcatatgtttgaaatatttcttaataacttgttaaagacatacttccttcttttttaagtaactgaaactgtggtgtggggcattctttttttatcatagaaatgatatttctgtgtttacctgagtgcttccatgccgattcttttgtctctctctctttctccttctctctctctctttctgtctctctctcccctccaaatattctatgggatgctgcctaaacagctttgatgttcagactgacttatgacttaaatcctaaccgccagaagcacggttacttcagttcctttaaacgcttcctactggcgggtccgctgtacctcggaattcccggggtcctggacttcctgctgatggcacagctttgagctctctttgctcaaggacaggtttgggagagaactctccctagctgggctggaaacaagaaaaggactacatttcaaaggaaagggggaggggaggggtggattagcctcgcctcaaaggctaaaaataatccggctttgtagacttcttcctccaactagcctgggccggaaatggggagggggaaagacagggtaggatctggcatcttgttaagtg

SEQ ID NO: 43218 - DNA, 3145 bp, Bovine  19866880930492
aattcttttctcagaactcagttcaatcagcattccttcctagcagatttctctgtcctccctgactagatcaattgtaacattttaatataactggctctagctctcagttacttacttctgtgtttttattctttctctctttctccctatcccctatatccatttaatttctatctccccctctagactaaactctaagaacgcaggaaccatgtctttttctatgttcaacaatgcccacttaacacttagcataattcctggtatgtaaaagctgcctaataagtgaataaatatataaacataaggatatatgatttgctaattcatttttactgagttgaagttaaaagcttcttgggaaccagtgccagttgtcttttttttttttttttttactgtattcttgaaatactgaattcactactgggcttatcgtgggcatcttttaaatattagaaaaatgacaatcattttttctgactgttctgtttgagaagactctaagggctctctctgtataaaaatataacacccctctgaagttatttgccttatccttgtactccctgagatccccagctctccccagtagctccactaatcatgaactctcccatgagagaagccctctaaaaatgctgtctttgtttactgggtgattttgaagcctagtctcttctgggaataaaaacccaaactgaaacggttggagtctgcccactgggaatttaaaccacttgactctaaggctatgatgacaggaacacagggaaaaatagatgagattctgagttgcaagaattccccaggactcactggaaagctacctaaggacagagggggaaaaaaagcccaaccataataattttctccaaagggccatactggggacagtgtcctgctcagttctttggttatagtttttccacctctagcagttgcccctgaatctggtgaagaattgtggcaccatcagtccccaagtcagtttgtgggggggttgtacttggtagcgccagtgctacatggatttttaattttccataaaacactgtctcctaggcttgaggtttttagaggatgatgagatgggcaagatgggcaataaaagaaagatatgatgttgctcaggattgttgtcattattaattccctgtcctttaacccataggtgaagtgtcctcgtcaaggactttagctgactagggtactcccctgtctttgccagatgggggatgtagaaacctaaagggatgtattttttcagtgtttacactgcatggaagtttccttaaatatataatcagaggtaattagactctgtggtgtaagaaggggtgtaaacactattgacatgctggtctcagaataggcacatctgacttgattggcctttgacagttcctgattttcaatatttttgatattttgggaagcagatgtgatgagggtaaaaaagtttaagcttgagaataacatctcttggttccaaaataatgctgcttgtttgcaatcgttcaagtttttaacctacagagagacacaggctcggggaaagatgtctgtctggggcctagtgaatcaggcagtcgaggtggcaagattctgtctgcccccagactaataagcttgctataaagctactgatgttctctgccacaggggttgacatctttcctctggggtgaatatttttttattcacccctttcagtcttgagacagatttgatgtcatagcgttttgttgtgcttgtcagcaaactgttaagtcattctcttagtattgtgtgacagtataaaacatgataaccataaaagattagtatgatttttaataattccaaaaggaaacaaatggtgtttcctctctttgatgcatttgatgtgtttcagatatgtttcccattgtttgcatactacaccagcctggagataggatctgggtattaaactgcatttatttcaaggcttggtgccttgccacagaccccaatataaatgcttccagatctcactgcttttgctgatatagaacagatatcagcataagcagagcttagcgactaaacacaacaaatatctattacttcagaagatatagtttctgtgggttaggaatttgagagtggcttagctcagtgacctggtatcttatgaggtcataaccaagtatcacttggggttgcagtcatctgagagcttgactgaggctggagaatcagcttccactgttactcacgtacatgaccattggcaggaggcctcagtttcctagcacatgggcctctttgtatgactgcctgagtgtccttatgatggggcatctgggtttccctagagtgggagaaggagagagagcaaagagggagccacttcgcctttatgtcctcgtcctaggagtcatgctgtgtcacatctaccatattctgttcctatgtcactaagttcggtttagacatagaagaagtgaacaggaattatcttcatcgtgtgaagataagagtttcagggaattggttggtatgcctcaaagctatcctgttgctgactataacctcctctacattgagatgtttatttcttgtgtgtgctgtgaggtctcattactttacactggtcctgaggatggcactgtgatacctccatctaggagcagaagctagtttataaccctctcctgaggagaagccaggctcaccttgcagggaacctatttgggctaaacctcagtcttttattttaagaggctttgtgagcagtctagtttgtaggactggaaaatgtcaactaactttctgatgaactttctttgttttgggaaaaaatcttcaaaattaaatttagttatccagaagtttagcagatcccctctcctgcactgtgctgggaggaggtggaaactcctttccaaggactttacgatccattcttcccaggtagtttttgtcaggactctatgcttccattaaaatttgtgccctaataggaatgagttacaggctgttggaggggaggaggtggctcaaagatctagatgcctgatggacttaggacaccagggcccaagttgtccttagaaagggctgactctggacataagcctgtggccaaggtttggacccctcctgactctgatgt

SEQ ID NO: 43219 - DNA, 879 bp, Bovine  19866880946057
tacactgacatcttcatcagattatattccctctcatgcaaatcagtggaatccacttgcagggaatttgacagcaagtctttcagcaaaggcaaaggagaattattcagcttctttggctcaaaagtcaacgtgagctgtgactagaatggagaggaaataaaaagcaagagaggcatccgtagaatgtaaggtcctttcactggaggttttcattcgctccctcacagtggcagctatgagagcaggaaaatgttgaacttccgccttaagtgtcattgcctatgctgttcagggaatcagggagcttgagaccacagtaccctcatcgcaccgtgattgttaacacacacacgccacacacaccattgagactgccactgtttcctctgaatccagagctggctcctctactgagaatctcttccctgggagaggcatcaatggaggaaggaaattgtctctaccgctgggtttgttaccagggttccctcttttcaaggctcgccacagccgtgctctgagagacactgctctgtgctcccctcattgtcccactgcaccagaaacaagcaacagcaaaagaacagtcattatttgtatttgacaagaaaggcggcagtaaaaaccaggaggcagtgggcatgaaaatgtcagactgaggatcggaatgaggctgggacagcaatcacagaggagcagcctcagtggagaggagcctcaactacaggcagacaggtaagtgatggagaaggaaagaaagagagagacagtggtggggagagtccacaacacccaagagcaaacaaactcaggttcaatgctgctgcactccagaggtacagagcacaaggctgaggagcacccagaccctcaagc

SEQ ID NO: 43220 - DNA, 1117 bp, Bovine  19866881061701
agtaaaagaaagcgtattatacatcagggtgcatttgacagatacaagtgattatactaatagtgggattatttccccacatgtctaatgtatttaggcttctttcaaatgaaatgagtttaaaactcatccctaaaaatgaaatgaagtctttaagttttattctacctacctccttcttttatctggattttaaaacctttttgtttttaatgagagtgatattgtgctgcatataatttactttaaaatactttgatacaaatagcttgattttatacttatatatctttatatatatatatgtatatactcacacacatggacttcaattatctttgtaaccaacactagaggttttactttttgtaaaaagttttactttttggttagaaatattgcagtgaccctccccctttgcataacagaacataagaacatatatactcatacacatatattcatatagctatatctgtatctacatctacctatctatatatctatctacttctctgtgtctgcacaccacaaaagcatcctcatgttggtatgtgtgatgtgtatgtatttgtatatatgacctatatctcaggtacagtctgttaccctaagagggagcatacatttctgggcaagcagttagtgttttgaaaacttcttgttagttagaagccaatactccagatgtggacttcaattatctttgtaaccaacactggaggttttattttttataggtgaaaaaaatagtgttcaagatctgtggattggttggaactattgcagtgaccctccccctttgcataacagaccataagaacatagtccagtggtccacaccttttcaaatgatgccagatgttttctttggaaatgatcctgtaccagccactgattagagaattctggtcccacaaatctaattataaaatcagctgaaacctgctgctagtctattgttacatcttcctttggcgaacctaaaactttctacagggatgagagctggaatgtcatgcttacagacttgggttgtgtgagcattttggagcttgcttgctaagtgaatgagtgtatattggggaatttgtcgggactaattttatgtaagcaa

SEQ ID NO: 43221 - DNA, 881 bp, Bovine  19866881065237
cattagctctccttgggctatgtgttggtgatacacagatgagatgttattttcaaccttggaaaaatttgctgagggtgggtgaagcagttgaggtgttttttcttttttcttaatgatgataaaatattggttctatgacagaggcttgtacaaggttaccataggaactctgaagaggagcaattaacccaagtgctcttaaggttgtgggagggaacagtaggcaatgaaggtagaaggaaagccgggcttgatcctccatggaatggcacagggaaaaggaaaagcaataggaattaagagctggatcaaaaaaaacatgatgatctgcaattcttccctagagcatgagcttcttggcatggggccttctatctatagggggctccgtaaatgtttgtgaattaaacaatgaacagaacgcctttggaacagaacgcagacctacaagaccaaggggcattgcttcctaaatattatcacagccttgaatttctcattatgactctctgagtagtttaattaataattgctaagggaagaggagagcaaagtgataattaatagctattggctagagccactgctgaattaacagtccaattacaaaatgaacaaaccacatccaaaaagaagcatgagttccaggagcaacaaaagctcatgggtaccaaggaccctgggggatttcttcatctgagcagctactaggtgaagtgcattccgaacagaatgaatgaagaaagggtaaatgtgaatatttgctgggaaatgactccctcaccatggtttgcacttcctagaaatgcaaaatttgccactgggttccttttcctcccaaccaatagcagagattaaaataaaaacagaagacaagg

SEQ ID NO: 43222 - DNA, 1486 bp, Bovine  19866881263624
acggagtttatttaagatcttgacagcgcccaacagtacaagtccctgaggggctgggtgtgtttgtcttgtccccactgtaattctaggcctgcacaactcctgtcgtaataacaggtgattaattcagactcggcagaatgaagagatgaatgtctgagagtaactgaggagtgtccaggctatgaatcaagtaccctgatggtgagttcagccaatctgccatcaattcttccctagtactcagtgcctgtggttagaagaatggagaatggtgaaaccatcccgcataaagggtcaaacacatataagagaggatgagacagatgagagactctaaaagaaatagcagcttaaccttttgcatccttattcgaatctaaataccctgattttgtttctcctcctccaaataaaatttttgtaaaatgagatcttgaactgaaaatgaaattagcactttcaattaaccagaatttaaaaattcttcctgaagatacagcaaaactacaaatgaatcaggagagagaaaacgtttctgccacccccatctatgcccaaaggcaatattaggggctatgtccctaggtagcagatttgaaccaatccaatgctaatctgtacttctaaaaatttatttattgagcacctactgtccgtaataccctttaagtaccacagaacacagaaaacataggcttcagacttacactacttaaaatttagctgagaagataagatacttgtgaaaatagctgtaaagcaccacaatgactgattcaacaaggcaaagcattaaaacagacaacttaaggggcagaaaataagtgcccactttagaagactgcattataaatgtccctcttactaaagagagcaaaccaaaacacaaaatatgttcaagagaatcctaaataataaattatatttttaatgggcagctgcaaaagtaatcataaaaaaggctaacttaaaggtattagccatgaaaagatagattcgaaaatttcttacagaggagagatttttcacccaaagctggtaagtactaaagaatgtattgtttgctttttatgttaagtatctgttcatgtattacttttatagcttaaataaatatttttaaaatatttacgaacaaagcctgatttagttttctaattgcctcctgaagtctatttgggatcctctttcaacattcttcatgttaatagagcacattaaattgcatttggacaaatgttcagaatggaatatttgaataataaccttcttatgttttgataagtactcattcacatacgtaagacaaagcattacaagttggaatataaatgaattctgacacatcaaaagcattttctttcctctgatattttatctgtttgtggtctggattttgaaatacaggagaatgttatcatgaattccaaatataattatgtgtttctagaaaagaaacgtcattatttgatagtacaaatgg

SEQ ID NO: 43223 - DNA, 1196 bp, Bovine  19866881271999
aaaattcttcgacagatgggaataccagaccacctgacccaccgtttgagaaatctgtatgcgggtcaggaagcaacagttagactaagcaacagtttaggccttgtaaattgcatagagtaacttgggcttgaggtgggccaagtcggagaggaggtttccaaactccataccaccagatggatgtctggaatagaaggcttcctcctgctttccaggggaaaacatcattctggttctctgtgctttgaacccatgttagcaagcagatgccatatttactagaaaagccttgggtggacacctggacagctccccttgttaattcttctttgctgtggggttattattcactcctgtgtactttggcaggcactgagcgtgggaattagacacttaaaatgctctcattccatctgaaaaccccttttgtggccaccacctcgccatagagcctcctccatcaggatttttgtgtggggtgggtcatgcttttatagggtggtgtctttcagggcaagtctattaggcttgtaggatgttttaattggggcagtgtaattgcagggtgccacaagggccctggcaagggatactttataaatcagattattatgcttagctgtgttaatgggcatttatatgccctaaatccttcatacagcaatgggataatagcccttaaggccatagttactattttgggttgggcccacttgtaaaacaggatcattttattgtgaagctgttttcagttagaggagtacataaaaccctttgaaagacagaatttcaattttgtggttgctatcttatatcgtttaaatggtagagccactgtatctgtgtatgtgtaaaaatatatgtatataaatattttaaatatatttaaaaatattaaatatttaaatatacatttatttttaaaaacttagaaccaaaaagttaaaattgtgctcctgaagcaagacttcttaataatggagacttacaaaatcttaatggaatttggccaaatgtacatcctttcccctgatcagtaataattttaaattttggggagaaagattctttttggttttgtgatgtgtctcagaggttctaatctccctggaagaccttggtctagtgacaggcagtggtgtggaggatacagactctgtgggttacactgggaaatgaacactctggcgtgt

SEQ ID NO: 43224 - DNA, 812 bp, Bovine  19866881312695
ccccattgaaaaatctcccagcagacaaaacccagaactaagcaggtagtctgggtggttgaatgactctcttcctattatctctttatgcatttcatcttcaaagcattgtgatctgtcttcaatacaccctcgggtgtgggatttacatttttaatattggcatttatgacgtggtgctttttcctggttaattggtatcagagcaaaatgtttgcctctctcttgaaataaatctcttcaagagcttcaatcacacattcttttgttctatccctcatttgaaatgggctctataatgccgctacataatcttttgcctctcacatttttaaatctgggggtttatgctttaatagctttgatatgtgtactctttagcctgttacttaaaccgtgttcctccctgcctgacaccccactccccctcagccttacaagcctggtaccctctgaggctgaaaggatttatttatcatccagaatgtttccataattttggaagcatatgtttcgaaattacattccaatatctcatactatgttctttgtcttgcatctgttctgtaaaaacaaataaaacgcacataattatattccaatggctgcagagccctatgtttcccgcaagagttggttcttccacaaacagtaagagtcacacaacaaaggcacttacacccccctgcgacgtcatccaaatctcattcttgtgttaattagagctaaccagtgataatagtaaacttccaccacgtaactgggaaactttgactcctttccaaagctatttcagttttacaggataatct

SEQ ID NO: 43225 - DNA, 1521 bp, Bovine  19866881608246
cctctgtttctgggtgatcgctgttttgaaatctgacgctccccgaatgagttcccctttcttctctaagctcaaaagatttcaacttcctgactatgaccaagccatcaggatagaatctctcttcatcatttggattgacttgcattcactgataccccactgtaactgtggatcatctctaagtgtcttattctgtttaatagctacatcattgtgcttttgagttggcagaaagctcaaagttagccgtgcacagcaaatggcttatgaagtaatattgaccctgatgtctgatcttaaatcccaaagtcagtgctatttagttttatcatttatggattcagtccacaattacagtagatcaggcaagtctccctgaaacagtccctgctttaagagttagcctttaatttgaaggtattttccccagctggaagttgtaataatgctccattccatctggcaacacaacaaagaactgtaggatttataaactgacagatcctctaataagtgtgagtgagagatcaaatttgcatccttttatgtcactaggtaccacatctcatcacctattctgactctggggccttattaatagccaatttgcacacaagcattggcatgatgaccaaagtcaatcataaccacaatggaaaatgctccaccagacaactacaaagttcatcagcacccagaatgtacagatacggcaagctgtgaaggtcacccacctgaacatgccacctcctaatttctaaagattgacctgtctgacaaactagaggtttgagcccttcctctctggtctacaaacatccctcatatagcagcttggtcaataaagcaaattactttcccaaacagagattgacaggagacaaaaatcaggggtgtttctggttgatttaaaagcattcatggaaaggtcctggtggtaaatgcattttgtgcccattagatcatgtgtggtatggagacaggacctacaatccttgtgttgacatgtaaggagatgtccattagagtaatcctctggtctcatggtcatgggccaccccttacaaataaaatagttcatggatggagggtgaaaagtatcagttcacactgctaagttaggagaaaactatgaaccctaaaatttggtctctttcctctcctctttcttggaccagagtattgctgcaatcctagatgagtatataagctgtgaaaacgttaattttccttcaagggggcattcttagggtctagactggagagaagggcagcagaacatattaacaagcccatctggttgcatatttatataatggctaaagttaaccatttgatttccatctgactggctcctgtgttgatcttcagttggctttgatttcaggcaaggaagagaggagtgttatttatgggctcctttcaaatcccaacagcttcattacatagccataggacttgtggtaacattagttgataaaacaaaccaaccccaacatttcatagactggaacaaca

SEQ ID NO: 43226 - DNA, 1597 bp, Bovine  19866881793516
ctcctgtttataatttacccaaggtttcctgacttggaacttatttctcttttcccgatggtgcaacattctctgaattgtcacataacacatcaggaggggcagaagcctgtctgatcttctgaacagtaataaacagtgtctttctagaacccctgaatctggcattgtggtgtcttagggagctttgcaaactcatcagtaccttgttaaaatggggttcatttctgtattatggatccctctagaagctcaaatcatgatcctttacatatttcatacaataaaagtgcagtttcacaagatctgtctaaacggcatgggcttatctatctaattcacacctgggctttgtgaaacgccttggaacccactttataaatgttaagcgattatggccttgggggtggagaggatagaggtgcaagaaagatgctcattgcaaacatattttgctcagaggcttttacgagtaaataggttctcctccccaacctctctatatttcaaaactaatcttgtttgaagccctatagatggacttcccctccccccctttaaacatagttcaattcctttcttctaagctcctcagctcccagcgcagctttcattacagcaacataaataaaaagtgacataaaattatacagccctgtgtaaagtagtttaaggaaaatgtcttttatggcggcttttatggtttcaccaattagttattagattttctccatttttaatttgatgtcctgggtatgcgttctgaaaggtttcctccccctttcatctcctggcagtaataaggctggggggccttgagcccccgttgaagctgactttctagttttgcgaaggcctttcactccagcctatttgggccaggcaagttcctcaggagagaggccagggtcgaggtgttttcaagtgagcagagttttacccccttattaacactcagggtcccctgcagctcgtgaacttgcctcccgctgagggtagctgcaggctgggctcaggtttgcaccctggtcgttgcaccttaagctgataaatcctgagtttttagtcactttccaaacattcccggggagtgagaataacagagatttactcctgccaaaatttaatcatgcagaaaaagtgaaatttagatcagcgtatagattattttttaatgtgatcactcgacggaggaggcaaagggagccagaagttgagcacttagtgcagctgagtctagaccattgcaatttgattcatttgggagaattgtattaggttttaggctttggcttgggctaggctgttctctttgggagtgcatgatgtcattgtgtcaagcgtgtcacggccaaggcattctggtatttatgttggcttcagatctagcccagagtacatggcaggctcgatttattgctactttaactttgtttagtcatggagaggctttatttatgttggtaaatttcaaacagtggccaacagtgaccgcacaatgaaaaggcctgcaagattcatcatcgataaatcaccttgttgctgagtttctttaattaaggaaaaactccgtctgttgatccctgtggttgctgga

SEQ ID NO: 43227 - DNA, 784 bp, Bovine  19866881924829
agaatgtgtgtatttcccaaggcatacccatcaactctcccctccaatccaatccaatactgaacatgcaacagtcctaagtgttttaaaacaccagaattagaatagtgtgttgcattttgaggttaacatacaaattcttgactttaaaaggcggaattttcacaacaaacatgcgttgctatagagacggtataagcctacataaacttcaggcattcatattcatagaaactcctgaagcaagaccaaatgttggccctaacattcttgttcttgccaacttccaaatagtgcacaaattatgccaaaaataaatgggtgtgactaatacaagcttagaacattttttttttaattttaccttgagggcaatatttgttgatataggagctgggtgtgtaaagcataattcccccttccataaatccatctgttttatttacacttcctaaaagacctgcatgcacattttttccatgaattgtacaactgctagtaatcatgtatcatttcaatctgtgccccagttctattttaacaccgtgtctcttcctttttgtttgtgatccattaagcacatactagaggcaaaacagtcaagacttaactcttctagtcccaattacatgctccagggctgcagaactgtcaaccagctttgcatagctgacacctccaaggtctgcaagcccagggtaaatcctattacaagctcaaggatgtcaaattggtttctgccactgaccatctttcccgtgaccctttcccaacccttcaggcc

SEQ ID NO: 43228 - DNA, 1967 bp, Bovine  19866880415770
caaaggtaaatatctgagaaaaataaaaaccccaccatccagccactccaagaaaactgctattaaatttgtctgtgctgttttcacaaggtacttgtatatcaaatcatctaaatgtccactttaaatatcttataattttatttgtcaattttacttcaagaaagctgaagaaaaatgttcatgctgctatttcagattttcttctattgttaaacattacatataagtagatatatgtgttttaaacagaaatagaatcatgttatatatcatagtctttttccttaaaaatctataatgaacatcattctatcattctatgtttgaaaaggaaaagttaatatgttattctaaaagtacaaaaaaagtttcattgtttaagtcataaattcagatgtaagtgtgagtttctagtattggctaatttcaggttttacatattcagattctgataactacagttacatttaattcactttaagggaacacaaatgtgctttttctcttcttccactgatttgctttatccttgtttattttttcagattgaattcaaaagggactcatctaagaaaacaacaaccctctaggctcagtggaccatttttttcataaccctaataaccacagagaagagcttcttatttaatttatggtacaaccttggaccctgaaactgtttctttatccatcagttcagttcagttcagtcgctcagtcatgtccgactctttgcaactccatgaatctcagcacgccaggcctccctgtccatcaccaactcctggagttcactcagactcacgtccatcaagtcggtgatgccatccagccatctcatcctctgtcgtccccttctcctcctgcccccaatccctcccagcatcagagtcttttccaatgagtcaactcttcacatgaggtggccaaagtactgcagtttcagctttagcatcattccttccaaaacgtgggataaaaatattcccctgctctcttttcacaagtaacctaagattcagtcttttttttgttggtcataaaaaaatcttgaaaaaatgcagaatattatgtaaaaatgtaaagtgttattatccatcattaatctgtgttttttaaagatttttttttaatgtgaaccatttttaaagtctttattaaactcgttacaatatattttttttctttttcttttttggccaggaaacatgaggcctgtgggatctcagctccccaaccagggattgaaccatactccctgcattaaaaggtgaagtcttaaccactggacaaccagggaagttcttgttaatgtgtgtgtgtgtgtgtgtgtgtgtgtgtgttttaattcctttttatgcattcaggagttctactaaatactgtcatttatattttctcaatttttttcaaagaaaaagtgccacatctaaatgtaactatataaactatataaaacttgatttttttttttttggttggtttagtagaatttatctcacttagatctatttgggcttgtgccctgtatttactctgtcccttctgtttcacactctttggacttaacaaaggaaatgacagaaatactgaaaaagggggtcacggtatacattttttaaaaaaatgctcttctacagagaggaataaatccgactctattgtctttcaattcaggatcgttcctccattcgaggtaactatgtttgaatggccaccgcacagttcacatgggacaatgtcatcatatcgtagtgacatagtgaaggtttacaattcaagacttgagactaagataatcatgggaacatttaggaatgggtctaaaaggttggctgggcttctgtgacctctcggaaggcataggcagagtgggagccaagggtggaagctccctgagggcccaggaggaaagaagcgggagaactggtgacagggccctgatgggagggacaaagacaaag

SEQ ID NO: 43229 - DNA, 1408 bp, Bovine  19866880768662
ttactgcatatttgatttgtacttacaggaatgtaggggcccttgtatgtttcaatctctgctgtatccccagtatgtaaaatagcccctactacattataggcatgcaggtatatttttgcaaaaagaaacagaacacaagcaagtgttcaaatgtgaaaactcttttttaacaactttgcaaacacattgccaaacagttttgctctcaaggaaatgagtgaaaccactccatcatcaagtatttgtcatttggtaactgaacagattgatttcacaggttctgttggcccaatgaagcatgcagcattgaacattcagcaccttatatacactctgggaagtatagataaaggcaatcggaagaggatgatttttagttgaggattcactttgaaaggaggagttttataggcccctaaaattggcccttgagcatttgtttcaatttgttccaatccagtttaatttctaacacaactagccaaaaacattaataaaagcaggaagagatttctggtttccagaagtgaattattgggctgcagtcaaagctatcacctcggatgaaaataaaatgatttaccataagagaagagtttctgtcttctttcatccatggttaggaatagggggccatgtgggacaagtttgttcaggatgctaatgaactgccatcagatgctaagtcataggatgcaaagtgatggtctgaggaccaaatctggcccacatatgtattttatttcatctatgctattttttttattgaattatctgccaatatggaaaggcaggagaattcacaaagaactctggtttcttcttttccccctggggaaaaaaataaaaacaagacctgcagcagctctgggcctacaatccaaaacatggcaacatttaactggtgttgacgtacaaattcccatgactgcctgtttccccactatagtcccagccctgcctgtttccactctgagaccgaaaacagtttcagtttgccattccccatctccctgcattgttttctttcttacagcttgcctgtctcacatgtttattttatctaatgggaacctgtatacaactactgttctaaactgtcccacaaatgttatcgttagatttccatcctctggctgagagtgaatgcacaagtgttccaatttgtggccctaccttttgttgttccaaatcaactgactgattgtaatcatttctccagaaacctactgtgtacatgtggtcactgggagagttgggaatgggatctgcaaagggactagttgagtgaaacaatcagtcattttctgtgactgtagatacagatagagtgtcttagctgagcacctcatagtaacccactagtatctattaaacataggtggactcaataagcctttggcaa

SEQ ID NO: 43230 - DNA, 3239 bp, Bovine  19866881011991
tttaaaaagtttttttttaagaaaagcttgtttttcttacacattgaatagacatttaaatgaaaaggtaaaaattattttgaggcaataaaattatttgaagattaacctttgtaaattagatggaggcagaaatgtggttttaccatcacctaaaccaagataaatgctttttactctaattagaaaataaaacccaggaagtaaaactctagtgttattggtaggctaataaggtgcattaaacaaatccaggagactgtcatcagttccattttttcccctctcaacttaccctcttttcatgtggcatataccatagagaaggatgtaaagataccagggaaatggtgcagggagagtaaattgtggtcgacatttgagaaagcgtcttcactctaaagagagctggcacagccgagtgatgtgtgcttagtgagccagactgtaattctgttacctcactgctgtctgtgaaagtgctaaatgtctgcagcttccccccgggcaggtgattcagcaccttccacatcaggggccagatctgactaaaatatcactcttgcataaccagattactgttactgactcaaaacgagacatgatgctgtgtgtacatatcaatatgcttctgcatatttctttactggaatgtctattttttcacatgggcatactttcctacccagcctattttcatactggttaattatttctgactcttatgactttaattcgtgttactcacccttaaggacctgtttccagtcatatctgtaggtgaaaccagagaaggatagcacacacaaactgatttctggttttacttttaaaggcaactaatctctttccctattcagttattttatttttcttggctataatacctgaatgcctagttccagaaagaactatcaccaaacacatgtaatataaagtttttattaatgtattgggatggcatttagtgctgcaaaatcttgttactgtgacttgcagtgaagaacaagaaatacaaagaacaaggaatacaaatccactaactattgtaaatcacatagaggcagaaatgtgatttgtgtaaatatgtaaaatttagtctgttcatgtataaacacacacacaaggcatgctatggggaaatgagatcccttatacatgctcattcacttagccagccaacctcagagcacagtctgattaagatggctccaagtggttggacatggcagaggagcagctgcaagtgatggaaagttagccagtttcacaagatctgaagtgctgtttctcctcacaagaagcaccttttgagtatctattatgtactagacattgagaatatagcagtgtgaaagcaagagctctactcctctgaaagttatttctaatggaggatattcactaagcaaagaaagaagataattacaaatagtgattattgccatgaaggaaattaattgagaaacatggtcaagaataataaaagtgtagaggggagagaggctacttccaatagagtggttaatgcaggcttctctaagagatgaaggaagaggcagaattagccataaaaggatgaagaatatttcaaaaagagagaacagtaaataccaaggcaaagactagccttttgggaggcaaggaagagggatcagattggttggaatgtggacaactgagaaggaacaggtgtgttgtgagattgaagtcacatagggatgtgtaaagaatggtagacagttggtgttttaaatgcaatgagaaaggttttaacaggactgatctgtgatctgacagcagctcattccaatttttgaaaggacagagagttatgaaagagataggagaaaaggaaagtgaagggagtcatgaggagaacactgtagtcatccaagcaaaagaaatagtgcatagtgctacttggagcagatgaggtggagaagagtgagcagatgtatgatatgggaagcaaatggtctgcctatttattggatgtgaagcttgagggaaagggaagaaatgaagatggctcctgggtgtacaacgaacatttagataaatttcagctgaatgctgaagccttcctgtaggaaattttattttatgctgggaaccttgacttttccttacaaagaaaatggtgtgtcaggaagctattatataagactgaagaagccaatgtcatcatttagctgtgtgatctaaggctagacactgcccctctcagagcctctgaaccacttccatgagctccaagatcttattaagatactgagcttttcattggtgtagactacacatactgttagtaacctgagtagtgttggtgttaagaggaactggggcaaatagaacagttggtgcagtgcacagaccccccaatattaccaccctgaagtcttcaggtaatctccttatttctgctatttctgtagtttatctttgtacctttctgtcagcacagcattgagaaagtccgatgcagacaggactgcatgagtgaacatcgacattttaggaatcagtgaactaaaatggactggaatgggtgaatttaactcagatggccgttatatctactgctgtgggcaagattccctgagaagaaatggagtagccatcatagtcaacaaaagagtctgaaattcaatacttgggtgcaatctcaaaaacaacagaattatctctgttcctttccaaggtaaaccattcagtatcacagtaatccaagtctatgccccgaccagtaatgctgaagttgaatggttctatgaagacctacaagaccttctagaactaacacccaaaaaagatgtccttttcattataggggactggaatgcaaaagtaggaagtcaagaaatatctggattaatgggcaaatttggccttggagtacagaatgaagcagggaaaaggctaatataattttgccaagagaatgcactggtcatagcaaacaccctcttcaaacaacacaagagaagactctacacatggacatcacaggatggtcaataccaaaatcagattgattatattctttgcagcctaagatggaaaaggctctatacagtcagcaaaaacaagaccaggtgctgactgaggctcagatcatgaactccttattgccaaattcagacttaaattgaagaaagtaggaaaaaccactagatcattcaggaatgacctaaatcaaatcccttacgattatacagtgaaagcgacaaatagat

SEQ ID NO: 43231 - DNA, 893 bp, Bovine  19866881145889
tatcctcatttccagctgcctttatagttcccaagttgtcccatcaaactgagttccaacccccattaaaatgccacactcaatattttttgtctaatcccgtaatactccaagccctggctgtcagcagacatgtcaggaaactcccctatccggaggatttggtttgggtttattttggcctgagaaagagaggaaaaggaaggaaaagaggagagagtcagaaagaacccgagtcctggcagtggggaatgacaagccttattaattcaggcagtcaggcccttgggtctcagcagtgagggtaggcagatacctcatggtagggtcccaaaggagagctgtaaccaggctgaaggagcacccatcagccaccaagtggaggaagtgaaactgcttcactggtcagcagctcctcaacggagagaggggaaggtgtccccaggatgactcagcccagcagattctgcccaaggacagttatggaatgcaaatatttagaaatcctgtggttgtttagcgctcttcagggcagtaaacacacacgatgcatccccaaagcaagaagaatgagccctgcttctgaagatccctgacctgcaaggatagaaggaaagaaacaggcagacaagggtcctttcctcctacccgctgcaattttgtgcttgttagtctttgtcagagactcattgttttctgggcctaagtgtcctcttcatggaggcagatggctttctatttggagagtttgtcttctgatgactcttcccgtggctttccatgggaagaggttagaagaggaacaagaggaggaagggaaagggattagaaatgtcctcttgatgttcttctttgctgtgtatctaagagtggcggatgatatgcttcagtcg

SEQ ID NO: 43232 - DNA, 742 bp, Bovine  19866881219455
tttaaataaatttttgtaaaaaaggaatatacctgccctaagtgccatgaattctctatgtgaaagagagataggagatctgtaaataatttttaatatggacagaaatgcaaattttacttgtgttctatcatcacatttgtactggacaaaatgatccatatgcagattggtcatacagcttcacatttgtttatataaatgatttggtcagaataatgaaaataaccctatataaaaacatttacaaaaaatgggttagagatcactaaggatctaaatggtaaaatgtgaagcaagacaaaaacaaaaataataaaaaatataaagtattttgaaaaaaattgtagaaaaataggttatagtaaactggatcttttaccattctcacaacattaataatactgcaatatttcacatcatttaatgccatgtcattaatgtcattttaaaacttttattagtgatgtgctaatgagaccttaaagactctaatctgttacagaggatgtagtcaaggctaacacaaacagagcttccctggcaaccaagcatcagttttttccccaatataagaagactggtcaattttctattccatttgatgtttcctgttataacaatgaagtaaggtatattttctctgtaacaggacgactaatttggttattggctttctgtttcaatttcatcttttatttaaattagttgaaaatacagtctgtctattctttttccacat

SEQ ID NO: 43233 - DNA, 999 bp, Bovine  19866881347181
ctgtcaagaacttagggtagtgctgtctgatagataatgtgaactgcatgtgtaattttaattaaaaaataaaaataaacaggtgaaattaattttgataatacattttattttacccactgtatcaaaatattatcattttaatgtcaatataaaaaatcaaataagattttgtcttttggctaaacctcagaaatgttggattagcctcattgaaggtactcagtagcaacatgagtgaagtcgctcagtcgtgtccgactctttgtgacccccaatgactgtagcctaccaggctcctccctccatgggattctccaggcaagagtgctggagtgggttgctgtttccttctccaggagatcttcccaacccagggatcgaacccggggtctcccacattgcaggcagacattttaacctctgagccaccaggaaagccccagtagcaacatggctggttgctatgaacagcacagagagcagtggcttccaacttgttctccatacatgcctatatggaaaaaagtgaacatgcatctcaacatatgtatgtgtatttctttagaagttatatacatgggttatattctaaatatatgaaagatgtcttgtttcatctgtatctcatttgacttatctttttgtatattttagaagtatatatttataacataacccatgtgtgcaatttctaaagaaaaaatttgcatatgctgggatgtaatttctttccccataggcatatcttaaaatttttcacttcctggtgattctaaaattttactcattaatatgactattattagtaaatacaatatgataaaaataagcctcattatgttggaaaatcttgatttaacatttgtaatacttttaattcagcaactcaaagatctgtcactatgttcagtttattttaatttttggttttaatggctgtcgaagctgagaaaaatatcttccaaagagaaatagatctaatttaaagaagtgcat

SEQ ID NO: 43234 - DNA, 1395 bp, Bovine  19866880440735
atttacattttaagataaccatattagccagaagatgaaagagaaactgtcctcaggcaggatacatttagtacagagtttaaactgagctgtttgttgtgtaatcatcagttccaggcttaaaggaaaaaacattttgtgtgactaagacaaaggaatgtagagaagaaaaagtatctttgttctttcctcctccttgagaattcaagactcctatctcctcttctagagccctagacccttctctcctcctctgggacccggccttcttatcaacctgcctaaaacttgactctcactctgccaccctcttctcctcctgccttcaatctttcccagcatcagggtctttttcagtgagtcagctcttcacattaggtggccaaagtattggagctttagcttcagcatcagtccttactatgaatattcagggttgatttcctttaggattgactgatttgagctccttgctgtccaagggactctcaagaatcttctccagctccataaagcacttggggaattataaaccacaatccaagtgttagtaattgtgttagagagtttgagacattcggtcctgtatgcagatatttggcatcttgtagacaaaccatttgaatgattgattgtatttctcagttgtctttggaaaactgacatcacataactgtcttgaacatactgaaacattttttcaagtagtagctagtctggcaggttgttcgatgaagacatttgtgggaagagtaagttccttttataatggtctttataagtgacattttaaaacttcctcttgcattaaatatttttagtatggtgtgtttttttggaactgaaacttgttaataaacgtatacccagattgccaataagcatatacagtggtaagtgattcagtgtaaaattcaaccagaacataactatcttctcagatgacagggcgagagacaagaaaaattacatgtaagattaagacattaatagagagtttatttgtgacactgcctaccctgccaattccactccactgcttgttagataagtggtctattttttaaactcttatattttgtagagcagttttaggtttacaacaaaattgagcagagaatagagacctcctttaccctgttttctctcaacatgaacagcttccccagccgtcaacaatcccacaacattgttacagttaatgaactaatgctgatgtatccttttcacccaaagcccacagtttacattagggttctcccttggtgctcaacattctctctatactagaatttatacatcattacagtctaagatagaatagttttcactgccttcaaattctctgtgctctccctattccttcctctctcttccgcacattgcttgcaaaca

SEQ ID NO: 43235 - DNA, 993 bp, Bovine  19866880454798
ctttacatttgaacgtgtctttttgagccacccctttttctgattcctcaggccctcttaaacttaagagaatccctccctgtcccttttcgctccagctgggctcttcctgcctcttcatctacaatgcatctcaggctgtgccttcctccctgttgccacacttgctgtctcatctcatctcacttgggtggttttaacagctttcttttccaagttactgactccaccacctccctcttctgttctttgttctatacattgtagtcgccctttcctcctaagaactacgttcttattgtcacataacttccttttgcccgtcatttctgaatcaaatattcaagatgccctatctatttacctcatcctcctgtctcaatttcttacaaaggaaaagaatgcataaaaggctacaggttaacttgtaactttttatatttccctttaaacctcctccctttccaaattgcactataggaaatgttacttttattccaaacatggaaatatgcttgtctttacttccatatttttgtacttcagactgtcccaaaatcccagatcacttttaccagtaggtagacatatccccttcaatccccattgatcagatggttatcttcactttcatcattacactcctcaactacttcaacttaatttttatttaacctcactgctctcaatctatccccttcccaatcagtagaaaatactgctgccaaaaccagctttattgcctgccagtccccagatgctgtgtttgctccctgccagtcctgtacagaattcaaatttttcacaattcatctttttggccttttcagatgaatgtctaccctggaagttcaggcaaactcagggccatggcctcttacagtgtttccatctttgtcccttattttcaggttgtgtagacactggttcctacatcagctccctaaactttacaattgtttttttccttctgcgttatgcaagcttcctttg

SEQ ID NO: 43236 - DNA, 758 bp, Bovine  19866880455607
aatgcctgattgtgatggtttcatttaaatgattgcatgagtgagcttcaactactgttcctacttaccatgtgtgccagggcagaattgtggatgccagggtacagaacatttcataattttttgctgcagataatgctcaataaagattttatatatatatatatatatatatatataaaatcacacatattctttaactacatatcatatattaagtgttcctatatgcaaatagaagctttgaagcaaatgcctaaaacacttgatagaatgatgtgtgtgagatgcagatttacgttttggattactgactttatggctatgatatatccccccccgccctccccccctgcagaatgttgttctgcccatttatgaacaaatcaaacacatttgtttcttcaatgtgttctaaaaatggcttttaaaatgtgcctttattcacgcagtttacaagaaaataagtaggactgaaaccgatgcaagctggggacattatttctcccaacaggcctgtcccgtagggcctgagaccggaagtgcacacatatgggtatgacaaggagtggtgtgcctgtgcgcccaggctcagtgtttctggacccctctggcttctcctggcacctccccctcagagcacttcctacgctccagtcacaaaaacgctggcctttctctccccccctctacttgctgctcttggataacccttctcatcttcaagaccgagtcaggggggccttccccctgctttc

SEQ ID NO: 43237 - DNA, 741 bp, Bovine  19866880500555
ttctggggaaaaaagtgccagacattaatatcttagcctgaactaccaagaccacgttttactgaggtttcttattaaaagtggcattttcattaaaatccccttctctgctgtgaaaaggcatgatgatgtattatctattttgaacaaatgtgctgcagaaagtgcctaggaggcaataacacagtttaagaaaaaaaaaattaaatatgatggctagccaaatgcaatttactcatttgtgttttttggtggcaagtcatatatcttgtaaaaagggatacacctgaagcaagagtagaggaaaaaagtttgcagttttacacaaatagaaatacatcaaaaagagttgcacaaaattcagatatttcaaaatgaaaaactcctaaaacaaaatcaaacgagtattaggtgataccctatatctttctttttttttttcagataaaaacctgttgccttttaccctttcgtccctggggcgtgaagactttctcgccttctccctgagccccaggagtggctgggcctttgggctgcaggtgaggggcaatgccatgtcaccgtccttgagggcaggactgggagcccgcacgctgggttggaagtctagtactgtcagagctaatctctcaactcacccccactccccttccgtctctggtgcacaggtccattctcgtctctgttcctgccctggaacgaggtttatctgtaacacttttctagattccacatacg

SEQ ID NO: 43238 - DNA, 730 bp, Bovine  19866880554812
taaaataattctattgcagtcgcaacacccacaatgtcgaaccctttgagaaatttaaaacaggattattctgacagcacctgtactagtcagctgcctgtgagctactttgggtaattaggttcccagtttccctatcaggtttcacagaaaattatggccagcatacatggcaataatgacttagactgactatgagataatacaatcttatgtgctattttgaaatctttaaatgttcgatttgcataaataaaacagggcatatattaattacatttctattcgaactcttcacctctgaatcaaatgtaatgacaagtaatttgacattgaggcagaataaatgcttgattttcctgcgagcaccatatagaactatgattctcaaaagagaaggaaatgcctaggaaggcatctctatagacacatgcactttaatattaccctgcaatctttcaggaggccaaaattaaataaatctgcaacatgtcatttgaagtcaaaacacacaaactgacttttgagatctggaggctacattttactagcttacaatttcaaacaccccaatattattaggagtatgtaacaaaagaacagattgaataaactgcagaattgcatcctttcatatttttttccctattgggaaattttaatttagaattaaatattcttgcctattagcaatattttattaaacctataattagtgattctagtttta

SEQ ID NO: 43239 - DNA, 825 bp, Bovine  19866880555704
ggtcaaatccatgggatttagagatgacacttaagtacacacacacacacacacctgttgctgcaaatatatcctgcttttaggagaacacagggatctagctgttgagtggtgcactctcagtcttgctaaaatcaaaatatgtcacaagacaagtgcaaagacctcccgactcacaccctgtatgtatctgaaggtcttccatgacagaaaccagattgtacagggttaagcagaaagtatgtcatgaggaaggggaagaaggacagatactgaccttttgctccaaacctaagattggtcatattagttctcttgtctgacataggggttttttgtaagcacagatcagatcaggaaggaataatgctaaagctgaaactccagtactttggccacctcatgcgaagagttgactcattggaaaagactctgatgctgggagggattgggggcaggaggagaaggggacgacagaggatgagatggctggatggcatcactgactcaatggacgtgagtctgagtgaactccgggagttggtgatggacagggaggcctggagtgctgtgattcatggggtcgcaaagagtcggacggatggcattttaaatcgcttgatacacccttcatcatcatgacagataccacagaatctcttcaacaagcacctcaaagatcaggtggcagagcccactcatcacaaggagaagcttgagatctcaaagtctacactcccacgctcagggtgaggaatctcttctcccagcttccacatgttcatccatcagaatcacctggacaactgattaaagctcagctca

SEQ ID NO: 43240 - DNA, 1763 bp, Bovine  19866880624529
ttgaatggagaggagctgatggttttgctacataatatgcagacttttttttccctatacagcctttaatttaatgctcatgtattcagaaacttagcttgtacctccagtattctcgcctggaaaatctcatggacagaggagcctggtgggctatagtctacgagatagcaacctgtgcttcaaaggcgtaacctattcagaggagaagtacggttgcatagactaaaggaagagccttggggcaatctaatttcctcttgaacagatcattcagttcttcccattttcaatcctggacttcacatactccccctccttctaaatcctgactttccaaagggttccatgcacactggaacccactgcatgatcataagttttaggtttttccatttttctaagtcacttgctaatcctctactttctgtcttccccaaactgttgacacttcttgtccattctctttttactgtgtgttcatcatttttttttattctttagtattatttggtggagtttcaggatgaaatgtaagtgcatatattcaaccaacaatcttaattggatagtttctagaattagcttatattcttattcattttcatgtaattaaacagagaccatttaaacaaaaggtctctgtgtttgtgtgcattattttaatcacaaaatataaattcctgcttgtaaaatagacaatagaaaggcccccttgaagtccctttaagtgcaacagaaattcctgaggtgtgaactgctgttccatgcataattgatagattattcaattcccatatgctttgtaattttgtgttcaaagttataaggacctttgagacaaagaatgagtcttgctagcacagaataaggcataaaatcgcaaccaatccatacaaccaaattttctatggattcacactgaaaaacatataagataggttcagaattgtaagattcaaaaaaatttttttactctaaaaagactttaataattacatgttcagatcagtatagtgacaaaaatttctatcagcatatttattcatctctcttagtaactcttcaaaaagttcagattaaaggacctcattatggtcatgtcatttttcaaaatagcagggtctgatgtgttgcatgaaagctgttattaggcttataaagttgtttctgatgggggttgtatgtattcagggcaatgtaagaagcctaattgctcaacaaaaaataagcaagcatttgataattaaaaaaaaaataggttgacaagtaaatgagaaaatgatactagtaatgtctaagaatttcaacataaagctaaaatttgctttcataatttatggcatttggtgcataatttattctaattgtaagcaactgattctatattgcagaagttagaaggagaaggtcagagtgataagctttgagttgtagtttaaaaagccagaaatattttcttagatttttggaattttcttacttagttcttctttttgaataataatattgaaatttgattctctccctgctagagattgcttagttaatgtctagaaatctagttatcggtattcgagtttccagttcagtcgctcagccgtgtctgactctctgcgaccctatgaattgcagcatgccaggcctccctgtccatcaccaactcccggagtttactcaaactcatgtccatcgagttggtgtcagtatagttactaataaatattaattgtgcaaaatactctaccaggccatgacgaaca

SEQ ID NO: 43241 - DNA, 964 bp, Bovine  19866880831727
ttgtggtgattattaaacagatcacaattactggaagttaatctcttaatgaaatggatagcttggcctttttccattatttcatgtattccatgggtgaccatgacttagtgctaaaataagacaggacccagcatcaacttcctttcattttcagttttttattgtcttttttactgtaactgtggagattctttgtttacataaataaatagatggagatggaagaaatgccttccattatagcagtgtcactcaaatccttgaactcctcagctaaatgccagaagtcagtgatctttcatcaaaaattattttaatcatacattggctgacaactcaattaggcccttctgcaactttgcttaaatagagaattgtagaccacttgacttgctaatagatttgttacacagtcggagccatgtcacgtgtcaatactaaaaccaaattgtctcttactttattatggtggtggagggtgacgggtggaggcaggtgggtatcgtcaacattctgagtctatataccagtgggaaagcctcatacaacccagggaatacagtttaaagtccactacccaatagtgcgatggcaatttatactacatgtatatatgttcacttctcctgatagtatactacggagtaaaactagagcacaccaatttgaatcaaatgacttcaactgaagatctcccaaggatcttcctttattatcagcaaataaacatacacacattaatggttcaaatatctattgcaattcagtgttaagacaagttatgcagaaatcttccaaagaacgccaggacttatttttatatgcccaagaagattgtatcagccaaataaggcaatgcattattagtaatactcattcatccattcagctatgatttttggaaagcaactagatgtatttccttagttggtttctgagaaatagaaaatggctcaaacct

SEQ ID NO: 43242 - DNA, 934 bp, Bovine  19866880832697
ttaattttttaaatctaattttacaggaagcttcaaactctcattgtgttaataacattatcactatggaaattttcaacatgtcttcctaaaggaacttgaaatattttcaccattttcagatgattttccctaaaaaaaaagtgaactctgtcacttacatctgatgattatatcattgattgtattgtgcaatgaaaaccagctggaattgagagcaacctgctgaattatggctgactctaaagaactgtgataaactctttaaattctgtaataacctgacaaattggttatattattaagaaatctctatgtagatatccttttttactccctttcttgtttggtaaacgtagaaattcaagccagctgtgcttgtgttctggcatcaaagggaggagccttcccaggtggcgctagtggttacaaaccctctgccaatgcagagacttaagagaggcaggctcgatgcccaggtcggaaggtcccccggaggagggcatagcaaccccctccagtgttcttgcctggagaatcccatggacagaggagcctggcaggctatggtccatagtcagataccactgaagcaacttatcaccctgagaaatgatcattcaagtgccaacactggaggtggttatacctagtaaagaaagcttttcatgctgaagcctttactaagttttgtattttgtctctccgagcttgttttcttgcactcaaaaacagaatggaatctcagaccttaagagtcaccttcaccctgtacctcagtgcctttaggggtcaataccctgactgatgagaaaaagcaagaagtctgcatgattcagttattctagctctttgtcttcaaggtcaaagccctaatctaggaagcatgttatagctaatatgtatcaagtttcacacagtactaggacttttt

SEQ ID NO: 43243 - DNA, 1708 bp, Bovine  19866880857595
tctctctagtttttttaatatggtaaatcaattcttataactgaggagttgataggcaagatatttagggaggcagggacttctaaaaagtaaatttctgctctatgtatttgttagcaaatcagttgtgtctgattctctgtgaccccatggactgtagcccaccaggctccgctatccatggaattctccaggcaggaatactggattgggtagccatttccttcttctggggatctttctgactcaaggatcaaaccccatctcctgcattgcaggcagattctttatcatctgagccacaagagaagcctagtggtagactccaatttccagttgccacaggtccaggaaagactaggtaacatctcaatagcctttataactataaactgcaaaaagcctttataacatactcctatgcgaagatacatatatttgatgtatataataggagcattgtaaaaataaagaaaaatttgtttgttatctaaaagtcaaaatatggaccttaactcctcatgcacaaaatagatgtttcagaaattttaatgtgatcaagtattatttcaatccaagcaactggtaattaaagaaaaccaaaactgccataactcagcatttttattgaccaacttaggcctgcctttgaattcgtatgccaagtgtttaaatgtgcaaataaaatagattgtttagtccagtcactcagtcgtgtccgactctttgcgaccccgtgaatcacaacatgccaggcctccctgtccatcaccaactcccggagttcactgagactcatgtccatcgagtcggtgatgccatccggccatctcatcctctgttttccccttttcctcccacccccaatccctcccagtatcagagtcttttccaatgagtcaactcttcacatgaggtagccaaagtactggagtttcagctttagcatcagtccttccaaagaacacccaggactgatctcctttagaatgaactggttggatcttcttgaaatccatgggactctcaagagtcttctccaacaccacagttcaaaagcatcaattcttcggcacctggctttcttcacagtccaactcttacatctatacatgaccactggaaaaaccacagccttttccaaggcaaacgctgaacagttttagaaaataggttgtagatcaccccaatacttagccatgaaaccagtagcatgtgcattctgtatcactgttgtattatcacaacttatatttattccatatctaacaagtgtcaggagttttacatagaccaagcttatccttataatacaccaccgagttctatcacagtgagaaaacagacatcctaatttatagcattactttgctgccatgtgagatgagtgcaattgtgcggtagtttgcacattttttggcattgcctttctttggaattggaatgaaaactgaccttttccagtcctgtggccactgctgagttttccaaatttgctggcatactgagtgcagcactttcacagcatcatcttttaggatttgaaatagctcaactggaattccatcaccaccactagcgttgtttgtagtgatgcttcctaaggcccacttgacttccaatttcaggatgtctgcctctaggtgagtaatcacaccatcatgattatactgggtcgtgaagctcttttttgtacagttctgtgtat

SEQ ID NO: 43244 - DNA, 1929 bp, Bovine  19866880931025
aaaagcctggactctgtttttctctagccttccacttccttacctctctgtaaaagtatcctccttccctggctgttcaggaacctacaagtgactcatcatggctgagaccacaaattgtaattctctgattcccaataaactcacctttactgaagaaacctctgacgatctatttcaagtcaacagtggtaatgtgtacttgttggtaacattgaagaaaggtcatggaattctggatatatgtaccctgatatctatgatgaccccattctttatgacatcaaaacaatgttttccttactatttcaaacaaatctacttgtcttcactattgtcagacaaaacacaatgtgtattatgaatgtttcctggaaatgctacatttagtaatatcagtcttttaaaaatgacatttttaaaaatcttttcaaagcaaagatctgatttggataaaatgtaggaaaatgtatttttatggagaaatagtaatctagactgtagtaacagtttaaaaggtattttatcagttttaatactcaaattacaggtaatgaacaatttgtagaaacccatgcgattcccaaagggaattttagaaattgttatttattacaattttgtttccctactttcttcatgtatgtgttctaggtcttcagggctctcttgtgcttactattattgttactactaatgcaaccaaagtacttcccaaagcagccttttattcttcaagtcgtagcaggctatccacaggcattttccagacttaacagagtgccaacacctctttgtgcccgacaagtcaaggaattcccctctcatgattgagaatcaattagatattaaaagatttaagtggattaagatgcttattcactgaatttagcaactgggactattattcctttactgatcacaaggctcatgcataagctaccacacataattactctggagagacccttgatatatcattagtcctgggcatactaaaatcacatcactctccgaggacttcactagattcctatggcccttaccacagaattacatggaactacttgctgtgttagtctaaaatgttttaatgaccacatctctactgacagcaggtacactgtggtgggcatggcctttgatatttctaagcattactgattcaaatgtgatctgctgagttcacagaaaagcagagaaagctgtttttctgggatctttatcattttatacttaaaattatatattatttatagttccgttcatcccagataaatgtgtgtatcttatcatatatgcctgagcctagaaaataactcacaaaaataatcctcaaatagagttgttgacagataaatgatggaaatagtgagcaatggacattttggaacatgtttagtatgacagttaacaaccatacatgttatttatcttgcttttcagtgtcagatggaaaatatttcattccgagtaatggtactcatgacaagaagcaaggtttgaaaaaaaaatagtggcccttttcctgctgagtcctaaaagttggaaatcataatggaaatattaaaaatggaaaaagataaagagaaagaggaaaactggactactgcaactcagcgttttgtcatagattcatgacaaggagatgcacaaagaacattttaaaatagagtttcggtaggagagtgttgcagccctattctaaagaggacttaaccttgattaactcttagtttagaaactttttgactcctagatgatatatctttgttgctctctaaatctcagtaaagtatgatcaaggactgatgttgatacacacaaagaagtgaaattcttaaccatgataattatctgagagcctacctgtgccaggtacatgctcaaatttaatatcaatctttcatttcatatttgcaccaactg

SEQ ID NO: 43245 - DNA, 770 bp, Bovine  19866880949462
caaaatcctatgaacaaattactgcccaagtcattttgttttagtgtcttttatttggaaaaacatacttttaagggaggagaaaaagatgccatttgattgttgagatacactaccattttccactaaattgttgttaaagacttaaaaaaaatcaagttgaagctgctgatttaagttgctcacttcatgtcaatttctgaaaatgttaagcgtggcattaaaatcaaagatgcatttaaggagaaacatacacttagtttggagggataaatgagaacaacctgtttggttcacattaagcttgcagatttatcaacactgggtacacatgggaaagacagagcgagtgtttatgagctctcagaaaggattgatttctacaagtccctgatttagctggaaggggtgcctatatatttagttaccaaaagggttaatggacttaaccttttgaaaaatgtattttttcatgtgcatataacatgatggatagtttactgaatgcacataggtaaacataggtgaaaacaaattaattggaaggtataaggtgtttttgttttgttttttttttttcttgatagatggatctcattattttccttgggcagacaaagccataacagtttccagagaaaggagagtgacagttccaggaaactgcttacagagtggacagccagcaggctaaaaatattattgtgtccacctcatcaataagctggctccatgaagagtggcaattattcttttcctgcttatgctgc

SEQ ID NO: 43246 - DNA, 2580 bp, Bovine  19866881025589
aaatagtgaattattgaacactggctgtcggcaccctagtgggtgctaactttgattcaaacctcatacactgcctgctcccatgtgactcaacagtccgcaacaggcatggacacagattatttagtatgtactcagcctctcagttgtgtctgactcttttccaccccatggactgcagcccgccaggctcctctgtccctggaatttccgggtaagaatactggagtggtgattatttagttattagtgagttatttagattagtgcgatggaagttagctcagtggacactgggaacacttagagccctaacactgccttgctgtcagtgcaaggactcactcaggttgcctcaaaaatcagcgagacaacacatttctatttcctagctaaagttgcctttaatgttctcatttgtcatcctctgtagaaagcagttctggtttatagttgaaactattagctgtttgagaacctgtaaactccctaaaagtttcacaactcgatcaagttcaccacttcaaacaacggataaggcagtcattgtacctcagggtattcattgactcattgatgaaatgttttaaatcaaaatagtcaactacttttgctacagtctcaccattctggctaaatatttattctcataacaaatatttactgagtccataaattgggctgggagctgaagatataccaataaataataagcagtttgccttcagatatctcagtctactgggggagatgggcaggggaatgaatgatttttcatatgaggaaacatgttatgaggaatagagggaatagctctcttggtttaggataaatcgtatccctgggaatgcttggagggttgcagaatatcatcactcaactgctttttatctctttttatttcaaagatcttccaaagaagaaacatttaaaaaattctgtcatttgaattgggttcttgattttgtagaactgggcagtaattacaagaatttatttcttataacattagagataaatgccatcttagataaaagtttaagcccaaactctgatagtgcaagaggcagctaagtatgcgagcagatagctggcactttaaataaaatgggaatatatccaaatatcaagacagtattaatgattttagcaattaaaggagcaatggccttccacacattttgcaaaagagtaagttcagctttgcctcaattaacccagatttcaattcaagggtagaagaatcgtgaaccaaacggatcctccacaaatcctgcagtgaaaatgtagcatattagatctggtcactttttttttttttaaagatctgatcatatttttaacacctgttttaaaaactgtagcttaatttatatccgcaaatttcttgagctgatgatctagccatcactaaacaaaaacttaaaattaaatgtgaaaaatacagaattatcagtgcagaaaaatggaaaataaagagagttgactttgatttttcaaaataacaaagggcagaatgaaaatgagtttgttctgcccttgtaccctgatgcataataagagactgaggggacaagctcaatgaaattaaaggtcaatatacttaaaatgaatggacatatttatttgcccagcatgtataataacattttagtaccctcagttgctagaggtcatagaaaacaaataaaaatacctggaatttgaaaagaataaaataattttctaagtaatgaaaacatttatgaccaagataatggcatagttaattatattgctatacttcagcgagtgttaaataaatcatctaccaaaaactgccccatcagcaataagtacaataaagattctctacaagtctttgaagtcttcagaattttctattgctttcagtgaagaagtaactagatctcactgatttgttagccaataaaatatgtccctatattttttggggggtgtgcaaagtgggtatggaataaacaattgaataccaaaatgaaacatgctgaaatattggcatgaagttagattttaatgtaaatgtgtgttcttctatatcttaattttataattttcagagtcacaaattctctgcaccacagttttcccatttgtgaaagtggattcactgagatttccctttgaggacagggcagacacactgcagttttagctttctatgtatgcaaactctacagggctcagaggcctaaatagcaccagtagcccagcttcaataacccaccattgctcaaagtaatggcaacccactccagtactcttgcctggaaaatcccatggacggaggagcctggttggctgcagtccatggggtagctaagagtcgggcacgactgagcgacttcactttcacttttcactttcacttttcactttcatgcattggagaaggaaatggcaacccactccagtgttcttgcctggagaatcccatggacgggggagcctgctgggctgccgtcatggggtagctaagagtcagacacgactgaagcgacttagcagcagcagcagttcaaagtaaaaataaaagaaacaagtatctctaatcataat

SEQ ID NO: 43247 - DNA, 1700 bp, Bovine  19866881030591
cacaggtgcccaatgtgggcaggtaagtgggggtagaaacctacttcatcaaggcagggagaggactgaagaaagatgatgtggccacagagcctacagtcaccattgtcttggcacaggttctgtggggcacaccttccctgagtccactttcagaagccaacagtaacaagaaactggagtaggcagggagagtgttcagaggacaattccgcactcaggatgcagtcaggtaccagacttgtcccaagagaactgaccatcttagtgcaggatccagcttcctgaaatgtaccaggcagaccctccccagagaagaggtgacggatcgagaggagaaggaagcaagctgtcagaacccaaggaatggagctgattaggcactggatcagaaaaacccaccccagcagaagggagggctgccagttcaggggtataggccatctgggtcacctgggcgttggcttccagggtccagctggccatgaagaagtccagctccaagcttggtgccagtcatcgtggttgaggacttcatgcctgattttggaaatctctgagctcattccaggcccagctcctgtcagaaatgaagggccagaagtttggcagtgaagctttcaggaggtgttggcttttcttaggaactggaagtgatacagtctgaaaggtgggttaatgtgaggtggctaaggaagacagtttggaggtggggagactctgtgagaggtgcaggatgtctcaagagggaagattgtgactacaacccaaggcacttcccatatgtcagttggtgggtttaagtttctgttttacatgcctttgtattgatccatagtgatgctaaaatgaagcacgtgacttggtgcactggacagttctctgaagcatgtcctcttgtgaatgtcttatgcctcttcaaagagccttttataactcttccacattacatcgattgcttccttttaagaaaatcttgtaatgcaactggaaaaaatgtaattgagcatttaaacagtccttgcctaataaacactaattgtttcaaatatgtaactcttgcttttctagatcattggaaaggaaggctatcctgttgcttttgtttttcttatgaaagcctttttggaaggagggattttttttgtttgcttttgcttttttttgtcaaccgattatctgcagaatcctcacattgccggaaacaattattagacatgatactgtgctctgaaaatagtagtttggaaagcaggtggactgaaatttctaatcctaaaattgtaaatgtgtactctttgaaaaatgatgaagaatatgttatttatctataaagtataaaaacactataaagggtatgtcctcaaaattgctcatgcatggaacagaactaattcagatatctagacagaactaattcagatatctagatagacttaaatgagagaagactggtcattgcttctcctcccactttaagtaccgctgtgtaatgtgatctgtgctgcagtttgattgcatgaaaatatattgtgaatccaaaggattttcctaaatataccaatatgttggatttgttttgaagagtttatacatgttcacattcacttttccagaaaattgaaagagtgagcttgggagcagtcgtgtgcaggataaaaagctgcaccctccctcattgtcttctagggtctattaat

SEQ ID NO: 43248 - DNA, 2584 bp, Bovine  19866881094939
atgtctttgctttttaatacctgtctagatttgtctggctttattcccgaagcagtgtcttctaatctcagggctgaagtcaccatccacagtgattttggagcccaagaaaagaaaagctatcactgctactactttttccagcttctatttgccatgaagaaatgggaccagatgccatgatcctagtttcttgaatgttgagttttaagactgctttctcactctcctctttcaccttcatcaagaagctctttagttcctctttgctttctgccataagggtggtgtcatctccatatttgaggttgttgatatttctcccgacaatcttaattccagcttgtgcttcatccagcctggcatttcacatgatgtcctttgcatataagttaaatgagcagggtgatgatatatagccttgttgtactcctttctcatttctcaaccagtcagttgttccatgtaaggtcctaactattgcttcttgaccgtatacaagtttctcaggggacaggcaaggtggtctggtattcccatttccttaaaaatttttcacagtttgttgtgatccacacaaaggctttacatagtcaatgaagcagaagcagatgttttcctggaattccctcgctttctctatgatccagcgaatgttggcaattggaactctcattcctctgcctttcctaaacccagcttgtacatctggtagttctcagtacatttactgctgaagcctagcttgagggattttgagcataacctcactagcatgggaaattttttcaattaaaaatgaaaaatatacatattttaaagaaggcaaaaaaggacatcatgactaatacatactaggtgttaaatattgaataaatgttgtaggtatcaaagtaactttcttcaccataacttgtgtcagtagctatgcttgcaaactgcaagcagtagaactatttggagacctcctctgtggcttagttggttaaagcacctgtcctagtaaacagaagatcctgggttcaaatcccagtgggaccttctgtgatttttcctgcctacaaaaagggtataggggagatcaaagatccagtcaatcttaaggcttccttcacggctcagacagtaaagaaccaccctgcagtgcgagagacctgggtttgatccctcgtttgggaagattcccctagagaaggctatggcaacccactccagtattcttgcctggagaattccatagacagaagagcctggtgggctacagtccatagagtcgcaaagagtcagacatgatggaaccactaagcacagcactatataggttcctatacctatgaagaagaatattttattatacatatagatagttcactccagattaaatccagtgtttttttgatccagttggacatcaggcaacacataatctagactagaatgttctagagctatcccaaaataagttctttataagagtttgtagagaaacttctcaagccatagaagtgggtattagacatgcagctcagctacttttgacatgaactgaagtcagcaaaattaaaagatggatttcattaacgtgcatctcagttttgtgggtctgagcaagatggcctcactttatctgtttctttctaattatgagttattttcagatccaggttttagagcacgtatctctagtttctgctaagaatcagtctcacaattgatactttggtgcttatgctttagtatattatcactttccaaaacaacataacagcttttttaagccaagcaaaatggttaagcttgcaaatttaacagaagttagagacagaaaatgtaaaagacctgtggattttcttccatgagtagatgtaaatgctaatgaaatgttccttaaaacacatttaaattaaacccatgagctgccttcaacgaatatatgaaagttcaagaagaattgaaaatgtaactgccatcaggataagacagagtaccgacgggctgatgggccatgtgctcaggcggaaggtagttttccttctcctacatattaataatgacaggtggtgctggagataattttaaccagattatggtgagctgtagttctgattctaagacttttttcccactgctttgcttgaataaagtatgactgaacacactttaaaattcatttctttcccaaaagcatttgaagatttttttgtgagagaactgatgaggtacttgcttttttttttttcaaaactaaataaataaatctttgaaaaacttaaagcactgatttttaaagggcttcgcagacatttatgtaaagatagatttttctaattccttaatatgaagatgcctgttcacagagcttccaggcctgaagtgtacgggtacatgtccatgcgtgtgtataaagaatgcacagaaaaagaatttctcatccttggactttaaaacaaagctaattctaattggcaagatatggaaatcttttcagccccaaagtaaaaacatctatctctttggtgtttatatcttacaagaaaaaaaatgtgtttttttctaagtaagccaagctctgactagcatctgc

SEQ ID NO: 43249 - DNA, 1338 bp, Bovine  19866881139126
tataaagtcctcccccttgtgactataatttctaagctgtgatgaacctcttgcttttggaagagagttactgatgtaactcaacaccttgggtttttattaacgagatgctgagtgaacaaaagtaatactaatcaattcagagggaagtatatttttaagtgttctttcccacatcttggtgagatccttttaaaatacttaatgcatgggttattttcccttgtgacttccatgattttgcctgatttttcatctatttcccataatgttcatctgtagaacaatgattagagtcactcacataagagagtgaaaatagcttattctgaatattagtaatgagatgtgttagaagccatcaaaatgtgaaattaaaaatatatcagtgagtcatctttataaactcacattccttttagtatttgttgcaagcaaagaatcctgctagattctaaatcttaagttgcaaggggcaagaaaaagaaaagaaaacttaaaagttccctctattactttttagatctaataccagtaagactgtactctgttggtattgtttatcttcatttattttttgcagtatttttgtctgtaaggctaagattttgcaaattacattgaattctttctttttatagcaatatgaagttcaagataaaaatactatgctttgggctgagagctgtttcagtttttaaaaatatgatcatcttgtcatcacttatgagattttatccaccattggaattgaccctttgcagaacagaccctacatgctgtcaccagtcgtcacggctagaggcaacgaactacagccagaagggcacagcaggatggccttgactcagcagtatagaaagcggctccttaagaggaaatattccacaacccataaactacgaagaatacaaacagagtgaataattacatattcactcaggcctgaaaaatcagtaaatatttcttttcccctgtctgcaagagtaggtacatgttgtaaatgctaattttcaaatattggaaagacaagatcatagttacaaatagcagggaggataaagataccaggacacaatgcaaaacattccaggttctgggggatcatattaatagaccacatttattgagggcttaagatatgtcaggcactgtcctaaatatttgcttagttttgttaactcatatagtcctcccttaaccttgtgaggtagatactataattattatcctgtggaagatcttattgcccaaatatgattgcagtgacctctctcagcccacatgctcttctacaaggtgatccgtcactctctccatcaggatggggcttcccag

SEQ ID NO: 43250 - DNA, 1795 bp, Bovine  19866881151165
taattttattttaataaacttaagcatttgcttgatttttttcagagctatgcataagctcctaaagtaaatagttcattaatttttatgccagctttggtgctatttacatgcataccaatgaaaggaaaccaccccagggaacctgtagagggttggtttcaaattcatgaattaatgcaaatggtaaggttacatcatttgggtataagttataagctttggagaatggagaataagcaatcaaggtaaaatagccctcgggcctgcattatttatgaaaacaagatcctggcatttatattccgagctgctattacagaagatagagctacctatctgtgcaggtgtactagaaaggtcaaagggggctgaggttcagcctcacatgtgggggaagtagccattctgctgcatctttattcagaggaaatccacagggctttcatttgacctagtatatttccaatatttattgctgccatatctgaaacccctacaggttgagagcaatcatatttcatccattctaaggtgtcatcaatgtaaaggtgcattattatgctcagtataccactaagaaaggaaaagtacttccagttaaaggatgacttttcacaaactgaagattcatcccaatttcaacgatgggaaaatgtgaaagataaaaagtcacctcagagttgaagtacaatactgctttatgtcaaaagtgctaactaacttggaggtaaagcttacatgttgctttcagagggctatttcgggtagagatggacattccctttggagaaggagaggtcagcacattgtcactttgtctgtcacaggagctctcccattagcagattagagagtattagagcttcatctggtagggtccttgggaattctgtctctgtatctatgtattcttatacttgattccttccagtgggttttagtaagatacaaacaggcataagagcacatcagcagtgtttcatatactattatttattaatataattattgtatatttgcttaaattaaaaaaacagtccagacattcttagtagaatgccataaaaagatgtatttctaggaaactagttaatgaacaaaaccagcaaaaaccttcatctgcttaacatctcattctgttcccaaaagctcctttcttagcaacgttaaactgacagttgatggcttggtaaggatatggtaacaaggactaacttctccatatttaaggaaactcagaatttcaattcttgccacacatatatctaccctgttaattaaagcaaaaagtccacagataaaatgtagtgtcccaaacctgaattttaataaatgcaaatgagccaaaagtgagaatagtcagctaaagttccaggataaaatgtttgtcttgtatttaccatgaaattcatcagcttttactcagcgatagcggaaacctcaggagaagattttaaaaaaaaattgttccaggagtttgacaactaacaaatatactccataaattctttgaattttagtgtggggaacaatataacttccatgaaaccagaggaagaagaagccttgtcatctcttctccatttcaactccatggatactggcttccccccaccccaatgtgtttaggaatctgggttttaaaatcatctactggaagttctctgcaggattttttagccattaaatatcaagatagtgagcatgttattctcactacatggttaaggtgcactcttcaactgaaacatctctgaattgcccacaaatttctttcacattggcaaacaat

SEQ ID NO: 43251 - DNA, 751 bp, Bovine  19866881155831
ctggtttgaatattaaaatatttttatatttaaaaaaggaggggggaaatgctaatttagtacatttaaatattaaatatcttctcacaagaattagtcctgaatgtatgcactacatatttcctcaaaacatatttaatttgctccatattttcaaatttaagttttctctctttattaaatcagagaacatgacaggtataaatgttcttagatcagtgcctttgtttaaatttacaccacatttaaaacccttcctcaaaaccaactccaacctttccaaggcaataccaggcaattaatgagatgcttcttagaaccatgctttttttattttaagttatttttctaacattgttaagtataatttatcttactttgatttttagtctttcatggcaaaatgacataaaaatctatgctattaatgatgtttgtttttatctagaggtgttctaatttgtaaaagaagacatgttgcccttaaaatggatctattggttaaagttgaccatgcttccctacaaattaacttcttgatcgacaaattgttctctgtgaaggaacttgggtgttgtcagtgctgttgatggatggttgctaaacagcattataatatatcattcatttaatatggattttggattacaaatgagctttcctgatctatgtagccagcaaaatggtgctttagcaagaaatttaatgtcaagtcttacagatggaagaaatatagtattactgaaaacag

SEQ ID NO: 43252 - DNA, 1800 bp, Bovine  19866881229854
attgtagcatgcatccttacttcgcttttatggtcaaatatgttccatggtagaatgtgccacattttgtttttcaattcctcagttgatggacatttgggtggtcctactttttggctactatgaatagtgcagctatgaactgttatgtagactttttgctcattgtcttttaatatattgagtactatgagaaaattcataaactttgcaactataccatctagcattcagacaccaatgggttgtatgatttagcacatgtttaatttctctagcccctgtttcctcatctgcaacatgtcttagcagaaaataagtgctcaaaaatgatatttatgcaagaaacaaaaaagttccaaacattgtatcctgcctgtcttcacaactaccttcacaggtggctggttgggaagtgctctctttcgaagtcaatttaaatcatctaatttttgcaggtaaaaaagaataagcctcaatccataatatttgttaatggagtaaaaattcaattgaatgtgccctttttgatgggcaaaaatgactgcctagtaaagaagatttaaataatacttatgagtttaaatgtaattttattgattttgtgtgtgtgctaatttatcagcatagaaagaaaaaggagaaatagtagtatgctttatcatctgtcattaaccaaatagactatttttttcaataacattcttgggataaattactaatttccattttgtgtaaaaatcgatttttatgtaatagtcttggtcacaacctattccataaaactggaatttactatattcaagtgctgacaatcattcaaactttaatagagtatatgaagagtatttctctcttttttcctgactatggtacattaagtctccagagggggcaaatgtttagcaacacattacttatcactatgttactgtgttagaatctaactcagaaatgtctcttgcaatcagcaatgacttcttcctgaattgctcctactaggcaatcattagcaaattctgtacctttcaagacaatttgtagacaaatagttttctctatttatgatctgctttactaagataaaatcagctcaagagaacttttgttacttttccaaggacaccatcacttttttatctcttttgtacttaaagagctttctcttcctagaaagtaaacaccacaactgaccaataaacttatagacctgcttattaaacccatccagctaatcaagagaaatagagaagtcctgtgcactggcatactattaatgttgggacttattccttctcattcacagtgtaatggaatttttcccctatggttcattcatcactttaaaaaattaagccaatttagaaatataatttgaatgtataattgaatttgtcagttgatcttagcctttacaagttaatcaaataacagagacttaagcaagtttcccacacacactctggtctatgggcagccaatcatctcctaaagagaatgtcagattctttcagggctttttgctgattagatccccatttttactttagaggactgaattatttttttcctggcaatcaaaattcctgctatcagtcaaactgaaaggaagaaaatggcataattttagctaaaatattagaaatgacaaataagtgaaatatgttaactggagtggaaaagaaatgtgtaattaagcagcacaaggaccatgtgtcagagtcttccatagtaatagatgggtggaacgtttcgactttttgcaaagaccaacacagctgtcaggaaattttagtcctc

SEQ ID NO: 43253 - DNA, 587 bp, Bovine  19866881270668
aaacactactcaattttaaacatattttaaagcaggtatgtagcattatattatagtttacattagaaaaaatattaaaaaggaccacaagaagcctttgttatatgcaacgattactgaggtaagactagaacctggcatgatttagaaccacagatattatttagcatttcctgaatatgtatagattgaatatattcacccatacacacatatacacacctacgtatatcttatactcttgtgtcttggcagcaaacgtaaagttcaccatctggtcttatagtagagtccaaacacgtaagtataaaaaatgtgttaatccttaaaatgaactatttggaagatatttgatttctctaaagggtcatataattatattgaccatggtctattaatatacctatttcatcagaaagattcttggatatcttgaaaaagaaaccttgctgagcagaattatttttcatagactagttgaggttcatgttgtttgatctttttgttttaaaatgtattgccaaaatattacaactttatgacaccataacttttgcacactgttccataaaaaagaaagagaaaga

SEQ ID NO: 43254 - DNA, 1238 bp, Bovine  19866881285526
tgtgtgtatgtataatctacatatatgcacatctgcatatatacaacttcttgagcattgtgaaagtaagtatgagtgactgtctagaggggaggaggacggtgtaggaagcaaggaagaaggaacttcagtaacaaaggacttagctctagagctttgcaccctgtagcgtctcagctctttgtcttctccgggtctgagtacccacaagtatgaaatagttgcctcagtgagaactatgtataagggtgtgaccctttattgtttctctcactttctaagaatgtgatttctgagttacaggtatattgcagaccttcaagtaattatttttattcttctctgtcctgagctgtgttatcaccctttggctctcctctgccatttctgtatctcctctcctgtttggctgtggctcctgattgctctggcaggaatatgcgcagctttagctaattaattgcttcgacagagcagtaaagtgtacttacctagagtgcacttgcagcaggcactatggatttattagcaaagagttatggatctcgattcatagctcatatatgcatatgcacatttgaattagaattttttaaaattgtatgttaataacccctcagcaataacaggtcttaagaccattatgaatgttgagaactagatacagcaaggtttaattgtaaagacgaaaggatgacatatgatttagccgtatgtgtttatatgtaaaaagctagttatttagcatggggctccttttgcttctgtcaccactttaataagcacgaaagcatatcatcctttaagtgcagagcacactgtaaggatcctatctcaaaacacactgatgcaatcttgaaagtgcatttctactgcgctctatttttgttggtgttaaaagcagcaaataaactcccaacttgagagcatcttcaatacaacatgccctttatttctccatacaagccagatttcttggcccagaagagaatgtcctctctttggccgatgtgagaaggtgacagaggcatcgtgtaacaggcattttccatgaccataatgtggcagcttttctccctgtatttttaatctgctttcttgtcagctgtgcagctcctttcagcctcttccaagttcttctctctggggtctgaggtgggccgacagagcagtttgacttcagtgtgacagctgggaacagacccagcatggatactattattttgaatcacagctct

SEQ ID NO: 43255 - DNA, 802 bp, Bovine  19866881321119
ttgcttccttctggcactctattacttgaagaatgtgaggcagttgcagaagctaaagaattaaatggcataaatacacgtttctcaaaccctttgagcaggaaaagggaggaaaaactcagtacagataacaatataactgtgccctttatagttttcctttagattatttcttaaaaggaaattattaaattttcatgtgctctgcagagtctagccttggtttataagatgaaaagaaaaagaaatattattaactgcttcactgccaagggacagccgatacctgcctgtgtgcattagcagaattcttagtagcttgggtttcacctctttcaaacgctaacgttttaggatttggtctcactgcaattccaatgcccacgtccaaggtcatgagatcacaagctttatccagtgcctacagtcatcatgtggctgctgctgctgctaagtcgcttcagtcatgtccgactctgtgcgaccccatagatggcagcccaccaggctcccccgtccctgggattctccaggcaagaacactggagcgggttgccatttccctctccaatgcatgaaagtgaaaagtcaaagtgaagccgctcagtcctgtctgactcttagcgaccccatggactgcagcccaccaggctcctccatccatgggattttccaggcaagagtactggagtggggtgccattgccttctccagtcatcatgtggagtgggaagcaaaattacagaacatttgtgtagccggcctggttcaaacctctcctttttttaatattaaacaaact

SEQ ID NO: 43256 - DNA, 1624 bp, Bovine  19866881507247
tttaatcctttaatttaattggcccattacttgcactagtaaagctatcagtaggaagatattttgaagtaatagaatatttacatttcagttgtgtttcttttttcatatggaggacatggatatttacatgtataaaatccctcctcctcagaataaaagcacataaccctataataactatgctggacagaccttttctcctgtttgtagtttctactgtgatttccccccatatatttattatggttacaatatttgataactggcaacccactccagtgggggcttcccaggtggcgcagtggtaaagaatccacttgccaaatcagaagatgcaagagatatgaattctatccctgggttgggaagattccttggaggaggaaatgacaatccactccagtattcttacctggaaaatcccaaggaccagaggagcctggcgggctacagtccatagtgtcacaaaaatcagacatgactgagcatgcacatatacacaatatttgatatagatattctataatcatttatattcaacttttaattcctgctctttgaataagtatccagtctctctctctctatatatatatatgcatatatacacacacacgcgagtaaaggtcatcatttgttcattcatttaggtattacaaggagttatgaaatcaatattataaaaattatatttttatgatttgtagagatgcagacaaattacacttgtgcaatatttcaaatgtatacatttccttcacctgcattaacattacattgataattataaattagtagataaaaataaatttccgctgttacctaaatatagatttgatgatgtatgagtctgagaattttaaatttatttgtaaatgtcatttctaattattttcctgtgaaatctctatttttgccctcaacccatatttttattgggtcaatggctttattgaactgaaactgttttcgtatactattgtaattaaccctttgtcaggtgtttccctttgcttggggaaaagtggtaattatttcactcctcatggcaactttatcaagaaaatattaatcccatcctgttaaaaatgtggaacctgtagtgttaacctacatatgctgctagaaacaaaggaagtctactttgaatctacactttgatgggatactgaattacttagtaatatgtatgtcaccttttactttctcaagcctgttatctcctttaattctgaatttgggaaacaatatcatgttgtgaaacaaatttattttggggtgtcaaactaaagatgatatgtatctcagagtacttccctggaagctttccctgtttagatttctcttcatggccttttcattatggagtaagtaaagaataatctgactcttaaaacaatttaaataaagaagtacatagtgagaaccaatctgttagaaaatgagaaatatattctatcacctcattagcataatttctctaatggaagcttgatatcacttctcacagaagattgattatccatgtatttttgaccagagttgaagcagaagggaaggagggaggaaaatcttatcattcattataactacccagaagttataaaattcataaatatta

SEQ ID NO: 43257 - DNA, 1107 bp, Bovine  19866881632739
aaggtaaaagaagatgaagtgatagtaatgcttataataatgaaatgttaatgtgcttgacctctgcagctacccatcattaaataattaattttctgaacctggatccatttattttctcatcttagcttaggttgaggtgtttaagaggaagagagaaagaaactttaaaaattgaagctgaaataaagtttgaccagtctcaccgacaacccattcaatgtcatacagaaaacattgaattacaccttggacattctttctataaggttaaatagatgaaagagtaatatacttcaaagaagtaacaaatagtgaataaactgagttttgaggaaatgttataatagattttttaaaaagaatagaaattctcagggaatccattactcaatttatgttatccgtttttcacctgaatgtggaaaaaaagtacagaattttcttatttctatgtggttatgaaagtacgtgaatcacatcacagctaaaagatattctcatgtaccaggagagctttctgaaggactgaaacttaataatggattcaaaattctttaatggaaagaactgttaaaaaaaaaaaaagctactgatctatgcactctttattttatatctatctatcttagagagactcattataatagctcacatgattataagacttgctctatgctaagtcgcttcagtcatgttggagtctttgccatcccatggaccgtagcccgtcaggctcctctgtccatgggattatccaggcaagaatactggaatgggttgctacaccctcctccagaggatctctgcaacccagggactgacccctcatctcttacatctcctgaattggcaggtgggttctttaccactagcaccatctgggaaaaatctgctgggctgagaggctggagacccaggactgctagaggtgcagttataatccaccagcagtttgctggagaattccctcttgctggggaagctattctttttgttctgttcaggccttcaactgattggatgaggcccacccacatcatggagaacagtcttaactacccaaattcacgatttaaatgtaatctcatcccaaatcacccgcca

SEQ ID NO: 43258 - DNA, 1415 bp, Bovine  19866881661637
gctctgagggacaccttgttttagaagggagccactagaaaaactgaaaccaagatgggagagaagtgagacattgatcacttaatgatttaagatttcaaattcagctctgccgtatcctctagacgttttagttaccagagccaataaatcacattttgtctaagacgcttaagccacagagcattttacactgtgtaaagtcacttgatatgatttctaaactgtaggatatacactgtaaacattagtgccctatttgcctggaattctacctgtgtatttccacagaaagtgccttagagcagtgattttttttttttttttccccaaccttggctacacatgagaattacctgaacagctttagaaagtctccatgcccagtggcatcccaggtgggttaaaccagagtctctgagagtaggattcaggcctcactatgttcttaaagctccccaggtgattcgagtatgcagccaaagcggagaaccactgttttacagctaactcacaaacagggtttacagggaaaggaaagaaaggctttgactttaaatagcaaccctaagtattgcctacttattgtgccaagattttgaagttcactacttctatggcgacagcttctaatcttgtttttgttccctctggcaaattgttgctagttttctttagcaggagttaagagaatatccttttagcctcactaggtaacgctcatttatttttattctgtgaaaaaccctccaagcttttgagctcgttattttattagggactaataaatttaacttgaccatacacactaagctaaaaagcttagtcttctatatgaggcaggccaacagactgtgtttttaacccttcagcttagcttgtgaaaggcagtagtgggcttcccaggtggggctagtggtaaagaacccatcctgccaatgcgggagacctaagagatgcaggttcgatccctgggttgggaagatccccggagtaggaaatggtaccccactccagtattcttgcctggaaaatttcatggacagaggacaatccatggggttgcaaagaattgaacatgactgaagcaacttagcacacacagttttacattaatagctgatgttaaattatgtgcaaatcatgaatttttttttaggtcccactccctatggagcttataaaactgaagatccttatgataagcctagatccttctagaacagcaggaatttgaagctagcatggcacaagagcaagcactaagtagctgtgtttgctgttttcagcttcagcttttctcatttttaaaatgaagtctataatatttcatctataaatttcacaggataaatagttgtttgcatgcatgaggtttgtaaaccaaaaataaggataaagtagaagttaggcat

SEQ ID NO: 43259 - DNA, 691 bp, Bovine  19866881962079
tcttcctgcccctgcaaagccatgtgcttttagggagcagagccccaggcgcacacaggcccatggctgcagtgctgttctgagtgaggctacgaaggagggggtgaaatctcacacgcccggcatctgcatttgctggggaggggaggatactacgcgtttgtgatagaggaactcagatcaaggcaacctgcctagatagatcagagagagaggcgcatgggatccccaaggggtattgcttgctgcatcttgtagcgtggctgtggtctgggatacgaacagcgaggagtccatgagagcaacatctcagcttggacattgattgcgttgaaccctaggtattcttttcttcttgttggcttgccgataatgcaagtcaatgaatctccctaggcctctactcttctctgataaagttaaacttgtaccatttacttactaactgactcaacttgtttattataaagcatttctttttatgatttgtattctaaggaggatcaaagaggcttacatgctaaaatgcatgtgaattaggacaataaaaaagaccagaaggcatataaatagataggctgtgatggattagtaaaatcaattataaagcagtttgccttcacaaattgcaagatgagggtacaatacacgatcataatcacaataaatgataatagcccgtcttcagctg

SEQ ID NO: 43260 - DNA, 2886 bp, Bovine  19866880446778
catatgggatcttcccggactagggatcgagcccgtgcctgctgcattggcaggtcagttctttaccactgagccaccagggaagcccctaatcatactcttgcatctattcgccaactggtttggaatacagagagaaaagggtctgattagtagtctcagaaattgaacatcaaagagaacctcttgaaaaaccaaaagagaaatgaagaagcctcctgatttctgctcagtcctcaaaccgtaggctcattatctgagagggaccaagaaaactatatactatggctttgctgccaaggatcaggattgagttgggggcctaacagtctgctcccagttcagtgaggttctgtgaggggacagaaggcagtcctcctgggacagaaaggatgacacagagtttgtgtgctgtgtgtgtgttagtcactcagtcgcgtctgacgctttgtgaccccatgtagcccaccaggctcctctgtccatggggattctccaggcaagaatactggagtcgtcatcacttccttcttcaggggatcttcctgacccagggatcaaacccgggtctcctgcatcgcaggcagattctttaccatctgagctatagggaagtccctatagctttatgtgtttatagtttatgtgttagacagtgacagaaagaccactgtttgaacccatggcttatgatcccaactgagtcccaggcagcctcatttcttcctgagtgacctgtatggttctgtgataatcctggtagaattcgcttactggtaggtgatgccccaactcttaagaaaataatatcgatctctgagaattttcaaaattaaatgtgaagatactactggccagggaagaaaacggaggtaggcgggaagaatgaaaggaagtaagatgctagaatttcatacaaaagattcatgtaccactgattttctgaactcactttctctgcatcctaacagtcattaaaatgtataaaaatggatattctgaagcagtaacactaagaattatcattgctgcagttgcttggcaacctgagactttggttattttatttctaaacagggaatgctataaactggtatctggtgtttgtgaaaatagttttaaattgatgttctctctgtaaatcaggaagagataatacagcattaacgtacatttaaaggttgctaaatttgcatatgtgtgtgtctcataccacacgcacacaaagattcttcctcagagtttctctccattatatgctatcttaactaaatctggagaattaatatccctttgcatttttcctggaaaatatctatttaatttccctttgtcaataatatgcatttgggtcccaaggaacaaatcttttacctcctgtgtgaatcagggaaattgagtattgtggctcatatcagtcatgagctcctttctctagcttcccagacactgtgtggatttccagttctgagaaagcaaagacaaatccaacatctatctggctactgggagaaaattatttctcaagacaaggcaaaggtatgtccaccttcttcagagatgtgactcttctgaaggcctgatgaaatcttggggtactcccagagatcctgcctatgggttccagcatggatgaggtattcacatttttaaaaagttggctttatttataaaatgtcatttctccacaatctctccacattctcttgaatgtgacccttggttcctgactcctctgtagggctttaggaggagaaagactccctttctttcacatcatccagaccctgatgatgagcatccctaacttctgtagaataatctcgtctaaagtggcccctgggacttcccagatggagctagtggtaaagaacccgcctgccaatgaggagacataagagatgcaggttcagtccctgggtcgggaagatcccccggaggagggcctgacaacccactccagtattcttgcctggagaatctccgtggacagagtagcctgatgggctacaatccatggagtcacagagtcggacgtgcctgaagcgactcagcacgcatgcgcacaaagtggcccgcggcggtatttgcttgccactgaagctcatgacagcacacggccttgggctccacctttcgtccccagagagaagaagggcaccagagagtcagatgcctgagccccagagagtgtctgtgatggattctcacacgcaaggattaggtcttggtctgaaccacagaccaaacccataaaagaagagcacagagcaccagttccatcatggggctgttcatgcagaaccatgcttcatgttgacttgggaagaggctctcagacagatacagcactagagggtcacagaatgactttccatgacctcttgttctgtggaagccgggacattataacatctctgtttagaaatagaggacagcatattgttggcaaataatcaaatagactgtttgacctattgaagtcattatttctccaaatggagtcacagttataaatgaaggaaaaatgtttcaggctttaagtatcactgtgtgaagggtatgcttcccctccatctagaaggtaccaaaaattctattttgagagaactgggtggtggttagaatttccaagtctggagagactggtcctgtagatcagctgggacataacaggactttagccaaagccaagtacacactgacagatccttgtggtggcccttctgggtaccagtttagtgatgtgtgcctgccatgctggttcctggcatgggaattcattttgatgccactatacattttttctcatctatccaaggggaaggctatgatgaggaacagcaaaggctgagcaaggaaggaaacaggcaaaatgcactgtca

SEQ ID NO: 43261 - DNA, 768 bp, Bovine  19866880526505
cctcgaggctgatgatggggtgagccctaaagggtctgggggcgtcacctgcctgccacagcacctggcttcctgtgaggaagagaatttaggccagaaggcacatagcctcctagcctgcggcttgcttgacctcagtgaatttatatttgtttaaagtataatgagatttggagcattgtttaaaatggaaattttgtttacttatatataagtaataatccccttggacctgggagccagaactcaattaaggaaaagtttattaattagtcaccctacagggaagcagagcaaagcaaactgctggtaacgggccattagacatgaagatgatggatccaaagagttcaaattagttgtctgctgtaagaactaaacacaccatgtgtgcataggcacctggatcttatacacatatatgcattttataaacacacacatacatacacatacgcacatgagtggaccgacgaaaatgttttcaacatgtccaatcaagatagaaaagaacattctgtgttgatatatcactgctttgcagatagcactgggttaagcttaaaatatttcctggtttaaacgttgttggagaattagtgaggctgattcttcacccagcacagagccttcccctgctttgctaagctacctctgtaaaggcttgagattccccttggaaacggcactattgaggaagagaccctaaaaccatagcagtcaggagttgctccccataaagatgagtaattaggagttcaaagccag

SEQ ID NO: 43262 - DNA, 1687 bp, Bovine  19866881018039
ttgggaggaacttggttccctctcttttggaaggcatttagacctccacacgccagggggtcatacaaggtgatctgcttcttccgcgggtccacctttaagaaagagctggattctgaggtatcgcgagccagcgtggaacagatgcgaagcatgactttcacctgttaagaaacaaaggcaggaaatgacaggcattaaggtgggctgccgtctatggggtcgcacagagtcggacacgactgaagggacttagcagcagcagcagcaagacacttggatactttatgacggagcacttttatgtcctttggagacacaagtgtatatggcagtgtggaatcatctcatgacaaattacgataaaatgcacaatgaattagcaacataatcctcagcaggtcatgggaaaactgacttatttataattaccaggtagaatattttgataggtccgttactttattacagaactggcacatcacgctctttgtcttcctattaatataaatagaaagttaagtgtacccaggtggcccaattacttagatgaaaaggtaatctggactgccacgctttgggggctagcgtagttcccttgaagctcgcagatcaataaaccctggacataaaagttagctccgtaatttactccttgcctcttgcacatcaggactcttagagacaaaaacccacagttattagtgtcatcattagaggcctgggaaaatggcttgtttttaatgaccagcatttgaaatgtgttccaaggggcaaaagtgatacaagatttgtttgaaacatgttattttgggatcctattaagtgagtgcatagaaatggtcatttcagggggatgaaagcacatctctgcgggaaacaggttaaagacctgcctcttaagtcatcgaacgtggacatttctagtgctcaatccagcccagccccatcccagggctgagcagggcacttgtgggaatggactgcttgccctggactctttgagttgagtaggagtcgagctgaagcctcacgcacagttctggaggctcaagtcctgagaaaatggcagcatttgctcccttaccagctcttgttatcgtggagctagttcagtccaaatgtgtaagcacctaacctaggcgccaggcactggggctgcaaagaccataatacggtctctttgcaaagaccagaagggcagacagacacgaaggcaggggatttttttaatacaaggaggcaaattctgatgttatgaatagggttacttttattatttaaatttatatatttatttaattggccatgctgtgtggaatgtgggatcttcattccccgaccagggatcaaacccacgccacccctcaccccacatacacacattagctttgttgcaattggaagcttagagtcttaccactggatcaccagggaagtcccacataggggttatttttgaattcctctctacatcatgccctcttcatctaatcaatgttcaggcctgatgaaatctcaatcatcaattttggggaaaaagactgtaaaattttacatcaaagatttcaagcacacagaaatgctcagagaatactctccactgtgcctagcgagtgaggtcatcctcctgcttatctcagcctgtctgctgaggcacaggaactcatctgcagagggcaaagct

SEQ ID NO: 43263 - DNA, 932 bp, Bovine  19866881356872
agaactgctggcaaaagagacctccctcttctcctggtttgtgagaaagggcgagagtggacgtgggattgttgtggaaagctaaaacaaaacaacaggtttccccgaatgactgattaagtgccttgcaaatctttgttattatccaaacgtttatgttcatactttcttgtgtacagatggtgctagtcaagatgaaaacaacaacatgaacaacaacaaaaaaatcaaacacatttttgcaatgtatttacagctcgttttctcttggtgttttagcctatttctgacttgctatttctaagtaagttgtgtttgtagagctctttcctaatcagtattgcatatgaataaatgttaactgtctgctatggttctgctgggaaggccactcgaacagaagctagagacttctgggcccaagccagtgtgtttccagggacggttggaaccacaggtgatgctcattgccacctcccaccagtggcagggtcagagggcagacttggaggtcgattatggagcacgcgcacgtgagcttgagagaaacaggtgtgtcttcagggggaaaggcgcctctatgaccctggccctccttaccctttgagtgggatgtttgtgctgaatagttgcccctccaagtcctgaggcacgtcagttcagctcagttactcagtcatatccgactctttacatgtcctgaggcacgtaagactggttcctttttacccacgacgctggggtcttcaaaaacatttttcatattcatttttattccaaagattctggatctaaagaacacatgaaccagttcaacggagccatattttttgttccccagttttgcaaatttattagagcagaggattttccccagtctggagaccttcttggacttgtagatgctcagagacggaagtagttttggtcca

SEQ ID NO: 43264 - DNA, 1758 bp, Bovine  19866881797498
atgacggttctgtaaaacttcccatattttgaatttagctggttgcttttatttgttcctctaccaattgtttttcctgtaaaatggaattttatgggcttgattaaatttctttttttgttgttgtcaaggattctttataggtggtacaaaatcttactgtgtcagctcagacaacaggtagtgtctggctgtcccatgttagtgatgctaagattgatgactgggttcagatggtaacaaccttacacactgtaaaaattttccatcattctttgatctactggtttcatatagtgatacattttccatggattagttatttcttcaagagttgcaaaatgctgatttttctaattcaattattagaattagatttcacatttatcagctaaaattcatactaatacattatagctacttggttacactaaaatacagtttatatccattctaaaaaagagtcctaacgataagtggtttttgctgccatacaaatgttagaactgctacctgtagtgaagaaatgtgacctgtaattgcatcacgtgggaaaacctcagcaagaccaacaacataggtcctgccatcgggtgtgtttttctctatccccttttaatttgagacattccagttccctgacctgaagccttctgggagaatatagcagaaagatcttggtgcttatgggtcttagttaaattagcatgtgctgctgcttttctcttgcttgtttaaacaccttcccttcctatacacttcaccacggaaacaccaagggagctttttcctttctgggcccagcatcctgggccacacgattgctagcactatatccacaaaaagaaaattcataacaccaaacaagcagaatgcctgggtgaatgaaaattttgttattatacagtctgcttgtgtttttgtggcagcattttgatttctgaatcttggagtcaactctgactgccagacctcagcgggtctccaggccctatccagccagctgtagaacatcttttacgtcagatccttctcttctgttctcattaccaccatcctgcctcaggtctctctgcctctagagtctcaccttcccactcaaactcctgttttagtccttgggcatccttcattccttctctggttcaggccctcagcctggccttgattctgtgataagacctcttgcaggcctcctccctcctcatcactgtcacatgcggagagctgatgaaagctgtgccttgggtagagaacttctcccagcaggagtgagcttcaccaggtttccttggggtgctgttccggcaagtaatcatgatgcttattccatatgtcagctgggaggcctccagaaacaacccaggcacatgcacagcaccccctgccagagctgcaaggctgctccctaaatatttatgtggaagtccccctcccagacaacttccttatcctctcctgattaaactccactttgtttttttttaatatctttaagcaaccagagcaggtacctgtcatggagtaattatatgcaccactttctctgcaaccatagaacccaagattttctttgcttctgctaactgacatgacagacatccacttaatagaatgatgattagtataaaattactttttggcctttaaatttaattatgtcacattcatagcaataaaataaagttccaaatccaggtgtgcttttcaaggaacgtgtccgaggcaattaagtacagggaaaggcgtcctacactt

SEQ ID NO: 43265 - DNA, 2141 bp, Bovine  19866880135089
tcaattttgctgtgaatttgactgttctaaaaaaataatttttaaataaaaaagtgaaattgccaagtaaaagaaaaaaaagtaggctctgtctgggtcttcagtggagaatggactagagatgagcaagagtggaagctgaagaagcgtgacagtgatccagcaaaaggtgatgacagctggacacaggggtgacactggagcaagagagaagcggacgactcaaaatgtgttttggtgatgggatgccagaacttgctgagggattggatctgatggaaaaggaaatgagcaaccaaggatgacactggctaactagtggtactatttattgagcactggagggtgggagggagttgggggtggctgtggagctcaggggggttttgaaggaaaaggcaaccaagtttcactttagttacattgagtctgagatattcagttggaggcactgagtaggttatctttgcttgtttttactttgtggcaacagaagtttcactcactaatggcagtttctcaaaaatgacctttcctgatttggacttttaacttcttatttgcataactgaagggcccattttgctggtttttcaagaataaaagaaaaagctgactcatatatttattgttgttcagtcgctaagtctagtccaactctgcaactcaaatacgtactgtcaaatactccagaaaattgcttgcagttttgaaatgagtttttcccgctctgtttccatttctgcagaggtttcagtgatttgaggccaagtttcagacagctcaggctctagtagtctctgctgctgctgctgctaagtcgcatcagtcatgtccgactctgtgcaaccccatagacggcagcccaacaggctcctctgtccctgggattctccaagcaagaacactggagtgggctgccatttccttctccaatgcatgaaagtgaaaagtgaaagtgaagtcgctcagtcgtgtccgactcttagcgaccccatggactgcagcctaccaggttcttccgtccatgagatttcccaggcaagagtcctggagtggggtgccattgccttagaagcaaatctctcacagcgtaggtgcatgagaacacaggctcagctggggatatggaatcatacactgatgagaagacttactgtgctagacagtatacacttgtttatttctcagtcgtctccactagactgtgagtatgctattgccagggatttgatatccttagcattagcatatatacaatattggatatttgtgtattcggttagcaaataggccaactttgagccactggatttttcatttacagattcaaggctgtattacctcaagtcacatcagtggttaaaaactataaccaaacagcccatttggtttgtttgttttaattttttttaattatgaaagtataataacacatttacaggagactcagaaagtacagaacaaagttacaaaggttccactatataatctgttgctttttatatgcaaaaagcaactagttaagtccgatttctttcacaggattgactaaatttagtaatttagtagtaatttagcagaaaccctttcttacaagggtgataccaggtcagtgttgggtgcagttaaaggtttagaggttctgatgctttctttttggccttttatgagaattgttttctttttttcaaatcacaaaatgttcactttctaaaaaaaagcttgtttggtgtttaaggagaaatatcactatttttctgtgatttttttttttgtttgtttgtttgttcattcactcaataaaattctgagtgactgctgtctctgaaactcttctgggcccatcaacaaaaaatttcacatttagagtttacactttggtaggaggagacatgcaaatcatgtgtagggtgttaattgaaatactataaggaaaaaatgcaacacaccctttaggcttaaaaagaaaaaaataagtaggtttaagaagatgaagtgtagagaaaattgtgcatttgtagagaggacagtctgacttctctgaggaaataacatttgatctaagatgtgaatgaagtcaagatgggagctgtttgaggatagtaagaacgttccaggaagaacagtaagtgcaaaag

SEQ ID NO: 43266 - DNA, 869 bp, Bovine  19866880421552
aagttctgaaatgatgccttatattctctgaataaaagataactgccttcagggtaaataatatgcctgcacttgcagctctcttcctaccttaaaccatcactataatggcccaaggctctgcttctcatcactacacaggaagagagaacaaggtgtggcttacaaagctggtagccctaggcacatgtcactttacttttttgccttctcttttttcttccatttagagtcttctgtgccaactctcagattggtaaacagagggtggggctaaaggtcgaaaggtgacagatctcaatctgaactcactagcttaatcagctgcatttcttcattttaatcaggaaatcctggagtgacccagtcagcaagagcacttgtggggcgacaaagaagggagggaggggaaggagaagagggaggagtcctgtatcgaggaagggaggggcgcctctctcttttctgggctcaaaatggatcttcctttctttagaccacatgttcaatctctgacaaatttttttcctttgagattctgttggttttatcatctctttcctgactagaggggatttcactgcatttgcagataaggtctgtttccagatatagccaaattggtctacactctattttgttacattgtaaagcatacagatatttgtggtaagaccaaggatataaaatataactataaaatgtgtttatagacatgggaaatagtcctaatacattgtttagcaatagatgcagattttttttaatgtaagccaatagatacatatgtatggaaacatctatgtatctttaaatggctagcatatattgagtgattattatgatctagatgtaaagttagctctgag

SEQ ID NO: 43267 - DNA, 1903 bp, Bovine  19866880435359
cttatcccctcccagcatcagagtcttttccaatgagtcaacacttttgcatgaggtggccaaaagtactggagtttcagctttagcatcattccttccaaagaacacccaggactgatctcctttagaatggactggttggatctccttgcagtccaagggactctcaagagtcttctccaacaccacagttcaaaagcatcaattcttcggctctcagctttcttcacagtccaactctcacatccatacatgactactggaaaaaccatagccttgcataaacatatattagaataacatcttatggatgagctggaatggaaacataagtttaagggaaaaaatgatgtaaatacttataaagaaagcataaatactttttaaatggatggtagggatattaaattgctatggtatttagatcacattaatttatattaaaaaggaatacaacattttaatttttaagtaaaatatttccctgagagaaattatatcctctgtaactatctgaacttacaataaaaattttcagctgtaacaatgtgcaagagtgacacatgcttttgcaaaattcttctgggctgcctaaatgggaaaagaatctgaaaaatagatacatgtgtgtatatatatatatatatatatatatatatatatataactgaatcactttgttgtacacctgaaactaccacaacattgttaaatcaactccactccaatataaaataaaaagttaaaaaaattctattaggctgcatgtgaataggaaagtttaaggaccattatgctacaggaacacagcatttgtctactatttgtattgaaaaagcagttatttctaaaatcttctgtagaaggcagaaaatcatatcctgagagtacagcatcatagcaatgtatcactaaagcaaacataatcttctgaaataactatttgtgtctcagccaacacctcctactattggctgcctacttcttctacaagtacatcttaaaacttatttgccagctcatcatgcatatcagggaagaaataagaatttgggaagctgctgtaacataataatattaaaccacactgtgataagtgataattctcttatataattaaaggcacatgcatacacatgatcacataagccttgacccaatccagcataacacatgtggctgacatgtaggattacattagttttccaggagttgctcccaaggactaatcaggaagttggttaccctcatgggaacgtcatatacctaaataaaataggccaacattgtacacaggaacaacaacgcataaaacaggaaatgatcatctctttgcatgttttaatttatcttcagggcaaagtgacagtaaaccattaaagttaaactggaattaacttttaataaaaatccagggaaaaaagtagttaaaacaagtttgctggagctattagaacacagagttctgctacaaaattgttcagaaaaagctttacaatctaaacacactgaaactccctagtgtaaaacactcttagctaaattatgggaaaagccaatgttgtatcagcaccaaacaatcacccagcatcagaatgaaaagaaggaaatgttgttctgaatagcttgccaaggctaaagaaaagtagaacagttgctgaagacgggttgtacagaccaaaaggacgcattttaatttgtgttgccacttaaattttgaaataggtcattatcttcaaattttgggtaaatatactgcatcagagtgaaagagagagaaaaagagagagggaggaagagaggaaaaagggcttgacaacaaacagtgaaaaatgcattttaatttttagatttctctcaattgatatatcctataactcattataggagtatgcaggctgtg

SEQ ID NO: 43268 - DNA, 2037 bp, Bovine  19866880439177
tctaagggtccagcttgtattctgtctattcaaaagttaccttcaggtgctctctaggtgggggaaacgctaaactcataatctatatcaaattttttattattgtttattacctcatatttgtcttatgcattttttcactcttaactagtgccttatatatgattaaatatttcattttgaattgagtttttatcttcaatagattaaaaaaaatcattattcagtatcaagttagataaactgctttccctataacttactctcggttaaaataaaaaaagcctgtatttacctcatgtttttgaaaactgctctttttataatctttaaatgtagacctgcatcagtaatggtttgaagggaaatgatcataagaacaaatgcttacatttttagaatagtaggtacacaggcctcggcaacctcagttctcgtcaactgtatgattttgttccagtttccttttgtactttactggtaagtccttgaattgtgaaacacaaagggactggtccttctgttctttgaggtactgacatctaaatggtgaaactgtttgcataatgttccagaattcattgaagaagtttgtaccacagccatggaaatggttacagtctataaatcagggtcctagaaagcagtgcttatgtgaggttttctttaatcgcccaaattagacagttcagagaagcttttacacaaagtgtttcagcctagtgtttacatgtgactagcatctcaatgcttttttaaatgaactgttccttgctttttgaatgaagaatttatgtccatgactatatttctgtgactcttaaaatattgaaaacttgtttatttatttatggtgacatatataattttctttaatggttttaccttaaggtttttttaaatagagtaatgttaatattccaaaatctgatcagagatgccaaaaatccttttcaaaatgtaaacgattgaacttgtcagattaagtcataagcatagtttcaaatatttggtaatatttgagctcattccaataaggaaagcagttggattatagtgtaacacagcattttagagcatcttcattataaacattatcattgttagattatcacatccctaacatttattaagtctttactatagcactgggcgctacatacagtatatcagttaatccttaacaaaacagattgttaggtttataattattgtatcgaattggcaggggagttcctcctggaagtcacccagctagtcaccatgatcatccaggtagtaggaaccagagcaatgcttgctccacagcgtttgcttgctccacagcgtttgcttgctgtgtgaggtattaggaagactgcatatttcctgagagctggagctctgtttgcttctcactttatacccatgcataatgtaatgcctggcacattgtggatgattcatagtaaatatttgttagatacgtttgcctctcatagaacaatagcagtgacagaaacccccaacagagcaaggcttattccttgtagcctacctgaatgaattccaaagatctcacattgaaactctacagtttttttacagagaaatcatattaggtatggctggaaggtttatgatttcattctgagagttatataggtctttgtaaactaatctgtgagtttgactgcccttgaatagcatggcttcaatgcctctttagacaattttcaaatggactttgggaataaagcctactggtaagtaggttggaggttgtgaccatgtgaggaatatgatgaaatgaaccttctcttggtagctcagagtcatcattatgagtgtgagtgatagattttaagccctccatgtataaacatccagaagggtcgagcttctttaggcatgtagagatgggggactctgaacatgcctcttgcagcagcattgttcaaatgaagaactttaggcttagaaaagttaggtgatctcgtgaagtcatacagctgtttcaaccgaacagctaatttgtggcagaggactaggtgtgat

SEQ ID NO: 43269 - DNA, 1449 bp, Bovine  19866880583677
caaccaacgtgattcaactataatgtactttacaccctgtcaatcttctgctcatggacttcccttggggctccgacggtaaagcatctgcctacaatgtgggagacctgggttcaatccctgggtcgggaagatctcctggaaaagaaaatggcaacccactccagtattcttgcctggaaaatcccatggacagaggagcctggtaggctacagcccatggggtcgcaaagagtcagacacgactgagcaacttcactcactcaatcttctgctcagaatgttccactgacttctagcctcacctagaatgaaaggcagacaaacccctatactatacaacatgtcctcatttcctgtactctctgccttgcccactgctccagccacactgccctccttgtttttccttgaatatgctagatgtcctctcagatgagggtttctgcatttatgtctcttcctagaatgctcttctattgcatattcacatgtccaatgtctcatgtcctttaaacctttgttcaaatgtcttttccagtgtggttattctaaacaacttatttaaatttacagtttctctttgctttgtgccttggctcccttcttgctttatttttcttcatagtacttccaccattaaaattattatatattttacttctcttgtttattttctgccttttccacctaaatgaagtctgtaaagtgagggattattttatgacttgtttactgctatatctcctgtgcagtatctgacattcaataggtactactaaataaaactaaatcactacttaataagtatttgtcttaatgcacaagggaataaatagcatttgagagaataaaagcatactgtgcaggggtctgaattctggttttgactgggcgttctatgaactgtctccactgtggactcgtagttccacctctgagctttattttcctaatctttaaaacctatttaaaaataagattatttcagggagtgcagtcccctgtttgcacaaaaaggaatttaattccttcttattccccacttcccccaatatactcacaatcaaagctttatgtcaatcttacttcaggaaaattagattccctatgggacagttttttttctttttaactgccactgaaataaattgccagttaggtaaatactgtatttagagatgggaggcattaaagagaccttagcagaattaggatcccccatatcttaggatgtatgaaaaggaaagggaaagagacattagatgcctctctttctgtccttgccctcatattaaagttcaagttaaggaacgagaaatgaaaaggattttgcatttttcatggttagtcaggctcatgtggtttgcatagtcgtaatacaattcaaatgaccatttttgaagttttaatattcagtgccctttgtcccagctaggcaaaataaca

SEQ ID NO: 43270 - DNA, 1092 bp, Bovine  19866880647513
ttgcagcagtcatgaggttttggtaaaccagatgagctcatcagcttgcaaggagaacctgcaggaggaagttccaaggttggtgatgctgttggaagaaacatctgtggctgacctggagtgttattttgggatattcagtccagcatcacactgcctaggaaaacaagaatgcaacagcagttgaataccatggagatgggaaatgacaggcttttagtcatgaatttacaaaaaatttttttctaacctaataatctagttaaaggaggtaccccagatttggtgagcttctgaccttaggcaaaagagatactccatagataaaatactacactcagagcacaaatacccttctcctctaaaaagaaaaataaaatgtaagaatagcaatcttgaactgcaaacttccttttagaaacagaagtatttcttattctttgtgtaggttcaaaattggtggggacttcttttttcccccagtgagtctatgagaaccctgttgttttttttgacagaaacatgacatacttttaaaagaatacagtcatctggaaaacaatttacactttgcattttcaccttgctaaattgtattcagattctctttagtgctgctcctctcacaagacatgaagcattttggttcttaaacacttatgagtggtacactgcttgagatgtacaaatagctttcattagtgctaatgggagttatacttctgaaccaggagagaatagagcctgaagattttaaactgtccttcatgcaaatctcccagatggaataaattatgagggatgcttagaaggcagaggtctaaatatcccctaaagccatagtttaatggccgagtagcagaagtggagtcacagtaatggctttggggctaatgccatgctaagtagctgatattgactcttgaaaattcttattggattagtactgcactcgaattccattagttttcaaaggacccgagagatagttctctatcttgaatagtccactaaaacgggttcaatttggttcagctttcaaggccatttgttttaaattctgtagatttctaatcagcaagccctataaca

SEQ ID NO: 43271 - DNA, 1665 bp, Bovine  19866880699055
tatggtgaccatgggtaaggggtaagattcagcttctctaggcctcagttttcttagccataaagtgaagttctctaaggctcttttatttatttatttattttttcttaattcttttcagttggattcttacatgtttacctgtccatgtgtccaaataatctataaattccatgcttcaaggattttctatttatttattctaaagcaatttggtacttaaaattagtttaaagattaagtaggagagctataattattaatgggtttcagtacaaaactttcccccttagacggaagaaaaatatctgcaaacttttcactcatttgacttcagcagagataaatttaggagatttgatttctgtttttgtttggtgccattaagtcttaatgctcaacagctcaaactcaagggtatttggaaaatgaacttgatttgcctagtgaatgtgaatgaatagcctttgtttactagcctaccaaaatgtatttcaatccattctcaaactagtaaagaaaggtagaaaaaaagagtaaaaaaaaataacctgaaatacatcacttgcattctggttactgctcctgtcagaaaactggaattcttgatagtcatctcttcaggaaaacatcatttgattatcttttctaattatgttcttttccttttgctatagcagagctcaacttgatccaataaccttaactgattcttcaataatcccatatgttgctaatgcttctcaagaaactgtgcttggctgactgttttcaattatgctggttgtacatgcagagtttacatctgtacagccttctgagctccttgaaaggccctcttatgtaaatacaggggaaagtagccagttcttgtatcagctgacagcaaaccatatgaattataggggcatatctttcagaatacaagggacagaattctgggtggaaaaatgaaaagtactgtttcttcatacagcaaatatttgccacttcctttgcctctccttgcaggaaccatatagttgaagatttaaacagagaacagaagtttcttctggctttaattatcttgcctgaagtttttctttttttccccaaaacgtctgtctttcactatgtttaacagtcctgtctccattccacatttgattgtaaaattctttggagttgggacctttgtattcttcttatttcacagtcttgaatcaagacaatgtgttatcatcatggcggtttgcaatggaaagcagccttgcaaagaaagcaatggctcactgaactagtgtgttccctggcactaaaaatttcaagtggaatagtaggttagatgttgagttagatattttgggaggcaaatcttccttccataacttaaagatcacacaggtgtacctttctggaggatgaatgtctttcagagacaccattttcagaagctaattatttagagctgttcttttcatttcttagcctatctatcccagtagttattctttgccgtgacattctaagcctcaggttccttatctataaaatgaagtatatctgccctcactaaaataaaagactgtgatataacacgatgaaatcttgagtttaaatcccagcttcaccattactagctgtgtgaccttaggaaaattatgcaaatatgctgagtctatg

SEQ ID NO: 43272 - DNA, 1542 bp, Bovine  19866880702895
cagtatttatatttcatatcataaatatttacatttaatgttgtgatgcatctgttagtaatcactttatcccaggtgaattaaaaccttccattttgagacctttgcatttaataaagattagctctgtttttcttctagtgtcacgtataaacctcatattttgcttgatatttgcagccttccctagcgatccagaaattgaaatgagtggcccattagtgagtggaaacccagtcactgtaagctgcagggttcctaatgtgtatccttctgaccggctggagattgaattgtttaaaggggagagtattatgatgaataaaaccttctcgaaagatttaagtaagaaagccctagagaccaagagtttggagaagaccttcatccccaccactgaagatactggaaatgttcttgtttgtctggctcggttaccaattgatgaaatggaatttgaactcaaacaaaggcagagtacacaaacactttatgttaatggtaagtacatgtgtgatgtattcacaatagattatgatttttttttatcatgtttgccaggtaatagtcaacatgaggttcatagttgaaaccactgtgaaaaaataattgaaaaaaaactacaaaatattgattgtttttttaaaaaaaagcacctccaagcttaaagcaactgtttatttgcttatgattctaagctgacactttgagaagaggtcaaacgggtagtatgttcattatggtattagatgagtttacgtattcatttagttggttagaaggtcagtgggggggtggtcccaggtagcttcactcacacatctgggccttcgctgggggtgtctggactttcctttctccatgtggtgtctctcagggaaggtagcgtagatttagtcaccagagtgcagtgtttcaagagagtgataatgaaggtggcttcttgtggtctaggcttggaagtcctagagtgttacttcttccagggtatattggtcaaagttaatcacaaggggagcctagattcaagaggtaggaaaatagagtccaccttttcataggtggtttacatggctcatggtcatgtttaacctaccataaatgtcaatacacactatcattgaccatccagtctttgatagcaagagagtaaatacccatgatgcacccatgttctactctttcattctgtattgggcttccctggtggctcagtggtaaagagccagtgcaggagatgcgagttggatcctagggtggggaagatctcctgaagaggaaatggcagcccactccagtattcttgcctggggaatcccacggacataggagcctggcaggctacagtccgtgggctcacaaacaagcagacatgacttagggactaaacaatagcaacaacaattactctgtatctgttatagtaaattggggcagaaacttcctttggtaaagttatcaagatacaaattggtctaatccactaaactcaaagccaagttttataacattagtaaaactctttggcagggtgtaaccagc

SEQ ID NO: 43273 - DNA, 936 bp, Bovine  19866880717384
gtctagagagtgtgtcctttttatgttcttgctctttcccctgttctctaatttttaatgtccagagttaagaaaataataggatattttactcttggactgtaagtggtcactatttattctccagataaagtgtagcacactttcttcttaaaattgacattatagttatatgctcatttcacataaccattgcaattgtcttataacccataatctaggttcacaagtgaaagctgattctgtatctgtaggaaaaaaattcatttctgtggcatatgcattaaaaaccacatggctttttaattttgttcttttctaagtgctctcatttactttaaaatctaatttaggtggtgatttagaagaatgagacctattaaagtaaaactaaccaaaattaaagttattttatagaggaggggtgaggatcccattatggtttcttattataagcactcttagaatagtccacaagacaacatataaagttaaagaatgacagcagcttgccccagtactttaatttactatatagatattctttcattctagaagatgaatttccttccagagctcagatttaaaactgagatatttcttttaatactcaatctgaattctttcaaccaattggaaatcttgaaaaaaaaaaaaaaaaggaatgaatgccattaatacaatctaaagtgtttttggtccagctaatattgtctaatatgatctctaataatgtcataaacacacacacacctttgcatatacatatatagacacatatcttctttcagatgcccaaactttcatttttatttagctttacagtttaataaagacacccaggacagagaacccatctcaacaatgacaccatttctcctttattactttgctttgatgtttaaaaaaagacctagtaggcatgtagggcagata

SEQ ID NO: 43274 - DNA, 1326 bp, Bovine  19866880781112
tcacattctttatatattgattccttttatacaatatgggaatttcagaatttagataaatgcaatttatctgggtagtatgtagaccttgctgatattagtaactttgatgtctgttccgattttgatctctctcgtcttttcaatgggaaatgtgacaggtggtaaattgggtagaaggaagttaatcttcagtttgcaggagtgaaagtttactttccacatgtccggacttttgttttctccttttaggagagtcaagccccacccggcgagaagctgtgaagagaagaactgcagaatatctcatgcgagcagagactctctctagcctttgtgcgaaacctcagcttgatgatgtgtctcaggtatgtcttatgtttcattgtgcatttccttttagccatctttgctgttttttttttctcttgattttattttgaactaggatgtttgagaattttggtctttggaattttatcagtgattttctttctttcttttttttttttagcagaaattttattggaagaattctgatacactcatttattattttttaaaaatacgtttgaggttaaaatatatccgtgaatgtcttcagttagaaaaaagcaaaatatgagcttgttgtgttgttcttaggcaaatcataattgctcactctagtgtattcaaaccaaattaaaacatagtctttgacacttcaaccctagccgtgtattcagacgttttagaattgttttgatggcatcctcttcaccaaagaaatcaaacccagatcaaacttggccatatgtttagaaaccattaaagacagataggtaaaatgttgtaggggtgtttaaaatatacaagaaaggatttggcagtttttcattcacagtatttctgacacagaagacccattgtgtttcttgatcagactcacaaacgttcgggcaaaatatcacttgggcagatatatcactgaatttgctgctcttagaggaagcaatgagactccttggcaagctcttgacaggatacctctagttcaaaatggcagctttattgagcctaattgatgtatgatacatgatacttaaaattcaaaataaagctttttcgttctgccagcaaaagagaagttttacattggcagcagcaatgaaaagagatggcaaataagtaaaacccaaagaaataaagagaagctctatgaaaatttattatttagaggggaaaaagagaagatgaaaactattctaggaatattagatcacttaatgaatacatgtagtgctgcttttatagaagcaccttcaagatataccttgaaagagt

SEQ ID NO: 43275 - DNA, 1052 bp, Bovine  19866880781983
atcactgccctgagcagggctttgtcatttccctacctttctaaaggccaaaaatgctaatactccaagagaaggggtgggagtaaagggaggcagtgctaaaaaaaatcaccagttttcttaaaaatgcatataattgatactatgatttattttgttgtaatgtgtctctctcaagattcttcttgagatttaacgtaaacccaagtgtcctgtttatccgcatgggttcaggaaggcctgtggagagggaacaagacaccagagagggaacaggcacaggctgtgatttgccctcagtctctaacctcccacgggatagtcttgagtacagaagagcgactaagatgacttctaccaaggaaacaatccactttcccccacgcctccaccttcgggtggaagaagatgtgagagttgagaaagagattatctaaaacctcaagagattctctgaagagaatggagattttcctttgtaatttgacttctactgcacacccagctcaccccacattcttgacagtgatgtggttcacttagagatttaatgcaaaatatgacatgtcctttcattcaaaaccacgaaagcaaaatgatgcattgagtttccctcattttaaatcgctgtcagccatactctttatttccctccctttaacaattaaaatgttttagggctcttatttttttctgccagaggagatgaggacagaaggggacaactgctaaatctgatgaatttccatatagtattactgatatacatgtatatcccattaaatttggatttattctttctgttcctgttatatttacctactgcttgccattaactatgccaatgtggccctattattaaaaagttgtttctaaaagaccaacttttttgatacctttgtttaaatacttatgaaagttaaaactcaacatttgtttacttatagagctatttatttttttctctgaacattgtttcaacaatttgtatattttgactacatactttctcaccttgtcagtcagataaacatatggctaagatggggcac

SEQ ID NO: 43276 - DNA, 1060 bp, Bovine  19866880799798
tgtgtccctccctcctgatttatgaatatgccacctgtggatcctttatccgagatcctcagtacatcctcactgaagtcatgtgtaagagcaatgtcagagggatgttatttagaccagcctgtgtttcttgccagttggtgtttttgatgaaactaatacctatcttttctcttcacagttttcagtctgattttcccaagtccagtgaatatgtctggtaataaccaatattcttgacatcaaaccccaggatgagagagtcacttcctttaacattcagatcaccataatgtacccatgtgttctcctctttgttggtgatagttaagccccaagtccaagtgcattgtattctcaaacttctgagtgataaaattacctccaagacatcagtgtattggctgatctgtttttgtcaggcttcccaatggctcagtggtgaagaatcctgccaagcagaagacacaggttcaaccttgcagtagattacacagaggctaaagcatccctactctcccatcaaatcaatatcttgtttccttgccaactttaagtttctattgagaaatcatcctctatgttcctttttggataagtgttcaacaatatcactaccttttatccttacaaaaatgttctataccatttatttattcatttaacagatacttattaagcacatgtgctttattagttttctcgagctacagttaacaaagtactatagactggggtggcttaaacaacagaaattaatttttttcagagtcctgcaggctgcaagtctgacatcaaggtattagtagagttcagttcttcagagggctctgaatcagggatgtggtccagacctctcccctgggcttgtgcatggctgtctcctccctctgtctccacatcaccttccctctgttcatgcccatgtaccagtcatactggattaaggccctctctaatgagctcatcttaacttgattacctctttaagaaccctacctccaaatatggccacattctgaagtccttcgggatgactttaacctgtaatttagaggga

SEQ ID NO: 43277 - DNA, 973 bp, Bovine  19866880879907
ttgcttaccttgaacaattaatttcacctcttttctgtctttcccaacagggttatttccttcacacacataaatcccagaatcttctgccctcatagaaattaaagtgagagttgcattctcagaaaggagctgtaggttcccattgtctaatttcttgctccagagaatccgtggagctggtaaacctgcactggtacacgtcatcgtcacggagtcgccttcctgcagccttgtggagggattcacggatatagctgtgtctttgggggagactgagaaggcagggcacagtattagtcattgctaggcagcataatggtcccacagggcgactgtaaatactctcatggactgtatttacagctttctcaatctgacaaacttactctgccaaactagtataagaattgctgagtcatgaaaattagtcaatccagtttctgactgatttgatggagttactttttttgatggttggtgttttcagatggccatagacactcagaaattaagaaaaacccttagaattatgtgattcaatctcccaggtaaggtacaaattccagctcagcttcctcgccaaatgttcacgcaagacagcttcagtacttctggggcacaaggcagtccacggccttataggaaatattgtccatgtgatttttggacagctctgattgttagaacgttttccctctattgagctgaaatctttctctttgtaactaacttctatacaccggtcatagttcagtcctctattgctaaagaataatccaaatttcacttctacatgacagccattcagatacttaattatagctctcatttccaagttttatgttcctaggaaaaatatctcctatttctgactattcttctcaaagcattgataaaatcctttccatctcattttgtctcagctagacatgttgtagaaggcaatgctccttttaactatggtgtctag

SEQ ID NO: 43278 - DNA, 921 bp, Bovine  19866880932634
aaggtcctctggggaacttttaaaacattctcaggttctgcctcaccctacctccagaacccccacctctaagattccagtttgataaatttaaattggttctgtttttgtaatgtagtcactaagtcatgtctgactctttgtgaccacatggactgaagcccaccaggctactttgtccatgggattttccaggcaagaatattggagtggattggcatttccttctccaggagatctttccggtcaaatctgtgtctcttgcacatgtctcctgcattgcaggcagattcttaaccattgaaccttttatgttttgatgatacgctagttaaatgaccagaaaatacatttaaggaatggacactaaactgaaagggatgaaatacaagaacttctaaacaatgtttaaccatatttcatgattatatatatgtaactacttgcacttcttgggggatttctattcaaattggacctctgaaaacactacatcttattattctaaagttacaaatgcatttcagtttctttagaatgtgttaggcttttgctgactaagcagcattacctcttagtagaggtccaaagctataatttgacccctctggcaaattaaatacaattatgcaaattaccaggatttgggcataatctaattagtacgatacatatgcaccagataataatttccctggctgaaagctagattgtcttatttcatgtttgaaatatgttttagaaaaacattctactatgtaagtaagatttcattatcttatatatactatttgctcagctccacaatggacatgtttagaaaaataaagccaaaattggaatcttcaagtgatgatgtattttgtcagaaattcatagttaccaaacaggatattccatgaaactagaaagaaaattcaa

SEQ ID NO: 43279 - DNA, 1533 bp, Bovine  19866880950366
tttccaaagtgatcagtttctgctaaatgcttattaataggttttctttaccatctgtatcttatgactttttttgcttttttggtgcaatggcaccaatttggtgtcaggccaggtctctttgggcagctttaattcttactttcactagtacagaacactataaagcacttattttacctttcaaaattgttcttttttcttttacatttgctttcttgctgacttttaatttctttctttcaaagtttccaaattcaaaaggtatgaatatacattaaccgtcaaacacgcactcaagaaattcactcatgatgacagatggccatttcaacacagtagctcataagtttcttttaatgtcaacagaaggaagttaagtgtccagtgaataatcttggatatttagcattaataatctaggattcttttctcttcagaaaacacacaacaaaaacttatctaacagtattatcagccctttgtcctttccataacacactgaatacctaagacaaatgtcttttttaaggttgctttcaatctgtccttcaaagatatctaagcctgtagttgtctatttcatgtgcatgaattaacagtaacacggtatagagagtaacagtgccaattctagaatcagatcaagcatagtctgattccatagctctatcaattactaaatttagggaaactacttaagtattccagttcagtttttctattggccagataacagtacttagctggattaatgtgaatattaaataaaataattcatggaaagcactcagtccaggatagtagtagtagtgttagttgctcagtcgtgtccaactctttgcaacccagtggactatcgcctgccaggttcctctgtctatgggattctccaggtaagaatactggagtggattgtcattcccttctccaaaggatcttcccaagccaggcatcgaacccaggtttcctgcactacaagcagattctttaccctccaagctacagggaaaatccttaatcctggatagacatgccataaattctcaacaaatattacttatcagttgtttttacaaaggtaccattaaaaatgtgccagacacatcaaacagggatttgttccccagctttgatcagcctgaaaaacaggcaccctaattctggaagcaatgggaccactgccgaaagaaaacttaggttcttcttcccctaggcatgtcattaatgttgacattgtttattgagtaaaaagaaatatgttggcttatgctatcattatccttagatcctgaaggtaatagtattagtagcatcattgctcaattgtgtccaattctttgcgaccccacggactgtagctcaccaggctctcctgtccatgagattctgcaggcaagaatcctggagtggattgctgttcccttctccgaaggatcttcctgacccagggatcaaacccaggtctcctgcattgcaagcagattctctactgtctgagctacaggggaagatcctgaagatatatttctt

SEQ ID NO: 43280 - DNA, 948 bp, Bovine  19866881014932
atggtgactacagccatgaagttaaaagatgcatactccttggaagaaaatttacgaccaacctagacagcatattaaaaagcagaaacattactttgccaacaaaggtccgtctagtcaaggctatggtttttccagtggtcatgtatggatgtgagagttgcactataaagacagctgagcactgaagaattgatgcttttgaactgtggtgttggagaagactcttgagagtcccttggactgaaaggagatccaaccagtccatcctaaaggaggtcagtcctgggtgttcattggagggactgatgttgaagctgaaactccaactttggccacctgatgtgactaactgactcatttgaaaagaccctgatgctggggaagattgaaggcgggagaaagggatgacaggatgagatggttggatggcatcaccaactcaatgggcatgagtctcagtaaagtctgggagttggtgatggacagggaggcctgccgtgctgcagttcacggggtcacaaagagctggacatgactgaataactgaataaattccaaaaagggctttttccccccaaaatgtggtatatatctggaaagagaaaatgacagtgaaagtcaagcccacacaaacacttgttcacaaaacacaggcaacaaataaatcacgtttgggaagcaattgtctttttcagactatatacaaatggaaaaagtcttcaaatgcttcagtaccttcattttgaaatgcctgtcagcctcaggagctggcccttataatacatttctggcaatatttgtgcctcattgttttcagagctattaatcaaatgctaaatattatgcaagtgctgtttaaaaatggagaaggcaatggcaccccactccagtactcttgcctggaaaatcacatggatggaggagcctggtaggctgcagtccatg

SEQ ID NO: 43281 - DNA, 1730 bp, Bovine  19866881018754
tctttgtcttgacatcatgaggcagaaaatcttttgcatatgtcaagacagatgtgttggtaagggcccttgctccttgcagtgctctttaaaccttggactcattcatttattcagtcaatatttattgagtacctattatgtgccaacactgtggtaggcattgaggatcagaagtgaatactacagaagttatctctgtcttcatggagttaccactgtaaagaagaaaatggaaacgagtgactgatcataatcaagtataataagaattgcaagaaggaactacagtaatgtggtgcgtttggcagaagcctatcatatttgggaatttgagaactgctctctgaagaaatgagaattacactgagatctggtgcatggaagaacagaaaaaaattacctaggtaaactggaagagaggagagtttcacacaaggtgaataccagggtgaggtggacataccaatgtcctcctgtaaggaaggacttgattctccagccttcggcagtgctgacaacctcttcaggcattgcttcagttgcagggagaatgtgacccttgcccaaggtcacgttttccctgcacatgcagaccaactctgctgggccatttctgtttcatagctacctgcacagttggctgaggctgtcaggcttgcatcacagcttgatttctcaatcctgctcccaccccctcccttccatgggtgttgatctcaagaacactccctaataaacatcctgaacactaaaccctgcctgagtctacttcctggagagcccaaactgaatgacaacataaaaagctttgccaaatcaaggcattcagaatgactgtagtttgagagacagagatgagctgtggtcaaaaaggtagacaggggtcagattctgagctcctgataaagcatgctaaggagttttcctaaaggcagcagccaataggaagccatagcaggatattaagcaggaatgacatcagtaaatttgtagttttgaaatttgcaatgcatgacaagggtgctttgaatatcaaattcatatctttcaaaaaaaaaaacaacccaacttcttccttctttcagatagtaatggtaaaataaaggtaccaaattgtttttcctatccttgaatcattgcttttcattccactccccttatcaataaaaactactaaatctgctccatggttcatgcagttataatcctatgaaatattacataatattaacttcttgaaagacttccgtcattgatcaatgtaaagaaatagaagaaaataatagaatgggaaagattagagatcccttcaagaaagctagagataccaagggaatatttcatgcaaagatgggctcaataaagaacagaagtgatatgaacctaacagaagcagaagatactaagcagaggtggcaagaatacacagaagaactatacaaaaaagatcttcatgatcccaggtaccacaatcagatgaatgtggtaatcactcacctagagccacacatgctagaatgtgaagtcaagtgagccttaggaagcatcactatgaaaaaagctagtggaggtgatggaattccagttgagctatttcaaatcctgaaagatgatgctgtgaaagtgctgcactcaatacatcagcaaatttggaaaagtcagcagtggccacaggactggaaaacgtcagttttcagtccaatcccaaagaaaggcaatgccaaaga

SEQ ID NO: 43282 - DNA, 1462 bp, Bovine  19866881089359
gaagtgttcacagatatcttttaaaaagtaattcatataaacagaaaacaatgaaatcatctacacaatcagactttcaagaagcttgtagtacctcaaacacattgtttaactgatttttgtaggtattagggtaagactgctgtttgttcagaacttttgttaaggactattgctttgttaggtgaatttatctatggaaagtggcaaccttttaattggttgccactgtattggttacaaacagaaacaatgtgacaaatgttaccaatgaacacttagttcataattcttttcattccaaattcctatttgtctcaggttatttgactcacagatttatctaattcatataaactgaaagtgaaagtgttagtcgacagttgtgtctgactctgcagctccatggattgtagcctggcaggtttctctgtccatggaattttccaggcaagaatactggattgagttgccattcccttctctaggggatcttcctgactcagggattgcataagcagctcatatacccacattagtaatcttgctttgtatttccattatttgcactcctaagttttttatcttcctcattgtctctatggattaatcaccatttataatatcaagatgaaatgtgttccatctggagttttcaactcctaaataaatggtgaacccaatataatataagtcaatatttaactgcatacatcctataataacaagattccattcaatttggttattagcactttatgatagcatctgtcttctaattgcatttttaatggtagttgctcatgcacttcatcatcaaagagaacctaagagatggtataaacagatatcatgtgaacagaacatatcaacacattagctaagtataaacatctggatataataagaaggagatagctcttttaatctgacctttaagtttctttttaggaaactgtaatgtgtgctaaggtgtggaacagaaaattgtgcattcatttacaatctggaaacttccatatatttcaagaatgcctaaatgcatgtttatttagtatacccatgaattcataaatcaagagggataacagaagtaaaagattatttttattgctaaatgttaaatcacataaaatcatacatcatgaattaattatgtaaaaatagagcaaatagccaccattaggaaaaggttaagtgtgaaggagcttttacataaactgtattaaaagacaatattggccttatttattttcctattccaaattattaaacttctaagacttctaaaggaaaataacaagcatatacaactcaatttgatctttaattaatgaatcaatttcaggccagtaattgccccaaataagaaaactctccttttcataaaattaatacaatattctctcctcaaaaaaaaaaaaaaaaagaggcatgtcttttttcaaaataaacaaagaaa

SEQ ID NO: 43283 - DNA, 1016 bp, Bovine  19866881159873
tgctcaagttcctgaaccaaggcaaagataataatgtgtgtcattttagctatgctctttttgtgtaagttgttatcttaccatcgacaactaatagaaccattctgtataaagctattagactaatctaactaaaatcagaatctgactctatatttccctcaaaaaaaaggaaaatccattagcagctccctactgactggtgtgttgcagtccttggggttgcaaagagtcagacacgactgagcgactgaacttgaacctgcctggggaattagatgtaaactctagcttcacttcctatcattcttgcttcacattttacgctctctaaaacgtaaacacactgtacttcactttctgctgtttcttcctttcacgctttgtctcatgctgtaacctctctaaacgtccctaaactgtcctttaatctggcttctagtccttctttaaaatctcagtgtcaccccttgcaggggatattccctgatcccaaactgtcctccaaactctatgaagttcttctctgtgctcttacaaaaaatttgtgatatctatagtaaggctggaggttaaatgggtggataacaactagaattggggttaaggatcttgacagtgaaagaacagtggttatcctttcattcaacctgaacagtaatgtctgtttctattcactgtgctgttattaaaaaggtgaaggttccctggatataccaaaaaggcaaaaaaaaccatcatagtagaataacaaggcataattcaattatgacattcttctttcctctctccatcctcatttctcaggaaaaagaaaggatccataactaaatgcttttatatatctaacttaaacaatttttgttttcctactttccttattgtacttctcaggagatgaggtacaaaagtagttcccccagaacaactgtttgagaataggaaaaaagtatttttttcacatgcccactaactttagctatttgataacttcttcttcaatcctatctcaagaa

SEQ ID NO: 43284 - DNA, 969 bp, Bovine  19866881163130
atgagatggctggatggcatcaccaactcgaaggacatgagtctgaatgaactccgggagttggtgatggacagggaagcctggcgtgctgcaattcatgaagtcgcagagttggacacgactgaactgaactgaactgatgatatgcataaagccataggctgcccataagcagagtcagtggaaaatggaaaactctaggatacatctacctgaagtatacctgaaaatagatgatgagcaatcctgccgtgtggcataaggagagtagtatgaacacacttgctacagtggtctttgtcattatctccgtgttaattataaatgtacaactgtttgttctattatttttcatcacttttcaacttacaataagctctgttagcagtaatgaattcaaatgtgtgtgacagtgtgtttaatgaaaaaatgagtgctacatatttatctctgagaaagttaatgatacccatgtaacacacaaaacttgtcaacatttaccaacaactatgaaggtcatagggatatcactgaatacattcaaagacacaaatctgctaaagaattctcagcttctgtttcaaaaataactaagactgagtgggaaaataatgactcaacatgtgctgccgaagaaagtgcatttacacaagactctgtgaagcctatcttttcatttagagcaaatgcctgttcttctaaacaaattttactcattttgattccacgcatttttgtgcacaagagtgaagcaatggctgtgaacaagttggctccattagcagcagcagaactgtgcaaactgttaaatggtacaagtttacaggacttgtaaactccagatgctttaaagggaagaaaagttaactccaataaggatttgattttctcatccagttcaagaaattagagtattatgttgcaggagaatgatctgacttatcatgaatgctatagtaaattctattt

SEQ ID NO: 43285 - DNA, 2132 bp, Bovine  19866881179595
ccttcataccatagacatatgcaaagaaccgaacaccacctaaccagtaaaatcaaattgtcatgacggttgctatgttaaatacaaaatgacaaaccaatttccaattgctgaagcataaaataaaggtacaaccatactttcagatctcttttagcaaatatgtataacagtgatagtggtggtgttggtaatatgtgatgggactagaaaggggagtttggaagagataaacatattagacatctatgtaagatgagtttgtgcaaatattaaaattcagtgctaattgagactacccattgaaagacaagcaattataaagtggccagctcctatgcaaatataaagtatgaaatctgttttacccatctattaataataataataaaaaaagctcacctcttttgtacatctttcagtttgaaaagatagttgtaaaatatgccttatggtctgatagtctgataagttattccactaaagctaggagaatcttaatgtgcctccctaggagctccccaggtggcactagtggtaaagaatccacctgccattgcagtagacgcaggagatgaaggttcaatccttggattgggaagatcccctggagtaggaaatggcaacccactccagtattcttgctcactctcagcaagtacttcagctggttctggttcttcacctgattaaatattcctaatcttttggggctttccaactggcaacccactctggtactcttgcctggagaatcccatggacagaggagcctggtgggttgcagtccatggggtcgctaagagtcggacccgactgagcgacttcactttcacttttcactttcatgcattggagaaggaaatggcaagccactccagtgttcttgcctggagaatcccagggacaggggagcctggtgggctgccgtctatggggtcgcacagagttggacaggactgacgtgactcagcagcagcagcagcagcagcagcaggtagcttagtggtaaagaattcacttgccagtgcaggagattcaggagatgctggatcgatcattgtgttaggaagatcccctggaggaggacatggcaatccatgccaatattctttcctggaaaatccccatatcccatgtacagaggagtctggtgaactgtagtccatagggtcaaaaagagtcgaacacaaccgagtgactgagcatacagggttctagagcaaaatcatgccttgagcaggggagaattacacattcagacagcagctcttggcaagctaccaggcacatggaaaatgaaaactttgatcatgaggcaataagtaactatctggctagagttgctcctcataagttgacttttgtcagacctacaaagtcataagatcaaatatgaaagtgttaactgctcagttgtgtccgattctttgcaacccaatgaattgtaggccaaaaaatactgaagtgggttgccattcccttcttcaggggatctttctgacccagggatagaacctgggtctcctacattgcaggcagattctttactgtttgagccaccaaggaagcccaagatcaaatatgctcagcaacaattcactgtaggatagaaatggaatacctggaagcaggcatagagctggctggaaggcacaagtaagctacagaagtaagtataccagacccacctctcacttggcactttcatgggccctcgccctcaccttacatctatagccatgaaagtggaggggcagggcatccctttataacaagctgatggaggacaaaaaagaccaagcttagtttatagtttatggataggttgactcaatgttgtaagtgcaagctaaaaaaaaaaaaaaaaaaagactgttgaatactaaaatcctactgaggactggctccaacattcaatcgttgagggtaggtcctcccaacaagcagagctttatagagtacgtactattctttcttaaaagtggcctaaaatgagaatatacatagactcatgggtagtggtgaatggattagctgcatatttaaagtgcctgtggaaataaatacttgaagatcagggataagaaagtctggagaagagacatgtggataacctaaagaagtggaca

SEQ ID NO: 43286 - DNA, 1175 bp, Bovine  19866881179816
ggcaggaggagtaaggggacaacagcaggatgagatggctggatggcatcacggactcgatggacatgagtctgagtgaactctgggagttggtgatggacagggaggcctggcgtgctgcgattcatggggtcgcaaagagtcggacacgactgagaaactgaactgaactgattaacctctatattagagtccaggcaacaacacagaggatgctccttttccctggtctaaacagaaggcagagatggcaccaacatatgaggcgagtcagcagagatctgacccccagcagatcaagactgctgagggcagagccaagctgttcagatgtcagaggcagcagctgcagaatccagatcaactaacagccaggtcagcagatctttggggtaaccagcctgaagtggtaaaaggagtccaagcagaacaatcaagtaggtggcacagtgcagagcagcagaaatcagccctggggagtagccaggttgactgcaagtacttggaaaacacctcctaagtgagcctccaaaccctcagcagagtgtgctctgacagaggcgatcataattggagtgtgagtgctaatggaccctcatttgtgttctctggctgctcaatcctgggacagttggctttagtttatgtcacattggtcaccttttttaggaaagcctatttttattgttgtgacagctgtctgagtaaggagtataacctgacaggttggtacacagatttttctggtaataactaggcacaaaactcagatgtgggagaggttcttcttcatccaaatccccaaagccaggccatagtgctcttgtgggttcagatgtgacagctgggctgaaaacaaggctctgtgtcactatttgagacagtagagtgctggggttggggactgacatcatcagtggattttttccccatttctaacacttttgattcaaatgaaaagcaacttagtaggtgaagaagggaagctatcagaaaatatggctatgtcctgaatgattttcactttataaacttgggtgtgcaagagatatttttaaagttttcttaaaccagaataaaactcagccacccctctctctaaaactagcagaaaattcagccttggtccttcttgaagttttctgtcctcctgctcctcaccagtttcctcccct

SEQ ID NO: 43287 - DNA, 2712 bp, Bovine  19866881273914
cttggcctcagggaatttctgagctctgtgatcactctccccccgactcggtccaaaaactctctcaagtcagtagtgggaggaatcatagagtttacttgtttgttttccatttctcgggggttaccatcactcattttctaattcaaatgtcttgaaatccattgttcatatattttgtccagttttcggcttcagactagagagtaaagctggcctttgttactctatctttgttgaaagcaaaagtccttgtgcctcaatctctcagtaaatgtttatccttctaacaaatagaatgtagtagaaatgagactcttgagagagaattctctatgggtctgttgcacttcctcacgtcttccaagcagaggcactgaccatatttgttatacactaacttttgaaggatatttaggtaataaactgacctagaagataatatctccctctggggcaaagaacagatttgcttaaagtcttaaaatagagagtgtctctctccagagtgaagtataaacatgtttatttcagtaaaatatatttggatttcctaagctcaatgctcctgttctagaaacgcaacgcagtgtgtgaggagcttgaccctctatgcaacaccctgtgaaaccgggcctcaaggcgttggtgggagagaatgcttattcttcatctactgcttttactgcaattaatgaactgtcctttgtctttgacctaggagtcttgtgccttctgccagcgttcacgaaaatgtggcaggctaacctgttagcttgtaagcaatggaaactctcatactcatcacagttcttgacagaagaattgaatagtctaggttagaaagcagtacaacttccacttggcttattctcttgaggcgcatgccttgggagtcctgagttgatatgttatatgtttgactaccttgaagcacgtgtgctggaaagattacatggagagtctacatttgagatactgaaggagttccagctgctctagttgttaggggtttgagtttcctcagtccaggtgccagtcacatgagagagtgaatcttcagatcatactcaataccagcctttgagccatactgataagcagtggtgggaagcaggcagagagagtctgctcgcctaatttgcagattagcgagcaaaagaaaggctactgctttaaaccactaagttttggggtgatttggtatacagtactgggtaactgaagcactatgtaatctatagcttccttatgaactttttgctgattttgctaaatcactttctccaaaaggtttattatttttgttgttgttgtttagtttttaaatttttgtttatttatttggctataccaggtcttagttgggacacatgggttctttgtctccatagtcaagatctaattccctgaccaggaattgaacctgggccccctgttttgggagttcagagtctaagtcactgaactgccaggcaagtgcctccaaaaggtttttgattttttgttttgttttttttcaaaaaaggttctagcatagtaaacgtgtgagacctaatatgcccaaaaagaaatgtatttttcaatcacatttcaataatagcttagttgattgtgaaagtacaaaagtgaagttcttttctttcaaaataatatctgttgttttcttacattccagttactgttagaaaatctgatgttacctttatacttacttctttataggtgatctgtggtttgtcccaacaatattttagattttttccttacttaatttttaatattttattatgagatgtttaggtatagttttttttcttatttacactattttatactttatgagctctttcattccaaggtctgagtagtattcaattgtatatatgtaccacatcttcattattcattcatctgttgacagacatttaggttgcttccatgttttggctattataaacagtgctgcaatgaacattggaatgcatatattcttttgaaccacgtatttcttcagatatatggccaggagtgggattgctggatcatacagtagttttatttttagttttttaaggaacctcccatactgctttcttcagtggctgtaccaatcttttgattctgctataggatttaaaggaaaactatcgcattattcctgttgctgctgagtcacttcagtcgtgtccgactctgtgcgaccccatagatggcagcccaccaggatgccccgtccctgggattctccaggcaagagcactggagaaggtgccattgccttctccgattattcctgttaagacctcattattccattctgctcttcttccaaagttcagtgacctcctggaaagatcaccactcccctgctcatcttagtcttaccactgctgctgctaagtcacttcagtcgtgtccgactctgtgcgaccccatagacggcagcccaccgacagcccaccaggccccgccgtccctgggattctccaggcaagaacacttgagtgggctgccatttcctcctctaatgcatgaaagtgaaaagagaaagtgaaggtgctcagttgtgtccaactcttagcgaccccatggactgcagcccaccaggttagtgccaaatccaaaagatgaaaccaaatccagaagatggtgataatcaggtctgatgatagaccttccactaagagatcaccaagatgaatcccatct

SEQ ID NO: 43288 - DNA, 1098 bp, Bovine  19866881328030
cattaagattcagttcttatatgctagtcacttcaatcagtgcaggtctattgacttctgtatcgaatgtctgtcatcacagctgtgttttaatctaaattgaccacttgggcatctgttaacctttcaacactgctttgtgatataggtgcaatctcaaagctttcctgattcagtcttgcgagtctgagctttccctgacatcattctaatgcactagaacataggagatttcacttctctcactcattggcaagtatctcagactcttaagtgcatctatctcccagtgctcctccatgtcctttcactctgctgcctgttcaatactagattatggaactgaaactctaagaagggacaagaaggcagcaatggagaagtgatcggaaaggttgccattgtccgagtctgcgataaatatcctttcccagacattatgaatgaggctgccttcttgaggaaggattgatttgctcaacagaatgtatggaaaacgacagagaaacactaggaagcagagggagtggtggggagcaagatgagtagcgacttcagaaagtttagactctgtttttaggacaatgactccagggattgagattaaaattaaaatgagaatctttgcattattctcccaaactcttcatgtgatttcttttgagtaaaggataataaatgcagcaactgaaaatactgggaggaattatttatcaactactcttttattgcagggagttgtttcccctcttcccatggcccactctaaaaaatcttctatcttcacaggggatatacagtcccctcagaactgtaagataaggggagggggatagtcctccttcctgtggagataattggaattgaaacatttcatatgctttagagtaggaaattgaggaactaaattgtacacaaagaacaaaggaagttattcagcatgtcagccttgcccctgtattggctttgaacccagtctggaactgaaattaagctttgccatagcaacactaaagatttctttaggctaaaagcacctttgtaggaaaaaatatgggatgatctcaagagggacagggtgtgggaggtagaaagaaa

SEQ ID NO: 43289 - DNA, 813 bp, Bovine  19866881368550
aaaattcagtggaaatgattgcttttcactaataaagtataactgtaacactgctataacttttctctttatataactacaatcagtgtcaagtatgatttaatggagataattctgttcatttaaacgtaaaagtttaggggtttaaaactgacctgaattaaattcataccaataaattccagtcacacactttctgaatggtatttataatcatgagattgagtgcactcttttttaaatatgtgaaccctattagcattaatcagtattacatgtatgcactgagcagaaatcaggaaagattttttttagagctccttactgaggaaactaaggaaattatcccttttatgtagagaaaaaaagacgctttctttttctttcttcctacaaaagtgatttcatatgtgagagaagtactgactaatagcattggatattggccttttatataaaggaaattaatgtgcgggtgtaccaaggcctccagtgcgctattgtcatttccaagtgtgtgaacacagccttctctcatttattcttagcttttccaggagactgccaacaagcacagccagctctcaagctgtattgcgcaaagatttgcagcccacaaagatcgggagttttttccaaaggtaacgtcaaggtcataaaagccccttaacagctgttagggagtaacaacgcttaagaaaacagtggccctgtgttagcctctttgttctgttagcagagaaatgctcatttttggtggataaagaggagaaaaaagtcctgttaattctatcctttcttaatctacttata

SEQ ID NO: 43290 - DNA, 1141 bp, Bovine  19866881426288
tgtgttttacgaagaaattgatctgcatagatattttcccactgtacttcattttctcataatgtacattcccctttaactgaaagggaaaaatttttttaatattttaattttttggagggggaaccctgcaggatggaaatgaatgtttagagtgaagataagtaataagcactttttcactgatgtggcagaaatcactgttggttttgtcttaagtttcagagtacctattgccctacttctgacctacagtttatgaaatacactgtaaactacagactacttgcttcttgcttttctaaaccactgcagattgccatgaactatcaatagtctcctttttctgcagattgcgtagtattttcaaagtatttttacgtactgccaggcagttctgaagcttaaaattcctgtcaacagaatgcttttaactaaacagttgttaagatgtttcaagagggaaatataaaaggaaatgtgctgataacggtactgctttttcactgtaagtataaggagtcacttggaagtttgcatccactgccaagcctgagacattctttaggttttggcatattgtggagagtgacgggtttgtatcaagggagggactttgatgtgtgcctttaaaaactaattatgtgaaactgtactgctacttagcatacagaggtaatatttgcattggcctataaaatttaccagcgcacactgaagatccacgtctgcccttcactgagtcctccgttccaagtgaagttttctgtcaaaatatgcatcactttaacttttacactctcagtacacaagtgcgtgagtgtggtttttaggacatttgaccaagatgaaactctttattttgcacctgttataagagatctccaattcatatcatttagcagattggcattaacatttatgatttaattaaatgttcttaaacctgtgtgtacaacaggaaaacaattttttttttcttactcttaggaaatacttttgtcttctcagttttcttggcacagatgtattgctaaagtagataatttcactgagaaatactacttgactattcttataaaatatatttagaatgtccctattggagattctaatgtgggctaatttgggggggggaaat

SEQ ID NO: 43291 - DNA, 716 bp, Bovine  19866881864853
taaataatagttatgtcccatagacccaaggggtacaacaaagaaacagtcattgtgtgaagttgcttttggtacctagaggagagaaaggaaagggagttacagagagcaaaagaattgaaaagagggttaaggagaaataaagacagtttatggtcttattggaagttactaaaattagttacaaatcaaaataactcaatatagtaaatgcactgaagcagaataacccaccagctgaggtccagaaaatgctgctgctgtaattactgtatggcggttgttactggtggtgctgatgctgatgttgctgttctccaagaggttctgatatatctgaagaacaacattagaaagacagtaggcataggagtgcaaaaccacaatgtagctgagttaccccaggacttccaacacccagaggagtaagaccatgaaacaccaacatttcttccctgtaaaaataagctctttttctccttctttgatcccatagatgtggatataatgagattttatcaaaaccactttatcctattgttagttctgccagagaaatagtggattatagcttcctggctttgttgcagacagtgaaactttctaatagattgccaattgctttgacacaaaagctagagaaaatgtaacttatcccagaaccttgttccctatctgtctccagcactgcagctgtcaaattggcccctaaaagc

SEQ ID NO: 43292 - DNA, 1795 bp, Bovine  19866880084765
ttaaaaagaatacatttgaatcagttagaatgaggtggatgaaactggagcttattatacagagtgaagtaagccagaaagaaaaacaccaatacagtatactaacgcatatatatggaatttagaaagatgataacaataaccctgtatgcgagacagcaaaagagacacagatgtatagaacagtcttttggactctgtgggagagggagagggtgggatgatttgggagaatgacagtgaaacatgtataatatcatataagaaacgaatcgccagtccaggttccatgcatgatacaggatgcttggggctggtgcactgagatgacccagagggatggtacagggagggagaggggaggggggttcaggatggggaacacgtgtacacctgtggcgtattcatgttgatgtatggcaaaaccaatacaatattgtaaagtaattaacctccaattaaaataaataaatttatataaaagaaaaacaattcagcaaattcatagattggatttaacgggttgactctttccagccttgccccattcacgttacagcttcagcaaatcaatctctattgatagaattaccagagattttctaatatccaacttccatgtttaagtttatgacaataactaacagttatatggtacttacagggttgcagagagtgtttcaaacacttgaaatgtttaagctcatttaataagcatggtattcccatcctgcagatgggcaaagtgaagcacagagaggctgagtcacccaaggtcgcccagatagcaagtgacaaagttggaatttacatcatagtctaactttaaagtccttgctcttaactagtatacactcctgccactcatagtatataaaccagagtgcaaaatccttccctcactactcactcaacacaggaataatctggttgctagattcaagcaaacttcacaggatttttcccaaggtttacagaacttgtggtctcttgatgtgtttattaccttcattaacggcatttctaccattttagggactgtgtttcgattatctggggctgagagaggagaaatgttgaaatacaagaggaaacattctctgaagcgctctcggcaagccattgttttgcccaaggaagagatcttgtctcgaagtatcgctcagatctgccctggtctgtagtcatgggagggctttcagaagttgttctggctttttggcaggaaaagagctaccatcagtttgaaaatgaaagtgaaatcgctcagtcgtgtctgactctttgcgacccggtggactgtagcataccaagcccctccgtccatgggattctccaggcaagaatactggagtgggttgccattttagatctgacctaaaaatattcccttgctccaaagatgttgttgactcaatgatgcttcctgtgttatacatggaccactccccttggctgtcagtgcaggctccgactgtctaacggcttcattctccgtctgtgaggagctatacccatctctttgattcccctggcccatctcgcccccagtgcaaacgtctctccacacacatgttgagatttagcctgtcgttttccagcaaagaagttcctccagccctgaggacgatgatcaaatggcagacaacagggacagcgcctgtatccgagtcttgagataaacatcacccagcttcctgttccttcccttctgagaaggaagagcaagatctggaaatccaggaggaaatccaggaggaaaaagggggccaaatagagatgatttattgaaaat

SEQ ID NO: 43293 - DNA, 2272 bp, Bovine  19866880255192
cacccttgttgaatacctcaatttgtaacttgtttccggatcttttgagcagagctgtttaaatatgtttgaagagatttgatgtgtgaagcttactcattttctagccagaggtctctttagatgttagggatttgtggcagaaaacccctaaatggaatttcagcacatctgaattcaaatgtccgagttgcctgacaatagggttggcagcctaacaacttgcaagctgacatgccttgatttcctggggagagtgactaaaagcaatttacacattacagagggttgagagtgccttttctttacctgctatggagagcacagtaaccaatgccaccacagatatttaggaagccttttctacatcctccctgttctgtgctgtgcttagccgctcagtcgtgtccgactctctgcgaccccatggattgcagcccgccaggctcctctgtccctggggattctccaggcaagaatactagagtgggttgccatgcctcctccagaggatcttcccaatccagggatcggacccaggtctctcacattgtaggaggattctttaccatctgagccaccaggggaacccaagaatactggagtgggtagtctatcccttctccaggggatctgcccaacccagggatcgaactggggtctcccacattgcaggcggattccttaccagctgagctacctgggaagcccatatccttcctgctgctgctgctgctaagtcgcttcagtcgtgtcagactctgtgcgaccccatagacggcagcccaccaggctcccccgtccctgggattctccagacaagaacactggagtgggttgccatttcctgctccaatgcatgaaagtgaaaagtgaaagtgaagtcgctcagtcgtgtccgactctagcgaccccatggactgcagcctaccaggctcctccgtccatgggattttccaggcaagagtactggaccctccctactttttaccaactcaaatcacacccatcgttctgatccagattatgaaggtttctttgacacagtactattttcatctatctaatcagcaaagacaaaaaggaacaattctttagcctatttttggtgagaatactgatgggaacaaatatgggtaaaatgtttttggaaggtgatttggcaaaggctgtcagaaaccttaaaatctacctaacttttgacacagagttccacttctaggaatatgttttgtagacataatataaaatgtgcccaaaggtttttccaataaggtgttcgctgcagttaatgtttataatgttaaaaaattggaaatccacaataagcaattagttgagcacatacaggtaaacctatagtaaaactttttaaaaaattaaaaatagttattgacctgacaagatgttgattgttgttgaatgaatctgcatatataatatagtctcatttatatgcaaaatataaaattttatttgcttagaaaaattctggaaaggtatataaaagtggatttttcagggtgatgatatcatatgtgatttatttttatactttctcttttttggccgcttggcttgagagatcttagttcctccaactagggattaagccctgggctatggcggtgaaagtactgagtccaaaccactggaccaccagggaactccctatactctttttttttttttaatctgtgttttcctactttgttttttttcaatgaaccagaattatcatacactgttttttaaaagttatttaaaattgtctgaatgctttgcttttctttgactctggaagtaagctgttcaaagtcaagagtcttgaaaaaataaaaattctcatatggaatatgtaacattttggatctgagatgttcgaaggagagcctttatctgcctaagcctcatagtcatgtgtgagtctaattttccattgctctgagagactgtgacaaagaatcattacccttgaaatgggtttgtatgatataaaaaaatcagggtctcctcttcatttagtgagtgtattcacatttgtgggagttctcatgcatgtgctgagggaaagtcctgtgatacagcatttgtgctgtgttgagctcaatcacttgtagaaaatgtgcaatgtaataggggtattacacagggtgatattatggaaaatcctaattggtaccaaagtaattcttactagagtggactataaaaccttcagtgccgctctaactaatcacccctgtggcattctgagccaatgcaggttaat

SEQ ID NO: 43294 - DNA, 1806 bp, Bovine  19866880364108
tattttttgggggctccaaatcctgcagatggtgattgcagccatgaaattaaaacacgcttactccttggaaggaaagttatgaccaacctagacagcatattcaaaagcagagacattactttgcccacaaaggtctgtctagtcaaggctatggttttccagtcgtcatgtatggatgtgagtgttggactgtgaagaaagctgagcgccaaagaattgatgcttttgaactgtggtgttggagaagactcttgggagtcccttggactgcaataaggtccaaccagtccattctgaaggagatcagcactgggtgttcattggaaggactgacactaaagctgaaactccaatactttggccacctcatgcgaagagctgactcattggaaaagactctgatgctgggagggattggaggcaggagaaggggacgacagaggatgagatggctggatggcatcactgactcgatggatgtgagtttgagtgaactccgggagttggtgatggacagggaggcctggcgtgctgcgattcatggggtcgcaaagagttggacatgactgagtgactgaactgaactgaactgaatggccagcagaccttgggaggtacacagaagaacctatttttttttaactttttattttgtattggggtatagcccattaacaatgttgtgatagtttcaggtcaacagggaagggactcaaccatacatatacatgtatccattctcacctgaactcctctcccatccagtctgccacatgttatctttaaaagaaactattacaaagcaaagtccacataaggtttgcagtgcagcagataaatcaataaataaacaataaaaggtgagcatggctttatgaagagacacaagagggagttgaaggaaggaagtccataaaaagctattgaaaccctcctccaggacacagcccaagtggtccccaactagagaaccaagatgtggtcatttccattttccctgagagctgtgttattccactgtcctgtttctttcctgccagatgagaatgtcccaggtggtgctagtggtaaagaacccacttgccaatgcaagagacataagataggcaggttcgatcccttggttgggaagagcctctggaggcagcatggcaatccactccagtgttcttgcctgaagaatctcatggacagaggagcctggagggctacagtccatggggtcgcaaagagtcagacacgactgaagagactgagcacagttcatggcacttggcaggctgtgctgagacactgccaccattgtgtgcctgctctgcacacttcctcaacaatgctgaggccatcttccaaacttaaacacacgagcaggcagagcagagaggctggcatgtaaaacccaccccgtatctcatcttgctgcttgcctccacttgagaaatcactacgcactcttgtcctacctcccacattctgcagaatgataaactcaccgtaaaaagaaaaacgtagacttttttggggaaagtcactgtacgtgttcagttgttctagaaagttctcttgggagatatttgttctaaggacattttcttctttgtagaaaggaaggcagaaagaggctaattctcaaagtgatgacagccccctcagtcccctatagagagcaatgctgtcactcacttgtctgggggaaatgtgtacattgagagtgaatctctctcctggatcccatatatgaaataaccatttacctttgggtgatgctgaagtatctatcaccccactcaccttctctcatct

SEQ ID NO: 43295 - DNA, 1695 bp, Bovine  19866880489547
cttaagaccctcctgttgctctccctttgcttatctgcctcagacaagcgccatgaccttggaagccatgggtggggatgttggagccacaggtgagatgggtggagtctgtgttcctgaatcatggtttggaagagaggcatcttggaaaagaagctctaccccatcagggtggcaccagacccaaccaccactggcatgtggggggtggagaaagtgatgttgcagatgaggaagatgttagagatggaatagccaagaataaaatggtgaaagcagtgtcaccaaagtgagggaggggaaacctgcccttgtgctattcctggagctgtgaggtttatctaatatggcattgctgctgctgctgctgctgctgctaagttgcatcagtcacgtccgactctgtgcgaccccatagacggcagccaccaggttcccccgtccctgggattctccaggaaagaacactggagtgggttgccatttccttctccaacgcatgaaagtgagaagtgaaagtgaagtcgctcagtcgtgtccgactcttagcaaccccatggactgcagcccaccaggctcctccatccatgggattttccaggcaagagtgcatcaccccaattaaaacaggttgttatgtttctgcgctaagctctgactgataacagccaccggggtgaaagtcagagtaagtcactggtaatactgacatgaaagccatatatgccacaaatcccaaaacaaacaaagcaaaaagtgaaacaaacaaaccagaaacaacatgtaagctggcataattcaagtaaaaaaaaagagttggagatcagcgtaaatttctcaggtggaaggcccaggaatgaaattcccttgatgtcatataaaccccacccctgctcattgctccatcctcatcctccatcacccaccatatacactgaactgcagaaaaagcccataaaagcctccacataaacttaggtttcttagccctttagtattcctacagggatgaggtctaaagaaccatcctcacaagggaatgcctggttccaaggtgtccagggagggcacccaagcagaagccccctctctggacggagtggagtccatctttctccacagtggacctcgataactggggctgttccctttgaaagtgatccaggagcagatgacaatctcagagacgagtgggcacatcccaagctacagatgtgaggcctggcagcccaagtgacagctcaaacagtatcgctcatggatgagccaggccagctggtctgttcccccggctgggagcaggcctcagaaatgcgtctgcctctcattttctcatgtgtcacaatttacccttttgttgttccggaacattctggagcacaggaggctaatcatccatcgtggtgagacatctgcttgtgaggactgagggctcaagcccagaacatcccagcatcatcctgaaggcggccacatagtcacgcttcgcctgttcaccgccgttgccctttcaccgattcacgaatcaaggagaggaaaacgcactcttaagtctggcagtgacaacagatcccaaaagataaattcattttattaagagtgaagcacaaaataaatactcacccatgttctgagaagacaaatgtgcttattattccagcaaaaactgggtttccattcccttctccagggtat

SEQ ID NO: 43296 - DNA, 1986 bp, Bovine  19866880660911
ctaaagagagccaactattaggacagtgggccggctcaagggggagccgatctttacagcttcaagacaaaggaaatccctgttggaagggtggcattgggtgcttggttggggcattatgccagggtgggtatttttgcataatatggggtcagcaagctggctggtaataatcagggcagtttttggcaaaggttacaatggggctcagtcagttccaaagatgactttgattctgggctgtgctctctgtgatcttggtgtagggctccacaccaacgtccttctcagatactaccaaccaacaggtatcatctggttgtttgttttagtcggtaattcatatctgactcttttccgaccctgtagactgtagcccacaagggctcctctagtcccatgggatttcccaggcaagaatactggagtgggttgccatttccttcttcaggggatcttcctgagccagggatcaaacctgtatcctgcgctggcaggcaggttctttaccactgagccaccaaacggttttctggacaaggatgcagagagtggaaggtggaaatgttaccaccacagtccttccctcttgtcctgacctgtgccaaggacattttcgctttttgagcatctactttgttcaaggcaggatgctaagagcagagagaggaaacgaagtaaataagatctggtccctgcatttgagaagcttggcaagtagcctggccttgagtagcctatcccttctccaggggcatcttcccaacccgggaatccaaccggggtctcctgcatcgcaggtggattctttaccaactgagctatcagggaagcccttcggcaagtaagggagaccagctcttgggaagcgaaccaaggcaaggagggttgatatcgggaagaagtgtcaggtgagagctgcttaaagggccagagctgctctagcagagccagctctgactccccagactgggagagggccctgcttggctgccctgaggccgcagcagcagaggagccccttgggggaaggaggcagctcacctggctgcaggtgtcgtggctccactcatgcgaatccacaataatcgtaacttcacacgcgagttaacttcttttcccaggctctgccgagcttctgtgccagatggtgcttgcctctcacatctgatttactgtggggcagagcagctgtgcctccgcccagggcaggcccacatctggtgagcagttggtaaaagtctctgcagatgactctctccctcacagcctattcctcagggcaagtctctttctgtcacggttttttatatgctttcctctctgggcttatttctaggactgagttgaggatccgtcagccacagatctgcgtaagcaccttcatgctgaggaaaggctcttgctgcgatatacgatatacacgtaaggctgctaccgtattctgtaggaaaaatactcatggagaaagtgcagagacagatgtgttggcttcctacccaagagccatccctccctttttccctgtgtttgtgggaccctgattttatttcaggaggcagtttgctccatacagaaaggacctcggcccccaacttcaaaggatgagaactgactgcttcaaagtgaccccatccctctttccagtaattggattgggaatgtgaagatgaaccaggagtagccaatgctacataagtgaaaatctgctgggaggcttctgcgaataatttcactccatctctaaaagagagagagagatgccaagataaataaaaacatacgtgcagacaaatactcggagaaggcaatggcaccccactccagtactcctgcctgaaaaatcccatggacagaggagcctggaaggcttcagtccatggggtcgctgagggtcggacacgactgagcgacttcactttcacttttcactttcacgcattggagaaggaagtggcaacccactccagtgttcttgcctggaga

SEQ ID NO: 43297 - DNA, 1634 bp, Bovine  19866880726459
gatacagagaagaccacacctacccagtgaaaactgactcatttgaaatgaccctgatgttgggaaaaattgaaggtgggagaaggggatgatagaggatgacatgtctggatggcatcactgactcaatggacatgagtttgagtaaactccaggaggtggtgatggacagggaggcctggtgtgctgcagtccatggggtcgcaaagagtcggacatgactgaacaactgaactgaactgaactgaacccagtgaaagctacccaaatcccacacgtcatgtctgaataccctgtaacacaatccctgcatttgcttaagagatgcttgcatgcagcaacctacaaagtgtgcattcttcctaagtgcatggcccatcaatttctatcactttctctggtaccttacatatgctcctaactctcatccaacacagcacccagcaaaagtaacttactattggcagtgaattaagatgaggaggctggacaaaacaggccagtgccagacaggatttcagtgtgcctgtcacagagaccgatggcttgggttcaaaccccgccattttttagtgatctgactctgaaaaaataaaaaaagattaacttttttatgcatatcagtttattgacctgaaatttgtaaaatggaatggtgatgatgatgatggtgggtgatgacgatggcatagctgaggagaatagttaaaataaaccagacaaacccagagcttctaataagcactcagatgctgtcatcattaaaccactgcaacttcagagccattccctgccactgagctgctgtgtgatctcattttagtaactagccttctctttacctagttccccagttgagaagctacagtccttattgaatagagttgccataaaaaaaactttattacaattgtctttatactctctccaataagctcatagcgcaaaccacctcaccgtcactccagggagccctgcagaaggccagcagtcaaggttagcccaagaactctggttagatacagggggaaaaaaaggtgaaagtgaaagtcgctcagtcatgtctgactctttgccagtccatagtagagtccatggcatcttccaggccagaatactggaaaggctagccgttcccttctccagggggtcttcctaacccagggatcgaaccaggtctcctgcattgctggtggactccttaccagctgagccaccagggaaccccaagaatactggagtgggtagcctatcccttctccagcagattttctggacccaagaattgaacaggggtctccagcattgcaggtggattctttaccagctgagctaccaggaaagctcataataaaagctgtcaaagcttagccagagaagaaatgcagaaagaagaccaaaaaatatgttattctgtcttcaacatataaggagacttctgatactgcagaattcaaagaatctccttactcactgcactggttgaccagtgaccatgcccctgtctgtttttaggatccccataacttcacaccacatctgtcatccatgggcctattgaccgtccttcttctagagagggacaagtttgggggtaggtatcaaataccttgcaggtataaagatagaaatca

SEQ ID NO: 43298 - DNA, 1718 bp, Bovine  19866880746351
cattatttaggagaatgagttatgctcttgcctaattagtgttttaagatttgtttacaacttttacagaagtagacttttcagtcctgactcttccctggggctttccaagtctttgcaggttatggttactctatctactcctaaggattttaaagttttccatgctttaactcaaataagttaaagcttccaggaacaggaacacagagcaatcataactagcattaccaagcacttactgtgtgccaggcattgtgcaaactactttacatggattattttatttaattttcatgagaatctaggaggatagtactattaacatcctctttaaagaagaggacaccaatgaaccatgcatatgtaaaatagctagcaaatggaaatttgctgtatgactcagggagctcaaacaggggctctgtaacaacctaggggagtgggatggagtgggaggtgggagggaggttcaagagagaggggacacatgtatacttgtagctgattcatgttcgtgtttgacagaaaccaatgcaatactgtaaagcaattattcttcaattaaaaatacacaaattcattaaaaagcagagaaagccatgtctccaagatggtaagtaacattcctgaggttatctaggattatctaggttctctgggattcaacctcggagctatttgactccaaagccctaataagtagtcactttattgtaagaactctaactggaagccagaggacttgggttctacatgaccctatgtcaccagtcacatggtttcagggacagagggttcccagaagtgatgctctcagagtctgaaggtgagtatgcatttgtagcagaggaaaacacacttcaagcagagtatcttcaaagaattcaagagacatgaaagctacaagcactcaggttggcagcccttgagattctacaaagatgtacgtttaggtagcaacgggaaaccagtaacaaccataggggctttctcaaaatgattttggacacttttggaagacgtggagtaacctcaagagtgatcgaatctgacaaagttgcagggtaacccaatagcactaggctttagatgtcccagaaatagaattgtgacctggtgccctgagcttctccaagcagaggcagctcaagtcagaggccacttgagttccacaagacagcaagtctgtatcaatgtcttgattttgtttagtcattctagtcatgtccgactcattgcgaccccgtggactgtagcccaccaggctcctctgtccatgggattctccaggcaagaatactggagtgggttgccattcccttctctgggggatcttccccgcccagtgattgaacccatgtctcctgcattggcaggaagattctttaccagctgggaagccccatcaatgtcttcccatcctctttactgtaaggaattctctctcccacttcattttttactgagctgacaatcacagaaatgtgccctctgattaccagggtgaccatcattccaaggaggtcaattaagaccatctgcagggagtctcaatcttggacaaggaagggagctcaaaggggtaacagctaccatccaatgatctcactaaagggtgctggtccaactgccaaggtgcccagaactgccccagtgtctgctggcctaagtgtgctggttcccctacaaccccttgtaatgcactctaagcctgc

SEQ ID NO: 43299 - DNA, 868 bp, Bovine  19866880779654
tgtaaacgttcaatgagaaattatttgcatcctttatttctcagttaactctccccagcatttaaatagtaaatatgtgaggaggggcaggcattcaccttcatcttacagagccttttgaatgagtagtttctggagctgctctgtgagaaaattttcttgtgtgtctaaaaatcgcaaactatttggaaaaacaaacaaagctggactgatctgagttgattgtttttagaaataacaaattgaccaaattcaactttttcctccctactcccatcagccaattttgggatagctataatctcattatgaaatctgaccgagcttgattctatgtgattcaatctccaggtttaaacaatctggaatgctctgtggaagaccttgaaagatttcccagcaggaaatggaaggctgacacgccagagaatgaatgaattcaggttttcagtttctggtgaccttgattagcacccagcgaagtttcttggctgtctgtctcctggcattcaccctcttcctctctccatagtttgatcgctcctattctgtctggaaggaccactgcaagaaatttcagggacgagaagggtcaacagcctcacccggctgatgaggaagcttagatttaatgagtttgcgtgaccagcatctattactctttgatgctttcctcatggttccaacacaatgctccattctcttcaagcaagagctattgagggaatttccaaccattttccagtttccatgttcttcatatcaaaacagaaaagtatctgtattaaaaatgtaaaagtgtcagctctttagacctgggtacacctatctgggggacgtgagtctgagtgaactctggggagttggg

SEQ ID NO: 43300 - DNA, 676 bp, Bovine  19866880823870
ccggtaatcagaaacccaactgggcaggtggatgggggtcagcccgtgacaagccacgagcagcgggggaaggcgtctgacctggccccggagagcctggagcacagtcaaaaattatttcagcgggagagtaacgcgatcagagcttcatcatcagtcaactcaaccgtattttcaccttaacaggtaacagtggcagcgagctgaccccagagaaccaagctcagctgcataaggtcaggcagtgggtggcctgtgcccccacgcgcctgagccggagaaataaccgcttattcaatctgtcagtcaccgagtcgctggaagcaccctccacgtgggaatgaccgcgagcacttctcctacttacttcttagcagcaggatgtgccctgctccacagctgtcaaccgggaccaggacaaagaagaagcttaagaggatctgagacaagagtctgcagacgcttccattttcactggccgtttccgtgagcttggctgaccgtgctggtcaatgttgactttttttttttctcctgcatgaaatagaaaagcagaactctgttgatttttgtgttttatggctgatcgatgggggtcagagcgagggctttgagacatgccgagggggaggaactgggccgctttttgatggcctcatttgtggcgtgtcttctt

SEQ ID NO: 43301 - DNA, 1151 bp, Bovine  19866880824153
tctttttctggctggaggtatggggccttagcaatgcccacacggcatgacttggtcaagcaaattggcagttgtctgagagtctgtagtcaggattaagagagagcacaaacaagccagtcttgctcttttttttcttcccaatctctccagctacagtaaatcaagctgcctgacaatttttttttccctgccgcatctgaatctaatgcccttagcttagaaatttccattatatcactaagtgcatggcaagagcaatgggtgtctctgattagtgaagctgaagagtagaaatgaatcaccggacctttgtattctagaacgtgggtctgggatgagtgaatgcaggaggtcggtcaaaacacagccccggtgactcaattcttaaatgatttaaaatcaacataagcctggggacttactgtgaataaatatcaccatttaacaggcaataaggagaggggtgaggtggtcaggctagggaaggggctgggaagacacctgctcctggtgatattttgctcagtttccctcgctgtaaaatgaagccatgtgtcctgatctgctctcaggaggctgtcgctgtgagccttataatttagaaagtggctggctgcccttgctaagttgcttacttgtatcaggctctttgtgaccccatggactgtagcccgccaggcgccttggctgtggaattctccaggccagattactggagtgggttgctatgttctcctccaggagatcttgccaacccagggatcgaacccacgtctcttacatctcctgcattggcaggggggttctttagcaccatctgggaagcccaaaagtcaggcttctctgtccgtggaattttcccggcaagagtactggaatggatagccattcccttctccaggggatcttacaacaaattaaaggcaacttcacagcatcaagcattgggctttataccatgcaaggaggaaatagcagatctagtctccaactaaacttccaaccagggatgcaggaatgactcccattcttctcagaaaacgggaaaagatataggggctcttatgagccaactggaataaaagctagcacactcaactttctatcatttgaggatcaggtagagcaggagagaattctaaggacat

SEQ ID NO: 43302 - DNA, 1120 bp, Bovine  19866880841218
gtttaagttctggttaaaacattttgctgtaggaagtgttcatttttatcacctgaaactacattcaagtaatttggtttctgtttccacaacagtgtcaaggtacaacatcaacagaatttatttgcttttgtgttttttttttttgaagaactcttccaccagctcaaacctggagttgaattttacagtcaatcttttctcctagacagaggcacatttcttaaaactgcactgtatgattttataatttaacatttctgatgaggaacagaaccttaggcgaaacaccaatagctcttaagaaaccttttatttgacttttatattacaaaacaggctcagaatcagaaaagatatagaatctgacacattgctaggtacaaagaagtcaattcaaaatgtgactgattgatccaaaatgattgaaggagagagtaaaatcagcttggttgaaattcacatgaccatgtgggatggtacggaatgctgctacttccagggtaggaaactctgtctcctcactagggaaatttacataaagaaactcaagcgcaagcaagcgctgcacgtttttttcttctctttttccagtagcttttgctttggttggacttggcaactatcagtagagaactatggccaggcagctcttttatcatgccttcctagcctgcctcattctccacattttcatgcaccaaactcaattattcattcacttggagtatgtttaccactttgtgttcagagagcagaattcaaactgcctctttgacattgaatgaagctgatgtccctcttacagttaaactaggataagtgatcaaatggatttggaaaacaaagcagcatttttcaacacatatttccttaaacattagactcactagattatctgcatcaaatattggtgatcaaatgcaggtgccaaatgctgtgtgcgatggggctcaaactgtgatccgtcaaacgatcacgcctgtttacagcttgtttcccgtccatctgttatgggacacatacaaaaaccaagactaaacttttagaccctcgaggagatatttgacttcagattttacatctgttaaatctattcataaaaataggtcgtatctta

SEQ ID NO: 43303 - DNA, 914 bp, Bovine  19866880843645
accacgagctggttgcttttgtcatcagacagagggacttattgagaaaaaagacacgaaggctttcataatgacagtgggcctgattcactgggcaggaattgggtctttgtctcctttagtcagagcctggaaaattgtagatgccggtaatgtgaattgaacacagcttgagtgagaattgatcggtgtaaggtgtctgtggggtccacagggtggatctcgtacccttccaaaggccaatgggacatgcacttatttttgctgcccatcccccacattatactcacatagagattaagcatctgccacagaggaagacccatcaccattagttttatcatctctgaatgcaaggaacagaaatatctctaatgggaaacactgatcaaacttatggaccattgtgatgtcagttgagcaccctgggctgatgataaacaggatgggagctggggagtgcacagcgcgaggacagagatgttcaatacaggacagggcaatggctgtcagcagggctcataattatttgcctgcctttcaggtgaacttcaggacgaaaagttgtgagctggtggtttctagtggattgtctagaaactgcttgatgatctctgctgttttgggagttgacagagctttttcaagaactctcagaatggcccagccctgtcttgtgcagctaattgacctccccttgtcaaaatgcaatgcgagacctttcttttggtagacagttgttagaataagctatttcttcaaaggtctataatacacggttcctcctgtaaaaaccttggcacccttaactggaggctttccaccttccatgtgagtgataaagctggttcccaagaaggctggcctctctaacaggctcctggcatgacctgtctagtccttattcatccctg

SEQ ID NO: 43304 - DNA, 809 bp, Bovine  19866880844754
acgtgaaagtgaaaagtgaaaatgaagtcgctcagtcatgtccaactcttcgagactccaggggactgcagcccaccaggctcctctgtccatgggattttccaggcaagagtactggagtggggtgccattgccttctccgcctgggggcctatagacctgaaaagaagtcagactgtagggaagcacagtgaaaagtgaagactgtggcctaaggttcagggtatgttgctgggggattagaggagggaaaggagaggcctggggtctctctaggaggtgttcccacatgaagctttgggagcaagcacccgcagctcagggtttgtccctgggatggagagatccattgctattctccacaaagggctttgttatttatctgtcatgttgtttgtttatcaagtaggtatttgacagacatgcactcagcagagcacatcagcggggatggtgttttaccagcaaataaattagaatcatagagttagcaaaggcataactaagcgcgcagcataaatatgtcatttggcggtgatgaattcattcaagtatagggatccttccagcatctctagcaaacctttaaacgaaaagctctttttctatcaggcttgtattttaattacaagcagcgatagtattagagcctcctccaggagccggctggttcagctctgagcggaagccccgagggacgccccccgcccccgcccagcacccccagccctgcccggcctggtgggccgtgtcctgaccccttctggccattcctcaggagccctgcctctctccctgctgaggtggcg

SEQ ID NO: 43305 - DNA, 979 bp, Bovine  19866880851920
tgcgcggcttgacgacagtttcagcccacttcctatcagcctagctatttatattcagaggcacggattccacagctgtacagagtgcctgcgagtgactcaaatcagtctctcctcccttctcccttcccatctcagggaagatgaacaaagttgttgttcaagataatcgtggcaaaaaggcagactcgtcagggggtggaggaggggtctcttgttcccttcgtaagcttcctcttctgtcagagatactgttcctttctcacctctcattcccagataccctcatcccttttataatgaaacaaggagttggtgctgaccttgactttgcagaaaaggtattttgctctgggccatctctacaaagactctacaggtttccgggttagggtcattctataagtcaagctactaactctggctggaagaggagaagagacctgggggcaaaaccagaaagtactgatggtttagggccatgtagtgtcgggaagggcattgtttcgtgaggccaaaacactcgtcagctgtggagaggactggaacccaggccaggcttggcctcggagaggccggggtgacacaggcaagtctgctcacccttctggcctcagctttctcatctgtgaagagagggcgctgctcgagaggacctgttgtgtcgctttcagctatgaaattctgtgatagcacaaagatcattttccctatttctgtgaaacaataacagctctgggtttggaaaatgatctgacagccttgttccctgaatgaaaatgtgtctaagcgttttgctgagaacagcccagtctcccgcctagaaaaacaacgccccccaccaaatgcaaacgcggtggtggtggtggaaatgaagaataataccaccactttgtatttttacctctcgtgataaaacagtagttttagaaatcgtaaaaatgtaccagtttgacaaatggcacatttaaaacccgat

SEQ ID NO: 43306 - DNA, 1152 bp, Bovine  19866880852912
cttttattttaatacctattatagaattttttgatggcaacctgctgttagagtacatctaactatgttaaagctccccaggccctgagcatgaaagaacctcttcagaacacacgctaggacaggtctaccttgttagcatggaaatgaaaataaaaagagctgctctggggcgaagaggaggaggcgggtgttctaataccaacacttaggaggccatctggccttgttctcgctggcaggcttcgggtggtggaggccgcatggtgacgatccttctctgcattctgctcagtgcctggcacttggtttagagtccccgtggctagtaacctagcttgcaaccctggcgctaaagggcatctctggtgcttttaggctgcagttgcattttggtgcaaggggatcagcaggcaggaaaacctgtaggttccctcctgagctttggtgacgtttcattagtgaaatgaaaatatatataattgaaataagcaggcgagcaccttccttcatctgcagatatgtaaacaggagccgccccagcgtggtccgagtaacagcttctgagagaagactgccttcacagtccttaaacgaagttccacttgccggctgccacaggaatgtgtgtcttgagtaattatttcactctagaaaatagtaatatgcaggtcatcctttcttggcagtacaaattagaaatacccaaggcaccagagccttctgggcctcagtcttcaggcccagaagaatacagagtggatgctgtaaataaaattaataattgaagtccatctgaataaaagatggttagacttgtttgtgctagtggtggaggcgacagtcattagccatctctcacgtattctggaaggccaggccctgcgaaaattgtatgtaatgatcagcctctcctggaaggatgatgcgttttttaggatgtttgtggtccatgatccaatggatccatgatccaattagggttagggttaaggttaggtgttcattcaggactccatagaaggagttagaatcattaacatcttctaaacattgtttatggactttttatgctattaataacaacagaagttgaaccaagaagagcagattgttttcgagagagtttggccaaacgatttccatgtaagt

SEQ ID NO: 43307 - DNA, 1598 bp, Bovine  19866880868775
ggtcccttccttggcatggttttcaaagacacatttgttgtcttttttctttcttttaatctttattgtagcttcgcagatgctgcaattcctaaaaacacaggaagttcgattggggtgggatcactgtgtagatagatctttatcttttcatctatgtaaaaaaatatacaaccgttaccccatagatgcagaatgtgtataatcagttttacaaaccaatcagatcttcttcctagttgggactctatttctccactctctgtcaaacacagtatggctaaaaggtataatacaaacgtagtatgtgggacctccaatgtaacacagttgtgtatgctgctgctgctgctaagtcgcttcagtcgtgtccgactctgttcgaccccagagacaacagcccaccaggctcccccgtccctgggattctccaggcaagaacactggagtgggttgccatttccttctccaatgtgtgaaagtgaaaagtgaaagtgaaatcactcagtcgtgtccaactcttcgagatcccttggactgcagcccaccaggctcctctgtccatgggattttccaggcaagagtattggagtgaggtgccatcgccttctccgacaattgtgtatatatttattcaaacttttgtgggaatctactctaggaattcatttatttagtacaactggttggacaaaaaccgttaggctaactctcttctctttagtatcatgaaaggatgcttacataggacaaatgaggtgtaaatctgtaataatgatctgattttctggtcaaaacatttcacctaagggaaagatgtgctatgaataatacatattcactgctcctctgattattgtctttggacggttactcactcttaccctttcgttggtaggtacaggctgagccattgctctccagtgtcagtgtggaaagcaacgtaatttatatgagaagtgtatgcatgatttcagtctcttctgtaaatggaggaagttgccacaatgaagccaaacacctagagagaaaggatgctgacaaatgcatttctgagctgtggaaacacctggaaaaggttgggttttcctggaaaatgcttctatttttctcctttctttctctagacaagaggactcatatgtcatggtgaacatccacaaattagccaacatctaccccctccagtattctctcctggagaatcctatggacagaggagcctggctggctacagtccacagggtcgcagggaatcggacatgactgagcgactaaacacatcacgttaacttgagagttttgcagcatctttctgtcactcattccttcactgtgggtcccagtggtgagcagagaacacaggtacctgtttctggggggtttctagtctagctaaggggaaccctgcaggaagaacagaagggctttgctcactaactgaagttctagaagcaacaccaagatgcttcaaggcctaagaatgctgcttttcttagccctaattttgtgactacagatcactttcttgagatttaaaaatgtcaagtttattttcgatagtgtcaagacctgacagctatccttaatatttagca

SEQ ID NO: 43308 - DNA, 1850 bp, Bovine  19866880875455
aaaagaagttggcagtctgcaaggtgaaattctgtcaccagaaccagaccatgatctcagacttcctgcctccagaaccgtaagaaaataaatgtctgttatttataagtctatgatactttgttttagctgcttgaacagacactctccttgacaccttacctcatttagtttgtatctttttatggaccttacattattttgtctctgttagactcaattgttaataatgtctacattgtctttattctccattctcatgcttccaaaatggtaaaatttttgaagacagacactatttatatctgactactctataactcatagcatactctcctggatataataggagctcaatagatatttgttaaatttaattcaataaaggtaaaatcatgtagtcctcatgagaaaaatgtgctggccatgagaatcactgtctaccagggaatctcccaaaagattcatgtatcaatttaaggactttgtaacctacaaatgaaaaggatagtttttaccctacttcatattttaagcttttcccttggacatgggggaaaatatctcatccactttatttatttattttagggaaattgtgcttaaacgagggaatgagaattatggtaacaagtatcctgaaaatgcattggaattttctcaacatcacctttctttagactaaaacaccttcttggcatttcgattactaaagacaccaggatctgtgagtgactttagggttcctggaaagggagtttttgcttaattaggtctcactgtatgaactgcagtttgattcacactagtggggagaaagggccaggaaaaacagcaatcatgctgcatccttcctgcctgcttcttcctcacttcttttcctgcatctctttctaaaccatctctcttttctacttgcatccttccttcttgctgcttttcacccttctctggttgctcaattataacttagctccatttgttaaaaatgtatctctcgcccctatacctgctttgatttttccttatctgcacacaatttatctttctcagagatgaggaagaagttcatttagtattgtacagacacatcttctccaaaccaccctagaaagaatgatcgctattcagtgggtgtactctgatgattaaggacaagggggagatttagcaacccgagatgcctgggcagcactgggcagaaataattgctaattagtatcttcctaacttgggagcattaattggctttgagggacctgctttccagactctaagtgtattttgttcattttagcttgctatataggatgagagaagaatgacaattagagaaatagtttcatttcagtaattcaacctaatgaagacttgtcatttgaatgattattcagtagttggtccttgttgttctgccaagttttcagaaaaacaaactcagatattcctccaacctgagaaaacacatcctttcctttaaaataattcagagaattttattttatttgtggatgcaggaatgctcctccaagaactgtcatcttacacaactatataagcagagagaaatggaaacagggtatcttttgaaacatatcattttcatttcagaacacatcatgcaatcatataaaataaagtgcttcaaattgatatctttaatttcctcctagaaagaaaatttgtcagttgttttatgatttatggagatgaaagacatatgtgagaacaagttttgtgattaattaagtgaaattacttgagcataatactcgtaatgatattatctttgaattaaaatgctcttgaataagattgatgacattttcaatcagcagattaattaaact

SEQ ID NO: 43309 - DNA, 2465 bp, Bovine  19866880895038
tgaaagtggagagtgaaaaagttggcttaaagctcaccattcagaaaacgaagatcatggcatccggtcccatcacttcatgggaaatagatggggaaacagtggaaacagtgtcagactttatttttctgagctctaaaatcactgcagatggtgactgcagccatgaaattaaaagatgcttactccttggaaggaaagttatgaccaacctagatagcatgttaaaaagcagagacattactttgccaacaaaggttcggctatggtttttcttatggtcatatatgggtgtgagagttggactgtgaagaaggctgagtgccgaagaattgatgcttttgaactgtgttggagaagactcttgagagtcccttggactgcaaggagatccaaccagtccattctgaaggagattagccctgggatttctttggaaggaatgatgctaaagctgaaactccagtactttggccacctcatgcgaagagttgactcattggaaaagactctgatgctgggaggaattgggggcaggaggagaaggggacaacagaggatgagatggctggatggcatcactgactcgatggacgtgagtgtcagtgaactccgggagttggtgatggacagggaggcctggcgtgctgcgattcatggggtggcaaagagtcggacaggactgagtgactgatctgatctgagcttctccacccagtacaatagccattggccacacgtggctaatgtgaccaaggaactgaattcttcatcatattgaattttaactcatttaaatttcagcggccacttgtggcaagtgattactgaactgggtggacggcccatgctggtcagatcttgataagtccagaccgtttggggagacaccagtggcctgcccttgcaaagactctgttatccccatggtctgagccagtcctggagtgaacaaggtacagcccagatccttccatcccagcacccagccttgccgcccctgggtctcgtcagccgttcatggagcctctcagtcactgcactggggatctgacctctcattttgccctggtcttctgtctcactgtctgcctagcttctcattcacagctaggggaggaattctaccgggagctctagcccagatgactgaagccttaagacttcctcctgccacccctgttccctgcagccctgtgtctgatggagctgctgctgtgagtgaaccgagtgcccaacagcacagcatcgccagccacctgtgttcagtttacacccatggccaaaatcggccgctgctctacccactaagcaccaggcaactctctcagacgtcaggctagagaaatgacccgggctcccccaccactttggccacctgatgcaagagacaactcactggaaaagaccctgatgctgggaaagatcgagggcaggaggagaaaggggcagcagaggatgagatggttggatggcatcactgactcaaaggacatgagtttgagcaaactccaggagacagcgaaggacagggaagcctggcgtgctgcagtccatagggttgcaaagagtcagacatgatttagtgactgaacaacaaccccagtggtgctatacacagcttcttttcccttcctactgggcctctggttacagttgggtttcagattcttcattcagcctaaagttattcagagttaagttatgttcccagtagaactataaaaactcaaatgtacatgaacagctaggtaaatattttgtttacattcataaattccccgagaaagtaaaatatagattcacttattatatttgtggccataaaaagactacatctagaactctggtaaaacagcctgctgctgctgctaagtcgcttcagtcgtgtctgactctgtgtgaccccatagacagcctggattatataaaatcctcatgttctctgacattgacggttcatataatttagggaaacatctatcaaaaccaggaggctcgtacgggcaacttggtttataaatacttgacagaaacataaatgtgtatattccccaaatgcaactgtctatatgagttgcagcgtttcagaaagaagtggctgtttctaaagtgtgtgaaggtgattcatcctctacaggatgatttaatccatcattctgcccgagaaggtgggggaggtggcatgctggccctgcggttctgaactctgtcgtacacacttggcggcccttcacttggggaggcacaggcttgaaaataacatcctttgagttccgagtgttctggttggaaactcatatttctcagctgggagatctgagggcaaagggtacttgaagcgagtacagcctgtagctgttttcatgatgtgatgaaagagtcctgatgccttgagatgcctatggtcctgaacaatctggaacaacttggaaatagaaaatgaaatagctctaaatgtttta

SEQ ID NO: 43310 - DNA, 3149 bp, Bovine  19866880895411
acctccccccagcttcttggcgtgcccttccttcacgctcctggtccagccacgctaggtttctctgggtcctggattcacccagccctctgacctctgagccttcacagctctttcctttgagcccagcaaactcttaggtcaagtcccagcgtgggtgtcctttctgctgggacagtctgcccacctcaggccttggttaactccctgccgtctgtacctggaaccccctccacgccccatcacatgtgtgcatgtgtgctaagtcgcttcagtcatgtctgactctgtgtgacccgatggactgcagcccgccaggctcctctgtccatgggactctccaggcaagaatactggagtgggttgctgtgccctcttcctggggtgtcttcctgacccagagattaaacttgcatctcttattctttaccactagcaccactgggaagcctctccatcacaacacacatcgtgcttgatctttgtcatttaggaggtcatcttgtctttctacactgttagactgtgtgcccaggaagatgaggatggtctttattccacattaatagctgctgtagccaaggacccagcacacttcctagccatattaggctctcagtaaacgtttgttgaatcacaaactctggtgtgagggcccaagacaatagttctagatctttccttttgcagtgaattctacctgttgaatcgagtgacttcttcccaccctgacacgtaaggccaggtgagggcattggtccatttttatgcggttgcacagcatatctgagcaagggcaatcagcatagagtcacccaaagggaatgctgtcaatacagagtcttgccttgtagcatagacaattgggataatccatataacacaaatgtaatatttttctctaatgtaaaaagattttttttttaacctccaaagggcaactgagttatccagaaagttacttcaacccctggcttcacattaggtgatgctgcctggacctttaccagcctttcctgcatggatccagtgactgactttgaggcagctacttgataactccttacctatcatccgtgctgcctcgtctcagaaattcctttcttttaaaaaaactttatttacttatcctatttttgactgcactgggtctttattgctgcacgtgggctttctctcattgtggcaagcagggaccactcttcactgtggcgcccaggcttctcatgctggtggcttctcttttgcagagcacaggctctagggtgttgtggctcatggtgtatagagctcagtagttgtggcacatgggcttagctactctgcagcatgtgggatcgtcctggactagggatcaaactcatgtcccttgcattgacatgtggagtcttaaccactgagccaccagggaagtcccagaaattctctctctgttagagctgaggcaccgtgttctctctccttgacctctgcagtctgactgggaaaagacgttgttgctgttcagttgtcaagtcatgttcacgaccccatggactgcagcccaccaggcttccctgtcccccaccatctcccggagtttttccaagttcatgtccttgtcctacggactgaaggaagaaggagaagagggtggcagggggatgagatgactggatggcatcaccaattcactgggaagaggagaaggggcatccgttgaaagtcaagtaaataagcagaggggagagagggacagaggcttcctataaaaggaagagagggactttactgtgataagttacactgcataaaaatgatgcgtatgtgcatgatagctttctttctcattgccttctgacacttgggagtttccttttacatagccaatcgtctctcctaaccaagacattacaaatgaagcagagagaaaatagcaagtgaagaagtgagagagtttctgagtttgacaagccaaggcgaagttaaaacaatgatgactggtgattatataacagtcttcaaagttggcatgtgaggtttatggtactttcgttaatgagatgtttgagtggagaaacaatagctttcaagttaagttcaatcaaagactcaaaatacctttatagctttttgtttttctcttgtcttctcgagacaggcaaagagaaatctatttcttgtggcagtgcctatgacaacaaattcatttcactttcttacttctatgtacatgacagacaacaccgagggacttttggtatcttttctacctacgtaattaagctcctggaggctgcctcccactcctgaaacgatttgaactcatgcttgggaagtaagggcaagagtgtgggtggggactggatatagttaataaaccagagaccaggaaaggatcatgttgtcttaatcttggatatccaatcatccatcttcatggacagtaactctagtcttttatgggagaagttgtgaattcaggaggatgaattccaagggaagcaagagagggtgaagttctaaatgcagaggtattttttagcgcttgttataatcagggcaagactggagacactgggaaggaagtaaaaagatgtaaaaggcaccttgctctccttgttggctgacacattagcatgggtatctgtgtgcatgtaactcaaggcagaatcttgcccttatagactgttttaaagttaatttcagtcttggacacccaaacccagcaagagaatctcaggggaaacccatttaggaaaagtcccatgagatgagcctatgccttttaatttttataacaacaacaaaaaaataggtcaactattttcatagctgaagagctattattttcagtaatattctggttaccatattgtctagggggactttctatcttaaatactttgattaaataagatattttaggattctagacttgtgcatgcgtgtgtgtgtgtgtgtgtgtgtgtgagtttgtttgttttcaattaagtgtttgtgtgttagtcactcagtcatgtctgactcttttgtgaccccatggactgtagcccatcaggatcctcagtccatgggattctccagacaagaatgctggagtgtcatttccttctacaattaagtgtttaaaagatcctaaataatgaggatattttctagcatttcac

SEQ ID NO: 43311 - DNA, 1504 bp, Bovine  19866880911681
caaaaaagaacagatttaaaagtggagtcagatttgtttttcctaattatacacatgcccaggttgttgtttagtcgctaagtcaggtccgactcttttgcagcctgccaggctcctctgtccatgggattctccaggcaagaataccggagtgggttgccatgccctcctccaggggatcttcccgacccagggattgagcctgcgtctcctatgtctcctacattgcaggcaggttttttaccccctgagcacacaagcccaggaagcagccctaaacactaccatgttaggaagcatcttctgagtgtgccattctcagaggcttttgtcaagtgacggtcttgagtcccaaacaaatcagtcctggtaacaaagctgttttgttttcctgctggttagattctaggggaagccaggcagagcctacatgtggatggcatgaaagggttgacaaatgcctgaaacaaaagtcagaagcaccttcagccctaccaagggctgaagagccacaaagaaatgaagaggcccccagcgagactgcctccttcaccacacaggcggctcactcctgaaattcctaaaatatgagtgtctgcaacactctgcaggatggcttggcctacactccagcaatccgggacctctgatcccagccatcctgccatgattagtctacctgccaggaccaggtgtcccccaaggtagaggtcagcagctggaaatcctcaggtgtggatccctctctcctctcgcagagcccagatccctacctgcgctgctgtctggcagggtaatgtcactggaggcctcattaacagcagacaggacagaggcatcctatgacttctggcctttccgcagggtttgaagtttatattacagaaggaaggaaaagaacagatgtcacaacttgtcttttccttttttcatcccatagctgtcactcacagggttccaaacagaatgaaaagagcccaaaggaagcctggcaaatcacccggcctgggagggcatactggggtgtcgcagtcattgcgttaaccagagaggacagtgacccagtgtccttccctccttctttctctttcaagattttccttcgacttgacacaggcttttggctgccgagattcagccagatcccagcaggcacctgcctgggccagtactggacgcagcctgtctgctcgccttaggctgtcttcaggaatccttgcagagtcacagggggagcaagtgagtgcatttcatcccctctattcctagctgtgtctgctaacgaaagctttctgttctgggatgcccgggggataggggtcggggaggagacaggctgtcccatccagggctctctggcttcccagtaagattacagagcagaggggagacacattttggacagcatcctctagctgatgcaacgattccttctctagccttactctgcaatgccacacagagtttctcatcagacagaggactagaaacgagttatgagctg

SEQ ID NO: 43312 - DNA, 1111 bp, Bovine  19866880932314
aaaaaaaaaaaaaaagaaatgcctgaacatctaaattctttctcttaattatcctcccgaggaaagcaggccaagcaccagggtgcaaaaaatttaaaccataaataaccagccgaaaggaaataaaagaaatgacaccagaataaactaagctattaactgaaagctttacatctccgtcctcctcgggtctgaaaaatctaagggaaggtggttaagtattaattttccaaagaatgtcattaggatctgcaggaattaaaaatggatgaaggaaatatttccttcctcatgatttccggtggtacttgggccctgacgcatgaaacattttggagagtgtagttgcattctctccctgaggacaattggtgctaagggacctctgggtctttgtcgggggtggggtgggggcgccagtattgcctgggtgtcgggaggagggccggatgggagagagggaagtgagcaaagtaatgggtggcgactgaatgcttcccgagataaatgcgctcctgcctggatctgctgcataattgtttcttcaaataaagaactccattcacacctgcagacctgtcaggcttccaattattggctcgcggttcaatttcctggctgcaactccagccttgggagtggagagaaggggtgtgtgtgatggcaacacggagaaagaaaggcgtgggcactggaggcgaaagcttcaggtgtgcgggctgcgaggcggaggactctgcttccttctcagtgcacccaggcagcagcagtttgatgatgcttgcagagtcacttccagctgcctggaggcctggggagtctttgtagcttcaagtctgcttttccaggcggacttctgtggcgaagacggagcagagcccggagtctgcaagtgtgtgcgaggggctgccagaaaccttgccctttgtctcgcgccagctcacaggtctgggagccagcccttggctcagcgagacagaggaggcttggcttctccgtgcagttgaaagtaatatgagaaaagccaggtgcaggaaagcgtatatgagatctcagtattgtaaaaccaaccttgaccagccgcccaaattctgtgtgtatttatttaggg

SEQ ID NO: 43313 - DNA, 1101 bp, Bovine  19866880934217
ccatatgattcattattaataaaagaaaaagtgtgtattcccatttgctaattatttttcactcatttaaggccaaaaaaagtgctttaaaccctataatttggtcaccaattagtctttgatttactctgatgtacttagaggttttttagtattaaaaaaggcttgcagctgaaaatttacatttaaaaagtaattaatgccaattcaatgaagaaatcctcagtttcctgtagaatcacattgaacttcaagcccttttaaaggatggaaagaattgatcatcagctaagaggtgcttccttggttctctgttggacaaaattctttgtccaggtaaatggacatcagaccccttcccacttctctttagctttgtccccatcactcttcatacctacatgtgttgttactcagaagacagcatttgacgaacggttactgtcaagttccattcctccctgttccagccgagcgcttcccagacacagacggtcaccaggacagtgactcaagcagagccgcttgcgtctgatgtcagctgaagtcctcccgcccatccctttactgctttcttggtttctgagccgtcatacacagagttatctcccccgtgtgaactcaccgtctcattctccatctccctctgtcaccccccaaaacaagagcccctctttggggtgggagggtgtgagggcctgaagcagctggcagccacagagcagtgttctagcctgcaataatcatcctgccattagaagagctgcaactgttggaaaattaacctctgcaaggctttctgatccagataaaggagagtgtttgacagtctttttagtactagaatgtggaggcgttccatcttccttttgtttcttgggtttctttaattaaaaaaaaaatttttattttgtactgggcttcagcctgattaataaccttgtggtaatttcaggggaacagggaaggagctcagccatacatacacatgtatccattttcccccaaactcccctcccatccagactgccacacaacattgagcagaattccatagctctacagcaggtccctgtggtatccatttcaaaacagcaggtc

SEQ ID NO: 43314 - DNA, 567 bp, Bovine  19866880965887
tactctctgaactcctctttggagagtgttttagaagagtttgcaaaaggacattgatggattcctgcagacaaaagtttaaaaagtaataatatctgagctgggtgaaaaaaaaagaagatgctgaagtgttcccactgtattctgctgatgctttaagttctacacggtagtaattggaatgggatttcattacaagaagtttttacccactcagaccaactgcatccttataagagtgacgaagactaagtgcacctgttctgaccattaccttcatggtctccagggaaacagcccaaggaagttatcaaagctgtaaaagtagaggaggcaatcataagacattgccaacaagctcaacacttcaaatacttggagctgtaaaataaataacaaactcatacaatttggcttaaataatcatgagcaaaaaaagtcttcatctccttttctacttatttattttatttaaaaacagcccatttcccttgaaaagtattattcatattcctattttcttcagagaatatggtctccataatattggcaagaacggtgcatttt

SEQ ID NO: 43315 - DNA, 1419 bp, Bovine  19866880982335
tttgattttctcctacaaggggtacagacttgtgagactgtaggcagtaggtcatcatattctgacccacgaattaacaaaggactatcttgtacctttttgtgaaagtccttcagtcgtgtctgactctttgcgaccacatggactgtagcctgccaggctcctcgtccatggaattctccaggccagaatactaaagtgggtcagttcagttcagttcagtcactcagtcatgtccaactctttgcgaccctatggactgcagtatgccaggcctccttgtccatcatcaactcccagagcttggtcaaactcatgcccattgagttggtgatgccatccaatcatctcatcctcaagttgccccttctcctgccctcaatctttcccagcatcaggttctttcaaatgagtcagttcttcacatcaggtggccaaagtattggagtttcagcttctgcattggtccttccaatgaatattcaggactgatttcctttaggatggacttgttggatctccttgcagtgcaagggactctcaagagccttctccaacagtgggtagctgttcccttctccaggaacctttttgaggcctctacattaaaaaaataataataatggggagatagaggaaggtgtgaatatcagagagacagaactgtagtaataagtggtgatttgtcatcaagagaagctgagcttggtgtgatctttccagaaacagttatgctccttttcatacattggggcactcagcctggggactgtgcctgactctgaaagtaagcacagtattatttctgcagaattatacagagcttgaccagactaggaagtcatttcattctgaagacttgaatgaggactttatccaaggctcaatccaacaaaaaaaaagaagaaaactaaaagagataatattattttttcttgggggtaacatttataagcacttcctactaaatgctttttgagtgggttgtaaatagtaacagccttgagacaaaggtggtggtgtttacctgggagcctggaaatatatcacttattctacctgtgcctctgaattccaggctcttctcaccatcgcaccctgaactctccagttcttagtacgaagaagtcccaaagtagtaatggtgtcttggaagaaaatagtgttgtcctaatttttcaaaatggaccaggaaaataggtcaagatgaatcttctgaaatcactgaattgtaaccattcaaaggtttttgagaaaggtatggaaaaagtaaagagtgagctagctttaatgaggctaaagtgacagtgcaaatctcatttggcagaaatattgtatctgatctgagaaaggagcattactttcttagagctgggttctttcatgccaagatactgggcaacgtgggggtgaggtaga

SEQ ID NO: 43316 - DNA, 1434 bp, Bovine  19866881051020
tggagatgcttctggagattgaccatgggggaggctactagaggagtgtcctatacatctagattttggaaagacaggggtaagctttctcatgggctaatcggacactctgagcgaagtagcgagttcagaagcatgttgagaagactctaagagatttgcttgtcagggcagggtgtctccaacaaaaaggctgaaagggatatatcactggagcagcattgagaggtgagtggtggtctcggaatggtgttggagatagtgtgtgtgttttggggtgggtattttccctttaattccattctaagttcccacacccaccccagtgtttgaggagccagaaaaatgtttgtgatgcagaaggcaaagaaataaggaagatctagataaaaactgaaaaagtaaaaaaaaaaaaaaaaaatctaccgaaatgatcagacatctgttgtactcagtgctatggatgctctcctgcatatccttttcacctaatgtatcaatctgccagctgccgtgaaaggtggctgctaatagctcacagctgctctgtgctgttgagacgtgcccttggtcaaacaggaactaccttgccccaaaagttgtcagtctcccgttagctaaactcaatacatctagtattttatagaaatgatcaatttttgtgctgctgggatggcatgttaaacatattataagtgttttggaggaatgtgtgtttctggtaatagtgaaataaataaacaaaatgtactttacaaaaagtccatttgaagcattggcaagctcctaaagcaactacagttggaggagccaagatcttggaaagaaaagtgccaagagaggaatttgacttttaggcatgcttttcccttcaagatatttgccaattccaaagacgcagcagagaggctgagaaactgagcagaaattgacagctgaaaagttgagaagtcaaacggagtttctggtggtctcatgggccaggggacaaaaagtggacttcagagctagttcaaagaagaaaacacggacaaatattccaggattgtaataggcccctgggtggtttataccgcgggagtgagagagagccagaaacagattagccctacaaagcagagcccagatttgagtcagcttattccctgatgagattaaggtgatctttctctgttctgtcagaaggaaagctaaaaactgtcttaaaagagttgacgttctccagaatctcaaactatttcatatatgttatctagaattcaatgcaaaatcaccaggcaacgcttgaaggtaaacacgttcttgaaagcagaaaaaaaagcagaacagaaacagatctggaggggatccaaacaatgaagtcacctgacaaatttaatgaatggactaaattaggaagttagctgaagcaaataataaataatcaaatgtaaa

SEQ ID NO: 43317 - DNA, 1290 bp, Bovine  19866881095023
aaatcagatgatgtgttttatgatcttaaagggtttcccttccaatagggaagaaagacacacccaagtgacagtcatgggggtggtggtgagtgaagtaagtgtgttaataagagaggcagaaggatataggaggaaaaactatgattgattccgctgggaagggggctgggaaagatttttagggcaggcaacattaacccaggtcctgaaggatttgaaacagttgcttctgatcttgctgatgagaaatacccagaaatatacacccagagccatctactcggaaaaagaatgtggaagaacaaagcttattaaaaaaaaaaaaaaaaacagatgtgtagagatttaggaagcaaaggaaggaaactatgtcagaggaaatctcaagggtagggcaaagtctaattacccaaattgaaatctggcctttgtagcagacctaagacttctcttgaacccataaagacctgctggagtagcagaagcatgcctgaaataattagctttgtatttcagctcttgtttgggaattcttggtttgtttcagcctttccccagaaagcaagagaggtatttgagagtggctagaaaattgcctggacagtagcagggcaggaaaatgtaaaatcaataaataatcaggctgaattttaattgaatatatcaccaaggccctgctgacatgtaaattttaaaaactactcactagagaaaatcagccctttctcccttgtggagactgggtttcaggagatgcataaagcctggcttctgtataccttccttggcagatcgcatattctgggtttcctggtgtgcatagaggcctgtggtcagccacttccctgcctttctctttcctgcataagggaatacatatttactttggaaaaaaaaaatcagttaacctcaaattcatgtagaaacaaagatctgagagaggaaggcgggctgctttgatgttgaaccagtccctgaggggagaaatgtggtttcctctcagaagagggtttaggctccgtcagctcatcactgtcactctgctttgcgaaatctcaaggccgatgagggcgtcacatttgtatcctagagatcagtcttgttttcatttgacttgtgctttctgtaaatattttctttgtactctcgggtagcatttggcccagtgatgtcttgaatttcgagtgagattcgggagcacagaggcataccggagagccactttgactcaaactggggctcaggaagcccccgccccaaccctgcacccctctcccccgggaccag

SEQ ID NO: 43318 - DNA, 1314 bp, Bovine  19866881109823
gttttatttttctctattttctgaacaatccttcacctataagagacttaagattatatggcctatgatttttcttcccttttgctttaaaaagagataataactaacatcatcagggtttcctaagcacctgatacgatattatcttatatagtccttaagacaatcttgaaagtgaaagtgaagtcgctcagtcgtgtccgattctttgccaccccgtggactgtagcccaccaggctcctctgtccatgcgattctccaggcaagaatactagagtgggttgccatttccttctccaggggatcttcccaacccagggatcgaaccctggtctcctgcattgcaggcagatggtttatcctctgagccaccagggaagccccgagacagtcttacaagatactgttattatccccattttgcagatgaagcaagtaagatacagaaagatcaactaacttgcccagagccacacagcaaatcaatagtaatgttcatattcaaacctaagcaggatgattgcagagcctgcagtcagcagccatgttttgtttcttttcaggttaagtgggtatcccagagtatcctaacacagagaacacacaaaaggatgggtggcccaggacctgagaatggtctagggtttgtgagcatctgacgctgggatcaatccaaaatcaaagtttaaacaccacttaccttcacccccacactgtctcattatctgactgctaagtttcaaccaggtctgtggagtgtgttgctctgcggtttggtataaatattgaaattcactatgccagttttgacagaccaacaaatgtcggggggtggggggaagctttctttaaaatacaaagtaagcagtcgaaggaaagagctggttgcatttctagaaagcaaaccccagtaaaacccagcgactgagtaattctaagaggtgtctacaaagtgtgctttagttacaagaatgaattggatgcctctgaagagctgcctctgttctctgtttggacaaacactttctgccaacttccctagaagctttatctgatagagtgagcctgttggaaaaagaaacggtgggctctggcttttttctttttaagttaaaaggttaaaaaataacccctgtctccatccatccttagaattacactttcctgcaaagttcttttcctggtagatataatcctaattaaaaataaattacatgctgtatagaatttgaaagggaaaagataatcctattacgtatgagagtatatcccgattttctttcccgctaaactgtaggagatatcagatctgg

SEQ ID NO: 43319 - DNA, 1148 bp, Bovine  19866881115024
atgattttacctagactttgctatttaatacttgtaactacactataaattaggtattattttcacagtgttacagaagaggaatctgaaactcagaaaggttaagtaactcacctaaggtcacacaattaacaaggggagatttcatcaaacaagagaagctttcgtccaacctttaatgtgtgttaagccttttactagctgcttccacatttggtgtgtcatgttaattcttaacctttgagaaagggataaggatattttttacagatgaagaaatatcatttcaggggagttattaagttactcaaattcaaccaattcaagagtgaagccctgggccttctgaattgaatgtatgggttttcaggcttcccatccaccctgctagggcctgagagggaagttctgactccttagtcactgaagcccagtttggtcaaagcagaattaaggggtagacaattatgacatttacctgtttcattatttctattactggagctttgcatctgccattagatacatatttaagactcctagggggaaaaaaaattcctgctgaattatcagtaaccacagtgaatcataaacctgtagcgcttagcacttgaacaaatcccactgagatgctaccaaaattagagaggatttgtgtttacgcgtactattcccagatggcctcctgcaaggcacacagcaaacagaaagagcccatccttactgatgcaaaaccaagcctttcaaacaagttacatgggaccaggggcatggtcctggtcctacaacacctcatctcttccacgttggtcatgtgactgcagactctctttgaacatcaagtgggtgaactgtgcattcagcctatctaaatgtgtggatttccagaagggattggaggtggtcagtgagggagcaaaagttggcagaagagtgatcagcctgccttctgagctaatctgagacaaaattgaatagaacttactctgtacctcattgctatacctactgggtcaaatcaagcatgctataaagtcctgatgtaacaagaaagacagtccaaaaagaaggaccagaagtgctctagcaataagctatcttctgagagaaaaaaaagaaatacccaggacagcttgaaaagaagggct

SEQ ID NO: 43320 - DNA, 1978 bp, Bovine  19866881139566
caacatttactgtctggccctttaagaaaaaggtccctagtctaaactgcagactagtatcaaattattatggggtggttccatcacagtgaaggcacatgctggaagatgtgcaagaattatacttgacatgattagaattaatcaaaaagtttccactagctttgagggacaattccaaaggtgtgtagagagtagacaaagcataagcctttattgaattacccgaaatggaaatttgtctttaaaatgccgagtcttgtttttcttcattagaaagccgtcgctgatacatgtacagtatggattcatcacagcagcaacattctaattgcaggctgtgaagagttctaattgaaataagattaatgaagagccatgccagcctcctacaatatcacaatctgtatgaacacttagcttctgtgagtcattttctgccccaaaataactcagattaaacagcaacttccaaactaatggcaacattttccgtccagatttctttttatgtcttgcatcatgttgcagggtacagcacatgaagcaagactcatcttctgccatcagctaatgttggtaaatgtcaggcatttaataaagttaaagggcaacaaagttttaaaaatgtattctgcctggcaatcagcccttgagaagccttggaaaaacttggtgctttattgactggatcagaatgagaaattttcttatcaggttctggaaacataacccaaagcccttagatattctaaatctctatgaaggatgtccatatagaatacacccacatgtttgcatttgattgtacctatgtgtgtattttggagaggggaatacccactccagtattcctgcctggagaatcccaaggacagaggagcctggcgggctacagtccatggtgtgacaagagtcggacatgactgagggattaatacgcacatgtgtgcatatctggggtttccctggtggcacacgtggtaaaaaaaaaaaaaaaaaatacccgcctgccaatgcaggagatgtcagagactcaggtttgatccctgggtcaggaagatcccttggaggagggcatggtgacccactccagaattcttgcctggagaatttcatggacagaggagcctagtgggccacaatccatcgggttgcaaagagtcggacacgactgaagtgacttagcaagcatgcatgtatgtatttagggatatttttgaaatataatggtaagtgttctcgtgtataccccaaatgtggattttgtgtaatggcaatttaaatttaggtgtttgggagccagggcacagttcgtaaaatgagctctcgagatgtcccagttgctcagacagaagtattgaatactctctacattgaccaaagggatggaatcagcagagccgtgacaactctgcaaatggatgaggggtccatgcttgggggtcacccagtgttctttagggaaggaatgtcttcttttcctcaatctaccttcttttctaccactggactcaaagatggaaggatgaggtttctctccttctattgcctcagcttcctctttgagtatgttgcgaggcggaggaaactgttagaaactgaggagaaaagaaaaatttgaaaatgccacattagagcatttaaaaaagtcaagtttgctaagaaaaggtggtagggaatattggcaatgtcaagtctctccacttattgggttcccactttacgacagacttcattcagagcactccagcagaggtatggagagtgaaacttaaaactttgtgggtgtcttcttgtttctgtaaatacgatgggactgctatctctggcacatgtcttaaaataaattcatcaaggaaagagctggttttaatgtaatatgtaaagtgaacaaaacagaaatgctgagtacccttctactctagaagcaaatgttaaaagatatatatatagagagagagagagagcgcgcgcg

SEQ ID NO: 43321 - DNA, 793 bp, Bovine  19866881144397
tcaaatgcaaactggaaagaatgtcagtcacttcccttccagcaaagttgggaatggacgagaagcactcagcacagtgcgcgttcagggagtctttatctggagttggccattattttttaagatgtgctcaataaatatgtggtgaatgaatgaagaatatctgttctgatcgcaagatgcttcaggcagcattttcaattttaagttatgctaggaagaaagcctaatgaaatgccagcctccccgaggaaccttgtaacttctgattgtctccagcaaggctggctgcgacgcttcctgtgtaactgtggctgtctgcgttttgcagcaacagcaccccgcagatctgatgcgagcggaagtggaattaggtggggctgaccgagcagggccccagggggctggcaagtgcttctatagctattcattgtggatgctgtttgaactctctggctaccaggcaccattctaaatgtttggtgcttacaaccacaagcctaccagcaggcactctgattattcccattttacagatggaaaaacctgggacagtttcagttaggaagtatcttgaagtgccttggcttgtaagggattgaactgagatctgagtccagaactggtgtctggctccggctttggccctgaccactgtgctctgtggcttcgctggtggcgttagtggtaaggaaccctcctgccagagcaggagatgagggtttgatccctgggtcagaaagatccactgaaggagaacatggtaacccactctaatatttttgcctggaga

SEQ ID NO: 43322 - DNA, 871 bp, Bovine  19866881236229
aaatgcaaaattcttccttgatgtcaggatgaaggggcttcatttgtaatattgtgctcataaaccaaactttcatcctttcccaagtaattggcttcctgctgtcaggagctctaaagagacgtttgacaggagttcaaattggtgtgttagtacctttcttacgtatctcttttcatgcgctgtttatacttcctcctgttagcatacccttcacttggtaaagatgaatttgggttttcaatgtcttcttgcacaggcttatttagtgatttgtagttgcatggagttttcatggctttgtagctgtaaaattcgcaagtaagccagaccatgtgaaatcctaaggtcttggaagtctgagtggccccaaacagcccctggtttttgaccttttcctattctgggctcgtttgttagttctgaaagactcagttgaattttgtaagatgcagaagatagttctattttcagcgttttgccctttagcctattacagagcgcaattcgattcttctttcagaggatggttcagacctacactgaatgattgcttttggggaaaaaacatcccagaccctaacgtgctgagactgaagtggttctggggcacacattaataggtaactaaatcagaatgaaaacatttctgaggatgcatgtcatattaaagcaatgaaagagctgcagaaattccttgaagtcagggctgattggtgaagtcagggcttagggatgcttttactggaataatgggtgggagagaattcagaaagcagttttttgcaataacattcctttctcatccccactgccttctccgttctcatcgccacccactcctgaaccatgaggtggaattgcagtgctg

SEQ ID NO: 43323 - DNA, 1290 bp, Bovine  19866881279277
acagaaggctgacctccttcaagggcccgtggaacgacagactccacccaggcttggcaggtgggaagtctcagagacaggccccgagctcccatcacttcatcactgggaagtgtgggtatctgtttctcaggctttcctcccagaggtgacctgagaaagcaggccatctcatctttcaccacattcatcctttgaaatggagaggtttcatctaggttctcaagtttgcaggtttgattttttttttttttttttccagttgtatatggaccacctgaattatttgcttgtgttgacagagagaattcttacctgagcctgtggaaaatctgaggtcagagatcagtaactcagggctaacatcatagctgtcggtatcaaagaaaaaaaagaaggaccgatgcttcatgaagaaatgtggtcagctctccagacagatgcacggtccctaatgaagcatctgctgaacagtcagtccatccaacaccgctgtcagcatccagcctcacagcaaggcagccagagcctcgctttgggtggaaaaaattacactggccttcgttcaagcctcctcactctctttagctgagaattttaaaaagaaatcaaaaaccagaaagaattagaggtttgccgacttttttcctcacatccagaggctttcctgctcctaggaaacatgaggttcatcctgaagctctgtttacaccctgcacaaacatatcaataatcgtccaatgatacacacacctcgactgtatttacaaaatgtgaatataaattatctggcacatcatattaatgtaaatacacttaaggatgtttgagtgagacaataaatggatctgtttgtaaataccagatgccaatgcgcaatcacttcagtgggtccatccgagagcctggtgctgtgctgcggggtaaggagagcgtagattagcttacttggaactgctgtttctgcagcaaaacagggtcagacatcggccatttaatacgtttcaacttcacacaaaagtgaatgacacaaaccctgggttcaaggagtcagtggctcaggagaaaagattcagttcagttcagtcactaagtcgtgtccgactctttgcgaccccatgaatcgcagcacgccaggcctccctgtccatcaccaactcccggagttcactcaaactcatgcccatgcagtcggtgatgccatccagccatctcatcctctgtcgtccccttctcctcctgcccccaatccctcccagcatcagagtcttttccaagagtcaactcttc

SEQ ID NO: 43324 - DNA, 811 bp, Bovine  19866881300173
tttgtgcttcttacttcccttcccctgcagtgcccctccccttcgatcaccccactggtaaccatagtttgttctctatatctgtgagtctgcttcttttttgttacattcactaatttattgtatttttaagattttacataaacgtgatatcacagtgtttgtctttctctgtctgactgatttcatgcagcattttctggatttcaatacccgctccctccccttgggcttaggggttggtaacgttaggtcactggccttgggaactacacagtctcctgtgttttcctaaactctgcccacgctgttgtacattagcccctgaatgaagacagttggattgctcatcctgagggtgccatttgttaccttcctggactttgatggatacaggtacactgagtcactttggtgacatcacatttaatgttttgctgtgcacccattaatgagtttctaccaggagggagatgatttttgtctcttgttttttccctagttatttcttatttataacttctggaagggctatttctttgtctttcatcttccttttgccatgctacttgctctttgaattttccctttccccttcaaatcgagtctgtaagacctgaaaaagccagtttccattctgattctccaagagtgagtttctttggtctccagagtctcagctctattcttttattaatgcttctttgcgaaactgtctgttggattgtcttgagaaaacaatgcacattttctaagcttctaggggaaacgattgttgccctaaaaagaagaggaaataatgaaagtatat

SEQ ID NO: 43325 - DNA, 1074 bp, Bovine  19866881426737
ctgtccatgggattctccaggcaagaagcctggagtaggtagccaatcacttttccaggggatcttccctgacccagggatggaacctagggtctcctgcattgcagatagggctgcactgatagttatactagagactggctccagaggaaggcaaggaaagatgaaggcaggatgtttcactataggccagacatggtcgtatgtgttctgcatgtatattatctcatttaacttaataaagcaatatatttcctcaaacatatgcttgagaatcagcatttctcaagaaaaaacagagagcttctttcctctagctcctgtttctctgaaagttcctttggtgactcttagatgagtacccttgtacccttctctctctttctttttgtttttcatttagacaattttaagggctgaatttcgttttaatttttttttttcaagttccaagcaacatcaggtcttgtaatggtcattcctctagggaaagataggacagtaaagtcaaagagattttgaaaacgaaatctggggggcagggaaacaagtttgcagagcacaaaataagataacaaaataaggtgacaatgacactattttgcttttgaaggagaagagctggcaaatgccttcagagattggatgcttttaggctgctaatgagagattattcatttttttgctctgcatttgaagagactggctcaagaagaaagctttggatgttggaatgggaggtctagctggggtctggtcacatccagcattttgttccaggagctgaggtctgtctgggctgtttgagctcatcaggtgcattttcagctcaactgccagcagaaaccactgaactctgcacaggccatagggagtgaggcgcttgtgagcacccaccctgctgttcagcttggagccaccactggtttcaattatgacgtcaacaggcagctttgagggctccactattcattacagcgcctcactctctattattagtaataaaggaacacaggcacttcacaaatataaagtgctaacccatcatcaggcagtaaaggcaatgcattggga

SEQ ID NO: 43326 - DNA, 775 bp, Bovine  19866881529762
ctccccagtttctcttataatatgatgatttctaatcttccctttgtcccaattttggtagataatagagatgaccagcctttattatctacctcttatctcacccctactttgtccccatgtccatagataataaactcctggaaggcaggacaggactgtgccctctgccccatatatcaccgcgcagaggcctttagacacggggacactcatactgagacagacgttctctgacacagccctgctctcatgctgccacagagggggagctccacagctgtcacgatttactgcttttccctggagaggcaattataccactttatcttcccctttggcttgcagccagtggctctgcacctagtctctaattttctttttgtttaaagggatgttctgtctactcagacaaatgctgatggtaatgagagctgctgctctgtgttacacacctactatgcgctagactgtgctttacatataagatctcactaatcttcataaaaatcttatacattagctagtattattctactttctggatgagagaatggaagctcagagaggttgaaaaaacctgtaccgtagccctaaagatgtagatcagagttggcgtcaagagttaaacccagatctactggcctaaatctttaccagaaatttccacccaaaaaggatgacttaagggtgaggctggatgatgcgatgtatgtaaggctctgattcaatattcttgagatctaacaccctgaagcttttcagtggggaagtg

SEQ ID NO: 43327 - DNA, 1386 bp, Bovine  19866881682305
cttagtggaatatatttcatttgaccctcatttagagatgtggaacatgtggccccaagaagttaaatatatttgcccaagattcataactagcagtggcagagcccaggactgcattctggtcttctctttcctaatctttgaaataaagagctcctccctgtaattatttgtagtgggccaggttcccctttgaagtctttaaaagaaagtttcacagtcggactaacttcactcagtacgacaatctctaggtccatccatgtgactgcaaatggcattatttcgttctttttttctggctgagtgataaaagaaagacaaatatcatgtgttgccatttatatgtggaattaaaaaactggtacaaatgaacttttctacaagacagaaagagagtcacagatgaaggaaataaacttaggttaccggggggaatggagagggaggggtaaattgggagactgggactgacatatacacactcctatgtataaaacagagaactaatagggacctactggatactgggaactctactcaacattctgtgatggcctataggggaaaagaacccaaaagagtggatatgtataactgaatcactgtgccgttcagcagaaactaacacaacaatgtaaatcaaccacattccaataaaaaaaaagagtttcaaaatatttttttaaaggcttgggaaattctctgtctttggatttatcatggccatctgaaaccccccagccccgcttgtggtcacaataaatcaaacaaacaaataaccatccccattgttttgtggattatttccccacgaggcagatgtttactttttccaaatgaaagctcattgttgtcaggaacatttaagaggcttaacctgtctcctctggcatatggcgctggcttttcatgatgagactggttctgtgcagcagcagacgaaattgcaagcctgtctccgaaacttcatcagttagagccacggaacgtcgctgctgtcctaggtgggggcttgtctgggcctcttccaccgtgaaaggggaaaaaaagaaaagctgtttcctttggtagcaaatacccatattttaatgggcatgatgtcatgaattattaaactagcttaactttaaagcccagctgaaagaacacagagtgaagaatgaccttgagactcttgaaaaatgggattgttgactgtgcctgcagactcgaagatggatttctcctttagtttatatttatgcaactgtgaaacttggtcccttgttcccagagaaatcctttgtgcagccgtgtggagaaagttattacattttagtgcagaagagctgtaaagtttcttttctgtgtactcgggaaactagagtgctgggcaatccttgt

SEQ ID NO: 43328 - DNA, 713 bp, Bovine  19866881831055
ctacaattatgtcttattgttgttagttgctaagtcatgtccaactcttgccatcccatggactgcagcccaccaggctcctctgtctatgggattctccaggcaagactactggagtgggttgccatttcctactcctgggaatcttccctacccagagattagaccccagtctcctgcattggctggtgggctctttatcacagagtcatcagggagacccacaggtatatctaaacccactgaaactctgacccagttagatacagccgaggaactaggagagacaaacacagtgtttgtagggctttaatctccaaaccctgaaatattgtggagatgttttatcttccattgcacacggaggagattaaaaagccgtgataaatggtgtactctccgggagggaatgccatatatagggcaatacataatttcctgcttctggtaccgttcgggataattgtcctggtaacgtgaaaatgggagggatattaatttaagattaaagcacaattataagccctgtcatactgctaatttcttttaaatgttcctctgaataattccacctttgcaagatggaataagcacacaattaaaaactgcattaaataaatgaataactaattaatgaataaaaagaactctgaaaataaaatgggccatgcaaattctaaacaataattttaacagcaggccagaacttaatc

SEQ ID NO: 43329 - DNA, 1087 bp, Bovine  19866881934600
ttctgtttcaaaaatgctttttggctttcattattttagaaattcttctgaagtattaaatagaattgagaggaggtgaccagaaaggactaatttaatccaatgacaagtataatggaatatatattcttaagagtactcattatttggatactgcaaattccacatccagacaaaagagagacattcattgaactgttatgtttgtgtcaattagaataagtttggctgcatgtgtctaaaatcctcaaatagcaagggctgaattaacacagagattggttttcccctcacagagataagcagccacgggctggtatgataccacaattaactgtttatcagagacccagtttctttatacgcactttttttcattattcccaaaatatttctcctacttcatgacccaagatggctcctaagatccagctggtatgttctcatttcagaatgtatgaccaaaaaaatgggaaaggagcttttctctttaagaatatacctagaatgcttgcctttcactcttgtttatattcagcctaataaaatgtaggctagggaaatgttgctttactcaggggagtcacgtgctccaccttaaaaatcagagattggatgaaaatgtgtagtctcttggcatatgtctcatatagttttaactctgaggctatattacttcatggaaatcacattgacaaggaacaaccaaatggtgagcaaaacggacagatctttagaacctggccatcacccagtgaacggtcttagaatagtagccaaacagatgctagttgttgctatgttttaggtaggacttcacgagtccttgacatttaaaactagatcaccctggggacaaaatgttcctcattgaaaggagggagagagagagagagagggagagagagagagaaggggagggaggaaagaaaagggaatgagaaagagagagaggagacatatttaaagaacaagacacatttctttcattaaaatattgatttttcattttaagttggagccaaatatcaatataggtaaaattggtagttcccagaactgatgagaattcaccgagcttaacaaa

SEQ ID NO: 43330 - DNA, 904 bp, Bovine  19866882059374
tctgtatgacagactctaggtccttccatctctataaatgacccaatctttcctttttatggctgagtaaaattccattgtatatacataccaaatcttcttcatccatttatctgttgatggacatttaggttgcttccatgttcagatattgtaagtaatgctgaagtgaacactggggtacatgtgtcttttggaatttttataagaggtacaattttaatctcttggtcaacttgtgaaataataaatgttattagtagtagtagtagtagtaatttttaagggaagtttattttggatccttcatatctaaggatttctccctctaggacagaatagtttattatctttaatccatgataaaatgcttgactatgtgacagcacataagttttccttaaatattttgttgctgttggtttgggatatttcttttccaggagggcaagattcaattaagcaaacaatgcctaaatcttctaacctacaagaaaaaagtgactttctatcatttcctcagggtgaaatgtcattgaacaaataagttctcaggaagatattttaaccagaatatctggttagtagcatatagaaactcaaacagtttttgttatcattaaactgaacacaccgctaactttattttaataattcatgcattgtttcataaacaaaagcaaacaagcattcatctgagagatcacttttagaagaggaaataatactttataattttatttattatttctttagtggagagcagtctcttggctgaacatgcgttgcttttttatttatgaaatggtgcatgcattattaaaataaacccgcgactgtgttctgcttaatgatatgcaaaattatttgaggtgagtacagagcagtttcatttctctacctg

SEQ ID NO: 43331 - DNA, 1057 bp, Bovine  19866880421720
tttgctctcagggatcttgagtccaaatacacccagaatttgaatcacaaggcttaggcttttagtttcatctttgcctcaggaagaaaagtaattataataagtaaatgttcttgttacataacaacatatcaataacttgcttagtgcttatgtctttatcacaaagtggaattaacaaacctactctttaatctttccccaaggatgtggcaaagctgaatatttttttaaaaggatattcaataaaaatcaaactgaagaaaaacatttttccatggtaagaataaaaaaaaagatcagagtgaccacttgtaagaaggctgtttgcagatagactgtggaagagtgaggtgagacacctcaaatctgccaaacctaaacagtgagcaacaggatgctaattttgagaaaatggaatgaaagtcacggaccgtccaaatcgacaaggatgagcccagcacagttaccaccacccatcgttggttaagaagctggtggggagcggtagtcccggttgagtggtcgagcacctccctttctggacgtggagaccagtcccctccggggcagtgggcgcagttgctgcccgagcttctgggctgggcacagcacctggagacacggggcaggatcgacagtttttattctctgtttccgttttcctccagagctctcagcatggcggctcctccacttcacttgcatccaccaaagtctgcagctcaatggacgagaacgacggacccggagaaggtggtaagcttgggatgtggtgtccaaggagaaggcgtatcttgtacccagacggagaatgggttggctaaatttagtccaggaaactgacatttctccagcagaatgaccctgaagcagctcagggtcattgcaagggggtgggaccgaacgtgggtctcaccaggggtggtatctgctctctggggctgggaagagggagtcagccaaatgtggagacctctcccaccctccaaaggtgtaagcattcttagaaggccagctcttgctctccttgcaaataaaaggggctaactgttgc

SEQ ID NO: 43332 - DNA, 1508 bp, Bovine  19866880437879
cattttaatgcctagatgcctagacatttattagaggttagagtttttatttcaaaatgcattaaaatatcttttcctcatcacatgagaaatgctttcaggcaaagctactataaagcaactgaacaccggcgtatcagtccttgagcaagaaagcattggtcttttttttgtttgtttgttttttaatgggcaggaaaatagtatttttccataattatccaatatcttttaaatactttgaaatataatgttgaacatgcattaggtattttactattaataaaaatgacataaaaacacgatgttaattaaaattacataatattaatattgtgcttaatattaatactaaatatattgcttgtgatgtcaaaaagatttgttagagatatggtaaacttaaggaagttattacctgtttaaggcgtagctgacagttctgatctatattggcacatttttaaaaataaaatgtatattgagaaattaagtaagcttactgcaactagaaattttttgagtatatgcatcattgagacacctatatttgcttgtagacttcctgtaatctgcaagctaacgaagcttttacatcaggcccccttactccacagggccttctgagagatcagagttaccaaggattgtattgtgatctcactttactcaattgccttaagacgcctcagggaaaagaaataaaaacctccatttctaagcctccagtatttgttgtaattgttctattttcattctaaataattattcacttacatagctaatttttatttgtaactttgtattttttttctttaaaaagtcatttcaaataatgtaagcttatttgacactttttaaaaaattttatttaatgtatatttttttatttagtgtcctcctcccttcccacccatgttcattctttccattgttctttaattataacaattctgcagtgaaaaatctggtacatacttcatcttgctttgttgagtgtatatccacaggataaatccctagaaatgaaactgctgcattaaagggcatatgtatttgacatttttgataggcagtgacagaatgttcttaatatattatactaacctggactttccccatcaatatgattgcctgttttcctcacaatcaaagttttagattttgccagtcttatagataaaaatagtatctccatattgtttcagctgtactctgggggaggttaatcatgtttttaatcaagaaagagcaatttgtgctgttttctggagtttttttttaagcagaattttactgtatctcagtgtttatagaaggagattggtaaataatatagtttgtctcatgtatctctgtgtattagatatatagaaatattaaaattatatacatatgtgtatataaacatgtctttttctccctacttctcatctagattaatttgttattcctctgtggaatacccccaccctagtcttaatggcattagttatgaggataaggat

SEQ ID NO: 43333 - DNA, 5002 bp, Bovine  19866880446301
aaaactgcttttgaagaacttgccaggtacttgcctggtgctccagtggttaattaagactctatgcttccaatgaagggtggggtgggttcaatgcgtggtcagggaactaagatcctacatgccacacagccaaaaaaaaaaaccacaaattgaaaaaaaaagaacttgactgattagggcagtctcaccttgataaccttcctttcaccatactgctgctgctgctgctgctaagtcgcttcagtcgtgtccgaccctgtgcgaccccatagacggtagtctatcaaagctacccccgtccctgggattctccaggcaagaacactggagtgggttgccatttccttctccaatgcataaaagtgaaaagtgaaagtgaagttgctcagttgtgtccaactcttagcgaccccatggattgcagcctaccagactcctccgtccacaggattttccaggcgagagtactggagtgggttgccattgccttctccatactaggtgatataataacaagagcaatatctcatcaatttcaagtacttaaaaataatttttgtatttttgtgtattatatacacaatggatctgtttttaggaaacccatttactccctcaacaataaaagaagtattatactatttaattagcacatattatttacatatataggtaaaatgaacttaaaatctgaaatgtaaataatttaatttcattaacatatttagataaacagcattatgtagcaaaaaatgcataagcatcaatgccaaagagaagaaagacagaatcccagatctgccaactttgtatgctagggtttagtttgaatttcaaattttaactctatcttgaacttttaacctctaaagagccatgtttaatatgtttacatctattgtaataactgttaggtttggtcttatatcatcttgtttgatatgatcatttttaatgttttcctgcttttcataatgatttgagtttttttgaaaatataaacaaatttttgcctacttttttgtgatttagaatgtagacatcttgttattaattctcccaaggatatgtttaaatttttaataccctttaaaatatatttctcttatttttgaactcaaaaaggaatcaacattttatatcacttctacatatgataagaaattttactcaatttactccttattcattccttacctctgtcaatatagttttctgcccagaatctatactattatataaaagctctatctacccttaaggaagcaggctatacagggtttctgtaccagagtgggaatttcagaattctacctactataagaatacttcagttcagttcagttgagtcgctcagtcgtgtctgactcttttcgaccccatgaaatcatgtagtattaacatacatgtgatacataatataaaactataatataataatgcttacttaaacaataattatgcttactatatgccaggaacttacaaactacatgtattttatcacttaatcctcaaaatagtattatgagagatagtattatattccccatttcacagattacagaagtaattcaggcttagacaggttaagtaatttgctcaaagtgatgcaactagttaagtggcagaaactggcttatacccagctcagagagcatagactttggaattggatagacccgttacatgctcctagtgccctataattctcctttatagcacttgtcacactgccaattaaataattattgtgaaataagttggttaggtagattacgagtgtcatcaaagcaactgaatttattttagagtgcattcagtaagaactaacaggaaatctgactaatagtagcttaaacaaatagagatccactttcctcatctaaaaagaagtggctactggtaatatatcagaggctcaacaatatcatgatgtccctttgactctcttgggctttacttcatgggtggctgcagctccagccatcacatccaaaacaaagctggaagaaaggaaaagggttgaagctagccatatctgactcattttagtgcgaaagcaaactttccattctggagcttggccataactggttgtagtgaatattttgtaagcaaaaataatttctggtaaaggcagggactgcatctgtcttattttgtcttctgcacccagttcagtggtttctacactgtaggctcttaattgctgtgcatgaatgtttgctaaataatgcatccaaggacttccctggtggagtggataggaatatgcctgccagtgcaggggacatgggtttaatccctggtccaggaagattccacatgccatggagtaactaaacccatgcgccacaattactgagcctgcactctagtgaagactacgtgccccagaacctgtgctctgcagcaagagaagaaaccatgatgagaagcctgcccacggaaatgaagagtagctcccacccaccacaaccagagaaagcctgagcaaaagcaacggagacccagcacagccaaaaataaataaataaaaacaaaaatgatgcatgtgaaatgcttagctacgtgcttagtgtaaaccggatagttgattaatgatgattactagtagctatatcgttcgtgagtgcatgctcagttgctcagtcatgtcctattctttgcgaccccacagactgtaagcctgcaagtgtcctctgtcgacgggattctccaggcaagaatactggagtgggttgccatttcctcctctaggggatcttcccatcccagggaacaaactcatgtctcctgtgtcaccagcactggtaggcagattctttaccactaagccacctgggaaaccccaactacatagtttagtaaccccaaatttatatatgtgtgcatcctgatggatgcttttcaacaccccactgattgattcaaggtaagtgccaacagctgatagctctgttgggcacattagccacaggggctggaaggggtctactctgggttgaggagtaaagtgaagtctaagtctctcagtcatgtccaactctttgcgaccccacgtactatacattactttgccaacaaaggtctgtctagtcaaagctatggtctttccagtagtcatgtatgaatgtgagggttgtactataaacaaagctgagcaccaaagaattggtgcttttgaactgtggtgttggagaagactcttgagagtcccttggacagcaaggagacctaaccagtcaatcctaaaggaaatcagtcctgaatattcattggaagcactgacgctgaagatgaaattccaatagtttggctacctgatgggaagaactgactcatttgaaaagaccctgatgctgggaaagattgaaggtgaaagaagaaggggccgacagaagatgagatgtttggatggcatcacggactcagtggacatgagtttgaataagctccgggagttggtgatggacagggaagcctggcgtgctgcagtccacagggtcacaaagagtcagacacgactgagcgactgaactgaatacactccatgaattctccaggcctgaatactggagtgggtcgccattcccttctccaggggatcttcccaacccagggatcgaagctagtgctggaagaagtctgctctttggtgagtaagtgggaagcagtgaatctccttctagcctgctgctgctgctgctaagtcgcttcagtcgtgtccgactatgtgcaaccccatagacagcagcccaccaggctcccccccatccctgggattctccaggcaagaacactggagtgggttgtcatttccttctccgctttgcaggctaaggctggccaaagagggatagccctgtagtaaatgttcagctgctgctgcttaagctcactttatgcaactagtgaaagtatggttactaaaagtgttcttaggctaaaatgaaaaaaatccctgccctgatggtcgcaagacttctctgtctgaagctgaggcttcagaaaaagggtattaagacttctgtatcagcaccatgttttggggaacacttcagcaagcttactcgtcttcaccttatttctctatctttccaactgaggaccagataataaggtatatttagacttccaggtgaaatatacactctagactctgctcactgtctcagaactagaagttgcaacaatgctgggaattgccaataagctgcttccctctttcattgacaggcactgtgtgacttgggtgaatatattagttttctagagctgccataacaaagtaccacaggctggtgcttaaacaacaaagattaatatctcatggttctggaggtcagaagtttaagaaagatgtcagcaggttggtcccttccgagtgctgtcaggaagggccatgttccaggcttctcccctagtttctggcatttttctgacaatatttggtgttccttgctttgtctctgttggcttatagaagcatcacctcgatctctgcctccatctccacatggtgttctccctgggtgccgtggtctctgtgttcaaatttcccctttattgaatgaggcctgtcctaattacctcatcttaacttgatcatctgcaaagtccctatttcaaataaaatcagtttcacaagtacttggggttaggatttgacatctttttgtgggggacacaattctactgaaaacaatgagaaactcattgtgtatgttcctttgtttaaacacaaaccaatagtgatccttgggtctcctacaatgttaaaatcacttccaagatcctgtgcaagagtcaggatctataaagaatgattctatgacctggatttttaggataacattgactccatgtaatgtttttctataaaagcaattgattaaacataattaaaagagatttatgtttcatgcccatatgaaatttcatagataaattaatgaccaagtcaggaaaattaagatttgattacagttacgat

SEQ ID NO: 43334 - DNA, 4455 bp, Bovine  19866880461473
tttgtaagctactcttgtgatcattgcagatggctacagtcagaaaagttgttctctagggtttattatatggctataaagacatcccatgatttgacaggctaaatgtgttaaatggcaacaattatgaaaaaggttccaattaaaagctgaaggcatgtcctaccaagaatagacctagtgaaaggtcaggtacgtaggtttttggtatgctgctattttacacaggattttctttttttaaaggagagtttttttgtttctttttcatttatttggggtttcgcagtagttgtaacttactgaacagaagatttggggcatatgtctgacctcgcttggatgagaaactgagaccatttgaaaaagttatttgaaaaactaaaagatttaatacagggtcataaaatgcagccggtggccataaaataatatgaaaattcacagataacctgaacccagttaaatggtttctgagattcccataatagagaactaaaagctgactaatgtaacagatgtgttggaacaaacataattgtcaatgataatatgaattcaaggataaccctgttgaaatattggctaatgaactgtccggaaccactgaaatgtcttcacagaggagctcaataggtactaaaaattacttcaccagagagaatttaacaaaactggcatgaaattgacaaagctatgacaaaaaagtgaatttactttttaacaaatatggtatcctttaaaaaagacatttatttttcttctagccacagaatatggcctttatgacactttctaaaaacagtggattaaatttaaacctttaagaagtgaagtataacaacatttatgcagggaattacttagcaaaatgtattttatgctccacatactttagaattaaggctgctaaaaaaacttaattcttaaaaaaacaaattcattttatacccacatgtaaaatctttatgaaacaaaagttatgtgaaataataaaaataaaaaaaggtgtacagaagtcagaagaggcttggcaacgtaagaacaaaaaataaaatagcttttcaaagtgttaccctagagatgtctgtgaagatggagaagtgaatgcaaattccaggaaacctgactctcatccgttctttaaatcagtcatgaaactatctagaaaggagttctacgcagctgcagtgagatacagcaaaaatgcacattcctgactacagtgattgtacatcccagaattctgttataactgggaattcagtgtcaactgctgtttttaaaaactgttacatttttgtcacacaagtactatccaatatgtcattgtaggaaaactggaaaagacagataacattacggagagaaaagaattaaactcactcgcaatcttgacacctagaaataaccattgttaaacatatgggcctatgaacttccaaagctttttctctctctctttcctgttctttttcactggactgcataccctgaacgcgtgccccagtgaataagcatacatgtgtatcacgatttccagtgcctgctggatagtccattgtatggatgcactaaaataataacccgccagactactgcccgctgccatttactgagcccctgccaggcctcatgtcgaggattcatgcttaacatcccacttaacgttcacaacaactctgttaagtactatcaccggtatttttgcagatgaaaaatattgaggctcagagatgttaagtaacttgccgaatgttacacagctaataaatggtagagccagaacttaagcccgggcatgttcaagtccatgattctaaccagtatgtcctcctgcctcccccttatgccaatattttaaaaaatcagtgccctgacctatttctatatatacatttttcctttccatgctaaaaaacactgagatgatgatccctttgtatgtatacatatctgatatttttttttctttaggtcacatttctaaaagtagaattacttgaccacagagttcatattatttaaggctgtagttacgtattaccaaactacttttcggaagagttccatcaggttaatcttgaactgagtcatatgagatgactggtttcctcctaagcttgccaaccctgcatattattattatttattattaatctttgctagtccagtaagaccatgtcatttaaaaataatttgattgacttatttatttatagctgtgttgggtctttgttgctgcgtgggcttttctctcgctgtggcgagcaggggctcactctctagctgtggcgtgcgggcttctcatcacagcggcttctcttgctgtggagcacaggctctagggcacacgggcttcagtggctgtggcacaagggtttagaaattgaggctcccaggatttagagcacgggctcaacagctgtggtgcacgggcttagttactctgcggcatgtgggatcttcctgggtcagggatcgaacctacatctcctgcactggcaggcggtttctttaccactgaggcaccagcgaagccccttaaaatgaagtgaatgatggtattctacaccacagtgacagaggaatgggcagtggaacagacagatgctggcccccccggagacactgtactttgacttcctgtcttcttccccctggtggaatcacaggtccttgcagaagtgaaagtcaaagtcactcagtagtgtctgactctttgcgaccccatggatgctacagtccctggaattctctaggccagaatactggactgggtagcttttcccttggagaagggccctcagtaaatgcttagtacaataactggcatattactgtagtaaattatgtttggggaaaatgttctttttcttatccaaatgcagatagaaggactttttttctttcctaacgttttcagtcactcagtcgtgtctgactctttgcggccctatggactatagcctgccaggctcctctggccattggatgttccaggcaagaatcctggagtgggttgccatttcctgctccggggatcaaactcacatctctggcatctcctgcactggcaggcacattttttaccactagtgccacctggaaaaacaagcattccatttcttcttggggatttcagtgattaaaagctactgacttttcaaacaggtgtaattgttagaaagtttttccttatgtcaacctcaaatctgtcattaacgtcttctccttagtttgagttcagtgtctcatacgcagcacagaaaagctctcccatctcccgtccggcagcctctgctgggccactctgctgcgctctctccatgtgtctgggtcccgccccactgagctcacgtggcacgagcaggacagaagactctcgtgagagtgatgctctttcagggaaagcgtctaagggcacattggtatttttagcagtcatgtcatactgactctcgtaatgaacttgttatggtcaatgaacagcctttaaactagcccaaatcttcccattactgtttttccacaatggtcattaaaacaaccacaccaaaacagacctagtccatcgggacttatgcttttaactcttgttaaattccatcttactggtctgggacctttatggagccaaagatagttgcagatctcagttctgttatttactatatagaatacatcttcatgtcgactcactggtaatggtgataagggcagggccagtgacagactcctgtgagatccatggctcccttccttagggtgacccccagtctgttcatccacattctggtggctcaagttcatcttgcagatctattcaactgtctttgtttatgacctctactgtccatctgtggcactggccttatccatcagtggagtgagctatctgaccacaaaatgagtttacttgaggattaagacagaaggaaatccattatttggtaaagtcagtgttgacctgaactggaaactaagaagagcaggaacacaacctctggttatcactagagaaaaacaagataatttattcctagattcaacccattttgtgaaaatgcaggtcattagctgtacatgccactttgatgggcagcaaggaacaggcacaaataccttgacagagtttctaaaaggaattttctgacctagagaagcagtttccctgagaaactgctttttcccaaacagtatttaggagtttggaagcaaaaagatttttgaacagaaattttttttatatttcaagaaaattgctgtttatttctggaatctaataaaaaactagttatgatcagttatatttttgccagtaggactttaattttcctaaggagaaggcatctgtgtatacatttaaaaaagacggtcccagctcactgcaagaaacaggctgctttttgctgccaagggtacaagcttgccatctagtggtggctcatgaaa

SEQ ID NO: 43335 - DNA, 1017 bp, Bovine  19866880490231
ataaatataagggaactgcagaagcagcatccatctgaacagctctcatatttttaaaggcccaaaaaacaaatattttctgttaagcaaagaaagaaagaaaacaacagttaaacaaaaaaaaaagtaaggaaatgaagcattaaattatgtttggatctgaccaatatctcctaaaatatcagaacacagtaacttttccctgaaagtcgtatacattttgggactttggaaaacagaataatttctgtctaagcatattagattatcataaaggtaccaaagagtccttgtttgttttcaaaaaaaaaaaaaaagaatcacacgtgagttttaaaattattatattttgcaattctttaaagtatggaaataaattttctctaacaaaatttattagtaaaaaatctgcaaagttaatgctacttggccactggctcccattataagattaaagaatttgcacataagagaaattctcaaagtcacaatggacaacttacagtaatatgggtaactgaagtcatctaggaaggtctttctccataagagtccatattaggagatactagatgtttgccctgtttttccttattggtagaggtttttcactggctcagggttgagacttgtaaattccatctatgacatcacttgacctcagtctgaaaatgacctaatctccatttttcacattatttaagctgcttgccatctcctttaggattcctttaagctctaatgtggtatgttcaaaagtatactaagtgagggctttgtgtaatgcacgccatttttccagagtaaaaacttccttattgaaaactctggaaatgaaaattcactattgtgaattacagtaaaatctgggacagactcaactgtatattgaaatctctgaagttgaactgagttaaattacatgaagtacataatttatgaaatataatatcataaagtgccttctggatattatattttataaacctatctcagatgtacacaaaaacatctcat

SEQ ID NO: 43336 - DNA, 2886 bp, Bovine  19866880521302
taaccttcagtgcctgcaaggacactaacaatctgtcctgccttccaatgatgtgcaaagaaagtgaaagagttactcgctcagtcgtgtgtgactctgcgacccaatggactatagcccgccagggctcctctgtccttggaattctctaagcaaggatactggagtgggttgccattcccttctctaggggatcttcccgaccagggactgaacccatatctcctgcattgcaggcagattctttaccatctgagccaccagagaagccctcccatgatctgatcgcagacaactcacccttcctgggccatccaactctgtcactcttcccctctgctctttagacaactcctttatttttctgtcttacatgacttccactcagtcatccagaagagtcttttttataccccctctgccctcttctttctctttgtttcatttgaaacaaacctcattccttggtaatagtgccgggacataattttatcaaagaaaagatacatataccttgaagttatataaagcataataaagaccaaagggaagggaactaaagttatgagcactttttgtgcatggcactgtattatctcagttaactaactcaatcatccctattatcctttaagtgggtgtaattatccccgttttacatctgagaaagatcacactctctgaaatggaggaatcattgtttacactgtgctgtgtttaacttcagaagtttattttctcccagtgttttcaaaagaaatcagaagtatcttttagaatcttcagaaacctttgtgtttcccatacaccaggctcttgtttaagaatcctcatctttctcaaagtaaacatacattgtccgttaagtatcagcaatcaagagaaacatgatggcaatattctattcagtagcattacattttggtcttaattacaatgtttgcattaagtgctcttactatttttttttccccactacaaatatatactgccgaagatatattacagtttaaataggcttttgggtaggatttcaagacaactcataatttatgaagtaagtccccaattctaaacaatttatcaattaacttgttgtacaacctatttaacttcctaaaaattatgattaaatgtttgataatggagttttgaacaggtaggttgaatatactgaatttggaacttgaataggttactaaaggatataagagtccaatttaattacttcattgaatatattttatattcagggtaagatttaaagcaaaaatattctaagtaaaatgtgtccttttatactatttaatgctgaacaaactctaaaattctgtaatagtttattcatcatttgcccaacagcaggttagcagagaaacagctttttcagaaacgtgtaatttagacaagtgactttactggtggtgtgtctaaaataatactttcaaatttcaagtaatgaggtatatagctaatttgcattttaaagcaattattatcaatgtcatactaaatatattgactgaaaactaataatgagtttaatgactttgggtctagaaggcttgaaagataaagaaaagatatttattttaatctatattttatttttatgaacaaattttcattgacacaaattttaatgtattttctacttcataaactccttgagatgggagtgaggaaatcacaattccctgggccattaggttaaacacttagtaagctattagactgtgatacttctatttataacagtacaacttgagatgcattggctaaatgagttcccataaaagcaaccctatagatttcttctttcaatgcaggtcacatgtgactactgagtacttaaaatatggtgagttcaagctgactgtgctataaatagaaaatacatctggatttcaaagaataccaaaaaaaaaaaaagtgaaatatcttatttacaatttttatattggttacatgttgaaattacaacattttggatctattgggctaacaaatatatttatgaaactaatctcacctttttactcttactcttcttacttcttgtttctttttactcttaaatgtggctactagaaaatttaaattatatacgtaagtggcttgcattacatttctgctgttccgcacagctatagacaattctaaaagggagtgtgtagggtaaacaaggatagcatttctgctgtacccctgcagagagtcaaatttgtactccatttctctagaataagaaatacatttaggggtgaattataatttattatttgataaaatgtttagtttatcagggatagaagtgttaacttaaatcaagctgttgataataagcatttttataaattcatatttaaattcttagaaaaccaattttagacttatttgattatacaaaagccactgaatattttatatatttcaaaatactataatacataatatgtataatatactgtcatataattctcaaaccaactgacttgatagtggttttttcagaaatggttcctgacttgtttttaatcccaagatgccctaaaaaggtgtcttacacctccgcagggtgatggctcattacaacaataactgtttcttgctttttgttttcttgttggtctatttttgagctcagataaaatattttacatttattgtaaaggacaccagctgtttgaaatcttgactggtgaatttttgggtttctgtgtttagttttgacctgtggctgaaactgctgctataaagttctctatatatgtgtgactgtaattcagaaaagcctttatctctttttatgagcatctagttattttcttacacctggagagaattaataagttattacaacccataaactaaaggtgttttgtt

SEQ ID NO: 43337 - DNA, 1303 bp, Bovine  19866880550207
ccattgttgggtgtctgttttctgttattcaaccctagcctttcaggattatgctaatctccctgtatgactcaggaagcttcactcttatcctgaaggcaagtggaatgagatttgtaattatcttttggactccatgatctctcaaacgattatttcctataattccatttttgaaagagagttccttatttctttttttttttctgatgcagtaagcatcttgatagacttgcttgatagacttgataatttaaatttagtatttaaattttaatttaatgtttatgataatgggttgcttgccttccttcccattatccaccatcacccacttgtccatctgccccgcccatggtcactgttaattttccagcctttactcacaatggaacaggccaccgcaccagatcctgaggttgtgaggatccaagaggctgggattccattgcagaccatttagcccctcagagtctcacttgccttatctgtaaaatgagaggttggatcactctagcaaatagtagttaagagttcacacagccggtaacaagatgagcaacaacgtgggccagtatttattgagcagctattatgtgcttttaaatatgccaggactaggtggtacccctggtagctcagtcagtaaagaatctgcctgcaatgcaggagacctgggttcgatccctgggtcgggaagattcccttgagaaggaaatggcaacccaccctagtattcttgcctggagaatcccatggacagaggaacctggtgggctacagtccatgggttcgcaggagttgtgatagattaataatatggtggaaaatgagttcaagagaagccatagaagctgtagaagcatggcatgagtccacaaggttttttcagtactccaaaaatcaaatagaacgcctacattagctctggtaagactgagccgcctgacaaaaatacccagtttctttctggtggctggaaacatgtcaacttagtgtggtaacagcggttctattatgctgctccagaaccctagctggtaggtggagcccagaactagcaatttctggcacctgtggcaaacagcatgtgacagaccccaaaatcaactttttaattcactttgcggctcacagatgggtgttattaccagtgtgcgccatctggtagctttctattttaaccattcatccctgctaactagacgccgggcttttttaaattattattttaaatttatgtgacctctaaatgttcacgacctaggaaaaaaaatcctagttatcctgcccttccttgtag

SEQ ID NO: 43338 - DNA, 2535 bp, Bovine  19866880589903
tactttgagctgacattgaacccagcagcggcccccgacttaggtagggaggacatggcttatagcgcccttcatggtaccaagtcactctggtgctctgctaggggagcttggtgctctgtcttttggaacttcccagaaaccaccctctagggattggtgaagctccttataggagggttctcctcagagcacgttgccataaaagtgcctggggcactgaagtgctggaaaaaacttctagtcaccggtgctgtcggccaccccacactgcaggagccaggccctggagaagcccacgctctgcagagacctgctaggtgcgcatacagaatggggaagaaaaaccccttgcctcagcatcgtctcttcagagtcctttcctgacggacctcaacatactcctggctaccaaaggaaaaattaagggcacagattcattttcacatgataagcaattaagggtgactccagagctgagagccaatcattgaataactggcacagttggtaagacagttttacatgaagcacttagactcaacccaacttctatgtgtgtgagccataggtatcaataaaaggtattttattgaatacctgctaaagatattcaataaaataaaccggtaatatgattaatggaaaataatactaggtccaatatccattaaatcatggtcctcaaagagaaaaataaaaataaattaatgtgtgtatgcatatacacacactaatatatataaagtctaatataatatatgtagacataaaatcacccatcctcctggcataccacttttagtataaaggtgccatcatagctctcatggaaagatctcttcttgtttctgagattatactcattttgttgttattcagtcactaagttgtatctgactctctgtgaccccatggactgcagcatgccagactttcctgtccttctctatctctgttaactccaaaaatgtgtttattgcagatttgactgccgcagaataatcaaatgtgaatttatctgtattatgaaacaagaagtccacatatggatagttgctgagaatgttccagcaacttagtattagggtcagcctcccctgggattcccttggccttactctaatggctacacaattgcttctatagtttctgccattacatctcccattcaagtaaggaggagatagaagtatgccagctacatatgacaccttttatcagcttttctggaatatccccaaatgactggtttcattctcattagccagttctgggtcacatgtccttacttatagttgcaagggaatttggagaaagcaaagatgactttatcatcactatcttagatcaaaggtcagacaaattctggcctcaggaacaaattcaggccgttgttgcaaataaagttttattggaacagagtcgtgcccacctacttacacattgtctgggactgctttcctaccacaatggcaaagttgaatagttgtgagaaggacaggtgacctgcaagtcctaaaaatttttactgtttcacattttaccagaaatgttcattgacctcaggcttagaccaatcatgaacccttgcttggggttgaccactttgaggactaaatggttttccattaaggaggaaaaatggcattggaaaagcaccaaccatatatatccagccacctggtctaaccaatcgtatataagaccaccaaggcataacacattttctgttttgtcacagggtcaccttgaacttacaacttttctgttcctttgttccttcatttctacatgagccaggtacaaaaaatttagagaggtagaagttttgtaaatatacagaatcaaatgattggcagtattgtgatacatcatgaattcaggaagataacccctaatttactgattttatacagcactaaggtattgtcagactaagtctgagacacgtattccactgactgacacttcccttccaactttattttaggtccttgcgtacactgagggacttcatggaaaatggatgttcagcgagatacgagctgtattttcaagacgttatcttctacaaaatactgctttggaaagtgtttatggcaaaccgaagtaagtctccttaaatatttttttaaaaacgtgctgttcatatttgaatgttaacgattgacatgatgtgacactgacttgattttttgcattgtatttctttctttgatatgctgctgctaatgcaaaaataaaaattaaaaaagaatgtatttgtttgaaaattttaatcctaggataaacttataaggaaatctaatttccatgaagattcattacctttacaaataaatcatgaaaggcacttgaaaaatgatttctgaaattgatggttagctctcctgtggttttctaaatcatgttttttcttcttgccacagcttcagttatgtttaatttccctgatcaagcaacagtaaaaaaagtcgtctatagcttgcctcgggttggagtagggaccagctaggtttgccacaagccagg

SEQ ID NO: 43339 - DNA, 1954 bp, Bovine  19866880591323
cgttttctgaatgttgagctttaagccaactttttcagtctcctctttcactttcatcaagaggctttttagttcctcttcactttctgccataagggtggtgtcatctacatatctgaggttattgatatttctcccagccatcttgattccagcttgtgcttcttccagcccagtgtttctcacgatgtactctgcatagaagttaaataaacagggtgacaatatacagccttgacgtactccttttcctatttggaaccagtctgttgttccacgtccagtaatttatataaatgtacgcagctaagaagaggcggaactgtgctaggatcacagggcttgcacgtctaaccacgtgctcttccctggatgcctagctctctctctgggtggccgatgggcccatgtgtaggtgcccagtgcccagagccaatgagcaagccagggcatcaggcatggaggaggaggccataaggaccaggaagattgcagcggtagggccgtgtttcaggagcctggctgggggaggatcgcaatcaccagtgttcagctgtgcctttgtttgggagcagaatgtccgtgtgtagacaatgaaaaacaattttcagctggaagcctggcttggcctggcaaatgggatctgattagtgtttctgaactttgattagcatttgaacgaaatacccaaatgacacaaagccaatcctagtagcggagacttaacatttttcactctttctctaaggcagtcaggcaccttctttttgcaaactactttgggtctctgataagcaaatcatttccacaagcatcctcacattcccctcccagaaaccaggccggaggaggtgggtcctgggagacttaatttacatcagcggctgctgggctggagaagtgggagccttttcccagcctcactggaccagggccaagggcagatcccttcacgtgatctccctggaccggcttctggatctgacaggatcccgcccctgagagctgagtttttattgccccttttgttgtaggttttccattttagggagaattgatagctgaggctaagaataaacacaatctctgccagttagattctggggggaggtttttaaaaggacctggccagcaataatatttatgttgaaactcagctcttgcttcacagcgtgagggcatgggtgctcaagaaaggaattcccttctccccatacaacacttctcacccgtctcaagaaagctggggagtatgtggagctcaaagtaaattctgcagtggtttcttggttgcctaagattaggattaaccctttaaaaagtctttttatgccaagacggaccttcccaggtggttcagcagtaaagaatccgcctgccaatgcaggagacctaggtctgatccctgggtcaggcagatcccctggataaagaaatggcaacccactccagtattcttgcctgaaaaatcccatggacagaggagcctggtaggctacagtccatggggtcacaaaagagtcagacacgacttagtgactaaacagtaagaacaacaatgccaagaggatattttcataattaaacttttcaaaaattgattttttttttctaaagaaaaaaactggtatctcactctttctcataacttttatcaatggcttcgaggcatttttgtccaggtcctgactcactaacccaataagagtttaacttcttttcacactgaaatcctttagcatttttttctttttggccataccacgcggcgtgtgggatcccagttccctgatcaggaacagaacccaagccccccgcactagaagcatggaatcccaactattagaccgccagggaattcctagcaacttaaatcattatttcactagttaaatgtcatgaagggtaggttcagtcacagtgctccagtaggtgacaaaaatcaatgcttcaa

SEQ ID NO: 43340 - DNA, 1689 bp, Bovine  19866880598568
tatttttttttaattttattaggaaattaataatagtctttttcattctgggtgaaagaaaattattaaaggattagttgagtgtgaaattaaatagtattttgctcatgcatactgaaaaggtgggctcggaacttgatgtatttaaacaagtttctgaaaggtttcaatttggtgcaagaaaaaaaattcaatgtttcctttgaaaatactgaatttatcaattgctgcatggatcagatggcacaggttaatctttgattttcaaaatcttaatgaagtaactatcaaatgatttgtatccatgattaaagctggaatgagatctgatttttttcctaatctctcagtttaagctaataaatgtaggttaatgtggatgaaatcatctgtgatatattatgttcatttatcaactgagcttttttgatgttgcctgtttttatgtaaaacatgttcttaaaggttaataaaagaatagtacttggtgtatgaactactacgtaatgcccgagctccaatgtccactcctcagttcactctgccgcaatggagtaaaatttcatttcagttcagttcataattgacacattcagtccacgaaggaataacccagctgtgttcttggggggaattctctctatgcaaggctttaaaaattagtcatgcggtcagagtgtagctttcccacatgtccttcatggcagagtgtctatttcatgagcataattcaaaaacaactattccaaaaatgtcccttttcatatattaccttcccgcctgggccagtgactcggatatacacaaagaaatcaaataccactcagcccgactttatccttccacctatctgccccagctctccagagaagagtgttgttttatccactaccctgtaaattagctgctgttttttttttatagtgatgtcctattaggcaacccacgtgtgatattgacctgagagaaaattgcaaaaatgtacagcggaatcaagttctttcctacgtgagttgttcagagataggagattgaaaactcggccagcaaaagtgattccaggtcccctggtgtcctatgaaggtgccagaggatctcggagcacttgtaaaattagcgatccccttcccagccatctacatgcggccgctgccgccgcggctgttgttttgccttttgctcctctgcagtgaaattgctaggtcctttctaggctttcagggcaactgctgtgaaacaatagctaaagtgattgtttcctaaggaccattaccttgttttatgaggctggcagtttccccaaaaacctgccatcagaaaaaacaaaaaaattgccccgacacagaaacgtcaaacgctactggcatctctgggattgaggagggtaatactgccatgtcaggaaactgggagatgggcgttccagcggggcgggactaacgttcagttaaggaagttttgcacatggaggtaaatgggtaacagggaaagcggcatcccggggaattccttacacacaagagaggctctgccttgtcttcgaaggtagccagcttccccagctccagaaggggcaccgagggaagacggggagccccgcccagccagctggaccagccaaactcacgctggccgccagctctgcgacagatgtccttgccagcttgcctgcacatccaaatcgttcat

SEQ ID NO: 43341 - DNA, 675 bp, Bovine  19866880610942
actagagcccaggacagacaggagccaggcccagagtcactgcaagttactggggccccagggctgtgctggggccacagcgaaagtgtgctgatcaagactcagcgaacacaagcagcagcctcctcaccagccagtcacaagtggaacagaagctttaatcaaagttcctggagtcaggggccctgagcctaaaaaatatttctttttttttttttgagcagaaatgaggcaagtcgggagcgtactcctatttgtgggcaagtctgggttttccgaatctttcattaagttttcctgaacccgatgttttttcttacagccaacatgctagactctggcaaatctgttcccccagcttaccacgttctaaaattataaaccggaatctgcactccgttgaaacctcacgctctgggctttcacacaccctctgctcagcatgcgtcacaaacaaagcagtcgctccgggctcctccgcggccttacctgagctggtggatgccggggatttgctgcgccgggaaggccctgggctcttggtggtgctcctgcgggacgacgaagctattttggtgtaggaagtggacttcaccactcgacattctggggaaagaagaaaggccacgcgtcagtagaggggcatggcgcgtaccattcgaaatgtacaataaa

SEQ ID NO: 43342 - DNA, 1150 bp, Bovine  19866880806193
aaatttaattttcttgtgattttcctttgagtttatattctcaacaagcaaggaatcaagtttattctcagaacatttaacttcaaaatatactataaatgttgcaaatttggataaaatttttataaagaggttgatatatttcctgcttacattttgagttgcctggatatgtattctcttaaaaaagagcatttggtgttaaaatgttttaaacagcaacaggttttaaaacttcgtccgttgaggccatcagcagggttttatagagtgaaatgctgaaaggtttcattgagctccccggttttgaaagctccatcactgtgctgtggtttcattgtacaatgttgtacttcgtgtttcacactggaccatgttattcctctcaatgttgttacgcttacccttagaataactgcataataaacaggaaaaactgcctgtgttgttcagtgactttctttcagaaaacttggtaagtagacactgaaaatgaaatgactgtgtagagtaaggtttaccttcattatcgtatttatggtgtttggtgacgtgattagcatcggtaggtgagacttaagagactgcagagtgagagcgcgtgacatccaaagtatcagatacggacagttaacagtgaaataagactatctggcgaagaactctggtttacttgggtttagtaaaatcattcctttcctctcaggtttgccttaagagtgaatatatcaaacaaattggcaactgtttctcttgaaaaaaaaagaaattttaaatatactttctcctaggcatgaaggcatttttcccaaggttgcctaatttgcagggggaagaatgtgtatgtgtatataggtacatgtgtgtgtgaaagttattttaaaagcaccaaatgagattatatatttattataaataaatatataatgttttattatatgtttatataatataaaaattaaataactataataaatatataataaaatacttgattgcccaactttaatatagaattaaaaccaataatctatttcattcataatatgatattctagttggaaaaaattatttacattaaaattattatagaagtctgaaattctatataagttttaaatctaacacacttttactaggttcattttaa

SEQ ID NO: 43343 - DNA, 1673 bp, Bovine  19866880836217
atggtacatatttattctctaataaagtgaaataaaaaataagatcaatttggttatagaaattccttaaagaacaccaccacttaattatttcaaacttgaactatcccaagaatgtcgtgaaaaaaattagcactggctaagaagcaaaagcagtctgggtacacccacgtaatcagcatgccttgtgcttgtctgttaaccctctgagtacatctctgacattcaggatctcgatagcttagtgctgaaaagattgcattccatctgattactcaatatttctacttgacaggtctcattccactatttattcagcatagatcattcaaattctgcagcgatgcgctgggatccccatgctgaacggccctgcattcttccgagcggcccctctgcagtgttatgggaaacacgccacagctttacacagtccacagtccttcaagacttgggtgaaaaaggcctgagccatgcactgtaaggtatgtacactagatgctggcatcatacacacaatgcccatggaaaaagcagtaattaattcagagaaagaaagtgaagtaaagtgaaagttgctcagtcgtgcccaactctttgtgaccccatggactatacagtccatggaattctccaggccagaatactgcagtgggtagcctttcccttctctaggggatcttcccaatccagggatcaaatccaggtcccctgcatggcaggcagattctttaccagctgagccaccagggaagcccagtctcctaacagccactctgtcagggagttggctctattccctgaggtccttgttccgttgttagtgtccaagtaacttgggaataaacatagtagattaacaccagaggagtcgagatcgaatcttagttctgactaggtcaaatcccaaattccaagggttaaactttccacaaaattgtctctagtatacccaagtctgacattctataacttgcatgtattctcaagatactaacattttgatgattgttttctcttcatatgactataaccaagaaaaggttgcaaggtgaaatgtaaactattacaaatatttcaatatgtcctgacaccaaagtaggaagaaataatttaaatatctggttggtcaaaaagttcatttgggttttctgtaacattttacagaaaaatcctaatgaactttttggccaaagcaatagaataagagatacttaagcttgaatttttgttgaaagttaaggatatcaaatagtgtaaaattttgttggcaaaatgtgttatcttttcagaaaacaaataaatgaaagatatattaaaaactaaccattaaaaaaagaaaaccacaagagtttcaaactcaaatgcttgcaaggggtatgcctttaatatagacctgtgatatttgcctcgtattgaaaaaaaaaaagtaagtgctaaaatgcttacctaacatttgaccataataactgcctagttcccttgttacactgccttcataaagtattttgtgatcataacaaatacaccataatctgtttagtgatccctgatatgaagcataaaagcacaataaaatgcagaagatacatatatatgtatttgtttagttacctctatttaaatatgcatgtgcatagacacacacacacaaaaccatgatgtaggaaaga

SEQ ID NO: 43344 - DNA, 1211 bp, Bovine  19866880912486
caaggaatgtagcagaagacggctcccgctatttccttttgatttcggtgtgtaaatctgctctcacctacagcttgaccacatgatggtgcagacacacattaaaccgattatttctgtctgagctgcgcatagaatgtgcactctaaactgcacataaaaatgttccccaaaatagtaccacctgcctgcagaagtatcattttctttcacaaagacagaccccaaatgtgtttctgggatcccgcagcctctggctgatgagggttgccaccctgtccctgctgggcgccagcccggcctgggccttccttccctctgaaggcagggatgccggtggtctccctggcatgtcttggacagaagacattctcagatatttagggagcagctcctcccgaatcaaagggataagagaggacaagtgggtgggggggagcaggaataaagagagtggggagcaaagcagaaggtaaaagtacaacacaaaccatcacaacccaagacagagctctcccagaacaggagggataagcaaacccaggaagaagaagggaaagggatgtaaaactaaaaaacaagacttgtttcagtttttaaaaggcacaatgaaaactaatcccagagaggcaaggtcaaattattgtgctctctcctgattaacgagaaatgttgaatatcctgttttctttcaaacatctgctgcgccctcaacattcaaagggaagggtgtttagaaagagaaagaaaggtgttttgcccacataggggcacacagagagcttttattcttgaaagaactcttccctgacttactaacttcttgcccagagacaggggcatctttctggctgcccatccagcacatctcgtcccatctctgggggccatggttgcaaactctctgtttcctaattgtctggtgctgcatgcccagagggaaccacacaaagacctgaatgtcttctgaattttcttggtcattttatgctcttgtaacagagctttaagactgtacacatggaagatagtagaacgtcttagcagtaagggtggaagcattcgggactatgtccttgtccatctatgtcttagtcagcttgaaaggctgagattgcagctgccttctcacagactttgggatgttgtctccattcctaacagcctggggaccgttcatccttatcctaagtgaaatgaagtgaaagtag

SEQ ID NO: 43345 - DNA, 756 bp, Bovine  19866880927328
cgctcctctgtcctgggattctccggaaagaatgctggagtgggttgccatgccctcctacaggggatcttcctgacccaataagatagtccctctgaataggacctactgtccctgtttaagaaaatgcagacagattgtgaaaatcagggttccaattcatctatgaagtcagcacctatgaagatgaaacaaggaaaaagcatttttctcaagagttctcccacccatcagacacttgtctgttttgtctttgcctaggttgactccatctgctttttccttctctttttctttctcgataatgtggcaggcaatggacaagggctgggaaaacatattttagagtatctacagcctcctccatgatcagggagtgagggaaagtctaaggcaagcagccagatctcccgggaagcctgcctgaatcaccaccccctgaacacacagacggatagatggactcacatgcgtgcaaacacgttccctcctcccatgcctgcaagtgcagcggcataaatattaataaatgagccaccttagttcaaaaagaagatagtgaaacagcaagatagcttttcaggtccaaaaggttagtcaccttgtaatgagatggtcttgcatggagattgttctagcttccagaccagtttgagacattcaagcatttggttttcacttgctgtctgagccttttactaatgaaactgtaaagggaaaaaatcctttaagtttacaaagggtttgctaaattca

SEQ ID NO: 43346 - DNA, 1348 bp, Bovine  19866880934686
cgttattctcagtgaaaattgtttccttcttttcccgctcacaaccctatgttacaaattctcaaaacctggcacctcatggcacatcccttttgaatgcctttacttctgcatatacctccctatcttctgaatttaattcatttcctgaagctctgcacaggacttccctggcagtccagtggttaagactctgcgcttccaatgcaaggggcacaggttcaacgcctggtcaggggaataagatcccacatgctccatggtgtggccaagaaaaattttaaaagttttgcacagaaaatgagctctaataattcacaattatttccaattatcttgttatcatttaatacaagaggatttttactacattttaaggagtacttctaatcgcaaaacattgtttttcccaagtttcagttggtaatacaagagtgatctttgtgtcctggttctagaagtattttttttgtctagactaaatgtttttgttcccaacttgctatagcggtgcagcagtaattgaactattttcgtggttctacaaacagcctagagcactgaagttttaatgttatcattgactagatcacaccaaaaatttagtaataaccttttgacatttcagctaaaatcaattcttgactgtctcagtcttcacattgacaaaacatgggaaaaacacggttttcagtctaccaaaacatccagtaacagcacctaataatttgtacagtcaatcatatctgtcccccactatcctaacagtgaaagtcaagatgccttttacgttaggacctcagggcttaggaggcttgccggaaacatttgcctccttagtttgtctgcgtgtgtccctttgtaaatcatgaaacagaggagccagaagaggcactgctttggctcatttaggataatcagtcattttagagtagataaaactggctctcagaggcattaagagcccactgagaacgatttacagacaagattaaaagaatcttcagtactatttacaatagccaggactcagaagcaacttgaatgtctattaacagagggatggataaagatgtggtacatacatatacaatggaatattactcagccataaaaagggacacatttgagtcagttctaataaggtggatgaacttagagcctattatacagagagaagtaagtcagaaagagagaaaaaccaaatgttgtaggttaatgcatgtatatatatggaatttattaatagaaaggtggcacagatgagcctatttgcagggcaacagtggagtcgcagacatagaaaaaagactggtgggcacaggggagaaggagagagtggggcaaa

SEQ ID NO: 43347 - DNA, 1872 bp, Bovine  19866880992621
ctcagttgaggagtccccatgctgagttttgcaggcacagtccaggcttgttagactggtcacccggagagaatgcacaaaggctaagtgctacttcgctactgtcacctgactaagcatattactgacaatcggattaagctttcccacaaactgtgttctgaactattaagccttttcctcttttatacctcatcttcaaatttaatttagctctccaaaacccagccaataacagggggttgctaattagtttttaatggcacccagaggggtaagcaggaatgatttgaagctcttgctttaaaaattaaagtcattgtgaaattactattcttggtcctagataaagtataatttacaatgttgtaattaccaaactttatttggtaataaagcatcaatatgaaaattttctgaataatgaaactgacctttcttggttggaataagcgatcaacatttttatctccctcaatctcaaccatgaccataacctggtgttagtacaaactaaaaagccttcaccctcagagaaaaaaaatctgaacttgaagtaggaaaaaaaccagactttatctataaatatagactaatcactaagttaaaagaaggccaatagatctaaaacaaagtataaagaatgaaaatttaaagtccctagaattaacatttttctatacagtaaatgattggttaattaaatgctttgttggctttaaatctttgcagaaggaaatcccacattccagctgccaccagctcagctgagtgattctaagtagaattcctggaaccctgggtgctcggcacaccctgatggagaaaacgatctgaataatttacaactaaagtagaaattactcacgcctttggtcagattaacataatagaaaagccttgagcaaagtacagctttatgaaaataaaacattcaattttcaaaacttctaattaagaaaatttcacatatggaagtagaggaaataggtgggctacctttcacatagattcaaccatcatcaacatctggccattcctatgttatatgattgactagaataaaaacataattttatgtggtgggatgagattgtacccgtcactgagaggcagtattcacattattattaacagggggtgctgtttttctattaccctggagtctaaaagttcaaagcttgtttttatgataacgaatgatacttttggagtagttcctggaaaagtgagcagtttctgctggagtaacaacaatcatactggtatctaacagtttgtgtcacagaagctggtgaaagggatttcttttaccttcagaacaacattcctagcaatatctcatttcacacaggaggggcctgaggtacagagcggtagacccaaggtcagggactatttcggtccaggctgagacttgaactatggggatacaattctaatgttaagactcttaaccgttatgccagtgcacagcaatgagattgaatactgctgagaggaaatgaaggagagagctccatcatacaggaaagtgaggtgctgtatataggtttacctcttttaccaaaacacacacctttactaattccatgacaagatacagctcagttggcacgtccatctcttcgatcagaagaacaatattggggtgcttcactcttctcaagatagacacctcattctggatcatgtgttcctattcaagagaaagttatctccatcaagacacacagcaaaacaatgaagggctaactcatattaacaaaaccatactatttaagggtttcccaggtggctcaggtggtaaaaagtctgtctgcaattcgggatacctgggttcgatccctgggtcagggagatcccctgtag

SEQ ID NO: 43348 - DNA, 794 bp, Bovine  19866881073616
tccctttctggtgtccgattcagagaaagaccatgtccccacaagccagcagcctccacggcccctggaatcccagcttcctggggcactggctcacatgctgccaagtacagtgtttgtgcggatggcaacccagctcactcatccctgtgggtgtgcaggatgcctggacacagaggacaccggggaacacccactctgcctatggaaacccataggcgacgcaaccctcagaggagagaatcacacaccacataggtaaatccttttgtgacccacaagagagacaactagaagacaaagtccatgggatagtcccatcactctgatctggaccacatttccaacaacacacaactaacatcttgaaatacataggctttaactgtgttctgaaaagaaaatcaaaagcctgcttcctttacacaaggtgggcacatgagcaaaacaaataaaccgatatgcaaatgagaacgacgtccaggctcatacgagaaagaaaccaacctaagtatttcatagttctgaagggaaatacataggaaatgtaataccaaattgagcgaagcctttggaaccttcagttatccatgttttcatttaacaaacattcttaagcatgttttgtgctgaatactgccatactgacataaatgggatcaaagggggctttgccaattctagctgggatcttaggcaagttactaaacctttctgaacctcagaatgacaaaaataaatggattaaaaaatccactttgacatacagccagtgaataactcaaatattccag

SEQ ID NO: 43349 - DNA, 1858 bp, Bovine  19866881079918
aatagtgaaaaataagataaaaattcacagaacccattatgatgaataaataaaccaatgaataggaaaatctctagcatggtgcttctgtgtgacacaattgctcagaaaaacgttaactattacagtagtaaagtttccattattatcttaatggatggcactattattcattaaataatcaaagatgaaaatctggaacttatctgtaaacgttactttaatccctatctccaactgatgactaaacaatgttgattctagctctaagtgaaagtcactcagttgtgtcagactctgccaccccatggactgtagcctgccaggttcctctttccatgtaattctccaggcaagaatactggagtgggtagccattcccttctccaggggatcttcccaacccagggactgaacccaggtctctcacattgcaggcagattctttaccatctgagccaccagggaagccctccaaaatagttcacaaatctgccctttcctctccatttccaggtctaaagccctcacttggccgacagcaagtcttttaactcgatctataatctgttttgatccatagtataccctgtaaattatgtgtatggtgcactcacttctccccagtcatagctgattgagaccagggtgaacacctgtttcagacactagacaatcagatcccctctccttgaaatttgaaattggaattttagtttgtattggagcagaaataaattgtagggagccagtgaggctactttggggttttgagcagggagatttagggaaatctaatcagtggagagaaataacaacggagcagaagcagagacaagagacgacatggccaaaaaaggaagaaatctagactctccaaatctagaaatttaggttttccaactctcagttccagtctcccatcaagctccagctgtacttgtcattggatgtaataaatcaccactaactgcttaaaataagtgctcttttagtttaagctagtttgagttctatttcctgcaggcaaatgattcctgaaagtttatacttgtgataataatggaatcaggattagaacttgtgtctggcacttggctgcttacatcctatcagattctattttctcctgtagggttcttgactaagaaaacacacaaaaataatactaatcaggtgtaaagctaagaactttaaaataagtaatagctgatactatcctctctcactgcaaggctattctgacaagagttagattgaagaatttactgtggatctgaatccaaagcaaggcttccaccacccagcatgaaaagaaatttgggggtatagagacctggatagctctgtggggaaaaatggctgggcttcaaaagagacctatctcaacttgatgattctacagaagaaggtagaagaaggcaggctggctagcctatcttgagtgatcagttctgtccagatgtgtttacctcatgggagccctgacaatttaacattatactgaccctaccagtagtgaatttttatgggtcattgaatactgcaaattctggaaaatcagagtagaaatttctttcctatgggaacaaaaccaagcagtagtttcttctctatggacaaagcagaaatgtgaggaaataaaagatctcccctcaacagaagtcttagcagtaaaaattgtccagacagaaaaagttgggctatggtatgtcataaataaatcgtgagtttcaagagcaatctctccaactgaggcaataaaaacccgctgaaacctccaatggactttattctggtttaagagagaggagacttgtgagaagtgtgaagactgtgttattttcccctgcagggt

SEQ ID NO: 43350 - DNA, 803 bp, Bovine  19866881156900
atggtaaatattaacagactctccctttgaaaacagacatttctaaggagcaagaaatcgtgatttctttgggtgttcggagcaattcagtttcactgaaaatctcagtgggtaagcctcctgccatgtttttggctttcgtttaagtctcgtacaaagatctatagtgttccagcctctctctgccatgtctcagctccccttccctcccaggtcctggcaaaaggacaccaggaactctttttttctcagagcccagaagtttgcattggcacagagtccagtgtgggggcggttttctgctttaaaaaaataaatcatgaaattaatatacactgcaaggcaccctggaggtgttggataatgatgcaactcccacggaaatgatcagcaaaagcacatcatatatataagccccagacctcccccggtgctttccatggtcgagctgtctaaagaaatgacccattctgctgtctctgggtggaatctcctgagtaatgcctgtctcttaggtggattgctttgaaaaagttataggtggatatttcagatgcttactgctatgacagaaactccagctgctgtgctattcggtttggggcctgtgttgaaatgcttctttatctttcccgctactgacagctgatgttcattttctgggaggccgtcatcctggaggaaagaaataaaaaaaaaaaaaaaaaaaaggagaagaaaaaaaatgagataaatgggaaatgaggccaagatattccagtaacaggcagtgatcttaaaattcataacatttcaggaagaaa

SEQ ID NO: 43351 - DNA, 2162 bp, Bovine  19866881174640
aatttatccataaatggaaataatccctttgccacttgaaagatgggaatacggttgagcagtaaggtgattcaaggctagtaattcaattggaatgattggtgagtttggcagttaaggactcattggtgcttttctttctggtgtgttgaagaactgagaattctccagagatgttgataaccaagaaaggcccaaaatgaatccacaaagattatgcaaacatgagctgaagggattagtgtagaaggagaggatattaccttcattttctaaatttcttaaatagctattgctttgttttgtagtaatgaatatgaaaggaaatagctggactgtcccattattttattttatagtaaagaatatggaaggagatagcttgactgtccattattttattttattttattttatagtaaagaatataaaaggaaatagcttgactgtcccattaagcacatttagcttttgggtgaagggaaatgtgtttctgcttctagagcaccttccaggtatcatggctggagataccttgtgaagcgttgctgtaccaagtctggggttttaacttcttattttttaacgtgatcctcctcattctgatgggctcctacccagtccactagagttccagagagaagggtatctgttcccatcatctttgaatcctcagagtctgacatagttgctgacaggcagaagacactcagtaaatgtggaaatgaactgaactggtttaatcataagggacagtggtcaagatggtgtgcccccatgcaaatcccataatttgaaggaaaatgcaaacctcatgcataatggaggaacggattaacgtaatcccttggatggaaagggaatgttcattaaaaaaacaaatgaaataatggagtctaaccctcacatgtcaagaccgcctgaatgggtagatttcatagcagataaaggaattggtactgggattcttaaaggctgtgaaccagattattattttgtcatcttctgaggtgggtcagtcagtacttgatgggttagaagcagtattaaaattaaaatcaatttttcttgattcttactcaaatttaatttctgctacatcattgctggtgtttaagtccaccaataatgtaataaatccatcggtgaacattagacttaaaccactacgcctgtgttgagacttttgttcttggatgtgcttattttccttgtgtttgctctccagtagtttttttagtaaatcaaggtatttaaggttgactaagaaatcctatttttctctattccatggacttaattatttagaagagattagtaaatgatcaactattaatgggccagaagagtttaatgatgacatgggatatgtggtaaattttattcaattatattatgaaagtttaacaatgcattaaacgtagttaagtacaagttatgtgctggagctggcttaaaccagcttgttagagctgacttaaaatttcaagagttttctgagccagttgttcagcagatggtagcttgagattggtcatagatatcatgctgggaatatttacaccacagacatcaacagttgcttcaaatcaagacttcctcacagtccccaccctgaaagccagttgctcaacgttccagctctccagtggcagtgagtcttatttttattaaatgatttttaagtcaagtataatacttagggggacttcccaggtggctcactgctaaagaatctccctgtagtgcagaagacatgggtttgatccctgggtcgggaagatcccctggagaaggaagtggcaacccactccagtgtccttgcctggagaattccatggacagaggagcctggcaggctgtagtccatgggggtctccaaagagttgggcacaactgagtgactaaacaacaaaaataatatgttcagtcagttcagtcgctcagtcgtgtctgactctttgcaaccccacggacaggagcacactagtgatgtccaaaataggatgttagagtggttctttttcatttttatcatgacagttctatgattattgctacttttactgtctttccatagagtaaaggttatacttttttttttgaaaaacacttcttaaaaactgcaaatataattttaaggaaaactaaattatataatt

SEQ ID NO: 43352 - DNA, 3426 bp, Bovine  19866881199485
ctaaagaatggaacatagaattggaagataaaagtgatctaccccttaagaaccatgggttcaaaagttcacaatatgaaggactctatgtttgcaaaagcagtcagcgttcatgtcgcctaatttgtttaggctgtctgtttacctcttttatttatctagcactaaataaaattacgagagcacatgtgggtcacaaaaggaaaagttctggcaaaaggcatacaggttacatagatcatctttaaaaacttgaagaatgtttacatattctagttactttagaaattgtgatttcctcatttaacttatcttttctataagaataaactaaaaatctataattaatagtaaatattttaccatatgccttatctcatccatattaatcaagatgaaggctatattttctttggttgggataatgtttcaagaacctttgagtccaagtgtcttagtgtacttgagcttgcatttttcagtctgttccagcccacactatacctactgccataatgctggattcccagatttctggtatctgagttttcctctcagctctggactggagtctctccaagatggctaagatacgtctttactgactcctgtacactccttcacctaggacagggcttaacatacatacagtaagtgtgtggtgtgtgttgaattaatgtgtgtgaatgtgtgttgaattaaagaatggacacgtaaatggaggaaagagaggaactttggtctgtaagcctcctttcatcataatatcccagttgatttcaaagaaaaagggctttcttccctgtgctaaaaataatctgaaatacccatagcagtagttaactcatgaggttataacactatgtaacatgctacatgactatctgaatgataaaatcattttctgtaaaattaaataaggatgaactatattatatagggaactacatgagaggaattctcatgtaagatgctatatgagaatctacactatacatttcattgtgtgtatataaatatatatacatacacacatgtacatgtatacacacatagtgtctaatacatagtgacttgaattaatgttaagtaaaacacatgttaataagattttgttaaagaactaatttaacagttttcacctccacatttataagttagtttggtcttgttttacatctaaagattatacctcaatcttagaaattcatgtcagaaatgcataccgttcaaacatcctaatttcaataaggatgtaacagtgtatatttatcatccttatttgaaacttgaaagataattcaaagtatatatcaatgatttactacattatatttatacacaatgtattagctaatgctgatatgccaggtgctctcagtatttttacacttaccaattcaacaacaaccctattattactgtcctcattatacaagtgaggaaactgaggaaaagagaaatgaaatagttgtctaaagcctcaaagccagtgagtggcagaattaggatctgccaggcagtctagctacagagttcttgttcctaacctctatttactgcttttcatgtacttccctatataacatagttcattcttatttaattttacagaaaatgattttatcattcagataatccataatcagatttgcttctgaagggcaggccttatgaattctgcctgactctgaatacttatttgtacacagtaaatgattaaagatttttgttcagtgcaatcacaatggaaaaatcattacttttgcagccatattgaaattcagttgctagcacttttctaccagctatgtgactctcaataagatgctggctaactgatcccttatgtccctgaagtatctgtaacagcacagctaaaatcagcaatgagctagcaagtttgatggggaagtcccataaaatataagaactagagagcgaagggcagataacatggaaaaattagtacacaggcttcagccacaggctaagaaacattccatatgtaataacagctcatattcatgaagtgcttctatgatccaagagctatgttacattctttaaacgcacatgtcattagaccttcacaactgtatgaagtaggacttattctcatattacgaatggggatactgaggcaaagagaatggcttcagctcccacaactataagcagtgacatagagaacttcaacttatgtggatctaattttcaaaggcaagaaaaaaaggcaagagaaggtgtgctaagttaaaaactgtctgtgagattaaacttaaattggttatattgctcactttcctgccttgcagggcttatactacactttttcatgagctctttaaccttctccccgccaaaaccaaaagtatacacatatgcacatatgcctttcatgctgttgtggaatactaaactagacaaccaaggaagacagaaaatccagagtggatgagctgaggcttaaaatggctaaactatctaaactttatggcctggctatgactttagctgaggctagagagaagcttttggggctgagtatctagttcttcactgaatttcaaagagtttcatatcccacattaagttttgtctcagcaaatgaagtgaacgaaccaaaaattggctttttattcttatcattcattatgtatttttttcttgctatttttgggacaaatcttcttttatcttaacagatccttgataaattagtgtgtcctactttctttttccttataaagcttctctccaatgtatgtatgtactacggttaagataacatgtctatcatctaagaaatatatcgcataaattattggtcatattttgtactaatttgaagtttctggcctgaacctttaaaacctagaatatcagaacaacctgtccttacatatgctattcctcaaatagccatttcattttgtctatactagtactaatttaacttcttatagcttaactcctatgttaagggttgatgaaatttagatgctgagtgcaaaaagaggaaacattcagctttacctttcttacaacactaattgaacatacatactctggtagaaatgtttttagagtatagccttacaaagaaaattgacttctatgtatttataagttacctttgatagatccctgaagtttcccggaagagtcaaatccagctcttctgattcatagtttgttaatacccatggaaacacggggtattggttcagatcattgtatgtccgtcctagtaaagaaagagagacatgaaatctgtatacactaactgcttaggaaagtgttgaccatctttataatcaatgaggcaactattgcattgcagaagtaactcttttgtttattgaactatgtctgtatttaatcaaaagcacttacaacaacgtgtttcaaggaattcactca

SEQ ID NO: 43353 - DNA, 1078 bp, Bovine  19866881227933
tcccagtcttaacgggtacacagcttcctagaaagacaggcattttaaatcaatactgaaataaaaggagaaacgtttccaaatgctgtggggtttaaaggacaaaagaactaacgccctaccttaaaggatggaaaagaaactactgtacctttaggctcaggatatgttgctcgatgtcattatatgattgatgggtagattacatgcacatcaaggtcagaggggacatccctggtggtcgagtggctaggactttgagataccaatgcagagggcctaggatcgatccctggtcaaggaactagatcccacatgccgcagctaagagtttgcacaccacaactaagacctgggaagccaaataaagaaaagtcttttattttaaaaagtcataaaatccatactgtgaaagggacttccttgaacccctagtcaaaccacaccctcactccccacaccctgtgtgtacttgaacctgctgccaaccttccactaagcaatcacccagcctgagtactgtgaccgagtttattcagagatagcacgtgcactgtctctgaggcagtcgctgcctttgtagaactccacttgttttccattgttgctgttagtctttcagttgtgtctgactttttcgaccccatgggctatagcctgccaggctcctgtgtccatgggattctccaggccagaatactggactgggttgccgtttccttctccagggtatcttcctgacccagagatcaaatctgcatctcttgcactacaggtggattctttaccccagagccacctgggaagcccttgttttcccttatatttagccaaaatctcttttctctcagtttctaccaattggcaccagttatttcctccaaattctaacgaagagtacagtccaattacccaagatgcagaactaagtaaaccactgtcaaaaagagtgctggattccaggcgacttggtctcttcactcaccacgaaatacagagcacctacattcactacattaaagggactgtgcaagaatcgacccagaggaagaggaaggctctgcccccctcaaaatca

SEQ ID NO: 43354 - DNA, 1131 bp, Bovine  19866881379698
tggtgcagagggtacagagaaaaaggaatcttgctccactgttggtggtaatataaattgctatagccgttatggaaagcagtatggtggtgtaaaagctacaaacagttaacatatggtctagcgattcttctcctgggcatatatctgaagaaaactataactcaaaaagatacatgcatcccagtatctctacagcaccatttataatagtcaagacatggaagcaacctaaatgtccatcaacagatgactggataaagaagatgtggcataaatacacaatgaaatattactcagccacaaaaaagaatgaaatcatgccacttacagcaacaagggattatcatactaagtgaagtaaaccagagaaaaacaaatatcagatgatatagtatgtggaatttaattaaaaaaatgataaaaatgaactgattttcaaacagaaatagactcagacatagaaaacaaacatgattaccaaaggggaaagggcaggaagggataaattaggagtttaggatgaacacttatacactgctatatataaagtagataacctacaaggacctactatatagcacaggggaactgtactcaatatcttgtaataacctataatggaaaagagtctgaaaaacaatatacatctgaatcacttttgctgtatatctgaaactaccacaatattataaatcaactatatttcaatttttaaaaagttaggggtagctttaatattgatccctgtattgttttagcaataaataatattcctatgtagatatactaaccatctcattgagatgaatttcccatagcattttaactttttatgttttgtaattatttttcaaagctcacaatatatttatgctatatggttataagctgataatatttctaaaaacaatttgtttcagaataaaaatgttaaacacttaaaattttatggttttaggaatttaaaatactaaaactttaattcattagtgtatatgctttctgtagattattagaatataatgatcaatatacgactttcaagcacaaaatacgttttagaatagctaagtttggaggagagatcaaatggaaatatttgttgagtaagaaagaggaattacataa

SEQ ID NO: 43355 - DNA, 823 bp, Bovine  19866881960285
acacagcagaaacgtgcccatggagcacggacaagggaggctgtggaattttaattatttagactgtagccatgcccccacatcatccaggtaaaagatgaaagaatcaattcacttcgtatttcacataaacactgtcgggaactggcttgactgatctttccagcacagtggtgtaaccgcactgaaaaattacactgcatcatgtggacatatctctaagctaacttcttaaatctctggaagcatgttagtcactcagtcatgtccgactctgcaaccccatgaactgtagtccaccaggctcctctgtccatgggattctccaggctagaatactggagtgggttgccatgtccttctccaggggatcttcatgacccagggattgaacctgggtctcctgcattgcaggcagagtctttaccatgcaagccaccagggaagccctcttccatcgtctggcagcacctaaattgcagctggttattagtaattgggggtcctctcccagcagctgtgcggagtgcctgctcctttggctgtgcccgcctcacagaccagagcgccgactgctctgctgcctgctttcgctcacgctagcttgttttaatctcacgctcccccatgctgtcactaactctgttattctttctgttttctttgctctcctccctttctattcaacagtgtttccttccacagagtccactcatgtttaaagatcagatgcagcaggatgtgatcatggtgctgaagtttccgtcaaactccccagtgacgcacgtggcggccaacacactcccccacctgaccatccctg

SEQ ID NO: 43356 - DNA, 735 bp, Bovine  19866882049364
tcgagctctagatggctgaatattcccttatgggaacatgtactcctcaacaatggaaatattgaaaaggcaattaaaatttaataaaactgccaaaccaatgagattgatatctttagagataatttcccttgctagtttttagaaatgatataaaagtcatttcaaacatcctcaaagcttttcaaattaacttacactacagagacaccatacaggctctaagaaaagtaagagtatttagaggcttcagagatcttgttgttgttgttatttatttactaagacaaagaaaaacactccagaaaaaggaccaggttaaaaacaaaatgcattatctaaatttgcttttgaaagaaaattaaaagggcatgtaggactgtttgatattatttctcttatttgtggcgcttccctgatgactcagacagtgaagaatctgctgcagtgcaagagacacaggttcaatcctgggttgggaagattcgctggagaaggaaatggtaacccactctagtattcttgcctggagaatcccatggacagaggagcctggtgggctatagtccctggggtcacaaagaatcggatgcgactgagcagcagacattcttacttgtattgttttcttgaaatcccaaagtcatacaatgaacaaaagggtcagctgagcgaacacatatatttgagataagctactgctcagcaatggagcggatagcatctctctcattt

SEQ ID NO: 43357 - DNA, 1667 bp, Bovine  19866880438288
catgtattttgcatagtgggataatactgtagctttcctaaaggaggaaaaacactcgtgtactgtcaaaaagtcaacagaccaaaatgttatatttgagtattggagttgagacttctttttttcccctgaatcttagtgaagggaggggttttcttcaagttgattgagattgttttttaacttatggtgactttggcatcttctgccacgttgttcgtagtggaagctgatcctgtgtcctgagctgagccacatgcagacctgcagccctgagaaactttgagcaagagctgtgctcagctctgagactgggcgccaaaaagagactggccccggtggagagctgccatgggctttgcaaaggtgttgtgttgttggttgtcagggacacccctcagtcccccaccctctcacctcctggcactgagccgggaggagcgcatggaggatgagggaggggacagttctccttgacatgaactggaccttgacattggtccactttccacagaaacaacatagagcaaagtggaactgtcctcatattccccacacatggtgggctatctctgcattcatggtgaaatacagaactaagaaaccggaaaccactcagaaccttctgtcttaaaaaaaaaaaaaagaaacttaaaatttaaaaagttaatagacatttagaaaatgtaaaaaaccttgaaaagtataaaggaggaaaaaaaggtcttcataattgaaaagcagctgttactagcattttggtgatttcttgccagttttcaatgccagtatagtggaaattctgccctgtttccccccagtagcttatacgatactatgtctattatttttttttttggttttctctaatatcaaaccccaagtatctttttcactctactgtactcttagtaaacacaattctaatggcttcataatactttgtctcataacagatggttcattcacgcagccttccctctgctactgggcatttggttatttgtattattcccaaatgaaaatacagtccaaattccaagcagctggtttgcaaaaaaacaaagtgttttttaatactttatcctgctcttaagtttggaagtgttattgctggtggctgagagaaaaacagatccacacatggcagaactattcacacatcagaatggtgatggctgatctggggcgggggagggtctggggctccagagaaatagaacttgaaagtaaatgttccttaaaagtttcttcttttaatttctgtgtattacatgtttatttgaaatgttatgacaagtgcatttcactgcttttctgaatttttcaatatattttgaatcagtgatatctttgtggagttcagaagtcaaaaaagtataaaaagttatgcagcgaataggtctctgtgtttctctgctgcaccttcgcgctccccctagttagcagtgctgaccgtggcttatgtccttcgaggggttaagtgtgccctttgtcactcattgagcctctctgctgtcttggcttcaagctggcatccgggggcagccacagacagtcacggggtcagagccttctgccaacggaccaaatctgtgcacattctattatcctcttgttgaagtctttccaggccaggcccttcagccagaagggcagcattcagg

SEQ ID NO: 43358 - DNA, 2355 bp, Bovine  19866880453876
cttggagctctgtttattcccaggaactgagggctcccgtgtgccagcgactgagccagagctggaagggatcgaagaagccaagggaatcaacgggactgtggagggagacaccagagggagcctgccacgcttcttttgggcttccctgatggctcagatggtaaagagtctgcctgcaatgcaggagacctgggttcgattcctgggtcaggaagaccctctggagaagggaatggctacccattccagtattcttgtctggagaattccatgggcagaggagactggtgggctaaagtctatggggtcgcaaagagtaggacacgactgagcgactgacacttcagactagatgtaagcagtcgcacatgagcacagtgactgatacaggacaagagccaccacggctggctccatctgagtaggaaaagcctggcaacggcctcagtgtcattcgataagggacggcagaacaaacgatggcacagacgtaggattaaaaagcatgaggcagttctaggtacagaacagaccataataaggaatgaacctccattcatgttgagggtaggcaacccatcgaaataaaatcatatatacttggtacttgggcttgcacaagtatctttaaaaagacacaagaaactgttaacacaaatggcctttgaagaagaggtggaggacaaatgtgggaaagggggcatttttcactgtatcttcttttgccactaatcaacttacttatcaagggcttcccaggtggctcagtggtaaaggatctgcctgctaatacaggagccataggagacacgggttcgatccctgggttgggaagatcccctggagtaggaaatggcaacccactccagtattcttgctgggataatcccatggacagaggagcctggcaggctacagtccatggggttgcaaagagtcggacacaactgaagccacgcagtaagcacgcatacaacttatcatcatcaattatttcagaataaatacatactctgttaagtgctttctaaatgactcccaccatagaccatcgcagtaaaacccacctttaactacctcccaacaagcttttgaaaaacctactaaaacattagaccttgatgcaaggtctcagctatgccgagcccagtgcttggcaggggccagaaggaatactcctggtttctccttcaaagagcttctgatgtggtgggttcagaactcactcgtgccaagccaggtggtgcacaaccagcagctgttctcagagaggaagtgaacgaatggatcctaatcaaaaccctcagctctgcgagaggctgatcctgaccgctcagcctcaacaggggaagccagagaaccacacctttcttcagaaaggaaacctacacttccacacaatccactcagagtctattttagctctgaacccagaatggtacactgactattataaatagcaaaaccaagattgcagtttgactgattcttgttctgttgttaggaaagaggtcagaagcttaagtcagttgtagaccaaggggtctagagcaaaccacagtgtgaacacagtcatgctgcgctggacggtcaacgcttgaatctccctctccaccacccaccacccgcccccgtgttgcctgagtaaccgagtcctgtggcttcagtgtgcagaaaagcacctgagaaactaacgaggctgtagggaggttctgtgggagtctgccaaaaccagaaaggaaattcttcaaggaaagcagctgtcctttcccctgaaggcagacgagctgagtggctcacctttgttgtgagacatcgcgtacagcaggcagagcacgaagagcgcatggtagtcatcgtccgggctatccagggcgtggtacaccatatccaggaagggtctggaagagaggggccagcgtgagcctcgcctgcacacaggatgccagctgcctttgcccttcacagcgcccaccccctgcctcctccaaccagcagcatgggcttcccagatggcttggtggtaaagaacccacctgccaacacaggagacacaagttcgacccctgggttggagaatcccatgaacaggggaccctgccggctacagtccctggtgtcgtaaagagttggacacaactgagcacgcacgcaccagcagcatagagcacagccaccatgtgcccagttcagccccaggtacggaggacacagagatgatcgacaggcaggctctgccccaggaagctgtcatgtttggggaaactgactaaggaacagctaaccgaccaattactcaacaatggtccacccgctgtccccgacactggggataagtgtggtcttatggca

SEQ ID NO: 43359 - DNA, 2474 bp, Bovine  19866880498234
ctggactgatttaggttttgctggataccgcatcttgtagtgtgctggtctctcagttgtgtctgactgtttgtgaccccgtggactgtagcctgccaggctcctttgtctggcaggaattctccaggcttgaatactggagtgtgttgccattcccttctccaggggattttcccaatccggggatggaacccgggtctcctgcattacagagagattcttcaccgtctgagccaccagggaagtcactcggcaacaaagtggttctctttccagttgtctttcggctcttctgattccatcaaggagaagatgcgtctctgactgtaattttccttcttctctctctttttttaaagctatatttctttttattagtcacaatatcacaggcagtgtgcactctttgtgtctggcttctttgactcagcacaaggttttgtgaatcatccatgatgtacatgtagtaggagttccttttgttccttttcattgctgagtagcgttccattttatggccatgtcacactctggctttgtgtgtgtggtcatgacgcatgcttgcagagtctagttccctgaccagggactgaacccgggtctgctgcagtgaaagtacagagtcctaaccactgggccaccagggattccatcagggggaagatgcttcttcaattctagctttccttctttaacctgacagagcaggtctccacacagccctttggaggacaacaacactgaaccagaacttgtgaaatttttttagtgggggtggctattaattttcacaatcaatcgatgtggcgggtcatgctgattttccattcccagggagccagaagatttcttcttgaaatacatatatttctcttagagagtggatttatttaatgacaaatatgaagtaaaatcttacagtggtactcaggaaggaggtgagccgatgactggagtttggagaaaccttctaatgtttagggctcagttctgaggtgctgtgtcaggaagtggtgaggtctccagtcctggggctcatacaaatggaggctggttgctataaaaataatccaggcagaggctggggcaggggtgattctgtatgatcgcacagcacccttagctgagactgcatgagtctgcgattctcattgtgtggggtccacttcccaattccacggctggatggtgtcatagctgcagatgcatatcatcagaggtggcccagctggacgggcaagtggtctggggggctgcctttctttccagccaggcaatctcacagttccccggacaacccggggcatgacggtggtgatatgttacagggtgattccaagttcatggggaccactccccagctggctcagcatctgtcccgatcttggatgtttaacagagcgcatcccttccttttgttcctttttcattgctgagtaggattccatttaatggctgcgtcacaccctggttttgtgtgtgtgtggccaccacatggcttgtgggatctagttccctgaccaggttccctgacctaattaaaggacatggcctgccagctctcgggttagtgagtctgtatgggctgcataggtatcccaaaggagagctgctttggagagagagagctgcaaaggagagaacctatcccaaagggttctccaagaaacagagccaacagaatgtgtatacatttgtgtggcagaggatgtgatggtgagatagcatcactgactcagtggacatgaatttgagcaaacttcaggagatagtgaaaggcagggaagcctggtgtacatggggttgcaaagagttggacatgacttagtgactgcacaacaacaacaacaataactgtatatgtgtgtgtgtacaccgctctccacatgtacatatatggagagaggtttatttctcaggcattggcttatgcagttatgaaggctagcaagtccaacatcaatgggtaggctgggaggctgggcacccaggggaaagctgatgctgcagttcagctccaaagggtgctgggggtggtggtggtagtgggtgtaagtgttttgttctatttgaaccttcaactgatcagaggaggcccacccacattatggagggcaatctgctttactcaaagcccactgatttaaatgttcatctcatccaaaaacaccctcacagaaaccctgtggcccagccaaactgacacagaaaatcaaccatcacagatgcttcaggtggactagacacacagcattaaataagatagtgctgtgttgtgcttagttgctcagtcatgtccaactcttttcaacctcatggactgtagccccccaggcttctctgcccgtggggattctccaggcaagaatactggagtgggttgccatgccactccagggatcttcttgacccagggatcaaacccaggtctcccgaagcccttttaaaatcattcctttttaattccctcccaa

SEQ ID NO: 43360 - DNA, 2263 bp, Bovine  19866880506617
gtgccaggtcctctgccctgagagggcacagcctctgttggaaggccgcagggccagagctccaggtgaagggctgtgcagtctggcgggctccgaaccctgcccgcatcttaccttctgtctctcctgcccccacattcagttggtgggaccttgaaaccctcatggtttggattttcagattttgggctggtttagttagaagagacctggttctggccctccctaggtgtgagcttgggccagatcacgtggccttcatgggtctcgagcctcaagtgccgagcggggctgccacgagggtcacgtgaccctagaaggagggtcctggcaaacaacaggtgctcagcgaggtacagtggccccaacctgagcctgtgggtaatggcacaaggctgcctccttgacttttttttattgtaaatcttggctctgaaagcaccagaacgatgatgctgaaagaggtgagctttgtcttgttcgttttaaatctagagtcattgtgtgatttctccatacggagcttctcaccaaaatgacttcactcttctctgctctccgaactgttggtccaggccatccgggtgttcttcatgctccgtgccctgtccctgcaactgcggggggagcccgagacccagctgccactgacgcgggaggaagacctgatcaaaacggatgacgtccttgacctgagtgagttggtcatcttgagtcactgttgggggtggggggacaccgccaggctggctctcgcatcactgggaggctcgtgggtgacctgcatgtcgtactggggttgatccatcaccgtgaacttacagagcgtgcatgttacacaaaactttcggaaaaggggccctagattctggacacttggagtcagtctgtgggccctgctttctggagaccaaggggagctgcgcagctgttttgctgaaatatctctgcatggtgactggggtctcaagcaggcgtgggcacagctctgggatccctgccctccatatagtcatagcagcaccaggaggttggttgtgtgtgttaaaggtggtctgtatgattttaatgactaaaggatcctggctgcttaaaaaacggaatgttttaaaaaacacaagccaccagcatttaggtaaagatgaaggctttggaggcccaagaaccatgtgctgagcctgaaagcctgagcatccaaccagtgcctcagcgctctcctcttcagtgtgagactgagatttaaaggggacagaatataaagcctagttgtgttcctgtaacccttctcccattcatataactctctttttcctgttatttgctgtaacattttgatatattaggattctttggttatgagaaatagaaaggccaacttaaactaacttaaggaaaaagaaaggcagattcactgatatcagtgtaaaaagctagatcttctttcaggcatggcttgatctaggtactcaagcaatatcatcaggaaaccgccaccttccttctctcagcttttctttcctctgttctggctccatcccccagaaagctctcaccaaatagtgacaagatggccatcagcacctctaagatctgctgaactggctaagcagccctgacaaaaacagagcttctctttccctataacttatatagaagtccagggcaatgctctcattggcccagcttgagtcacatgaccgttcctgacccagtcagtgatcagcagaatgtgattcactgattggttaggtcaagatcacatgcttagctgtgatgctgggaaggtgggacctgctccttttgaaccccatcgcctggggctgaggaaggagggggcccctaaagaaacttgaaaagacgagctggaagctggagaggcagaaacggcaggtagccactttgtagtggacgatgagagagagagcccttgttttaaatcaactttattgaaatacagcttgcatccagtaaagttcaccgagttttagtgtacagtggaatgagtcttgacaaaaactattcagttgtgtggcctgcagttatgatgcagaccaaggagggtttgtatcttttgagccagaggcccctgcccagctctgtattctctcaagcaagtgattgaaaccaccacgacttttgtttccttgcctggaaaatggggatgatcttcattatgttacagggctgttttgagacttgagtgaagtgtaatatgaaacataagatgaccaagtctagtgcctcacacataactgtgctcagg

SEQ ID NO: 43361 - DNA, 1670 bp, Bovine  19866880511997
agaagtgaaatgcttcatggaaggcctcgcgcagcaggtgacacggccaaggaatcaagcccaggtctctctgttggggccgaaggtttgaactcttcgctgctgttctttgccactacttgctgtgtttaactccttgactatattttgtcttgtatactctgatctaccttttatctgtgaaaatgggccccccactcccattcaccatatattgagcacctacagtgtatcagacattctggagtcttttggggtcaccaggatcagtaagatgatgttcctgacctcagggaactcaggtctcgtgaaggaggcagatcactgcaaaatcagagtggtctgtgcagcagcaaatgcatctgggtacagaggtgccagagaggagggagcaagcaaatccactcgggcaggagagcgggagggaggttcttgaagaaggcttcaccgaaaggtgactgagctgggttttgacatacgtggaagagtttgctggttggttaggaccttggcaagctgaactggcctcagtctgcgggcctgggagacgctctcttgaaacctgagccaggcagcactcccagggcattggccaggctgctggtccctgtgctgctcaggaatggcctctgcgattctcttgcccgccaggataaggccgggcctctggtctctgcacgtgtgggtgggtgggtgaggtacctcgtcattgcctctcgaatccactccacttccagctgcacacagcgggtaagatcactgcccttgaactgcaggccacccacttcatctgagccatcagtcctgtgaaggggaattagggcattccaggggcgatcatggtggcttgtgatttgtgccccagccgctggctctgggccctatcctccctgacctgtgactccaggtctcatctctgcagcagccagacagcagctcttaggcgtttggcgctgagctgtgcatctccattggttccagcagcctcagaaccacctgagagtgtgaaaaaggccaccgcctggccttccctccgcacccctgcacttgagtctccggtgggctctgtccccgctttgtcccgctgtcgaggccattctcttgcccacactggagcgtgagcacacctgtcttcaaaagcttggcagtcttgcttcggtttgggttggtaagttgctggttatgtaacagttcgaagtgtcgtctgcctttattctcgggtggtgagttacgtctcctctgaatgggaattgtgctgaccaccaagtctgaaaaacacccagccaaactgttgataacatgccgctcatggtccctgggcctggcttccgttctggcggtcaccttgagttctcctttcttcccttcctctcaggtacctgtaccacgtgttgaccaagaacaccaccgtcacagagcagaacaggaacctgctggtggagaccatccggtccatcaccgagatcctcatctggggggaccagaatgacagctctgtgtttgagtaagggtgtctgttttttgatccttcttctccctttgcatgtttttctaaatgcgagccatgagtcattcccaatgacgtcagggtttgacgccagtttggtcctgcaccttctctctctctctctctctcaaatgtccttgaaatgctgtagaaatgcctgctg

SEQ ID NO: 43362 - DNA, 855 bp, Bovine  19866880753521
atcgtatgaaaagcatctaatttatcagccctaggccatttttcttcctgcagtgcactggcaataaagatttcagtcaaaaatcatcatcctgggttatcaggattataaggaagaaccaataatgataaagatgacaacactatcaataataatgacagtagttatgaaataatcatagtgggagacacttacgacatgggccaggcactgttctgagcatgttaagtgcattagcccattttattctcctcataacaaagtaaatcccctcttttgacaaacgggacacagggcagggaataagagggcagggcctcgccccgggctgcccaggctcctacgggcctggtcacagctgtcgccaaaggccgggcagtgtagagtgaggcacacaggtgtctggaacgacaggcgcacccagggacacacacggggtgccagacaggacggcccagcgggcaggctggcggtggcgcgtgcactcaccttcattctccccactcgtcttgatgccttttgaaccaccctctgtacctttagccttctcggcgtcttcctgggcatcctcggcaggccctttctcctcgtcttcctcctccccaacgtttttgtagttgggtctcttttgcacccgcctcttgcccttgtgcttgttcatctcaagggaccgctctagtgtctcggtgggtttaatgaaacaccgaatgctcggcttagcctggaaagttgaaccaagacaatggacagatttgaacagtggggtctcactggctcctatgggagctgtctgaaggtttccaccccaagaatttccctccaatacagcaaattttatgtcttcgttgatcatga

SEQ ID NO: 43363 - DNA, 770 bp, Bovine  19866880862350
atgagaaaatgaggcccagaaggggctaggtgacttgccctaggctcttctaaaataatagtgcttcaccaggagctcaaactgagttccctgcttagcactctttaaatagtatttatatgcaaatgaaccaggtccagggagcaaagatcaaaactcgtccctcatctgtttagggcaggattctgattgaagagtttttctctctgcagggtccaggtgatattcagacatcactttgtcattgaaagacagaaacgttttaaagcaaacttttccattatctcgattcagtctatccatctgaatttatcccaaacaaccacctactgtgtcttctgggggccaccataccctgccaataagtggaatgtgctctaagaacgcagattaatttcaataatgctcaaaacaaaacctaattgaaagttaaattagcatccaaatccagacattaatttttatttacgtactttggattattcatccacgaaaacgacagataaaattgagacatgattcaactgtccaggaaacccagatagtgcgttacagatgccaagaactgagagcccagagacgggagcgttccaggcgctcacctcttgacagatggcatccatcagagcccacttaggaacgcagcgctggatgctcctcaccctttctggaaggactcagacctggtaggtcagcgccccaagatgaagcgactgcttcctctgatgaccactcactcccagggaattgcatgccgcatgcaaccgaag

SEQ ID NO: 43364 - DNA, 1351 bp, Bovine  19866880935142
tgaggaaggggtgaccccaagtgggttcctagctgatcctatactcctttcccctctcctgtaggtgagatgcccccggccagccaaacaccccccatccagcgggcctgctgtccagagccttcccaagtccccagaccggcctggctctgccagcccctttgccccgtctgccgctgacctccccagcatgcccgaaccggccctcacctcccgtgcaggcctgacaggtaagaatcagctggacctctgagagttaccggaaacagaactaaaggttctggggaaggagttgcctcagacaacgagatccacccacagaactgcctgcagggactggcaagttgtgtttgtacaaaacaggacagggtgtcctgggaggtgggtgcaagggagggtgggcgaggggaacagcaggagaatccatgtcaaatctcagcagcttgttacatggcaggaaaacaggcccagtgcagcctgatctgaattgccagcagaacctggagatcttgattttagcatacatattgtgatttctgaaacactggtgaaaattttaaaagtacagccggccaaagaaagacatctttgagtaggatacagcctcaggtcaccacctggggacactcagcccatgtcagctctgcccttggcatactcaagggactgatgacccagagggagggaggtccccggggtgcctctcaccctaactctaacaccagcttcttcccctccagaggatgagatgtcccccaccaaatgcccagcagctggcggggcctccagcaaacttcccaagtggcctggtgagtggtagcagggtcccttacttgttggctcattcattcattcattcaggtgctcatttggtcccaccattatcccatcattcgttccaccagttacacctgcacttagagaaaggtttactgaggacctgtcccctgtgagcccatgctatgtgtcagcattttcttgtttgcaaagctgggagaatgcaggagggaagggtgggtgacagagagtggatgaaggcaagagtgggtgatgagtgtgagagggtagaaaggaaagggcaacttacagaacagccagacggctgagtcggactctatcccagacacacttacaggcacatgagatgtatgtagtcaagtcaccaacgaccccagtatgatcccggttttacaggtgaggaaactgaagcatagggggtacctcacatgctcaagagaacagtaaaaagttgaaccagattcgtggagtctactatcttagctcttaacacccctccccccatggcctccctacggtgagcaaatagaagaatgttagcaacaaggtcctg

SEQ ID NO: 43365 - DNA, 1298 bp, Bovine  19866880957494
agatggagtccttaacagttccagtgtccacatcctgggtttgctcactcacctggaaaaggctcagaaacctggggcgtgcccaagactacccctggtcccccgagcagccggtgagtttttttaaacactggtctgatcagcacacctccagctaaagcaaccacttggttcccactgcctgcatcatagtgtccaggctgtctcttgtcctggcacttcgggctgtcttggatctaatccttgacaacactgcctgcctcatcctccagcttgaaccccacactccaaacccaggttagtggtcatccccaacatcgcttatatgtccccgaagcctgaccttgaccctggtcagctgttcctgcacctgaatgcacttcctgtctttccagaaacaatgactccttcgagttgattccaggtgtgcctcacctccctcaagggcctcgaggtttcttaatgacaaacaatagaatccagttgtggctcatttaaatagacgaccatactgaacaaatcccggggtgctcactgaacccctaagagggcaggaagtccacatgaagaaggcaggcggtaagaagcaagactccaactccatttctgccacaagccagcatgggcggtgcccacgctccttccaaggagcccagggaactccatgttgccgaggcctccctcagaaagaccttccggatccttcctttccactgcaagaggctcgttcaaactccagactgggtgcctttgattggctgagcccatgtcacatgaccatgccctagctgcaatggaggatgggaaagtgggtgtggcctatttgggctcctcccttgggaggcagggctgtgtcctgcccgcaggcatatggtgggctgggaattgaggttcctgatgtcggaagggggttcagaaggtgggggactcaaaggtgaccaaagcttgggtgtctgtgaccctcagcattctgggagaggcacatgtgcaatatcctgtcacttcttccttggatacctccctccgcagccccccacgtccaatacttcaccagtcctgtagacgggatgttttgtctccctgccctctctgtgcccactccttaagggaccacccccccccccccccccgacccaagtcaggggagaagacgggagctaaagggacatgacagccccagtgtgacacattgtggtgatggaggagtgtggagggagcccaaaataggcacatgatcctgctaggggtatctgggaaggctacttgggaggtggaatgctgtctcaaaggatgaatag

SEQ ID NO: 43366 - DNA, 2439 bp, Bovine  19866881125047
gggcaatacccagactaggaagactgcagagtgggtggttcttgcaccgttttccagataaggacattggggatcatctggtcagttgcacaagtggacagagtgggtgtcaggatgactcactggctgcacatgtgctcattctgtgccaatggaagccgagtggcctcttggctccatctttgcgctggggctgtcaccatgctcctcaggggcccaggtggtctgtgggccttagccgtgtactcttgcccgttttcccacagacttctccacggtgcaggcggtccaggccaccatgatcctgtccaccatcctctgctgcatcgcctttctgatcttcttgctccaactcttccgcctcaagcagggagagagatttgttttaacctccatcatccagctcatggcttgtaagtgaaatgacgggcttcccagaataaacactcccttcgcagccaaccatgagtattctggtgggaggagagtggcaggtgaggaattggaaaggaggggtcagcagctgggatgttttttgcacttcagagtttggatttagttagagcgtcaggaaaggtgtcctaaaaatgggaagcctgagctaggatctgtagggtaagtaggagttgctgccttggtagagaggagagaggcatagctctccccgcaaggaaaatctgggtacttagccttattgtaccactaatatctgtgaatgctgatggttcagtaaggatgttttcagctgcgattaagagagaaatccaatttgcaatgacttcaggcacaaaaactttacttttttaatataacaaatagcttgaaggtggaaggtgccagagttgttctggcagctcagcagtagcatcaggaaccctccactctttccatccttctgtgctgtcatcttcagagtgtcagtgatggcctcctcatggccccaaaagggctgctgcagctcctgacattcatcctgacctaataaaccaccaccaccaagagtttctaaagcagtaagcaagggaaaatacagcatcaaaaaatgctttctcctctctcatctccctcttttcaggataatacagtaataattttcactgtagaattttctgtggccagaactgggatatgtagaaccataaactataacaagtaaacaggacaggatgagtagctgcgatagagaccatatgtgtcctgcaaagcagactacttcctgcctggctgacccatgtcctggagcagttatgaccctctgggctgggtagctggctgtccaaatgacactggattcagccagcaagaatgggcagctgaatggctacagggcaatattctgccatgaaatactagttgtaatctttccaagagactaaaataaatgcctgctaataataaaacctgaaatttgtcttcagctctgaccacagtcccctcgggtccccggttgcacactgtggtctgtgatttatttgggccctggctttcttccaacaggcctgtgtgtcatgatcgcagcttccatttacacagaccggcgcaaagacattcacgagaagaacgaagaactgtatgcccagacctcgggcggcagcttcggctactccttcatcctcgcctgggtggcctttgctttcaccttcatcagcggcctcatgtatctgatactgaggaagcgcaaatagagtccaggagctgggtggctttcgccgcagttcagaatccacataaccgttttgtatataatcagtttttttgtgtgtgtggtttttctagcaaacacattgtttcctttaaaagccaaaagaagagtttttatgttcttgagatcagagaatagactatgaagtctggaattcggaactcctgcccatccgaaagcctcaacatgacaaagccaaaaatcttgcaatgctcaaatccaagtgttcagcaggataaccacagggatgtaatgggatggacaagactccgaaaaatccaggtcttgggggcatcttcccctaggtttgggctacactgagccccgctccctcacctcagcttcctgtactgaatctcggtgtgtttagtggtggaaggtggggagaagggggtccgggtactggagaaaacttccttggatgcttagccaagttccacatgagaaacgggtataggccccacggtgttctgtctacatccagaccagagccccaaccctcctgtcatggactggcttcagaaagtgccacccacgtttgctgacagtgtcacctgcttgccttcaggaaggtgagctttaatctgggggtctgatttaggctcacacgtgatcccccaggcaccttgtaaaatgcaggctctccgggtcccttcctagacctacagaatcagagtcttcagggatggagcctgggaacctgcatttgtaacaagctccttggtgatgctcaggtg

SEQ ID NO: 43367 - DNA, 1250 bp, Bovine  19866881207051
cgagaggggctgctctgttgggccccctacgtctcgaggcactgtgtcagcatggtgggggcgtcttccctggaggtacagagatctgaggttggggggcacggctgtgtcagagcgtgacagtgctggagccgggacccccgctgccacctgggtgccgtccacggtcctggctgccctgagatgcagttgcatccacttcccaagggtgttgacatgccgcagaagatgttcctggagcaaatctaacccacaggtcccctgagatcagagaaatcaaaaccgtggccccattttcaaatgcctggcaaggactgggatttgggctggcgggggtggggggggtggtggaaaatacttaaaagtggaacgtgccttcagtggaaatgatcattttactaggcaaggaaggagaaagctcaaaagccagtctctacactcaaacgccttatctcctccaaggcacaggatgcaatcgagaaattctgccttgcagagagaaaaaataatcatttttgtctttttcggaactgtctaggactacttttaatacataacccacaacagagggcatagccattaggtgaccttgtgatttcagcagaacatgtctctctaatgtagctcgattatgattgtaagtttataaaaacagggaaagattacaggaatatacattaaaccacatcaatgagtgctactgagaaaaaaaaaagtccagtagacaggtaccaatcaaataatcaatatgtaggaaacagctacatcaccctgctttaagagaaccaaataatgttgcaattggatttgctttaaaattttccacttgaacaaaactgacagctgtattataatcacatttccagtcactttataagacacaaatttcatttctccatatttctacttcatttctgaaaaggggccagcaacgttattcatcaggcacatggagaggcagcctaattcatggggcagggggaaaacgctgttaattccatgttttccatttcccgagagaattggtggtttaactcaaacatgatttttttctgatcagtctagttcagggttctagtttcaaacaagggtagggggaaaaaagcagcattttagtccttaggtaaaatgacttgagattgttgaaattaggactatctacatttttagaaaacaccagggtggatttaagattcttggtatattcttcatagaaaaagtctgttataaaaccggctattcaaatatca

SEQ ID NO: 43368 - DNA, 1653 bp, Bovine  19866881214442
tggtaaagaatctacctgccaatgccggagacacaggttcgatccctgggtggggaagatttcctggagcaggaaatggcctcacactctagtattcttgcctggaaaattccacggatggaggagcctggcgggctacagtccatttggtctcaaatggtcagatacaacttaacgactgagcacacccatgctgtttgggactttcacgtctttcttttttccaccatgtaatgaacacagatgtactgtgagcagaacctgagggctgagtctgagtttttcccattatggaaatgtttggcactgagatccaaaaacgtctggctgcttgactgcacttctagtttgcagcaggagtcttggcaccgcagggacagagcttcagagtgctcccaggtttgaatttgcctgaaatacagtcagaaagactaacaggaagcacgggagtttgctcccaccacccatgccgttaccacccaagcgtcgagtccaggatggcccaggggatgctctgggcaagttcgaaagcaagtcgccatgtgtctcccaacacacaaggtgcacagaggccagttctcttggcccatcttctgaaaagacagagtgcagttgggcactgagaaggaaaaggagaagaaaaccgttcctgttgttaatcgtgtcccaggctgtgctcttgttttcctgggagcttaagtacaatcataaatattattcctgcagactatgagagcatcctttgtacttttctaaatatttttaattttttttttttaaaaaacatcctcttcttcctttctgccaagcaattgctcaggaaaacaatatttttccaatcacttgcttaaagtgtacttactgtgactctttcggtgtggcaggcacttgggaagacagcagggaacaagctggtcaaaaaacctttgctccctggaacttactaaccagccctggtcagctgcactcactattgtgcttgacgctgatatgagttttgttatgctttgctttctaagattcctggctatgtctgtgtatgtggtttgtctcttagactgtaaaaccatggacgcattcccctcagctgagtgactgtcaacccagccaggtgactccagcctcaggactgaagccgggcttacaagtgcctaggaatctttgggtatagagaaattggggtgccttctatttccaacggaaggtacacgcacacacatacataggcatacacttgcacaccacactcatggtccagcagttcaaaattcaaagagtaacaggacaggaggagacccagaaattcctgtccattcgatgcttccaggcaagaaggtatttaagccattctgggcacttcttgatcggcaagttcttatatctgaatagtctggaattccgtccttacctgggataggactccttttggacacagcccatttctgtttgcccccctgcatgaccacccctgagaggctgatgccctggataaggcaacttggtgttcagcttctgcctcctgcaaccagcacagaggaggtgctcagacacaggacttttctcccctcacactgtttataatctgtaactgtatttgttaattttttatttatgtgctctctcactcattgtcttcactccccgatagaacat

SEQ ID NO: 43369 - DNA, 1861 bp, Bovine  19866881226204
cactctggagagaggcagagtggaatttgagctcaggtgaaccccacgctgactccccctccatcttggccaagacttacgccagtgtcttcacctgagggcactttctcaggccagcggcaagctgctgagccccagcggctgtgaacttgttgtactggacactggggagagaaagccattgtggatcctggccctggggaccatccagcctcagaccaaggtcaacaccacgctctcgacaaccagcccttccagggatgccagcaagagaccctcggtcctcccaagccctgcccgcatggcccaggctcccacactcactccagcacccggagggacaccatgtctggaagcgcgtgcgccaggctctcggctcccgcgtcgcagatacagttattgtacaagctgtgggagacagaggtcaggccaggggtcgggggtgctggggcgtcagggcctggcagcagacacaccagctgggactactgccccattcgacagaggggaaaaccgagtaacttctccgtggttactccgtgagtctggggaagcagcaggactgagtggaggtagcttcctgccagggacacctcaagttcaaatcccagctctgcagcttgttgcctgacttttggcaagttactcagcatccctgtgactcagtttgcgcctccataaaatgggcatgttagagtaatagtggggaagagtaaataagttcatgttggtaaaacacccagaacagggcccaacacgtggaatgaactacttgttaactatggttattatatctcccggggggttgtgaggttatatcagttactgtagtgcgcccagcactggggctatagcagggaagagcgagacccagagtcactgggcaggcttggctttctataggatactcagtcaccatcagcagtgtcaaaaatagaacatgggtgtcgcggatgcctcattaacaagagtccttataacaagccaggtgcggccgcggttctgatttcaaggccgtgactctgcctcgaaccggcctcagagcagcgctgcaggactgcatgaaaacgcagcaggtctacactgcggcaaagggattcacgctacactccggggacccctgaagtcaggagttggctcgcaccaggggaggaaccagggagaggttttgcaatctcttcctgggatggaccttagaacccagggggcccttcctcccccgcacagggagaggattcttcccatatttcactgatgccaagatgtacgtgttcacatttgaaaatcactgagatcaggatgtgtctgataatcaaaggatgtcatcatttagttaacagtgttttgtcctcttaatgatgtcttaccaatggaaggcatcttaaagtccttaaaatatgaggtttgtttttttttcattttttggccatgccgtgcaacttgcaggatctcagtttcccagtcagggatagaacctgggctgcagcagtgaaagcccagaatcctaaccactcggccaccagggaactcccaatgtgagtgaggttttttaaagtgtcactcaggtcacacatcacccccaccgggcccacctgcttctccattcacaccggaaaacccccagtctccctcctgaccctaacgaaggtctccctgtatggtctggcctcccctgacctctctctcctcatttcccactctgggcctagttccttatatccagccacaggggcccaccccccttctggctctgaaggacccaacccctttcccacatcaggccctttgcatctgcatcccacagaagggggagggccacctcctcagagctctcctgacctccctggtgaattcaatcctc

SEQ ID NO: 43370 - DNA, 796 bp, Bovine  19866881494065
gcactgcagcttccgcctgacctccgagcattcagcacgccgtcaccaggatgacctggttgtgggctgggacggcaaggaccaggtaggtgttgggctggaacaggacctgggaagcccacgttgtggcctgagtgggacattcggggccctgccctgcccaggagcattatgggtccaaatgggctgagccccggtccccaaaggaccacgggaagagcactggcggggaggagggagcctgggtcccagcaccacctggatgataacaggaagaccagtggctgatgcatagcgacggcctcttgtgtgccaggcaggccagccccctttcatagatgaaactgaagctcagaggggaatggggctactgaaaggcagggctgggattcagatccatgaaatgcttctaacccccagtcccctctctgtcgtatgcttgtccctatctcctgctctccaatcctcaagttactcctctgaaaaatgggctgaagctcccagagggcctcccccagtggtgggccagcagtcctcactcccttgaccctgatgaaggaggtgacctgtgctgggtggtggagaggccctctctgggggaggcctcccgctcagcctgtcccctccccaggtggcgctgtcctcctctctgcggctggggaagggcaagctggccgcacgcctggccctggctcaccctttcagcctctcctggcggcaggccgaggccagtggccttgctgagagcaggggcggcaggcagagctggcaggtgagcggggagcagccacggggc

SEQ ID NO: 43371 - DNA, 834 bp, Bovine  19866881679538
tgctgttatgaatctacttacttactcattaaaataatgtagttgaattttccgaagctacagaattaaaacaagtccattttttaatccaacaaattggaaaagatttttaagagtagttgccattgttaatgagggtggagggaaatgggtgttctcctacacttgtacttttcatgtaaattggcacagtgtttgggaacacagtttggcaatgagatggaatatttctccagaaggtctgggacctaacccattctagattagtgatattccaaagtgtacagatcttaactcgaaaagaagctaatgtttgaaaaatctggaaccagcctcacaaatccctgaagcatccttttgctcttatgattttgataaatggattgaggattgggaaacatattgtagaactgtggttgaccactttaaaaacaatcagaacccacccgccccgcttgctgaactttgtgtgaacgtgtttcaggtttgtgagtcctttgagcacctgccacctctcccggagccgccgctaccgctgtcggagctggcagacaaagtccgcgacacgcttcctcctcagaagcctgagctcaaagtaaaacgggtgctgcggcccaggggcatcgccctgacgtggaacatcaccaaaatcaaccccaagtgtgcccccgtggaaagctaccacctcttcctgtgccatgagaaccctagtaataagctgatctggaagaaaattggagaaattaaagctttaccactcccaatggcctgtactttatctaagtttttagcttccagcaagtattattttactgtccaatcgaaagacatttt

SEQ ID NO: 43372 - DNA, 1381 bp, Bovine  19866881714041
atatacttattctagtgatactttagacaatattttaagtgctttatacttgtcgagctgacttaaccagcacgacctacttgaggtgtgcactaattttacacctgtgtaccatctcagcatcccacagcccccatctccctcagcatctcgaagccccccctgatggagaaggggaggcagaagcccagccaaacacacagtaatggggccccatgaaacatccaggtttcccaggaatgaaacacatcatggcaaaggtataagcgagtcacttccactcagggtctacaaacagctgcagggagaacacacgatttctcatcactccctgcaggtggccctggagtgtctgtaccagagagagaaaaggatcgggattgatttggtccatgacaacgtggagaaaaatcttatccgggtaaagtgccccctgggtctggccaactccctaagggaagtggaagatcagctggtcagagaggtttctgagctgccagtcaagagtagaagcaccattgagtccccgcccccacccccacccagccccccacacgccatgcaaagttaggactcagaaagtggggcaggggttaggttgcaatttagaaatagtgagagatgaggtcatttgaccctcagtcttttcatctccaaaatgggcattataatagtgtgtgctgtggtgtcacttcagtcgtgtctgactctttgggacccggtagcccaccaggctcctctgtccatgggattctccaggcaagaatattggagagggttgccatgccctcctccaggggatcttcctgacccagggatcaaacctgagtctcttgcatctcttgcattggcaggcaagttctttaccactggtgccacctgggaagccacaaagtgaaagtgaaagttgctcagtcatgtctggctctttgcaaccccatggaccatacaatccatggaactgtccaggccaaaatactagagtaggtaacctttcccttctccagggaatcttccctacccagggatcagacccaggtctctggcattgcagacagagtatttaccagctgagacacaagggaagcccgcatgaatactggaggggtggtcatttcctactccacaggatcttccaaatgcagagactgaacttctgtctcctgcattagtaggtggattcttcaccactgagccaccagggaagacatatccctgtgtaataggtggtatataggcttactaggtggctcagtggtaaagaatctgcatgtcaatgtaagagacttgaatttgatgtatgggttgggaatattccctaaaggaggaaatggcaacccacaccagcattcctgccggattttttgcattccataaagac

SEQ ID NO: 43373 - DNA, 1348 bp, Bovine  19866881935088
tactgtgtttctcataaaaacatacagacccacagaagaatgggggggcccgtccgagatcctgaggggtcctgacctgcagaccagccctccctctatcagcgtacttaaaatagactgaccttctcgtggtattttttgtgtgtgcttgacaaacgccagagagttactcatgagttcatcttcccagaataactgtcagaacagggcccaaggacagcaggaagaccctggcctgaccctgtaaagcccggggctcctggaaagcggggaatgcgtttcaccattgtcccgcctgctctggagcatcgcgtctggccccagctttgcgcaggttcttagtgattccgggagagagagctccggaggccagaacagatcgaaggtctatgttagggacccagcagtgtccacctgcccgggtgccttccttcatccttcccctctttttctggtttaaaatgctgaatgtggtagaagtcctggaaaattcagacaagcacaaaaaaattaaagtaaaactcaccctagtaaaccacccggtgctcccacgacttccactccagtctgtttgcttttctcccggtacaaggagagggcttctgtggggagtcagttggtaaagagtgtgcctgcaatgttggagacccgggttcaatccctgggtcagaagatcccctggagaaggaaatggcaacccattgcagtgtgcttgcccagaaaatcccatggatggagaagcctggcaggctacagtccatggggttgcaaagagtcggtccgacatgactgagcaactaacactttttttccgtacaaggagagagacagagcctggattttgtgtgtgtgtgtgaaaagtttgagatgaattggcagcaaatttttttttttaatgaggaaagtcttttttttttttttaaatttttggctgcactacatcttcgttgctttgcgagggctttctctagttgcagctcctgggcttagttgctccgtggcatgtggaatcttcccagttgttgttgctcagtccctcagtcgtgtccaactctttttgacccgctggactgcagcacaccaggcttccctgtccttcactatctcccggcgtttgctcagactcatgtccattgagttggtgatgccatccatccaaacgtggatgagatcaggtgagatccaaccatctcatcctctgtcatccccttttcctcctgtcctcagtctttcccagcatcagggtcttttccaatgagttggctcttcccatcaggtggccaaagtagtggagcttcagcatcagcatcagtccttccgagaatattcagggttatttcctttagga

SEQ ID NO: 43374 - DNA, 1326 bp, Bovine  19866881977393
gcactaactttctccctgtgacagtctctctgctgcatttatctggtaccccaaactatgtgtgtctaagtatatcatatttggggtaacactttctaatatgtaatttatattttaatccaacgtcttggaataagaatgatgagtggaggactctttctctggggaaactcagggcagtttgttgtgtaagtgggatgggggatggcaatggaatccagggagtctgcagaactcagcaggggctttcagcttatcttgaggcatctgtgaggctctggccctagcgccaccctacagaagatggcatatgttggcaactggcaccagcgtggttccactgtggtgaacaccgttttagaatgactgtgttgaagacactccaacagtcaactcactatctttcctggtcatcaccccatttggtacacaacaaggaaccgaaataaaacacagggagtgtttaagggagcgtgggcaaattagagcatgcctagtaagagaaatctggcagcactgatcacctggtaaggggagaattttccgctggtcccttacttgcttcttttgcatgtttgcttagtcttggcgggctcctgaccaggtgtagggagactggccagagatgaggctgcctgctcctgaattgggcacctgaagacctcactgggcaagctgagggcaccaggaggggctgccagagtccggaagttgctgcctccctgtgtttcccacaccatgcgttgcctggctccacgccctgccgggtcctacctgccagagccccaaggtaaaaaggcgggtgggggatgttgggactgaaaatgcttcttaatttagggtgacatcccgccatcccccaaaaaaggagacactgctctgaactaggggggtgaggatggcaggaaggggtctttggcctgctggggcttttggaagaagtgaggtggtttgccgtttccttccactgagggacctgctcactcaggtgtctggaatgtaagagaacttgatcagcctgaagggtactaaagggatgacttccagggggcgtgtcgttagctctcagtgttgatggccaggctctgccaaccgcaaggtcctctctctgccaggtaaacactgaggggtgcccttgaagggtggaacccctgccagacccaccccatccccaggaagcagggacaccaaagccagagtcagcccattagtctagacattgagcctggtggggagtagccaggcacctggcccgatgctaccctctcccccatttccaactggcgctttgtggaataagtgggggacaggggacagacggtgaga

SEQ ID NO: 43375 - DNA, 1462 bp, Bovine  19866880401332
atgtggaagtgtatatatagaatgctaccctttgtatatgaatggagaaaaataagaatatattcatatttgattgcatttgaataaagaaaccttggaaggttaaaaattattagttatgggatggggcagggcagaggtggagtaagacatttcactgtacacctctgagtttgctctgctggttgaactgtatcaatgtattacctatgtttttaattaaagaacggaattctattagatgtgggcaatgctgctgctgctgctaagttgcttcagtcatgtccgactctgtgtgaccccatagacggcagcccatcaggcgcccccgtccctgggattctccaggcaagaacactggagtgggttgccatttccttctccaatgcatgaaagtaaaaagtgaaagtgaagtctctcagttgtgtcggactcttcgtgaccccatggactgcagcctaccaggctcctccgcccatgggattttccaggcaagagtactggagtggggtgccatcaccttctccatgtggacgattagataggctatagacataaagggagaactagaaccagctgtcattttctcagctttgggtccatgggagagggggtgagtctgtggtaagtgtccctttctcagaaaaggtgctccatagggatttccctggtggtccagtggttaagactttaccttccgatgcaggggtgcatatgttcgatccctggtctgggagctaagatcccacatgcctcgtggccaaaaaaccaaaacataaaacagaaacaatattgtaacaaattcaatgaagactttaaaaaatacccacattaaaaaaaaaaaacttggaaaaaaagaagagtgctccaggctgggaaggggacccctagagtggcctttctggagggagagcaagacctgctgcgtggatcacagtctctgctgggtcctcttctttggccccttctgcgccaaatgcggtctcccaagggaaaccagccatcactccccctctgcagtcaaatactctaccactgagtgataccctcaccactcccctctggatgggaggagacaattagcttcaggtctctctctgtttggggccttacaacagacaccctggggcccaaagcccaactttctgctcagactgaggtgcagactctgaatcagaatgatccctcatggggctgccacccaagaccatgaatgacttctttggcttagttcttcacctcctgtgtgcttggcatttttaggggtgacagaggtgaggtgggcacctgcccacaggagctccatgataaggattcagacttaatgcaaagaggtgtaggtctggagagcaaaagggcactcatttactcctggaatactcaaaagaacgaactaaaacaccaccaaatcaatacgccagaattaaaatagctgaattctattccagcaaagaaaacgaaa

SEQ ID NO: 43376 - DNA, 1176 bp, Bovine  19866880417517
attctgtcccaggtatcacagtgaaaagaatcagtcatggagccttcaactacacagccactgctctctcagctcggttcagtcacccctgaatcgcagaaatgtgcaaatggtccttcttgcccttctcacaagcgtaagcagtgaatggccatgcccaggaagtagaaagatcccatacttggcggtgtcaagccttggaccagttccttgaacacgaatcagccttctgaagtgtgcattgctgctgctaagttgcttcagtcgtgtccgactctgtgcgaccccatagacggcagcccaccaggctcccccgtccctgggattctccaggcaagaacactggagtgggttgccatttccttctccaatgcatgaaagtgaaaagtgaaagtgaagtcgctcagtcctgtcgggctcttctcgaccccatagactgcagcctaccaggctcctccgtccatgggattttaatgatatacaagttccctcataagcttggattccaagattctgtgtcaaggacacatacacagatgctctaaggccctgttgccttttcctcagaggggcggttttacaatcctccgtggagcccctgacctatttgcatagggttacttcgtgggaggacacgggggctgcaggcctggcgcttgaggctcactctctaggcaccctgaaaaagaccctggagcagccaactcccaggtaaccggtttgcacagcattctgctagccctgagaggagttcaggggcagagggagggccagcctggacttgccactttcccatgcccaaacccctcaaactgcaaggggtgcattttccttcctttggaaacagaagggactggcagcttctccaccattctggcattgtttgaatgggaattcatgcctgaaagggccgaggtggaatgaaggaaggagctaacatttagagagagagtgaaagacagggaagcctggcgtgctgcagtccatggagtcacaaagagtcagacatgacttagcaactgaacaacatttagagagttcctgctgctgctgctaagtcacttcagtcgtgtctgactctttgcgaccccatagatggcagcccaccaggctcggctgtccctgggactctccaggcaagaacactggagtgggttgccatttccttctccaacg

SEQ ID NO: 43377 - DNA, 2255 bp, Bovine  19866880511302
ccgtaactctgtctcctcgcagaggccactgcagccttagtatttcctccagactagaggcgtcgcctcgtgctctggccccaaagtcagcctcttccctcctccattaagtgaatacagggcccctcccccaggcatgcattcaagcaggtgcacgtgctggaacacgtgaggacctcccccggccctgcctcttccggggcgccccgggctgtgccctgtgagccccaccctccacccgccctccccacgggaaggacgtgctggtcacaccaggtctgtgggcggctgcatgggcccccttgtgatctgctgctgtccctctgcttttcctttcattgatccattcaagtaacgttcactgagcatctctgggcgtcagcactgtgttaggtactggggaccctgcgtgagaagacaagcccctccctaaggagcgcgcccttcagccgagaaacccgtgaggcaagagggactcgtgaggggctcctgccatgcttcctgctgaacccctcttctggaccacagttcccaggatacctcactcccatcccacccggaatccttgctcagagacctggaaagagagacagagcctcttgccacaactggagcatctgatggtttccaaagtgtctttccaggcatgcacaggggggacaggcagcccagacccgaccgacctggggagctgagagctgcagcgcaggggaagcctgagggcagggacagcccctcccccaccatggtgctattccggagctgggcagacaatttctggcatgtctccggccagtccccagcctccagtggagtaaacttctgaggacctgatgtcctcctgttgacatccctcccttcaccaggaatgaaagatgtgggggtttctaatttaaatgtgggactctgagaaattttgttaaccgggggtgcattttgggaaaaataaatgcctttgtagaaagctttttctctgtaaattgtgtggcagcagggctcgactggaagaattccctcctggacgtttgaggcccagagtaggggtgcttggatctccttaactctcaccgtccttaagtccctgggtttccatggccctttttctaacttcatttacccacttgataaggatgctggctgtccagaaagccaagtcctttggtcactgtatggggctccacccactcttagaagtgtcgcctaatatctttatctcagaagattcagactctaggcttgtttaaggcctaatgcccccattttatggatggggaaactaagacccaggaagaagttaacgtagaaaaggaactctacgtgctctttttggctgacacagtggaatgggcaccaggcctgagtcagaggtctaggtccaagacctcatttagcccttccctgtgatcctgagctgggcatttcacttctctgggctttagattttttatttttttggctacgctgtgcagcatacaggatcttaatttctcaattagggattgaacctttgccccctgcatttggagtcttaaccattagaccaccagggaagtcccagggccttagttttcttatatgaaaaatgggcttgagatttttcatcaccttccagttttgaagactaagaagaagaggtgaacatggcaagcaaaccatttccagagaaccaggttcaaggatgtgggagcctgcaaagtgcactgggctcctttacccttgggggccagggtctcagaactggcccaccagtcagtccccaaactctgcgggccctagggcagcaggaagagctcgggctggaggtcaagacacttgacttttgtttttaattttttttcttgttttcccttttgacttttgttcctggctctgctgctgacttgtgacctggtccttcatccctctgaaccttcatttccttatctgttagaaagggggtgaaagggacttccctggtggtccagtggttaagatgctgtgctttgaatgcaggggtcatgagttcaaaccctggtcaaggaactaaaatcccacatgccacgtggccaaataaataaaaattttaaaaacagcaaaatatgtttaaaaagaaggggtgatgatacctttggaaaggtatgtggaattctttccaaagggtgcttcttctaaagtcgatggccctaggagtgagtccagtcaccttactagaaggcccccccgactggtgctgtgggtaggttttagattcaaaaacctttcccgaggctctgtct

SEQ ID NO: 43378 - DNA, 2194 bp, Bovine  19866880539634
aaccccttacggagggtaaagtggctatagaattcacactaaagtgtaaatgattgacaggctgggttcttccctgtctgatcaagacctggcctgctggtcccaaacacggaactctgaggggccattccagatagttattgtctccagggctgtttgaccagatggataagacagcacatctctactggtccctctctccttggttccaacatcccatccctccgttttggccccaggagtccactttggtagaggattattggatttaattaatatgtccttagcttgacataattctcattctggctcagttgtgcagggtccattccttttgcctgtttcaatttcagggctgaaaagaattcccgacgcttttaaggtccttctcataaatcatctcccatggctaaacatgaatggatttataattctgttctaaagataaggaagccaagcctgtgcaggtgatggtaaagggacgtgcctaatgtcacactgggagaccctggcaaggctgagtctgaatcccagggctcctagtttctgttcttgcacttggctcagggttagtgttcccaccaactttccagtctgccagcaaaggtatcaactacagtggttttaccttttttacaactgccagctaatgtcatcctttatttccagttcttcctgcttagacatgagtgcctgctttcaggaagaaatagggctttgtcctcaggaggctcatgtttgggtgggcagacaagagtgtgactcagggagcaaggagatgcagcaagggggtgcaggctgaagggggtcagtgcatgaacaccaaggagagctgggagatcaccgaggtcttcccagaagagagcacttgggagggctcacggcccactgcaggctcagggcagcttcttgagtggagtgtcagcgaggtgatgggctccttttgggaacagaggctggagagtcagtgaagattctgttaagtcctccctacctgtagatatttacttttttccaccacacaaccccttactcagcagagccctccatatgcccagagtccctggtcaagcttgcttccttctccagaggccagatgcccttcccaggtccaaaagctgaagatgggcctccagagggagcctggatcttatcctcactttttcccgcctctccccacccccagcttggagcatattctaacagagcagcagtctccctcaaagacttccccagggacttccctggcagtgagtctagtggttaagaatccccgtttccaatacagagggtgtgggttctatctcttgtcagggaactaagattacactcgcatatgccatgtggtatgaccaaaaaaacccaatttttttaaattgaaagaaaacttaaaaaaaaatctagaaatttattaaaaaaaaaaaaagacttcctcaaagtccccagtggccttgatggacgtgaaaggctgggccgtgggggcagggctagtttgtgtcagtcatactaacacagtctcgtctctaggggtcaaggtttttttctaaagtgatcagtagaatgaaggctcaggttaggcccaaaatgaagtcctgtctctggacagtcagggctcagttgtaggagtcagtgatgaggtgtcccaaacagtggcacaacatggtcttcgtcttttgtttcagaaagcaggaaaggccgtgcagccgtatgcacatgacttcactgtgcgtccttcccaggacccgccccaagccaggtgcatgggggaggtggaggagacaaaccccctcaaggagctcccggctccggggccagatcagccttactcagagaacagttcccaagcctgttcgattcctagggctgccacgtaaagtaccacaaacctggcggcctaaacaacacagttaattctcttacagttttggaggtcagatgtctggcgcaggtttcactggttaaagtcaaagtgctgaccggactgtgctcccttctggagactctaggggagaatctatttccttgcctttcccagcatctagaatctgtcctccttctttggctcatggccccttcctccaatcttcaaagccagaaatgctggttgtgtctttctagtacagcactctgacattgacttgtttgcctcctgcttctgcttttaaggaccatcgtgattgtatgcatgcatgct

SEQ ID NO: 43379 - DNA, 2218 bp, Bovine  19866880552823
caggaggcaaaggtctgaaggtgagacctggggacaggaagtggtaggttgaagggaaattaaaattaggacagtgtgtgtgtgtgtgtgtgtgtgtgatcatgtgcgctgagagaaagcagctgtgtgtgtgtgtgtgtgtgatcatgtgcaatgaatgctcgacatgtttctgagccagggaaggaaggaatgtagtgaagtctgggtttgaggcatgttaatctggagcccatacagaaaggactgggaagggagagatgaataaggaagtaacttctctggagcaagcaaaaacatagactgtgactgactgtggttgctctagggagttcagtctggaatggggccctccatgcacaggtctgcagagagcagtgagctgaaggctttgagaacccctctgcatgtatctgggaggctgggcagttcccagggagggatcccagtggcttctggaactgcacctgtaaaccccctgcatctggggtttactttttactccccttctccatctggattccagggtctgagggctgagctgcaagccctgggctcctgcaaagccaacacattccaagcccacggcgaacttctgtgtagcctttgtaagagttttaaaaggctgtcccctctgggcagatgcatcctcttggcagatggtgcctttgagccaagcaagaggtgccagcgtgggctggatttcaaacccccacttcttccttggcaaagccccagcacatacaccatatgatcattcacagcagtcctgcataattcccagcattaagagaaactacaaaggtgacaagtcaatcttgaaaaccacaagcagccagagatgagatgttcccccccaccccacccctcctcattcctcctcctcttctggatcaggggccgagagctaccaggggcctggatgagggggagcacggggtgggggcaagctggctgggcccagggagtcagagaagcagggtcacaggcccaggcacaaggtctactgtgccttgtctccttgaaagtcagacaaaaacaaccctcggagggagtcacagcggagactagaattcgttttcaaaacactgaggccaaaagaggttaagcgacctgctcaaggtgacacagctaataagaaaacggtggatggtgatgttaggtaggtagactagggaaaaggagtccaaaatggtggtggctaaaagacaaggaagggaaaagcctgcgaaaatagaacaaaggaaggtccgaggaccggagtgaggacctcaggtaaaacaaacaacactcctggctggcccgatttacataggacaggcccagggagagaaaaacatataaaaagaggagccaaagctagctctctctctcccgcatgctggggcactcttctcttcgcgtctggatcgatgtgccctcatgcctcgaagatggattttcctgctatcttcttaataaaatagagctgtataacactgatttgtctaagagctatcacatggtcctttcgagacctgagagctataacacagtctatccaactggtgagggggctttaatgtccgtcattccaaatctttgttgtgacgagacaaaaactgaggaacatacactcacgtgacaagactaagtctattggattctttatattgactctacaaaggaatatatgaatatcatgagacaggctcagatgaatgtcatgaaaaatccaaacagggagaaatcatttctcaaatgcaaatgattgaggcagtttaaaaaattttttgcatcagtaaaaattctctccatttctgttaagtatgttcactaaagattacctgctttgcttgttgcctcagattatccccaacagactctggctcaatcatcttccattcagctgcaatactcctgaaaacatcagctccagtgtttagcacttgaatgagacgacgatcgtgggataaatgagccaagatcctcagctcaagttgagaataatcagccgctaatattaaaccacctgaaacaaatgattttggaaaagttggcacaaagacaaaaccaacttttatagtactgaacaggatgacagaaattcagttccaacaaagaaccttgagatcatgcatccaaaagctaaaatcttgctcttaatttgactcagttcaattctgtaacatgtaagaattttttctgcttggctttcaaaggtatgtaatatatataa

SEQ ID NO: 43380 - DNA, 1444 bp, Bovine  19866880569717
ttcttctgaccttgtattcctgagcttgatcttaatatgccttactcaggccctttctggctcattcactaattaagagactcttgtctcttgttaccagggctttctggagctagggggtctcctcccacaccctctgagctccagcccttggtttatttataatgggtgcaaagtgtttttgccctaaaccttacttgaggaacagagtccatctcaagaggattttgcaatcgtttaagtttccaaaatgggtctccagcccactcactcatcttttcccctgcttccttctttcaaagattgagggcaggaggaaaagagggcaacagaggatgagataattggatggcatcatcaacccaatggacatgagtttgagcaaacaccaggagatactgaaggacagggaagcctggtgtgctgcagtccatgggattgcaaagagtcggacatgactgagcgactgaacggcaacaacttcttcaaagcagtgctgtatccatccctgtttggggcccattaggggtcagactcagatttcccccttcccattctcagacattcaggtccttccctctaggaagccctccctgattgctccagttgagccccaacacccacgggatattgaaactctgaaattcaagtcacactcagagatgtactgggctatggtttctgtgtgtgtgtgcgtgtgtgtgtgtgtgtgcgtgtgtgtgtgtgtgttggagggctcgccccttggagctgagctgggatgaacctccataagtgctgagcagcaacagcacaggctgattgctccatcttaaatgaggagtcatttcattttcccagcgaagcttccctctgtggacacactgaggatgtgcaaagggaacacgcctagcccactggaggagggaaccgccaggaaataaacactgagcccgactattattactttttttgttgttaatttattctgtgcttagcttctaataggctccaagatgactaaataaacctgggaattgactccctgctcccccaaaccccatcttcagcaagggatagctctgtctgcggcataaattagcagaagccagagtgtaaaaatatgattctgtgaacaaacaaaagcctccagtcatgagaccagcagcggctgagctgttcccactgccgtcagctctgtttccaagcaattaaaagcagaaggagaagagacggcagtcccccagcggggccaggaaggaggctggcagcagggcagaccccaggaccccgctgcagccctcgagaccctcagagcttgtgctggggcgggcctggcaggcaggagacctgggtctgtctggcctcaggctctgggggaccctggggcatgggttttgcctactggcctcagttttttcatctttaaaatgagcatttttttttttttttttaagaagaggga

SEQ ID NO: 43381 - DNA, 2004 bp, Bovine  19866880632906
atgttaatagtggctcttgctggagaacagggcttcatatgactttctttccttctttctacctttagatagtctgaaaagctggtttgaatttagaaaagtcagtttctattatagatagttccttgagaaatgtcaactatatacatatacaccaaaccatgcagtccatggaaagggtagaaaacctacctacctagcagaattaacatgaggagtgagtaagaaggctaaggcaaggctcagaagcaggtggaccacacacacagctgaagccgtcttcgttgcttgggtcggtgcatcttttgcctaatcttccaaactgccaagcatggtcagactttgttttgaactctcctaatgtttaaatattggcagcttagtcaactgactttaaaatactacaggttaccaaagaagacagagatgacaaataaggatgtgaaaaacgtgcagttgtatatgacatcgtttatatgacattccggaaaagccaaaactatatacagtatggaggactgatcatagttgctaagagttgagggtttgaccttaagagtagatagcagtgagggaatttctgggggtgatggaaatgttctgccgtgattgtagcaatggacacaggcctctacttgtcaagcctcatggacagaaccagagaaagacagcaagctgtgtccttgggatagtcagtttgtaacctatttattacattcagaacccaatttccatatgatgaacagctcacacccattcttccacctattaggtgggatggatgaactaagtggagttcattcattgataagacttctcaatctacaaacttaatcagcactgtactcttcattaaagcagtcagtatctttgcaaatcactttattagtatacttgaaatacttaaggatacaagtttacctcactttgtatgtatatttagaaacattatgtaaaggaacttgcaaagctaattaacactaatttttggtgtcttatttcccaaatcttaccttaaggcagtttttctgtgttctagtactcaggctgttgctttcccctgtaatctctaataaactactcttttggaatccccacagtctctcatggcatcagaggagctgccacttgtttatgaacgatctgcatggaatgcggaagggttaggcccctttctacgcttgtgcctcatggatcagaacttcccggcatttgtggaagaagtggaaaaggaactaaaaaagctgacagggctgagtggttaacattctgtgtatctacagaaattgggagtaatggggaaaaaaatgcttcctcctaagattatagagaataaagagtattattccaacaccttttatcagttttatttttaaaaacaggtgaatccactttttacatcattgcacttcagcaattacacaaaacacaagtacatgcatctaccaattacgcaccgcgtgagacccctgctgggtgtgaaaatctacactcaatcaatgaaaaaatacagtgtcaacctcaaagaaaaactagttgcatagaataccatgctttaacatttcaagatcattgaaaacaaaaggtaaattataaaagattgccttaactcaatgtacaattaggttttaacacatcagtgcaaaaggatttaggaatttacatgatttaacaaaagaaaaaataataattgtaaaagcaatcatatatatatactgtaattcattatatccattcagtgaattgttccagcttcttatcaaagtcatgttaagcccttaaaattatagatttcagtttatattactcatctttatgtaccagaactgaacagtttcctcatctgacaacatacaataaggaatgagtatcagcagcttaaaaatgcttacgttgagatctttaatccattttgagtttatttttgtgtatggtgttagaaagtgttctagtttcattcttttacaagagatgaccagttttcccagcaccactgttaaagag

SEQ ID NO: 43382 - DNA, 1766 bp, Bovine  19866880930942
tgtcaataagggagcagttaccctagattgttgatgtgggcatagaaaagccaataattagttttcttttcccttttgggagctgtgcctcataatatattcatttccttcaagggactgacatcagcaaaaaatggaaaagcccatcataaagactaggaaggtcactatactgactgcagtaaaagatccacgttttatcttactttggaacaaagattgcataccgtctaattgcttaggtggagaatcagtgaagctaacagtcctggctgaacaaaattttccaaacctgagtatatagaagagctagccagatagataccacattaaacaagccagtgaatctgaaaaacaaaacgggatctggggacaggcaaatgctgacagccagtgtatctcattaatttgcagtgcccttttatccttaaagaggccagacttacctacaaatcacacagacaaatcaatcacatgctgcctttaattagctgtatgatttatatcccctggcaaaccagcaaatgtgggagagatgcaattaaaaattttaagtgtggcaaccacatcaaatttattttactgtaagtttaaaaatagaactaaattgtaacaataacaacaataaacctcttattttaacagaagtagctgcctttttttctagtctgatatcttgtctagttttagaagacgcagcttacccaaaagccaccccaaataggtgatgtgtattgtgtacctttattcaatttcttctgcaaagaaattcggatgctaacatcgtaatagcattttgtattttttaaatacacaaatcacattgctaactggaaaatgtttctaactgtagttaacaaaatcctgaaagtttctataagcagaaatccttgattttcttgttcacaatttacatgatttaaatttctagataaaaccatcaaacaaagccgtatctttaggatacagaaaactgggcatggctaggtagtggtaaggcgccatgcccacagacactgctgccccttttctgcctctctcgggttctcttcatttttaaattcattaactttcttcccctgagtataaaggttaatccattatcattgccccctccaacaatgaaaaaatatgaatatttttgagtattgcctattcatttccttagtcatttttctcttggatgaataaccccaaattatcaagagtcttcgaaagctaaccccctgaaggaaagggaaagaactgatgagagaactccacattcagtttttggtaattctatgaattttacgtgaaactgagctttcttgtttacaattaattagctatttccacctctcgctagttgagactgtacaaatgggacatctatatgtagcacctttgtatcagctatctccatgatgattctgtaattaaccttttgagagtaatcacataaaaaattgcacctcatcactagatgaaaactatataaaggaacagataattattaagtatataagcagggcaaaaatctcagaccacttgtctagaggtatctacctatctatgtgagtgtacacaacaatgagtttggacagttagtgtttctttggaatgtagttccaggaaatgacagggaaagttgtatgtctgacagcctaactgatgatttgctccatgttccttctataaaattcttagacagaatttgagcttatcatctgaaaccagaaataccacctcaatacatgtggacccaagataaagccaaggcacat

SEQ ID NO: 43383 - DNA, 1510 bp, Bovine  19866880941494
tacttaaatgtagacatgatttatgctatagctagacatcattctggggatatatttacctttcttctctactgtttctggttaccctttagttgcctcatgtgaactgacacaagagtcagatttttcccctgctagtatgccatgagatcagtgctgcaaacctgttccagctccacccaagctcctggtcatgctctcaccccctgccttcccacacatgcctggagcattcctgtctagcttggtcagctctcctctcccacaatctagtttaaatgttagctcttctccaacttcccttgactctttccagcagtgtccactcactctgcagtgtggctctatacataccctctgttggcacttcttacatgttcctggcaccatccctttggaggtctggttccctctggaggtcatttttatgtcatgctctccctttctcaccttcctcttacgttagatataaaacatgtagcatatattcgtaaatatctcttgactaaactttcttttaaccttgtaattctgaaaggaagtggaagttatgaatttcctccattctgactagtagcaagttcttagcattgtttctagaggaagtttagggaaactttccagaattcaccaagtgtgaagtagatgtgctgaatctgaagtaatcaaataggcctgatgttaccggatacatacctgaccatggagctcacaccctttctccatcctctttctagttatggagttcttatctggtgtttggaacaacatcctagattaagtcatgttttctgggtctgcagggaaggatgtcccttcacgccattaaaattggagaagtcctgattctgctagaagcttactgattggttgttgttgagattgaagggaagtcagtgatcaagtattcaaagttccttggacaaaaatgaccctagacactgctcccctgatcccgttcagtgttttgctaaggatggagaatagtctcaccctgtggtgggcactaattcacctactctgatctttgtgtgttctcactttttctgctcctgactaggatattgtcaatacctctggccgcttcatcatcatcaacagggaaaattacactgagctgagcatcactaacctccagatcacagaagaccctggcgagtatgaatgtaatgctaccaactccattggctctgtctccgttgtcaccatcctcagggtacggagccacctggccccactctggcctttcttgggaattctggcagaaatcatcatccttgtggtgatcattgttgtatatgaaaagaggaagaggccagatgaagttcctgacggtaagagcatccctacaaaatagctgtaatgttggggctggtccttgggggtggtttccaagcacccaaagaggactataaggatgttgggatttagtcccaaaaggagagaaggaaaaattcttatactggttcctcattccctacccctaagattagccactttgagctataat

SEQ ID NO: 43384 - DNA, 1725 bp, Bovine  19866880945215
cattcataacttctttgaagaccttttttcattctagcattgtctatcatatcaaaataacctaaaagccaaggaactggctaaataaatcacgctacacctattttagcatggaccactatgcagatgtaaaaaggcatcaggaagctccctgcctactgatgagataagaattcccaatagtactgtgccctaggcatagtatatatgcggcactgtgctacctttgtccaaaaaaaaaagcaaatatatagtcatatttgcttgtaactacataaagaaattctggaaggatatataagaaataaataaacgtatataggtaggccttcactggtggctcagtggtaaagaatcagcttctcaatgcaggagatgcaggcttgatccctgggttgggaagattccctggagaaggtagacaatccactctagtattcctgcctgggaaatctcatggacagaggagcctggcaggctacagtttatggggttgcaagagtcggacacaattcagtgactaaacaacaatatgggtgtaaacactggtcagatgggggacaaggtgggaggaagacattatcactttctatgtttttattacaatttctgaccatgcgattgtattacttgtcctaaatatccagaattaaatgtccttttaaaattctatatgtgtgtatatgggaatgcagtacccaagacagttgggaactggctcagactccaagatttcttctaactctaaagctctcagatcctaagttctgcctcctacaggaagcctcttctgattgcctcaacctacagcaatttctgtctcctacgggccacgccatggaaaagctagaaaggctggctgccctcaccagaagacctgctttccatggaggaccagtcaatcctgggcccagctccttgacaggcacacacacctggatgaccaggatggggagcagaccaggtgcccgatccagggaggaattgaaaaagcttatcctgggagagaggagaaatgcatgcaagtagccaagaggacaggttaacaggatgccactgcatttgcacccagggatatgttctaagagcactgcagagatgggagtggctcaagcctcaagaatgagcaagcttcctgtccctggaggtatgtgcatggtggctggacagtcacaggtcagtggtgctgcagagggaatgaccacatgagagggagtgcaggcgctttccaaccctgaatactatggctctcaggactgtgatggccctgaaatcacatcgatggagcccaggctgctgtgatcactgcctgactcctggcctcattctccattcctctccagaaccctatgtgggggaagggccacatatctggagtggggcgcacagaggggagggtcatctgccatgtctatcaagggcctgcctgccagggaccactgctttatctcctgtccatcgctgggcctaacacctcctggagacctactatgacatcaagacctacgatggcacttaggagcccagagccagccagcccttcctctgccccctcccactgaaggctccagtccaggccctgctgtcattctctcagttgctccctctcctctgtcacctgcagacacggggacagcaagactcagtttcctttccaacagaggggagctcccaacccacccggcctgcaggatggaccacctccccttcaaacctcaagtccat

SEQ ID NO: 43385 - DNA, 997 bp, Bovine  19866880961230
gttccggaagaccccgtggtggccctcgtgggcaccgacgccaccctacgctgctccttctcgaccgagcccggcttcagcctggcacagctcaacctcatctggcagctgacagacaccaaacagctggtgcacagcttcgccgagggccgcgaccagggcagcgcctatgccaaccgcacagcgctcttcccagacctgctggctcagggcaatgcgtccctgaggctacagcgcgtgcgcgtggctgatgagggcagctttacctgcttcgtgagaatccgggacttcggcagcgccacggtcagcctgcaggtggcaggtgagagccgcggaagggggcgccctccccttggcacgcccctcctacttcctgcagccctttacccactgccccagtgctgacccttgtcttcacagccccgggcgctctttccctccactgtgtcccactgcccttgccttacctgacctctgccctctacctctgctcccctccagccccctactcaaaacccagcatgaccctggagcccaacaaggacctgaggcctggggacacggtgaccatcacgtgctccagctaccggggctaccccgaggccgaagtgttgtggcaggatgggcagggtgcgcccttgaccggcaacgtgaccacgtcgcagatggccaacgaacagggcttgttcgacgtgcacagtgtgctgagggtggtgctgggcgctaatggtacctacagctgcctggtgcgcaaccccgtgctgcagcaggacgcccacggctcggtcaccatcacgccccatagaagccccacaggtttttcttttgttttcttaaatgtcccttggggtgggggacaggggcggggagttggtccaatctccagtggtcatagtatctgaatctagctccttaccttcagtctcccagaacagtgagacaccgaataataataacagaaacaggttgcatagagggaaagcttactgtggcagga

SEQ ID NO: 43386 - DNA, 3505 bp, Bovine  19866880980791
tttctgggtaaataggggcttctaagagatttttaaaatagattattcctttaaataggttaggcaccctttgacagcctcatttacattattcctttgctgggaaatcctttttttttttttttttttctgggcatagtgtagaagtcaacttcagcctcagtgtgaattgcattcagagactggatgaatgtggtttgggtacttagtggaggacaggggctgctctgtgccccaggctgggcagggcaaatccagaactactctggggagaaggagatgaatttccagagagcagcaaaggagccagggctttattatggctgtgaaacatttgaggtgcagtcagggatccaggggattcacagcagggagtgtgtaggatttacacaggcagagaaaagagggggcagattcagtgaggcaagagcttgagcaaaggcttataaacaggattgaatatggcccatccaactccccccaccctgtcagtcatctgtggccccttctccctcatcacccatcctccagacagagcaaaatggactcctctcctagcactatcaagcccactccacaaatgtcccacgtctggagtccctggcgcaccttctcttgcggtggtggtggtgttgaatcattaagtcatgtttgactctttttgaccccatggactggagcttaccaggctccttctgttcatgagatttgccaggcaagaatactggagtgggttgccatttccttctctatgggatcttcctgatccaggaattgaacccaagtctcctgcgttggcaggcggattcttttactgccgaaccaccagggaagcccacattcttttgcagggctgacccctatcctcccggctgcattaggtgggtggacactcagaagggcagcctggatggagagaccaaggaaatcagcaccctggccatgcttcccatgtcacaagcccttgacatggtcaaccatggaggctaagctccctctgcaacttggccagcttcgggttctcagaacgtttgctgatgtgcccaccatatagacttcaagccattatgaaagctatagaaataagaagtagcatgttcattcattagcaacaaattatcttagcaaataaggctaaatgtcagttcagtggccagcaaagatacatgttggtcccttcccccagtgccctgagagtgagggtcacattctgcaggcactgtttaggagaggatattgaaacacaagggggcttcccaggttgcgcagcggcagagaaatcacctgccaatgcaggagtcttaggagacatgggttcgatccctgggttggaaagatccccggaagtaggaaatggcaacccactctagtattcttgcctggagaatcccatggacagaggagcctggcaggttacagaccatggggttgcaaagagttcggacacgactgaagactgagcatgcacactgaaacacaagaggcaggaaggaaatgagatagggtgcagactagcaccccaggagcctgacagcctgaattatgggactagtcaggtagactccagatagctaagctttgagaccaagggagggctagaggccagagaccactcaggagggtagtggaaagcagtggtagaggaaagatgctatcctctggccactttggctgcagcaggtctgcagaacagtagaggccacagaatatcctggggcagaagcaagtttgaggcagggaggaaaggaagcaggaagagcgtgaaagctgctttcttgagcctggcacacgcgcacagcccgctgggctgcagtgagcaggacagatggtccttcccttcgtggtgctggagggagggagggaaccaggaccagccgcatgactgtgcacatctggaggcctgggggcaacaagggaaagagagggagaaggggaggcagtcggaggaaaaggagggagccccctgtctcctgtcctcaggctgaaggctgcactgtcatccctggagccccctcttttctcacttccccagagcctgggtgcctggtctgaccaagagtgggaacttagggttcctgctctcctctgggccccacaacagaaggaacaggccctcctcttcacactaaacaagatccctccccttaaccttccttgcacctgtattttctgttcttcctttagtgagaaaacaaacacccttaggtctgattcagtctcattgagaacagctggcttgtctctttcccctggtctcggaagcctctgctctgggctgtctctctgaatcctgttttgcattaacttgtaaggtaggctcaagcccctggggtacacacatcagctatttagcagtgatctcatctagctgcgtcagaacttctagggatggggccaggggaattgctattattaaaacttccttaagtgactctaaggtgcagccagagttaagaaccagtagactgctgtgatgtggagcaggagcgtggtgcccaggattatctattaggggccaaaacatcttgattcatgggcctccatccggaagggataatgaggacacaggtccagaggagggcagtgggggtgaggaaatcatatcagctgagggaggttgaggggagggggcgattttactgctcaggtgctgcagaaaggctggggacaaaggtcaaaccctctgcttctgagggctgggatgtgtgtgccccgtgaggcccagcgttccctgtgctctaacaggcaccacctcattagtgctgagatagtgtcactgtaattacctggaactggtggagccaaatggcaggtcacgaacaccctcagaaacaagtgcagaaaattgaatgtgccctgaggcacctgcatctaagtgagatgctgatgaatgtggccccatccattgtggtcaggtgtgcatgcaggatgcgcctttcagcccaaggcccacccatccatcaagaggcagacacactcacctctaagactggggtcctagaaccatgaagatccctagcacctggggaattgaggcggggcccctacaagttaggtgttgaagggtaaggcagtgcagggtgggtgggggaggaaaaagaggtccacatgcctcatccgctgctgggtcaggctccactgtgagtctgagtgcctggctggggtggcaattcctggcacccttgctgccctgtatagaattgttttgccagtggccctaagtgctcttcactagcacgttcttcctgccatgaggactggctgtaaaggaagcccaaacaagaggtaactctaccaacatttaatatctacagcctatgggcctgtgatgagtatgaggctccatactgtagcagctggagcgcaaggctgcagtatttgtctccaaactgtagaacctgccaaagtctattctagaatagcagtgctaggagatactatgtagccatttagaaagaatgaaggaggtctctgcaaaaagctaggcacaaaatagtatatgagg

SEQ ID NO: 43387 - DNA, 827 bp, Bovine  19866881000247
gaggggatatatataattatgacggttgcacattgttgtatggtgaaaccaacacaacattgtaaagcaattttcctctattaaaaaaaagaaaagaaatgttggttaattaaatattagcaggtgaaaaaaatgataatctctttcattttgctagtgattgtctcagaaatgtgagtcagttttgggtaatgagacataaggataaattaatgaaaggcttctggtaaagattttcttatgcctaagaggaaagaaacacaggaaaacatctaaaattgtgacagtcatcttgctatcagcttgagactaagagatggcagaacacagatatggaaagaacctgggctccagatggtatcatggagttaataaatcaactaattctggaacccccctacacccggactttctgtttccttattgcttaagcccatttctgtttcttataaatgaaataatgttttatatggaaaactacattggatgcttgcccaattttcatcttttttaatgcatgtcagtaatattgttttgttcttctattgccaccttttcatagccatatatccttactttatagatgcagtttgcttgactatcttcgagaacagtaatttaatttttttttaagttctgtttcctaaattaactttgttttctctagggttgaatgtcctatttgttcatcttggttcttctcctccatgctgttggttttcctaatgtctaatgattcttaattatctatttatatttttaattataatttttaattattatatttttaagccaaaaagtgggcttaaaactcaacattcagaaaa

SEQ ID NO: 43388 - DNA, 1895 bp, Bovine  19866881000609
ggacctccgaagcccccctgcctcccccaccattgcaccagatgtggctgcaggggaaaggtgggtgcagggcccagctagcagtggtcacttggtggtcctcttgctgcagagtcagcacattctatgccagcttgccaggcctcctcactcagcacttcctcggcccaatttctagaagcagcagcaggggcctgcgcagttcactgccagctgggctggggcttccacccccaggtccgcacaaaccccatcaagagcctttgccaggggcctaggctcagcagccagggatctcagtgggtggataaggaccagtcccattccaggtgggggacagaaggcagggacacccggagtttgcctcatcctttccccacaaccatagaaacattctgacccacagtgggcctcctggtcctttcctctgcaaagcagtaaggcatcccacggctcatatcctttctcggcttcccaaaccctctgtggttgggtctgaggcctcctcactccctccagattttccagagcctggagttccagcacaggatcaaaagacactggctgtgtcccatgggaagcccaggggaggagcagccccgtccagaacattagattcttaacaaagtcacacactaccagcaagctcttgcagccctataccccagccctccaagaacacttgtgcctggttcctattgccagggactggcaacaagcctcaaccacagggctaggtcttaaaactgtgggtgtgaacccagcccctaggaacagggcctggtgaggagctgcctgccacccgcccctcacctccagatggctcaggcccagcctggtgactcgaagccctcatttgaccccagctctgcatcctttgctgcctgtcgggggtctctctcagaccccggctctgctgcttccaaaggatgtcaggatacctccagctactcaggcaaggccttgtcctgtgtgtgcagagggggaaccagctaggctcctctgggctcagagatccaagagggtcttatcagccactttgggagacacagattggaagagagaaggagggcaaggaagggagtggagaggaggagaggaccggccccaggagtgtgccctgggctgggtataagaaaaggatgcagaagacagatgaaaaagatgaaagggacagagaaaatggggaagaggggaacaccctgggggtgaagccctcccttctctcatcagtccagagggaaaaaaaaaaatagtggccacatgcctggcactgtgctgggtaggtactcttcataatccttttatttcatcctcccaaatataccacgagaaaggtattattactcccaagttatagctgaagactttgaagctctgagagcttaacgggcttccctggggagtgtctgggggccaggccaggaccccaggtctccagtctcagcagagatggctggcagggctacaatcctggccccaggagcttgtgcagaggcccaagctatgttcagagcagagtttattcaaacagagcctaacaggaaacttggctcctctgactcactctgattcgaccttattaagaaaaaagaaagaggagcaggagccagcactgggtagggtttcacgccaaaagctggctcccaggcagaggccggctgagcacaatggcctgtgccccgaactccccacagctccaaagtcccgaggcagccctgtccccctgcctggctcaagaagaagggtctggccttctccgctctgccagtggggctcccgtaccatacggccatcctctctcctccctctgttcctctcttcccttcccctccctgcccgagggtaccctggggcctgtttccactgctcctcctcctcctttcctggcgctg

SEQ ID NO: 43389 - DNA, 842 bp, Bovine  19866881021033
aagcttgcctgacagagactgagagcgtaacagtcagccctgaagcatgctgagggggtgagtggggcatgagccctgccctcagggagtacagactggaggggagcagacacaggtgactatgatgaaatctagtagtgaggcagaagtgtgagcagcttggaatgtcactgccaatcagagaagccttcctggagcaggaggcacctgcctgaacctgaggttcctcaacagtaagaggaaaagggtcatctttggctcagcctaggaccaggagcaagcttcagtgtgtggccaggatcagaatccagtatgtgatcagagtcaaggcgcagtcagaggccgggagcacacccgccccgagtacccgcagcctcttagctggctctttcagcttctctggactgagaggaagggtcgggccagaaagctttgtagagtcatctgtacagtgtttattgaaaccgagcctggagtgggggtggcaggctgcctcatgccaaatgtgggtctcatgcagcttcaggcccagctgacccaccaccacatgttgctgagggaaaggctctttgataatgggaagggagccattcctggccattcacccccttctcccccacccacaagcttctatggaccagagagtgagaaacagcttgattcggaggtggcccttgctttcagggcctgacgctccctggggaaatgactgcaagcattcctaggggcttgagtaacggggccgaggctggccaagacagcccccatcagccaggagccacctcatcctcacccacccttgtgctccgtgcttcctcttcattcctagcaggtagatcaca

SEQ ID NO: 43390 - DNA, 1708 bp, Bovine  19866881147638
cggagcagggtattttgagcatctccggacacaatctagaaaataaaaaactctctgatgcccgaaattctaccattagctcttattttgagtaaaccattgcccttttaaaatgtcatcctttacaattcaaacatcctcagcaaggttaacattacatatggatcaattaatcaaaggttggcccacctatggcaacaatgttacttctctactcaaaaccctttctcatcatgtacaaaatccaaacatgacctcctgtcctgaccaccgggggagcatcaggtcagtgttcagggttcactttagtgggttaccgtgtctctaaggtaccaccaggtgatcctcactgtatcttaaaacagtactctctactgaactgcagtgatttctatgtatttccctattggaactcaggctcctggagacagacataacttagtcctctctctgcccccagtgcctgcctaccaggcactccatgaatagttcagtgaataactaaatacacaaacaaatgtatagtcaaggactctttcagttacagataatagaaacctagctcaaactgacttaagagcaaaaaaagattactcatgtatctgggcagtgtaggtgtgcagcttgctttaggcctagggacttaaatgttgtgttcagggctctgtatccctcctgtgttcacctttgcctctgtgtatttgtttagatcaattctttagattgttgctagttgacagattcattgccaacagccccagaccacatcctccttagcaacctcagcaagaaagagtgctttctgaaagtgccagcagcaaagccctgggaattctctgattgggtatggcttggctcacaggctcatttccaagcctgtcactgagtgggggcagggcaggggttctccaaggagccagatctggtcctcagctgaggcctgaggctgggagtcagccctaccagtaccatatggagtgggttccctgaaggaaattggagccctgttatcagaatgatccagtctagaatgaaagaggggcactctagaataaaggatgtggagcaaagtgtctagtgaaggcagagaaggtctgcccagtatctattttgcttctgtatcaaggacaggaagagaagctattaggaaggaaccagagttcaggccaggaggggaggtgataatctgctttaatgggtttgtcttctggctcctgagattgcctgtcctggtgctgagtgaacctggagatgagatctcagagaagctatcagggatatttcaggacaactgggaaagacagcagggattggatgggagtggggaaggtgtgggttgcagcatttcagtttcccactgtgtacagaatcaatccaggacccctaacccgccataaagaaggctgagcgcccaagaattgacgcttttgaactgtggtgttggagaagactcttgagagtcccttggactgcaaggagatccaactagtcaatcctaaagaaaatcaaccctgaatattcattggaaggaatgatgctaaagctgaagctccaatactttggccacctgatgagaagagctgattcattagaaaagaccctgatgctgggaaagattgagggcaggaggagaaggggacgacagaggatgagatagttggattttgcaataaatggcaacccactccattgttcttgcctggagaat

SEQ ID NO: 43391 - DNA, 658 bp, Bovine  19866881178136
ccagctgcctgcatgaagcacaggacccgcccacccttgagccctgggcagtagcctgttggcccagcagaaagcccgctgggggaagtttggtagaaaaaaaatggaaagtgagagaattgattttttttttttttggctacacagtcataaacacaaactggaagatacatttcttcctttatgggagataatcaaaaacacaatacaagtttatagagggaatgtgtcttacacgggatattttcccccaaacacttggcaacttgaaaccacttcattctagagataagtaatcaagtggaagaggaagggtggtaggaagagagaacccagggttttatgagccagaggccctagtcagttaggaaggggtggctctccctctacgtctcactccactggaggtccagtgccacctgagctgagtccaggggcccagagtcaacctttggcagccaagagcatcatctgggtcattaccataccaattctttcagtgcagcttccctgggcagctcctctatgctgggagccgaggacagacagctcagacctgctcctcactcttgagaaagaagggtatgtaggtaactcaggctgaccacaagcaaaatgaatcaagagtgtgtagacgtcttgtccttcccctcctcct

SEQ ID NO: 43392 - DNA, 1928 bp, Bovine  19866881234212
tccccacaggacactgttcttgctgttctgtaatctttacgagagtctgtagtctggagaataagatagaggaagccaccacagttcaacctaatagtgggtcagtcaggctgggctgtgccagcagcaagtgtatgcagaccagaagatgttctgtgacagaccagagaaagctgagtagtgctgacatccctctagaaaagacttcagacagaaaaacaggctcattcttgtgccctggccaaaaccagaacctgaacccagatgagccatgagttatctctttttttttttttttttaatcaaaacacttacattttctgagtttaagtgccttcttaaattggtattttctgattctgatttaccaagtttttcttccctgtttcaactaagggcaacttggtcccctttagtaagggttatacatgtgtgtgtgtatacgtgtatgtgtgtgtatatatatatatacacagacacacaagatttttttaaaggcccataaaggtgggggaacaagttaagtgctcttagtttctttttattttacaaaagtccgggagactaaatgattcagaactgaaggcttctagaaaaactctcagcaggattccacaagggggcttggtgcacatgaagcagttatggagattacagtctcagtgtaggcatctgcaggagcacacgtcaggagtaatgtctgtcagagggagacattgctccacctgttccttcgaggcaacggagaggcaaagccaccgccagcacacacagtgactggagcaaaaaggatttcaaaaaaaaaataacaaaaaataacaaaaaataacaaaaacggaaacaaaactaaccacaaaccaatgacttatcagccaaaacaataggctagtgacacaccagtgtccacaggattctactactaaaaacaacacactattgaacagtacagagaacgaactaagacttagacacccaagacagctgtgcgctgttatacggtggagttgtacagagatgcatcgggcactgagacacacgagcctggcctggatcctccctcagcgcaaccgcccaacgctctcagcgtcccggccacgccagctcagctacatgctaggaacgaagcactgcagggactggcaggagcagacttagaagtatttttagtgctctggctgtgtacccgaaaacacagaattctaaagcaagatagctgattcaagaataccaccaatctactcccaattttaagaggaaaaaaagcaggggagagggaatcgcgatcgccaagctcatcttttcaaagcgtgacgctgtcagcaccaaccgaagcacttcacaccatgagcttttctttcttcagtaatgcggatgtatgtacaccctggtgcctgattaataacgtcatttcccagcccaacaagccgattaacgtgcaaagggctgcatgaaggggttttagcaagagtggctctggtgtagctgccaccatgcctgcaagtgggagcagctgctgttcacaacagtgtctacatctcacagccccttcatctctctccccaaattcactttcacatttacaaggaacaaagagcctcaagtctcccatttccctaacctgaaccactatctgcagtaccactctctctttacaggtcaaacaaaataacaacttgacctctaacagggaaatcggaagagagggaaagaacagaactacagaaaaaaggtacgaaaattaaagtaaatgaggattaaacagcaaactgaaatccaaattagttgtgaaagtgaatgaagtaaacttgaagaaaagtgttaacattatgaactgtgcatcgtatagactgaagcggagattaaacaaactccaaaagcatgcatatcactcacttaccaccatgttttaagggtttgatgcaattgag

SEQ ID NO: 43393 - DNA, 1026 bp, Bovine  19866881330826
ggcttgagggggccagcaggggcctctgtgtgggcaggctccggggacaggcccccctcctcctctgcggcctcctcctcgccgtccccctcctcgtcgtcacagcacagagcgtggtagagcactttgtcgctgaaccgcaccctttcccgcgtccccggggtccgctggggcagctggcccttcacagggccggcgctgaaggcctcctcactggaggagtccggggtctccacccggggcccgttggggacgggcaggccaccgttcatgagccggtagtctgggccggcccccggccgggtcgactcggggccgtccacggagtctgagggcgtggagatgtccaggaaggagcagaactcccagctgtccgagaggatgtcggccgtcataaagtccaggtggccaaggtcaaaggggccgcccacgcctgccttgtcgctgctggaggtgctgctcacagtggctgtggtccagtcatctggctccagttcaaagtcgaagtccgaggttagtttatcgatttggctcaccacctggccgggcaaggggagaggagtgagcggccagcatcaccaaggtgcgagtgtgccctgtcccagccttggctaatgaccctacaggacacaggtggacttgagttcacaggtttgctcgccctgttgagggccaaagctggaccaaggttaacacagctggttcgggccatccgcctgttttccactcctcagtgcctctgggagagggagggtgccttccagccctgcaccccatccattcacacacatcccctcctgccccaaagccagctgctgttctggggggcagccctagttctcagagttggatcttcctttgattggggaccatttgaaacagggctgagagattccagcaagtccattcagtggcaggatgagaagcccacccaccctcggagaggaaattagatgtgaaaaccgcaaaaagactgcccaggctttctgaaacatcctggaccggcctctgcagcaggtcagaaaa

SEQ ID NO: 43394 - DNA, 1625 bp, Bovine  19866881332271
tctgcccttgacccggctcttaggggcaagtcaaataacctctgagccttgatttccttcctccaaaacaaaagagtgatactagcctttgtgcagcaagatgcaaagctgagatacactgaggcagccaaaatgctatgcgtgtaagaagcattgttactatcacaaatagaattttcttgggaatttcagccagttgatttatttcctgaagggactggaacctccaggaatggcattacccactcccttccctgccctctaaccctggggaaggcagagcctaggggaacgaggagaaacttcacccacggtcccctgccaggacatgggagaaagcctgaggtgagcatgggagcaggtgacttgccgtcacatgtgtatctcaacccctcttgtcacaggagggatctgaggtgaattccagtgtaactgctcacactcagacaagaggcagcaaaaagacccagaacaaagaacacaaaaccacaaaaatgcacatgctgccttggggagcatggaattccccagaaggtgactgggccaggaaggcccctgctcctgtcacccacctgcctgcccaggaggccactcagagcccctgaggcccagcgttgtcatggcaatgcctgcagggcagtgaagagtgaaacctcgggtagtcaatggcaagactcaaggccactcccctggcccagcccctttacttctcaggccaggtttgcccaagatcgctatggtctgtgcccatcttccattcctcagctgacagtcccaccaagaccactgactcttcacaagttattacactcttgggacacaaggtaaactaaggcccagagtgatctggtgctatgctaaagtgccccagcaggcagagcccggcccgtgtgccagccacggaactctgcctggtgcagagctgcctaccaggagttggtcgctgatcttgagcttctccatctggatctctcgaaggggcctcttgagcagggccttggtcatggcattctgggctgtcatgcgtgtggctgtgttcaggtccttcaccgtcatcaccgacagtactgggtcccagatgcggaactggacgtcggcccccacggacagcacagccccatccttagaggccaactgttaggagaggccaggaaagaggggcaggggctgcagggaggccaggcccactgagaccacctaacctgacccacttgcctggccactggctcctcgagaacaaaatggtaaccccaagtgcaggggttcgatatatacagcaaggatgtcctcccagcctccctcctcctttttctggtgtcttccccacccctcagccctgatggctactcgcaggccaaggtactgacatccacaacacacccagcacaagctccccactccctctatccaggggagccgagaagcccctcaccttgcagggaggaacactgaaggctcgtgtcctcagatctaccctctgaaaagagtcgatgaagggcaggagcagaaccataccgggtccttgaggggtgcggatccggcccagtcgaaacacgatcatgcgctcataggtgggcacgatctgctcgtaatagcaagggaaagggtcaaaagcactgagctga

SEQ ID NO: 43395 - DNA, 938 bp, Bovine  19866881370619
tggatcctgcagaaccttgcctgccttctggtcacccagggtgtggcaccgacagtttaatgtcctgattattagacgatcatttcctaggacccagagctgccagctcccgcccccgaggccctcccggcccatccttattccaggccatgctctctgagcttcctgctctccccaccgaggggctgctctggagtcaggccactcgggccaaaacatccctctctctacatatttcacaacccactgaccggttcctgccggacattgtttatcctccagctccaggctcgagagattagggctctttggcattccatttgccttcagctgcttcgtgtgagcaggaggctggggagaaggatttcaaaggagacgaggtttatggaactcacaggaaagaggaagccaagaggaaaacaggtgaggtgtaggcacgcggagggaatgtaacctcagaccctccgctctgggcggccgccaggaaccgctgagcaggagggaacagattccttctaaagcaggaaggatttaggtcagacggtgggagaatttcctggcagctagagtatcgtctgcagaggttgtgagaggtcctgggctcttgcccaaagctggggaatggcctgaatagctcctgaaaaatattttaatctccaagtgtttatggagccatcaaacctgctctcacgggacggttactctaatctccccgtcatccacatggggaaactgagcctaaagaagggccgggacctggaacatgaggcgcagggcgagatggcagatatcgcctgctggactctctcccaccagaaggccccagctgtgtcctgccagggagcaggaagacagtcctcagccttccacaggctggtgtgggggccagccggcagctccaggcccagcccaggtgaggcgggaggacatcagacccc

SEQ ID NO: 43396 - DNA, 3180 bp, Bovine  19866881446601
cacgctgcccttttctgtgcctccaaagccctgcccttgaagagcccagagacaggttaggggagggctggggtcctcaaatgcatgtggtaccatttgagcactgcgcccaagtaacagagaccccctacgatgtgccaagtgtgatattggcattttatgtagatgacctacttatgctcatgagaactctatggcgtaggttttgtcctatccccatttaacagatgaaggcactgaggtgtagggaggttccctgacttgtccatgatccttcggttaggggcggggagcttgcacacaagcccagggatctcactgcggagcccacgctcctatagcccacatcgtgctctcctgagaggcaggtcgtgccctgctctcaacagggcaaggtggggaagagagcacatgagctcctcagtgcttgcagggcagggttcctgtgggtggggtacttggcaaaggctcctaggggagagaggatcctcctcaagggcacaccctgagcagacccatgcctggggcctgctcccaggcagggccccacagagcctctgctctctcttaaaggctgaatgaaagaacacgacgtggatctaccattggcccttccagggtgtgtagttcgctcagagatgaagagcaagggcattaccaggaaggggaacagcataagctaaggcctgcaggtgagggtgactgctggggccttcctagagaggaagagaaggcctgacttggtgcggaggggtgctcaagacccgcaggccaggatcaagttgaactggttaggctgaggccaagggaaacgctggcagtcaggccactgagccagccgagtagcaacctctgctttggcctgacttgagtccatagacctgagaatctgggaatagctgggctaacagagcctttccagattaggtggcccaacacatcttgtgctcctgggaaataggaggcccagggagggaagggcagcttgcaggcctccctacctccttctgctggtgtgtggcggtcccaggggaacagcaggcaggaaacactgtctgaggtttccaaccatccaggaggaagcctgaaaagataaatccttggcagagaggcataaactaaggcctagaaaggacagaggcagacctcctggcccctgactgcctgctttggccccttgcaggccagactctttttttcagtccacatcttggctcagcagccctggcaccagggatgacctccctgttcctttctgtctctccaaatgtcccttggattggctggacctttatctgtggttggacgcagccccaggctctactttctccaagaattctcccaagatcgccaccacctgccaacttctcacttccttgagtggcttttagcctgagtctgttctactgaaaggaatgggacggtgtgaaatcaggatttcttcctctgtccttccacaggcctgtgttcctcccctgctatgccctgaactccctgaggtgatgagtttatcataggctgatcttcttcctcccctatcccctcagagcagtcatgctggagaggagaaggccatcaagccctggtctgcaggaaaagccaaagcagggcccctcgcctccatcccatcctgcctgccctcgtcacctgcatggcagagagatggcctctgctcctgcagtgggaccactaggctttaggcatgagattaggtgatgttaacctccacttcactcactccccagaccagccccctccccagcccttcatggatcacttcagggtcagacaggcatatgtggctattagcccagagtctgtaacagaaccctactggggctcatccagtttctctcacatgcctccagtgataggctgctcactacttgtagcatcactccatatctcgcctgggctggtcagcatctatgtctctttaagtcagcaatgcccggtgccagagattctgacaccaggtccaaagcggagcagaataaaggctggacaactcattgtgggcacatagaaacaggacaagcctttgctctccaccctggctgttgagtcttttgtctgggtagcatcgcatcacccatctgccctccctccctccttgctctgtgtgattttcttctccttctccccccacttccttgtatctaaggattgcatgagtcacttcactttgagctgccagatgtcgaatgcagttgggctgagtggaagccaattttttccctttactcaaagacagtccagggctgatggaagcccccaacatcgtcatcctggattttttacatcctggattttttacaagggttggcatggttgtgcaagctagcgctacatctccagggttctgaccagtgcctcctccattgccagcttggattctcctgctggcccggggcagggggccaggccagcctgtgctgtctagggcacactcagggccagcgccctcccccagcccctcaggcacagctgatctgagaggagtcagggcccgggccccacccctgctcccaccagggagttttcagcaagagcctcctatgcaccagctccgtgctggtgctgtgggggagacaggaagaaataaagcaggccctcgccttcaaggaattggcagtctgtttagggagacaaaattcatacaaacagtggttcatgtttttcagtctgggttgtgcctctttcttccacacgatctcatttaattctcacagctcttcagcgtggtggtattatcctcacttgacagacaggaagaacggggctggggaggttaagtgactcatccaaggtcacacgggtggtgctggtggtggtggagctgaacctcagcctcttccatccattgggcccccgtcctcactatgtggtcaggttggaggggacacagggacaagttgccagacaagaggcccactgtcctctttcccacagctgagactgagctctgctccttttctttgggttttttttcatatttatttatttagttttggctgctgtcgggtctcagctgcgatactcgggatcttcctggcagtgcacactctctagctgtggtgtgcgaagtccagagtgcatgggttctggacttcgtggcacgcaggctctctagctgtggtgcccaggctttgttgccccgtggcatgtggaatcttagtt

SEQ ID NO: 43397 - DNA, 767 bp, Bovine  19866881542155
atcctgcctatctctctctgtccattcatccatgcatctctcccaggcattcccccaccttcatttcaccccctccttctggctattacatctctcattgctccggtccatctgcccagtgagcctagtacaaggcagagccatgctgagcagctactcagggcagggagggcagggtcaggacaaagcacagaggaaggaggccccaggctgctgaagtgggcatggggtggctctctgaggagtgcacagcaccccaacctctgctcctgtcccctctcctagggcctgagcccaggctgctatgacacatacaacgcagacatcgattgccagtggattgacatcaccgacgtacagcccgggaactacatcctcaaggtagggccccctggaggcactcctccagcctgatgtcctcacccctgacataagctgcacattctggtgtacaccctctgggtgttagatctcacaggcagtcacgagcactctaaatggggcaatcacggtagacttcctgcaggaggggacctgagttgggtctaggaggctgggtggattctgggtcaagtgaacagaatgaaagagttaagtctgtgtgggaagcagtatttgaagctggaacccagggtgtaggggaaaggggaggccagtatctccagactaaggctcctccttcacactcctgttgctctgcaaccaatgatgtcccctgaggtctgcacttcgcatctgaaggtcttagtctcaagcagacacagcct

SEQ ID NO: 43398 - DNA, 1289 bp, Bovine  19866881649255
cttgaaccctagtcccttctgcccttcaggccccttgtggggaatgggcagttgtcagtctctttgttcagctctgtcctcctccaatacagatcatcaggcagattgagcttgaggagaatccaagtcaagcctagaagccaccccaagatcgcaggccacctggccttttcaggcagatttaaggtatctgattggttgtcacatggttgcctggtatagcccctataggtaactgcaccagtccagtcaaactgttcttgggaaaagccatgggaacaggtcaccctttggttcccttggttggccccttcagaaggttttcaaggttcctggtgaagcaggcccctgccatttggcatttttgtctgtctcacaaagaatggtggagagcatctgacgcatcaccacccccagttaaacaaatagctaagcagtactgcctggcgtccttgcccaaggtggcactctcgggctggcccacggtcagagaagggagtgaacaatagcagcagaactacagccaattgttaggcattggaaagaaggagagtcttagattgatagacatacttagagtcagaaaaggttatggaagtttttatgttttttgttatggatattccatttctaactctgtgattgtaattggtgggggagactactgattaagacttggacccatagtacttcagattcctaactagctccgcagctccatcctccagccctataacatcaccagcaaaaacaaataattgaccagccaaccatgatcaccacttgcctgtcactgattggactgaaagagtgtgcccctaggctcagtggaggccagctttgggtgacggggaggatgtcaaccccagtctggctcttttgggcccatgctgtgtactggagtgctgtgccctgccccagagagctgtctgtgttcttgtggctggccagcaggatgcactgcctgccatgtgtgtcagtggagagtgctaagggaggtctggtgctcccttagaaagagtgcagccctgaaggcatgccagtggcttcaggttctctggaaggacatgtctgagagcagcagccacctctccttttcctctttgctcagcagctcctcagtctctttgcttgcactcggtagagggaggattgtagtgaggttggtgacaaggtgttttgttgaaactaacagtgtatttggatttccatccaagtgtacatttagcaatgaactagatggaggaatgggatggactcagctggaagcagacgggcctttgtaaatt

SEQ ID NO: 43399 - DNA, 790 bp, Bovine  19866881701796
cttttaaattagagctaatagtcattattccctagccctgcctttgagttattggttgagtacaagactggaaccgctgctgtttattctgagctgaatgcttactctgatgctgttgtttgaggcacatttctggtgagtacagagtaacttgaacactggccaagggaaggaagggagagggaagcagaaccatccaatgaagaattatttgcttttcatgtgtaagatactagggtagcaagtttattttcttgtctttagatatcactgcttcttgaaggagaaaaaggcaagatgtcttgtcctgtgttggcaactacttttgaagtaattttcaatccatagattgaatgaaaatgtgaaatttaaattagggtttttcaattttataagtttaacaggttggaagctattgtggaccatgtggaaaaaaatagctaagcagctccagcattgaaattatattaatcctgaatctcaaataattcatcaagaaagatgaaataaatggctttaatgcaaaccagaaagggctgctacctggaaaagagcaagtataaagaggtttcaagtaacgtgcagtgaaatgtcattgaattactcttagacaaataagatagtgatcacgtatcaaaattatggtttctattttcttactaggattgaagtccaaataattatcaacacattccaaccacatttaggaaaagatgcagatagttatacgctgatggtaacataagacaggagaaaaacctgaaggagctaaatttaagaaaagggagca

SEQ ID NO: 43400 - DNA, 2415 bp, Bovine  19866880168434
ttgaagaaccagaggaatgacagggagcgagaatctgagagactgacgaaaagggtctttcagacttagagaccttgtgatcctttttatgttggagaacagttccctttcttctgcatatttgtttatgtttagtcttgttattgctcactgtagtctattttaaaagaaatgtctttagagcagaactgtggctcagagcatccagtgggagaactttatagccaattgatggtcatgctgtctccaacccagtaggactgtgctgaccccacccattcctttgatgtcctgaggacctcctgtactgtcagagagcccagcctttgatgtgggagttgtctttatccaggaaaccaacatactatttttatttagtgtgcatgtgtgctcactcagtcatgtctgactctttaccaccccatggactatgctcctctaggctcctctgtccatggaattttccagacaaaaatcctggagtgggttgccatttcctactccaggggatcttcctaacccaggggtcaaatccacgtctcctgcattggtaggcggattctttaccactgtgccacctggaaagctttatttttatttgcttatttatttttggctacactgggtccttgttgctgcatgcaggctttctctagttgtagtgagtccaggctactctgcagtaagctgtgcgtaggctgctcatcgcagtggtttctgttgtggagcttgggctctaggatgcgtggacttcaggagttgtggtgtgtgggctcagtagttgcagctcaagggatctagagctcaagctcagtagttgtaacacatgggtttagctggcccatggcatgtggagtcttcccagaccagggattgaacccgtgtcacctgcattgcaaggtggattcttaaccactagacctccagggaagtctggcaacacactttaaattgaacttggctgttgttgaggtcagcagcatttcaatatctgagaaaaaccatagaggaacttctagatttctgctgaaatgttgagaggatggactttgtcttggacatgcacttctccttcttccccttgatagtagggaacacagacctgggtttgaattttgactgtgccaactggctgtgagatcatgagtgatcatgataatatggacagttgatgcctaatgagtagttagtgtgtgccaagcactgttctgaacttaacacgcatcaactcatttaaccctcataacagcataacgcgaagtagattcctgttattcacattttaccaatgagaaatctgaggcacattaagtagcttggctattacagccagcaaatggccgagctgggatttgaactcagttaggctccagaatcggagaaggcgacggcacccccactccagtactcttgcctggaaaatcccatggatggaggagcctggtaggctgcagtccatggggtcgctcagagttggacaggactgagtgacttcactttcacttttcaccttcatgcactggagaaggaaatggcaacccactccagtgttcttgcctggagaatcccagggacaggggagcctaatgagctgctgtctctggggtggcacagagtcggacacaactgaagcgactcagcagcagcagcagcagcagaattggctatccttgacataagaacacctaagcctttttgtcagtttcagatttgtaaggaaatatgactttattcaatctcctcattttgtctgggaaaactgaggctcagagaagttgtgtgatttgcccaaggtcacctgtttagttagtgagacaatgatatttctgctccagcaggccatctccctcagcttaaagcatgacagtttctggtctctttaattccttccttcactggttttgtttcaagttgaataattttgagtcaattttaaaaatcggatttaagtgtaattttcatgcagtaaagttaacgaattttaagtgtatcttttggtaaatttggccaatggatacagttgtatcaacaccaccacaaccgaaactcagttactccaaaaagtcccctcacatccccttatttttagcctggctactggcagtcacttttctttctctcactgtagttttgcctgtttcaaaatttcatagaactggtttgcagcatttagttttatgtctggcttttttcacctatgttgtatatatctgcagtttttttctttttctttttgctagttactactatcctattttataaatataccataatttgtttattcaccagccgatgaacacaatagtttccaactctggtctttaggaataaacttttaaacacatccatgtgcaagtctttgggtggttaaatgcttttagttcttttcaataaaaacaggtagggaatagagga

SEQ ID NO: 43401 - DNA, 2564 bp, Bovine  19866880505616
ggggtggggggagctctgagacgctaaagcaggagagtgacgggatctgatttgtgcttttcagattccgttctggcccccatggggagagaatggattggagccagtggcagggaaagcagggagcctggtggggagactggtgccggtgccggatctggaggagacccagggggtcacagcggggaggagggtggcttctggatggtgagaagtgggtggagggggtagatgctggagatgggccctgcggtaggaagactgagtctgggttgggggaagtcagtctggcctgagtggccttgttttctgagatgggattgtgggccaagcagaagtgtgatggtcctcatttggacttcctgggtgtgaggtgtcaaggagcctttcactggagcatcatttcctcgggctctgttgggacctcctgcatgtctctagactctcgaaatgacttcacgtgtcttattacacttgttccaagctcaaaggctttgccctaatacattggatcatcccatttgccaagtccatttttcagatgaggaaactgaggggctcttacctcacctccgtctctgaactgtacactgcctccctctaaacccctggcatccacattgagaagagggtgtaagaattgcagtgatacttcaaaggaaggtggcaggaaaactcggggagcccggcaccatctcctgctgacgcctgggggtatgtgtgtgtgtgcaggagcatgcgcgtgcgtcaggcccattaacaaacagagaaataaattaacgagtattcaacccaccaaatgttccttctgttctgtataatagagcacgggaacataattttcccctggagcaaattgctacagctgaacctgctcctcgttttcctccaaaaactgcttaaaattctggaacgcttgttgatttcgggtcctttccctttctgcctcctgtccccaacccccaggctgcttccttccaccttccttgtgccaggcctcagaggagccagactgtcactgagccaaagtccctgccctgcagatgagaggatcctgggggtcagtagctcagtcagggggtggcttgtgtatggggtgggggggcttttgggatgctgaataaaacatccagggctggcagaagggaccagctccccattgagccctgccacaggtgtgctgtgtgaccttgggcaagtcactgccctttctgggcttcagtttctcctgattataatggggttgaatgggcctgctattccacggaccacatcttgaggtgtacagagtgctgtgtaagtgggaggcacatccttctgaggattccttgtgcagagaatggttaagtaagtgttagtcactgagctgtgtctgactctttgtgaccctatgggctataacccaccaggcttctctgtccatgggattctccaggtaagaatgctggagtgggttgccattcccttctccaggggatcttcctgatccagggatcgaaccaatgtctcctgagtctcctgaattggcaggtagattctttaccatctaagccaccagggaaaggcatgcgtgcccctccttcttccccacttccaggcccttctgtggagcctctggattcagggactttgtcctgcttctgaaatcctctagggcacttctaattttcttaaagcaaattaattttaatctactttaattaagcatgtcttataaaaatgtatattcatttgtagctcttctctttctctctctgcatatcctgtcattcagagcccaacacaggtctccacttataggtagcccccataggggtgggagcctgagttgggggaggccctggcatgttgactcctggttggcccagaccaggctgagttacctttgacgggagcagaatagggatgtggggatccagtgcttaggaaccttaatattctgacctcctaacccgtcttgaggggtctggttgtactttatggaagctgcaaagttccatcaatcccacagctatctctgtgctcctcggcagaggaatgaaaccccgaagaagctgctgagactttgcagacccgatgaaggagggccttggctggggtccactgtgtgaccccaggtccagccagccagaatctgacttgtcttcaagccctaggatggccccaaaccttgtctcctccaggaagctctccttgactttgctctttgtcttagtctgcttgatgactctaacaaaagactgggtggctatgatgtagactggctggcttaaaccacagaaatgtattttcttctggttctgaggctgaaagtctgagatcaggatgccagcatggtcagattctggtgagagctcccttgctggcttgcagtggctgccttctcactgtgtactcacaaggcagagggagtgaggagggagcgtggagagggggagagacgggagggaggggttcctggtgcctcttcctttaaggtggtggtggtttagggctaagtcctatcgactcttgcgatcccaggacagaggagccggcaggccacggtccatggattctccagg

SEQ ID NO: 43402 - DNA, 2033 bp, Bovine  19866880560336
tagtgagaagcgggccgggttccctgatcccagtgtcatctgccccaggccctgaagggtctcagcacctcttctactatgaaaagggaacaggcaaggatgagatgtgtggagcggcacctatgatctaggaccttttctctaaacaattccataacgcagttacagatctgagactaaggcctgagtcctggcactgccactctgtgcatctcacttgacctctctgagcctcagttttctcatctgcgtaatggggataataacaggacccatctcccaggactgttctgtgggtgaataagatcttgttttaaaaaatatgagatggtgaagatgatacaaagaccccatctcttgtaagtgaggaagcaggaaaggttgtgggagttgtctgggtcctacactggaaagtgggaagctaggaccaaatgcagacttgtgtgactcagaatccaagctcgtgcccattgctggtcagccctgggctgggagcggggagtggcgcacagggggcctgtctgccatctgtgcatcagtggtcgtgttcccttgctccccaggtgaagtgacttaggcactccccacaacccggttcccacaggttcagcacagagatactttaggaggcggggagcactagccaaggagaacaactcaactcccacttccccctcccaccatgcctgaggctagggagctggggaagaggcagtggcccaagccccagacaggtaaactgaggcagcctaagagcaagtctacgcagagactccccagggtggtctaaggtggaggaacgggcaggtctgagactcaggaagtctgagaagaggaggtggcccccacagcaggggaggaggaataccacttagcaagcacacccttgtccacccccaacacatacacacacacgcgtgcgtgcactccagccaagggcacagagcagggggaggcggcaggactccaaaggccctggggtggggtatctaaggacagattcagggagcacccactcccactcagacagccttctggggttggaaggtcatcagtgaaggtctagagacctagaggtaaggccaccctgctgagatcctgcttaggtccagcaagtgagggacatggcagccagagccaaggtgccttcagctggcggctggtgcacattaagaattattcctctcaccagcaaacaatttgttacaatatccattgcgcgcttttcccagctgggtgccctcccatacatcctggattaatcccagaagtcactccattcattgaggacatgcctgagtgtgcctcctcttttatcagggaaatttttcattgttttgaagcactcataggttttaatttggggttgagattttaaagcctccttcagtggtgaagacgtatgaggcagcttgtggctggaaagattacctctgacctccaacctgaaagggcccagaaggggccaacagaccctctagaggaggggaacagagaacctcctctccaaagagccagagactgaaggcctcagtgtggcatgagacacacccttgacctctctgagcctccccaagagaggcaaagtcgaggaggactgcatatttgagcgaccctctactgagcacattcaggagagtctgggagatgcttgcctttaaatcctgcagacctgggggggagtggggccacattgaaagctaaaagttgggagttccgatcctaaacgacctgggacaggtgaatcattatcctctctgactaggatgagctcagtgccaccgcaggctgctgtgcaagcccaagttcaagagtgggtctaactgagggcctggcacatagtgggtactcagtaagagtgactctcctggttgggccttccccggaggtccagtagttaagactccaagattccaacacaaggagcgcaggtttgatctttggttggcaaactaagatcccacatgctgcatggggtggccaaactgaaaaaaagagtgactctcctggccttcccagcccaccacagatcc

SEQ ID NO: 43403 - DNA, 1633 bp, Bovine  19866880576740
tgcaaagtccttctgggtactgaaggcaccacatacaccccacccccccatcctacctagggcgtggctgaggcagagagggctggggtggggacccccggagacccagtgagggaaggggggcgagagagaagtccttcatccaaaccagagggctggagtttctggcactgtgaggggctgtggagcaactagccatctgcattccaacctggtctttctctggccttggcctcagctcccagtccctgtagagggaccctctgagcctgggtctccctgccctgtcctgggacccaggcaccagcatcctgtccttccttgcagcctgacaagctccggaggatcttcttcacagacaagaagcacaaaccctgaggaggtctggcttccagcagcccaccagcgggtttcctgggcctggggccacaccagaggttattgggaagctctcagcttgcttgaaggcaccccttggaccctcaaacccaaccagcctgctctgaaaccaggctccaagacagcctaggtgcccaccagcgacagggtgggaggggaccttccagtctcctgctgctcaggactgagtcccactccccaccccagggcctcccacccatccagaggaagtcacagcctgagaggaggggggaccagccaaaggcaggggtgagcaccccctgcttccaagatgagcaggctgggggggtcctggacgattgatggagctggcctcccaccactgaacacttactgagcatgggacaggccctgtggcatggctggcattttcttagctgagtgatgtcatacagttgctccagagaccaaaaccagtccccctcactgtggccctagcagagagcatagggtgggaagtagcagtagagtgccacctcagaggggatggttctgaccctggggcagctgagctcctgggggccatcccctctgcccctctccacccccacctttatgcaggcctcataatgcaagctaagcagaccctgatctgacccttttgctgcagatgagtgggaggggtggggggcggggagggacagagacccagagaggagcagcaacctgcctgaggctgcacagtcagtcagcctgggcactgctgggcagtttctggagtcagccagtgggtgcttgctggcctccctatatgaccaggtcaccctcatctatgctctgcctccagccagtgatggcctttatgggtggctctcagacccctcctaacacaggcccaaacctggctggctgcctgggctcagcctgggcactgctgggcggtttctggagccagccagtgggcgcccaccggccatccctatgtaactggtcaccatggacctaggcccatgcctgatacaaatgttcactggaatggttctcactatgagggacgtggagatgatttttcacccaacatcggctcttcgcggagctccctaggatctggggcacagatatgtctcctcccaaggacacaggtactgaaataaagttggtgccgaagctgggaaggcagcacttaacctcaagaggtgaggtgctcatggggagatttcaaggagaaaagggatcaacaaacctttcctaacctcggcagacacagagaaca

SEQ ID NO: 43404 - DNA, 1595 bp, Bovine  19866880626708
cttgatggagtctgctacacagatacatgggaagtgccctccaggtagaagaaacagcacaggtgaagaaagagttgatagttgggttgcaaagcagtcagaagggtgttcacgttccctctatgagcctgcgtggctcggtcctctggacatgttgctgggctgtgggtagcagtagtgccttttgccaaggattagaatcaaattgttccctgctctttgaagccaggcgtggggcttttctctgagggccttctgagtctcctgacctccttgtctggctagaggccagaggcaacatggtgcagtttagaaaatgtgggtcttagcatcaaccaggccctggtcagcatcccagcttcccctccaagcagacgtctgaccttgattcagtcacttggcctgtctgggccttggtttctttagctctagagagaacacgaagtccactgtggggcaaagctaggagggccatttggcctgggtctcacgttcccaggaagcctcagatttggacattccaagtgtctcaggctaagtctgtgcttgccgtcatgctgggggtttgtgcagatggtgaatgtgggtttgttgaacgtggtgtctagaggtgccttgtgggtgagtcccccttggtcccggtcggctgaagaccaggatccagcgtccccagagggtgcatggggaggtgtctggtgtgagagtggagataaacccacccgctccctgcagacttcaacacagacaacttcatctgcaaggaggacctgcagctgacgctggcccggctcaccaagtcggagctggacgaggacgaagtggtactggtgtgtgacaaggtcatcgaggaggccgatctcgacggtgacggcaagctgggctttgcagactttgaggacatgattgccaaggccccggacttcctcaggtgcggctccaaggggctggcttgggtggggtgggccttaataggggccgcagctggaagaccccacgaggctaagggccctcgatgctcctagagcggtggtgccgcaggccccgtgcggcccaggaggcaggccaggctccaggcccggctgccctcagcgtgtgcctggtgagcccgctgtccccagcagggccagactctcgggggaagggtaagacctgggggccctttggttgggtggggttggacacgaaggcacggctggccctccaggccttcacgtggattattcatgaactctgcgtcctcctggagggactgtccagggttggacatggggcctggttggctttctgcaaggacctttacccacccagtccagagctgctcaccctctcttggtctttccttctttccagcactttccacatccggatctgaggacagtgaccagaagccgaccatccggcccggtccccgcacgagtgtgacctccaagctccccaggagcggagccgtggcctctggggtttacacccacgaacacttctttggccctttcagcaaaaaaaaaaagaaaaaaaccttaaccagggaagggggggatgtgaggagcacggcccttcctagtccccctgtgggccctccccaggccctccctctg

SEQ ID NO: 43405 - DNA, 1873 bp, Bovine  19866880679992
gggggcggtctagtcatccagaacaaatctgaggtggggatgggagcacccactggcataggctgcgtccccatagaccttaaaggggtcactttccatcttggtgcctcagtttcttcatccatcaatgggaatattgtgaagaccaagtcaaggtacttatgatctaaaaacgccatagaggtgtgagggtctcggtgttttcctgcagggtatcctcagggaagtcttctattcccctgaccacacagggcctccagtggaccctgaaccacagagaggtccgatcaagtcttcagaggagaagaaagactggagagaggataaggagagccagcaaggggtgagaggctgccctaagggacagagagaaggatgaagaggagaagaaaggcagccataggtgtctatgagcaagagctgcctggaaatgcccagaaccccccaccctgcacaggcctcagggcacagggcccctggtaagaagcccaaccttcagctcgttagccaagacctgctcattaatcaccacgggccgcctctccttgccttggctgtgtcaggccataataatatatgaagaacattcatttattcaccatcttcccactcagggaaagatatatgacattgtaggaatggatttatcctgacacccagctttcagcaaagtgaggctaatttaaacatttaagtcaacagctcacccctcccgttgtctcccaatttcttttttaatggtgggaggtgaagaaggggaaggaggttgaaaatgcacaagcctgcgtggttggaggattaaaggcaatggagggagaggaaagggaatctcggccagctttccctctggcctctctcccaccacccatcctggccccacccctgaaaattaaaaaaccagggcaacaagtgggtgtggaggagcgagcaccaaacttggggtccagagtcctgctccatctctaactcactgcaccctgataagcccgtctccagcctctatgcccttgtctgtagagcagcaggttgaacaaactagactctgcctaggtcatctccagcttctggagctgggttcctttgtccacttctgggcatctcctcacccctgtggtccacctgcatgctcctgggatacagaggggaagcaggactaggccctgcctagagatccatcaggaagggacaagacggctgctgtgctagggagagtcagctgaacctaagggagttcggagcaggctgagcagtcagggcgcacttcatggaagaggcaaggcttacattcaggacaagggagcagccaggtctccatctgtttaagagcaccgcctccaggggtagatgtgtacgtgtgctaggtcacttcagtcatgtccgactatgctaccccatggactataacccaccaggatcctctgttcatgggactctccaggcaagaatactggagtgggttgccatgccctcctccaggggatcttcccaatccagggactgaaccctacatctcttgatgtctcctgcattggcaggcaggttctttaccactagcaccacctggaaagcccccgaggctagatgcttggactcaaatccctcctccgtggctttagcaggctgctgaccctctcaatgcctcagttttctcgtctgaaatctgatgacgagagtgcctaccccacagcattcttgagaggatcagatggggccaccatccatgggaaacccctggtaccatgctcagcacagaggaagtgccgaagcaacaccatcatcaggggtgggccaagaggagaggaagaaacagctgggtgaggtcggtctggcccgagtctccccacttcagcccaggcccatctgggcatggtat

SEQ ID NO: 43406 - DNA, 1423 bp, Bovine  19866880749753
catgggttgcaaagagtcggataccactgaagcaacttagcatgcacacatggtcagacaccagctttacacagcctgtgtgcttgcctggtgtccagtacaggcaagcttggtgccagaaggtctgtcctgcctgtccatgtgagtccctgcccctcgagcctctcaggaacccagtgaccagaaggaagtgggcaacccaggaggaagtggctgctgtttactgaaaagaggaaatttgggcaatgaacttgctcccacatggccagcctctgggcaaaccccgggggaacacagagctagtgactcatcctagtcaagtttccctagcagggaacagggtgaaaggcctctaaggagcacccagccacccaccgcctttttaattcccagaccccagggtatggaattggctaagacccaaacctgccacagaagcagcccgcagtcctgtggggagcccagagagaaagtagaccttaccacctgatatgctgtgtgtcctttggcatgtctgtgccctctatgggctacaatttcccatctgttccacgagggactggatggcaaagtgatctgtaagggccctgcccacctgctctgaaatgtatcagtggcataaggcacagctgtgagggcctttggtcattctccctacaggtccccagaccagcagaggctctgttttgttttttgagccttcatgctcaaaggcctcttgattcttctagctattacaacagacctgacccttgcttttaggactctgtcttatcctgcaagcttggccgcccgctctggttagtgcaagcctgaccacttcgcctctcccctggccctgctggagaagctgtcctgacacaaagggcacacatggaggccttctgtgcctgaggcagagaggaccggcagagatggctccactgcttggggctgggggacacagtgcaactttggtggggctttgttcaacccagagcacatctggaggaagttggcctcgatggggaggaaattggagttcatgggtcaaggctggggtactgcagctgtgaatgggctgagcaccagagcgtgtgagaaggaacagggagaggcagaccatcttcagagtggggctgaattgaccactgggagacgccaccgccaccacccattgagagtgctggctgagtgctttcatacagctcagcgccacgccacctgccctgatagagggtcagtggagaaatggatgaggcgctggaagcagtggcagtgggggagggggctcccaaataaaggaggggctgtatgacattgggtggatctcccagccaccctgtgcctcagtttcctcatctgtagaacgggacataatgaccactttacctcctagagctgttacgaggcttaaacgagataaatgcaaaagtgtttggca

SEQ ID NO: 43407 - DNA, 1233 bp, Bovine  19866880752579
cagctgggcagtgcgatgccctgtcggtcctcactcctgtttggtctcctgagcgtctcccagccactcccctctcccgcagggtatcccccagcccctcaaatcaatggcatccaccttggaactctccatcggctcccccacccaaatgccctcccccatgtgtgcctcccagccccgcatgctggacactcagctccctggctcaggtcagaagtttcaggaggcggttggtggccccacgagactgctcccctcaatgggcccgggcagcagggctggtggctgtgcctgtgcggctctgagcgaggaaggaaggagcccaaggcccatacagccgactgtatgcgtgttttccttccacaggactgcaccttcttcaataagaaggacatcctcaagtaagtgtggctcttgttcacctctctaggggtaggggtggggccggccaccctgggggtggggggtgcagggcggtggggtgtgcaaggggccgcccaaagctggagataagcttttccgcctccatcagcagcctagtgtgggctgctgtatgaactcaggaactggcccacatccttctgccaggaatcaaacgtctaccgagtgcgtgccaggctccatggtgggtggtttcaggaacattttcatttaatcctcactgtgcccttgtaacaggagaatccttttatcctcactttacagatggggctgagcagcttggctaaagtcgcccagccagggactgaagacctggcctctgactctaggctgctcgctatttcactgcccccctgaaacctatctgactaggaggtccctgtcattagacagggatccctaagagcccccacgctcaggctctgatgtccttccattcctgggaggtccagaagtcaggagcatggcaggatgccctcactgcctttgagctgtccactgagaatctctttccaggacagtccctttctttgggggtggggtgggcctagacaggagagatgaaggttgttggcagcctcagagctccaggaccagatggagggcaggactcatagaatgccaggaaacctggtcccacaggccttaccgggcccccctccctggactgttaggtggcactaaaagccagcatggtctcaggaccgctttccctggaggtcaatgggcaggctgggctcgatcctgtctacactacccaagggagatgggtctatcattgccagaccattc

SEQ ID NO: 43408 - DNA, 788 bp, Bovine  19866881071373
tcttggagcagtatcaagtatttgctttctatctggcagagcttggcttccaggctagaatactgcagagaatgtgatagttacctccgtccagacagacacacgggaagagcaatcctcaagtacctcaagcaatcaacgaatgacaagcccagaaccaccaggaagtgagccagagagggactatatcccaggcagagatgaatttatgccacaggccacttgtcttatctaaacggtccactgggccccctcttccctctgggggaagtactggtaataaagtaataagcagagaagtactggtaataaggcttctgcgtgtcaacacacgagttctggacagcgttgaggtgaacagcagaaaccaggccacacactcattactgaggtccagctgagcacagcttggcacacaggccccaggcagccaccttatggtatttcaatactttcctaggatgctgtgacccagcaccagctcccatctgctaccttttcagacaaatcaacacatcccttgaaaacatgcaggaacaaggcctgggaagatgctctgaggactgttcaaaaggtatatgaggcatttaatagctgctgacacagtgtcactgaatttcatttgattatcactggaatatctgtgatgtctgtacactttgcaaagccctctttgaaagtgaagtgaaagtgaaagtcgctcagtcgtgtcctactctttgggaccccatggcctatacattgcatggaattctccaggccagactcctgcagtgggtagcttttcc

SEQ ID NO: 43409 - DNA, 1426 bp, Bovine  19866881267982
cagcatcagcatcacctgggagcttcttggaaatgctgattctcaggccccatcctggccctgctgaaatcagaaactctgggggtggggcccagcacattgcattttgacaagccctccaggcaactctgattcaccgactggtattgatggggaagtcaaggcctagtgaggggagtgggcctgcccagggttgtggggtgacaaagctgagatgaccaggtcaaggtcccacttagaggtgaaagacagggcttgggtgctccctctggccaccacatctgaccccaggagggagaatctgaggctcaatcctatgtgtccaggggccagagaacccacaggtacaggtaggaggggacagctgctctctgcttatgtgcgcatccctcagggcccacgtggagctcgggtctgcagcaggaaccccctgggataactccgtctgtcctgaggcccctccccagggctgcagcagagtacctgacttacggaaaagggcgttcttaactctatgcagtgagtctggcacccctgggctgcccagtctcccgctccctgtgtcctgggctgcgggcagaggcttggtggggttgatcgccagacgggtcctatgggtgaagagtctgcaggcctccatctgactgtgctctcaccccttctctgctgtctctctgcagatgtccctctgaagagtccctgagcctgcttgcaccccctagaggtaagcagtggacgtctggggtggtgggtgaggagaagaccggagggtgaaatgtgtgaggggcaggttccaggggcctcgtctccctctgcttggccctctctgccatcttttctttctttctttctcctcttctgtctcccagagcccctgccctcctccagccatgaccctgggggtacttctgagttgcagaaagcagaaggggtttgggatcagctttcagggaagaaaagaggagagtggttcctaggtcggatggggtgaggcttactgatgctggggagcagctgctggggtttgggagcttctggcctaggaaccagtcaggagtggggctcagggaccctggaggtccctcactgagcagggggcagagctgtgggcctgcctgtgggggacaagctcagggcatgagttaggtggtcgagctcaggctttgggggcctggctgtgctctgcaatgaataggcatttgggggtcagtattctggggcctggagaatgctgtttgatgaggggctgcatggacagggcagacgctttccctcccctccccccagtttcctgtgtctcctcggacttcagctccaaggaggctttgctgagtggacgatttctaggagggctctggctctaatttggcgtcaggggccccagggtgtctgctgagtcagtctcgcctccatgcaagggaggcag

SEQ ID NO: 43410 - DNA, 2144 bp, Bovine  19866880643164
cgggtttccttcagaggctgtttcaacacaggggttgcctaacagcagcatgcttacaaagaagcgaagcccagaacttctctgcctgattgagaaagagcgtgaagattactcgacgcaaaacagaaacacgttgtgaaatccaagagctagagcccaggtggctaccgtttgtccccagctccagggaagaggctgcaggacgggtccctggaaatgttgctttaggccaagccattacatgagccttggcccagaggcctcagattccttagactctgaggtcagctcacaagccccctgacacaaagggccatggccgggattggggtgggagccagtttccaaggaaactatcagccatttttcaggaagctgtgtgttcccaggatggtaagcagacactgtgaccttcatcatgatcagaaggtggcctgctctaccatctgtccttgagcaagtcactttgcctccctgggttctcaccttctcacatgcaaaaggcacagccagcaagtcctgcccgccctgccatgaaggtgccagcatccttgggagtgtccaggtggctccacattaccttgaggcatacaaagctggagatcacagcatctgctcttacaaattgttttgttttgttttgtttttttaaaaaaaaaggcatctcccttacaaccttattagctagaagcaagatgctgctagtcccggggttgtgaaggaaatacagagaatcagaagccttggaccccagcccttgctctgcaggactcaatacataactttggacacaagtattagtgtctgactcctggctgtagccatgtacaagctatgtaggctcctctgtccatgggatttcccaggcaagaacactggagtgggttgccattcctactccaggggatcttcccaacccagggattgaacccaaggctcctgggtctcctgcattgcaggtggagtttgtactgccgagccactgggaagtccccagttatcagtataaatattctttataagctgaagtagatattgcaagaaacactgttaatggactcacagaggcccaggaccactcacattatttttaagatcatggtgtttgtacccacccctgccttcctgaactgcagctctaagagcctttgtgggacctccctgcggtcaagtggttaagactccacacttccaatgcagggggcacaggtctgatccctggtcagggaactaagatcccacatgccatgcatcatatccaaaaaataaaataaaagcctcttttagacgcaaattgggtcccatcaattagattcatttcttcatggttctgaaggaataagggtgcgatagctatagttctatggctatgagaaaactagacagtttattaaaaagcagagacatcactttgccaacaaaggtccatacagtcaaaggtatggtttttccagtgatcatgtacagatgtgagagttggaccataaagaaggctgagtgctaaagaattaatgctttcaaattatggggctagaaaagactctcgagagtctcttggactgcaaggagatcaaaccagtccatcctaaaggaaatcaaccctggatattcattggaaggactgatgctgaagctgaggctcactttggccacctgatgcgaagagctaactcactggaaaagaccctgggaaaggctgaaggcaggaggagaaggggacaacagaggatgagatggttggatggcatcactgactttatggacatgagtttgagcaaactccaggagacagtgaaggacagggaagcatagggtccatggggtcacaaagagtcagacatgactgagtgactgaacagcaaacaacagccattgtccagtgttgtttctggcaagtatgaccaaagagacattgaatttttctaaaaagcattccagggaccactcacaagtgagagctagttgcagtgtctacagggacagctttccaattcccagatcaaactgtgtgacaagccattaactcaagggttccagggctggtctccagattttcatacctgcctgaccatggcagaggcagcgggcgccctggtgggccagttctacagagatgctactgggagtcaaagatggagcttctc

SEQ ID NO: 43411 - DNA, 775 bp, Bovine  19866880736858
ctgttgtccgcttggctgacctagtcctaagccgccccgtttgggtcccccactgccctggcgctctctctggatttgatatttaccagaaaagcgttttctgcagaacgcattgaatgtgttgtgttttgttttctcggaaggtacagtggtcccacctggcatctctcaagaacaatgtttcccctgtctcgagatcccattccttcagtgacccttctcctcccaaatttgcacaccaccatcttcgctctcaggacccctgcccaccttcccgcagtgaggtgctcagtcagagttctgactctaaggcggaggtgcccgacccagcccagaaggcttggtctagatcagacagtgacgaggtgcctccacgggtaaggagcagaaagacagaagggtgctgctttttccttttccttatttccttatttattttttaattaactgatttcagtgaagggtgtggtgacgtcaccagaattaatgggtgatgaaatggcagaggaacttctcacagtggggagaaaattccgtagtgaggcagccacattcagccctcagccagttagctcttcattggtgtctctcactctgtactgaaacacaagatgccaaaataattgaataagagtacatctacagagagtatgcatctagaacagacaggatcaaaatatattttaccagctgtcttatcaagtttatacagaagctataaatgactccgcactgctaagtaataccaaaactttcagaaaagatctcataaggg

SEQ ID NO: 43412 - DNA, 914 bp, Bovine  19866880826557
agcgttagggaggatgagtgtccccgtgggcttcccagggggctcggtggtaaagaacccgcctgccagtgcaggagatccctgggtcggaaagatcctcggagaaggaaatggcaatccactccagtatttttgcctggagagtcccatggacagaggagcctggtgggctagagtgcatggggttgcacagagtcagacacagctgagcatgcactcccgagtgtccccccctgggccttctttccggttgggacaaggtttctaaccctggcctctgatcctgtgaaattgaatgtgtcactgtgatggagcgagcctgtctgtctcccctccttttggttgctgtgtgtgtgcatgtcagtgcctctctccagggctcctggtgtctcattttctctgtttaatttgaggctgtgacaaaagggaaatttcagttcattttccttggggaaactttatacctgtagccttaggtccctgagaaggtgaaaaacgtaaccactgtatctttggcttgtgggtcacggctcctcacatctggattgtgtctcaacagatcatctctgaacttgagcaatggtgaaacagagtccgtgaaaaccatggttgtccatgacgacgtggagagtgaaccagccctgaccccgtccaaagagggcacgctgatcgtccgccaggtacccatgtgctccgcgcggttagaggccaagctgctcctgtggtcattaacccacttgctcatccactcactcatgctgtttctgcatcgtcatctgttctcacattaaccaggcccagagggcagcggggccggggtgtgggaggcaagcgtgtgccccacacccccggggcggccggcagcgtcccccagtcctgccctctttgcatgttgtatggcagcccccctccca

SEQ ID NO: 43413 - DNA, 1126 bp, Bovine  19866880941933
gtgggaagcggggagctcaggagggggttgaggggattggttgcaagacttgtgatttcagctgccccggggagtgaaacggttacaggacaaacacagcggtcagacgtgtctttcccctccacttatataccccacctacaattacattccttcttacgtttaaactcggctccattttgctctaatgtacagtatgtacaataacccttaactcactaaactggcaagtttatatttctgtttgtttttaattgtcattacatttccacttaacaatttgtttcactctctttgtgttttctttttttttttgtcttaagctacattattaaccaaaacactcctcttcctaaaagagcaaaaaatatgcctttgcacctttcactaatgagccccgctgtttgatacggagttgatgatatacctcaaacgatggtggccgaagcttctgtagtttctggcaagaggctcactttaaaacaagcgatataagacttaagatttgcctgtattccaacatacagtcattggacttttggggggcaggagagcaaactcgaaaacggatgaattgagatcaagacatttcaaactttctttaggagtcttcattatgattatttattaaaaacccgaggagctcatgaagtatagatgttgctggtagcttgcgcgttctgtcttactggaacgatgtttctggaaagaggggttgctctctttggctcctggttaaatagcctgttttgggggttgtggggtgcacacacagaggtgcctgcagagcatttggcgggggaagaagcaaggggaccagtcttctgtactgggaagcagagcagtgcagccgtgggttgaagtattttgtgtttgttcttttactgtcattgtattaatacgactgaaatttacattgcagactcagtccgctagtaacacactccagaaacacaaatcttcctcctcctttacaccttttatagaccccagattactacagatttctccatctagcgggacaacagtgacttctgtgggtaagtaatacagcagcaagcaagcagccaccggcagggtgcttctcactctggtgtggtgagcacgcatagtggtggtcggcagg

SEQ ID NO: 43414 - DNA, 1909 bp, Bovine  19866880966966
tcctcctctgcgtctgttctcatcaccattcactgccagctctctggaagttcaagttcagaaccaagggcagcagacgtgggggagggctctagtcaacatcactgccatttgtaatgttacaggaatccaaagatgcctcacattatttattagtacaaataaaaatatcatggctgtgggtccactaggactattttcttttttcatctatgggggaaaaaataggctcctttaagtaaatggatagtatgagcaagctggcacgtggcatgtgagtcctgcccaaacttcttgcaatgaggatccacaagcaaaaggtcgtgctaaccacacctaatttctatccactaaactgcatctagaaaggtcatgttggatagatctttccaaaaagacaagaatttggcaggcaaaaattcaggcaaattcagagtactgacactacaatttaaaaatcctttataaaaaataaataaaatttaaaaataaattaaaatcctttataatttggaatatggaagggtctgccttcctcacacaaaaaaatggttcccatttacaaggcgtgactgttctgcgttcagagggagaaaacgttttccagagaaggcttatgagaacagagttctcgctttctttcatagcatccttccttagagactgtggtagctcacggtttcctgagaaataggcggggctcagatccagctgctatatctcagggtctctttaagggctatgaaaatgttggactcctaagttgcaaagtcaggaatggacacatgttagctcaaagtatttgtttgaaaactgcaacactcgagagaaaaagatttaattaaacaactagaagaggcaacaccaaccaagtattaggctgctactcaactcatagcattacaagccttgattctcaagagtagttcgtgattcttagcaaagctcaatgtcaaacacgctaaagatccaacagattagaataaaaatatatatataggtttgtcctgtggtgtgtgtgtgtacgtcatataggatgggttggctaggacaccgtctgtacaaggaagtgacgtctgcggagggtcacaaacagctgtgcccaggggacaaggaagatccgccccatcacttactggcgctcgccctcggtcacgcggcccccgtggtaggcatcctctatgaaggtgttgttggctgtccaccacagcagagtggttgtgtgtatgccggctcccagaaacaccttacatgggattgtcagcctggaccctgtgacagcaagacagcgcatcagacgtcagaacccagctggtggacaggggtcacgtgtcatgcggagtgaataagtcagacagagaaggagaaatattatatgacatcccttatatgtggatgagcagtgggcctttcacttcttctcagacaccctcaacacactattattttttcttaaaaggaatgttagttcccttaagctttcaccttgagtgtcagtatttactaagcatctccagctccgtcctcgtggcagatggaaagccagaagcaaacagctttcccaaggccactgggctcctacagagcattctgaagtcccaggccaccttcctccacagttcattctcgctgcctccaaaaatccgggtgtgtgtgtgcattctctttgcccactgctggtcccggctctcctgtttgcctagggcgctctccacccaggtcgtgctcatctgggattaaccccttcaaaggtcactgtgttctacatgcatggtccaagaggatgcacgcacctcagtgttcactgcagcaccatttacaacagccaggacatggaagcaacctaactgtccacagaggaatggataaagaagatgtggtatatatatacaagggaatattgtgtgtg

SEQ ID NO: 43415 - DNA, 1086 bp, Bovine  19866881330760
cctggaaaaggacatattataccctggtcacatcacagttagccagcaaagacctcgatagaccccttactgcatacagtccagcaggtggaacaaaattagaccttgacacatgccccacccccgccgaaatccacactgcttctctctgctggatatttgttctacctgactttgttgttgttgttatttatttctttacccactgtggggcacatgggatcttccccaaccagcgatcaaacccatgccccctacactggaagcttggagttggactgaactggttgttcagtcactatgtctgactctttgtgacctcacggactgcagtacgccaggcttccctgtcctcaccgtctcccagagtttgctcaaactcatgtccattgagtcggtgatgccatccaaccaactcatcgtctgccatccccttctccttttgccttcagtcttgcccagcttctggggcttttctagtgaaccactggattgccaggaaattcctgtttaccttccttgtttccataatgccgtcaatatcattctcagtactcttgatccgggcgtccttctctgtagagtgcacggcagtgtcccatttggccacaggagcttgttcacagctcatgtgtctctgttcttcctacagctgccacgttctcctgggagatcatgcttgccccgctgtccctcatcgtcttggttctggggggcatatggatgcacagacggtataaacgcagaactggaaaagcctatggtttgatggagttaaagactggccatccagattcgcaatcctatccgagtaaaataaaggaaataaaatagttcaaatcaaaccatgtcctttccaacgggagcggctcagctttgtgaaggatgctgttcttttcctcagttatttaccaaagctactgtgtgtatagtggggttttgtagtgaaagactgaaatgtccacgtaatgtttactgtgaaaccagatcacgggaaccagggtgcgtgtgggtgggtgtcacccgctctttgaataagagttgaaaacatcaaaatgagttttaaattcattattcatttcataa

SEQ ID NO: 43416 - DNA, 803 bp, Bovine  19866881563641
cagtaacttagaaaatattaatactattcagtcatgaaactataattatgtataattacattactttgtgtggaccacatttcattttaaaattagaataaaaaccctcttaactacccccactctctcaggaaaatactgcatagaatacaaaattgtaccttttttcgggaggaaatcatagaaggaatctctgtaccaaagcacaatgtcaaccttgaagactttgtagatgcaaacagagcatgtaattaccaatgttaacatgacgaatataccaactgtgggcttctggaaatcggggactatagcagagaagagggaaaaacacattagaacccaaagacttaaaaactgagcacagcaaattaaacattaccatcccagggaaaccatatttgggatcagtctgtaagtccaaattccagacagtataaactcattcattaccgtatctcattaatggattattgttgttgttgttatttagttgctaagtcatgactgactcctttgtgaccctatggactatagcctgccaggctcctctgtccatggtatttcccaggtaagaatactggagtgggttaccatttccttctccaggggatcttcccaacccagggatcgaatctgcacctcttgcatttacaggcagattctttaccactgagccaccattaatggaagcccctattaatggatactaatctacaaaggcattgaggatggatactgtataaaactaaggtgcactgtatttaattcccacttaagtagtatgcaataacataggaaaaaca

SEQ ID NO: 43417 - DNA, 664 bp, Bovine  19866881922506
aagggacaaaaaaaaaaaaaacaccctgaaatcagtaaaagagctttcaatgtacagagttcaatgatattcattttccatgatgtgcatctaccacatgtcaggctttcttccagataatgataatgcgatggtgaataaaacaaaccaaattcccatcctcctgggggcacacatgctagtagaaacagaccgtgagtagacaagaccatgaaggaccgtgtgcagtaagtgagatgcagacacgtgctctgacgcgccaggagaggcttcagcagagcaggatcgtgtgtgcgcatgcgcatgctcgggggccatctcacaatttgagatgcttacttggcaacgaggagggaatttctctggcagaggcgatagggactttaattgtgtaggaaggacaggaaagagagattgcaattgttcagacaggaaatgattcaaatttgggcaaagctttttaacaatgaaaaatgaagagaaacagaaccacttcagcgcggcaacacttaacgtttcagagtttgcgtgaggaaggttgagaaacttctgtttgccaaccaccgttttgtttccctgaagcctttcgcggtctttgagtactgtttagatttcggctcctgagagtcctttgtgatgttgactgtatttagtgtcctatcac

SEQ ID NO: 43418 - DNA, 1669 bp, Bovine  19866880563766
acgctttgtccctgagtcctggaagaacttcttcagagggaagaaaaaggacccggggtgggataagccagtgtcagacatcagatacatctccgatggagtggagtgttcacctccagcctcgcccacaagatcaaaccatcgttcacccccaaactcctgcaaagatcctcacggcgagtccgaaggcagctggcattcccagaaagagactgaggccgtgtttcctcacgatccctatggatccctaggccgacacacgcacacagcccgaacctacagcgagaaggtggaggagtaccaccttaggtactcctacatgaagtcgtgggcaggcctgctgcggatcctgggggtggccgagctgctgctgggggccggcgttttcgcttgtgtcacagcgtacattcacaaggacagcgagtggtataacatgtttgggtattcacagccctacggcatcggaggcgtgggtggcctgggcagcacctatgggggctattactacagtggccccaaaactgcttttgtccttgtggttgctggcttggcctgggtgaccaccatcatcatcctggtgcttggcatgtccatgtattatcggaccatcctcttggactcaaattggtggcccctcactgaatttggaatcaatgtctccttgttcattttgtacatggccgcagccatagtctacgtgaatgataccaaccgagggggactctgctactatccgttatttaacacgccagtgaacgcaggattctgccgggtggaaggagggcagatagcagccatgatcttcctctttgtcaccatgattgtttatctcatcggtgctttggtttgcctaaagttgtggaggcacgaggcagctcggagacacagggaatacattgagcagcaggaggtaagggatttcaccatctttgttctttctttctgctattagctccctccttaaatacctatagttctcaaaacaaagccgtcgttgttgtttttaatggtctgaagttccaaaggcctcactccgtatctgacgtgctctgaccagataacccactctggcgtgtcactgctgtgtaatgtcgcaagtagaccccagatgtgtaaggtaatatatagttcgttggttgcactattgtctgtccaataggtaagagaagacacagctattgaatttccataaagaagaataacaacatattcagtaaagtaaatggcccatccttaagaacaatcttgattccttagtatggtaagacttaataaaaagcataattgttcagttgcaagagcaaagtgctcatttaaatctgtaatgaaatctgaaacccacttttcttggagtttataaatttatctcagtattgtaagcatattttttaagttttacatctgtgtatgcaaagtacagaattttaaattctaatcagtgtgaaatcagatggtgaaacacatccttataattttatgtaatttaataataatggagttcttaatatcacttcaaattctatgttatgatggctgtcactcatataattctgttatttcttttccttttcctaacagaagcttgtttttataagactttgcataatggttgattaaacttgaatgatgcctgtttgggttgctgtaacttcctaaatgttaagacata

SEQ ID NO: 43419 - DNA, 1395 bp, Bovine  19866880865578
caaatatgagcttattttgtcatatattagtcaaaagcacaacatttttgtaatgctgagaaatatatttattttagaatacattattaccgcacttcaaatgaagaaatcaaaattcctggcagacaattgcattccaatctgaattagaaaaattcaacactgagtttaatgtaaggcaaattgctcacatatggaatcaacatagaagtatatcaatatttgtaaaaaatatttatatagccattttaattccctggagagaagtacagaattcaagcaacaatttcattttttccaatttgtaaataagaaactctagcaatttatttttatttttctccatctaagcagttttatctgaagctttagagaatcctgtgaagaatatataataatggacattttgcttacttccaatccaacagaaggaaatttatacttttatgccttgaagaattgattcttttctgtaaatgacatctggtggtgaatcctttttgaaaataaatacttttgctttcttgctgaataggttcttcatttaaattcacaacaacatatcaaaatgtttgccatagaaatatagaatgatgaatctaagtaatatagcatttgagtaaaaaggatttaaacactttaatacttgttaaattcaatttaaattttaaagacaatatcttggaatatgctgacagagtagacacatacacacacacaaacaaacccagcttaaggaaattgtgacagctataacaacaatttcattaaagaacagaaattaaagtttcttttaggctttcagctgaagctcatagcaaataatagtaagtgatctttgccagatattattaatttacagtacacagaaactttagaccatctttatttacatagcttaactgtcagaactgaaatctgaggccatttgtgtcaatatgatttaaaaatttatttcagaaaattattttccaggaaggtaaggctgtaaaccaataaataacttcattgtttgcctcaggaaattccttcacaccaatttgtgtgagcaaacaactcttctctcagacaatagattgctcaccctgggtagagagctgtttattaaatagcagtttatttatgaagattcactccaaggctctctactcactgtctctcaatcctaaatgcttctgtcatgaactctacctcttctaatcagttactggccttgaaaggcccatcttaaccacttgagcccagacttcaacagctataaatatcacctcattatttactcatctaaaacaccctgtcaaagcagagttctcccttacagtcatattgctgtctcattaagctttgcttaatcaacatgctttaatggctctgttggggagacaatagtgtgga

SEQ ID NO: 43420 - DNA, 1343 bp, Bovine  19866880942123
actttcctgctctattaacctagtactcattttcctgaacaaatctgacagatcatcctctctggaaagcctgcttccctttcagaaacatactagttgcttcgtgagctgaagaaaaatataatcaagtcatacatacggattattcatagcatcagtattcttagaccttatcctcacaagtcttaaggttgatagggattacttcaatgtatgaaatggttcttagtttgtgaatatattaatctggtcaaggcagaagtgttccttttcttactgctctacgtggttgcctttatctttattctgttttacttcttttttgataggtgattttaatttttgtgtttcaaagctacaaatgagttttaaaagaatcagcctcatctttaccctgaaagtgaaagtcactcagttgtatccaactctttgcaaccccatggactgtagccaccaggctcctctgttcctgggattctccaggcaaaaatactgaagtggattgtcatttccttctccagggtttttccaacccagggattgaatctgggtctcctgcattgcaggcagattctttactgtctgagctaccagggaagccaccaatctttaccctggaaagattatttataaaaataattgtttgtactctgtattcatctatatggcatttatcattgccatggtcaagtagataagcatgcatttatacttattgtaaagtagaagaataacatacatagagtcagttttatttaaagaatttgtgagatttattgtcaatgttgctaatacaagaatttttaatagagtagttacatagggaatagatgcaaaaaaatataactttatttatatggtttctttttttcaggtaacaaactgggtagacccatcatttgatggtttttcagagactacaagcatttctgctattactgccacatcattaagtgtgaataactcaagtcttagaagaaaaaaggtgccttccacattagaaagtagcagatttccagctagcaaaggaggaaacctatcttcctctaaacagatctgtggtctagaaaattcaaaagaatatctgtcagaaaatgaaccatgggtggataaatacaaaccagaaactcaggtaataattagcatacaaagaagtcttcataatttagtttcaggaaggagagggatgtgcatttttgttattattcataaaaacctttttgcctaaatgaattagaaaaaaataataacttctaagtttttttatatttccagtctcgaattttcccagcagttattctgaagatatatcattggttatttgtctttgatttaatttaacc

SEQ ID NO: 43421 - DNA, 1211 bp, Bovine  19866881039743
aagcccgtataaagccagtaggaaggttaaaagacagaagccgtaaaaccatctatgtcacctgtaagtagtggttgccagagaggagagaggtgggggaaacaaagaaactggtaaagcagattaacaggtaaaaactttcagctgcaaaataaatgagtcacaggtaggacatgtccagtgcagggagtatagtcaataactacgtagtatctttgtttgatgacagatgataacagacttatcctggggatgattttgaaaagtatagaaatactgtatcattatgttgtataccaggaactaacatactgttgtaggtcaattatgcttcaaaaacaaactcacagaaaaagagatcagatttgtggttaccagaggcaggggtaggggaagaggaagtttagggagagaaaattggatgaaggtcatcaaaacctatgaactttcagctatgagataaataagtatcagagacacaatgtacaacatgataaacacaattaacactgctgtatgttatatatgaaaattattaaaagagcaaatcctaagagttctcatcacaagaaaaaaattttttcctttctttaattttatatctatatgagatgatggatgttcactaaacctactgtgatgaacattttataatgcatgtaagttcatgatttcattacactgtacacactaaacataaacagtgctgtaggtcacttatatctcaaaattggaagaaaagaaaatcaaagtgataactttttcattaaaacaagaggaacaggaaatcagcttattaccttatttctcagtgaccatactgtaccttcagttcaatatactacctctcaggaaacaaacaactgttcaaatataattgactttaagcagagtattaacttgaagatgaacagaaaaatgaaattccaaatggaaccttgctatctctaccttgaagaaaggcagatactcacgccacgtagtctggcatcacaatgggttttgggatgtggcccgggggaataggtccactcagaagttcaggtttcattttcgttgctctcagttctttaaaattaacttcttggtctctctgtctctcacaactggtggccatgtcacactacagttagaggggaaaaaaggatttatttataaacagagcaaaaaaaaagtcaacttcattcttagaggaataaagacccagcaca

SEQ ID NO: 43422 - DNA, 1720 bp, Bovine  19866881107674
agtagttgccacttcggaatctgaaagtttatataatactttaagaatgtaaaaaaaaaaaaaaatgtaatgtttttcctttcttacctattttcaagtcttttgtacaaaatactgttatctgttttcaggacaaatactatatgaaaccagcgttcagggaagaaatcacaaccatggtaatcaacaataactccaccttcactcatttggttttctagctcatcaactacctgtaagaaagggaaaaaataaagatgaatactcttttaaaaactgaggtcaaaaaaaaaaaaataataataaaataaataagctaaaaaaaatgatcacctcagtattcaatcaattaaaaaaaaaaacctaaggtcaactttcctattaaattttttaaatgtatactttaaaaaattgtacttactctgtcttcatctaaaatgggacagtcatactcttcatcatagccatcatataactgccctaaaagagatttacattggagtattaaagtagtcttttcttggtaactttcagtaattttctattacttttttagagataagagagggcactaatacacagtgtcacatggacacccaaatataatgagcaatgctgataagttagaattttgtctaaaaggaaatttgggtaacagtgtatctgcaaccgctttagctattgatggtttcaaaactgaaaccatcaacagagaaccaacttcagtatttgtggtcctaaacactcacatacattaacagcagattaagttccaaacttattaggccaaggatatgaaacttattaaaagcaataactggcgcttgattccacgaatgaaccctttgtcaccgaggtcacattcacggggtttggggaaggaaagtcagtatacacatgctcctgaacgtctagatttccagcatccccaaaagccaagggttaaatttcagaaggtaaaacaagaatgatgcgggcaggcataaagaaggcaaatttaaatctaacataaaaactttccagtaaattcgttctctttcaaatgaagtgtgtcgtaaggaggcgagatataccaatcccaccctcaccctgaacccctgggaggcatgtcctcacgaggcagacttagatcatccttttagccatctcaaaacacatgctatagtcttctccctcttccccctaacaatgtggcacaggttgaaatgagcttaaaatggacataagttctgaagtgacagaagggtagtccctgagggttagtggaaggcagaggcaattttaactgtcttgcctggaaatcggcctgtggaccgattctgagcacatgaaccacttctctagcatcctagtgtgacctcggacttcctgggttactgttcagctaccagaaactttacctgctaaaaagttaaactgtcttggtgtggggaaaactggttaactatatagaaaataatctaaacccttactttacaccacaagttctaggtggattaaaaagttaattactacattccaaagataactaatggaaaactaaactttacaaaggaatgattcatttgagtttgtgaaaaaaataactgattcaaataaataaaatgttaaatctcttgaagaatttttttttttaatagcagggagaaatatttatactaggacaaaggactgaaatgtagattatataaatatctcaaaaacagtaaccctaataata

SEQ ID NO: 43423 - DNA, 1239 bp, Bovine  19866881289134
ggtgcatcctgctggtcaggtctagggtggagatactgatcatctggaaggctcctagctcttgcatactgtgtacctgatatttgaagaaatttaggaatgtagatgaaatttcctagtggaggtactaagacaaagcagtcaggaaaatcagaaggtatggtctgtggatgcctgtgttcctgacctctcctggaagcctgctgcttgtttttctcatttttccccccatgacttgtgagggtgttggcgattgttttcttttgacctttagctccaggcaaagccacctatagagggactaggacagtctgttgtgaactgtgaagtcagggtttcgctgagagtttctgggtgtgtcagttttcactggctgttggatttgtttacttaaggtttcgagagcctaaaaagtgactcaggagagaccagggccagagatattacaatcccagggaactttgacttctcatctgactttactgtcctgaaagtttaatcagttctaggtgcttttgataatttgacagaagatagcgatagtaacttagggaggtggtgatgatgacgaagtgaagggacttttaatttttaaaaaggcattatttttataatgcttcctcactgaacctctagaaatttgatagctagcctatagattgtttcaggtgaacttcatagtttgtctatagtaataaatgtttcatcatatgaaggtagataatcatctgttgaatagcagatgtgagactttgaacacactaatgtttcatgcaaaacctaatcacttaaattcctcatttccttttcccttgttttcccaactgaagcgtctaagaaaggctgtttgaaataaggccttggtttaagctacaggtattgtgtttttccttccatttttctctgtccctcacctgctcaagtgtgctttgctgaactcagcccctcattttcatttttgcctgagtttatgtccacaaccagatgcagacacttactctcttttctccactcttacgcaataattctgctccagtgggtttcactccgataacatagctgcccaagtggaaacgtttgatgctgcatctacagtgcctgacagtggagcggactagtattttttctttttgggtattaaaaattaatatcataaaaataaccctccacttgaaataatggaagagaatctaaattaataacttgtactacgtgataattaaaatttggaattctaat

SEQ ID NO: 43424 - DNA, 1007 bp, Bovine  19866881529847
tgtgtgtataaatgcttaagagctttttatttcatgttatcctggtaataaagatcatgtaaaagtaacaaatgtatgaaatttgaagattgtaaatacatgtttacttttgaaaaatcaaagtttaaaccttctggttagaattttgttgtgtatttttaaatgccttttatcttttatggtttacatacttttttaaagccaactaggcgtttcctttttatcaaagtatctaattacatttataattcacttctgggaatgttcaagttttgtacatattttataattattaaacctggtgttttctttccataatatacctttttgacatcattagtgctgttaatattaagctgtggaaaactacgctcggaagttgtatttgttgttgttttaaattattttgggtgctgtgctggttggtagtatcctaaatcctttggctaacagaaggctgacttgtctggaaatggaatccagtatcgtaaagcaccaaattatttcaaatggtgccctttaattctcagcatttttttttaattcaatattttcctggtaaagtaaaattagctgataatactggatatatagctaaccaaattgactgtgattatcccctcagtttagaactctcattaaaatatattgtttttaatatattagtctgaatcattttccaaagataaacttttaaataaggtttccattataacactgacttagttcttcaagttggaaaaattcttaattttccgtgtattgcgcatgctgactacagaaggtaatagtttgtttttcatgccttttggagtcatgccaaatagtgaggactctcttgagcaatgtaattgattttttgtgtgtgttaaagtttaaactctattctaggaagtcagcatagtttacgaaggcacgtttgccagtgttgtgatgaaacaaagctattcagctgaatgcagaaaatcaagtagcatgagtttgcattataaaattgtgccataaaa

SEQ ID NO: 43425 - DNA, 1993 bp, Bovine  19866881562259
ctgaaaataatgaagtttttttttaacatacaaaaatattttctcagcaagtagatctttattattgataaagattcattaaaaaaaattaagcacgttaatgctttcagatttccattgtgtttcataaactgttgttgataatcatacactgctgttgaataaaacagcaaaatataagcaatgtcagaaaatatttaaaaagagaaaccttcacaacgatgggagtaggtcaaagaaacacaagaggcagctgaaagggttcctagtggtcctcgctaaagcaactcaatcaacaaaactacgcagtgctggattgtaagctgaagttcagaacagacatccctgcatctacactgatataaatgattaaataaatggaagtgacaaatttcctgtgcagacaaattccaagtaacttgtgtaggtatactgcctttaaagagctggagcataattccctgatttcttaagtgtgatctatgcagagtgacttccttccaaagagcacaacacagagaggggacataagaagtaaagagtaactttacatggacaaacacgaccccagacaggtgatcaagggaaaaaaataaagacaagccacaaactactgttgagttaaaaaaaaaaaaagcaggaaggatacaagtaaagcttatgattctttatgaaagatcacttctaggtacacttctgcagggaggggacattttaacaactaatattttggttgaaaaaatttaaggcaatctatttttctgtcttccattctgtattatttgaattttttttacagaaagagtaaactcttttctgtttataaatagaaaaattaatgtagctattttcttttaaacaggaagggatatatgtacagattatttttttataaatcttaactacattagtacactgttccatttcaaaaatactttaagactggatttcaattattattcaatgaaattacagtttggtaattactagcaaaatctgtatcaatactagtataaaggataatgtagctccacagactagaataaaattctatgtaatatctaattataaggtttgaatttaccatgtactcttcactttcttctctatagtcatccagttctttatccagacgagagagttctttattgacctcatcaagttctgcttgtaggctcttatattcctgtaggccagtgtcaaaacttctcttgtagagttgtctttgttgctctgaagtgataggtggatattccctaaaaattcagagagaaaacgatttttttatatatccttagcagacttaagttccacaaagataataaagctggtggcatgtggagaatgacattctcttggttttctttttgttgctattgcttatggatagaggaaggtgggatacaaagaagttcttttaagaatgattatgcttcttacactgatgctcatctgttgtttttttttttaaaactctgcttattggtttttagaaataagtgttgaaaatcatttatgaaatttcagggtggccttaggaactcatttgttctgaatacacaacatcacaggagaatggacacttacatttaaagtcttaaaactggaattatgaacacaaaggatattttcatcccttcagtggcagagcagctcattgacaggtgcctgttttctgctaccatctgtagttttcagatggttttgagcatttttttggtgggaaaatgggagggcaggtcttgtttttctttaacagaaatcgttttgattgtaaaagcagacatgaaaaggtacatgtatgaaaatgcatgctcactgtaaaaataatctgacaatgtgttaaactatgaaaaaagtcctgaaattcttatcacttgtatctctcaatatgccagctattccttacatatgatggtgatgctgttaaccatccataatccactgaggaaatactcttgagttgttccacagggttagggttaggggttag

SEQ ID NO: 43426 - DNA, 3149 bp, Bovine  19866880357532
aaatgtggctcactgcacgtgaatgtttttattctgcctcaaaagttacaggaaacttgaaaagaagtatattcaccatccttgggtgggtccagattacacggttggggcttcggcttgttttctttataggaaggcagcaagaagtcccccagctcccccacagctgtgcctgtctaaagctttcacaatcactgggcttctcagcccacttaggagaaaccaagggaagtgcttttagcagccggctcccaaacccaggccacggggcccagtgtggcttgtcaaccctgaagcgggaggcagggacttggggttttggttacaccctccacggtctgccttttactgtcacagctgctgttcttgttgagggtgacgtctgagcaggctcctgacactggggacagagagacttctaccatctaggaacgacagggtttctctgagggaacattttctctaggacccttgatggcgtccccaaaagtcagctcttacacaggaaatttccactgacccgagacattctatatgagtgccatcattctagaaaccaaacagtttcctctaaaaaaatgttatcaggcagaggtcaatgtactttaggagtagttaagatattaggttggatctgggtctatgtcttatcaggtctgcaaacttgtataagttaccttcagttctttgtgcctcagactcttttttccctcttagcaactttcaaatatgcaataaaatattattaattataatccccatgctgtgtattacgcccccagggcttatttcagttataaaactgaaaactgaatacttcttgaccccatgaccgattttacccaccccttacctctggcaaccaccagtctgttctatctttgtgtttatttgactttttgtttgttctcctttttttatgttccatatataagtgagatcatatgctatctgtctgatttatttcactaagtataatgccctcaaggtccatttgtgttgtttcaaatggcaagattacattcttttttatgactgagtatatatatgtgtgtgtgtgtgtgtgtgtgtgtgtgtgtgtgtgtgtgtgtttatctatagacagatagataaatcacatcttctctacccatccattcatcagtagacatataagttgtttctatatctaggctatagtcaataatgctgcagtgaatgtgggggtgcatatatatatatatatattttttcaaattagtattttcatgttctttgaatcagtacacagaaatggaattgctagatcatttagtagttctgtttttaattttttttaggaacctccgtactctttttttgttagtggttacaccaatttgaattcccatcaatggtacacaagagtttcaatttcttcacattcttgacatttgttatttcctgtccttttgctgctagccattctaacaggtgtggttttgatttttcagtttgctgatggtaagtgatgttcatgtacctgttgaccatctgtatgtctcctttagaaactgtcaattcaggtcctctactcatttttttcattgtattgttttgggttttgatattgagttgtatgagttctttgcatattttgaatattaacccctgaacaggtatataatttgtaaacatattctcccactcagtaggctgcctttccgttttgttaatgattccctttgctctgcagaagctttttattttcctgtagtctgacttatttttgcttttattgcctttgcttggtgagtcagacacaaacgtcatcaccaaaccaatgtcaaggagcttattgcctatatttttttctgttttgtggttccagatcttacattcaggtctttaaccattttgagttaatttttgtgtatggtataagatagtagtctaatttcattctttggcatgtggctgtcagtttttccagcaccacttactaaattcatttattacttctttgtattaacagtgggataataatagcagcttcccataggcttgttatgagaatcaaatgagacagtgcagggaagcgctgcacgcagtcctggtgagtggcgagtgcttgataaagaggagcaccggttttccttattgtctcattcatactctgttatcctttcccttccattcaggcagagtcaccatttcatgagcacactggttagcaaatgacagcactgggcaggatgacatttggccacccaggagggagagaccagatggccgaggatgcatttacagacacacaccaggaagaaccggactagtaacagtccctcgtcaactgagggaggaacagcttgaaaatgcactaagtcaggaacaagaggacaagcttactacctgtcactagatgttgcattaactgggggggcataactgggaattagatccaaactggactcacgctcaattcccatggcttcttcaaactaatttagaagtaagagaacaacccctccctttctgacaagtcagttcaagttcaggttcacaaccccaaagttctcctagaaacatgtcaatgactaaaaccttcccatcccttcctgaccagttccctatattcctttctccagagaatcttcctaacccagggatggaacacaggtctcctgcattgcgggtagattctttactggctgagccaccagggaagcccttactacttttcccatctcctcctgacctggtcactacttttttttttttcttgattcagaattccactgtgacctgggctgtagaaactgggagagatcatcccttccaacctaacaacaacaaaagctgaatacattacaaagtcataacttttcttgtattcttcaagttactgaggtcacaggacaaagaagtagcctgaaatccaaggaaagagaggcatctccaaggaaatgttggggaagagtgttggttcacttttagacactggatgaatgaagacactggatatcacacatgcaggtgtaaagaattcagctggggtcttaaaaaattgctaaaggttaagggcaaccatggagaaggcaatggcaatccactccactattgttgcctggaaaatcccatggacggaggaggctggtgggctgcaatccatggggttgcaaagagtcgga

SEQ ID NO: 43427 - DNA, 1518 bp, Bovine  19866880407803
actttttctctttttaaatatttatatatttatttatttggctgcatcaggtctcaggtgcatcatgagggattttcgttgcagcgcttgggttcagtacttgcattgctcatgcttgggtgcccctcagcacgcggaatcttagttctctgaccagggatcaaacccacgtccactgcattgcaaggatcactggaccaccaggaaagtccccaaatacagactctttaattcaaaatattaatatctactgcaaaggagataaaaaaaataccactcctgtagtcacctgtaaagagagttttttagtattttgattttgattattagatatagactgatgagtcagtgccagccattgctgactacaagccgcagcctaggcgcagacccacgtccactgtagacgcacccacacagaaaacctcattgccagggacaaagccccagactctgctgcctgatctaagagtctcactctgtttcctgatgtatgtactttgcaaagtagccccaagaaatacatttaaaaaagagagactctctggaaaacaacaacaacaacaacaacaacgaaagaaaagcttcatacattagcgagcacacaatggttctgagaagtcctgcagttaaaatcaaaaatctgtttggcgtgtaacccaggccttcccacgttcattcaccataggaccatttctccaaaatatctataaatatactgaaaaaagaatattccagggaaggtatctttggaatgctccggtttaactcattcagatcctactcaggtagctgtttgtttggttgtgctgattgtcatcagaggaactttgtaaaggtagagcattttcctaagtccattgtgatcaattacatcatgtgctgaactgacaaccaaaattctgttttgccctttaacagagaaagcaacccagatgagaggcaacagtgtctctttaccctccaaaaagccacagaatgactgcctggggcctgtgaaggactcaccccacaagctgacacatggttcactgtgctacctttgtttcgtgttgattttcctagtgtgtgtctctgctttggcaatctcagataaatttctaattttccaagattgcctgcagtgaagttctatcccctgagatggatttttttttattagtctcttaagcaagttatacaattcaaatcacctctctctgtccacccatctgcttgtttttgcttttcttcctctctgctggacgtggggtagaaatcctccaggcctcctctcgccccccctgtccactgccctaaactctcccccaccgctctgtctatcctctctgtcaggagccggggccccttctgttcggatggctcggggcccacctgtaccagccccatctgtcagcaaagcagccccagcatctcctgaacctggtggaggaaattctcctctgaagaattgacgtcactaggtgctctcctgagagttgtgtccgaaaatggagctacattgaagaagaataaagg

SEQ ID NO: 43428 - DNA, 982 bp, Bovine  19866880592227
atttttaaaatctgtgtgttagagagtagccataacacatacttcatgactgatccccgatgtttaataagagggaaatagatacatccatatgtttctttcaagccatgtaggtcttcttgttcacaattaaaacctgatgcaaaaggaaaacaggttcttttcacaaatataaacctgcctgattatatcctaacatttgatttctgaaaacaaggaaatacagtgatattcaatttctttcaattgctaattaaactttatttcagatttcataagtacaaataaagaagattttgagaaatattcattttgattaagtcagaagattttgtacatggtttgtcattttttctctttttttcttaaagtgtgggttcttagcatttggaagaaaacaaagattgccaaagggtgggaagatgtgtctcttgttttcatagagatttcaaagcttgagtcatccatgtcattttcagacccaactgtccaaagctgactcaaaagggtggggtaaagtgggggttaagttgagttttaaaatcaatccagcaccctgtgacattaccacagaagttccttcattcattgtcacctcatatgtctgttctggtgccttcccagggctctccgataaaagtaagttaggctctgttcatttcccacaaatgtcctcttctcttagagatcatggggtttccctggtagctcagctggtaaagcagtacaggagaccctggttcaattcctgggtcaggaagatcccctagagaagggataggctatgcactccagtattcttgggcttcccttattgcgcagattgttaaacaatctgtgtgcaatgaggaaaacctgggttcaatccctgggttgggaagatcccctggaggagggtatggacagaagagggcctagagaatcctagggacagaagagcctggcgggctacaatccatggggttgtaaagagctggacaca

SEQ ID NO: 43429 - DNA, 1502 bp, Bovine  19866880656885
ctgtccccagaggtgtttaccttatttttaaggccggaaaagaggctcagagagtttaaatgacttgtccagggtcacacagccagaatactgatggagggggatttgaaattctcccgacagccattttttctattctgcacatcccctagatgcttaaaaattccctcaagaaagtctacatttttcttggatcatttttattctttgccccctcccacctagaccataaattttaggattaaactctcagttaacgttaccaagtaccccttgaaatgttatgtgaattgtcccagtggattgcagacaaagggaggttgaggctggacttactccagccttcttttacccactaaatatctcattaccattgaccagccggatgtcagcatgtcacacattattctgagagcagagcaagagcccctcaggtcaggagataatcaagaaacagtgttatgagagttgacatcttatgaataattattttaaaaatctgttcctttctgtcccttcaactccagacgggcgagttggttctaccgagttgctcagtcaaaccgtgatgagaacatcacttaaaaaggtgctagttgtccttattcatgtatttttgaaactaagtttttaagaggtgagtttactcaaagttttcattgtgagagtgtgcagtcaaaaggccaataactctgggtgtaagacaagcagcctccggactccctggcatctctggaagatgcggcccctggattcctcctgcatcacagagtctgtgggtaccacgtttctgtttcccagatggccgatgataggaagatactatagaagtgaacagaatacagttttaaggtcaccatcatatattgggtacatgcgtgctaagtcacttcagttgtatccgactctttgtgactccatggactgtagcccaccagactcctctgtccatggaattctccaggcaagaatactgcagtgggctgccatgccctcctccaggggatctaacctgtgtctcatctctcgcatctcctgcattggcaggcaggttctttaccactagcaccacctcggaaagcccaattttgtgggatacctagctacattttgagaaggaagagtttgagagtgaggctggacaacaacttccacaaatagtgtctgagctgcagatgtgggctcatgccgagcgagtggtcccaggggaggaggtgggggcatgtcctactgtccttgggggctgctgagggtctccccaaaccagggacccagcatcgccagtcagcatcctcctctagcctccgtttccccttctgtcctgtgtgcggtcgcttgatccacatgatatggaagtgagggagcagaagacaaggaaaccctctccctgaagagccaggtgagccctggccgccgttggtggtgagcggtgggggcagcagaagggctgcagcctggccttgaggtctgtaagccagtacgtgtcctctgcatcattgcag

SEQ ID NO: 43430 - DNA, 1245 bp, Bovine  19866880848309
cagagatttctaactgtgatgtgcttaatacgaaagaacaactaagttgagcagttttgaattaaactaattgtaattgtttttatcttctcaaagattgtatccccattctcagccttgaatcatgcctaagatttaaatgaactcactctcttggtgactgacttgcattttcataatttttgaagagaagtgttaatgatgagtgaatctgacctgctagaaatcctcacaggaaacaggagatggaggcagtgctcagatgtctattttaggactcacagggagagactttttccttttgtaaagaagcaaatcccagagggtctgacaatgacttaaaaggtgcaaaaatagcttactttgagattaaatgtacagcggctgttgtctgagatgaaattcctctgaatttcagctaatacaaatagctactgagcaccgaaacccgctcttgggtttctgaatcatgttataggtataacaaggtgatggagactgagtgggccctgtgagtgtctgaaacattaataagcttattttggtttttttttttttaatatattatttagacgctcagttgtgtacaactctttgtgaccacacggactgcaaaaagccagacatttagaagttttgtgttttattagctaagggctccaatttatttttgaagccagcagacctcttgtttggggtaatccacaccgatgggcttttaactgtacacgtgagaaaaagatttctgaaatctagacatttgagaagggtagatccaaggacctacactgttctgagaaataatgtgaaacctgacttttatagtggtaagagtacatgtctatagtttaaatttttaaataattaacgaaatttatttttagagcagttttaggttcatagaaaattgagaggaggtataaagttcccttgtacccactcactcccccagtacacagtttcccctattattaacatctctctttagtatgaacatttgttacaaatgatgagcaaacgttggtagattattaattgaagtccacagtttaccttaggttcactcttcccgttttacatggtaagggttttgacaaatgtatgatgacatgtttctatggtcttagtgtcaaagatagaagtttcactgccctaaatattccgagacctcttcatctctcagtctttcccttcaacctttcaggaaccactgatctttttaccatctccatattttgccttttc

SEQ ID NO: 43431 - DNA, 1379 bp, Bovine  19866880961397
aacataatcaagaaatagaacattttcccagcaacccccagaagtttccttgtgcccacttgcacatcctgcaagttttgagaactgatttcttttacttgaagtgctccgtttagagagagagagaaactctttggaaacaggccatctcattcccaaatgaaatatctccaggcagaaattaatttttgtaattgtctgtcttcttttctgctacaatccatgtcagaaagcatggacttgaagctgtcaatattgaaactgctttcactatgggagctgaaggccgcatccactgggctcttgacaccaagcctaaatttctcatgtttcatggccacgcccaccacaagccctgactttttgcatgtgtatatttgactttcattttgatatagaaacacttaagtagctataatgcctgtttccctgtggaagtgttgtatatctgtccaaaagatgggaaatttcagttgttgagtgatcaggaaatgtcacttttaatccaaatataaaaataaatcctatagacatgaccaactaaactagtgtgtaattatggaattttataactttaaatggtcatctatgtacaagaaaactaaaagccaaaattaagtgacaatggctggtacaaggtcctgctatttaaggaatagttgggatactgctggggatatatccagaaggaaaactgtaattcagaaagatacatgcatcccaaatgttcactgcagctctgcttacaatggaagcaacctaggtatccatcaacagatggctggataaagaagatgtggcacatgtactactcagcgataaaaaagagtgaaataatgccatttgcagcgacacggatggacccagagatgatcacactaagtgaagttagacagacaaaatagcgtatgatatcaatcatatgtggaatctaattttgaaaatgatataaatgcacttatttacgaaacagaaacatttcaaaaacaaacttacggttatgaagagggaaatattaggggaagggaaaaattaggagcttgggattaacatacacacacctactatttataaaataaataacaaagaccttctgtatagctcggggaattctactcaatataaagacctatgtgggtaaagaatctaaaaaagaatgaatatatgcatatgtattaatacaactgaattacttcgttgtatgccccaaactaacacaacataaatcaactgtacttcagtaaaataacaggaaaaaagagaaattggggtaaaaacttttccaatggggtaacctgcctcttcttctcgcaccccagcccgccagccccatctcatgttcttttcattcgtattatgctgccattccacacggcatt

SEQ ID NO: 43432 - DNA, 1015 bp, Bovine  19866881017257
acttagtgttcacgcaccacgtcactgagaaagtagaatggaaattccaacctcccaaatcctctgtccacgaagccataacgcaacacacaaatccactcatccaaatgaacccttgcatgagtcaggccagcgtaacaagcagcttaacactttcgaaagcttcaaaatatggcacttaatcacatctctaggaagagtgtggtacagctaaatacagctaaatggcgactcatgcacaaacctcaaaaacagcaatgttgcttctgactgtaaacctcactcaaaacttttttcccaagtggtttcaatattcagttggaagagtgacagttgaacttaatggttttcttttctcacttttcttcagaaaccaatccatctcagtgctacagtgctttgagacctttttagacccatgacccttttggataaacttgaaaatctcatgacaccatccccactccacctctaactcccatcttgagctagtacagggaacaaattctatttcctgcatatcctgtcagacaagaaaaaaaattatggcctttatttttcaagttacatgaaaaaagatattttactttccatatataaatatattttttaaaaaattttcaaatcacataacatcctctcctaacaccccaccctgctactccatcaactaagggcttccatatgttgataatgcatggcctattctatgcaatattgaagctcagtgtaagactctaaatgggtctaattatgaaaatagttagcatatttgtccttcataaaagaatttctagttaaaaaggaaattaaataatagacccgaaattcagagactaagctatccaggtgctaagggcacaaaaggattgtttagcctcaggctttccatgcaagacctcataagaggtccaatttttgaccctgaggcctagggatctgggttgtaagcaagcaactgagatcaatctaataaccactgaattggggacccagttactcagtcttatcccag

SEQ ID NO: 43433 - DNA, 1290 bp, Bovine  19866881067936
atgcccggcccgggaaagttcggctcaaatcccctgcgggcactggttcattctggggaaagtgaggggtggttgctgcgagaggggcgtccgagggacacttttagccttaccagtagagtttttgtttctgtttttttaaacgagagcaacttaatattccctggcactcgtacttgtaaaaaaaaaaatagatttttaaatagaaacatcctggaagaaaatgaatgagcatctgaatgggttgagaaattgagtgagggatgcagaagcgcgggcattgggggaaataataaattggggcaaattacttcgggaaagaggtttccccgcgagttgccaactcaagaatgttgtacgtagtgagggccactggacccacaggtattctgtttgtagacttcccagtggcgtactcgaacgtgggtctgtgccccggcgtcgcgatttacatctcctggttctattcccttgcacagacgcatgtttccttttttgagcttcaacataaacggactcaatcccaccgcccactacaacgtgttcgtagaagtggtgctggcggaccccaaccactggcgcttccaggggggcaaatgggtgacctgcggaaaagcggacaataacatgcagggtgaggagagaggaggcctgggcagggtggcgcgccgggagccccgctcagaccacgcacaaccaaatctcgcatcgcttcctccgcatccggggcctggaggtgttagcaggagtttcttcgtgttgaatgtttgattgagggagataatcgctaagtcagacctcttgctggctagcgtatagcatgttaaccacgaccctagctagcctgccccgccacatccctacctctgaggacgtcattgccataaactctccgggaggcaaggctcctgacattttaatcttaacttgagaagagatctccccaaggttgagtttatcataaaaatccaagcaccttccatcatcagatcttgactttctagcttcagacatcggcaaattgaccttcaagaggcactgcccgttggctccatttttgctttgtccaaggaaggccggaagcacagggcccctgggaggggaatcagtagagactacttggtctccactggtcttcttaagcctctaaggagagacaggcattgtaagtctagctcttaaatcttgcccatgagtagtaaattctctctccccctacctccatttgcaaacagccatatatgcttggagttttggggttttggttcattttctcttaggcaacaaaat

SEQ ID NO: 43434 - DNA, 2413 bp, Bovine  19866881198112
atacttcttataaaatggaggtttgaggatttatagagacttcattttgctttgagtttctataacccccaaaacctcaaaatgaaaccaagccaaaacctctacattttaaaaccagagtttccttgaatcttgactcaggtttactaaaagaatatatgacaacttcacaaaagttggtaggaggtaaggtttctgtggagggcagtgtgaaacaaatagcaggtttaggagaaaccattataaaaataaaattttactttctcagaatgttttcagagactttctatttatatgacatgttgtaaagagcaaattcaataagcagcaagtgtggtgtcaaggcggctgtaatcattctaatagaatatttatgtgtttcttctcttctctaagtctcttacctacatgatcttctatcggcaaactttgctttgagacagctgagatgaggagaagacaaccctccttttttaaactccgtgctccgcgggacctgaagtgcatctatccagagcaagttcttctgccttttctctgtttcccgctttgaaataccttttctttctttatctccactctttaatgtcccatgtcgtgtatcctaaagaataaacaggcaaaaatgtcttatgaagaaagacataatccaaagcttaatgagtgaggagtcatcttgccaaatgataaagtgtattataaagctatgccaggtagcatagcaggttacgggtccaaaaatgggtacaaataagaggtgttacagaagctgatgctagtttgtgaaaaattattatgatataatttaccttgtcacataaagggtgagtacaccatagagcaaactgtgagagcaaattagaatctcactatatattctatatcaaaagaaactgaacagaattgaaaagttttcttaatataacaaaataacaaattacaattagtgccatgatctccgagagagagaggggaaaaaaaagactctagaagcaaaaatagaaagcaaaaccagtggaggaaatcacaaaaggaatggattgatcaaattaactagtttaagttttgtttttagtgctagagacagcaaaatcagtaaaaactgactgcttgctccgggtctcacgccgcagtgataaagtgggctctgaaccttcccaagtgcgtgtccacagaggagcgcagctgctgttcacagatgtacgggctgcgtcctgtgcatgggcgcgtgtccacagaggagggcggctgctgttcacagatgtacgggctgtgtcctgtgcctgggcgcgaccattcatagtgtaggctttcactattttgagatatttttttatagttttactataatgttttaggttgcaaagacaggctatttgtgtatttgttatgttcgttccctgaccaaccaagtgacataccttctcactgacagaggagacaggtatcattttgctttgactcctgaagaaggaaggggttccacgaacagaagacttgtttagtgctaaacaacgctcctaacactggaaggtccttcagacgttcatgcttccccagtggctcagcggtagagtccgcctgcaacgcagtagccctaggagacacaggttcgatctctgggttaggatatcccctggaaaatggcaacccactccagtatttttgcctggatagtcccatggacagaggatggacagaggagcctagtgggctacagtccatggggtggcaaagagatgggcatgactgaagcgacttagcacacatgccagccgcactgcatcagaaaatatcttcagatgaaaaagtgaaattccctatagtaaaagttagctaaatctgatgtctcattttgcagttcacagtactgtaatttattttatgaaaatgatattgcagtatttcaatttaagtctaacaacactttaaactgacataaatgactgtataataaggacctaatatttattttccatgaccacataatcactgaattatatcacagctattatttatttggttgttgtgaacattttatcatgcagttttgatcgttgttaaagtttaacggtttatttaaataaatataattttaaaataatacacatttgatggtaaactaattaaatgatcatattatttctgcctggtattagaaagctaagaaaataacatatcacagtcagaaaaaatagaaaatgggaatctactacgcagtaaaatgaaagaaaattacttggattgttcaatgccgggtcagtctcaaaaggatccagtacagacacttaacactatctcagagggggagatagtgaacccactctttattttcacgttagtaagaatggatgaattccttttaaaaaatgagaaaaaaaaaaacatggggaacccattaaatgaaatgtac

SEQ ID NO: 43435 - DNA, 1619 bp, Bovine  19866881358522
ccttgccatggtccaagttcagagtcttatcatctccacccctggatactcctggatctccacccccaccccactgctggaaatactagccgtgtctcccatctgaatgtatcattccaggtgcaacaggaataagtctctgctcctccatccttctaggtgaaatggctgtctgccttccattcccaatagcagacttcagtctctgagggaggcatttgccttcttatagtcagtcacttatggacctatctatccagaaagactctgagccacttgaagataatgactgtttgcgcttcctgtgcttagcatatattagatactcaacaaatatttattaaataagaaaactgtccactctgaggtactttcaaatattttagcatatgcagagttcaataaatctacatttatgctgaataaatggaaggacacaaacactacactaaatgaaagaagagaagggtgagagaaattatacatgaaccttgcatacttaccaaagataaaaccttattcatccaccacgtggccaattctcttagctgttttgaaaaaatgtatttggaatcttgaacgcaaagaatcccctcaagaattagtcacatgcatctcataaaacatgtagcagctaaggccaatcactcttatttcagctattaatcaccaatgttcatattcacttcaggcttgaaactgttgtttctcaaaatgcaagccttatatcagtatcatttcagaacaagtgcaacatttgtaacctaagtaattagcatctgctctgttctttcaaaaatgtatctcgctctttccagctagtcctctctgcctcttcctctctttctctgcctctctctttctctggtttaattaatgctaattcatactgccctacaagaatttgcgagctgtactgagaaataatgcagtgttagttttgtaatttagtgcacagagcacatttgtgcaaaagctctgtaaactgggcccgtggtcaaaggagcaattagcactttgttagtatgcaatgatgtactaatctgtgcagtccccaaaagcggttgtctgttccattttgccctcatgtgcaaattctttgcagtgtatatagcactgctccaaaaataacacactgcatgcctgctgctgtaaattgggttcatgatgatgaagacatatcaattagaaaatatttgttggggacaaatacacgtgagaacaatttccagcaaaaacgggaagtgggtgcaagagacttgaagggtagcttgcattcttcttcctccctcgaatttcactaccagagctgtcttcatccgcagagaaagactagaggaaggacatttggtgggaaaataagatctcacacgaaaatagttaacctgaaatcacactgatagcaacttcattaacactgtagactgatttgcatttaaacagacaccatcagttcctttgtttaagcagcacaggagaaccatataacaatttgtgcgttctgcggacttctcaccagcttagtgaagaacatgacaagggtcaggttcatgatacaagtaaaatcacgtgtcacgtgatttgcaggtacacagactgcttgagtctccacatctgta

SEQ ID NO: 43436 - DNA, 1340 bp, Bovine  19866881410265
ttggggtgtgttattattccaattgttggaagcaagtcttgcaggaggtagggttttgaattcctgatggtgtgtgaatgtttatccccaaggtttctctctgggatgaattgatttacgggccagaaatgaggctgaattcctacatcaggttaaaggcccaagggtgtttggtttagaagcctgcccccagccctcatttgcatgcggataaagctttcttccctctcccaagcttggcagtggccagtggctaatgcaagctgttggcggaacaaaacagaaatcaatctagcttccacctgaatggaagtagggcctaaagaaaggtccctcatcctcattaaaccttattcatttttcaaaaattttgtccatttttcgctgcattgggtcttcattgctgcatgcagcctttctcttgttgcagagcacgggctccagggtgcgtggccttcagctgtggtggtgctcaggcttagttatcccgcatcacacgggatcgtcccacaccagggactgaaactgtccccagcatgggcagccggttcttaaccactggacctccagagaagtgctcctcattttttaaaaaatataggcaactatctctagtcccatttcacagacttcttccagctcaggcactgaaagaacctcagcttttctttgtctttccctctgcctcattcaggcatctcttccccagattttctcagtgtgttattttgccggggcggctgtaacaaaataccacagagcaggtggcttaaataatagaaatttattttcatacaattctagaggccaagagtccaggattaatgtgtcagcagcattggtttcttccaagggcctctctccttctttgtcttcactaagtcttctgtgtctgtgttccaatctctccttaaaaagaccctggtcacactggattagggctcagccatatgacctcatttggctttaattacctgcctaagacctccaaatacaggctcattctgaggtccttgaggttaggatgtcaacatatacatttcaggaaggacacagttttggggggaacataatatataaggtctttcaggtgctgcttggaccccagaatgacatttctggtcctgaatgatgggatcagtcatcttttcctttgtcttggaaaatgttctgggtagaaataaagtacgatctcaagacaggctagtccacacacctcctagtgagttagcttgtcggtggcggaaattggtggtttctttggtctgacactagggtggggtatgagtctgccaactcagggctttggaagatacttgactaaactaaaaagaatcaaa

SEQ ID NO: 43437 - DNA, 1673 bp, Bovine  19866881528707
tggagcctaagttttatgagtggatgtttttaacaataactagcatgccagtatggtaagagacctgagagtggggcccataagactcaagtttggagaccagtggtgcaatgaaacagcactagactggggttcagggtgtgagatggaattgcagtcactctagaaggattttaacctctctgatctcaatttgtcctcataaatgtgttgatgataaggcctcatttcaaagtggttgagaagattccacaagattaaaatattttacttattttaataagaataaaattatggcagagagcaatttctcagtctcatatctaaatcaagttaacatttccttttcctgcccacagtggtctggaggttgggcgattttaggccctggggttgtcagtccttgatggccttggaggtttccggctggtgtgggggggagagtaagctttctgaaggtaggaacagccaagccttgctagctcttgcccaaacccctccattcatcccccaggaagagatttagaccacatttctcgcatttctcatttctgttacccatgaccaagcgactggcctctgactgtagaacagagcccagtgacgtgtgttccttaaatgcttggctcctggaacactgctcacagggtccttggctcctttttctccaactgctggtctgatgaagtgtacaacggaggccctgaaaccctgagtatgatggagcaataaggaggaagagcctgtgagctgatttctacaccgaaaatgtacacaagtgagaagctgatcttgattgtgttcattcagtgagacactggccttgtttgttacagcatctctcccaccctgactaatacagaagacactgctcgcggctttcctgtcgaactgccagaaatgtaaaacatgtgcttctcgggtgtccagaaagtacttactgaattaatgatcaaggagtaaaccaataattgatacggaaaaataaaaggtatgagttgaggcgtggaggtaggaaaaagtattttgctttctctatcagatggctcagttttggcccatggtagaggaaatgattttaatttccttgctccctgggttttaaaattttctgttctcttgtgggcctattaagagttgggaaagcttgagaaggtgacatccaaggctgtttattagcagccgttttgttttttctctactagagtccaatgcctctcttttaaaatattttactgctgtaggagtggcacctggtatagaaaaatcaaaaccaaaccaaaccaaacaagataataatcatattttaaaagacgatttctggggcttatttgaatcaggaaggaatgtctccagcagtcaaagcatcaacaacagaatgagatttgaaaagtgctgtgccggctaaccccacttgtttactgcttctcacctccttaataatccgcaaactcaatacttctcacagaaaacccagcagtttcaccccacttttccaccaagatttcatagccaagagctgtaatgaggtctctgactagtgtaactcacatcctgtttaccaaacatgttatggtatctttactgaaagagtcttgtcaacagtgtgtgtctcctctgggcacagtttacagggtgattccataaacttgcatcatttttttttttttttc

SEQ ID NO: 43438 - DNA, 2906 bp, Bovine  19866880462979
catttaaactggaatcagatagaagcaggtatttcgctcaattatgtcttttagtgggaaattgtattccaagacctcaatctggttattatgagtggtcattgtttttaagaaatatgaatacaagtccccatgaattcttactgagagatcttttcctactttaatctctgtataaatgctaaatgaattattttgtactttgtactacacagacacaagcagagacatcacttcaccaacaaagatctgtatagtcaaagctatggtctttccaatagtcatgtacggatgtgagacttggaccatgaagaaggctgagtgccaaagaactgatgctttcagattgttgtgttggagaagactctcaagagtcccttggactacagggagctcacactagtcaatcctaagggaaaccaaccctgaatattcattggaaggacttatgctaaagctgaagctccaatcttttggccacctgatgtgaagagccactcattggaaaagaccctgatgctggaaaagattgaaggcaggagaagaagggggtaacagaggatgagatggcttgacggcatcaccaactcagtggacgtgaatttgagcaaactccaggagatggtgaaggacagggaagcctggtgtgctgcagttcatgggatcatagtcagacacaacttagcgactgaacaacaacaaaacaaaggaagtggggcctccacctagacaggggaagaggtaggaagggtctggaatcttaactgcctcgccaatccagagaggggcagctttcgagcaagagaaaggactggagagcatggagcagcattgctaaatttgttttgcagccgctgcaaacagctatgtacaatttttctccagcagtattgcttcactccagagaaaagcagctgatgtactttgaaaagattttcaataacaagggctttctaaataactttcagcttaaccaggaaatcattcaaccagcactgccccccctccctcaagtattccagttagtcaaagtttcactgagacatgtcagcagtgaaaaatgcagaaggcatctaagtaggaactgactgaaaaggcgtaagaaatcacagagcaacaatggccagtctctttaaaggctagccgtttcaaacctgccatctccaacgcataagggtaccataggttcaaaaggggaaaaagaaaagaaagaaatccacagctcagagtagaaagactgtccatttggagtatttcaagacacatgtgtttattttgtggacctggcattcttcaataataacttcaaaattaaccactagctctgcacagtctgcatgaacagccagagggattcagatggccaaaaggttactaagtaggtgtgacacaggatttatctaaaaacgttcctgtaaaaatgtgtactgtgcaagccggagcccagttaaggtgtgctggtgagctgttggcagagggcatggagaaacccgatcctgcactttgtaaattataaactgtttacacttgtcatctctgtctgggacactttaacaattggcttatgtgtgacagagcgtgcagagccagcggcatcagagtaaccgcatccaggggcattctgagtgacgtctgctgcagcttgggggaagatcacaaggcgccgtgatgtgacaggggtgacgacctttactgccaggctgtgggtgccttcaggaaagtaacgctgtaaatgtttccaggggcaaagcagggcctttccacaggctgcctgggccaggcatgcaggttcctcagaccattctgaggaacccgagtgtctcccacactagcctccaggtcccacaattctccaagctggaaaggtcagctggaaaaggcaggatttataatatcaaactatagtcatttgaggacttctctggtggtccagtggttaaaaatctgccttgcaatgcaaaggacatgagttctatccctggttggggaactaagatccctcctgtgggcagttaagcccatgcaccgcaggtggagagtccgtgagctgcaacgaaagctcccacataacacaaaaatccgacacagcctaattaattatttttttgaggaaaggagacacagaggtggactggccagcgggatctcaacagcctggggaccagggacctagagacacctcctggtgcccaggaggaaaaaagtcatcgagtcatgtctatttgacccacaaaattgtaggaagaattgttttttaaaaaatttgtcccctagttttctccagtctgctgctgctgctgctgagtcgcgtcagtcgtgtccgaccctgtgcgaccccatagatggcagcccattaggctcctctgtccctgggattctccaggcaagaacactggactgggttgccatttccttctccaatgcttgaaagtgaaaagtgaaagggaagtccctcagtcgtgctcgactcttagcgaccccatggactgcagcctaccaggctcctccgtccatgggattttccaggcaagagtactggagtgggttgccattgccttctccgttctccactctagaccctcccatttctgacccccagtctccagtacagtgctctgcacctaaactaataggcaccttccattaaatgtttaacgaatttaagattccggaaatgactctgatcagagggcagtatatgtggtagttacgaggaagctttggagtcagcttgcccagggttcaaatccagtgtgtgaccctgggaagtctcctggcctgtaaaatggggataataatagcatgtgtctggacatgttgtgaggattaaatgagtcattacacacaaagagtgctgagcctggtgcatggtaaacacaatacaatgttattattttgcaaaacaa

SEQ ID NO: 43439 - DNA, 1297 bp, Bovine  19866880473344
tgtgcttttggctcatgtttgtgatgctgattgaagtctttcgtgagtccagcctgttgcagggcgtgggggaagagtgaaggaagaaaaatggaggtgagtccttcgtcgtgaaccttcaccgaaccgcacggcccaattgtcgacagtcccttcgcccccactgcgtcccagggagggactcagagtcccgggcgccgccgcggccgtcttggtcgggtgggtactcagccatggagaaccttgccgagctgagcgggcgggcgcctcgccttttcctgctggttcgacacctgccccctccccaccccggggattatgtacacgcgtcgttgggcttcatggatgtggaaagaggggcaaaggagggtttggggggcacgtccggctttagcgagggcgtgcgcttcagccctgcccgggtcagtgagttgtaggcgctgttgaggctgggctgcctcgacacagtcacggcctggcctgagggctgcggcgagctgtgcgcctggatggagtccaccctctgtggggcagggggcgggttgtctccccggccaaagctctggttcctggagaggtgggaggaattggaggagttagtattgtttcttttgagggtggcggcctgatggcttctggtgagcgagttcgtggggtagctcctcttatagtccagcccgtaggacgaggaggggcgcatctccagccgcttgctcaggccgttctgcgacagggaggctccgggagggcccagggaggcctcccgctgggggactttggggggcaggctgtctaggttctccaccaggttcaccccatggttgggactcttgctgctgagatgttccttgatggtcttatactccagggtggccgcctggtcctccagagccatctgtgccacctcgctcattttgggctggtccacgtactcgtgctggtagccctgccgcgtggtcggcagcacgaccacgctggggatgtggctgggggaggcccgcaggggcaggtcagtggggatcactggggagcccatggggggcatgtccttggtgcaggcgttgatgaggttctgattccgttcccactcgcggctgccacggctgggcttgcgtttctgctgcagcgttggcgtggactccggggtgggcagggcggccaggtccaggtggtgctgatcggccttgatgagcatcttggcggtgttgctgggagtggcgagcttcccgttgtgcatgagtggcgtgaggatggcctctggcttggggtcttggactgggtgtccccgaagaggcca

SEQ ID NO: 43440 - DNA, 1766 bp, Bovine  19866880504757
atctttgtttctaagagatatttggtgtttctataatatttattccccacctgcagttgcaatcctttgtcacaggacagtcatttccacagcaaccaactgtgatgtcacgattgaggggatgaggacagtacacaaagagaaagagaatgctttcttctccaggctaagttttctgagttttaaaaccattgcttcaccaatcaaaatattgtaacagaaaaaccccatgacaaagctgcatttcctcagggtctcgggtgtcacacacaaagcatttcaacagaagtgtaagggttgtgtgttgtgggtttgggaaagggtagagatttttatttcattttattctcattctgtactactgatatctgccagtaaaatacattaaacatattccagaaagagttgatttagttgatgaaaaatgtgtctcctgagaccagagaaggtacattttctgtcttactatcatttccataataggaacaatgtttacatttcctcagcctatgttagagcctctaatgtattcatgttctttcactctccagaggcaggaattgaggtatttgagattttattttttcagctactgcatcaagcacttaagatctgacaattgtgatgtgtattctcacttggctttaaaaaataaaagcttcagtgtttgcatttgattagagtctctcagcttggtggctgattaagcaggaacagggaaagccactttcttcagaaacacagcatcttggttaatgtagtgtaagattattgacaggcagagtcacataatttttattaaattgaagagattagctctgctgaagaatctcaccgtgacagcaaactctagctgtaataatgagacctgacacttctcaaacccactacaggaccccaaatggtctctactttgaaatattctttcagctcaagtagaggaagagcttcattcaaatattcagcttatttacctaaaattgagtttttttacatgggttctttgttttgggagaagtgatgcaaaatcagcataaacatttgtaatctatgggctttagctactctctttcattataaatgatacccactggtctttctccctgttgcttgaaatgctaacctagctgttctccagacagaggccatggggcccaccaggaagtaagtcatcagcaaactccctggaagcctggagcattgtgccatttgttcatttaacatgcataaaagtattgcctatttccccagacacagaatacctcactggcacttttatgatggggaagattgaaaaaaagatgaaaagggaaaaaggattagattttggaaaggaaaaaaccgccatattccacggactgaaccaacttagagcccatacttggaaagaggggaatgcacctttccaaaacacaaagaagacaataagggaagtcagtttacatcctggggggtggggcggagaggattaatgagttaatgtttggcaagagggagcctcaaagacaagttctgcagaggtgccattgtcacttattactgttattaattaacagggtgaatgccaaacaaaattaagcctcggggtctgctctcatttcttcacaccatatgcgatgtcttttgcaggagtgattcgggagagctatctcaaaggccacgaccagctcgttcctgtcaccctcctggccatcgcggtcattctggcttttgtcatgggggccgtgttctcgggcgtcatcgtctactgcgtctgcgatcaccgg

SEQ ID NO: 43441 - DNA, 3114 bp, Bovine  19866880531065
atcagtcctcggtgtgcattggaaggactgatgctaaagctgaaactccagtactttggccacctcatgcgaagagttgactcattggaaaagaccctgatgctgggagggattgggggcaggaggagaaggggacgacagaggatgagatggctggatggcatcaccgactcaatggacatgagtttgagtgaactccgggagttggcgatggacagggaggcctggagtgctgcagtccatggcgtcgcaaagagtcggacacgactgaacgactgaactgaactgaaccactatgcatcccttgctatgctgatgttgttgtttagtcgctgagtcgtgtctgactcttcaactccatggactgtagccccccaggctccctctgtcccagagatttctcaggcaaaaataccttagtgggttgccatctccttctccaggagatcttctcaactcaggaactgaagctattggcgggtgagttctttaccactaagccacaaaggaagcccctttgctcagtatagcaagtactttatacacacatatctcatttgccctttataatagcctgcaggcagttgttttatctccactgtataaacgtggaggctgaggctcagtgcgtttcagtggttgctgaagaacacagagctgagaaggggcagagttgggatttaaatccaggtctgggccctgaatgcattgttcagcatgcttctcttcagaaccattctgcttatttattaatgttgtgaaagaacatttcaatgaaacaaaatcctttcaagtgtgtagaatatattcacttttcaaaataaaggtgacttcttgctattttcaattctttcattctacgtattgatcttcttgaattcatctcatccttccttgaagtaacgtgattgcatggtctatctcaggctttctcctctgtctccagtcacagtaacagctcccactttcccgtatctgcaggggtctagttggttttctgccacatagttcatcagataggggcagcttaaaatattctatattaccaaagaggcccacaaatgttgtgttcaatggcccttgcaagggggacagtagtcttaaaccactgacccttggatagtaaatagtagtatctgatgatatttaaaataaaagttggattttgcattttttctgtggaagcttcaaaaaactgcctcacttaagacaactcatgcagtttgtggagacatgacagtgttattactgatgtcatcggtgccggtctttgccatcctgcttaactctacccaggatcagtcagccagcctggcatctttctgtcccagcaaggctgctcccctccctctgttcctaccaacccccctgccaacagctgctatgaaaaactgattctcttccaattccttccaggatttaacatgaaggttacaaggtgaggggcagctggttcagctgggccataatgaaagtctaggagaagcaagatgaaaataaagaaaatttttgaaaaattttgaagaaaagaaggagaaaatacctcaggggagaggccctggtaaaaagcagtttgctccactggccggcagtacagcttgagaggaattttgccacaagtattcgctaattattgaatttaattaaagtaaccttggtgaccaaaaccacaacttactgttaaatgtttgtgtgtaaagtactggaaaggagatcaagtattttacaataatatactttgtaaagaggaaattataaatatagggaaagggtagttgctgccatctctaccagggtgaggttcctgtcctaactctgttaagtgttttccttctttcattagaattgcaaatttcacttgatcttctttagatgcaagtatacactcatttatccattcagaaatacttactgtttatttcttatatatactatagcctgggctaaggaagttaacacaatatatacacaaataatcacaagaaggtgattaagtgccatcagaaaatgtgacctgttctttttgaccccgtggagtgtagcctaccaggctcctccatccatgggattctccaggcaagactactggagtgggttgccatttccttctccaggggatcttcccgacccagggattgaacccgggtctcccgcattgcaggcagacactttaacctctgagccaccagggaagccctttcactttcacttttctctaaccaaagaatgtacaaacgtctaaggccctctgtggagcagagtcctcacgggctgccagacagctgccatgagaggccttactgcataatagctaagggcacatactcagaaccaagcatcaacctagttcctccattagtcagcttgtcatctgggatggtttcctgccttattgaagatacagtttcctcacgcataaaaaggagacaagatgctgtttacttcagagggtggtagcaaagcttaactgaagtcacccaggtgaagaaatgggcacagcacctcgtccagggcaagtgctgaagaaatattcatactagtactattgtgcttgatgtatccatcaggatgatcaggcttaatcaacaaagtatggctttggctaatataggcagataaaaaggaacatggtaacttaagggaatagcttagagacttaagaggtaaagaattagatcatggaagggacggaaagcagggatctgcataacagcaggaagagtctttgtaggggactactgtctctgtttttcactctgaatatcgctgggctcagacttacattccagggagaaagtaggtgattggcttacatgttggttccatgattagcccacccaactcttggaaagataaagatgcagagaaaactccttagaagctgtggtattttttggtcaaggggaagagaaaagaggatgttcacagtgagaagcctaaggccaagcagcagcatcactactggtaggagggtgaaatctgctgacgtggtcagagagacagaagattgtggtgatgcgcataaggagggccagactttccaggggtttctggaaggccagcaaaaggggttcagagttggtgtgttaggaacttaggagacactgaagggat

SEQ ID NO: 43442 - DNA, 3175 bp, Bovine  19866880540888
ttacagctttctctcctaccaccaaaacgacctacctggtccattctctttgttttttctgttacaacaaatagtatgttcctactctcatcacagtccaaccattccatttgtgctctggttctcttctcactttcttaaggaactcatacccttctctgtccaggagcatcaatttttcccccaatagatgtggcactggcatacaaaccttctctaatatcttctgccactgaatccacattcctctacactgactattctattttgctttcactttcttacctcattttctttcctcaatttattccaatcaggattcttttccctctcaattgttactgagattacaattgtcaaggttatcagcgaagtccatctaaccaaatccaacagtcatgtagatgtctgctcttcttttctgacctctgaatagtattcaatatcgccctccatcttgaaacacctccttctcctgccccacacggtgatcaccagtgacccctatggtgctaaattcattttttttttaactgctatgtagtgactgtaagttcaggctattgtggcagatgaacctaagttcaaatcttgcctacatcactttttaaaatccaatctgaaagtgaaagagtcagttgctcagtcatgtccgactctttgtgaccctatggactgtagcctgccatgctcctctgtccatggaattcttcagggaaggatattggagtgggtagccattcccttcaccaggggatcttcccaactcagggactgaacctgggtctccaatctagggaaagatatttaaccactgagactaggttctcaatctacaaactaggaaaaaatattagtacctaattcccagctgtgagggttaaattagtaactttcattctctcttttacctattacagcatgtaaagtaattcaccctccaagaactgctctctcccttcagttgctggccgctcctttcccaatcactgtgaaaagctcctccagctctatttgccttttaaatttgggaattcataaggttctatactccttccctaagcaactaagctcttccatctcataactgaaattataatcaaaacctcaatgatttccaaggttcaatttctgatgtatcacccgccccctacctcaccaactgccatgcaaaaatctctacctgcatctctcagctatctcatactcaacaagcccaaaagataaggctctcttttttcatgtgttcttcctccacctcaaattcccctttctgttgcagtctccaactccttgctgtcagtttccacagtttcagtatttcctctttgtaacagtcactaaacttacacttacaggcttagaatatgcactcccttttagaccgtaagccccacgatggaaagtaaaatctgtctatatcaaaaataccttgcctagtatcccacatgcgtgtgtacgtgttcaggtgctcagtcgtgtccagctctttgcgacactatgggctccaggacaccaggctcctctgtccatgggatttcccaggcaagaatactggagcaggttaccatttcctcctccagggatctttcccaacccaggaattgaacccatgtctcctgctttctcctgtattggcaggcagattctttaccactaggcccatcccatgaataataaatgtgtttaacagtgtttcttgaattgaatttgagatattttagaagtttgcttatttaacttactgaacttaccagcattttatttgtttagatgtctaattcattgttaacacttttatttcaaaatacttaagccactcatttacattagattatttctaacccataaaaatattttaaagaaaatttaaaggtactcaaacatactatatttgaggaattctacaattatcaattgccactggatttcaaaaaataaagaggttcagaagttaggaaaggcaagtgagggtaatactatttgtttccctactttggaatttcacaaaatttttgaaaagaatttcagtaaaaagatgatttttttaaaattatgaaatgcatgaatggggtattctttttttaaaaggatttactcctacaagacatttttatctaactatcaccatactctttgtactaatactttgttttcactcaaagatatatagtgtctaaaacaatatttttgctagtttagaaagtcttattatggataaatatggactttccatgaggcagcctaaaatacagataaagggttacacatacacactcttcacacacatacaaaggggttcattttgtgatatcaaggagttgtacacatataatgtgaatacttcaatatacttgaatacttaagatcttttagaaagtcacattatcaggaaacttaaaaataagccaaaaaaaaaaacactaaattgaggaaagacatctctgtattgctctcatttagaaaacatgacaccttaaaggatactatcactgagaaattcatcacaatgaaaaaggatagaaaacaaaattaggaatcagaaaactagagctacaaagtcttagaaatatttaaataagtaaatatgatttcaaagaatcaagctttttttttttttccaaagtacatgttcaattgtctaccaaacaggggctgttttattttctctaagctgctagaatatttcataagattgcttccacatgttatttaataatatagaacacatataacaaaagcttgtttaatgtgtatactattggaataaagaaattataaatgagagggctctataatattataaaaatacctgggctttcactggtctcctaaaattatccaaagtataataattaactagttatcaaagaacttctttttgagatagtaatgttatacctttctctagaaaattttaaatctctcaaaggcaacctaaaatgctcctaaaatgattatgaaaagcctattatctaattatagtcagatcttttttttttttttttatttagacccttcacccagcaattatacttctgaagaataaccataaattccaaagatgctttattcattcattcattcattcattcatttgaataggaaaagatctgttacagagttaaggaaaaaagcagaatagaaaatcaaagactgcaaaagaaagtatcta

SEQ ID NO: 43443 - DNA, 2682 bp, Bovine  19866880554617
aaaggtgagagccaaagaattgattcttttgaactgtggtgttgaagaagactcttgagagtcccttggactgtaaggagttcgagccagtcaatcataaaggaaatcagtcctgaatgttcattggagggactgatgctgaagctgaagctccaatacttggacacctgattcgaagaactgactcatttgaaaagaccctgatgctgggaaagattgaaggcaaaaggagaagggggtggcagaggatgagatggttagatggcatcagagactcaacggatttgagtttgagccacttctggtaggtaatggaggatagagaatcctggcatgctgcagttcatggggtctcaaagagtcagacacaactcagcaactgaacaacagacaacagcaagtataaagatattctatgttgcctttctggaaaaagtgaaatatgtgcataagctgtttgtatagttatgtgtagaatgtaacacatgttacattcatgtgtgtgaaagagcaccaatgtatttactcgtgacagactctgggcaggaggtttgggggtcatttctttgcaatgcatccctttatatagcctatgaattttaaatttccatgtcaggatagaaattagccaggcaaaaaggaaaatatgaagccaaggacaaatatgtagctctagtcatttgtgaacagctgagttgaccttctggatgaggagaaccatgccgagttcacattcgcgttcaaggaattgccaacctcataataagcagagctgaagtcctagagatccacttgggttctctctaactccaaagcgaccaactagacagagaaggcaatcacagatgatagataactttacatttcgagcagtgtttggcttcatttgaaaagatattcagcttaaacaatttcctttccacagaaatgttgtacgttttagaccttccatggaatttggcagacaagaaaaatgttgacttttccacattgcccattatgcaaaattcggaaatatgcagaacacaagaagcacatgtgacaagcacagtgaccttaaaatgtttgcaggcagatgtatcagaatccgtttcacattgctgatgtccttggccagcaggctggtgtacagctggctaaatgccgcccttataacggccagtcaagggatgggcattagcgtttgatttaaagggaagccagggaacatgatggtgggaagtgagatgtattactaggagtcaggtggcaaatgggaaggcctcaaaaacactctgatggtgctgccgcacgagtgctcggagtgggttagcaatacagagacggggtcctgtgtctggatgtgaaagcagagaatggggtgagatccattctcagagctacaggccagcagtgccccagacagaaaaggtgggtcacgggaccccgagtcatgcccaccttgcagcagcaagaactacaaatggcatgaaatccagaggctgagttccaaaactcctagccccacattggaagggcttccctggcagctcatgtggtaaagaatctgcctgcaatgcaggaaacctggatttgggagctcattctaccacttgggtactctttgtatcaatcagtggctgctcttactgctttttctggaagaaaagtgtccagttccagagtggcaaagtggtaccaagtcaggacacattggcttatatccatttccttgtgttccctgctgttttcagtcagtcctgctctgtcatccttacctggggcgctctccacatttgcttttctgctcacttcatgctctaagctcttgtctaaccacaggttccctgacttctgagtgggtgtgtgtgatcatcctgctgaggttccattctttctttcccagtcgctgagagccatcctcttcctgctccatctctatagctcagatgatgaagtgccaggactggagccagtgccccagagccccgtggccacggtggtttgtgagtacacatgatacaactgaccaaagcagaatgagtcctagaactggcaggagagcttctggaatgtgctttttcccgctgaacttaagctgggagagtgtgagttaaagcagtcctgtgccactctgttgggcctgagactgaggagtaaaggcctggacaggtctttactctttccaaaattttcatctacattagctaatttgttcttcctacaaccctctacgatagtcaggacaatttatgttaatttccatttgtatatgggagaactgaggctcataagtgttaaatgacttggctctgggtcatagctagtaagaagtagagcccgttctggaactcaggactctggatttcatgctgtttatagttcctgctgctgcagggtaggggtgactcggggtcctgtgacctgccttttctgtctggggtactgctggcctgtagctctgagaatgaatctctcaccctatatctgaggactgatgctaggggtccttcagactcaaccaggagaatgtctggggcctcccaagtcgaaaaggagccttttgctgaatgaatgggaagtacccagtcctcatctcaaaggactgccagggtagagcttggtgaactgtcagagataagccacatctgggtgaggatggtattcaggggcaaagccaaggaaagggaggcagagcggatg

SEQ ID NO: 43444 - DNA, 1011 bp, Bovine  19866880556466
agttccagctagcttcagctgcatggcaaagctatctaaagcctgttctttcttctcaaaaggatagtagtgagtttctggagttgttaaagcaccaaacagacttttgtgttgacataactaagaagatggaaggagaaatgacacgggtgttaactttccaccatatgattgggtattgaaggccatgatgtctctgagtcatttaaatcatctcttgtaagatgtgacctgtcctccttggaggcgatgatgtacttgaggaataaagaattggatataaagaggattgttgataaactctatgatttatgcagttccattcaggattgttagaaagtgtggacagtatactcagcatcctttatagaccttctgaatcttactggaatattatttcccagactaaaaattgcttacaaaacagcttgtacattgattaaaatatattcagcatttgctgtacattttagtttaaattattcatttgatctctaatttaaattctgtttctacatcttttcctggtctgaattgagcacatcttcttgactaaatataataatgtgataataacttgtttcaaagatttcccaaaatatatatgcatactacagctctggcacttccaatccaatgggaacatttttctacatatcgactatttcaccagcttgctgagagctcatgagaactctagaaaataaactctgaaggagatttccttctaatctggtttattcctgtgtccttggggcagtggtccatgtgtccactggacatttatgctccacagctctcttggcagagctgtccatggctactcccctcacctatcttgcagtcttcttggaaataaggttttagaggactgttactttgggtcagaaacgaggcacaagagtggctattacttctcactattgcttaacctagaaaagaaagctctcatttcttttgctgtgggaagggggggtggggtggtgaggggagacaagccaaatctaaaaa

SEQ ID NO: 43445 - DNA, 3599 bp, Bovine  19866880568392
ttcttgagtggggaattccatggacagaggagcctggcaggctatatagtctatggggtcacaaagagttggacacgaatgagtgactttcactttcataataatagaaagaacaatcttagattctccttcaaagtgaataaatttagcctgtaaggatctgaccagtggaaatcagcatgtcaaacgtcaatacactctaatgagcaagggtatggagaggagaaaagaggctagaagtagagccttggaaacacttgggaggggagaggaaaaaaagacctgcaaaaagcagcagaaagagcagctctgagcatcagagagatggcaggaggcaggaacagagaggaagaaagaaacccttacttggtgtgaagaaatgaggtctgtgtcaaaagatcatattaaatctaaacatttaaacacttaaatcaatttagctttatcatgccattctgaaagcattacctaactactctaaataaaatattggaatataactttcaattcagatttgcatacacataaattaattttccatgttactatttactcaacatagcaaaagattatcagctataacagatacaatgtcagctatgagtatcatatgcaatatcagctacattatgggtaatataacatagcatattacttattattaaagttgtagattactgattgcaagtgctttaaaattcagtctaggtagaaattaatgaaaataacctaaaatctaacagtagggaaaatattttatatatatatatatacacacacacacattcatatagacacatcttataaagttatatgataaaatactaggaaaccgttaaaaatcttattttcaaggatgatctaatgacctgtggaaaagctcttgatatagtatgaagcagaaagggcattacacatttctgtgtaattttctcttctaggaatatttacaataataaaagcctgacaaaagaaaacaaatcaaaaagacaacattgagcatctctgatattacagataatttattatctctatatttttctgtattttacacactttcaacaatgaaaattaactactattataattagaagaaaaattataaattaacagacatacttaccattgggagtttaggattgaagtggttaattatcccaaattcaaaataagatgcaaaaccttcattgagccagatattattccaccaattcatggtaaccaagtttccaaaccacttttggagttggggataaaaagaacaatcttaacttcaatttaagtaatatttattgtaattacatgttaaataaatgtaaggtcaaagacaaaattaaatgtaatttgctatcagtgataaaacttgaaaacaggactccaaaatcatgttgttgttttattaataacatgaagtcattcatttttttctgtaaaatttcacatccaatgactggaagcaatttttgctttaaaactgtgatgctgagaaataaagtaagctagaatagcatttcttaaattgtccactttactccaaagttaagtcaaagtagaaggcctgaatgttcacttaacacctactgaatgacagcatctcatactctaaacagactacatcagaattttgctgtaagcagttgattatgttttaaggacatgatttgatctgcaccatgcaagaatcactcaagtattcgtttctgcaaagtggtccagttataattattttctgtttgagcttaacagaaggaaagtgtcaaatgatgatgaatagaatcaggaaagataaacacaataatttccaaaaccaacaaatccacaccctggtttttaaccaaattcttataatagctgtgatgtactaatagttagcaccctattttccaaaacaatgtgtcacttaggctataataaaaaatgacactgtgagtgatgatcaagacttgtgaaaatatgtgttgactgtgtaacagggtataatttaatcacaggaaatcactcctctccaaaacttcttaggggtccatataacaagaagataatttcacagtttaggtgactgtcacctcagtgatactagtatattgactataaccctttaacttgtaacttcttgcaaaaaaaaaaaaaagtttgtgacaatctactgatgaaatgggatatcttctagtgactcctttgaatgtctctattttaagatggaatgaaaagcagatgaccacaggtctgcttggtttacttttcctgaagagaactttgtggcacacaattactctttgaatatacgacctgctactgttctgagatttcttatcaccatgatctatcaccaaaagttcaaatccacccaggatctgattacatagatccttccttgttttcactcactggaccacttttcaagttattttttaaaatttggtgtatggtatagtttgaggagtttttgctgcttttggtacagaagctggagaatattcttgtgtgaaataagaaagaacattttaccacatgcctgatgtccgatttcgtgggagacaatataggagatcatgatctttttttctgttagtttatcatttggttgcagcaacaataatgactcgtcaaatatcaagagtccccagttttccattgcacggttgtcaaaagtaggcaaagcaattatatctaagtggatttaaatggagggaaaatgaatcatctctttctaaagatttgagagttccagatacaacatctcaaaatgaaatcataaaattaccgaaataaaatgcaaatgaatatctatgacttaaggggcaggagaaaggcattaaagacatagagaagacagagtcagaaaacaaattgctttgactgtatgaaaattaaatagttttgattaaggacctatatccaaaatatacaaagaacacttgaaactcaaaaataagagaacaactttacagaattagcaaaagatctaaagagatagttcactaaagagacacttcactaaagagacacacaaatggcaaatgaacagatgaagatatgctcaacaccatatgtcattgctgctgctaagtcgcttcagtcgtgtccgactctgtgcgaccccagagatggcagcccaccaggctcccccgtccctgggattctccgggcaagaacactggagtgggttgccatttccttctccaatgcatgaaagtgaaaagtgaaagtgaagttgctcagtcgtgtccgactcccagcgaccccatggactgcagcccaccaggctcctccgtccatgggattttccaggcaagagtactggagtggggtgccattgccttctccatgtcattaggaaattgcaaattaaaacaacgagataccatgacacaccagttcaaaacaaaacatcgatgttggagaagatgtggaacaataaaaacactcatccgttgctggtgagaatgcaaaatggtacagccacttcagaagacaattcggcagtttcttataaagctgaacataggttggctatacagtctagcaattgagctcctaaggatttacccaaatgagttcacaactgaagtcagcaacatgcacgtgaatgtttatag

SEQ ID NO: 43446 - DNA, 1462 bp, Bovine  19866880569555
tgcccacctattctatgggcatggacataattaatgttatttatcataggatcagggcaggattgaaaactaactccatgtattttgaagcaaaatgagtttaatacagggaccgaggggtttataaaaccactgaaaagagtgagagatgtctagagcaacccagaaacctagcatggggcctgctaactcaaaggcacaactagagccacagcccagagtctaatctgaagcccctagtgcagcaggaagcaggaaaatggacatgaggagcagcactcagagatgagacacgagatcaagaaggggccacgacccacactgcttcttgacaaccagttaagaggggatcggaagtcaatgcaggaaacccacggtctggctggtcattaagacagtggggatccaaaggaagcccagctctcttcttccaaatttcctgggagaacttcttaagtggaacttaacttttaggcagacttttagctgcaagggaggctgagaaatatagtttcaaagtagacaaccatgtgccaagccaaaactctgattataaaagaaggaacacaactgtggaattcagtacacaatgggaggatgagacatgtgagagcggagaagaatatcactgaagacccagggcaaagaaagaggaatcagcaagaacaactgggtaactgctacagagtagggtaagaaggactctataaagcaagctagaaaccagatatctgacattgcctagaagctaaaatagagaccacttctgactttccacatttccccgctttagaacaatgaaaacttatgatcctttcttaaatgttcctcttcccctgaaatccccaaatcccgtttaaagtctcattaacatgtcactcttagataaaacctcattgactgagtcagaagaaaaacagagatcccctcctcaaaaacctgctccacacggagccagttccaacaaagccgtatatgttatctacttaggttcaattaatgcacaaaggagggattaatagttacctgtcactaggttttatgaatttctcttttaaatgcacatttattgttattgttagtagtagaagtaatagtagtagtattcaagctgtactccttaaatcaagaaggcatttactaattgagcagcaggagagaaagcagacaacaggtgataattacacatttatcagaaaacattttatatctcaaagtgcagcctctgatggctgcagccaatttctctgctcatgcccagggtgcagggaagggttctagttctttactgtaaaaacagggtggcagaaactaacaaaatagacagtattgttttgttttgtttttgcactcatgtccctagacagaagcatgcatttctcacatttgctttctcaaggcctttattgtctgagcttcctgttagaaaaatcaagctagtgatagcagacccatgctatcc

SEQ ID NO: 43447 - DNA, 2295 bp, Bovine  19866880600457
cagtccatggaattctccaggccagaatactggagtgggtagcctttcccttctccagcagattttcccaacccaggaatcgaaccagggtctcctgcattgcaggcagattctttatcaactgagctatcagggaaaccctgaggagtataatttatcactttttttttttttttatcatttttatttcctgtctccagtttctatctctttacattttatttctctggtcagtgttggcagaggtgacaagaaaattaacctctctaacccccaatgagaggttaagcaaaatgggtcacagggggttccagctggagccctgctgggtcagctccccatccttatcctctccttctgaatgtcacaagggtttcacggtagtctgggctcctccgggaaatacacataatcaccaagatccttctgcttcttatctctctccaggctttagcctgaatcatgttctagtacctgagatactagatgtgggatggcacaaaacaatgtatcctatcgttaaggctaacctctcagactccaagggaaacttttatttcttgatatagtcctcaaatagaggcttataaagtatcctcttactaggcccttatattaagggagtatagcatgtgatacccacccccccctaattttcagagacatttaagagatgatttatcagatctattttcttatttgcttataatgacttttaattgtatttttagttgattcatcaagagcttgaaaagtgcttatttggtcttcccatcagttagttctgagagcctttaaattcatggtttacaatactgtatctataagataatgctttagttattgtacatgtttttctagaagaactgccaacagagaatgccaggcctgccccattattgccttcattttcaagacagcattcatgtaagaacagagttttaaattgttttggatagtgacaaaaacccgtttggttatgaaccatggatcatagaatggaactgtgcagagcagtagtgtcttaaggtgaactgaagctgtataagcaaagagaatagaattgcctttgtatatcttctgttgacttggtaaaatctgtgagcaagcctgtttgttccctggcctcagttttcccatggaaaggggagttttttggaaatatatcttaaaccctttatttggctgaagaagctgtattaatgaaaaatgtattatttaagcatagcagtagcttttgggtagtgtgtgtgtgtgcgtgtgtgtgtgtgtgtgtgtgtgaatgtgttcagacgtgtctgactctttgtgaccccatggactgtagcccaccaggctcctctgtccatgggattctccaagcaagaatactggaatgggttgccatttcctagtccaggggatcttctcaacccagggattgaacccacgtctcctgtacctcctgctttggcaggcagattctttgccactgcaccatctgtatataccattatgtctctagattaaattgaacaaaatgtaaaacagatagtaggaggccggctttatgattcttgaccatcaaaaaaacctaaagatgtattagcagcccacagcaaccctccagaacccatttttcaaagcagtctgtgttagaatgacacacacagtttctgccctgcgtggcaggagcttgaaacttttctccacacacaccccaaaggagttttctgctccaatgtgacaataagtgtgatatttactgaaaataccccaggagccttgagaaccattgttgagctgacctggacatggcagctcagtaggcaccatagggagtgtgccaatcctccttggaagcaagaactaaggttcataaatcaaatctcaagtatggaaaagaaagttgtcaaggcggtgaaggcttcataactggctctcactgttctgtagtgcccagctgtgctgatgcccacagagctttgggaccaattcaagaccagtcagccaccagctagacagttaagtccagggctgccagatatccctgcctgcaggtgtgaatgtaagtgatagggtagatggtcttacacaataactatgatagccatggggccagtgtcttccaggacaaaaggtatgtatgtccagggataaagtttagcctttttggagatggcattgatctatagcccctcaaagtgcttttcatttctcccaaagaatagtgtatgtattgcaaggttctgggtggaatataattaatagcattgaattgtgttccctccttgtttgcagaatactttacattca

SEQ ID NO: 43448 - DNA, 1199 bp, Bovine  19866880636711
atttagttttatctttaccggaatgcatttgagttaaacatatacataagttgtgcatgatcttattttgggttatacagcacaggacagcttgaaagaatagaagaggaaaagaaaaaaaaacatcacccagcctattggttacattggtcacatgttccctggtttaccttccaagtttagccaggtgttccagccagcaggaggtctgccttttgcccaagtctcccaccaggaaagagaagacaatcttgccaatgtagagtgaaaattcagcattggaccagaaaaatgagacttctgttcactgaggaattgattcataaaagaaaggaggagggaactgaaacaaaaacccagaggaaatctgaactgcagatctgggggacaagctaagcttttgtgctatgtgttagattagcgaggatgataattacctgaaattaggaaaacgaaaagcaagacaggaatgtgatagcctgaaaaaccagagtccccagagtcctacttgtcctgtcatgactgcctgatcttgcacaatttttcccagggtgagtataacacagaattccgcatgcttagggacatgtttgatggattaaactaaaatctaacctgggatatccattacattgcaagatgcatgcttaatatacatggagttgggaggaaagtgtttatgatgggaggcagagatgagtcaagcctactttttaaaattcataagattaatgctcatgttactcaaggtccaaagagttcatgatttcactttctgatcatgctttagttcccatccccactagaaagatgtcagttgtttcaatcctgtctccagagaactaaaatatccctgaagtcatttccaggggtgtaaaatgatagcaagcaagccctgaattagcattcctcaaccctttcagggctcagtgtcccctggaaaagaagcacaaagaaaacaatgttatagccaatcctggtgatgctctatcaataccactattttgtcttccaaaacacggggcctaaatgctgaatatgacagagacaggtatattaaagctggatcagctggctagggtatgaagacagctgaaatattcacatctctaaggttgccaatccaggtgataaagggttaagacctaaagtcaaggaaaatagatcaggtggtctggaccagtcaacacatttcagaa

SEQ ID NO: 43449 - DNA, 2560 bp, Bovine  19866880638356
tgaaatcatttcactacacacctgaaactaaaacagcattgtaaatcagctattcttcaatttaaaagattttaatgggaaataaattgacttttaaatgtaacgtttatggtagaatattttaactttatgtaaaagttagaaagatggtacagagagatcccatatattccataccccatcttctctattattaataccttaaattggtagggtgcatgtgttaaaattattgaactaatattggtatattattattaatactgactcagatttcctcgattttcaccttatatcttttttgtacccagaatcccattcaagatagcactttacatttagtcatcaagccttttcttgactgtgacaattttttagactttccttgttttgatgaccctgaaagttttgaagatattggtcaggtattttgtaaaaggcccataaatttgaatttatctgacgttttcttataattagacagaggggagttagcttcacctgcctgaaggtagagaatctacataatttatgtagaattcctcgacctaagagatttgtctttctttctccatttattactttgttcagtcattttttactatcagtctagactcagagatatttattctatattttgagttatagttcaatatgccattatttatttcgttactcaaatgattccaacactggccacggggagctctttcagttgactcctagttataaccccatcattctggcttgctgttgttgtttttaacactttcttattttcttatctggtgctttaagatgctacaggcttatcttgtatattccctagaatcagccactgatgaactgatttttaaatgttttctctccctccatttatgttttagaaataatgggcagaacagcaaatctgtaggctagacccaagctagatcagttttgctggcagatactatttccagactcttgagtcttaggtgtccatcttcaccttccctcctctctactcagttctaagtctgaatctattctcattctcttcattcatactaaaggagaaatgactgaccatgattcttctattttaaaaaacaggttagtacatattaagataaatcaatcacttaaagtgcatggtagaaggttcagaagaaatacagtgatcctgtacacaccctcttccaaaaaggtacagtctacttgtacacgatcgtctacataaagtaagagttgatgtgtgataaagccaaaatgtagtaaatgccacaagtgggcaacgggcatgtgtgaaatcgagatagcacaagaaaagagcaagcagtggagactctggggactcaagagggactggctggtggcccctgtggggagtgagagaaccctggcatcatcttaatggtctgaggacaagtcgaccctgtgtgattcttgccctccagggaagagggctcagtgttgacggatctgattctcaatagaaactcaaacacttcagttagcaccactataatttattggttctgtacataatgctattatggtttccaaattttgagattcagttatcttttaggctccatctgctggggaggatatggctgacctacttgcaatagaatgggaaagtttctggaagtcttgactatacctagggtcttgttaggaggccctgggtcagactgtggcagcagctgctgcttgcgagtggaaggtccactcgcaatattttgtcagtatcaccatcaaggaaagctgatgtcgcaggacttaaacagcaacttggccagcagatgttgtgctgccttgatttgcttcctgcagttttttcagatttactgaaaacattctcagccgtcatagcctgactggggtgctatgtgactcagggctgcagtaaaataattgttattactaactgagccaggcacttagggaatagttgactttgtacatttagtgagtagggtcttggagcatagagccagacgctcccctgcagatccagtgcctgggagtcagcacccccagcccccgagacttgcattctggggctctttgccatccatcccttttgaggctgagcgagacctgtaaagtcttttctcccaacaaagaaagccgggctgagaggctcagctgctgggtgatggtgcaccctctagcccctcttacccatgcccccaaagcccactgagcagccagtctgcaggggatcccctggaaaccacctgccccgctgcttcaggattaatggaatcaagtgaggcagcaaaaataccatgacagaaccttatgcttccaatcctctcggtgtcatttagctaaagaaaccgtcaacaaaaacgaaggagaagaaaacagctggtggtataatcctgctttattcttcagaagaaagcagaggggagaaggagtcctgattttcacatcttagaggactcgattggtggaaacatcaagggaactggctgtgtttgtgtgtgtgtgtctgtgtgtgtgagtggttgtaactgcaatttgattgtgaaatgttagagctggcttttagctgcagccctgc

SEQ ID NO: 43450 - DNA, 1209 bp, Bovine  19866880643403
ctctccttggaacgtggcctcggaccgggtgaatcctggctttcattacagctagaaatctttatcctttgaggctgaatttgatttttgacacagcttaaaaacactagaaatgaacacagcagattattagatcaaggtgtgactgtcaaagtagttttccgagatggttcataaataaactctgaaggcagttgcaaaatcagagttttgagtatgttgcagaaagaagagcagagttcccccccaaaaaaacaagactcctttggactattccagtgtgtttatttaaaaatcaaattagatactattaagatcagttcttttggggtatagagtttatgcagcccaaaggtgacctgctgctgctgctaagtcccttcagtcgtgtccgactctgtgtgacccatagacggcagcccaccaggcttccctgtccctgggattctccaggcaagaacactggagtgggttgccatttccttctcccatgcatgaaagtaaaaagtgaaagttaagtcgctcagtcatgtccgactcttagcgaccccatggactgcagcctaccaggctcctccgtctatggattttccaggcaagagtactggactggggtgccattgccttctccaaaagtgacctagtggacttgaaagaagagtgaacctgtagaggagcatgacagcaatactcctgaagactggatgtggggccaggtgtgaacaaaatacccacatagtctcagcaaaacacaccaccgtgttctgtgtcctttcagaggcccacttatagccaccaaccgctgtgaacactttgctatacaaagttatttctaaacaaagaaatagataaaggtctaggaaggcaagagttggggtgaaagagaaagggagagaggaaaatgcttctggatgttggttaacatttaaacttttcagatgtttcaaaaatgctcagggcattagcagcaaagagtgatataggtaatccacaaacttgtttaccccctgaataaaacctgaattgactgcccaaaccatggcttctccttggagattcacaaaggactcatttctataaacttcggagataaattttcaagctgttttatctacttctttttatagctggcactcagtttttcaaactgtgttagttgctttagtgaaatttaagatgcatgcggaataaagactcatatcattgaat

SEQ ID NO: 43451 - DNA, 847 bp, Bovine  19866880657799
tacttactgttggttagatttcctgccggtgatgttaaagcatacaagacactgggctggcccttcaagtgaaaataagactgacaaacaggaagaaaaatgatactgcaagaagagaatcagagtcctcatgggtggggcaagagtaacccttcaagtgtccagagaaagaagagccagcttcggaagcagctgctgttgtggaaattgttctacgcaatttctaagagttgttcaagccagctttttaaaatgagtttaaggtgtacatttcagttttacactttattctaagtggtatccagataacaataacaacaaatacttagatagcacttaccgtctgccaggatgtactttacatgctcttcaaatgttcattgattgaatcttctcataaccctgtgatgagataaatactatcttcagccacattttaaaggtgaggaaaccaaagaagagttaagacccttgtccaaccaaggtcacagagattggccatggtggaactagcactcacagtgcggagctgggctccagaatccatgttcatgagcaatacatttaaggcaatatcacacatggacatggaatacatcccaaacactacttaaatcaaaggtgattgtacaatcaacgggtcctaaaaatccaagaactctgtactttgatatgttacattgaattggtataggaatttggcttgatttagcaaatatttatttagctgtggcggattaagagatgagtaagatgcagtcactctccttaaggaggtcaatatgtagtgggagacacagataagcaaacagcttttcacagcgcactgtgctaagtgctgtagtag

SEQ ID NO: 43452 - DNA, 2605 bp, Bovine  19866880720234
cttgaaagtgaaaagtgaaagtgaagtccctcagtcgtgctcgactcttagcgaccccatggactgcagcctaccaggctcctccgtccatgggattttccaggcaagagtactggagtgggttgccattgccttctccgttctccactctagaccctcccatttctgacccccagtctccagtacagtgctctgcacctaaactaataggcacttattaaatgtttaacaaacttaagattcaggaaatgactatgatcagagggcagtatatgtagtagttaagaggaagctttggagtcagcttgcccagggttcaaatccagtgtgtgaccctgggaagtctcctggcctgtaaaatggggataataatagcatgtgtctggagatgttgtgaggattaaatgagtcattacacacaaagagtgctgagcctggtgcatggtaaacacaataaaatgttattattttgcaaaacaaaattcttcttgggcagagggaacccttctgaaatataccacctataataaaggtaaacatgtatttttggtcactgattaagaaagattgtacaacttctgcgttttcattatcctgttcctaaaggtaaaattctctgattaacttgagatttttactcttcagaagaccaaagggtcttaaataaagttatatacaattttatcttttaaaaaagtcaatatgagcctttttaaaaaataagttaagcttctaaaataatttttcctcttaaaaaaaaaaaaaacttagcagattctctttggaaacagattcacatctagattgccaaatttcactcttaatacggtatggaacagctgagttgtaattttttaacctcccagaacacacacatttgtgatgggaacatgggaaaggacatttatcttttcagctgcatgaaaatgaaacccacaatacttgagtgaactaaacgaaaagtatattttaaaaattaagaccatgtgtaacagggagtgtctatataactacaacattgaaattcgtacagttaggctattataatgtcctttaccagttgctggaagcagtcatgccttttatattagaatgaaagcaatgaaaattttcattctaaggtattcaggatttacatttagctgaaatggatgtgcagccatattgaatcagaagcaccttgtaattaggaaaacaaaagcactgaaagaaaaggggggaatgcggattttaaatgctcacttaatccctagttttaggccatacaacagctctctcgtggatgtctctccagataccaaaataacaggttgaaatataaagttgtccatgaatcactattcacactaactaggttctttgttcacactcgccagattatttttcagttttgttgatgttttgttttaatggctgcagttaataaccacccttagagactgtctatgtgcccacctagtacgtggcagagctcggattattatgatgaaggcagttttacaatcagaatccattagttaatttaacacagagcaaaaactcatttgtctccttcagtgcaattcatactgagagtgacacagggtcaggccttatctggtggagggggacagcgaaattaaagtccatgggtcccagcccttcacagcggtgggatgggtgattatcaggatggatataattgtacagccgcagcagtcccccacaatacactggctatccgcccagcacaaaggtttagatccttaatttgttgccagccagaacatctatgaaggagctatgtattttcgtgcaccatcagtcacaactatgctgctgtttgcattttggaagcttggcagctgtcaagctcctgcctagtttttggccagaaagatagtacgcagggctgtggaaaggcttttagtggcagaagtgcacctctgcccgggtcctatctcaggctcattagctgagtggatatttgagccttgtttcaaaggtgtacttcgatacacagtcatctgtttcattaagttaatttacctgagcaggctttcttgataatcagctcaatgataatacagcctctgcggtatccgctcaattctaaagacaaacgatgagatgaggtgagaggactgatgtgcagggtacctggggtctgcatacatgcacttgcctttcatgggacatttccagaaattcacatcgtgtccctaagcaagcaagaaccgtggcaggaagtttaccacggcttggtattcgcttttggtttcaaaggatgaagctggaaaatgagaacgagagcatgtgctatgttaatcgcttaagaatagtatccaattgttaagaaaggaaatgaagaaaggaaagggaagcagtaaaaaaaaaagggggggggggctatgcttttgttgattaggtgtttaacctccaggtgatcctggagagagtaaattgctttaagctaaattcacttaaatgatatggcctaaaggaaatgatatctataacttatgtcctgtaagaagctgttaattaaaaatccacatttccctccccctccctttgttggttctataagttgttcatttttaataagcttttgctttgtggtatt

SEQ ID NO: 43453 - DNA, 818 bp, Bovine  19866880723768
gaaagtcgaagatagaacctattgcataattcccaggcacatttcaataactgttgatctatcagggaaattaatgtaaaatagggatatctttttatctttgtaaagtctttgaagtagcctgccaaagattgtcttttttgaacaaagttatttcacagtagtgaatgattccatcaatcatttaagatttgggtgtaataaagtcaaacttagcaacttacatgtctttgaaagttaatttggcaaacaaactgctaactgacgctttttggaacacactgaatattagatacctgtgtgtctgttcttcatgccaaaaaaaaagcataacaagccccaagtgttgcatcacaactgataatttcacagacacagctgggtcttaatcatttgttcaatcgaaaagtgcacattaattaatttgccttaccttgaaaatcaaagagggagagaggttgagagaaaagcctaagccattccatatctccatttctgatgtgtaggttaaaattaaactttaaataattacttgttcacagggcagtccattacccagagatgcaaatgtgtatttacagacaggtgaaaagcactgctctagccattcattcagttgccagttcttcctattctggagaatctaaacccaaagagaagctctgagatgccctgatttggcttgtcagggcttctgttcagtgtaacattaaggaggagaaatcaatcacaggagtaagtaaaacataaagcagaccccaatcagaaagtattcaggtaagaggaagtggcaacctttaccaagggctcaagagcaa

SEQ ID NO: 43454 - DNA, 826 bp, Bovine  19866880727855
ttggactccctgcaatttagaagttgatttcaaagaaaaattgcttcaggcctcaactccttctgttgttgccaactctggcccatttttacagctgactgaccaccagctagaaaggcaggtctccggtagtcccggcaggccttgatggctccttgctgtccccgagcacaagtcacgagcgtaattacagctaatggagacaggttggggcaggccatgccccacacagcccccaccacctgcttccccaaggactgagctatagcttgctcaagcagctgctttgttgtgaatccccggtcaacagctgacatgattcatgagaccttcacactcctgcactgcaatcccctcacgcctctggaaccttctctgctagccctcacacacagtcccggtcgctggcttcatgttctcccaccctcgcccaacgcgacctctaaggttaattgcgctgcctccaggcctccacccagcaggaaagtcaacagtctgatttccctgggagggactggccagtggggggcaagaaatctgccccactccccacacataatcctagcagacatctttctcttcagcagcttaaagtctgagtgtctgatttaaaatagatctcactcccaatgccagtctgaaattaggggaaaggggttatcaggtggctctgtggtaataaagaacacattaatctcagctgagcttccagagagaattgttgttgttgttgttcagaaagggtagttatttaaatagagttgtctggagggtgaagatttaatacattgtcccctcaacaaaccctttaagaacctattaacag

SEQ ID NO: 43455 - DNA, 1591 bp, Bovine  19866880730702
cctgccatttaaacactttgattcttgaactgtccccttgatacaggaataaccttcaatctccagcattcagcaaactggattttctgtactgacatccgctccccaccttttctctgagcagaggttccctacttggacttaaagagtgtccaaatctatttatcctctcagctcctgaaacaggcagctttgttttcacccttcatcacagacaatgttctccatgatgtatttattttaaaacatcactcttgagggagctgccagcaagcaagtggttctacttaacaaagaggtgtcacgagctcatctatacctcctaaaactgtggtcgagaagcatttgaatctttctactaccttcagcctgcaatcaccaggccataaagcagaatgagcctttgcgtgcctacacgtttgcaagtgcctgtgtactccttttagagatttttttttattattactgaagccattagggactttcagccactctgtccacctaagcacagatgtatcaacctatatccaactgtgatcattagggtgcagtttccatttatgccagcctctctctctttccaaccttctgtctgttcccctttctttgacatgctaggaaggacatccactttggcatcacatagccctggctcaacccaggtggtgctaatggtaaagaattcacctgccaatgcagaagatgcaagagacacaggtttgatccctgggtggggaagatcccctggaggaggaaatggcactccacttcagtattcttgcctgaaaagtcccacagacagaggagcctggcaggctatagtccatggggtaacaaagagtcagacatgactgagcgactatgcatgagccctgtcttggtttcctggctttccccttttactgatgggctgtaaatattgactggacacgttacttatccctttgagcctcagtttccttgtctgcacaatggagagcacatggcctgtctctctggattgctgtgatatttaattaaaataacaaacatgtgtgtcacacatagaaggtgctcaataaactttcacttccaccccacccttcaccagtgtccacaccaatgttttcctttgcatttgtgagagtgctatgattcacatttttaaaatcacacaatgtgagctgtgccgtgtgagacagactctccctccagagaagaagcttaggggccggaaggaggaggggagggatggagggaaggaaaaggaggagagaactgcttctcctactgaagacacagagctccagccattaatctgggaattcaaagaatcccaagaaaacctgttaaaaggcaatttttagtatctcaactgaagaatgagcagatgtttgtggagggctaccattttctatgtgcgttatctcacaatcttgagaagcgattttagccactgttgtgatgagaaatccaaagctcagagatcttcagcatctctccagaggtcccaacccatgaatggagcaaagccattcaagtcctgtgttcctgccctctgctcccactgcctccctaggattattaaccatcatttcatttcaagcaaaag

SEQ ID NO: 43456 - DNA, 1822 bp, Bovine  19866880740598
tcctattttgaaaaagtaacaaagaaagtaccaagaaaaggattctgttcccatttgttgctaaaagctaacgtgcatttacaaagaaaggttgtaaaaagaaaaatctttaaagggaaaaaaattgctgagtgctggagagtggagaaaagtgaggctggcttaacaccatttaaaatcatggaagaatactcatggaaaaagttacacttgtggattttatgggacctgggctttgttggctgcaccaccctcactcctcatttgagagaatagtttcccctaagtactttttcaacgttcacataaattggcagaagagactctttcctaactgtctctgaactttggcttgtctagtctgtgttaaatatagttaattcttgggtgtggaccgtgtcgtaacagaaaggtacagtacacagcaagtgcacagccaagttcgtgctgctggtatgtggcactttgagtgtcatcgttgccaaggggacatgctcagagcccagctgccaacctctaagcgttcccagataggaaccctaaaattccagaaagaagtagagttggaggccagagaaagggtgcggtatggagtaatggaaacggaggtatgcacgctccagtcagtgggtggcaggtcagcccctgggcctctggatccctgggtttgagtcccagctctgcctactcatcacctgtgccatcgtggtcctgttaagcatcctcttcatgcttgaatatatccatttgcaagataaggataatcgtgttctttcacagaactgtgagaattaaactcaatagtttatgtaaagtgctcactcagtgcagtccttggcatataacaaacatttgataaatattcacttttattaacctaagtaaagcacttggtattaagcacacagattctgttatttaaaggtacaagtgattttggtaagtatgacttctgattttttttaacgtagacgaccttgataacctgcactttgttgttgctgctgttgctgttcagtcgctcagtcctgtccgactctttccaatctcatggactgcagcacgttacgcttccctgtccttcactatctcccggagcttgctcaaattcatgtccactgagttggtgatgctgtgtgacatctcatcctccaccacccccttctccttttaccttcaatcctcgggaaaagctgtatactgacttgctacatcatgactcagccactgttcaccatggctctgtaattcccaaactccagaacaagacccaaaatttgaggttttctaaaaagtgttattttacattgtaatcattttgccctgggttcagctcccaattctccagaattctccaccattccaaatctatttagctctgaatataagcttgagaaatattttttttaatgagcctagggctaagtgacagcaggacagacagactctctcaaatgaggctccagccagcatctgggctctccagcagagccagtctgctctctcaggagggggaaatctaatccccagaaagcagagagaggtagagagttcaaaaagaaagtgaagtacctgctaatctgccttagccatttgcatctctgacttctcccatttgctgtcacctcctgcaaacccctgcattactgagggcacgcgtgagtgcctgattctatatctttgaacaaacaaactcatgactcaagagtaaaatttgaaatttgtcaagaaacagtgagtgctgtttgccagtggatggaactccccgtgtcagactctgcccgcgcccttagctcccgaccacaccagtcagctgagtcta

SEQ ID NO: 43457 - DNA, 1469 bp, Bovine  19866880743821
cattctttgccattgcctttctttgggattggaatacacttaccaaatacacacaagtgccaggaactaggaagcactgagcctgggaagtaacgtgaagctgtgtcttaattctgggcatggttaagaaggcatggttaattaaggctttcaatgactgtgaagctggggaaagcccagccaggagaaggatattgaatctcattgtcttcctgccctttgaccgtctgccgaagaccattagtaaaatagcttgattccctcctccaaaaaaagaatgtatggttaagtcatgttctagaaagagcaattattaaaagtaagctatttgatctgtgcatttcaatgtctattctacctgacaggctgtgaagcaagtatatttaatcttaaaaggtgaaaaacataaaatgttcaataatatggaacccaaatacataaagggaatctgacaaaagacacaagctcagcatccaagcatatgtagtaatatgttgcatatgttgtttcttaaagatacggcgatgtatttcacaaaacaaaatggaaaatgtacactcataccgaaaaacatgacttactctaatctgtgtctccgaagacaagattcttggtgggcaaaatggggaaactgaggtagataagtatctcatgcaaaactacattcacagagaaaaccaaaaccaaggataagtgaccttatcttccacgaagctggtgtgtggtaagactaaatgcaggaaaaataaccacttttctaggcaacgtgaaggcctttagggacctagccagactaaacctgagccattcaccagatcgatgacctaaagaaaagggtggtttcacatttcctcctcacctttcgctcacagcttgccaattgttgattaaaaagtcctttgcaacatatcggccaacttcagatgctgcaacagcttcgatgacatttgtttcattaaaagtgaaaggagacacagtgatggcataatccatgtatctgcaaaagcacatttggcagaaaataaatatgtaaaaattattcaatagaaagaatataagtggagttaaaaatcccatatggttctaagttagtggtgcataaatatgtttcatattaattcttacattagctcatgtctgtttttctccctttagtttattaattgcattcctccaccaagaaccttttcaagttaagttacaataatcacctgttcagtatccgtggatctttactgcagctcattgcataagcaagttgaatcctttctttcttcctctgtgttattattgtagatttttaacaaaaaatcccattctttatcatttcccaaggcaatgccataacataaaataacatttttaattggattaggtattctgtaagatacaacatacaatgaagttatctaggttgtcacatatttagaagtctgctgctgctgctaagtcgcttccgtcgtgtccga

SEQ ID NO: 43458 - DNA, 1448 bp, Bovine  19866880768170
tgtgggcataaaacagtgctttccacacttgcctgtacactggagtcacctggaaagctttaaacattaaggatgcctgtgtcttacacccagagattgtgactgagttgacctgggggtgtgacctggacttcggaaattttggtagatccccaggtgactcaagtgagcagacaagtttgggaactgctgatataaacacaaatggcttccaaattacaatctgaatccctttcattgcaatgccttcagcttcagccagggataattaatcatgattcagagaacttgtatttgtgccagccacatggagtggcttttcaaatatccaagtgtatttcgtgcccacccaccctcatgccaaaccactagcaaaatataatttaatccattcaaaattacagggagccctgcagaaacttcttttctagcacggggcttgcaaaatatttctaatgtaaacacagacaataggtacgttctcttctatgacaagagttgaaataaagcagatctaattaacccacccagatgctacggagtagaggccatgtgaacactggattagaagcctatctcgcagccttatcaggacggcttttcttttcgacagtgccctggtaacctgagaaatataaattttgattactgattgctgcattgttagtaagtgactatatatcatcaggagctggtcaccagtgtcagcccagacttaattatctcagctgaagagaaagtaaccccctgaaaagaactgttttccaattaaagcagcatagaatatgtgatttgtctctctggcgataaccaattcatctccccttttcatgttatttgtattgtcttctttccctcattacaagctcacagttgtgcatcttgggctccctaacaagaaacacataaatatcaagagggcagctgtcagaactttgaacagaaatcatggccaccaccaaaaacacaacagttattacagagtttccactagcaaatgctacagctaaggttaaagacagctttcagtgtatctacttattttcacaggtttctaacctcaatagaatgtgtgtatgactacttgtactcatataaagacacacacatacacacacatacacacacacacacatacttaatttttagaagctattctttaggggtcagatgttctatgctttgtcttggctattgttgcaatgataacatttttatactagtataagaaaaaaatattttgggtaacattctagacagtactctctctttaactcctcattgtcctaatcttagtttttactgctgttactttgtgatttatttctattgaatgtctgcccccttgtctttcaaggcagttctttatcccaggagaatgtataagtttgtctctgtgactgactcaaccttgcccaggccataaacaaaggcttaaaaagtctggg

SEQ ID NO: 43459 - DNA, 933 bp, Bovine  19866880788392
catgtgcgaagaccaattcagacaattaggacgagtccctctgtgggcaacataacaggtggtcactagtttttcgtcgctgttgttctcgtttgcttgtttttgtctggtggtttgtttttcctttggatggacaagatgaggaagaaggcaggacatacactctggagcctgatttcccagatggaacccttcgcctggcaactttaccaccttgaagctcgcctggctctggcagataaggatttgaatgctagtagctgagctgggaagtgatcccagcagtaagagagtaggagagtgaagcaaggaaacagaggccaggagccagaatagagtgagttaatacacagtttcatgggtgccacaaggactcagtccttttggagcctgtcagactccaacaagcttcacagcctccccactccagaggcgtcgaggctggggtattcagccacggttcctgagtgagagctgcttccaggggccttaactctgaagatggagctgggccatgggagtctgcagggcagtgcctgctgacgatatgtgggcagagccccggcagcatctgctccaagctcctctcttcagctgtcttccgtttcaggcataggagcagctggtggccaggagccaaagcaagcaccaggaaaacccgattccagtaagagccagcagccccaagaaaggaaatggtactaggaacatgtggtgatgttttgctaggagcgctattgtgggctctgaaaaggctcctgtgagaggatttgcaatgcttctcaaaccatccagcaaggagcttccagctcagccgtgcgatggtgttcagtgggtaacaggcatgacagggccaaggcctcctgggacctcgagctaattaaatgcaatcccatctctccttcctccactgctaaacacatcagcccgaat

SEQ ID NO: 43460 - DNA, 1802 bp, Bovine  19866880798925
cccgaaatcggtcgtgccctccccccgcccattccctggccttcagagaaactttccagaagtgcctggtcgagtgaccccgtgcagggaaaaaaaaaaaaaaaaagaagaagaagaggaggagacgctgggcggagggtggcggcggcgagggagcgggaaagacagcggaatcctgtttcctttcccgatacccacaagtctaagactgctccctggctccccctgtaccgttccggtcgtggaaggagggaacggactacgggatcctgctatgcaccgtgtaatacggtggggagccgagaaaaaaagcagagcatctgggagacgggggagaaacacttcccatcccagcggggtcatgcagagtgggtgggcgctgtcggtctgggttggcagcggagcgccccactgccagcgaggcagcgctctacacgcagcaagtagtccggacaatcgagaaccccgggcccctgcagaggtctcgtctggttagcaagtactgagccatttctagccaggtcttcccacccttccccctcccgggacacctcctttccgaagagggaccacgtagtatttggaagagggagcagcgggcgccagcccccggcacggggttctgtgcccgagagggacgcagacgctacagatgctgtcttcgccgcccaggagggagctgcggcggggaataggacccagggcggggaagccgcgccacaccaggaggaggccactcattcgagcaaacaaagcccggaacctctggtgcccagcggccgcgggagccgggatgtcaccaagtggcagggtgcgcgggtgccagggccattacaagtttcccgcactccactgagcccagcccagaccccgcgccgacaacaaaagactctctttgccccccacccccaatctctccgtgtctgtggaacccctcctcccacctcgaacccaaacctagtgtcgagcgaaaacagcgctcttggaccgaacctcctctagccctcgagggtagaaccccttcccctgccttcgcaccaggaccgggcgcttccgagaatctcaccctttcttggcctctctgctgcccgctggcccgaaagtgaggacgaccccccagggatactgcacacacctcccagggccaggcagctatccgcgcggttggggtcccgagcggcgcctggcgtgtgcgcgacgcgagtggggaagctcataacgcggagcccggaggtctctggggcgcagggcggagaggagcggcggacagggctcgcgactgctcccccagggccgggcaacgctcggaagacagacacaagacaaaataaaacgcaagcaccacaaagccgacacggtgtgcggaccgcggccccgggacccgcaggagggagcggaaccgcccgggaggtggggcgcaccagggcgccccagccgtaccttttcggtgcatcgacgggcaggcggccggggctcggagcggactggtacagcgtgtatcccatttagtaatccattatcgaggggatctctccgggccgcgagctgcgctttccttcgcaagcctttgtcattcctacatgggtgcttgtctctgtgggggtacagtcgcagcgactactttctgggatgcaaacgcgccgtattcatttccaatgacaggcggagaaggggagatgaaaaaagaaagaaaaaaccaacaagaaaggaggaaatgttcaagaaactcttctccaaatccaaatttcacttggattccactccggcgagtcccttcgctggtgtttgcgccgattaacaag

SEQ ID NO: 43461 - DNA, 1799 bp, Bovine  19866880810541
tacacattatattgtatccacaggtcctccttaatacacccaagtatcatcaagtatgtaaaaaataaacaggtcaggcaataaagcaaaaaataagcagtaaaaaccacatgatagccacttttgtttcctttaaaacaatgttcttaaacaactgcttgcttttggcacacagaactagagaatgtatattagaacatcggtactcagaacaatgatcttcctcggctgttatttgtctatgaagcaataagccatataatttacaagaagaaagcaactgaatccttcagaaaacacaacctggcagttaatcttcaaagtaaaataaggaggtggcagaagtgtgatagagaaaccagtcttcaagaacatcatgtaagggaatccagctgtgcttgtatggtctctagctgtttacagagacaaaaaaaaaagagagagagagttggtgaaaggagagaaactcatatgaagtgttgtttagaaatatgcaaatgaaggaaaagaatgcaactggtagctctgcattttaaatctactcacagagcaataaatacaccacttggaaaatttttctttttatgtgaagctattagaaccccagcttgtgaagtttccaaatttgtaaagaaggatttctaaatactattgcttaaaatgcaccctagtgttttattttaaatgatcactacataaaatttgtatggggtgttggaggggagggtggtagggggaacagtgcattttcctgggttacaaaaatcagcatttaaaaagaaacatgaaatatcctcaaagataaatctttatagacctggtttgttccttttcccttgggccaagaaattaaaatatttaacattatctaagggccagtgtggctagatactacacagtttattactcaatgctttacattaaaacaacaatcctattgttttaattaaaaccatatccattttcttcctgatttagtctgtcagatcttcctcatctcagcaatgcttcctactgtgaaacacgaggtattcacaagggaagtttaaggaactcaagctccatagctccacaatagggcatttaaaaataagaattcatgaaatagaggaaacattgtgaaaaacccccatataggaaattattgaaaaaaatacataccttgttatagaaatcaaacaattccttgtgactgaattccacaagaactttctgcaggctctgtaaagaaaagaaaggaaggaagggagaaagaaaaaaaaaatttagttttatacagtttacactgcatttcttttctctccagctagcctcagaatatgtcatattattctctgagtggtttaaaaaaggaaaaaaaaaaaaaaaaacaccttacctggtctactcaaccccactgttccaaggactcaaaatacacatttaataacactccactgtaacaaaaggtttcaactctacaggagtatctgttctttaagttgatttccacaaaggttaacaaaatacaggccaacaagggaacactttcattatctatttttttcaagacagagataatacatgagattatatttcatctttctcagcagtccatttgaaatctggtaaataccattacacaaagacactggcggcagcatatctgattgaactcatccagccattaaatccgcacaccagcacagctgctgcctccaagcatcaaccaacagttatgatcttaacctgctgagatggttacctttttaaatgcacagactcagcaaaagttaacaattaacacaacagcttcaaag

SEQ ID NO: 43462 - DNA, 988 bp, Bovine  19866880811176
tgttggcccctgctgggcgatgttgcgtgaggatacaagttttatgcccatgagaaaaacagctctagccttcaagtaaagcatctgatctttttctcctcctcttctcagccattaacagagacataaaagctcccatgtcaggggaaagggaagtggcacagaccgaacttcaacacattttggagaaggatgatggcattcagtggagtacggtaataaatatcgactgtgtttaataggtgtcctattttagatctgaaaccactgtcacaaaggagcaggaaaacagctgtgaattcagaagtccttttaggaaaaaattttttttttttttaagaaaaataaaggttggttgtaaacctatgatactttggaggagagaaggaaagtctggtctttcaggtgatgaagtctttgttatgatcattttcttcctttctaccaaggctctccccaccccatcaatgcttgaggcggtgtatttaatgcacgtttcttggctgtttaagatacagtctcgtgactcgttagggctccgcagttacaggcatgatcttggcaatctatgcagaaaagactgtggcaggctcccttgatctcagaaagctgccaccatcccaaccatgtttacccacatcacaccctagctccctgccatctctgtgcttctcgattttttgtaatattgctgccctcaaacatctgctccagagataggaacagatacctgctttgttttgctgttgaggaaactgaggccctgagaagtgagatcattttggcaaatgtcgtgcagctgagaactggcaatgctgagcagccattgaggactccggacgccagccccgagctctgtccctgtgttacatggctttcggaaaggaagccaaggctcattcatttctccttggctttctgcctgatgttcattacttccatcactcgctctccctcttacaggttcccgctttcgccaggagccagg

SEQ ID NO: 43463 - DNA, 996 bp, Bovine  19866880821988
cgctttgtatcaaagtgagtctctctacagttaattggaactttgaaaattctctgaactctgtgattaatttttgatgagagcagaaaactcaaaaaacggtagataatgtccatacactctaccttcacctacaagatgcgacgtggagaaacacaaggagtcgctgataacctcctgtgacatgttctttatttaatgcactcagctacttaattagtatgccaatatcaatctttaaaagagctgtgtgcaaagtcagcagggggtctgagtcctgatgttatttttcccacagctgaataaatgattttccctaccaccaccacactcgtaggcttgtcctcattagtatgtatgaaatgagtggaatacgcatggggagatttatactatagcatacccaacttaattaataagaaagggagccaactttgagaggaggaagtacaggttcacaggttcctgtactttggtgtgattaataatataaatccatcataagaagactcgaaatgtgccttgtgcattttctctatttattaaccaaacttcagtaacttacagatgttcaggtgctatgattctcaggtagagtttgcaatttagtcataatatatccttagcatccctagcccacatccaactcactcattcagggaatagtaagtgagtggccaccttggccactgtgctgtgtaccggggacagagaaatgaacaggaagaaccagatttttaggtaactttcaggtaagtagaagagtgcatgcatgctcagctgcatctgactctctgtgaccccatggactgcagccagccaggctcctctgtccatggagacaaggatataaaaaaatgtgatccagggaggggggctgtctgaagggagatgtatgtataaattgctaaaaaaaaaaaaaaaaaaagcctcagacaatggcactagggaaaatggagcatagagggaaggcagcggagaaagtttcacaaagga

SEQ ID NO: 43464 - DNA, 1719 bp, Bovine  19866880839381
aaattgtggaagtgatggcagaaatcctcatttgacttagaatcagtgaacacagtgctgagttacccagcgaggttattatgatgacgaagattgtctttaaagggctggaaagcattttggatgcaggaagttttaataaaataataagtcatttcagtaataagtacctgctggaaaccaagggaggagtcttgtttcttagagtcaaagctctggaacctaataacagccataatcctaaagatcatggagattagcatcagtcttcttatcgtccagtgctttgacctcacttttgtttgctcacatggctcttggggctattagacaaatattgggccctcatgactccatgggtacaagtacgtcaaagtccaagttaacaacttcctcaagacactccgctttacatcctgaaagatatatattaccaataaataccatcacatccctacaatgtagttagctggcgagctaaaattgttcctcccttttctaagacccccatttttgcaccccacattccactgtgtcctcatatcctttaggccagtagctctgaaacatcatcgagtgccactgtcacagcggagactcctctccagtcagtctggccaggggtgagggtggcatagggagggctgagcacctgcagttctgataagcttgcaggtgatgctaattctgctggtctcttggccacgcttccagaagcaaggctataggtcacctgtcaactggatcacagggcttggaagtagatgatgactgatagttcttgcctgcagcccggaagactatccagactgcctgggaagcccccatctaattacaaagatccttatcctattacacagatccttatcctaacctcttccagtgaccaccacagcacaaggggagaattaaagagctttcaaaactcacatcccgagtggacccattttccctgattccatctccctgtgtgttagccatgcccacctctttttattgctcattatcgctagtctgaacaaacacaagcttcaacttgataagcaatcagctgacttttccataaatatagattctcatgaaaaacaaaaagaaaagggaacagaatggagaggtgttatgtgttcaatttattttcagttccaaacctacttttttccttaggtttgttgcctgatttccattaagtcattctgtttgctgcctctgcatcagtttttcctgctactctataaagacattgaaaaggattttggaaaaaaaagaaactattagctttaaaaaaaaatctatcctttttattctactggcattaaagaaatggacatgtgtaccaaatatcctagtgaggtcgagccctgatatggctgaaaaacctcacattcaattttctggaaatatttgctttgatccttttccttttggtcatcccaattggacccgcagttaaggaatccaaggtgctaaaccctctaaaggtgctccatttatgtttgtttattttttcaatattcaaacatgaagttaagacttaggaattaattcctcaaacaccagccaatctaagttttaaaagcatttattttttctcattattaaactgtttgactggtattctgttaagtcatatgctgattaagaaaaggcctttgttttatctcttgatgaagcctctgtaacagaagcttttattcataacagtagtaccaagaagcaagc

SEQ ID NO: 43465 - DNA, 758 bp, Bovine  19866880885849
tgcattttcaccttgctctcagcacatcatggccccacggttgaatgggtttctaccctgaactggacacccacaagtttgaactgtttttcaggatgaagtgtcacaactttattaaagttctgctgaagaaaaatgatgatactttgttcgtctgtggaactaatgccttcaacccttcctgcagaaactataaggtaaatgttgttctgtctgttggaaccacacagcctggaggtatttcataatttactgcgattgtgcctgcagtcacctaagagggttaattcaacaccacctgggttcctcttgcttgttccgcttaatgtagtgctccacatgactgatcctgagcaggcttctaagcttcctgtttgttcaggattgactgacgtggctttaaagagccgacccggcaaagtacgtttctgttaagaccctattctctattgttcagaatgtcagccctgtgtaccccacagaccatgtggatttcctctctctccctttctcctcttccctcccaccccaccatctcctctctgagcacaaaagcacacttatactgtgaacgatttctattttaaaagggatctcaaaagcatgccattggaaactgtagacattcctctaggtaagattttcaagaacacaggaatttaattccattcagaactcagctgacttgaccatggtctgacttatcttggccttcatgcaaaggggaaaaagattaacccttgcagcattataatcaa

SEQ ID NO: 43466 - DNA, 1410 bp, Bovine  19866880888765
gatcttttcagaatgcaaatctgattatactgccacagacttacagcccttgaatgactttcctctgctcctcaggtaaagaccagaaaccttaacgtgacctcctaagccggcatgatctggctgtctccccagcctcagttcacaccatgctccccacactctgcaccccaatcacacagatattcttttagtttatgtaactagacctcaccaggcttttggcacttgctgtcccttctaactgaaatgttcttctcagcatcttgtttattctctacctaaacaattaccgcgttctcaggtacctcagcatatgcagtagagcagggaagatggcatgatttgtccaaaggcacagggccactaaatggaagctcctggcctcgaattcacatccccagactccaagtttgaggatgtttccagtgcctcttgcatctgggttaagtgtaaaaacttaagctctagttctctgaaatctctgtgaagttccccacagaggcggaggctcatcttccaagttgaagaatatattgggaataagacagaacttgatctgaaacagccctgacctctcctaggctcagcccttctctctcccagcatcaggcaggatgccagctctcatggagcagtgattctgtaccaagttcagcagggagttttggattaagattctcttgttgacagcaatttttcttgtgaagatgcacaaagccagccttatgaattcctttcacacctgggagaattgaaatatatttccgtttgcaaacgtatataccttggtacatatctcataaaaaacagaaatgtgatttctttgaaaataattcacagttactcttccatttcaatcatttagtgagttctaaatgtgcttttctttccagagtccatgaaaaggtgtttattttccctcgtcttttaactagctgggtgccagcattttctttccatcccttgatctgacgtaagttcaatgttttgcttctgtctgctattccagctggtaacctcaggttgttggataaaagaagctttctctcaactcaggcaatgcaccaagtcccaccccaaacacagatgcacatacacacacacaaacactgtggagtacaatagtttgacgtacaggatgctctgaagaaagaaggcagttcacttccacccacaggcctctgcagggcagttcggggcagtgaaattggctgctatccgtgcaaatcagcatcctggcaaaggaaggtctgggtcaagaggaaggaatatcctatcctgaggaaaaaagattaggtttgttctgtatgattgcttggggatagcttccaaatttacaatgcacttcagctcttaaattagcctgctatcagtctaagatgcaaaactgtatttagaagaaagaca

SEQ ID NO: 43467 - DNA, 2309 bp, Bovine  19866880919320
taataatgaaaataatttccctttaaaaacatatcttgaaagtcgatgtggggcatttccaatatatccataaaacaaacaagacagtttaattgtttgtttctccaagggaagaagctaaaccaggaattaatttggttcagcctgtgaaacaattcgtttgctctgcctcattctgccaattaaagaacttttcccagacacaattagcatgtaaaccaggggcagaaaaggaagaaggggcctcggcgatccggcccggatggagactgccggcggagaaccccggggacgtcttgggccagacatgagggaccgcgccggggacgcacagacgagctcgggattgaacgtcgaaatcaagggcgttaaatagtcacggcagaggattgagcggtcacggctagccgggacccttcccccgggtccggaccggattcgaaagggatgtccgcgagccagtcgccacccgggccgcagaagtgcgcagacaagaccacggccccctagccccagcccctcctgagctggcgcctcgtgcggctggggctgcgcgcgcacctacggccgcagcaccccaccccccaccaccgcggatctctggcggcttttgcctgcgaaaggtggggatagcggcccctgctggcatctttggcgaacagcagggagacggaccttttcccctcaaaccattttcctcaccttttctaaatggtttgtggacaatatttatactgttgtcacgagtgcatttattttattcttcatgagccttcattagcatgcttgtgcgtattttagttgcctgtacgaaaggcaaaaaaaatgggggaaggcggtcttattagtggccctagccccaattaggcagcagcagccccaattagggaacaggtacagtttctaatgcatttatttaagggaactcggccgaagggggactgagaccctgatcgtcccagtgctttcctcggccgaccccataactagtaaatattgatccgagaactgcttggccgccagcgcgaaccaagtgagaagccccctgggtgcgggggccaacgtgctcctttgcggtcttttcggccagcaggcagggagcgcgcaacggccgggccagggggacgtcgtgtggcctgcccagtgggcacaagccttgtaactgtgggacttttgggctactgaactttcaagcggaggaagactgtgtctgccactctcctcctgatgataacacaaaagcgccttggaagaagttgcgatttagttattccatgaagctgttggatactcattggaattgtgtgttatttctgaagtttacagaattatttctaagaacagtgtacagacgttctaagtttaaaagcagatcgtcgccaccagcatttcttgcactatagttaatttgcttacttaacatgctttattaccgtgtgttgtttgtacgttaactaatagctgagttcatatcgtcgaagtgtatttttaagtgtaccggtttctatccaactcatctgggtgcgcagagcgtccgtcacttctggaatttacctcttgatatagtaatcagaaaggctcgccgttcacttaccctcatcctttaaaacttttccatttaaaaaaatcgatgaacaaatcctttcttgtaacttgctcctgcactacgtctatttttatttatttttttgatttggcagggctcggcaatgctgtccgagatctcccccccaccccccccccgcccagcaagagcaaatgcgggggtgaggggaggcacgggctgggcttctgcgggtgtcgcccccgccgggacctccaccgaacgcgccgcgggcgggcaatagtggtggaaggaagcggcgctgaccagtcggtccaaggctccacctgcggccactgcgggtagtttctccctctctccgcctcgctcgctccggttcacacacagagaccgcagccctcctttgggtcggagaagacgccagccaaagtaggcggggttgcaggagagtccgctttgcgcaatccagtccgggacttggctccgccctggagcggcggcctctctagtgacagaggagtagtgagcggcacggggtgaggctgcagccaactccgctccccgcgcacttacccaggcgctccggccgcagcagcagcgcttctccgcggagccgaccgcccgcgatgccagcttaggagcggcggtagcgtccagcaccgccacacccgcggcgtagcgctcccggttgtgaagcggagctagagcgcgcacccctgccccagcccccaccccgcccccccac

SEQ ID NO: 43468 - DNA, 1618 bp, Bovine  19866880929968
tgcctccctcccttccctcccttcccatatccccaagaggcagctgtgtggttgccagtagagaaatagctcagttgctcttgcagcacattttaaggcagaggagaaaagccttcactctggaatagaaatctctcagagacaacttggctccagggcaccccaagagagtgggggacactgggaggtcccaacaggaggcttccaggcttcccctggagatgtgaacacccaggaacactcactctgggaggagggcgatgaactttaagtgtgtgtggagcgcggaaggcagtgcagggatttgtgcagattttcctagactttctactgctgcaaatggcagatgcctaattaaagcatttgcaattagtttggcttgttctgtgattcctttctgcaaacaaatatgatgggagaatatattagctcttggcaatctagttctaaaaaaaactttttctcccatcattactcttttgtcctgctcagaagagagctgaagcactgtgtacacaaccttaagtatctgacttacctccttgtccaaaacagtatttttccttccatttcctaaaggaatgcaactacccatttgcctttaaaagcaggaagatttattctgaatttaatacaagttcttaatttgggtgtcttatttgtattcaatgatgataacagtcttcctaattcttgccatccttctgattcaacacacttggctggcgatgttatccacctcctcgaaatgcaaatgctatatttttttaatgatgggaaaagcagtcactagactttgaaagaacttgaggggtgtatgtttgtgtgtgtgtgtctgtgtgtgtaaataaagagttgcacttaccgccactttattataaccacttacttaaaggcacagattttttttttctttttcactgcaggggaaaaaatgtgcccaggtcgccttcaaggggagacacgtgacccatttgggactgtttctttcctttactcattcaacatttacttgagtttctatactggttcttatgaaattttaacttatttaaacttagatggttttatccaatgagtatactctgcaagtagcccctgagataacgatcttaggtgtctgttgaacattaaatgcattatgagactgtggcccatctctaaagggtaataactgcaaaacagaacacttagggaagattgccatcaaacagtgtaaataagaaaaatgaactagaatgcctaacacaaaaaaggtttaaatctgatggttattcatttctgctttcagactggcttgcaaagcacctcatttaagaaggtcctaaaaccaaaataataatagacagtagtggttactcaagagtcaaataaaagttaccatataaacaagcatgggtaagccaaattcaaatagtgcaattttttttaacagatagtttaggttaataggtggagacacacagtgttgccactatatttaaggttaggttaataattaactctgatgcctggagtagtttaatcaaagcttactataaaaactgctccatgcagactaaaagggtattaaagaaccatacaaaatacttgcaatcttgacctctgtagtcatttg

SEQ ID NO: 43469 - DNA, 691 bp, Bovine  19866880939767
tttaggagtggtagaagtttgtccagagctgaataatttcctctcctttatttaaaacagaaagcaagaacagatgaactcctcctggtgtcatgacaaaagaaatccagttcagtcatggcccttctctcgggttgcccatccttaggcacaggcacacaatctcagggtcaccagcagattagactagaatggctctctggaagaagttatgatctatcttgtcagaggccttctggggacactttaccccttgtattaatgacacaatattctggaaatgcttctttggaaatcatctgaatatattacaaaaccctgtggtttagcaatcccaactcaactgactgaaaactcttctggttttgataattatatcagggtacagacaatagtacaaaatcttgaagcattttgttttttcccttggaacttgcagggagccatacgtttacattagagacctgtctcctgcacatttttattgggaaaaccatagctattataaatactctttcatagacagtaaaactgtttaagatttttttttccttgattttgtaatgcctcttagaaatggctgaatgcttcatacttaattcttacaaaaacaattttcccttgaacagatccttggttttctgttcgatgtgttggtgtaattttttccattaacagattgaggcatttt

SEQ ID NO: 43470 - DNA, 1513 bp, Bovine  19866880957640
tcccttgtgtgtgcttgagctaatgaaaaccaaggggaaaaacacacaccccaccccctccccctacaaacaacagccacaaaaggatagtgaaataaaaacaactaaaaaccttttgccccagtcaacgtttttgcagcatccattgtggttggccttgtacttggagttactcattaatcacagcagggaccagcctgcctgcatctatttccatggtatttctttgtgtgcactgcacgtgtgtgcctagcacatggcttggagacttcccccaggtgcctgcccaaccttacacagcatgttctcctggcagtggacacagcagaaatgaggactgggacattagtcctttttctgctggctaatgaggacatcatcatgttgaaatgatctgagaatacaagggaagcagggagctctggaggaagaaagaggatttgccacccacaacactgggatccatgcttggcagaatggccaaagggtggttggggttggcaccactagatggaagtgtgaatcgggctgtggtaccacccggctcccctataaccatcactactgcatcctccttccctcagctggatgctaatcttccagaggactgcagtgggggtgggaggagggaggatcaaataaatatctgcatttatttcaaaagagggaaaagattatcataatgacagtttacaagtgtacacaactcagggtgtaaggcacaaatttacatgtggaaaacaggctattcacagatgtaaccccacgaaaaacctgtgtgatcaaaccattaatttatgcaaggtagcagccagcatattaattagttcacaccagtggtagattttgtttgctgtctcacatgcaaggtaaaatgagatggtgtttcacaagctggtgccttcacagaaagtaggaacccctgacaaagctatgttggcagcaatgggacatgaagtgccattctcaaagttcctctcctggttgctttaagttaggatctggaaggacttttaaacaaattattcttttgcatgttataggccagggacctgaccagaaaattaagctggtagatttaaataaatattcccctcttaagtgttttttctttagctagagatcagacagtccaaacacaaagctcagaattccagctccgacttatttactcagtgaatttattgtaaaaataaagaaactcaattattccagttaatggatttcacgttaaatagttttaactatcaagggggctttctgaagagctgttcagaggatggtatgtggaagagtcctttccttaaggaaaaaaaaaaatgtgaacaataaataaagagttacttgcgttaacggtcacgttatttcattaaaagagaggagcagaaatctatgacatagttgcccagcatggcattcatctgttataacagaaagctgtaactggtgggcatttcacagtatctgcgcatagtaaacttctgccattgttaaagtctagttagaattatca

SEQ ID NO: 43471 - DNA, 1462 bp, Bovine  19866880961552
caggtgggttctttaccactagcgccacctgagaagccctaattgcagcatgcagtatcatttttttagttgtgacatgtgggatctggttccctgactaggaattgaacccaggccccctgcattgggagcacagattcttaaccactgtcccaccagggcagtcccccagcttggctatttcttacttacctcttcctctattcttacttctcctcattcttctacgaaaggaagggtaagcagaatctttacccttcaacataggagacatttcttcttctgtgttccgaattaatcctgcgttctcttaagcttcttatatttctcttgtgctcttggggttcggataggaagaagaagctataacagccgggcctttcatcctttttttccactgaggcagcccgcgtcaccgcccctgaagtggcagggtatgtctccagaagggaggtcagggaatttggcttcagctctttcttttcttgctttgtggatagtaccttataacctggctggcatcaggactttgcagacgcaggaaggaagagatgtgttctttaatgatggaaaaatattagagcacaatgccctcaaaatagaacgtgtgcacctcgcctttattttggggacttttattgttgtaaccatctctcctgggaaatgctgtgggaggcttttcccctttggtgaagcagaataattgtgtaacctgaggtgtccccgagagagctgaagggatgatgtcaacacacaggttttagaaacatgactgcatattttttaatgtcaatcactgctcaagtaacatcccttgtctccaaagtccaatttctgtaaaatgaagataatcatatatgtggctgcccaccccaccaggctgctatgaggatctaatgatataatggataagattatgtctgcagactataaaatgcccccagtgtaaattgtcattttcatcagcaatcagaagacctgctacttttgggttggtgccattccacatttcatcgtttatgaagcaagcattagccttatttttgaaatttgtgcttctgcgctgacacagatcaggcctgcaaaatgttcagtgtccatatctaagaaagaagtttgttgagatcacccactttctcatcaccctgtaacgtggtcagggcaggtgtcatgatgaacaggataaaagagagcgtttggttctcagacagagttttcatcatctttctcatcctaggagacccctgggaatcctgccagagtttcttttcgtgttggttgcctggcactggtgttgtgtccaatgtcaccttcatctgtttttttgtttttttttttttaaactgaaaatcatcaatgagaaaaatgccttcaatttcatggtgtcctactttcgccttcattaacatccccttatttgaaccattattgcagctctgtcagtgggaccaataatgtggga

SEQ ID NO: 43472 - DNA, 778 bp, Bovine  19866881014881
tgttttcctttaggattaacaggtttgatctccttgctgtttaagggactctcaaaagagacttctccagcatctctctgactcccttccaaactagctgtgaactattctccaatgtgtttgctaaatggtatttctaagttcagaatctctgaaagtcaactgcctgcttaaaccttgaaatgactcccagacgctactgtatataaccttcaaggccctatctgagctgacctcagtcaatttctcagcttcatccctatcacactccatcctcaggctacaaaaagacacaaagttaaatattcacttttctaaatgacccatgatctcacttgtcatgtggctttttcacagataactccctctgcctggagctctcacttacgtcacaactcagtttcaatgtctttttctctgtgaagcattccttgatcccaaagtctgtttggttaaacccctgggacagggaaagctggcatgctgcagttcaggggtcgcaaaaagtcagatatgacttagaaactaaataacaacaactcacaccccagatccccagaccgtctccctttagaacatcaggattctgtttgctctttgcttgtttgtttctcttgttagatcgaacctcctggagcacaggaaccctatctggttaaaaagaacaaaaaagagcaaaagaaatagtacatgaatgattcagcaggaagtacagctgatgtgctgtagggtttctaaggaggagaacacggaaggaatcgtggagaaatgacattta

SEQ ID NO: 43473 - DNA, 1329 bp, Bovine  19866881030807
tcttgcctggagaatccctggacagaggagcctgatggacttaagtctatggggtcacaaaagagtcagataggacttagcgactaaaaaacaggatcagttcagttcagtcgctcagtcctgtcctactctttgcgaccccatggactgcagcacgccaggcttccgtgtctaccatcaactcccagaacttgctcaaactcatgtccattgagtcagcgatgccatccaatcctctcattctctgttgtcccctcccctcctgccaggaggagaaacaacagggtacactatcattttatggtagcccgtgttctgagttcttatccagtgacacagaaacagacttttgacatgtatattatccatcatcacttggcatccggcttgtatgtaatattggaacaaatgttcttataactgaatgcttgacctgattcagtgaaggagttggacgatccactataaatactcttaaggataacatttgtaaagaaacagatgctgtgtactgggtttgagctttggaaattacgttatttttgagaagagggaaggtctctctgtccataaatctggtctaatatccaacatgaatcaggaaatctttgttgaacacctactgtgtgctgctgggggaatagagcagcaaataaagtagacaaattttctacttcctggaacttcctctctgcatcggcttcttcaggacaggtgtattcttcgtcatattttctcagtcgcatttctcagggacacacatttctactcattccaactgccattcatccgtttgcaagatcccgatactacctaacatgaactgtgtctgactgtgtctaagtgagaagttcacttacaccaatggactgaccatctatttgttctttcagctgcagcagttttgcagtaacatgttggaggagcaccagagactcacagttcaggccaaattacagacaataaagaacgagaatctgaaaaataaagagcgaagtgccaggatagcggcgtggctgcggaagaacacataatttactggtgactttcagcctttcgcttgcgtattataatgtgctcacagttttgtcctccaatgttctctgagtctggaaaaccacacgttttgtttgcatttcagtcacctttgctgctcagagtcctgtccctcccatgttgtcacatttggctcagcgactgttggggatttggccaaccatgctgtatttctggggaagattttgcttcatgtcaggctacgaaccacataatttactttaaatgccttggaaaaacaaatttaccttgcagaatttcgctcattctgtt

SEQ ID NO: 43474 - DNA, 980 bp, Bovine  19866881038133
agaagggaatcatcttgaagttcttggccaggacaggaaacagtggtttcctaaatgacagccttttcctggaggagatgagcgtttacaatcctgaaaagtgcgtggaatgtttggttcttttcctagtacttatttgtcacgttattatcttttccattcagagaaagcatggtagacttagattttatgcattttaggtgacttttagcattatttgtaaaaatcctttcatacattaaaagcattatttcctccttgctgctaatgtgtgcgtttatacaggtaaacacatatattgtgtatttatgtgtatgtatgtgggtgcacacataaggatccattgcttcttcagttagatcagatgaagagacctaatctcataggctgggggcgggctgggggcggggaggtggcaggtggtggcaggaagaaaagaactaacccaagagagactatgaatgccttagactatcctgccttaaaaatgtaggtgcagctatgacggagtagaagacaagaggatcatgggcatgcagctggacaaagccagcagcttcctgtatgttgcattctccacttgtgtgatcaaggttccccttggccggtgtgagcggcatggcaagtgtaaaaagtacgtatttgcctcattgatcatcggatgttcacggtgcttagggaagagtcctaggtaagctcacagtcattctcttcctgcagaacctgtattgcttccagagacccctactgtgggtgggtaaaggaagcaggtgcgtgtgcccatctgtcgcccagcagcaggtaaggagcccgaggcatgggagagtttaaagtggcctaaacgtaggcttgattgtgctcacacacagcactgccgctcggccttctgtgcacatacctcatcattgtgcctgccggccgttctccttcctttccccatttcatagaataccccaacatcatacgggcagacttccaat

SEQ ID NO: 43475 - DNA, 1989 bp, Bovine  19866881080010
atagcactatagaaataattatgttttgggaatgtataaaaagtctctccagattttggtaacttgaaactgaattcattgactatctggtttattcttcttctaagtcacttcagtcgtgtccgactctgtgcgaccccatagatggcagcccaccaggctccctcgtccctgggattctccaagcaagaacactggagtgggttgccatttccttctccagtgcatgaaagtaaaaagtgaaagtgaagtcgctcagttgtgtccaacccctagcgaccccatggactgaagcctaccaggctcctccgtccatcggattttccaagcaagagtactggagtggggtgccattgccttctccgggttattacaaacaggataaaatattggaacattaattgccgggtgggtctaactttacctacctttgccttcttacgagaggaagactaaagcataagttttccaatcaggaaatgtaaaattacttggttcttggtttttgccagagagtaagatttctaagggttaagattataattggtcataattctaattagtgtaaccaagtttctttattgattacattgtaatcagaagcttcagttcagttcagatcagtccctcagtcgtatccgactctttgcgaccccatgaaccgcagcacgccaggcctccctgtccatcaccaactcccggagttcactagattccatatatacgcattaatatacaatatttttttctgacttacttctttctgtataataagctctaggttcatccgcctcatcagaactgagtcaaatgcattcctcgccatacatctttatgcacttgtttatgtcctcagagaaaattcctacaaagagaattaccatttcaaggatatatacatttaaaattttaaattttgttacatactgccaaactgcattccataaaggtttaccaattcacagtcccagtttataaaatggccttatgcattggcatcctttttagcactgagttttatcaatattttccttctttgatgctcagagcattattatttgcatttcttttcaaatcgtgctattgaactcttactgtctactgagctatctggattcccttttgctgacttcttctattcagccttggctttgtcctgctttttctcttcatcagtttgtcctatggaaaattcaactttttggttaggtctcctttcagaatggaaagcaatatttcaggatgcagggttattcagagtctctcctaaactgcattttctgattaggatgccgctacctgagtgactaagatgctaatttcagagctctttatgctgtggaatctgctcacttcacttcctttctcttctttctggtcaatgagcctgagtgattggcagtatctcagcagttttttcccaagcccatatactcttctatttacagtgtgcaaagctttagagagtgtacatttaaagctgttacaacattaaaggtgactggtgcagtccatctgttgggttgcaccctgctggcctgcaagccctgtgcctgccaagcctcaagacccaagaaagagcctggagtcagcaacagagacatcaatggtttaacggatgaggggagctcacatgtctgaaacaacgccctagaacaacaccccaccgtgtgcagcaaatggtaggcaggatatggcagtggtcttgctacaggggcagagggaagttaccaaccatagggggatgtcaggttggctcatctgttaccagggaaaccagcagaggagtatgcacttcaccacccctttaacaaactatcagatagagtggagatggctgtgatcaaagattagaaacagtcactagctagggccagtgcgtagacatttcctgattaggctcagtgatttagagggaaggtcagccatgtgagtaggtgtaagtgaagcagggactggtcagcagaggatgtacagagagcaagagaa

SEQ ID NO: 43476 - DNA, 2255 bp, Bovine  19866881087137
ttaggaatgatgaaagaaaaatgacatccaaaagaacttaactgactggccagtgctccatagctacgacagactgagccaccagcgagcaaaactgtccatgttctttacacaatgtgtgtgtgttagccactcagtcatgtccgactctttgcgaccccatagactgtaacccgtcaggctcctctgctcatggatttctccaggcaaaaatactggagtgggtagccatttctttctccaggagatcttcctcacccagggatggaacgtcggtctcccacattgcaggcagattctttactgtttgagccaccagggaagcccactttacatttaatgttaacctgcaaatagaccaagctattacatacccatggacattaactttgaaataagtttaaaaattattaatttgggtgttaagaatgtacagtgtgttttgatatagaggtatccttgtaaatgacagactggaagatcagtttgcaattaatgaaaccaaaatttcatataaatgcttaatcgctgctgcattaattgttggtgattttgcttttctttactttcttggattaggtgtttgggtttgttgtgggagaaggaaagcaaaaaactgcaatttataactccaggtattagccagggactatctgattgcaagaaacaaaaaacatttaaattagtttcaggcaagtaggaggaacaagaggaatgaggctcagatgggaagcgagcagaaacagacattcttaccctccaacactgagggggtcactgctagcctttgctctgctctgtgaggttgcttctttcttctctctctcagggtaattttctctgcctctccatactcaggggaaaaaatgccctactttatatcatgtcccagttcaaatacatccttaaaaaaagcaacctctgaataggttagtaaatactctccggaatatctggttcactggaagcttgtatttattttctgctccagcagcagaaagggactctccaaattctcagagcatcaatgtgtgtcttagtctgctcaggctgttataatgaaaagctacagactgcctgccttaaacaacaaacatttatgtctcacagtcttgaaagctgggaagtccaagattaaggtgttgatagatttgaaagatggtagacatctgccttctgtgacatccatgtcttcctatggacgagagagagatctggcatctttatcttcccgtaaagacactaaatcccatcttggagatccaccctcatgacctcatataaatctcataactttcccaaagtctcacctccaaataccctcacataaggggtcaggacatcaacctgtggatttgaggatgagacaaatattcagtccatgacaacttgtgccaccatcaccttggctcttaggcacacacacccccaccaccatcaccagtgtccccacatttcctagccctctttctgatctttatcctgctgctagcactatttctagaagtgaaatagatcttcattaaccaatattaaccaatagatcttcattaaccaatattaaccaaaaaaagcttcaggaagagttgttggccaaagacctttggagaagagtagtctgggtcctgcaagttctaacagcatctgcacatctcctggaggggtccctgatggatgaatctccaaaagcagcattctttgggcagacttggggatacccattttggattctatttcaggtacaatcatcagacacagtgccatggaaaaacttctttcttctaaacatcagttaaaaagcctacaggatctgagtaaatgacccctaaattctatagttctgtgacatggacactataccagtttggccattcctccatttattatcatttaaagtcaacataaatatacttgatgcttaagctacattttctcccatattccaagttactttacctatttctgaacttatgctgtacacttatttttagttcttcaaaaaccacgatcagtcacaaagttgtgttgcttgtatgagtagttcgcctctggttctagcactccaggggattcatttattcattcattctttcaaccactgcttagtgagcacttctgccaggcataaggaaaagtgccagacataccaggccctcacaacaagctgaacctcaagaaaactgatcaccacaaaacagcagcaaagaaatactagcagcttctatgaaggctaacaatatgtcaggctaaaatat

SEQ ID NO: 43477 - DNA, 1009 bp, Bovine  19866881088344
tcatgaaagctatgaataattttagtgaattggggccctgaaagtagcaaaggatctggtccatgatgtttaggaatgaaaactcggaaactaccacaggatgagtggctcgaagaataagaaaacaaagcaaacccataaactgaccatatactgtgttgtaagacatttcatgatctggtagaggagttgaaatgtctataaaaaataatgagaatttaaaagttaattgaaaaagaaacataagattcggaaatactcaagagggttagtgaaataggatttcacaaatagatttccattgctattaaattatcagtaacatcttccttaccattcagtgccacgaaggaatctgaaagacaaaagggaggagtgagttacttaacgtttaacactctgctcaatgtgacttttgtaaccagtgggaatgagctgatacagagctgcgctaacacacaaggcctagactaagaaagtgctttttactttctgctggttacggaagatgcttcatatttggttcagtttcatatccctgtgtctctttaccaagtgggcttcctcaaagtcatgcctttgttgccaagaggcagagaaaaagcaagcgtgagtgcagagaagggtaactgcgattatacataagccgtgctccatcaggagggacttgtacatgggtaagatgagtcacttctggaccacacttacgaagcaattgttctttatcgtctctctcatttcatcctcccaactgtcctgtgaggaactgtccgatatcacaatgttctgacctcagcaggggtttaagttaggaaatgaacaaaaataaaaaaaatcacacatagagacaacatcctgtttgtgtgtgtgcacgcatgtatatatgtgctgtgtatctgggtcatgtcactgggtcactcagcctgctcctcagcctctgatactggctctttatggtttcctcatttcccctgcaacttctgtgcgagagtcaccgtgcaccagatgt

SEQ ID NO: 43478 - DNA, 739 bp, Bovine  19866881103744
ctgcatgctctcggtgtgagatgaaagggcagaaagccaggaagaaggcaaggtctggaggaggtaagccaccagtaagccaccaggagggatctgaagccgggagccctctgagcaccagctagtcacacggcaccatgcagagaaggagcagacaggcctctgcgtgtttaggaacgtgtaggacacaatgatgggaagccagcagggctgactccaaaacagcaaaaacaacaaaatgccaaccggtccttggaggcccatctaggtatcttttgatctcaacctagagcacccataataggaaatcaaacacattgtaagggaagatacctcacctgtttttggaagagggtaactgatattaaataaatcctccagaaaagagaagatgggacctgtgatgttcaaagcaaaatctgcatttccatctgcgatggcatctttccgggcccagatgcgtatctagacagaaacaattaagcagtgattaggaaaagcaatatgtacagtgattttggaaagtggcagcctgcttgcttggatttcctgatgctctggagccaaaggttatcttttcagaagaagttgcatgataaaatgtttacatgtgtccatgcaatgagaaaagccctggaggctattcattaagttgggaacagagattctccagaaagtgtgttatttcaatcttttgcaataatgtgtaaaacttttataattcaaaaataatcctggt

SEQ ID NO: 43479 - DNA, 816 bp, Bovine  19866881152469
cagcacttatggggcttgagcttttgaccctggactcatttgttctgcattctaaccgctggccccagaaccttcttgccttttaggagtttgctcggagtagtttttaaaattcaagtttccatcaggaggaataagcatgcacattaactaactcacatttctgcccggtcccagtgcagtgatgactattgttgaagatcctgtgcttgaagtcagatgacctgagttccgggctcattaccacggacaagccccttaactcttttgaaggtcaatattttaaataaaaactgtaaagagtaaaaatgcatgctttctatctagtagaagtatagggagaataatacaaaatcatgagtgtgattgtatttggtaaaatataaaatgcactgtggtttgacaagtttgatgctaactcccttctcatctccagagaccccaggcctagcagagaccctgcttcattgtcgtttatagaacaaaagaaagattataccttgtggatatcattttaatgttaaccacatgatgaaattaaataaggtcctcagacttactgaaaataatctaggtagtgtatggatggcaaatttatgaatcagatgccaaccgtttcaactagtgattgttttcaatgtgaccattaaattaggcaaggtcataggagtatcactctgccaggcgttattttttttttaagtaagggcatttttttgctcaggtaagttttaaatagttcacatcagtgaaagcattgggacctccctggtggttccgtggttaagattccttgctgccagtgtggggggtggg

SEQ ID NO: 43480 - DNA, 1374 bp, Bovine  19866881162651
ctatgggtaaaggggtcttggtgctagagactatatgccgatctgaagaaaatggcaggggtggccgttattcaactgtaccttcctgccacttggctaagaagggcctgaattgacttacccacatgttcaaaagacaaaagaaatccaagttttcataagcaatctgcctttttaaaagagaattagttttcctttttctttttctgaacatactcagatgaccaaacaggcaggctagtaataacctctagcatacaggaacaagcctgggctgggcacaaggagatgggagtcaagtggcaaccacactgctcatatctggggcccatgggagcctctcagcttctgggcctctctttctcatctccacaatctgagggtcagacgtgtttctgaagtaggtgcaaaggccacctgagctctgcttgcacctgtgtttttgttcatgcttgctgatgccatactatttagcaggtaacctgagaaagaattccagagtcttctcctagaacttaacccacaaaggcaagactcctctggcaaaacaaaaccaaaactgaggtcattctctgtagagttcatgacttagcagataattctaggggacaggggaatatgttttcctggtgaatacctcagaaatcccttttccaaggagaaagatgcttatttctctagcattccaggaggatatgggaatctctttattgtcatggttctgagtcaagcagacatgactgattcttctgactctcctagctacagaatcttggtcaagtgacttaatctctctcaacatcagcttccccatctgaaactaaaagacttaaccttagagagtatttgagtattatttgcaccaggcataaaaattgctcaaaaaattaagtgctttgtaaatattagttgctgttattactgtcagttgttgtttctaatttagtcctattatttcatttagatggatactttggagcctgtgggtgatgaatttagcggaatggccagatgcccttacgatgccaaacatgccaatatcgcactgtttgcaggtaaatgacctgatttcctgatttctcctcattgcatttgttttcatgggctcagcctgtggctctggaggatttgcagagtcacagttgtactttgattttctggtgactactgtaactaagaaagccttttccatttgaaatcatatggaaattgtacttttgtttttttattgctattcagtcactcagttgtctccaactctttgcaaacccgtggactgcaacatgccaggcttccctgtcctttactatctccctgggagtttgctcaaactcgtgtccattgagtcaggggatgccatccaaccatctcatc

SEQ ID NO: 43481 - DNA, 1123 bp, Bovine  19866881164834
acaatacttgctcatgctcacacaccggtgactgatacaggtcaccgtatgatgtttgatgactggatcattagtcatcaacctccctcatcatatttgctaatgttagaatttctatttgacatacgtaatgaaacttttccctgtttcatcaataatacaccgagcggaaagttttcttctgtggccttccgatacccttcatttgcattagctggttttgcttagcacaacttttcaccaatagtacaacttacttaagatttcaaccagtagcataatagttgagaatataaagctatacactcctgtgtgtacacgtatgtgctttgcaagtaaattaagatccctaactactatttcccattaagatatatgtagctcaccaatctcaaagctactattctcaaattgcacacagatctctcagtgaatcgttaactattaggatcttattttatgaatctggaaacctatccattaatatgaatcatttaattcaattgtcactgttcagaaagtacttacagagctaaatagtcctcctgcaaggctgtcacattttcacggatcatagttgagtaagtattccatattgagataagtctctttaacagatacttctataaacaataaagagaatagtagttagttctgttcacaacactcaatttgcactgcctttcccttgtctgaaaagacattaacagagaggtgacaggtatttcttcagaaataaacttcatttgttactaaatatttgatgattttttttaacattttaggttcactttcttcataagaaagcgatatgtaaacaacacaatgtgtgtaagcacagtgcctggcacatagtaggagcttaatcagtatcacccactcttattacttactatcaccccagaatttctagttgtctttaaaatagagggaaaaaagggggaaaatataagacaaactttctaccttgaaactctcaaactttcatgcttagtgtgtgtgtgtatatatatacacacatacacacacacacacatatatatgtgtgtggggtatatatatatatatatatatgaaaacaaggaacactgatttatgccttggacaaatgtaaaccctggat

SEQ ID NO: 43482 - DNA, 788 bp, Bovine  19866881166879
gggcttaatttgatgagtagagtgatatatatggtagacatggaaacgatcccagtttccagaagctcaagttgtgagaatactcaagctccccttaatccaaggacatcctgagagcagccacttgaatttatgcttggctatcagctgggcccagagcagctcattttaaactacaattagtagcaaattatagtcagactgactttcaaaagagctggttacattctgctaggaaacaatttaaaggatcaggttggtagtgcctctaaatcaggcaggctcatctggctcccgagactggggcctcccaaccctgcaaagatggattcttgtttagcagaaattcaggtttgggctttggtattctcatcagtgttcactgacaatagctggatctgcctggagagggtgcagagaactcagtggcaaacatgcagaatggtaaggatgtgtgttccttctgcaaatggggagaactgccagagactgtggtacccagcttcttcaatcttgtggtgtgacctctctgtaagccttgttaggaagtcaagaagcccccagaggtcacaccgaggagggaaactcctctgtcaactgttctctcattcagtacacactaaagaaaggccagacagcacagggtaaaatcatgccactgggctccctacaaagtcacaccattcccagtgtgatgactggaatgctatcagctgattagtcccttcagagctggaatgcggggtgtgcagagtggggtaccgttttcaagggtcaagtaacttcct

SEQ ID NO: 43483 - DNA, 845 bp, Bovine  19866881172896
tgtcttatctattcattgtggggatctggggaatgtcttttggattctcacgtcacttaccaccttcattgcttcctcgctaagtcaaatttgcatcaccctttgcctggcctgtcacattagcttctagctgttagttctttagaattctattctgtcttctgcagcacaaattgaaacaaaattttaaggcatcaatttcatgatgttaccctgattgtttaaataccttcccaccaaatgtaaattctttatcctcatagtcaagcctctccacacttttgattacctattagcccccatctctcagtacatacaaaagaaattccttgccttggttaagttggtctgctgtgaaccccctctttgtcctaactgccttcctctatctttctacttattccaatcctgtccttccttcattcttttttcaagttcctcctccagaaagcctcccctgtccctcccatcacatacctatatttttcttctttgctactttattgtattcattgaccttgaatctatcaaattgaaatggagagcctgtcaacattgcttgggttccaccttatcaacgagatgggacctttgccctatagcttctcaatttcatataccttcttgaaatcaggcactgaatcatgtaacaaacatggaaagtgtgcagatcatttagcaaggaaaggcttttttgaatctttggttgtttttttaaaaaccaaacagaaacgattatatcgaaattgaaacagcacttgatttaaccaagtaccttgctgaagaagatgaaatcatagtgtggcatgcagttttgatgaacctagtaaccagggatcttgttt

SEQ ID NO: 43484 - DNA, 931 bp, Bovine  19866881178207
atggccgagacccagactctttgctgagtgactgagttagtagagttgtgtcctctctttcccaggactcccaaggctccacgtcagcttcttcctgtgcccctaccagccatttatacttcaaagaatctcttcttgaaaggaactctaagacccttttaaaatctgtgttctttgtccttagagctgaaattatccttttgggtatgctttcagaactcatacttttttttttaactagttaataactcgatctgtgtgtaaattatttacagatgaatgcacttccagccaaattgccttatttaaatgtatcattactggacacttcaatagcttctccatttgaacaccgaattttacttcatttcaaatatatttgcataagcagcttatatcattccttactcatccattttatggtattaaagtaataattttacccgtcttcaaaacaatatgcattagattattactccctcgagaatttatatgtgaactgggggtatttttttctctttatgtgacctttttttaatgattattacaaaattgaaatcgtattctttttcatgctatctaggactttttgcctgtttttaaagcaggcaagtcttttaaatgcctggcttgcaagtgttagctagcaaagctgccttgttgattggcattgctgttcagtgacactctctgtctttccctgtaagtatttccaggaggaacccattacatgactctcatgctgctgggagtttccctatcttcctttgtcgtgtctgcctccactgtctgtttggcttccatagcagatgttattcagattggattcttcccagccacagtgctggtgggaattttagcctcttttctctctctttctctctggcagtaaagaccctgaccctttagaaatgttaacctcactgattat

SEQ ID NO: 43485 - DNA, 763 bp, Bovine  19866881199245
ctagatgggagcggctggtcccctgaatgctaagaataatgctggcaagtgaacaaagatgtgactaaaaattcgccttagggtagggggcagactgacgtggtaatggtgggagtagagaaggggctgaattggagatggcactttccctggtggtatataaaaacggagtaaggctataaaatgactgtagcccttgttcatgaggaacctaatgatcccactaaatgaaaaggttaccgctgagatagtcatcctcatgagacataaatgtttaataaaaagggcccttcctttagaatatcctaacaatgttttccccatataatttgtgtacttcattatgaagtattaatgggattttttactcaattaaatactgtatgcaaatgccatcaaaatgtaattagcggtaaattaaaagtggccatgaaatggaaattggtgtgagaatcacctatcccctatggattaataagagccaccatttgttgagtgttgactatgtaccaggcagtatgccaaggacttaggagtcatcatttttatggcatttagtcctcccatcatgcacataaaggtagatactaggtttccccaatttaggaaagaaattgatgcacagagaaatctaagtaacctatcccaaaagatttggccagtgatagagtagatccagtccaggttcctctgacttaaagtcaggcactgaaccaccacactgctggattccctgcagccctgtcatggtgttaggcaggca

SEQ ID NO: 43486 - DNA, 1777 bp, Bovine  19866881201704
tgcccttggtgttgaagggtaggggggaaactcacccagggaaaatacgatcagacactgactaatttccaaatgtgacacttgtcaaatatttcacgatttatcttcatgaacttttaaagggtagaaactgagaggcaaaaaaccagcaggaaattcagctaaaactcacacctttttaggctgtggagctccccaaacagtggggtgtcttgcatccaaatatgttgtaataccaagtaactgcgctaatgagaatttcttccttaaatttgcatttccttgttatagcaaccaattttctttcaactttggttttgcatagtgttctactaagcatcatttttaaccacctacatatgatggcacagaaatgtacacctgtgaataaaatgggcttaatttcacttattgacttggtgatgtcagtggggtgtaacacaggctaggcccccccaatacagatattaggtagattgtttcatagcagtgggcatttcttgggccccttctggcaactgtatttatgggggctccccaataaattcatacttgtgataggtagtgatctacaattgactgtcaatttacaatttaaattaccatctaagtttaagaggatcatagaagaaggctagagcaatccatttgtttcatttattgtttaattgggaaaactgcaaaaattttaaagtatatacattgcttcttcttaactttgcttttagctcccaaatagtctttcttgtctgaagatgcttaactatccgagtctcttggaccccatttgctctttcactgggaaagactcttttagtgcatgacatttgagttcaggtttttggttgtttaacaaatcaagcagggtctgacctttgagaaaaatagtctcagacagctttctttggctcattttgttatgtaaatagtgtctttaaaaacctttctgcatttcttgggctttgagatagctaccttgaaacaggtggcttccctcctctgcttgtgcaaaatcagaaaccccatgtccaaagttagaaacagatcagagattaacttgaaagcaaagtcaagaagataagacgtgaaaagttatttttggaagatgctttccaaacttaaagctttctgattatatcataagaaaagggcaaagcagcatctgtggaaatgattaaatcagctttgtacagatggtcattgtgaagacttgaacacaccagacctgtcagtcaggctgagggtagtgtaacactagagatcttgctcccacttactgctgggtgaccattaagcaagtgacaatgtctctgggcctcagttttttccatctgtaatgtggggtaaacacccttaattttaatgccttactgcgtagttataagaatcagttgaaataatgattaagaaagagcttaagtacagcagtttgctggacacatctaaagatcagaggaagccaccaaagagagatggggggttagtagctcacggagggcttaagagtgacagtcacagctttgccattagattctatttgctatgggtctcccagaggaggggcagacgtgttcttcccagctccaatccttgggctttgcaaatgttgccaaaaggttgatatgttgaggcaacatcagggaacatgtacctctgtttcaggattgcctgtaggccctgaatttggaaataagtgaaacaacaacagtgggaaatgttgagcaaaacacagtgattatattaatagttgggcttcccaggtggcactagtggtaaa

SEQ ID NO: 43487 - DNA, 1056 bp, Bovine  19866881271263
ggcagcccaccggctcccccgtcctgggagtttccggcaagagtactggagtaggttgccatttccttctccgaaacctgaattgagagccgactaaaatatcaatgcctctcaaaaggacaccaatgtttctataaatcaaattatcaatccctgctttatctcttttacaattaagattttcctttaatttggttttgattgactgagcacacatttaaacaattttctgaaatggtgttaggggcagattcaccagaagatgacacaagttacaatcaggctctatctcatcaagtgagcagcagcattaaacaccacacacctcaagaatgttttggacttccctgtgtttctcgaaagggttgacacaaggaaccagctgtatataactcacacccttccttggcctgactgcccagcgcagctggtggctgccaccaaaggcctggctctgaatgctgcctcagccacatcgcaactaccagacactggccatgttttcactggtctctttgcttcatctgttgaatggggataataacactactcagatattagaattatcataaagacaaaatgggctagtacccacaaagctcttagaaaagtctccagcaagaccagtgttctacaacagaggaagatttcagacctgctgctttcatgatgccccactcaattttctcctttttaaactgtgtgttgtcagattcacttctcttttccatgatcaggacttccttgtttactttcaaaaatagtctttgtcccaaatgtattgtcgaggcaagctgggaaatgtctttgctgccagcctgaggaggaaagcacccttgatccccacacgcagctagatcccaggggatgtgtgatccagccccggacccttccatagtcaccccagctccaggtcccagcacccctgctccctcatgacactgtgagtatcttgccatgtttactgtccaaggacattttcatgagaggcactttgctaggagatttcaggtatccatcccagatttaaaaaaactaaggctcaggatctctggg

SEQ ID NO: 43488 - DNA, 1871 bp, Bovine  19866881290591
acaggcctgtgaatatggtggcaaatcgcaatacagctggccatccggtggccttgctgtgagccattgccagaccagccttcggaagtggcagctatttacaagaagaaggtggaatattcagccagagcaagaacaaggggcagcacagtttcttacaaaggggtcgggaggcagggcgctttaccttgctcggaattattcaagactcaatagctttgcatagcaacggaaggcttattgacaggagttacaggctccggacagccacacacaaagtcattaaccccctgcgggaaagtgtgaaattatcctgtattgagggctggcttcacttgtgtggccctattgaggccattgccccctccccctcccacccagccagttgagaaccagtctcccccttctttctgaataattagtgaattttgggtcccatatcaccaaaacaattgagatcccagcctttttttccttcctcagggggccatcattcccctccccacagaattgtgtgtttagctaatgcctctgcaccctgcaggaaatcctcccaccttgactttaggaggaaatgcttgctcctcctcttctctccactcgcccctccctgccccccatcatccttcctgcaaggaactcttgcatttggaagggttgatttttatttagtacaaagaaatgaggggagaatttctcaggtgaattgtttatcaccatatgggccattctaacggtggcactttcaacaagtcacttagcctctgagccaatttctatggattcaataggaaaaaaaaaaaaaaattcctaggggaaggtatcaagggaacaaccaaaagactctcccagctggtgagctgggtaaacattcagtgtaacagaaaaagcagagacttagcaatcatacgaatatgggaacctggatgtaggtagtgctagctcgcatgctttttttaacagaacagtctcaagcaattaactcatttgtctttttgagccctagtctccttgtgaaatggagtggggaatgcctacttagtagaagaaagtggaagcaatctaaggactacaaagagggaagcagtcagataaactgtgggacatctgcagtagaaagtactacataaactctaaaaatagagacatatatattgatgcggaaagatgtctataaataataagggataaaagcaagatggagggcattgtgtatgttagtgttccttttctgtaaataagtataaagcagttttacctgaggacatgtgcatcctagtatgtacataacaaaaagggagtgataagaatcataagaaacagttaaaagttagtttgaaggagaggggtgaaaagttaggtgtcaggaggaaggtttatactacttgtatttttttcctctgttaagttttccggccagggccatgtattactattatttttaaaacaccatcagagtttatttgcatagtaagattatgaatcttccttcctttccatgtttttctggattaaaaaatgaaaacttctaaaactgatgtgaaacttaagttacacatattaagagcctgaatcacagacagagcttggtttatgttagagcaaataaaacaagaggaaagatctgaaagttctctttatcaacctttttaataaatggatactatttttaaaataataatgattactgtgtattcagttcagttcagtcgctcagtcgtgttcgactctgcgaccccatgaattgcagcatgccaggcctccctgtccatcaccaactcccggagttcactcagactcacgtccttcgagtcagtgatgccatccagccatctcatcctctgtcgtccccttctccttctgcccccagt

SEQ ID NO: 43489 - DNA, 1757 bp, Bovine  19866881306508
gcatctgacactaaaatatacaaagacagggttttttcagagtcaacaatactattcaggatgtggtttcagatgctgcctgtaacattctccacagagactgaaaggatccatttctttctttttaaacatagattgtgtgactttatttatgtctaaggtcactatagaattacctgtagaattacataaccaggagtgaaaatctcaactaaggggtcaagggggtaatggaaatcattgaactgggccagtacaggtgttgggggtcaggtggggtgggtggtgtttgtggctgagagcataatgcttgaaggaaactgtcatttaggtcagtatgtcggatattctgatttttctaaagaaaggtaggaaccttctaatttttcaatattggggaactatttcaaaattctgaaagatcctggggtggccacacagaacatgtctggggatggcatgtcgctctaaacctgctgagaagaaaaaaatatatacatttacattaaaagggggaaaaaagcattctcaattatccacatttttcagaatgtcatttcgtgattgtgaaatagtcacacataatggcctcacgatggctcagggcaaaagaaccaagactctgagtcactggtttgggagaaattttgcaaaagggctcctatgcatgagggaggagggtgcagtgagtgataagacacaggttccttctgcaaaataccatcacgagtgtatccaccatgagaaagatagaacacagaggcccctttctctaaaatttatcttcaaggccatttgattttatggagtggaataaaactgacttgcaaaaaaaagagaaaagaataaaaatcccttctttgctctttggcagggtgaagtagagaagtaaagtctccccgctgaactactatgaggtcagaagccttgctgctatatttcacactgctacactgtgctggggctgctttcccagaagattctgagccaatcagtatttcgcatggcaactgtaagtatccacctctctctcactctgtccatgggcacttgtgcctgtttcaaccggcaaaagacacacattaaacatttcatagaagaggagacttgttagtcacttaaacttgtgtggatggcatgcatgtgtgcgtgctaagttgcttcagtcgtgtccaactctttgcgaccccatggactgtagccctccaggctcctctgtccatgagattctccaggcaacagtactggagtgggttgccatgccctcctccaaggggatcttcccccacccagggagtgccacctgggacggtggataattcaagtctagtcaaactggtgggatgactgttctatgactccaataaacgaggttgcggggacatacttgtgtgaggatttgaaacagccctcagtacctccaatgaagtctgagttactacaaggaggctttgatcacacctagaaaccagctgcgggagaacatcacggtcttctgggtgttgccaggactgcacattttcatggggtaacgaatacagaggcattgttacaacagaaaagaagaagactgggacaaaaattaacttttgtttagactcagaagtatatcattgcaagacttaaagtgcttctgaattcccagtggacctggtttaactgttcataactttcttttgatctctgcttcaatatcaagggtagaaagcaccatgataaaaggtcagttactcctcaaaagaggacaattctacctg

SEQ ID NO: 43490 - DNA, 937 bp, Bovine  19866881361237
aattcttaaaattctattttctctctcctacttctcttttatatttcatatcccccctaccttgtatttctcttccaaaattcctcccaacaccttgcctcttctttcccccaaatctgcgtctctaaagcctaaagaatacctctaaaaatgacagagactgcattgaagagcaaggaaaaggagagaactgagcggaggaaactgaaaaaccagattccttttttagaggaaatggaaatgctgggaaatggggaaaaaactatatgcaaataatttttgtcctaccagaagcacaagtgcagtgtttaaatgtgtatccaagcattttctggtcctttctttctgatatgctggtgggctggaatgacagctgtggaggtgcgttctcagaacagtgaagtgatcaggtgagatttcctgccttggggaagagctctcactctagtggtcactgttacagggaaccgatgctaaggaaacagaaaaaatattagcaatctaggaaaggggtctcccaaattcctgaggtcattgtgttctcaaccatgctctctggaacactagatcatatttagatatttagagcggggaagggaggagaaagagaaagaaaccataaacagttaaataattttccttattgcaggatcactcagaaacttgaatattaattacatgtctctaggaggaagagaccatgaaatatagcttaatgtttctttaattttttgatcacagaactcttctctttctagaacccctactttttacaacataatttggaaaaagggggtatatttgtatttttgttttcatttttatagatgttttgtagtgccacacattttatttagtaacaatatacagagtgtacaataggacacaaggtatttctttacatttaagatattgtaaaacactaaatatgtttaaa

SEQ ID NO: 43491 - DNA, 1006 bp, Bovine  19866881380645
cctgctacgtagactccagtttagaatgctgtaaacagtttgttttctgtttagtgctcactctacagaaaacgttcttaaagtaactcagagctcacatttttagaataatgcaaggctttataggctggttttccacctgggtttctgaggcctaagaacaaatgcattcatacaccaaaatacgtgaatgaagtcaagtggctcttgggtaaaaaggagagacagtcgctggactgttgtgagtgtcttttacggagtgcaatttttttcataaagcattccatgttcaggaaaggaaccttttcattcaccagctccatcagtattctcttagtttcctcattcaagggcagtaagagtctcgggggcaggagtcgggggagcactggaatcgctgcaatattaatgaaaagattgaatatgctcctgaaaaaaaaaagactcaggaataagaaaaaggaaaaaagaatggatccacagatagcttgtctttaaaactctcatataacatgaaaccataatagattctttatttcccagtccctcaaatgcttattttccagtggtgtgttttcattgtgttttgatgccagatgctgttctcttctataaatgcttcaaatcaaaccatggacaaaggcttggtcttaaacacgtgtgagggcagaaggggtaagagagggataaataacatcaattttagaaattcatcggctaaggttttcaaattggcttggattctttgatttaaagtttctgcagatggcaattataggttagctggaaaccactcgaaagtgctgagtcatactaaatgaaatcctcaggtctgaaggctgaatgtggaaacatctatactaacaacactctcaaagcaccagtcatcgcacaggctgctccgcgggagctggtccttcagtctttggggcctgtggattgctgatttattctgctctctgtacatcctctttccgcttacaaaatttaagagaaaaattttgtc

SEQ ID NO: 43492 - DNA, 835 bp, Bovine  19866881394760
tcctcttttatatatgcgagcatgctcagtcactcactagagtccgtccaactctagcaagtcgtaacccaccaggctcctctgtccatgggactgtccaggcaagagtactggagtgggttgccattgcctactccataccttcatcttttaatgatgttttcattaggtttagaattctaggttgacagctctctccctcactttaaagatatcatttgaacgtgtttttgagaagtctgctgtcatattttatatctccctgtgtaatatgtatttttactcaggatgcttttcaccttctttcatttcttctctattggaattccttctctaattatttttccttctgtaattccttaatttatctctaatgtccttcttttctttatgttaaattcaagcttctgacctataccatgctccttctcttcgaagaacttattttaacatttcttgcaaggcagatccaccagcagcaaactccgtcaatttttgcttgtctgagaaatgctttatttcttctttttgaagatattttcacaggacacaattctgggttggtgttttatttctctctacattttaaatatttcactccattttcttcttgctcacatggtttctgaggaaaaattggctacagttcttatcttagcacctttataagtaaaatgtgtttttcgcccccctctgctttctttcaagattttttctcttttaaattctgcagtttgaaaatgatttgcctaggtatagtcttttcatttacttttttgaatgtgtggatttagggggaggtttgtttagttttgcatttatcctgcttggtgct

SEQ ID NO: 43493 - DNA, 1317 bp, Bovine  19866881410258
tcaccttctatttcacttgtcttaaaatgaacattttcatttatttgaggaaaaaagggtcactccctcttctcgctattaaggatactcaattatagtaaaaaatatatgtatgtaaaaaatagctctggttgacatgtgaaatatacatttctttaaatgctgtaacaataaaaactattccatagcaactctttaacctctgataacatgttgaagttttctgaaattaatactaaggaagaaatcaccatgcagtataaaactaatccaaaactctattttgtaagagctgagatttaaacatagccacaaacatactatacatacacaaacacaattcaggtcaccttcatattccaggcattggctggacaacagtactccctctgccatatgtatgcaggttaaaacacaaaaccagaaatattcacaaacacctaaaacattaaaattgtaattttattatgactaccaccaattttttcccattgcagaattcaaaagaatatgttataacatgttcttacaagaacgccaccttgtaagcaaatctggtttctcaaataaaaaaagtgaagtgtaaatctgacatcaaaacttgcacaaataaagatctgtcattttgttaatccttgtctacttttaattaaattattttttaattttcaatccagagagcaaagaccctgccaacaataaagtacaagacgtaggaaacaaaatacatcatttcaatgggatactctttctcaccttcgaatcttcattgctcactccgagctgtaacacagcttgaggagattttagttttgcttcagcagagtgagccatctgaaggttaagctgccatccaaccgtctcgagctacaaaagacaagtgtagattggaatcagatggtacagaaggaagaaaacactcaacttaaagcaagtctccagtcagcaggaatgaacatggatagcctggactttgcggaaagtcagttcctgggctccttcaacctgcacactctgcacattctccctttgggctcgttagattggcctcatgccatgcctgtcaaattcaagcctaaaactggtctttaaatacattctgttctaaaaataaaagttctgagactaggcaatgaaatacactaaaggagtcaatggtttttaaacagtaaactactattttaaaacagtgtattttaaagccaatggtgtttaaaaatagttatagcatatatatgtgataactactctaaatgacctcccattatctttcaaaactctttgcaataagtagaacaaggtaaaactttttttttt

SEQ ID NO: 43494 - DNA, 825 bp, Bovine  19866881413851
tgtatgttggaagggaagaagagagagattcttagaaaccatactttacactgaattacagtaagttttcagtttagcagcttaaaagtaaatactaccaaaatattctcttataatttgcactgattctaatcctctcagaattattttaataatgtgtactttcaaaataactacactataaagcatacatatgaaagaattttacctgtttcctgtttttaaaaaaaaaaaatgacaatttcttaagcacgacaactttgttcttcatgatactctgcatcatacactaaccaatgataactttcaatattccttttaataaaagttctcccttcctttaaccaatctggtatttaaaacacattccatactcgtagttcctttaacctaatattctaacctgtctagaatttccgaattctcatttcagaagagaaaaaagaacagaatgagagatcataaaaacatggagaaaaagcaaagcctcccagcatcagttcatggagggcacagtggtgtggtagctcactgtccctttagagatggggcacacatcacgtggagagggcatgtttccatctaggttgatcataaccgtaccttccattacatgtctactgtttacaaggtataaggaataggggccaaatccataaaaatgccacaggagagacaggcaatacagacaaagaggttcacttaaatctgcatacaaaaagaaaataacttgtatatttgtgtgctgcagctctcttcccaggcgcctgttaatgaaaatcgttctctagctgtacaagtcatgcatgtgtatgagtgccaagt

SEQ ID NO: 43495 - DNA, 1114 bp, Bovine  19866881578364
tgattagttacatgttatatctttgttagttacatgttatatattataacttagccttgattataagcaagctttaactatttaattcagtttaatctttgcatttgtagagaaaaaaattcttcactgcagtaaataagcagtaaggcatacccttatattttgaagattaacttaaccttgagaatcatacttttgattttgacttcccaacttctgataggattaaggttgattgttttatcttcctgtgaaatagtataaaataaatgtgtacttatggatgttgcagtttagagtagaagaatttcactttataagaaactaatttgtcttcatatttaggcataaaaatgccagtatgtagaggacatttataatttattaacttaaaaaatatttttattatttccctttttactgttttttttattcctacttacagaatgagatacaggtagtgaacttatatttaagattgatcatttgttttgaatcaggtacagactaataatgactctatctaacgtagatattttgggttcaatctctaggtgatggatattcatgtgtaataaaactcactgcttgatttagcattgattgtcattgttgttgataatcctggcaggagcagcattgattgaacaaatgtgaagattgaatttgccttttcctagcaaggtagtcacagaagcaggatgaagtataaaagctgacagcaccacagcattaaatctattcaactgtacttcagaaaaaagaaatggcagtgattaagggtaccattcaattcaacaagcatttattgagcagttctatagcccaacacagtgttagctgctaatagatacaaaaggaaaagacagtataatttgccctaaagaagtttatcatgtaatttgggagacaagtcattcatatatgaaacagctggagaacaaaatatgacaatatataatcacgtgtggatttgtttgtgcaacagaaatacaagcacagttatttgtccagcacgtgaaaagaaatacctgtgtgatgtgaaattctgtgtggtgacataaagttaaaatagccttctctctttgcttctaatatcctaaaaactcattca

SEQ ID NO: 43496 - DNA, 865 bp, Bovine  19866881812893
taagtggtagaactgggatttgagcttagatctgtctcgtcccaaggaccgtgctccaggcacccccttctggcagtgtcctactctgtgaggttaagaggctcttcaggtctcactctagtatctgtgatgttggtggagggaaaaggaaccctacctgcagcgggggctcccagggagtggcagggccatgtaactgggactccgggtcttggcttttggcagaagctcctccaaacctgcttgatgctccaagcaggcagtcagggagcctttgcccccctcagggaggcagctgctatttccagctctgtgatgtgagcaggccccccagagaaagaattattgcaaacctggccttttcccctctctgttccagtgactgcaactcctggctgcagctggaggtctagattgcaagatacggaaagagttgggcccattttctgatcacttcttggcagtgagtgctcatgtttttacagcagccacaggctgcttcctggagtctccttcctggagactctaaggtggaaacaagcaaactcacctcttcccactttcctggcccctggcaggcagctgtctggatttgctgtggtcacagcctcccttcactgggcagtggccctcattagaagaggttgatttcaaggcactcctggaaatgtgctgcaggtgggctctagggcacttggcttgtctgctgcctcttcagctctgtttgctttgtctaattgtgttttctctgccggtttgtctcttccccactttgtctgaggtgcatctggtacccatttggctggggagggagcagaagcagggttgttaattgactgcttggcacagggctgcaaaaagtaaa

SEQ ID NO: 43497 - DNA, 826 bp, Bovine  19866881826625
agctgctggagacaaagagctgcatttgcatgcatcaagaagcaggagtataggtcctgaacccttggggtggagtcctcggaaagctacttctaaggtttttctgtggcaggagtcaatctgcatagtaggcataatgtgaaaacatcttctgttggaagactaaattatttccaaattctttttaaagtattcagctgtacaatgtcatagagcgtaaactcagtttcagaaggcttcagaccttgtctcaagcccttcccttcccagaggcgtatactgttaggccaatgatttgacctctctgaacctcagttatctcatctttaaattgggcataataatacccgccctgcctaacctaggctgtaatgatattaaacgaggcaatgtttgtaaacatacttagaaaaatataaggactgtataatgaggtctttattaatagtaataacactgttaaatactgttgatgctgatcaccatcggtaagcctgacttctaaatctgagcagcaagattcttcctgggcagaccagtcctgggtgtgcacctcactgttgcaaagtcagtctgtcctctccctgcaagataccattccaggaaggtatgtcgagctcttgaaacataggcagtgagaaacgatgaaacactgcagatgcactgtgattacttttattagaataagccctccagtgaagactgggttccgttgacaataagcaagaatagacattgcctatgttgaaaacctttgcaagttgtgctggagaatttgcatctcaataacaacgtgataatgtcaagctattcacaacatttcaaa

SEQ ID NO: 43498 - DNA, 684 bp, Bovine  19866880356237
ctcttgcctggaaaatcccgtggacggaggagcctggtaggctgcagtccatggggtcgagaagagtcggacacgactgagcaacttcactttcacttttcactttcatgcattggagaaggaaatggcaacccactccagtgttcttgcctggagaatcccagggacggcggagcctggtgggctgccgtgtatggggttgcacagagtcagacacgactgaagcgacttagcagcagcaacgaggacatttaagtgacaccgcttattcttaaaacacatacacaaagtttgtccagtgtttaagtatgtgtgaagaagaaacttgtgtttcaaaagagtccccatgtagaatttcaaaacactctattacattacgataaagtagaaatttagatatttttgtcatatagtctagatgagagaagaatatatacctggagaaataagctaatttaaatcattaaaaaaatgtcttttacatggaactatataaaatgctctgtgtatgtaaatattctgttaccttctttgagttgtcagatgcaccatcatagcctatggaaatgtggacagggaatcaactctgtgtagtcaatgagggacaggtgggaaatgatgttttcgaaaaagagggcacttatagtaacaagttatcactgtcaactttcacctctaccaaat

SEQ ID NO: 43499 - DNA, 1638 bp, Bovine  19866880442124
cattggagacaagtgtcagagtctcaagaatttccattaaaatcaaacaactaagacagcaaaacacccaccgaaaaagaacgactttgaaatgcacttgttagacagctccatgttagtgaagggaaaaagaatcaggtgtatgatctaaataaaacatcatttgaagattaagaagtatctttgactactaaagccttcgtgcacttttagcaatgtctgcagagttttcactcaaccctgaagctgggaacttcaggaaacatggcactgaataaccatttccttgtcagcaatcttttcaaaaacctgccagttccctaacaacactgcagggttttggtttcggttttgagcaggagaaagaagagatgaaaccagctactaccaccctcttgggctggactagctaagccatccctttgcttctgttttgagaagggctggaacaatttcgcttttgagaaaatccccgtggatgggtctggtgattaaactgagcatgggttcaagggcatcacgagataatcccatggtcttcatgactcaacccgtggagctttctctctcaggtcacaagactgcgggcagctggaccgctgagccgagcaggtcccaagtgtatggcctggggagcctggacgtgccagggacagaatgtagaactgggagatgacaagcagcccaaccactctgctcccaaggtccacgcagggttggattcctgggagcctgggggtctgaggccgttttatgtgaaatgtacaacgtggataactggatgaagggactcattctttcttccctttctaaataccagccgtgagaacagggtcaggttcatcttaccacctggcacagaggctctgtaaatgtctgtcaaataactgaataaaaaaccagaatcgaataaacagagcaccctgcactgaagatctgtacgtgggggtggaaaaacagggatgttggaagtcactcctgggacagggctaggtgaccctgttaacagcagccacagccaggacagatcaacatgaaaacatgaatggctaagaatcagaggccaacttggaaaacaacagaaaagaaagaacaacaacaaacgctgccaggttgcattaaattaccagaaactaaaagtgagttgatttcctttagggatggtacggggaggaaggagggaggagggttcaggatggggaacacatgtatacctatggcggattcattttgatatttggcaaaactaatacaatttgtaaagtttaaaaataaaataaaattaaaaattaaaaaaaaataaaacaacaaaaagaggtctgtttgtaggagaaactcagtgagacagtaaaacagaatcatctctaagctgttcagggttcataacttgtctcttttctagaaccttcagaaaatggcttaatcaagaaagagaaacagaaggtgctcatgttgttattctctttacaagatttacctggagaatctgccgtggaggcattgtaactggagggctgggacacgcttttaaactttggggtgatccttcgaggatggggtgtcacaaagagctgtctgggtgtctgtccaaactctaagatctgggtgagcatggcgaccttctcgtcaggatcctcg

SEQ ID NO: 43500 - DNA, 812 bp, Bovine  19866880473188
atgactgaggggactaaatgggccaccacttgggttgctgtggagagtggacagtagaaagacaagagtggaggaaaagaccaaggttgaatgactcttgctgtggaggtggtagagactcttggctgcagaagtggagaaaattatattcaaataaattttgacaagtgataacttcttacctcaacattaaaatttagaataagagattccactgctaagcttttattctcagtatagacttgctaacagtataatgagtgcttctgtgtttttccatctgtagttattatgtattttcttgacttcatcatgagtcatagtgatacagtcccaaaagagaagcaatgtaataggaaccacatttattacttacaaaagaaaacgtcccaaaatgcttggaagaacatttcacactctataccaatttcagcactcaatttaagttgaaaaagtttgcttttaccaagtctgtatgtttttggaaacattttcttttttccagttgggttgtttagttttcatcttaattctcaggtagaatttcatatgctaaaactaatatcacagtcatgacagtgtttttcacatctaaaaatttttttggttttatcattatcaacaaagatttatttcatgttcatttggcatctgtataaataaaaagaattaacagaaattattttagatgcatcaaaactatgattttaaagcagattcacagtgaatactagctgtgctgaaaataatactaaaatcttttaaatgtcagtcattaatggagtacttttggttttgacaacatgtgtgtg

SEQ ID NO: 43501 - DNA, 4499 bp, Bovine  19866880486171
cctgccaatgcaagagacacaggttccagtccctggcccaggaggatcccacgggcttcagagcagctgaaccggtgggccacaactactgaacctgtgctctggggcttgggagccacaaccactgaggctcgcacgcctaagagcccttgcttcccaacaagagaagccatcacagtgagaagccctcacatcgcaactggagggtggcccccactcaccacaactagagaaaagcccacagtgggaaaacccagcccagtcaaaaaaaaaaaaaatcataattaggaacaaaaggataaactcccccaaagaaagcaggttggattgttcatacagtggggttactacaggaggaatctcctgctgactatcacagtgctgctcgtcattcagttcctgcaggagaaaaaggcaaagctgagagagttaaggtataatatctaacagtacaatagtattataaagagaatcagtaagattgtgttaaagctatgtaaattaggctggaagaggatgaatatgaaaattacatgaaataagaagttttacttgaaaaacagaaaaaacaaaaccaagtggcccttagaaatgtctgtgtttgtgtgatgtgtatgggtgagtatacctgggtaagtttcaaggaagagcaatctgcccctaaatttgtttagttcttctataattcagattttgttttatttcagatcaatggtggagagaaacgacctgcctctgacatggggaaaaaaccaaaaacccccaaaaagaagaagaagaaggaccctaatgagccacagaagccagtgtctgcctatgcgttattcttccgtgatactcaggctgccatcaaggggcaaaatccaaatgctacctttggtgaagtttctaaaattgtggcttccatgtgggatggtttgggtgaagagcaaaaacaggtaagaaaagatacaaaatggatgattcaacacgatttgagaaagtgtgtgcatcctaaagaaatggcttctgaggtcgtttggtgtgtgctggtgtgtgtgtgtgtgtgtgtgtagtagctccagtcatgtcctactctttatgaccctgcggactgtagcctgccaggctcctctgtccatgaaattctccagacaagaatactggagtcagttgccattccgtcccagggatcaaacctatgtctcttatgcctccagcactggcaggaaagttctttaccactagcaccacgtgggaagcctggtcattgggtgaattcctcggatactagagctaaggctgagaatgtgccccaccagaaccagacttcaggggactctgacatggttttacattcctttattgctgttataaatagcatcttagttcctttgtttcaaagtttatatggtgtagttacttttggaagggcttctacatatccaagccagaattacctcattcgttaacgctgccaatgtgatcctaaagacagaaaaaaaaaaaacactaaaagcattttgaaaactgtccacacctctcttcagcacttagtatttactcttttgtcatcaaaactctctttgctctttgctaaatgaaccttgaatttaaggatctctacccttagccattccctaaagactgctggagtatgttattcaatccctcttgtaccatattgctaggctgtattaaatgggcccagatacctgattattttctcctcttgtggattgccatggtgtgactgaggaccacactggtggggagcaggggcatgagacactttgtatctcagccacagtgtaagtcatccagaaggtcttaaggaggatgggaatcatggaaaagagtcttatccatctctttgcgattctgtggacggtagcccgccaggctcttctgtccatggagttctccaggcaagaatactggtgtggttagccatttccttctccagaggattcccaacccagggatcaaacccgggtctcctacattgcaggcaagttctcaggctgtctgagccaccagggaaacccatgtgtagacagaacccacttcaacaaagaagcagtattgatcgcagatttctagatttccaggactagattgccattgtcaccatctagaatttcattatcatgaaggaaaaattagacaagcattatcattaaagtgcagtcactggatgtggatgaagtggatgcagctttagctactacagaatactgaactgcattcatgatgggttagtctcatattggattcttaacagagacttttacctctcctcctcaggtccagggaagtatgtaagaaagagaacatctcaaacctgtgtacatctctaagaacctatatatcgtagtatctgtcagcatctacaatgtatattgtgttttatattctaacaacagttttacatgatttatttcatttgttcagcacagtattcatagatgctgttttctgaatttcacaggttatgaaatggggccagatagttaaattcagtcacttatccattcaacaaagatttattgagtgtttactgtgtgccccaggcacttttctagacactgtgggggcgagctgagaatagacagagtcccatttgttgattgatttgtctaggactacacaccgtgactagaacttatcattcaacctacagttcttttctaaccaatttataaaaacaattatagctgtaatggtaaaaccagctgctaacaaaacattagctgaacctacttctccagttctctccaacccccctttactgtaagtcaaagctgtcctgtacagtctgaaatctacacattatgtccttttcaagattgccagtcccggcaaagggcttcacagaaaagcacagccctgccgtgtggagctctgctacaagagtcgtctctgaggatggaaaccgtagcacggaaatgctctctgtgtgtgagattaaaatacccaactcacaaatagattggttgacactatattttgtgattccactgaaaacctaatgtagttttttgagacttcagagccggtttctatcctaacttggatcagtttgctctcacactcccaaagccaaagtgtggctccccactgacgttggagacacacggtggaattctacgccgggtcttattcacggattgagaaactgagtgcacctccaccaggaaccccaggcccacccctgtcctgctctaccctggcctgggcaccagcacgtacctccctccctgctcagacagcccctgtgtgtagtcgtggataggggccaggcttcagtgctataaactcttgctttgtgagatagaatttgccagaggagacatccagaatgtgattgccttccctagtgactgtgatggcaacttgtaatcagaggacattagtgatcccttctgtgacctggcagcgagctgggggtgctgctcaaaggctcacatgcgctcctttggttttatgtcaagaaatttcagttgccagtgctaccaccgatctgactcctcttacctgtttttctaaccctggatatcttttcctaattacttcccacatttactagaggagcttaaatgggggaggtctacacagctctttcctagcccacgatcaaatcctttacattatcaattcaaggtcagtgcctgtacccatgtttctagtggaaaagaataatgttcttatgatgaaaactgggtagttcctcaaggcaacaagtataaagcttcagaatttccccactaattctaatacagtcttttatttttattatagcaagaggggaacactgagataatattccacatttttggtctgaccaggtaaggtctttacagacccaaagaatatgagagtcactattctccagtgtcgtgctaaaaagagaaatgactcccattctcccattctgcctttcaaactcagctctgagcctttctaatggaagtaggatcacaattatgacataatacttaaggctttttaattgtatattgtgataacaaaacactttcctctttctcttttgtttccaatttaatatgtaacttgtaatgagtctgtctttgggttctctcttaatagaaatagttggggggttgaagaatgtgttttataaataaaaaatgagattatataatagctgaccctatttgggggcttcccaggtggccctaattgtagagaaaccacctgccagtgcaggagacctaagagatgtgatgtcgatccctgggttgggaagctcccccggaggaaataatgggaacccacttcagtattcttgcctagagagccctgtggacagaggagcctggctgaccatagtccatggggtcacaaagagttggacacaactgaagcaacttagcatagcacagaccctatttaactcactgagtattataaagcaatttccataatcaaagtgcagttgtttaagaaaattattctaagattacttagggagatatattaatagaaatactttttct

SEQ ID NO: 43502 - DNA, 1356 bp, Bovine  19866880489492
cgtgtccgactcttatcgaccccatggactgcagcccaccaggctcctccgtccatgggattctccaggcaagagtactggagtggggtgccattgccctctcccgtatacttatgtggatatctgtaatttccaaatgcacgtattcaacaatctttacccaaacttttccagctggatttttttgtgtgtctattaatagttcagtggtgccaccatccacttaggtactcaagccaaagccttgggagtcctgtcctcttctaccctttcattcacacacctgacatctaacatattaccaaaaatacatctctaccactaaaatatgtcccatattccacttgagtctagagcttcaccaagagctattggcttaatggaataacttccttacctttttttcccctagttttcattcttgttttgacacaatctgaggcctattaagaagccagaatgatcctctagaaacttccatcaggttgtgttgctcttctgtttttcactgaatttagaaaaaaaaaaaaaaaatcctatctctttatcactgcctttaattcttctatgagctcatctctgccactctctgtgagtgagacttaatgctattcctggatttgaccaagtccattctgaatttgaagcatttatacttgcattttcttctgaaatcttctcatagctaacttctacctgtcaatcagaacagaatcaaatcagagttttctttgttagaagattaactttctgcctattgaatctaaagtggcttcctagtcactatctataataccaccatcttttattattttcccagtacttattgtaatataagcatatctattttgttattggtttagccatttactcattcgaactccataagaaggagcatcttgtatgtgattgatcagtgccttaaccccagcaccatgaagagtgtctggcacacaagagtggctcaagaaacagttcttatataaataaatgaatgggtatccagtacacttatgtgaaagagacttaattacagtagtggcattgaattaaaaagtgtcagttggtagcaacaggtcccaaggaatacagaagaaatacagtggaaaaagagtgttttcagagtaagctgaggttaatcaagcaggatttaaggaagaaatagttttaagagttggattttaaagatttgggctataggaactgtttattctcaacaaagtgcagcttttgaaagttcccacttccaaattcaatactattattagtagtagtacaatggtagacagtggagaagcaggtgggtttaattctatctgtaataaacctcaactattaaccatttgatgaaacagg

SEQ ID NO: 43503 - DNA, 1173 bp, Bovine  19866880502166
tccaaggaaatagccttagttcaaatcattctctgatcattctgctgaatttttttaaaagataaaatctcaacaatattattccttcaaaagaagctccctgcaagtaaatagaaaatgatttgtttttaaatctcttagtttttcagtgggtaaaaaccatgtatgaaatctgctgcaaaaacagacaaccatgagattaattaagttgctttttttggtcatttccagcaaagcttgcttatgcagcttttgaattcaccagataagctaaaaataactcttagcgtataatgctttttgtttaccagatatagctatctacttcagagattctgtccttgaatttttaatagctctgcaaggattaaaagtcaacacttcaccacaccagtgtgttaaaagaaccttcctgaagtctgattattatttgccagttaatagacttttcaattttaaaatattttctctgccttatacttttcctcctctgtgttttccagtggcaagttgttttgaatctccttccctatattagtccaacaactgttaaaaagctttggttgaaatttttagctgagaaagaagtacaaataaaagaagaagcagatggtccctttgtgactgaatgaagaaaaagggttttgagaacaatatgtgaataggtgtagtctaataaaacactcagccacctgctgcctgaatccttcggaaaagattctgttgcatattctggggattaactattaatgtgtccttgggttagacagaaaacataaactctgaggggtttagggccttttctcttgttttggttgagttggcttttctaaattttacattgtttctcaatttcgatgtatctgctcaagagtacaagtcaagtaacacatggctaaaggaaggaaaggtaagaaagatggagtgtgggcacttcttttccatctttgctttaagttttcatggttcttgggattagcttgcccttgcaggggcacaagcaggaaggtagtagtgtttgcaaacagtggctaaatatttagatgcttttcttcttaacaaggcacttttgatcctcatttgtggacttgctttgcttttcagggatttaatcttcaacccgactatcagaccataatcaatcctacatctacagctgcacaagtggtcacc

SEQ ID NO: 43504 - DNA, 750 bp, Bovine  19866880513778
tctcatataaagggaatgatcttgttacattattatttttctttctctgtaggttccagtcaatgaaagataagtagcgaagaccaacatcaccgtcacacttatgttttatttccttttctctagctggtgccttttggaaacgacttactatgtctctgaaccaggttctccactgtcgtaggattcgttagcatttaaaaccttctgttggaatcccaaacacaatcccgttccccttccagattcagccccatcttcgaaagtattcaaatggagacgctgatatgtcaagtttgtttagtggctttggtaggaacaactcataagggaggttttgtgtttctggaggatttttatcacttcttttagcttccttttgatttctcttctttgagagattctttacagaaatcaaagtacatatagttcctccctttccagggcttctgaaaataaagacctgcccatctgcagtggcttcttagccccgcctagactccacaaagaggaagcatgtgacacacacagacacagcagccccattagtcctgttccctctggctggcaagaaaacattcaattgtaatctcactaatagctgtttttccttaaatattgtaattttctgagcccctaataagtcatcaataattttgcccattttccccagtttgtgtttatatttggagctgttcataattgtgggctattatgacaacgggatttctgaacaatggtggtgcatga

SEQ ID NO: 43505 - DNA, 1953 bp, Bovine  19866880615723
gctgaacttgttgatacatgtcttttaagaagttatctgatgtctgtttgaaacttgcctgaataaggtacaattaattccagtcctaaaggaaaaagatgtttttaacttcataaatgccattaaacaactgaaaatacccagggatgttctacctatggtgtactataacttacattctagaatgtctccagtcgttaaatcttaatttgtggtgttttaaaggaatttaattggtatcactttacatccagtgataacaattgtactgcaatttaactaaactacatggtttactttcacataattacacattaaggttatttaatccatgcacttatgtaccaaaaccacagatcccacaacttaaccagtaatgggtagtatgtggatcaagaattttaacaacaaaaggttacttagtagtttctgttctttacattagaagtcatgagatggttatttgccaggagcctattacagtgtaaattgatgccatataaaagtatcatggtaactgcataaatgtcaaaatgtcacagaacttagaaaaacttcactgccagactaattactaattactttttaaatctggaaaagagttaggtaattcttcaacactgacttccatgacacgactttattttgatttcttgaaatctagtaagtctgacttaaccatagtaagttatatgttagaggcaatttgcagtttggggggttatgtaacaattgcttatgactcagtattttccctcattctccacaaagctgcctggttacagtcagcattcaatgcttgttgaatgaattaacaaatgaatcactaaacgaatgcattcaagagtaagtgaaggagaagatgactttttcaaaggcatgaagtttatgaatatacccatgctatggcatgggcatgaataaatacactgtattcccaagaatgcactggctagatgaccacatggtatggaatgctgactgctcagcatgttgggaagtgaaagtactatatcctgtgaaagatgtaaaggcttaagcagcctgagaatgctggggtggggtggtctggtgtgcctctttggctatttattcatctgtccctctgaagtggcttgcacttaccaccccatggtaacacagaagtcccagaggattcctaagggcggtttggggcttctggctctcaggagttgttggactaaccccagtgcagctaaggaccaggcggaagcctcagttccacatcaggatcccaaggggttggccatagagggcatgagagcgtgctctgagcatagaaactggacaccaatgatgataccaggggctgagtagtcagagaagcttcagtgaacgtcattccttgcacttcctaccaattcaggatgcttttctgactcaggcttattttcttccttcaagtctcagtgaggccaggtattaaaaaactttcatcctccaattttcttgacaccaaaaatcacttgatcctaagaccctgcatatccctataagacctagggctatgtatttttttttcagcctgagttagaggccaccaaggatcaatccatggtctctaagaatctagagggctgagttccagggtacagtgctggagaagagcaggtatggaccctcaatgtggcatcatcttcctgatcagccttgatagtgccgttcactcctccctgtgtagagatcagagccatgcagctgcctcctccccaagaaatgacagaaatcagtggagaccatctccacaaatgaagagaaagtactgagttaaataaaggtatgaaattcaagccaatatgtttaattttaccttggatcttcaccaagttaatgaatggtgaactggaatcaaagactcatgccaagtgatttgctctaaaccatagccagttagcatgatccaaattatttcaaatactcaaaattcgatca

SEQ ID NO: 43506 - DNA, 2452 bp, Bovine  19866880623116
cctacccgcccccacctcccccccagccccaggcatgatgtgtattccattactgtgttgtaatcattagtttataagctatttttcttctgctttagattatatctcaatcatctttatacttctaacctttggtatagaaatgagtacaaatggcctagtaccgacagggcaagtttttttttttttttttaatgtgacctgcttctgttaggtgttatttgggaatagtgtcatatattttatggggaatacagtttttaaaaaaagatttatccactcccttagcagtggtttatctctccctcagagaaaaccagaatgagttttttaataaaatgattgaacaggtacactgaatcttcaatttaattatttcaattcctgcaaaaaaaaggtctttcaaaaagcctgctgcttggtaaaatgtgataaagttccaacacattcttaaaagttggaaattaatttataaatttccattcaaagtttaatctgctattttcacacaagaaaactcataaggttgcttcctattgagttactatctttgcatctagagtttaagccagtatttaatctctttctagaagcttccagaggtgcttggtgcattataggtgaatgttgcccatttttattgcttttggagttaagcaagaattccacacctgtcattccagaccctggcttgcttacttacttctagtttatttctctcaatttttgtatttctcccagggcaggtcacctttttttttaatgtgccctgactctggcttctgcgtgtatgttcctaagcactgtcctgccctccacatcctcccagaagcttcatcaccctcttgcttttgttcttaacagccactgccccgctgaaactactactgattcttctgtctcgatctaggcttgtcctactctcattcctggagcaactattggtgattctttcatgggatgtctctctcacccactgtgttaccattctatgtattttatcccatctcccttctcaataagtttttggggcagtattaccgtgccctgttcatctctgagacgcctgcaatgccgagcacaatttcttgaccataacaaggactcagtagctatttgtttaactgaattgaattcaaatatgttcaaacagctctctcctcactatgtttgacaaaataattataacaagtccataatcacattcaatggtaaagccaggatttgaacatgagtagctcactgtactttaacccctacaactttgttatccctacaatagacagaatatgtattcaaaattgttggcctggctatataatttatctctaatcattaaagggtaaacattttcctgatactactgaacatattttctctgacagtgtgacaaaaaatgattttattttttctgtgacaccagtttcacagaatgggaacgtaaagcaatttaagagcattcctttcataagtttattatgatatccctctgagttctttcaggatctatagatacaatgcacagatgtatagatactatcaagtttactatataatattggattatgcatgcatgctcagtcatgtccaactctttgaatccccatggactgactataaaccaacagtctcctctgcccatgggattttccaggcaagagtactggaatgggttgccatgccctcctccagggaatcttcctgaccaatgaattgaacctacatctcctgcattgcaggtggattctttaccactgagccatcagagaagtgcccataataacggattgtctgtccccagttggaagactgtttacttctgtgcacttcagtggctcaaaggtagcacaggagtatttggagccaaggatgtgggctttataataaacttggcttagcattcaggggtttattctgggttttggggcttcaatatgctggaagaaatatggaatctacaaaacatctttttaatctcagtgatggaacttgaaaatttaaaaaacaagtctaaaaaaataacaccaacttaatctctccctacataaaggaaccacttgttctagtagaaagcactgttgaatttatttttagaataggaagggaaaataaaactgagggaagcaatgaagcaacaatgaattacccttctgctctggtgatatatttgaactgatttttcctttgtggctgggctttttctgggggacagaaacagcagaaattattttacaatgcccttcaatagctgagtcaaaattctcctgaattgttgaaattcttccttatttgcagttgagtttactttacttttaccagtaggtgtttcagatcaatgtgcatttcgccaccatcttctggatggaaaactgcctttccgttcagcagccttctcttaaaatatcttaagtttaagattttctactttataactgtgttgtttcctttctaa

SEQ ID NO: 43507 - DNA, 3155 bp, Bovine  19866880743917
aattcacatcaggaagatttaccaacttggcccagtagctacaaagcagtgtggtaagtgctgtaatggaggttggtggagaggagaaggatgtcctagctccccagagattgggaaagcctttgctgttacactaagttgtgtccaactcttttgcaaccccttggactatagcatgccaggctcccctgtccatgggatttcccaggcaagaatactggaatgggttgccatttccttctccaggggatcttccccacccagggatcaaacctgagtctcctgcattacaggctgcttctgtaccgctgaaccacctgggaagccccagcaaagctttgctgggaaaaaaaatccttaaagaagactcaaagcatgaatacaagtctgtcacgtgggccagggagaatatgtccaaataaattagcttttagagcaaatatcaacacaagggggagcagggtgattactcaagaaagcataatacttttataaatatggaacatttaactggataatttaatatgaattgagtttgaaggcagcatgggaataaggaaggaggcggtttcagcttttattatcagtgtgctttaccagaatggctcttctgggtgatgactactacctgttctaagtatacagcttaaagggatattgcagattgctcatcttctccatttataaaacaaagtcaagaactggtgcttttgttttatacttgctccccagttacagaagttgaaacaaccataaaattcctcaaacctttgccccttactattgaagtcaagtccccctctataactttttgtttcctcaaaaattacacaatctctgacaattatttctaagaaataaaggatgtttgtgtgtgtctgtgtgtgatagagacagagaggagttaagattagagaataaaaggaaatcagacctattatcaagctttaagactgctgcagtaagttagtttttatcccccttataatatagattaacttctctaaatgatttaatttaatgcctttatcaggataattaagccatatgaatccttcacagtaaagggggaaagacttaaggatttatttcatatttttattcttgcctgttttttagtaaaaataaacttgcaaaacttctttagaaaacgtgtttttagctttacaatgcacatttttagctgatattacttacaaggagttctctagtgaaatcctatatattcattcctcaataaaagtactaattaatagaggattaagaatgtcagaatcttgatcaaacactgtcaagactgtgtctctgatggggctgagacaggatttgcctgctaactaaacctgtatagaatataccacaggtcaagtgctaactgcttatttttctatttttcatctgacaaaaaaaatggcagatttattttattccaaaagactggacactggccagactgttctagctaatgataatgtttcttgaagacggacacagatttttactgctttagacctaaacttaactataaaagagtacttcaagtactgagcttctgaaaatcatcattgttaatcatataaatgggaatgtctatgaacacatttaagtaaagaaaaatatcctgaattcctttagctgtgatgatatatatctacataaggtatgtcacacattcctggaggaccaatgttgtactaaacgtactatagagagaataaaaaaggctttggaaatgacacaggtttaaagttcttttactaactctgctgagataattcaagtacatggaaggggaggtgggtgaaagcgagagtagaaaggagacaggtattagtgcctgttgtaattactgtgttccccatggtctgaaatgctaaaaatgaatgtttcctctattacaaggatataaacctttctcactgaaagccattagcatatataatgcacatgtctgaaaatcatggtttctctgtcactcttttaagacctttagggacttgggttattgtagagacttaaattaccgccaaagcgtaatttgtagttctctagttttccagggtatttttaaaaatcagtttaagcaattttactcatatttaatggctcagtcttttccaacaaattaaagtgtttgtacagtcttgactctggaaaaatttgctatacaatttgcaaaagagaagaaacattaatatacttcatcaactgcctgcatttctatcaatgagatgatttaaaattgcaattctagtaatttattaatgtaatatttctttaaaaataaataaacaacttctcagaagtcaaaacacatataaactcttgatctgcttacaccattctaggcatataaagtcacaagaaaatgaatgacattaatttgtaccttttgtacaaatacatttcctcttgtattctggggatagaaattgtactacacttaacacacactctgttttttctgttttcagttctttcatcccaaaggaagaataaaacaagaaatgttacttcccttattcagttttatttcggtctatgtcaatttagcatattttaaatagtctgtataatttttaaaaataaaaggaccattctaatgttaatttggatcaactttccaaacatatgattctaggtttccaaaaggggccctcttgaggggacttttaaaactgaacaacaacaacaaaaaagcaccctgaggctgcccaattcacatttaacctacttacatgaaaaaggaactgctttggttaagaataaacttccaccagctcaggttcaagctaaatacaccagcatattagtgaggaaatgagacagcaatagtaactcctttcatactagcgagaaaatactgtatttattttaaagcagctggcagaaattctcattttaattaaattacatttactgaaataacattttcataattaaaaaaataacccatttctcccaaagagctagcaaaatataatcagaataacttaaagtgggcaaaggagtaatgagattgttagaataaaagtgactaatttggattacaattgtgcatcagttcagtggttttcagtgatgcagaagccattactatcttttgttgccatgtaaagttaatacaaagtagatagcaagttttgttattaatg

SEQ ID NO: 43508 - DNA, 4694 bp, Bovine  19866880800008
gcacactaatccagaaataaatgtgtcgtttctatggctacattgtaatgggcatagcctcagagagtgccttaggccacataaaagacttaatgtacagcttgaatagaaagcacattatttattatgaagctatcaagttgagaaatttagcaatctcatttaaaaaatttgctcatttgacctgggccaatttgcctgactgataatattgaatatttagtatcacaatgtttttgcaatcttaaggataaagtgttttgaactaatttgatttgaaacagttggctgaatggaatgattttatgtccctaaaatgtttattgatgcttcttttttagttttagtgactaaaagtttaaggggaataaggtctaggcaggcctctgatgagggaagtcaattaagcaaaaacagtaccagagatagaaacaaacccatttggcctgattctgtcatctgacatgaataggtggggagagataagagcagggatggagttgggagtggaaaaatgtgttccccacagctccccacatcccagaaggcaaacggattttattctctgtgagctttggtgggaatggtttgattcaacctgaaaatttgtaacaggagattcagaggagggaaaatttgtagagaaaatcctctctccatcttgttctcctaaacctcacacccttagtctcgcttctgtaataatacgagaagtgctaggatcatttgataaaattggagagaccctctcccaacacagagcctgctgcctttctttagtgtatttccatctgcactgaaaacaaaatggaaaatgacaatttcaaattggttattttggtgttatataattaaaaaaaaagaaaaccaaacgtttgactggatttaattttttctgaaagtgagtgtagacaaacatttcagttaagtgtaccttttgatggctggtggaatatataattggaatctaattattgttgattcattgattcattcactgatgtatgcacataaaaattgagggattgttttccttaaaggttgctagtagaatatctctcagatcaaaatttgtcttggtttttgctatcatgtagtatctggaggagcctgacatttttcagggagatatgtagggcctacctctgactatccttttttcatatgtcattgcttacttttttgtttccttattatttggcatgatttatcatttaaacagatgtgaaatctggagttattactacagtattcattggcatatacagttacatttatacttggcattgcatttggaaaactatatttcagtttgggatttgggtagaaaatgttttaaatttatggatattttactgtcttctaaaaatctgttgaaagacaaaattgttttctagtatctctttatgctttcttaaaaaggtattaataacagtgtagactgtaatgttgacaaaagctgacatttctagaatttcacacgtcaatagaacagtgcaaggagcagtgggaagacaagagaaaggcagcagagcatggtagtggcttaaactgagccctccagtctactgaagtcttaaaccttatgtttaggaaaagtcagaataaccctcatgacacatttagtcagcctcaatactaagaagcaaaagatactaagagtaggtggtttaaaattgaaaagaattgttacctaagaattagcttgaaatacagtgtctgcatgaattggtatatttttattttattagagaatgttatctgtccttccagtaagaaatgtctaatacagacttgtgtggctattttccagtacagaattagcacaatcatcctcaattttctgagaagtgaataagggctctttgttcttaaagcagcaggtatctctatcttttactttgtttctatagcatttcgtttatattttgataataaaaacatagtattttaatactctcaacattcaagtacaaatacctaaaaggcctaatttaaaataaatatatacttttataaacttactaaatggaatgctcttattttagtaagagcattctgtgggctagtcatattaaaagttatttaagcctgagagtaaaaaaaaagttcctaccataacatttctttataggcagagctttaaaaggattatatgtattgtatgcctaaaacattgaatatgtaacattgttttcataaaaactttcatatagcaacaagtgtcttccgtatcaacagtatttttcaattgacattttaaaatgtgagtttttttcccttcctattctgctactgaggcttattggtgaatttagaaaggctaaatgtaaatattctagcgtcagaacatgtgaaaggaaatttctatggcgttttgccctcttagttcctgaaagagtgagttatcgtttctctctcgcatggtcattaataatgacagatgtccatggtgcggagttcacgtacattattgtcagtaacagggctggcaagagaatatttattacaagaggaggagggacagagacataatgtggaaacagaagacaagagcagagttcagctgttttttttctattgaataaaatataatcattccctaagctttcttaatagcgtttatttgtaagcactgttattacaagtatatttcatctgcgtaaatgttccttgtagtgttggattaaaaactgaaatgattaggcactcatttttattttatttttccagtaaacctgtctaataaccaaatatattggaatgactcttaaaatgtcatttgagttgttgatcataggacagtttgattggtaagctctctttccccgccatgatatacagaattaagaggatttaatgtagagacagcagcatttaaatacttatttaaaaatttgcttaaataaatataataataataattgtaggttccaagaggaagagtttacagaatacatttatacagcctctccttgcttctctgcctgcttttctgttctttcattctctgccctacccctcgttctaattttagcctattaaggcaactatacttggaattcctttcctgacttagtctgttgattgtccatcgaggtacaaaggaaagcctgtactggagtcaggttttctctgcttacccaccctccctcaccccagatacagcaacagaagcccagaaatagcctcttaagtgcaaatctctaactgactgtgagttcttttaagaaaataatgaagggggtgggttaaggagaaatgaaattggataaatgtgaggttcttttcctccctaacttccgactaaagaaagggaaggcataagggacatagcttctttctctcattaatttatagagaaagcatacaaactcacaagtatggagatatagtaatgaagatacattaaaagaaaacttaaaagcctttttctcacttagctgacaaaagtcatatgacttctcaagattattcttgaggtggttgtaacaaagatacagtttgaggtatggcacatagtaggtgtcccacaaattttagctttcttttcccttgaggacaagatcctatattgttcatcgttctatccccttaacagtgactgttgcgcacacacctaggaggcattaaatgaatatgtttaacagttgtgtaaagggtagatatgtacaggacatagaggcattaattaaataaaattcatatccataaatatattttaagatagttttagttgtgcgatcatactctttgaggcaaccccctactgttggttgttagtagatttcacagtgctgtttgactcaagaaaacctcccagcttatgtcctcaaggtctcgtggatgaagtctgcccaaagtgacccactgacaaatgatactttcaattccctgattctctgtaaaagattttcttttttttttttaattttatttttaaactttacaatattgtattagttttgccaaatatcgaaatgaatccagacttttacagcattagtggttttcctttaattaaaaaaaaatatatatatatatgtaccttttccaaattaaaatcaagctgaacaaatataaattgttacaaaataaaattgaatatccaaaaattactagttatgggcttatcaaatggtattaacaagcgtaaggcaagatgagaactcaactgaaatgatgttgctatctcaaaaagctattctcatatagtcacaatgaatcaaatcactgctggggttgactggaaacattcagagtagagaaacaaattaaaataaatctctttgattattatggctcaaggtaaaacagttttattttttctctcctttataaatattcagtgatttgatttaaattatgggaaaatggaaataaacacatacacacttttttggtaaaggtatagaattacagtagccatggaaagcctgcatgcagtatttgccttttcaaataacttccagtgtcagttatctggctttttaaaataggatggaattacctgttattcctttgcctcaattttatcctctccttcactgttgctttgaacatgatgccaaaggatgcttcattctgcctgacaagccacagttattagagctttcccaagtaacataatcaataccttcagaggtgttgcattctacttttcttagaaatcatgtaaaaaatttttccaagtg

SEQ ID NO: 43509 - DNA, 1645 bp, Bovine  19866880800681
tggtaagtacagaatgaatatttataaaagcctagagaaagtgtttgtggtggcatgagctgagaccaagggagagagggaaagaaggagaatgaatgacccaggaggaggaaaacccaccattgctgtgagggtatattacttctatattttagccccttttactttacttttgcatttgaattttaacacaaaaacctttgcttctgttaaataaggatcatgtgggtactttggtacctttttctggggttggaggacataatggaaatccccaaagtgctgtattgggggtaacttctagatgtgttttgtttaggaaaaataatagtcctcaaggtgaaattttgaattcgtaaaatatacattaaaataaattaataaaatttaagaagtttaaaatactaaccctaaactagaaaagagttaagaaagatgaggaagagcgatgcaaatttgctctgccattgctttcctggccttcctgactggggcagaggactggagtctgctttttgccaactctgccttctttctccaggtgatgtccaagaggacctaattctagacctctgggttgcttgttggctagatcccttgttttatgtaggaaagtgtcagatggtgcaatggtcaaaagtaaagttacaagctctactcagggactcactgtcctctcatcaggtagatggatcactcggccactaactatgaaactggtgaagaatcttagaggccaggtgggagttctgctggtagtgggaaactatggagtaggggaagagaggggaatttttttaccagataaacatttttttttggttatttaaaaattgtggtagaggaaattacagaagacagagaccatcaaagagaggaaatgccaggtaattactaaacttttactgcacattatcttttagagatatgaggatgtatctctgttcacaggagggtaaaatggttcatggtactgttttcgtttttttttttttttttttcctttatcaaatgccttttctcaaagcaatcagtacgaggtgctttagttgcatttattgttgatgatccacactgatagttcagaagccgaagcatcaccattcataataccttgatccagtcatttaataacatattttgatcatacacatactcaaatgcagatttgctttgcaattttgaaaaaaatttttgttttcatcttctattttgcattgttttacaatctgtcatatttacggtacaatcgcttggtaatctcctgtaatccttgctgactcagttcttagtaaatcaaaaaagatggagctttatggtagactttaagtggggagtgacaaaagtgaaggacgtttagtgtgaaaaattccattgtgtttttcaattaagtttttcccccaagagtagaattgttcaccagctagtcttgatagactagcagtggggtaatttctcatccttaatatagacagtgaaggagactaaacagcacaaagcaatttgccatcatggaggatcggtcagcaccgtgcatcagaaagaaatgtcctccatgtacccattcagagctctgtgacattggtgaattatagtcagtctctctgagtcctggtttcctcatttgtagcatggataatggtat

SEQ ID NO: 43510 - DNA, 1437 bp, Bovine  19866880876041
acttcacttttatttttctgttttccatttctaattgtcattacagagaaaggggttttctagattactaatttaaattcaccctagattttataaaataaatgtgattttttaaaatacaagtaaaactccataataacaatggtttttaaaaatattctactaatttttttcctctactcattcattgttattagatctctatcctaagctgtatccggagctctctcagtacatgggcctgagtttaaatgaagaagaaatacgtgcaaatatggccttggtccctggagcaccaagtcagggggtatgtataatgtaattcattctgaattatataaaatcatactttacggagagatataagctatcatctttgtggcagactcacaaatgtatagccttagcattgatctcctctcaggactgtcttctggtattgctttttacagtctgcttcctctgcgctgttaccactttcctaattgagtaggagttaaaggttcaggtgcctttaactggcacattctcctttgtcttctgcatttagttatggacctagtgattctgccactgccgcgtttcttatactcatgttcttcattgtagcctgctgtggccccgtccctgtgtttctacctctaacctagattgttacagttgtctctttttccagtaactcctccaggaacttggtatatcaatgaatactgagctactgctaactttatcattctgagattcaggtctgttatcatttttttgctcataatctttttaagtttaaagcttcttatagtttgaccccaaattcttggcttaaatatagtgtgtcacagtcttgtgttaagattattgctataagactataataccttatagtacttgtcgtaggtaaatgcataacttcatgaagacagcctttatgtctctgttgttgccatgacccccatgcttaatacagtacctggctttcaatttattcaccaaatatttattgaaacttgcttacgtcagtcagggtccaatcggaacaatagaaatcacactagattttttaacagagataacaagaatcagagaggttgaagaactgaaaaaagcaaaagtggaacctagaaagctgcttctagaactggggcgcacaggatgggggtcgtagttctcagagcgacagtgatggtggaggagtcccgtgagctgggcctcaggggaggggccctgtgacgggcgctggtgcctctgggggctgcacggaggctcttctgggagtgtctggaatctggagactggtcacctgctgccagcagcatgaagggctggccccaggtagtactggcaggagcaggaagcagacaggaaggggcaggccctggcacctcctcctcttgaggggtcctgaccagaaagccaggacagaagagggctcaccacata

SEQ ID NO: 43511 - DNA, 1054 bp, Bovine  19866880920115
atgcaagagacacaggttcgatccctgggttgagaaagtcccctggaataggaaatagcaagccactccagtattcctgcctggaaaattccatagacagagggacctggccccagtccatggggctgcagagtcagacaccgctaagcgtgcatgcgcacacacacacacacacacacacacacacacacacaattctgtcatttactagccacatgattttaaatatttcacttaaatgctctgaccctcagtttcctttactatgtaagggatcgccaactccctctgcccccaagaattgttaaacatttcaaatatatgtacaaacgccctgaaaacaataagggagagtaccaattaaaggataatcgctcattatcaaattactttaaaagtataaatggaatggtaatgtctcttccacactcttattatcacctggtgagatggactaaacgtggttttaaaaatgactttaattagtttaattttctaacacccattagcactcctaacattaggagtatgagagcttttgttcaagccctaataggcaagtcattactaagccatcttaacttccttgtacttttgtctattcactttttactaacttcataccaaagctgaaagtcacaacacacacacagagtgcattcctctggtataaaagtgagtgcctctcacctttcatggaatgtgtaatagtcaaactgtgacaatgaaacccagattgccctaaagtatcttagaaatagttctctaaattctctctcacacacacacaaattacaaatctttatttaagaaattaaaacgccactagaaatccaaaacaaagataatctggctcccgctttgcagataatggtcataatatcatttgaggtaattacggagaaaataaaaaagattgggaaaggcacagaagatcacaggaggaggagtgtcctgtcgacccttgtgggtttgttgacacctccgggggccacggcagggcaaacacagctaagagccagggcgaaagtgtgtaactggtatctttgcaaca

SEQ ID NO: 43512 - DNA, 801 bp, Bovine  19866880933235
cgtacatgtatggcggagtccctttgctgttccctgaaactatcacattgttaagtggctatatcccaatacaaaataataataaaaaagaggacatttggacgcagacatgtacacgtgaagacacaggtagaaggcggcatcagaagtgcacgacactttggtcttgaccttctagcctccagaactgtgaggaaacctatttctgacggttgagctgtctgtctgcggcgctttgtctgtctgtcggcctggagcaaagaagtcccctgggaggtgtgtcaccttctttgctgtttctttgtggttgactgttttctttccacagatgcccccattcctggcagatttcctgatacaagcctccagttgtagggttgtatcagagctttctacacccagagctttctacacctggtcttctcccgtaaataaaagtcattgtcaagttaatcttcaaagcctttccttcctaccacatggtgatgcaaagcagaagattaagccattcaagctaatctttgcaatcatcaatatgggccctccaagttgaggtaaagcctttaattcaaagacattaagaatgttaagacataattaaagctcttaaaggatgtcaggtaccaggagttaatcagaagagagtttctgagttaaggaaactttcagcatcttttgaatcattctccaaaactcatccaaaaggatgattccactgaaagaaatattttggcagatggaggggttgagaagctctgtgtaaatttactcatttacaatctcatgacttgtttgacttca

SEQ ID NO: 43513 - DNA, 1355 bp, Bovine  19866880933387
cagagagctcaatagggtacggagggagataccgagtttgggccttcagtctagttcaacaaaccataccttgaaggtcaacttctagcaaggctgggtgtttctagaacataggaggcaaagaaataaagcactcttaagagcagcaagaggaatctggccagaggatttgaacttctcttggctctagtgcactggcagccttccaattggtttgtagtaaggaagaggtagaggaattttaaataatgaggatggctcactagggacgtaagagccagtttgctcttagtagttttctggagtataaaaggaagagaattgcaaaagtgcagtatcttcttttttaaaaaagttattttccattatggttgactataggatattgaatataattccctgaagcattgtatcttcttactcccctttccccatgtcaccaaaatcaaaatcaaattgaataagtacacatacaggtttcctaagagaataagaaagaaggtgaaggtatctttgatgctcaactgaagataaggtgagcccccaaagacctcctgtttcaggtatagggagaaaacaatttaactggaaggaaaaaatgaaggaatctttttactgttttaaagaattattttatgaaaaagatattactgggttagtaaaaatacagtgtggaaaaagaaagaaagaactagcaataaatgtatttcctttgaacaaattaacactaatattgattcttaaatgtccttacagtagtctactgtcaaattagataacatggatttatattattattcaaggaagaattccctatcgggaggcccatatttcaatgcagaaagtattacattatttgtcaaggaaaacacattactctttgtaaaacagaaaagttgaccttggcaaacagttagtgaaattgttctctacttgatttcacttacatgcagtgtgtgggagagaacatatttagtgttgcttggtggcattgtttcaaaagaactctcagtattgtagccagaaatgagtagggaacatctagaaaatagttcttattgcagtgctgggaagtgattgaattcttgtttccatgctttatgttaggtaataacaaagaatttggtggtaattaagtactggcttaatgtatgtttatctttttcccaagatcaaccatagtcactttttccataatcaaagacaaataataagctttcattctttgttaaaattctaaaatcgtgtaaccatttcccctgttactaggatgttattactttatcattcagctttgtttcaagtggcactgccacttcttgtacatagtgtttaattttggtaaggcaaaattt

SEQ ID NO: 43514 - DNA, 914 bp, Bovine  19866880946565
tgatctggctgaagacaaaagtgctaaaaatattattgaacagcagtgtgatcttattgaacaacaaggtgtttcttaaggtttgggcatgtaactcttcttagaccaagagtggagattgtctctacttccttctaggtcacgtgctatctttcctaactgggaaagatataaggcaggaggagaaggggacgacagaggatgagatggttgaatggcatcatcgattcaatggacatgagtttgagcaagttctgggagatggtgaaggacaggaaagcctggcatgctgcaatccatgaggtcgcaaagaatcagacatgactgagcgactgaacaacaggtcagtgcaggcatgtattaagaacagagggctgagtgcttgtagatactcaaaatgattaccttctactgcctaaaagtgctagaaattggacaaagtaactggccttcctcaaagcatgatacagacccttttatgctcatgaattctgtcagttccagtcctttgacccatgaagacaatgacttcttggagcttcacatcagagtccaaagcttaataaactaccaaatgacattcttattatggtttaagtgctttccttatgctccctaattcaatcatggttaacaagggaaaaattatttccttggttggaagttttaattaataattatactgaaacaaagcttagactttgatgcattttcacaaagaaaagtcttgaagttgatagaattctccttttcatgtttttattatcactagaagcaaactgtcttgaaaaatatctcaacaatagggctttgtgttgaagtgatactgataagatatgactggaaagaaagaaagagttggctgtgccttatacacatattgacaatctggaaccctgtaactaaattaaaga

SEQ ID NO: 43515 - DNA, 1155 bp, Bovine  19866880954201
aattttatgtaattgtaacatgaaaatatcattataagtggttttttaaaattctacaataaaaatgattatagcaagtattaaaacctaggtactgtgtgtttaaattactgaatagagctaaaaggaaggtaatataaattagcaacaattgctggtaaatggaaccttatacatattgatatggatattatcacatttttgcatttctatataataactttttacaacctggaaaagtaaaatctatcacaataaagtatagctagttttctagaattcactttctaaacagccgtcaattaccagtttctatcatctttttttttccaaatgagcataaagcaatgaggaaagacctgttaataatcaatttggtttcgggaatgacagagacttgctcactgacaactttcttggaactgaaacagtgtctttcatttttctcccaggtcccgcagtgaagctcgaagaccaatatcttgtcacctactagccccctggcccaaggtgaatctaccactgtcctgggtagatttaaagctgtacatttagccatttgggtgcattttccttctcagatctttttattattactagtaaagcagcaccctcagggtctgtacttaccagacctttctaggcacagccttgggctgccctcctgcctcggtttgccaagtgtgcacacagttattgtctaaagcactccctgccatatgctcttgcttatgggagacgttttgcatggattccagattaatgttcgaataagcccagcattgcatttcaactttcattttgtcagaaaacaaatgttctctcaacattcacgtattagattcattgtgtccatgccgctttcttttagtaaaagaaaagatttgacatgtaactcctaagcctctggtctttgcacacatatgtgggaacatacattgtgagattactgacaaggagcaaaagacatagtttcagaaaaattgggatgctgttttcctaactccctaagtcctatcactggcttttaaagtaagcctgtgccctgatggatttatgtcctcttttggaaaagtagctgctgttctattatgatggacgttttccctgagagaaggaagaaaggtggggaaggaaaaaagttgtaattaggta

SEQ ID NO: 43516 - DNA, 1480 bp, Bovine  19866880962271
aaatttcctcttagaatagtaaaacaatctaaaatagagaattaatatttaaaaagacaatgatttacaatctcctggctgtccattagaataacttaaaacaaaagacttctgaataaatgtgtttcgtgtttttagtgacaagtctttggcaattggttttgtattcaatgagagaaaaaggagtgaaagcgcccccaactcacatctggcaagttcaggaagtatcaaaggaaaggactcaactctaggttagccacaattgaaaatcacaaatcgtctctaagcttcagtttttgttctctaaaatacaggggtgtgaccagatgactccttaggttttcctgttttgggactgcagttcagcaaatggatgttgtgtgagttacaaaacaataaatgaatagctttaggtcagaaaaatcgaacttaaaagtgatgcttaaaacagacagacctggctctccagttcttgtagagtatttttttctttgtgtacttaacccaaaatatttgataaaacttccaagtatgcctcattttttgtcaggtgatactattcattcataaactaagtaaagagataaatatttttaaacataaacatttccacaaaatatgtaagtgcctccaaataggagaaagagatggttggatggcatcaccaactcaatggatatgtgtttgagcaagctctgggagatggtgaaggacagggaagcctgatgtgctgcagtctatggggtcacaaagagtcagatatgactgagcgactgaacaacaacaacctcaagtgaaaatatatttatttaataatatatgataggaactacatacaaatattgttttatcagcctgaatttatgagcctgaataaagtagtttaatcaggccagtcttgggtactggtgggcagcacagaatgtgctatgatttgaggaggtctgtatcagctccctgcactcaaagaaccttgggtaaaatgcaccctttcacaatcactagtttggattaacatttttcacttttaaaacaagggagaaaagggcaacagtaaatatatggagccagccataatcattcacatctctgtttgaattactttaatttgactgctttccttttagagtttatgatcagtttcactgagcacattgggggaggggcagaagagagacagatgcccagctatgtgtaactagcgggtagtgtgaaagggtctagatgttcaaggagcaggaaagaaagacgtttcaaaggctggaataaaaactcctgttttagaattttcattccacatctgttcatgtagtgccctctacatgcctggtactgtgctgagtggaaggggatagttacagtcttgcctagctcattctatttttctcctagaaatgcaaataaacatgaacaatatactttcagatattcagaggctattctgaattccaagtagtaaagtctctttggtatactgtat

SEQ ID NO: 43517 - DNA, 809 bp, Bovine  19866880984103
tgggaagccctatcctggtctggagatagtcaacacctaacctatttcctttgaaaggaaaataaaaagacgattctttaatgatggtttaatgtcacttttcttagaattatagtcagtcattcaagaccaagcaatattcttgctttctttctctctctctctctctatatatatacacacatacacacatatctcaaaaaaccacgtgtacttttgttaaacattgttttccaactttgcatatgaaatctaggattaattttattcatattagaaaaagaataacatatgataaaagagaggttagttcaactaattgtattaactagaaagttaatcatctgttcagtgtttagggctcaatttgtgaaaatgaatgaccaaaatgatctaataaaactctccagtgttttaaagccacatgtgcattatagcatcttatgttaattattaatcaaatacttataatatgcataaataatggaagctatatttaactctcttacacacagttcatgagtaggcatgagtacagagattatcagtatacaggcatcatccccattttggggtactctttccttcctctagcagaaagaaaacaagaaaagatttctaactacaccacaatgttaaagccttgtccagtgttcccaaatgtcagagatgaggaactgttttcttttatcctgccaatctatccttacagttatgagttccctggaaatggcttttgtgacttgtgtcatgtaatttaacattgtcagtatttggtaattaaaagggaagaaaggtttggggtttgg

SEQ ID NO: 43518 - DNA, 1042 bp, Bovine  19866881051584
gtaacagaattaagatttgcaactatctctaggtgtgaaaatatagatcagttagagagatggatttttaagtaaagaatgagaacatcttacatcctgatttgattaagttgattgtacaagtaacaagtggatgatgtcgctcagcaaaagtttaagcaggaaagatatgggggtttcaatcgatcccaagctcaacataaaagaacaaatattgaaaactgaggtcccagtaaagcaagtatagtgtcgtttgagaaatggaaacattcccacattactccatactttccagatctcatttggtgcattgtatttcattttactcaccacattttaagaaaaacattgtccatctggatgtcttgtttattatgtaatttggcagtagttataggtcaaactccagtaagggtagggaagagggtaacaacgtgttgttgctgttgttatttagtcactaagtcgtgtccaatccttctgcgaccccatggactataacacaccaggctcctctgggatttgtccagacaagaatactagaatgggttaccatttcctcctccaggagatcttcctgacccagggattgaacccaagtctcttgcattggaaaacccaggataagaagaaccagctgtcaatccttgtggcttctcccagtttctaaaataagttatatcaaccagtgcctcttcctaaagtgatcacatccttttctttttttgaaaatctctgtttgggtctctatttttcatacctgttttagtatcatgagaagaaaccatgctattgccaaaactcattgctcctttcaaaggagtctgacttgttttccatgcagaggaaagtctttcaacctcttgagtcagagtatcacctctcctgtcatgcttcattgctttagccccatgtcaataggttctgttatcaatcactgttgtaaataaaagtttatattgatgctgtgggcatttatttatgatatttgttatagaaagatttcatgggaggtgctaatcaggcggtaagaagggccacc

SEQ ID NO: 43519 - DNA, 1249 bp, Bovine  19866881064695
tttctcttttctcttcttaaggccgtatttttaaagagccatcagttacttgtagccttcagtcatcatgctaatggcttctataaatactctaacagatcattcttctctaaattgtccaacaaagagaggacaagaaatgtgtcaccagaggctgcaaaggaggccatgagcctacttcccatctctggtgagtatggttagaaaggcactgaagactctacccactagaatatcccatgtgcaacaatgcacaagaaatcccaggtgaaatgtgattaaacatatgtggccacaatggttctcctgaatattttttagcctttcacatcacagtgtttaagtgatgggttacactgcatttttcttgtcttcctcaagaactctattgggatagaaggtatctgctttatcattcctttggataaagccaggtcgtagaaagagacaatcaattagcgctttcatcatcaatcaaatctcgatacctacactctcttctattctgaataaaactaggagttccagtcaccatctaaaatcttgagtttaccagaaacaggtagcacgacttttgaagtctaatttatgccaatcatctcaacaataggcaataaagtcatggtgaatgcaaactaacactgttttattttatttttggagtataaatgctttacaatgttgtgttagtttcctctgtacaacaaaatgaatcagttatacgtacacatatatcccctccctcttgagcatccccccttcactccctcatcccatccctctagatcaagcttccccactagctagctatcttacacatcagttcagttcaattcagtcgctcagtcgtgttcaactctttgcgactccataaaccacagcatgccaggcccccctgtccatcacaaactcccagagtccacccaaaccatgtccattgagtcagtgatgccatccaaccatctcatcctctgtcgtccccttctcctcctgccctcaaactttcccagcatcagggtcttttctaatgggtcagctctttgcatcaggtggccaaagtattagagtttcagcttcaaaatcagtccttccgatgaacacccaggactgatctcctttaggatggattggttgtatctccttgcagtccaagggactctcagaagtcttctccaacaccacagatcaaaagcatcaattctttggtgctcagctttctttatagtctaactctcacattcatacagac

SEQ ID NO: 43520 - DNA, 1065 bp, Bovine  19866881165459
actggaaaaacctagtcttgacagatggacctttgttggtaaagtaatgtctctgctttttaatatgctgtcagaaggcaatggcaccccactccagttctcttgcctggaaaatcccatggatggaggagcctggtaggcttcagtccatggggtcgctgagagtcggacatgactgagcgacttcactttcaattttcactttcatgcactggagaaagaaatggcaacccactccagtgttcttgcctggagaatcccagggacgggggaacctggtgggctgccagacgtctatggggttgcacagagtcggacacgactgaagcgacttagcagcagcagcagcatggacttttaggagacgtcattcttaacttcattcttactttatccttaatatcaatatagattagtaattaaatagccattataatagccaattataatagccattataaataaccattatagccattataataaccagttatagccattataataaccaattactaatgtaatttttcaaaaattaaatatagctagcacatcttgaagagatggtggaaaaccttcagccctcaggctagatttcctgtcatatgtggtataaccctagtgaatagcacttcacaactctggtttcctctcttgactgtttgtgtcttcacaaagctgacttatatcttaataggtggcccgacagataacagatcagtccactgtcactcaccatgagtcatggatgcatttttagagcaatcttcacaatcttaactcaaaggaatgattaatgaactgggaatatcagaaactttaaaaatatttttttctagttctaacaagcatacactgagctcttactctgtgcccagaaatatagatgccaagaaaacaacttctcacaggagaagttattatctagcttactgtctagatcaggaattcttaaccttgacattttgggttgaataaattctatgttgggggaggggggatactgttctttgcattgtagaatgttagcagcaaccctgacccctacccactagatgccagtag

SEQ ID NO: 43521 - DNA, 2873 bp, Bovine  19866881232105
actcacgtccatcaagtcagtgatgccatccagctatctcatcctctgtcgtccccttctcctcctgcccccaatccctcccagcatcagagtcttttccaatgagtctactcttcatatgaggtagccaaagtactggagtttcagctttagcatcattccttccaaagaaatcccagggctgatctcctacagagtgtactgctttagtcatgtacaaatcaagattaccttgtagaaatacatacacacttaagaaatttaaaagtattgcccacaaagaaagtataagcagaatgctttagcagttcagaataaggaggttcttgaagctttgtagatgagctgacttttgaactttaaaatttattcagtgtttggatatgtgaatatgataatggcatcatggaattgtgacaagaacacaaacatgtaaaataagcgtatttttactctaatctttgttggtagagagagctgagaccatttaagctctaccatcctcagtaaacttgtgtaaacagacgtttctgcctcaaaggggaattataaggcccaacaggtgaaaaagttctgtgcaaactgcaaatcactgagcaaagtattttttaactgtttttcaaattttcaaacagcaactcctcagaaagtgaatgctgaaagagcagcatagacaaggcacatgttcaagggagagagagagaggcaaagaaaagcagttagttgggtttagttgaataattaggtgtttgatggacacataaggaataaagtttatttggagtcttgaatagcatgccaaagagtttggattccattttggaggcagatatcactgagaagtgtttgagtctgactcatggagattaattttacagcactctttgggtggatgtgaagatgttctttttattaaacgttaagtagctgttgcaagtgaagaggtagtgaaagcctgaaatacgtgaatggtgtggggtgagagaaggtcagatgggaggggtattttggagccgactgagtggaacccaccagagtttgatagagaaggaattaaccaaaaattactagaacatttggagtagaggtgatgaagaggatgaaggtgtcatcaagagaaactagacacagagtacaaaatagttttgaaaaagaaaactttgttcagttttccagcaggggtgatgtccaagtagtgatgtctagcagagttagacccagaattggggccagaattatacattttgatttagaaattccccactaacaaaatcgtgatgcatcttagctggatggaagaaatgtgactcagaatgttagggaatcttttaggggtggaaagttgtaaaaagaatagaagtcaatggcagagccaagaggagtcagaatagcagttgagactaagcatgacttaagtgaattattcacaatacgtggaaaatactggagagtaacaggaaataatatttttcaagttgatgtttcatatttcacattaagatctgtagtcagtcactatctttctagaaggaaaccagtaatcaaaacatttgcttacattcatgagctgactaattatttttagttttcagtaatcaagcttcctctagtttaatttgccccatgttatatattaggcagtgatgaacactgaactgactcctatgaaagcaggctggaatgaaaaaactcctcctaattcagaaatgtcaccaggggtgttaagatctatttctaagtgcatctgagggctaaagagatgaatgtgctctctaatttgtgcttgccaccctccacacaggagaagtggtctttgattcagtgttaaagctgctgtctgcctggcctaacaccattggttacatgatattttgaactaatgataagtctattgaaaaagtggtatcctgttgagtgcttcatggtccctacccaaactgattccttactccctttcaccatgcccacttccttctactaaaattacaaaggtgaaaatacagctttagtactcagagatctactcaccacactaattagcatgggagaataataattttaagaaaatattacaaaatagtgaaagagataggtgctatgaggtggaatttgtaggcataaatctggaaactctgtgtgtaggtaatttagagatcactttccgccatgtcatgtgaaaaccacaatgttgctgaaagagtgagaagtgagctccagataagttgcacactgttcaagcttgtaacttgggatttctgtgaatatcaattagttacatacttttgggaaaataatttaaagtatgaatctgttagtaagcatttttaatttacaggactctacaaaacagatatgtttgaatatgcatgtaacagctttgtttggtgtagggttgagagagggagctgccctatgtatagaacagtaccctttatgggctcccattagtcggtggccacaatgaaacaccagtcccgcatgctaaaagtctaaaaaaaagcacattatgacctcaagaccttagagtacgggcctgaaaagagactcagtggcacaacttcagggataaccgtgaatgctagtattgatcagattatagaagttatatgaacagttacacaggaacaaacactattttagtaaactgagtggaggcaacatgaatggactcaataaaaaccatggatttgggtagacagtttggacaggtgtgtttgattatctttaattaactataactatccctttaggatacataaaatattggatcagctgcttaatacagtagaaagtatcaaagactggaattgagagatgtaggttttcactccaactctgtatttgggtaaatcgttttttaagatctccaggtt

SEQ ID NO: 43522 - DNA, 1536 bp, Bovine  19866881232813
aaatactgaaactcgggccttcatttgttctgatgccattcaagtgtgcaattttaacaccctttagttactaatacaactaatgttttaaggattttttttattagttatacacaaaatgttactcattttttaaaacaataatctgagctgaacaacctgggtattatttccttttccttttcaaagagaacccaagaaaaataacatgcaaacgtgtttaaatctgtatcagagtgggcccacagagtccttctccagctcttcctcagcctggcactcttacactgtaggtgtgggccaggggagaaaagaatgttatattagcatcaagccatggatgtaataggcaggtcaggaggggagaacacatgttatctgctttggtttcctaattgattttaactgagcctttgctttccattaattggaaaaaggttttgaaggaattcattgaaaatctcttcatcatcataatcctcctccattactttaattgacattttttagtttctataattaaagaacaatattaatcctcaacaaaaacctgtggaatttaaggcaacagttccagttttcaaaaaagtgaaatctatcctctaagttcaatggatcaggtttccccaatggggagataactattaagagccattcaagactgaaatgccaatgaaatgccggactttcagtcaagaaaaaaacaaagttcactgggcttgaaataaacaaaatgagaaatgcacacacaagttagaaagcaccttgagacatttgagtcctaagaatttagcaaatgaagttcccaaaagatcaaggatttttcatattatttgtgtaaagcccaagtcatcagtcctaaatatacccgagcatctatttgatgaaattcaagatatatgtgctgagtatctactatgtgtcaaggtctgtgctagatatgagggctacgctggtaaatgaagtagatttctatccctgcttttttgaatttataatctattagggtgtatcaggcaagattagttctgctatgtacaacagaaaattcaagaggactgaaaaagattgacctttacttcccttccacattacatactcccatggtaggtagaccgtccgtggtctggtgtcttcatgatagtcagacactcaggcttctttccgtgagtccaaaaacattagggtgctgcctcttggtccaagacattttcctgagctctaatcaccacacccacattatttccagcagaaaaagaacaaaggaaagtgaacccttccttcaaggagatttcttggaaggaccacccaacactttcatttatatttcagtagccaaaacatggtcacatgaccataaagctgcaaataaaggaggcagtgtcctctgtgagccagctttttggctcgacaagctaaataccagaggcttgtccctctggaccaaagtaaatgaggatcagagggtacagcttgagatttctgccacaaatggaaacagacagtattcatattttcttttcattttgggactaa

SEQ ID NO: 43523 - DNA, 1152 bp, Bovine  19866881271649
ggagaacttcttccatggcagaaaacactcctgttcttaaagctgccggccaaaaggaccaaccgcacaagcagagtattgggatttctgctctttcaatgaaccgctctgaaaaggggccagatctagataaagcctctaatcttaacaaggtttagtgtagaaatctgagtctactgtctggccaagtgagtctacaggcatcgtggaagagaagcctgcttccagcaccacccctgcagctgcccagtgacagcatctcagcacgcacctctgcgccgccggagaggaccactttctaccacttctctgggcaagactcagacctactgattgtgtttataattaaggaataacgagaaatacgactcaggggtacagataagcaggtacacaggaaacatccattttccttaaccttagtagatttcactgctcacttgcatgagtgcagaaggtataaatctctaaggaccctttactaaaatcgggaggggtggggtttcttctcgcatcgctgacagcaagtgaccccgaagtcacagaaaacaagttaggggacgtcaaatgtcaaggtcacacggggagcctgttaaataccagatgctggatgagcaggggcggtcattctgactctcaccaaaatgtgagaacacagtaaggtcaagttcagagaatgaaaagttcacagaagacgaaaactgcagtgcaaaggagctctccctggcccgcagtccgcttaccgggtacccgttgagaggctggaaatagagggtggtgtcagtgacgcaggcgtggccagggttcgtcaccagaggtgtcaccatttctgctttgcattccatgtgcagcttttcagaaacactttggaacctgaggatacgttttccagcaaaagcaagaaaaatcagaaatcaatctactttctaggcttaactttatctgagggagctccagggtgactctgcagaacaggtatctaaacacaacacttaatataagaaaagcggtgacgtaagctagtcgcctaaataaaactgcctttcttttaatgggtacaatgagtacttgattttgaaaaaatagatgaggttatgtatcacagaagagaagacagacaagtgaaaaaacttgtcaaacaggcacaagaag

SEQ ID NO: 43524 - DNA, 807 bp, Bovine  19866881295416
ataaaagtgtaggtaaaatgattgaaacctgacacagatattagagtttccagcaaaaataaattaaatataaagagaatatagtaagaccatctttaatgttctcaagacatcaagacagtcattttaaaagctataaatactagatataaggaaagctgaaaaaaatttttattaaaaggcatgatataatcctttaaaatatcctctgtaatatacatctatgcccaaagagccccatatctgatcagaaagtcatgcattttcactaaaacgtgaatgtgtaccttttgtataaccgtgggaggtttatataaaaataaaacagtttccttaggaaaacaaaaaaagaagaacttttgccaaatactctgggaaaaaacaagcaaaaaaaaaagactttttcctctgaaaataataaagttcagttcctggcaatgtgaacactcacagacttattcaaatgaaaacaaattattgtgcttctagaaactagtttcttttttttttcacttgcagagtctgaaacagcatctggaaaccatcaccaaaacgttaagattcacaagcaagcactgctgggcagaagggaacctgctgcaccgtcgtactgccactaaacacgtctgcccacagggcaccggtgagtgatggtgcccgcagccttgtaacagcaccagggggcctccaagcatatgttcacgaatgcttgaatttatatctaaactcagtatcatataatggtggtaaaatgcccaagcctgcccgggattggtccaacaggggacattgacacagctctccaca

SEQ ID NO: 43525 - DNA, 718 bp, Bovine  19866881335030
ttatcctgttaatttgatgaacgtggacagccataccagctatttcaaaccacccaaacagaatttttttgtctcaatgatctactctgttaaccagataactgccaagactccaacttcattctgttctgtataaaattacaatttcttagcatctctgatatcagctacttaagggaaatgtatggataaatgtattggatggaaacgtatggatatttttgcattgaagctgtatttctcacttcatactgataaagtagcatggaacacagaaagaacacagacagttatggctttttttaaatgctgcatctcaaatgctgctgctgctgctgctaagtcactttagtcgtgtccgactctgtgtgatcccagagacggcagcccaccaggcttccccgtccctgggattctccaggcaagaacactggatagtcagtattaaaagtatatttaaaaagcaatatgatatcatggctacaatcaatggctttggaaccagcatgcttgaattcacatgctggttctgcctttgactatatatgtgaccaatggctcagtttttctatctgtaatatgggacatgagagcgcctaccttatggatcactgtgaagatcaaatgagtcagttcaaataaagtgcttaaaatagagcctcagatcatggtaggcactgaataaatgtaactattatccttatcgtaatctcatcat

SEQ ID NO: 43526 - DNA, 1923 bp, Bovine  19866881355037
atgcatgaatttattaaatagaaaaggcacctcggaaccagtggattacaaatggattttccattcaatatgtgatgagtcaactgacaaaaattaaattgtatccatacctcctaactcacaccaggaaaagttctaacagactgtttatgaaaagaggaaatatgaatggctcttaattatatgaaaaaatatacttagatttttttcatttgacagactgaccaaaatctgacagaatgaagcagacactaacatttagacaatgataaagtaacttgttacaaaacctataaagggcaatttggcatatctattaaaattacaaatgcatatgctacatttttttaaatccagaaattccacttcacttgctctcatacaaaacacttgtacaagactccctagtgaaacactgtttgcaataggaaaaactaaaactggaacaccttgcaacaggagactggttaattgagttacgaagaattttacacaatggaacactatacaaccatgaggatgaatgaagcagctctgtacttatgtgaaagatttccaagtgaaaaagaggaagggagtagtatgtcatcttttgtaaaaagaagaaatggggagggaataaggatctataaaccctggaaaaagatggaagaaacaacgtcagtggttatttattttgatgatgggggaaatgggaagatagaagattaagggagcatccttcgtgttaaattatgtgaattttattaatcattcaaatagctatatttagaagaaaatgttaatagcaatacaaagtgacaattagggacttccccagtggtccggtggttaacactctgcacttccaatgcagggggcacgagtttgatccctggtcagggaattaaaatcccacatgccacacagcatggccaaaaaataataatgattaaaaaatgacaattatactataaaaaatctatcagtaatagatgaatctcctgtagatattttggagtaagattttacatcttaagagggggcttatctagtggaaatcatggtttaagaagtgaacttctgtgtccaaaaaaaatgtcacagcaaaggtttcaatcttcaaatgccttacatttactttaattaatattactaaatgtgtatttcaaaatcagttaaaggtacattattagtttccaagagttcaaaattcaaactaagactgaagtaatctcttaacagcattgtaaaaacaaggattccaattttaaaagcttagaggtgctatatgttatgagatatgactcacactttcccagatggctatgtattacaggcatacctcaatttaatgaattttgctttattgcatttcacagataattcattttttacaaattgaaggtttgtcagatgatgattagcaattttagaaataaagtacttttaacttaaggtatgtatactgtatgtttagacatcatactattgcatacttactaagtatagtataaacataacttttatatgcattgggaaaccaaaaaattcatgtgacttgctttattatggtatttgctttattgcaatggtctggaactgaacctatggtgtctcccaagcatgcctgtactcaccaaagatgggtgtgaaaatagaaaaatatttttaaatcattatgttggtagaaaatccgggaagtgaggtataattgtcttaaacattttataaaacattttacgtccagaactttgacaatcatcttttggggggctccaattaaacataagatatatttgataatacttcaattcacttgataaatatgagagttattatgtacaagataaggttgacactctacactgtggagaattcaaggaagaggctaatgtagctctgatgttcagagagcttacagtatagaggagggccctatgg

SEQ ID NO: 43527 - DNA, 703 bp, Bovine  19866881418955
taaagatattcagagtaaatgaggaatttgagaaaaagtcacatttcatgatatagaaggataggaaaatatattactcacagaaactagaaatttttcctgtaacttatttacagttggaaaattgtccaaaaacctaattagacaagcaaatgttcttggaagagatctcagactagctcattacattaactccataaatttgttctttgagtaggcaactaatcatacagagagtttcttactttttctctttccttaatttcaacttttgccattgactagaattgtatttttactgagcattggagtaattgacccagaaaaattcatttagcttataaaccatcacttcaaataagatgtagatttgaagataatttagttaacattctactatgattcctcatcaatataaaaatatggatttcatctccaacctctttagtttataagaatagaatttatgatagtcttgttatataaggaaggaaaagacattaatcctaaaaactgtactccttaagattgaaattggttttataaacattttttttcttttcagtctctctcaaggccatggaatgatggaaatgctaatggtggaagacgaatccagtaactgtggtcaaagtcatgatgaatagacagcatacattctaactacatgcaggtaaatgcaccatatactacttataaatga

SEQ ID NO: 43528 - DNA, 1993 bp, Bovine  19866881638735
ttattaatcattcttaatactgaatacaaatggtacaatatttaatctgagtttttaaaaacgttttgtgagctcaagcctggagcttaaagaagtttggaagctgacagccagaagtgtggtagttgaaggcacagcacagatgagatggattgcctggggaacccatatttcaaaaactctactattaaattactgcatccaattatcctgggtaagcccccattaaaaattgaataaggacagcaaagaaaggaataatacagtaaatgttcaacaattagatatatgtcaaactctgtacacctctaataggaattacatctccttgaaagacactaatttggtaaaaaaggcatcaggcttcagcgtctagcacacccagctctgagctctagcactacactctactaagatgtgatctgggcagggcacttaacttccagtctatttttccattgcaaaaaatgtgtagattatcattcttacctcgctggattgttggggattaaatgacataaatattggaaggatttttttatggtggtggtggtttagtcgctaagtcatatacgactcttgagaccccgtggactgtagccagacaggctcctctgtacatgatatttcccaggcaagaatactggggtgggttgccatttccttctccaggggatattcccaactcagggatggaacccaggtctctcacactgcaggcagattctttactgtctgagtcaccaggggaatcccagagaaatgaagatgattcacaaaagttacagttttgctttttaaattttttgccaacacaagagtctgaatggagacactgtgccctttcacagttcctcgcccttctgctccataggacttaccccctagagtgcctccctggcttcctgggccagggaaacacagagacaggttctcctggatccttatccagccccttcctttcctcccactcctctttcgagtgctcccacggaagatcgctgcctctgacatcccaacagcctctgttctagagctgctatgacttaatctctgcaagattagctttgttattatcaccctggcttatctggtgtgctcacagcatgtgccagcttgctgaaagggacgtctattaggagatgcttgttctaacagtaggaggagagagcgataaggcaactgctttaccactgtctgaacagcctagcagttttgagtttgactgataggtttgtaaacaagaaaatcccgtggctggattcccaggcttccaaggcaatgacacatatcacgctgtgctgtccttttcactaacttagttaaactcattgatatgaatgaatgaatggttcaaggcttgcggaagactcactaggtgccaggttctacattagatgcaagagatacagacgtgagttataccacgtgtgcattctaggcacttgcgttctgattggaaaacaaacctaaagaggcagaaacacttatttaaaatgactgagtagtttttttgtgccaggctcaatggcaaacactctgggagaaagtgtgtcttgttgagccctcaggaatactcagtgttccattaagggtgatgggggctttgataggggaattcttagggttcactcaattcacttcaatgcttattctaggatattagtgctctgtgtgtgtgatataaaatatatattatggaatatctacatatcaatggatcaatagacagccattttcctgaaacagcttttcggagtatttctatttttggattctgagttgtgtctatttctctctgaattaaccatgctggttgctggttcagtcagtaagtcacgtccccaaggactgcagcacaccaggcttccctgtccttcactgtctcctagagtttgctcaaaccaacgtccattcagtcagtgataccatccacctccttcatcctctgtcattcccttctctttttgcctctcaatctttcccagcatca

SEQ ID NO: 43529 - DNA, 1552 bp, Bovine  19866881689139
ctatcagaaggcagtgtgagccataatttgtactctgtgcacactgactcctaggacaagtgaaatgcaggaatcctcctctgagtgcttggatagaaccttcagggtgaaagagataaagacacagtctacaagggtatcagtgataacagggattccagtcttctggtgttggacaccccacaggtttttgctttggcatcatttgcaacacctttatctcctcctaaacattttttttggtggcacaatatctgtgttttaaatttaaatggattaaaattaattttgtcttcagcattttgtaatatctgttgagcttttttagacatccttttctggagactgagtcttaatacaaatagactttctcctctcaataaatggtacatgattctcatctttggctccagttttctaatcttggctcagaaatgcctcaagtaggcaaatccagaagccagaattaccttagtgctctcagtcttaggaagccaaaatgttcttgggaacgcatatattcctaccactgtctacccgcacacactcaaaacagccctcagactcttccttctccaaagcaaaataaaaattccatcattctgaaaaggcactcttgtatttctgtggaaagtaaaaaatttccttaaggaaatttcaatactaaaattctaaaaatccactgctgctgctgctgctgctaagttgcttcagtcgtgtctgactctgtgcgaccccatagacggcagcccatcaggttcccccatccctgggattctccaggcaagaacactggagtgggttgccatttccttctccaatgaatgggataacaaaaacatgcgtgggcttgttcacatagttccagcacttagaaatctggggagtatatgccaggcacgcatagatgaagacccttatagtagactcaccagccaggtaaaaggaacgctctagaagtttgtttgtctttggtatgattaatgatggggcccagctcctgtcacacttgaccaacaatgggtcctcatccatcttgatgacaaaaagtgctggcgttcaggttatgtattcttttcagaagggacaggtcactcaggaaatatcttgtcactgcccttaaacagattgtacaggggaaatatccaaaattaatggaacctttggtagctagacagctaaatatagtatcctccatgagcaaagaccaaaggtagtcagggattctgccagcattctggcatacccaatacagtacaagtttggtgccttctttttaaacagttccatcacatgcgagtccagtgagcacttggagaatgacagaaatccagtgctcattttttagtctcacgttgatccatgcatgtgccattgtggtatacagagaactttctacataaaatgaaaatttctaggctgtagtaagaaagatcagaacacagtagttacttggttaaaaaaagcagttaagcctgtcaataccctgtcattgaggatgagaccaacactgccgtagtgtttgcatccaggcttgcaatcctgtgcagtt

SEQ ID NO: 43530 - DNA, 1536 bp, Bovine  19866880159543
tgttactggttggggcataggcttggattactgtgatgttgaatggtttgccttggaaagccatgcctgtggggccacccaagacaggcgggtcatgggggagaggtctgacagaatgtggtccattgaagaaggggatggaaaaccacttcagtatcttgctttgagaaccccatgaacagtatgaaaaggcaaaatgataggattcagaaagaggaactccccaggtcggtaagtgcccaatatgctactggagatcagtggagaaataactccagaaagaatgaagggatggagccaaagcaaaaacaatacccagttgtggatatgactggtgataggagcaaattctgatgctgtaaagagcaatatggcataggaacctggaatgttaggtccatgtatcaaggcaaattggaagtggtcaaacaggagatggcaagagtgatcatcgacattctaggaatcagcgaactaaaatggactggaatgggtgaatttaactcagatgaccattatatctactactgtgggcaggaatcccttagaagaaatggaatagccatcatggtcaacaaaagagtccgaaatgcagtacttggatgcagtctgaaaaatgacggaatcatctgtttgtttccaaggcaaaccatgaccaacctaaacagcatattaaagagcagagacattactttgccaacaaaggtccacctagtcaaaggtatggtttttccagtagtcatgtatggatgtgagagttggagtgtcaagaaagctgagcaccgaagaattgatgcttttgaactgtggtgttggagaagactcttgagagtcccttggactgcaaggagatccaactagtgcatcctaaaggaaattagtcctgggtgttcactggaaggactgatgttgaagttgaaactctagtactttggccacctgatgcaaagaactgcctcattggaaaataccctgatgctgggaaaaattgatggcgggaggagaaggggaccacagaggatgagatggttgaatagcatcactaagtcaatggacatgagtttgagtaggctccaggagttggtgatggacaagggaagcctggcgtgctgcagtctatggcattgcaaagagttggagacaacagagcatttgaactgaacttgaactgaaaggtcaaagctgtatttctgaaaaactgggttaagagaatcacatctttcaagtcggcatctaatagccatagtttataagggctttcctggttggctctgtggtaaagaacccaccagccagtacagaaggcatgggttcaatccctggtttaatttctctagcttcagaagaattttggagttctctcataagatgatttaaatcccaacttgaatgaaactttctctttatcgtcttcaagaattaacttaatcatctagaaatttatatacacaaattcagtggcaaaaaatatggttaaataatagaccataaaatctaagcagcattcattaatatcatcagggcctaccatgtcca

SEQ ID NO: 43531 - DNA, 1876 bp, Bovine  19866880350243
tgttgaactgatatccgatggaaggtaattttaagagttttctcctaacgccatttataagaatgtgaataaacttttttttcacttagtgcagtgtgctttaaaagaactaaaaagcataaaattaacaaactctatatttaccaacagcattttatagcaaggaaaatgcttgaggatgggaaaatctatggtgctactaaagacagataaccatatttgtgttttgtgttgtttctaggttttaattttttgttttgtttttttaatttcataagaattttatttagagctactgaacttctaaaaacaagtaaaattataatttcaatgaatgagaagcattattataaaacagaatgacagtttatattttgtttgtagcaaagaaaatgaaaaggatggcagacagagccagcatcttgaggtgagtagccaccaagtaaaagtaagattgtgactgtgacaggactgtccctgggaagatttattggcttatcaataaggggtgatgagattacgtgacaggactacggttgttgagaaaggcaaacattgagacataaaaattacttgagaaatcgtaagaactctattctttgggtttttttttttaattcttttatttgacttgttaagataaactttaataccagggagatttctccttagatttttttccataaaataagacaaaagccaaagctactggtttgattttccatgaattcaagcatttttttaagtgattgagacagataatagtgaatcatagtggatttgtcacagagataatttcattaattttcaaattaacgtaaaatcatttcaaggtattaaattcatttcctgagttttgtatcttgttttaagtaaacgacagagaaaataacgtctaactcccttctatcatctgtatcttaaagtttcggtgactttcctagcttccttgttgtcctctggtgacattgccttcctgacccaagtatttgatttcctttgtcccaatgctggcttccattcagtgtgctgagcttcatttttcattcatacttgtgtatataactcactacttccaaatgcttccaactgcaccttcagtcttatgatcagctttctttttggcaagaattaaagctttcttcaacctgttcttggattctgactcttgatatgttaattatgcatagaaccgccccctctaaccactgattcctaatcattttggggcagtaacctcactcactgatgggttgttcagtaatatatatatattgagtcctactgtgtgcaggtaatgtgccgggagctgggatttaataacagctgcagttcctacctccataaagttttccaatctagaaagttaagaattcaaaagctatggacccccttcttagaaaaacgcacacttatgttgaatttggtataaaattgctggaaatgaatggccacctgacacgaccaccccccaattctctagattcctcatatttcctgtttgtcatctgtcatgggcacttctttcattaacccagccagacaacaggaggggaggcttctccttgacttcatagcttctgagccactgctttcatcttttctttccaactcctttatgcttccttccttgggacccaagcaaaaagcagaccttctttctcatctctagtcacagtttttcagagcacagtgtccccatgatactgttttagtttccttctgtttcatcctttttctgctcccttcctcttctcacaacgagcacctactcatcgtgccattgaacattattttaaagaaaatggctttgccagcctcctggggaggtattctcagttctccccttttctgcctcttatctttaggagataaa

SEQ ID NO: 43532 - DNA, 1349 bp, Bovine  19866880357310
gaatccgagaaatttaaatatatatatgtatatatatataaacatccaataatatgtacattttttacctctaaagtttgagttagaagaggcttctctaaaacggctctcgttaagccagagcatagttgctcttattactggaatgtgattttcctgataaagagcaatccatctttgacaaagaatctttgttcacactggtaatcttcaacagagtatcaaaatctttagtgtaagatctagtgcaatagtattaaatttccctgaagctctgaaagatgaattcctagggaaagtaccaccctcaaccttcaaatcacattaaaccactgtccatgaaatacctttataattatatgcaaataactattccagaagaaataaaaatcttcaggtgggaggctaagatacattcagaaagaacataaaataaaccataatataaatttaaagatatttcagttagcagaatgttagatgattgattttttttccaaaacagaaagaaccaagatacaatcaacataggctttgagaattacagaaaatatatagttgtgttttacaatagaaagctttgcaaaaagcaggtgtgaaatgtgagaaagtttagctgattttcatggttaagacaagttgtaacttcaactctctcgcctcctccactttttaaaaaatgtttgatctatatgtttaacaactctctaaggacctgaatttctacagatgtaactgacaaagggtgactttcaaaactgttccgtatttctctctaaagctttgtaataatcccagttttcatgttgtcttccacacatctgagactactgtagtcatagtctgctttcgccaaagcagcatgcgagtacacagtgttcctttgctaaagtaattaggttgcccctataccttttggaaaccggaatatgtgaagaacgtgttacaactggcaacctgcagcaattttttaaagaatgagactaacaagggtaggaaagatctagaagtacataacaaaagtaccgattttccctgggtgctaaacactttatagattctgacttccattctttgcctaagggtttggagagggaagattaagaaatagatcagccagtcccccacttcactgagatggggaaaggagaaaatgaaatggacaggtcaaagtaatggctgaaatttagaaagcttccattgtaagacaaggatgctactggactttcaaatgccctgtagttaacagtgctggtcttatgagaaaacagaggctcaatgacctctgaaggcttttaactgttttatgtgccaaatgcttctccaggtgggtaaaagaggagctcatt

SEQ ID NO: 43533 - DNA, 761 bp, Bovine  19866880518679
cctgggtcaggaagatcccctggagaagggataggctaccaactccagtattcttgggcttcccttgtggctcagctggtaaagaatctacctgcgatgtgggagacctgggttcgatccctgagttgggaagatcccctggagaagggaaaggctacccactccagtattctgacctggagaattccatggactgtatagtcatgtggtgtatatagtcagtggagtatatagagctcttatcctaagtgtgacatgtgcttataataaactgagttggtttattccactttgaaaatttctacttagagtcaatggtgaaatgaaatgaaacatttttcttttcccaggagaagaaatttcgagcttgtatgaggttggctggcattgtggaccaagaacggtctgcattatcttcactgcccacctttaatctgatagtcagaaggagtcacttgattgaggatgtttttagtcagctaaatcaatttgaaaatgaagatctgaggagggagttaatggtaaagtataattcttaatatttttgctgctgagaaaaggaaaacgtaaaagaacgtaacaatgggccttacagagagggaattacatcccttttacgctggagttgtctgtattgcgggtcccctaattttcctcagttacttgtgaattccaggtgagaagctgccattgttctctggctaaggggcagcaggggaaatggttgccctctccagtactagccctagatattcagttcc

SEQ ID NO: 43534 - DNA, 721 bp, Bovine  19866880684110
acaaattgattgaaagttatttcttgtttctagcaaatgagattgctttctaccctcacaagtgttttaataattaattattaagttaaatttttatgaactttagaaatgtaactcaaaatatatgaacaagccttgagcatattttaaaataattgatacagttattagaaggtataaatttttaattatagttgcctttgtgaaaaaaacaaggcccagtacaacctcatttttcccttgaaggtgaaatcctcatttaaagatactaattctaataacattggccaaatgtacggactgagacatttaaagtaattatgaatttgtaagtgatgtaataatttcattttgagaagattttttttacttaatcttctaaggcttttgaacttccctggtggctcagatggtaaagcgtctgcctacaatacaggagacccaggtccaatccctgggtcgggaagatcctctggagaaggaaatggcaacccactccagtactcttgcctggaaaatcccatgggtggaggaacctggtaggctacagtccatggggtcacagtcggacatgactgagtgactttactttctttttttcccaatgcgttggatgacttggaagaaatattctcaatctttaaaaagtgaaaacaaatcatttctccttctgagaactttccaggtcattataacccagtttttgcctttaactggggga

SEQ ID NO: 43535 - DNA, 1278 bp, Bovine  19866880815111
aaaaaactgagtgcagttgaattgctgccttgccctaagcatcattccacatttgctgctgttctgccctattaccttggctcattcagagtcgctaaccttgctgaagacttctaaagagcttaaattgcttcttgtgaaaggatcagaaataaaatatacttttattgtcaaaaaatgccaaatatttccttagtgtgtttaattatctaaatgtgtgggttgagtttctgtcatgatctgcaaaatatagcatacagtcttgacagaatgaatcagaagagattacgtgtgaacatgtgcactgcagcctgagtgttcccaactggggcaggggtgtattcagtgagagctgtgcacgaagcattcccagttgacccagggaatagattctagaagagcaattaaaattttactgtaacagattcctagtatgaatcagatgagcttagttttctggctaggagaaatgaaataaattggacttgatacaactaggattttaattctctacaaatctttgtgttactgaatggaacctctgcctttggggctgcaagttgtgttgtgaaataggggttccttccatgtctgttttggtggctgatgtatgatgagacaggaattggtttgcctagggcttgctccttggaagaaaagctgtgacaaaacctgctgctgctgctaagtcatttcagttgtttccgactctgtgtgaccccatagacggtagtccaccaggctcccccgtccctgggattctccaggcaagaacactggagtgggttgccatttccttctccaatgtatgaaagtgaaatgtgaaagtgaagtctctcagtcgtgtccaactcttagcaaccccgtggactgcagcccaccaggctcctccatccatgggatttcccaggcaagagtactggagtggggtgccattgccttctccggtgacaaaacctagacagtgtattaaaaagcagagacatcactgccaacaaaggtccatgtagtcaaagctatggttttcccagtaatcgtgtatgggtgtgagagttggaccataaagaaggctgacacaatcctcctttccaagtttaaagatgagtttgttgtctcttgacttgactttgcttacttacttcatcagtaaagtttccagtttcatcaggattggcaggtagttgaagacttgagagtctcctgcatagcaaagagatcaatccagtcaatcctaaaggaatgtaatcctgaatattcatctgagggactgatgcctga

SEQ ID NO: 43536 - DNA, 1666 bp, Bovine  19866880893761
tcttgctatttttgttgctactgaggatgtttgaggacaacttttccacaaacttaactacttctccacaagcccaaactaccttcccaatgttctttcttaatgggaaacttttgtttcagtccagggattctgttggctgtacattcagtgagttcacatacatcttctcctctggttttttctttctgcctgaagcttccctgtcaccctaacctggcacctctctgcccgccttgaggctcagtgtcttcattatctcttcacatcatacttcctagctgagctcgactaaactccttgtatcttgctgttatcttttcacatacgtaatttccccccaactagatcgtgaactcaccaaagacaaagaccaaatgtcatgatttttcttcaccccacatggtcccatgtagttctctttgcacaagggggacctgataaatatttttgaatgaaatgattaatttcttccttttcattttaagttttgttctttctgtgaactaccttaactgaagcttatttctttttagtttttcttacaggaaatgatagactacatgtaaaaggcatacagaaaccaggaatccggtttcgctgtcctgagacttgcagtgaaagcgatttcccaaaatcactgacatgtcataatattctggaactccctgaatattctacaatgaaaaaagtgaaggaagcacttcgaagagccatcaacagcaacaaaggatttatctcagccacagtcacagggtgatagtgacctctgagaggctcacatctcgggtcctctcaccctacgatccttctgttctttagtacaggagtacagtttcttctttaggtctgattagtacaaaggttgatgcattttagatagaattagttgacaaatgctgggataaacaatgacatgatgagtcaaggataatattgttaataaaccagcatttcctggtccttaaatttgctatgagaatgattgctttttactgaattatttcctgaataataattagcattttaaaatgtactgaatattaaaagctaaaagatactctaaaaatattgtacatctaataagtgaaagtgaagtcactcagtcgtgtctgactctttgtgaccccatgggctgtagcctaccagtctcctccatccatggaattttccaggcaacagtactggagtgggttgccatttccttctccagaggatcttcctgacccagggatcgaaccctggtctcccaaattgcaggcagacgctttaccatctgagccccagggaaactctaataaacaatttacaaatatgaagtttgaaaaaataaagctgtaattgaattcaccatgttttgaggcatgtatgtgtgtgtgggtgtatatatatatatatatatatatatatatatatatatatatttgtttgttttgttttttttcctattctgggatgtctccagagttttgattatagccaaacaatctttttgaaaaatctaaatattgtgttcagtgctgtgttctaagaatcgttctaaatgaaaataacattattttggctaaaggctgagcccaaccaggaactcctgtctaattacagttggaaaaaaatgaagaacatgaaatatgtttcagcattatagctatagaatgaattaaag

SEQ ID NO: 43537 - DNA, 1065 bp, Bovine  19866880951456
tactctacttcaacagggtattataattttctagtattttagccattatcttgttgcagagatcttgttctttcacaccttcaagcccaggtggcacactagaaataaagggaaaaaattgagagcaatgactttgtaatagcacaatgccagcacagctgactcatgcttatacttttacatttcctgaatgattgatcagccttctcaaaaggacacatgggattttcaataagctctgtggtgacacataggtattgtttggacaactggcaagttcccaagatctgaattaatagcttgtgctgaataataaaagtacatgctgttcaggaagaaggtataggttaacatgggtgcaatcaataatgctttgcctatattagaaattgttactcataaagtattaacatttatttttttaaaaaagcaaaagctagaaagaataagtgttacgacaaaaagaatgagtgttttatcatgttagaaacactcagttacacaaataatagcaatatgatctttatttaaggatttcttagataattcacaaaaggcacaaaacttgaaaggataagatacttctgggaaaaatactggtagttgttgattatgcacatggaagatgtattattactatttgctcttctttggggtatgttaaatttttccataattaaaaaaaagtatacaaatctgaatgcagaagacactatatacatacatatacatatatatatatatagagagagaggaaagacaagctatagattgaaagaaatatctctttagtaacatgggtaatgggtataggatttagtaattacacctaaagaattcttactaatcaataagaaaatgaataattatttttttaaaagatagagaaaagacaaactgacaaactcatatagaagaaaacacatggacagtcaagaatcttaagatactcaacctcactgagtaaccagtgaaatacatcaaaaagcaacaaagatgtatcaattaatatccatctgtattaatttcctacagctgctgcaacaaagctatgaccaactgggt

SEQ ID NO: 43538 - DNA, 1322 bp, Bovine  19866880962702
tatgggttattgggaggattaaaattgataatatatgcaaagcacttaaaatatacttttgccaaacatttttcactttattacatagtcttcagacccgtaatttttatttgacgcatatcttattgaattgacatacaaatgttacttatctggtctcttacttttgaacatttaaattgcttctaattctccatgattatagacaaccatgtggtgagcaaatcagtacttctggtccttttcatatgtacgatgctgtctccagagcaggatagcagaggtaggattattagataaaatgcctgaattatggcttttgattcaaactgttaaactgtgccctagaaaaaatatttttgagatagaggcattttctaggccaacagaaatgagctagtggtgaggaagcaatgaaaagtgcatgagtgagtgagtgagtgtgtatatgtttgcacatgtacaagacgtagagagatagatgcagaaaacataaatttcaaggatatttaatcttagattttagaaaaatgtttattatttgagcaggtaagaaaatgggtggagatctagagaaattctgaagcaggaaagagggaagtcactgaaacacaaacttgctgttttagctgttcaaagacaaaaacagcaaaaaagctttccatctgagagaggctcaagagcacagatgtgagctgatggtgcaagaagagagcagaaggttctgaccacagcaatcgttagaggtactcaatgccactcactaccactaatttctgagttcagaactatctgcagtctctcggtctctgctgctcatgatagttcaaaagggaaaagaacaaggcaaattactacagacagttcccactctagaggttcttaatctgcaagttgccctttttagatctttttggctgtgttatgggctggtgagatcactgtaaaattatcactcaaactcttcagttcctctcctcttgttttctctggaaaatgctttgctcccatatctccatcaaaactgctcttactgagtgatctccagcttgctaattccaatggctaaactctcactgttctactcagttaactatttgaccttctttccagctagagatacccggttcacctggcttccaaaacatcaaacacacctcattttctcctttttttgctgttgtttccttcttaagtctcatctactggttccctgttatctccccatcctctgcatgttcataggcctcagggctcacggtccctgaggtcacttcccttgtctgttcaaactcacacccttgattacttcatctagtata

SEQ ID NO: 43539 - DNA, 854 bp, Bovine  19866880962940
aaattttatagaatatgcacttacccaagaccatcttgattttcattgagctcagaaagtctggaactggatttctgacgtttaggtttacccctttctccaatataaccagaagtattttcatataatttttccacttcacaagcattcaacatacattcatcaagattgctgaagccagaaggaatattttctttgttgagacgtccccttgaattgaaaaaaaattagcttcattttactttaaaaggtaaaaaggatgttttaaagacactgcatcatgcagaaagaagagtgcttagaaattccatgtttcatcttttataaaaatctgagcagagtgctactcctgagaccacttggtgccaaatgtatcagattaaaagagaaattattcctaaaggcaaactggcgagggctgtgtttctaccaatgaaaagcttttgtatttgtaccgaaagtaatctgtattcaaaaccaggggaattgtgcaaacttgcaaagacatttttccattattcataggttttatatacatacatacatacacgtacatggatcttataaatcaatataatatattaagaaaaatccgaaaaggaaatacatctttttctccagaatgggacactgattttctccaattgagaaagacattttatcacagtataaatgcattaatacctaaatctgcctatattatatgatctgggtaaaaatgatataacaagaattacagaatacaaagaaagcatttcaactgaaatatggattcattacttcccagtaccagtttctgaatgaaagcttataactaaagttccttcgtgacttagttttagaagttttaatta

SEQ ID NO: 43540 - DNA, 952 bp, Bovine  19866881021526
taagatttaagtttatgttttcagactatatttgctatcagatatagaaaaatgaaagacccccaaacctcaagtgatattcagaccagctatcatgtataatgaacacatttttataagctggactttatatatttctagctgacataaaactgttttatgaacaaaaatattaataatttaaaaatagtttaatctacatgaaggcttgtataataatcctataatgtgattacctcatactgttaacgttaatgaaacaggatgatttttcctgaaataaaatagcacttgtttgggaatcaagtaataaaggtatttcactcaggaaatcactaactggcttaactgggtatgtattaatatacaatgatcagtttcattatgtaatactttttgacgcatctacatgttttaataagtcagaaatgtaataataaaataatgataatgagctattgaaaaaaatcagagtgtactgtgaggtgtatcctttagagtataattcagaaagcacttgtggacttaaaatattgcttctctaaaagtatttctcagcatgcatattcagttagaaaaaaatattgtgaattgtttggcgattttgacactttacagttcctaaaagtggtatctggcagtaatgtcctggtgccttcaaggacaggggccatcgaagatttctctcttcacctacagcattgctgttgcatgtaaaatttaactatcatccacttgcggatattactttttacacatggattgtcattgcttataaaacacatatggaaaaaattccattaaagtaaaaagttatatactacttaccatagaataaacaatgaaattaaaagattaccacaattaaatttaatctaagtaggtcttaaaatacagcagtttgcaaagcaatatggtaattcattgcctttggaactctcagttctagaca

SEQ ID NO: 43541 - DNA, 1226 bp, Bovine  19866881109561
cctgtaaattcctcaaagttatgaaatcagcctaaggacaaccaatcaaaaaacaaacaagaaaagccgactaggctttaagatacagctaatcaaaggcttcctttctttctgcgccttctctatgtctttccctgagctcttaccactggagctctccaccagttccaaactggtgctgtgtgatgcagatcgatgttcactcttataaactcttacaatttttaacctgcctcactttatctttcagtcattcccaggtatattattggagatcaaacagggagggcaaggaacagttgacccagtgttcagcatttaacaaaggaaatgataaaactactaagatcaagtgtcaaaccaagtagcagagaacttggactctcctctgtggtaataagactgttaatagttaaaataaataggatgtgttttccttactgggctcacaataagaccttcaacgtgcagcccgggcctctaagtacataagtgaagttagaatgagttgatcactcctagatacaaagattctggaaaaaacaccattcttgccaatcagataacacaggagggcagggcagaggaaggaacaatgtaaattagagattacaatttgtagtagtccaatgggaaattcctttataaaacagaattctgtaacaatccatgggagttttctatgttggattttttggttcatagataacaaaattcacaaattaaaatgactgagtctaaatatttcatttaaaatattctcccagtgttttaaataaaggtaagtctctttaaataaaggtaattataaatattacctcttctttaaaaaacttgcagtcagacaagcaggagatgaaaatatcactctaatttcactgcaaaaataataaaataaggttaagtcacaacatactactagcatgttccttttattttactcagtatataactgggtgatgtggaatcattaataatgataataactgctctcttaagagttttccaaattcttgctatactttgtgcgtggtctgctagatctccataaaaatccttcatagctgatttgatcaagtcatctagatttaaataaaatccacccttttgaaaacagaaatttgtggagctgcagagaataaactgctgctgctgctgctaagtcgcttcagtcgtgtatgactctgtgcaaccccatagatggcagcccaccaggctcccctgtc

SEQ ID NO: 43542 - DNA, 4527 bp, Bovine  19866881197747
attagacttttcgatgtctaacagagtacttccttttgaagaaatgagagaaactaaaacaacatcgattcactgactggaactgtgataaattgactactgtccagtactgacatgtgctggctaatgactctaatcttgttatctagtccacacagtgtcaccaactgtcagtaacaatcatttatttgagtccattttaaggaaatcccaattgctaacatcctgttattctaccagtgtcatttgtaacttctaaaaataaaatctttactctttgacttgtctttggtgttgctaaacattgttttgccaatctcaagagaagaatgcctgcaatcatgtttcaccttgagtgattatatacccttttgaaatctagagatacagctctacaatacagagcttttctgagcctgtgcacataaacacgccaccgaacgcacaaaaggagtctatgaagcacaactggtttcccccggtgtttgtcatttccagataaaacattaggtacttaaagaacagcactaaacctttgcagctgctcaagtacctgtctgtgtctcaagtaatatcacctagattttcgtgactcggtggggctgggctttcttggcgcttaggaaatgtgctacgagggagtaacaccgttaaatgaggagcatataatctgatatcaatctgtgtgaaaccaaacagtcatgaaaagatgtaattttcaattagttgttttaatttgtgatcgatttaaatgtaccagtatgaataaaatgcatttacgtgtgcatacatatgtgggtaatctatttacagttatgttatgtatacatttttatgtgtagaaaacaaaaattcacattgattagcctttttgaggcttttgaacaactgtttcttcttcctgttttccactgctttgagaatttagataattcatacaaggtatgtacacaatcacacccatagtatgtacatcctaatcacacaacacagagaagatgtgtgaggaatgtaaatcaacccagtggtcaaagaactgaccttacctgtgactaatggcatggggaattagccctggcatatttggtaacaggccaatctactgatgactgcattcagcctttgtgataattatgttatctactctgggagatgattaagagaagaaaacaacagccctttctgaccttcaaaaacgaaaggacaaattctgtcacttaacacacatgcacacttctgttggttttattcactttcggccatgtgcctacctgatgacagaacttggccttaaaatgggatgcagcgttttttttgttttttgttttttcctacacataaaaatagaaaaccaactgctcacagtctgtacatacttacaaaatgtactgatgtaccacaaccagctacagggtaatgcacaatatagtgtttacatgttagtacagcagagataaatacatttagaagtttagtaattcttagtatatttccttcttgggtttacaggccctgaagacctttctcaaatacctgggaaaggtatttccagatgcccttaaaaacaagacttagtctctccaaccctttagggaatggggactgtgagaataatactgtaatcttccaagttaccaacatcagaaatgatggaaaacattttacaaaataatttactcaaagatgtggttaaataaatgctacgaagtctaaatgggtaagccccttctgctcatttcatagtttgctctatacataacacaaaaacaatatgaaccataaaaaaaagtttaacttctcaaaagttttgcttaaaaataatttaatttttaaaggaacaaagagtaatgctagcagcaaggtcaaaaagcaagctatccttttcactccaaaataaacggatggcctcccatatcttaaaagatcgagaaagaagttagtgtttcttccccactcaattctctttaacacacttaaatcattagggtatttgtcatcacaactatcatcatgctggttgatcatgagtacctttttctaaagtgtaaaatgctgctgctgctaagtcgcttgagttggaaacacgtgatctttactccagccagttgatttcgagcttgaacccaaaagaatacttggtgaagaattagtatttagaaacgcccatctacaacatcatattcacgttttagctagtcctcatttgagaacccatttatttcatagctaaatctggtaatctccaggcagagttaactgaattgctttcttataggctagtatccagggagagtaattactatacatttaaccttccatttcaacggtgtttctggatgaagctgtcttgaattttaagctagcaagactcttggtgattcctttggtcttgactaatgttaaaacagagctgttaaccatcaggtctaatggtcactagtgttgtgcctctctatggagctcttacgtaagtttttccagcaagaaagcagaaattatgcctttgctacttttatcccatgggttatggtcagtcttcatggagcaaaccataaatatataatggtgtgcccataatagatgcacttggtgatataactgcctctttttggcacattattgcttgactttaatttcattatcaacagtctttattctcaggatgagtagctgagatatctgggtcttagaaaaacacaccaaacttgggaataacaccttgttgcaccattctggccctcacagtcatttcaccaaggcttgccgttattcaaatgtccttttgattatcaccttgatttacctaacagccaacagtaatttttcagggtttttttgttttgtttgtttctatctacacatatatgccaatgtactggatttgctttgagagaggttatttggttgtggcaagtgagtagtttagctggtgaatgttcacagttaaaagtagctgtaatgaactctggtagatgtcactgatttgtgagacagaatttttccacttcaatccatcttcatttatgtccttggtcattgcaaatcaagtttattttatttctgtagccaaggagaattcatttttttccaacagtagggtaaaggtcatggaaatatgtttcagtctttccaagattaatttttccccttttgcaaaaaaatgtctaaaactttgtagatatccttcagcccatgtgtctacacaatgacatttataaattactcagctggctgcagaatttcattaagaaggataaagttacaaagttggacaggagatctggcacgttacctgttatttgccaggtggcagcagctgacccacctttggagattcaacccaaagggccacacatggaaccaagaacattgctaacagaaaagaaaatgctcagatgggaatataaaacagcaagcactgaggcagaggagggcaagacttctggttcactgtgtagacagaacagggatagagacaagatggtcagtttatttatccaagatactgctgagttcactgcattattatcacaaagggaagttcataggctctgtttctcaaataccgcttagaacaaagctggagagagtaaacagcgtcatctccatggcagcattggagatgattagtaaatcagacacgtagaggcctacacaaggctacaagtgacatttgtgatattcagtaaacacacacacacatatatatatgcaaaccttatcctaatgtattgttttcctttatactgattcttaaaaaagtagacaagggctgtggtaaattatgcggtactagaaatggacaaattgttaaacacttgcacaatatgtaggaggaagaaaagacagtttctcacattttggaagcaaaacagtaacaaagaggatacaacagaggccaaacaatttacattaacagcctattcatataggtcctctgtaaacaaatcttaaagtcacatcatatcctagtcttcatgtggtatatacagatatttcccaaatgataggaaatcccagagttgagaggaagactatcagaataagctagaacaataaaaaccttaatactcttagatacaacccaaagcagttttccttttctgctttcttaagatgacaagctcttgttaagaacttggttccaaaattcaacctctagggtatatggtacacatgcatattcagtcccatttattccagttatgatatttaacctataacatggagaacactgatatccaaaataataaatattcgaccattctaaagattaaagatcatcagaaatcaaattatattcaatagagctgacttgtcaaggtaggaaaacacagtaatatttttttataaatatttcattttggatgcaaacaaaaaaggtttctggtccactttggcctaacaaaacgtttaacacgtgccatggatccaaaacacaaagcttaattaggatttcagtgtatgtaaagtagttggtctgtggcatcaagggtaatactccaaaaagacataattagaaaatca

SEQ ID NO: 43543 - DNA, 1226 bp, Bovine  19866881241810
aatgaacccccccctgttaaggtaattggtgctttctgaaccgaagaagcctgtgtgtggcatctaacaagtcaggtttaagaaaaagatgtcagcgacttaagacccaggtcacgtgactccgtcagttcaccagtcctagaagctgtggatcaaatttcaactccaggcagtcctcccagccatgtgggtttagccaaatcagaagcaaacccacacttccgaaaatgttaggagctgccctggactttccgtggggcctctggatctggagctgtgttttatatcagagcatatcgaccaaatggaattctagtgttttgctgctgttttgatcatttcatccagcctccgtcagatctgccaggcgagatgggggctggagctctcgccatctgtgtgagtacaggccgcctctgtctcggtggacgctgccagggcccaggagaggcctctgccctcctggtttggaggagatgtctgtgtgactttgtttttccttcttaggaggtgtggggagatttgttaagttaaattcctaactattcacatggacattcagcagtatttggggtggtattccatgttatcgtccagtttccttttccacatgaaggaagatgtgtgctgagtttactcagttaagtaaacttacatactgtatgtagatcactctccagtgttttatttatttttttcccagtgttttagactttcttgttctgagttaagtatgagttaaattgtagttattggacatatcttgtgcctagatttagagcaaactaaaagaattaaaataaccgtcaatgtctttgcttccaagaatgtatgtaacatttttctatttcacatttttgttttaatttagtaattctagaatttttgttttagcatggttgctaaaagtgatggtgaaagagctaagttgataaacgtgtgtaaatccttaaccacccgtacaaacttctggttataatacagtagcagtaataaaaaacacggatataaaatccatggagaaaggtgtgtatttctagggctgaaattcatgaattttcaaaaaaagcaattctcttggtgcttacgagtacccttttgcaataacccagtatatctacaattacataaattacagaatgctgtaattacatctttttaaataatacacagaaaatacatctatctcaaattggtactgttttccaaggggcattttatttgtc

SEQ ID NO: 43544 - DNA, 891 bp, Bovine  19866881272564
ctcttggaccctgctgtctcaggcagtcatatatggtatggtgatatctccctcctttctccatccttcaccccacttttggactgaaataaccctctgacccaagaaaactaatccgtaggtgataaagtaatcttcaccctctaaggccagattcaaaaaacttcatctggccaaatgaactctctttctcatgaccagacctaagaagcaaagaaagaaattttcagttcctggtggaagctttagttgaatatgatacaaaatcaggacttgggaggctataatgtaccacatataagctaaaattatggggaagcagaagttataaaaagcagaaacaggtattaaagcaagatagaaagaagtagataaatagaatagaactaacattaacagcagagtagtaaaggaaaaattcttgaatttctgcatataaagtttctagaatgagcttgaatccaaaaccaatttcctgcttcagtttttgaatttccatgaaatcctaatttcctttttattcgacatgaactaatttgaaagggtctttgttgcttgtagataaagaaataactaaaaatattcagcataaacttgttacatttgacagtaattgttttcttcaagtggcgagaactctaaagaacaaaaactctaaagagaactcttaatgggaaaagtgaatggaaattatttgggggagtagtgaaggaaaaaatgtatgttgcttaatgttgctgctgttatttgttaggggcttctctggtggagaaggcaatggcaacccactccagtactcttgcctggaaagtcccatgggcagagaagccctggtgggctacagtccatgggggtcgcaaagagttggacatgactgagcaacttcccttc

SEQ ID NO: 43545 - DNA, 1056 bp, Bovine  19866881344702
tgctgtccaggtgcaagctccaaggtttttcccggagagagattccatggggactgtacctgaccctctgagatcagccaaaacatccctgattgcagcttctggagaagaagagggcctgggagaggtgcaggttgcctcgccccagcctcgaccagaagtcctgagtgagaacaccaatggcctttccagcactcctgcagagccagacctcagccccagaacagctgccaaggccctgatgcaggccagtgagcatgtgcccacgcaggcagccatgtcctctcctgacattgtcagtgaggtggggaaggcatctcccacactcaactctcctggcaatactcagctgtcagggggcagagagcccacagcaccagccctgtgttctgcagcaggcaaggatttaatacctgcagcatttacaatgccagccaatcagcacatccacccagttgtcccaggcaaccagccccatgccagcccccagtcagggcctgaagataccctggtgaaatcacagagaactgcagatggagggcaacctgagaagtcaagttgtccggtggtggtcatctgtggcaaagatcaaatgccctgtgattttccttctcaagaaacaatgcagggaatggtgcaaactgaagatacagcagccaggtcgttcagtcctacttccgctactgtaggtggacccgaagcagaaaggcagcaagctgtttgcacttcccagacaaggtcctgtggctctccaacaggagaagatggatgttcggggaacaaaccaccctctgccgccacctcagacacccaggccatgacttcggtgattcctcaaccatcccacctccctagcaacggatccatgtttcctccagatccagagaaggtgccgctggcagcacagcctcaagtgtcaaggtttaaagaagcaagtacgatgaccagccaagctgaaaatgagatcaagaaaaccccgcccagggctcagcaagatgccgaggtgcaggcagtggcgagtgtccagagcagatcggcgtccaccagccccagcat

SEQ ID NO: 43546 - DNA, 832 bp, Bovine  19866881349418
tttccttggggcttcccaggtagctcagctggtaaagaatccgcctgcaatgcaggagcccccagttcaattcctaggtcgggaagatcccctggagaagggacaggctacccactccagtattcttggatttccctggtggctcagatggtaaagaatccacctgtaatacaggagtcctgggtttgattcctggtttgggaagatcccctgggggagggcatggcaacccactctagtattcttgcctggagaatcccatggacagaagccctggtgggctacagtccataggatcgcaaagaatcaaacatggctgagtgcctaagcacagcacagcacagccatcattgtcttgaaaattacatgggaatctctgtcactcaatctatagttttttctaatacttacagaggcttgaagaactgtattttgtcctatatgggaaaatatggttctaaataatggggatcttaaccatggaccacgactgagtaacctcactttcacttttcactttcatgcattggagaaggaaatggcaacccactccagtgttcttgcctggagaatcccagggacagggaagcctggtgggctgccatctatggggtcacacagagtcggacacgactgaagcgacttagcagcaacagcagcagccatggaccatagatcttaaccttaatccaaacaaaatgtcatttaggcataataacctattgtatcctgtctgctctggttaataatttctgtaataaatttcacagttgagggattaagccttagaaataattatgaaatgagtgaatacaaactacattagcttttt

SEQ ID NO: 43547 - DNA, 688 bp, Bovine  19866881764331
catgagagccttactgaaacacgtgaacttaaacatgcagtagaaaaagaaaaatactttgtgacctcacttctatgtggaatctaaaaatattgaattcacagaaacagtagagtatttcctgttttgttttgttttgtcatgttttatggaaaatgtcaaaggatgagatagttggatggcctcaccgattcaatggacattaacttgggcaaactccaggagatggtgagagacagggaagcctggtgtgctgcagtccatggggtcacaaagagatggacacaacttggtgactgaacaacaatggaaaatgtccatatcttattttattattattaatgtcatcatttgatgccaaagagatgaaggttattttacaaactgagaattttggcaagtacatgaaatttccattttattgtagttttatatcacattaattcaaatacattgtctataactactccaacatggctcccttggaattatttcagtcatccttaacatgtgacttttaccaaagactttgaatttaaaacaaacattgggcttctctggtggtccagtggtaaagaatctgcctgtcaatgcagggctcacagggtttgatccctggtctggggagattccacatgcagaggaatcggtgcttcacaaatactgaacccaagctctaaagtctgtg

SEQ ID NO: 43548 - DNA, 1003 bp, Bovine  19866881868685
cagggaattgcagccctttgtgacttgctccaaagctgctctggcgggaagagcattgctgctgctgctgcagatgcaaacaaaagaatggggagaggcttggcagtcctgggccagcaagataccaatatgctgcagatcatggtgacaatcctgtggtagcaatgacctttgcctacttaacgacgtctgcgctgctagaacaagggctccaggatgtcatcagatctctttagtgacattaggaaaagcgttacagggaccctggtgtccctgcttacactcatctgactgcagccatcatttggatgttcacaaagacccttggagaacagtggggtgagagataagagactgttaatcctcaaaataaggataaagaaaaaatatcatctggtttcctattcaatccgatttgatttgctccctttacttggaacctttgcctagatcatttgcattctgaacccagcagatcctgccaatgcacagctttagggggaggtgattcagtcccaggaaaacacccacaggctaggaaaagcagttgctgcttctttctttaaaaaatcataccctcacactaatagctgcctcaaatgcactcttcaaagatatcagctgaaaaactggttcttcccttcgaactgcatctaaagtcaatcagaaggctcaagagacaggcagtctctgctgtgcgccaagacttttgtgtcccagacttttggttataatggtcattttaataaaggcacatgagacacaggctgcatcccttccccattcagcttttcttttgttccacagtttttcagaaaaacaaatgcatggcttgtgagctcattgaattccatggtaagcagggctggacaaaaacaaagatgtaaaaatgagctttgaaaagcatgaagaccacaaatatatccttcctttttgtcaaatatattgaaaagatgacttctaagttcacaacgattagaagcacacagtacagcaagcactc

SEQ ID NO: 43549 - DNA, 1297 bp, Bovine  19866881872119
tgagaatccagataaagtgacataaaagtaatcaagcttactcaggacttttgaagattgattggtcattttacgaatagcctctgcaaatggaaccaccagagttatatagttcctggaatcaagcatgacaggacactctgggagcagaaggaagactgataaagcttcttggtgtgaagaatgacatggaagagccccaagcagattatccttgagacatgcggttatctgtggttgaaaaacaatcagggaaaggcccaggacatattagatacagtatcataagaaacaagatataagaagagaggtttcatatctactatgttcctaatggaataataatttagttttcctaaaacctactattcaaactccatcactcctcgatatcccaaatccccctaaagtagtatgtgagaaccatcttccctattttatgttggagtcaattaaagaaataaaagtgaaatcacatgcctggacctactgaacaaatcgtgaaggttgctcaattagaagggatccatacctaaatctatctcacctaaaatataccgtagcagaaaaaatgtcacatgttcacctcaccaatcctgtttcatcttccttcagggctcacaggaagatggcattgcccggccttcctgcagttaggtggagccatgtgaccaggttccaactaatggaatgtgagggaaggtgatatatgatacttccaggcttgacccctgaagcctctctgtgacctttcacaccctttttcctcatctgccaatcaacatgaaagatctaccggagaattttatggccctagggcctagaatgccacagagaatgagcctgagtcacccctgaatgagcttgggtggagttggggagggtaacagaatctgccatgcccaaatatgccactctgacatgacaattattttaagctgaaggcaagtgagaaaaagtagacacagaatgagctctctggcctccccaatcttcctgaaaacagaacataattcccctcatcaaggtgtcctcctgtccacaacttcccatatcaggaagggcataacagtctcactagcagagctgagctggcccgccacacagcaaaccttactacctagcccttatctaccattactttcttcatatatctgccttccaccatttgccatctaagaagctcaaagtccttttcctttgtcttttcacttctctacaaaattattgttcttcatttgctaagttgctatcatgaagtgaaagtgaaagtgaagtcacccagtcgtgtccgact

SEQ ID NO: 43550 - DNA, 997 bp, Bovine  19866881924765
caatataggcagtatccaaactaattatattcctaaacatttttctataaagcttactcagtaactaattttaaatgtaaatatgtcctatattataattttcctatttgctaaaaggaaatgttatagcacccccttcctacccaccagctccaaaacaaatgttttcaaaaaagtgttgcttattatcacatgaaaagtcagtgggttacataactgatactttttaatttttaaaattatgtttgctaaaatagctcttaaatatctcaataatgtgcatgtgcaacatggaatttacttgtactatttatcttatatctttaagcaaagataagtttctttttccccataaacattttggcatagatgacaagtccagatgaaaaagaatgtggggaactagggtttggtttagtctttgacatttaataggaagtacaaaataactttatagagactaaatgctacagtaggcgaaactttcaggaaaaatatgagaatatagtctattatatataaatttattttccttaacaatttaaatcatgattattcaataacatgaatggtaattattcatttctatttttatcaaagcttttaatggagaagagtttattgtaatactcttcttgaagttcatgctaagagaatgctttaaaatgagacattgtaataataaagaactcaagcatttcctcttttgttagacttgagctcagcctttcttatactaaaacattatcaactgtcagagcattccagtgacgttctggtatttaatcaggtcaatataagtaggggaatctgctggctcataagaaaatctaacagcaagctgaatgttgtctaacaagggaaaaaaccacctctagacaggcatctggcaattttctcctccaatggtgcaggatccctctaaataagatattgacgagaaagccattaaatgtattaaatcagaggtagcttcccaccacatacgaaacatcca

SEQ ID NO: 43551 - DNA, 1008 bp, Bovine  19866880344182
ttctgaaggagatcagccctgggatttctttggaaggaatgatgctaaagctgaaactccagtactttggccacctcatgtgaagagttgactcattggaaaagactctgatgctgggagggattgggggcaggaggagaaggggacgacagaggatgagatggctggatggcatcactgactcgatggacgtgagtctgagtgaattccgggagttggtgacggacagggagacctggcgtgctgcgattcatggggtcgcaaagagtcggacatgacggagcgactgatctgaactgaactgaactgaagctgtccaagtcaagttgattggtggctgctggaaatggttggtcctgctcccagttaacccctcctgcaaagcctatgaccagctcccatttacaaaaacctcttcattgagctcagcagccctggaaaatgaaactgtggctcagagaggtaagagacttatacagtcaccccagcagataagagcccaggaaaggagcaagaatccaggtcttctgaatgcctaaagcaattcccactctaccttattgcctctcaaaaacctttccattaatgaaacatactcttcgaaatgaaatatattcataatgaaatatacccttttctccaagttagttgtgaagagcaagcattaagactatatcatatactgagagtgcacttcttagaaaaataaatttaattgcagcctcttgattcaaatcaaacccactttgttttaaactttccattacggtaacatagagctgcagagaatgtgctttccatcctaatttgagactcagatggcagctcctttcgtacttctatctttaaaagcctacctcccccatcccccgtcttgttatcttctcttccacttgccaaacaaatctccaaaaaaaaaaaaaaaaccagaactgattaaatgcctaagggaaagaaagggaagagctcaaaattagtagaatctgttcccacatgttcaggttaatt

SEQ ID NO: 43552 - DNA, 1670 bp, Bovine  19866880447941
tgtttggtaggaatgccatctccctaaaagctgcatgataaatacgcagtcattttagaaggactcaagtattaaaatccagctcctcaaaggccatcttaaagtctggcttcccaacagccactgactttcccacgatccagtgaaacctgtacatattccaacagttgctacctcttggctaaaggcagctagctaataagcctccatctaacaggcccttttctttcctggcaagtcaacacggagtgtccctaagaaacctcagactgtctttggccaaacacaagtagggaaagggggtggagaaaggaatggtcatttgcctttaaagcagagttcaggtgtttcaacctcaccttgactgaacctgcattggaagaactttccgtctcaccaggtctgagatctttggctctcggcaggctagaaagaaaaagttaaagctgcataatccttttccatactaactgttcacaccatgaattcagattcatacctgaccaccctctctggacaccaagtgcacattccccaggctctcagaagtgagacgtgtcagccaagcacgaacagctcgcttagcaaaagagcatcctgagagacttccctggcggtccagtggttaagaatccacctgccaatgaaggagagccaggtccggtccctcatccaggaagatctcacatgctgcagggcaactaaggctgtgagccacagatactgagcccatgctctacagtctgtactctataacaagcgaagccaccccaatgagaagcccacgagtgcaactgagacccagcatggcccaaaataaataaatgaattttttaaaaaacagagcatgctgagtttcatttattaataaaatggcatccccctttgaagaaaccaagtagaataagaacgtctgcagagctgctccacccaggtgatatgaaagtgtgaaaggattagtcgctcagttgtgtccgactctttgtgaccccatagactatagcccaccaggctcttctgcccatggacttctccagggaagaatactggagtgggttgctatgccctcctccaggggatcttcacaacccagggatcaaacccgagtctcctgcattgcagggcagattctttcctgtctgagccaccaaggaagcccagtgatatgaagcaatagtagttaatagaattatccatttacgtagatagtattagcaaactggatcaatatggaataaaagccaagggcaaggttctaaaatgtagcccaagataggaaatcacaaggttctcatttaaaattgaacagcagtgtcaaccaacaataagtcttgagtaactgattcctccaggtcctttctctgcaattaaggcttctaatgatcctttgagggcaactcaaagcctggtttaattttgttgaagtctctctttcttcacaagtgaaaaggaatccttcccatctcactttcccaatcaagcagccaacatttgtctaattagcaacctagggaactctagttgtattaatttgtaagagaagggttgacaaaaaaatctccaaggacataggtaacaccatttccatacctaatgaaatcaagactcatagtctgtgctgctggggatgaaggtcgctccggctaaagtcaaagtcttcctttcacagc

SEQ ID NO: 43553 - DNA, 950 bp, Bovine  19866880526365
cttttactcaggaaagaaagctgactctggtaaagaatcgcctgccaatgcaggagacaggggttcagtccttgggtgggggagatcctctggagaaggaaatggcaacccagtccggtagtcttgcctggtgaattccatggacagaggagcctggcgggctacagtctatggggtcataaagagtcagacgcgacttagagaccaaaacaaaaccaacaacaacaaaaaaagccaaacagaaaagaagagcttcagggaatgtgcatggcgtctgggcagccaagctgctgactgagctggagagcaaggctatttcattgtctgtcaaacattcacgtttaaagggagcacagagggatggagtggagaaggaaaatatttcaagttgtgagcgagtgagtccactccctgctggaattctgaatctggcccccgtcaaggaaagcttagcagcatatttcctctaattacttttctaaaaagagcgtttgatgagatgtaaacacccactgggatggcacggcagacggttgttgctcatcgactcgggacacgtgtctgaggatgagaatccaaacatcagggccaagtgataacccaacacaaacagcatgtgaggggagaaacccaattccactgacttcaccaaacagcagtcgctctgccagcaggatccagcctaaaaggaacaactcattgaaaagatgtgactctggggaatgaagctttcacatgaataacttcacaagtgttgcttccaacagacattagctggtggggagcgagcatccaggcaaccggggaggataatttgaagcccagatatgcagtgggcaggagcaacagtggagagagggaatgtggaaagaaagcaagggggaaggagtggcaagaaaaattagatgttggtttataatgggatgtgttagcaaattccaaggagagag

SEQ ID NO: 43554 - DNA, 860 bp, Bovine  19866880529024
atgagagtatgaggaaataaatgactcagtgggtgattaatcgtcctggtgcagcacagggtccagtacccaagatcattatttctattgtatgacaagaaagaaagaaggaacagtgaagcattgtgcataaataacaggacatagatttcctctctgctcaggaaagttctgctgtcccttcttttcagactactcaaagagacccaaaccagagtctaaattctcatctctttcctgagccttcagaattgatcctggctaacccatctggtgcggagctagggacgtctgagagacggtttccattccattcactgccaagtacaaggggagcggggcatcgcaactttgccctttttggagcttgacattacgtgctgtctctgaggaggcagctctgggctgtgaggataagaggcagtggggaagaagataaatttggattgaatgaaaattatgagaaaggccagtgcaacactgcagaaagctcagggcgcacagagcatcagcttttggcattttgactaagttgactatttaacccagttgttctaaatcccatcgtatattagaaacatttcacttgggaaccctaaagaaaataccagtgcccaggtctcctccagaccaattaaatcagaagctctaagagagaggtctgggcatcagcaccttcctcaaacactagtcaaatggaaacaggattcctgagctgtgggggtaaccctctgggagcctcggggcattgatttcattaggaatccctcaacagcctaaagagaacatcagagaacaaaacacaggaagattgttctagctccaacattattgcttccgatgggggaaataaatcaccg

SEQ ID NO: 43555 - DNA, 1001 bp, Bovine  19866880662222
tttagaactattcatgataactctgctctttaaaacttagtaatatatgggcccctttgaaagaagaaaatttccactttcctcccagggctttctacaattataatactttcaagcatattgttatagctttgatatatgtggaaagcaaaaaaccaagttatagtcaagtgagttaaattcagttcagtacaattcaattcaatacaagctaaaaccaaaaaagccaatgtgattcaatttaacaacactaatttaatgggaaggatgatgttgttttgctgaaacaaaattacctctcaaatgagaacatgatattgactactgcctcattagttctttcaagtttcatataattgtcctacagggtgccgtgcgatgacccagttttccaccatttctctctatttgaactgcaatggaaactccctctgtgcagcacactattaatttatttggccttaatttggggtgagcataacatttctgtgctaagtcaacgtatgtgtcactggaacaaacaaaccctttaggaccctatggcatgagtgactatgtcatgtctttagaatgatgcagaaaatggtaacactaaattttaatactatgatcaaaaggaaagcccccagtttaaaaatcctcatgcaactttttcaagactctcctaggggtttgtgtgagccatggatcctgggttaaaatgcgtatgtccaaagtcaataggtttaggccaatattgggtttaaagctagaatcaacaaaaaaaattctgggaaaaaagcaaaaggtgatcaaaagacatcatgacaataaaattcatccctaatcagaatcacggacttgagtaaggaatcttgtcatagtcatgacggagactactcagtgtccaagtgtgcgtctgttgtcttcttttctctttatttatttagaggctacttttattttatttattaatttttttttatttgactgcaccaggtcccagtggcagcacacagagt

SEQ ID NO: 43556 - DNA, 1580 bp, Bovine  19866880747242
ccaaatattctgccctcctaatatccatccaagttaaagacacatccaaggacaaagggagtggcttcaaaacctttggatctgtccatagcaaagcaatgttaaaaaccccacagatgcttataagtacttgctggagtctgtcaatcacttctccctttgccattttataagactccaccttttcttcgggtgatcttagaatgaactagacaagtgcatttcaaaccacagaacttaacctactagtgtgcaatgaaatcaatttattgggagaatcttcaggggtttttttggacagaaaagaagagaaacagagcagaatatatcatatgcagtaaggttaacagtgttccatttgtgtcagttaaatgtgtatgtgtgtgtgtgtgtgtgtaaactagaccacaatgtaaactatatttcccctactgtaagttatgttaaaaataattttttaacttgctggtctagagttctgaatatatgtaattgcacttacattgttcaaccaaaacaattcattaactatagctatgaatgcaaattcccatggcaacataattttcatatgaaaatatccatgaaccagatcaagctcctttgttaagactccatgacctattttcacaataagaaactatggtcacagtaagagaaacctgcgtatctgagatgagatgttctgagccagatgagaggtcataatatgggctgtgtaactgtatttctatgataaagctggagcacaggctccatacaagtttgggcccatagaatcctttggagaccaaatcttctggagccaaactgaaatacagtacaggaggaaaggcaggactttaaaggtcatttcagagattaagggttaaactcatcccttcgaggtgtttgccttagtccttctggcttagccttcaggttgcctctgcctagatcctctcttgctctaccatctccctggttttctgaccattctggcctgccaactcttaagtttgctttactctagcccttggcaacaatttgatcttctactgccaacataagccactcacggtccagtctggcattgagatctcaaaacatatattgtttaaattcctcttaactctaaacttatacatttagcaagactcctcctataatagtaacaaagacaacagctaacatttaaagagcacttacaatgtgtttggagaaggcaacgcactccagtactcttgcctggaaaatcccatggacggaggagcctggaaggctgcggtccatggggttgctgagggtcggacacgactgagcgtcttcacgtacacttttccctttcatgcattggagaaggaaatggcaacccactccggtgttcttgcctggagaatcccagggacgggggagcctggtgggctgctgtctctggggtcgcacagagtcggacatgactgaagcgacttggcagcaacaatgtgttaagcattgttaaagttgttaagcattgttaaagttttatcacaaactagattattttactctcacaaaacactatttcttaactttatacccattttagagatacaaaaaca

SEQ ID NO: 43557 - DNA, 1737 bp, Bovine  19866880813421
tgagaaatatttaaagttgatcagctgaagagatctgaaaatacaataagcagacaaaaacaatctcctggacttttcctcctccatttgtgacaacgggcaaagggcacactggtcatttggcttctgatctcctggaggaggaaatggcaacctactgcagtattcctgccttgaaaatgtcatggacagaggattctggtgggctacagtccatggggtcacgaagacatgcatgcataaacgtacaaacttcagggaatttcaatatgatgctaaaagccagttacaaaaactaggatttaaagaaacatgaacagcggaaaagcaacatgaaggttttcctgcatgtatgctaaagcattttaatatttgtttagctaaagtgtttttatattgttcatgcaatttaattttaaaaatgatccagaaaaatgggtaatattttctttgtaagttaaaatgagttactctgacctcttcactttatcagtgaggaaaagagctaagtaggaaataagcaaagagaaactccaaagacatttttttagggaattctgagaagaaagggaggcctgcagaatttcaggcttagggaagacatgagcaagcctgctgctgagggcaaaataggccaggacaaccctccagttttttgggtaacaaaggttactttgctgtccacatttaagaacaaagccttactggttgtctaacctagggattggtaaatggtttttgtaaagaggcaggtacatttttcttggcattttaactttatctttttaattttttattaatttttgttggagtatagttgctttccaatgttgtcttagtttgtgggtcacgtggtctctgtggcaactactcaatagaaaatagccacagataatatataaacagatgtgcatgacagtgtttcaataaaactttatttacaaaacaacaagaaaaaaagaacagtcttattaaaccacaaatgagttttattctgccagtgcttcctaggaaataagtacaaactaagcatcaagaactcacagagcaccacctggaatcatccaaggcaccaaagagtcaagcacgtgcccataatcacatagcaaaattgaactcacaaagttccgggcatattatacattcattcatttatctgaactcttccactggataaagttattttttttttttataaaacactctatgaaaagtgaaagtgttagtcgttcagtcatgtcagactctttgtgacctcagagactatagcccactaggctcgtctctccatggaattctataggcaagaatactgggagtggtttgccattcccttctccaagagggtcttcttgacccagggatgcattgcaggcagattctttaccatctgagccaccagagaaacccataaaagaccctatactttaatagaaaagatttcttgtgaaagcatcaaaaaataaaattatacataaagaaaaagtattcagaaataacttaccattcaattgtcatcttttaattaacatatacattcacacatagacgctaaaagatgtgtacagtcttcttaacctctcaaaactggtaacctattatttttttggttttctttagaaactgctatttctttacttcagtcatgaacatcttctcttgaccttgagtagtcctggagaagtgattttaaattgctgcatcattattttgtgtggacaagtgcttctctttcct

SEQ ID NO: 43558 - DNA, 1390 bp, Bovine  19866880821674
aaatgggaggggggaattatactaattgctgaccgtaccctaccaagtttcacccacttaattaacaaacaaaccaaaaaacccaaaccagttagtaatatacttgtacatgtagagacattttacaacaatccctagtgcagtggttaccccaaaagaggaagaatgagaagggggaggggaaattttgacttttcaattcatacattctgagtttcttttgtttaaaaaattttctagaaagacatatgagttttgaatgacgtataacatcctccatttgcccaataaagcactttgcaaatatcttcaacccgggggaaaaaatctggccaaacacaagatctaacttgggtataacttatttcccttcctagagttgccacaaggccaaactctatgattttcctaggggaaaaaaatgttgtttattattccaactgttgccatagcagtcagtgtttccatgttatcgtctttttctccccagacattactccactaatacatgttccagacctgcaatctgaggcatttcagccagaaggaaacatacttgcagtgatgtaaaatcaactgagaaggccggctctgccttggagtctgagtcctagagttttcaatcactgcatcaggagaggacagtggaggtggtctctggatcagaaggattggatcctgcagaattttactcaatcccacaatgacccattttcttccccctacacctttggtcccagctaccagaactgagaatttgcctgccaatgcaggagacacaagagatgcggggtttgatccctgggttggggaagatcccctggaataggaaatggcaatccactccagtattcttgcctgggaaatcccacggacagagaagcctggtgagccccagtccatggggttgcaaagagtcagacatgcctgagcatgcacacattggatatttaatgatattaactatattatttatttagatagaataatagcattgtatttacttttaaaatattttagctttagcatcagtccttccaaagaacactccaatactttggccacctcatgtgaagagttgactcattggaaaagactctgatgctgggagggattgggggcaggaggagaatgggacaacagaggatgagatggctggatggcatcaccgactcgatggacgtgagtttgagtgaactccgggagttggtgttggacagggaggcctggcgtgcttcaattcatggggtcgcaaagagtcggacacaactgagcactgaactgaactctaagataaagaacatagtatgaatcacacacactgtttggaaattgtagcattgtttaatttttgttgattattaatgtatgtattggctattgataataa

SEQ ID NO: 43559 - DNA, 1751 bp, Bovine  19866880824641
tagcagcagcagcaggctgtctaaagctggtatggaggaatcatgaacttactaaggaatctaggctgtctctacctctgttatggcatctgcagggtatagtccttgtcacagaccgagatgactactggaggtccagccaatacatctgaattccaggatggcaggcacaggaacgtgaagaagggaagagaaccctttaagagaaccttccagaagttgcacacattgctgtttatatttcagtggtcagagttcagccccatggcattatctagttgcaagagggggtgctaggaagcagtctttttttcaggccatggtgtgtccagctaaaactggagtgtcttactaaggagaaatgggagaatgaatatgaaggaccaagctgtcttgccttaattggctttgccctccatggatttgaatcctggctctgctacttgttacctgtgtcatgctggagaattcatcctctctttctgaatcttggtttcatcatttgtaacatggccacaataattatttctccttttagggctgtagtgaaaaccaaataatacacgtaaagatcttagcacagtgcctggaatataataatccctcagccattagtgactcttgctacacctacagagccatctatggttctattctgagttcaattccagaccagttagtctgacagaagttcggacaccaagtttctttgggtggaaactggtcagccccctctccttctgctccttctgcctgctctattctggtgggtagaaaggctggtgaaaaacctgtcttcagaggagaggctcctgtatattgcagtgtcctgctggtgccttatgcactagctaaccaaaacacagctggtatgtctaattttaggttcacaagtcttgctggttgtcctctttaaattctgttttacattctgaactgtgggaaatttttatagaagcagagaggaggcaggggcaatacacccttttctttctgcttagaaaatagcctccgttttctttccagtaagaaatggggacaagttggggaaagccattataggcacccccactgtcctcctgtccatcctttgggcctgcgtgaacctggtggggtataacttgtgaatgatagactctgacttcatgtgtatgaggaatggaagtcatatatatccttttatattttaaatttcactctgttgcctgtgcggagaagggactgtagggtaggtgaggggagcggtattgcttcttggacctcagacaagcagggagtagtagagatggtaaagagtaattgaacttggcctaggttttagagttaggtctgaaaagacttggtgataggttttcttagacccaaaaaatgattttgcatctgagcaactgtgtaaaggtggttacctaacaaaggagtggatttggagttggaaaatcaagtcatgtgaagaacttggaaaagaatttttggacatggtgtgatgatactaaaatcggtttaatttcattttgtcaggactttgctttatggttggattccttaggaggacttcttatacattctatctcccaatccttttccattatttctcccccaaaaaactttttgtgaaaatgatagaaagttggattgattttttttttttttcctttttgaaaacatggtaccaatgcaaggccactgggatagaaaagaaaaaacaacaacaacaacaaacaggcagccaatattcttttgcaacccagcat

SEQ ID NO: 43560 - DNA, 694 bp, Bovine  19866880924554
aaattaaatagatccacgaatgaaagataagtaaataaatatcaatatcattggaaaacagccatttaaattaaaaacaaaaacaaaacaaaaacacacactaaggaaatgaggtatccttttctgaaatttaaggatctacccctgcctttattcattcccctttcatattgctggcctattgtcttttctgccatcatctgatgccaaccagacagatttataacgagatgtggatccttttctattctactgacaaatctgcaacccatctgcctccaatcaatgatggagcacgtggagatggagcaatgagatatttttaaacactcctttaattaattcactccaaggacttggccgcttggtgaggtgaggggtgaggggcagacagagggaagagagagcaagctcatgatctggtaaataaagagatttgccgtaatctggatacctaaaacccttgctatgaaacattctgctggccccaacaagctgttaagggtatgggagagaagagagcaggcaaggcggtgtgtggcatttatttgctttttcaaactcccagaacaagttctgaaaatgcaaacaaaactaaaatttcatcttgagaatgactcttttgcctactattactagatttgaaatgaccagtgtctggtttgattaaaataagtatagcaagtgattgaaa

SEQ ID NO: 43561 - DNA, 1018 bp, Bovine  19866880962805
agtctgttcctttttataagggaagtgagttcttcctcgggagcctccggatggtttgtacttatgtcctattagccagaactgagctggatggtgactaagattctgaatgggaattggatcaggcaactcatggtgtcggctgccaatacttactacaaattcatatagtgcggagagggcattattgggtcagccacaaggagctctggccagtcagctggtatcatggtagcctgtcagctggtatcatggtagcctgcagaaaggttgttctcctggtaacagttctcacgtaatggcatgggactagaaattccaaaagacaaggacattgtttgcgtgatctcacttagagcttcaggacctaatccaaggcctggtacttggtagctgcctgacaaacatttgtgaatgaatgaattgtccatcagtgaggatggatttcagtgggctggggcactcagggaatagggatcaggataattggattttctggcagcctgagggtgaagcagaaaagcttatgatttcaaattaattccagcaacactaagtgcattctacatccaaggctccaaggttaaaaaaaaaaaaaaaaaaaaagaatatcccatgtgctatgtatgtgtaacagtcaggatcttggcagaaaagatggcatgagcagggtagttcaggagatcataataagaggcctcttacaaaggtgtgggccggggtataggaagccagctgtggctggtcaactcccttggggctggtgatgccagagagctgttaccaccctgctgacagaggaaggggaggaagtggaagaagtggattccgaaagaagaagagagatatggctgtagctggagcagtcagcctggactgtctgggaggagctacagcctgccataggggaacagctccactgtctacggctgtagactggggccctggctcagggagctggggacacacacaccctgcctctctctccttccatctactgctcacctgttggtgtatc

SEQ ID NO: 43562 - DNA, 1546 bp, Bovine  19866880963270
aagggcatgttacgctgttagtcgctcagttgtgtccgactctttgtgacccctggactgtagcccgccatgctcctctgtccatgggattttccaggcaagaatactggagtgggttgccacttggttctggtgaaaaacattgtgaagttgccaatctaatctaacaccccttgttccaggtaagatacctggagtcagagaggggaaatgactttcccaagtccatgactcataaacagccctcctctctgggcttacagtatcctttccatttgactttaatgatcaaagcatgcttggaggtgggtgtcaattcttgccctgtggtttccatgccactttggcagctgacattctattccttcctggagcaattcctgtgcttttggatcagctggactcgcctctcctttcatactcctgccaagcttgcaccacccaggatcagtggttctgcaggatggggcaggtgtgtggagggataaataatctgtgcccaggcttggatgatccatggcaatagggtagctcagaaggtgcacagttccacagcttactgttccctggggctgatgagccatttgagaaatagaagcacagcctccctgtgaaaaagagggggttgcttgcgacaactcatacaagggcattctcagaaagaaggcaaccagctgacaactgtgggctttaggtaactcctgccagactcttgcactctggctggtcttcctgagccaaaatagaagcctgtagaaagtgttctgtgactgcagagatacagcgggattatgaaagaggatcctgtctgggactcaaaatgcctatggttttgacttagagaagaaaacgatctaccccatgaatgagcaaacatttatattacatttactctgtgccaggcactgttctgagaatattacaaatatttactcatttaatccaaataatcaacatctaggccttaagaggactctcctagctgcagtcctaggcagaaggtggagaagtgttgagaggtgttaaaataatttgtttttcttcaggatccgaagacaggagggcaagcactcttaatagagtttagaactatgtcattgacaaagtgcattaatcaacagtcaaatccagagagtaaaggtcaattgcctactttctcttggcagaaggaattgggaggaggattgttcttcttgcaaagattcatcactttttgatgctttccagaagtggtgatggattttcaatgagccatctactcttgaaaaaaagcaccttcatatatttgcagtgcggctgcctttggtgcagagggtctgcttgggtcctgaaaccacccactcaagctcatacagaaatctaacctgtgcccctggccaaggatccagtgctttgttcaggattgtatgctagaagagggttctcaatcatttaaaaattagcttatcattaatttcaaaaactggacctgtattcggaaacttctaaatttgactttgataatgaaaattagtagaaatttactgaactgtaagaaaggcaagag

SEQ ID NO: 43563 - DNA, 1155 bp, Bovine  19866880993715
tctttaacaaatgtagaatacttttttctttagcacctggactgggcccactcgggtcagacctctcaatttgtctttgaaaaagtgcacagtctgcccctagacctccaactgggagcataactatacaaggcaatatatttttcagacacacattggcttcaaatcaatataggaacataacctgacttccatcaccagagctatgggaaatggtacctatttcaaaatgaaactctaagattagatgttcataacaatcagccttgattgaactaccattatgcaggctggcctcattttaatctcatcagaatgataaggcagctctcacctcccttttactgatgaagaaagtgagactgctgctttcctggtggctcatatgataaagaatctgcctgcaatgcaggagccacaggagatggagtttcaatccttggtccagaagatcccctggaggaggaaatggcaacccactccagtattcttggttggagaatcccatagacagaggagcctagtgggctacagttcatggggttgcaaagagtcagacacgactgagtgactgacacttttcactttctttcaaagtgagactcagaggagccgatggatttgtccaagttcacccagccggtaggtagtagagccttggttccccctgggacctggtgtctttttcatgccaccataccctactgccttccctcggaatttttccatgttttggtcctttccccacccaaaatggctcaactatatgtcaaaacggcacaactacatgtaactcttgagttagtcacttggattggggtcccggtttttgccagagttctttataaagctttgcagctcatggcatagcagaaatttttatttaaattgaagtttacaaataacacatatgaaaatcaagaactggtttccccaagagattcaagagtgcaatgaccatgaaggaaggaagcacgccctctttcagcaagttccataaagaatgacatagagcaagaagaatgtggccaaagaaagaaccacagactcacctacccgcttgcccagctcccggtggaaagggagtggagctgagccagccctggaggcacaacatcattgcttgttgtgtaggtgaacagccgggattcatta

SEQ ID NO: 43564 - DNA, 1184 bp, Bovine  19866881005020
cttgtctctgtcacccacttatcctcttgccttcaatcttgcccagaatcagatagctagggtattggagcttcagcatcagtccttccaatgaatattaagggttgatttcctttagggttgactggtttgatctccttgcagtccgagggactctcaagagtcttctccaacaccacagttcaaaagcatcaattcttaggcatagtgaggattttctcagccctgttaggtacagaggagatgggggagagagaacgttttattttttaaagacatcactttgaaaagggaatgaaagtgggaatgaaaagagtaaaagtgggtggagagttgcccgatgatatctatgctagcccatgacacctattgactttaggggataaaagactatagaagaaacatgagaaaatttctcaaatggaacaagaaggggaaaaaaagtcactcataagcgcaccaagtagaaataaccccttttaagatttttgagccaaagttttcaagtttggtatgtgaatatgtgtgtcctacatcaggtacctactgttctagaaatctgcatctgtgattgatcaatacttatgacagctgacaggaacaggtccctggggccagtgggagtcgatgcctgtccacgcaggttcatgcaggggctgttccccctccctgaccacatccctcctgaccagcagacaggaagcaagtaagccctgtcttcctctcgctccaggaaagcagtccacttagccggccccagacagcctattcttcagaaacaaatcactccaacaacaacaaaaatcactccattaagaaattcagctcagtaatctcagcccttaaatgcttgctttttctccagcctgcctgaataggagaaaagcagaaaggagaattttaactggcacatattgattggcttggctcactgaaagaaggcacttttatcagcttttcaaattacaatttattcaatactgagaaagtaactcaatctgagaaagagctctgacacctttaggagttgctttctcaccacctgaattttgtcattatcactgttcactcatcatcctctgggagccactgggcaaagcacagttcttggcacccaggaagcaattgataaaggccattgaattaatgagactataacggcagggaaattcaaattccaggga

SEQ ID NO: 43565 - DNA, 879 bp, Bovine  19866881095638
acgcagcttcgatccctgggaggaaaagatctggagaaggaaatggcaacccactctagtattcttgcctggagaatcccatggacagaagagtctggcaggctacagaccaggctcaaagagtcagacactgctgagcatgcacgcagcccataaataaagtgtttctaggccattaggaatgtggaacttctcagaaatagtgaaagtgagcagtgttctgctctctatttgaaaatgcctgctgctgcaaaggaaatcttcacattctagtaagcctagctagtctgtgccctgtgaggatgtggcaattcaaagtccagtgaatatagacgtccctgcaaatacctgatgtgtatatgtccacatacacgcactctcagtttaacaaccaagggaactgcagagcagtcccctcattatcttacataccacgcagaggttgctgccggctctgatcacaagcgccaccaggtaatggagctgtggtgcttgctcaagagatgcttataggaagggcagtgcctcagcaaagcttgtcagctcctaaagctgagccaaggtgacagccctgaaggaatttacactccagccctactccaggatgtctaatgatatgggaaatttggatacccagccatttcggtgacctgagagtctgaacactccagtcaggcctgagggcatggctgaagaattcataactggtgagagtggtagggcttaaggagctctttcctccacctagacaatattctcttgcccatacctgaaattggcacactcacataatagctgttcgacacatgcttttccataagaaaatcagttgcatgtttactatgtgcctagcacatctaaaatctcttgtttaaaaaa

SEQ ID NO: 43566 - DNA, 1353 bp, Bovine  19866881097981
attatgtaaagtttaaaaataaaataaaatttaaaaaaataaataaaaaataaaaagcaagtccttttttcctccatctctgaatgttttcaggtgttaaactatacttgcattcactgcttgaatctcctgggctaacagctaaaataaagtaggaatgaaagagaatgacattttgtaaggtttgaagctatgaaatttacatctggtttctttgcaatttcaagagagtctttgccaccaacagttacatttggaaaatttttcaaaatactggttttggaatggttttcttaaaattatttgatttgaactctatttcatgtggttttcataacatgtaagtggttttctaagacagtgtaagcctgtttggtttcaaaccattttttgaaaccagatcactaaggcaaaatatttttgtaaaattttaatactatttaaaaattaaagaatttttaatccaaacaatttaaaactctttagaaatctatttatctgagtaccaagatttctggataagtttcacactgtttaacgtcaaaacatttagtcaaaatagtctggatccgagacagactttgaagctgtgtactttcaaaatggctcatctagataacatgcaacaatatatggaccgttttattgtctcaaaacattggtttcccatcgtataaatagccccagcagtaacttcacagtattgcaaaatcagctgcatatttttttaattaaaacatctgtgccatgcagaaatggattgaaatgttttctttatcaatagtatggaaacattttttgcaaaactttcagccctgccccctctttccttcccagagggttctgaccgtggattgcacaccactgaatggaaccagcactttgtggattcacctggttcttgctgttttactaatattgtcccttgtaattctcacaacagtgctctgaggtatgtatgcattattatgacactcaggatcaagaaacgtcttaaataatttgcctaaagtcttaaagttactgaaggcagaacaagtttcaggcctcatcagtttggctccatgtctcgagttcttaaccatggtgctttctgcctcacgcccagtgttcataactttaacttactgaaccagtttaccttccctgtatatttcccctctttctagtctctgttctggtagattacaaccaaagaatttccatgtccctgcaatcagttgccagatatattatgagtaatttataatccgtaacaaatgctgatattagtgactcagtttacagtgagacactacaatggatttggggtaatctataaagtaatactgctccaatgcatctctattcata

SEQ ID NO: 43567 - DNA, 2697 bp, Bovine  19866881100551
gttactttttaaggtgaaagttttcttccaagtcctcaattttatattttatttccttgaatattttcagtctatttttaagtcgtgtcagacaactccattatctgaatcctttatgaatctatttctaacatctacatttctcttgaatttcagccacatggtctcaccttccattgaaccttcccttggaagcatcatcctgctcaaccctggtcatatttcatgagcataacttaaaaccaaatgaaagagaagtagacaagaaaagtaggcatgtgtcttgatttcagacatgtcatgttagaaaggaatatgcatttaagaattatagaaatgtggcagaattcctccaccttgggcagacgtgtttagatatcctgagtctgttgccctttaaatcttcctttaaacccttttcaatgacatgaagaacctggattgtcatgaggctttattacctggaagggcttgagaactctccaaggttcctgccagttaaaccccacatgaaatgtaatagaaatcggacccatctcacacgtaagagatcatgaagtggaagcctaatggaccgtgaaggtacttacttctaagcggagaaaaatccaatgattaggcttacaggaaaagtgatttcttgtattctcactgagggctgacatggctagaggctagttcattttctttctgttttccaggacaggccttaaatatcactcagtctttcttggctgtgatctctagcaagcaaagttcaaaatgaatgaggagctacacttgaattacacaagtcatagccctttgatagtctaactggtcaaagattgaagtctctgcgggtaccatacagctggtgggtggggactgtgaccaaggcaagaatgtgatcctgtctaagtagagagctccgccctgcaccagctgattcttgccgtgtgagaatatagacccagggtttccagagctaaattttgtcagaagctagtaacacagatttttatgagacactgtctgatttttatgttgacaacgaattccactctctgaaacttgcaggtatgacatatgttttggggatgattgaagtctgtgggctcttccagttgtttctgggctatgtattcagctttgactgagtctgtactataagacagtggcccatcaatgaagcaatatggaaggctctttctgcctcttcgttccacatcatccagggattcctagaagtataagcactgggatttttctgagtccacttgaagcttcaaaaagtacagtgccttctctatgccattttggtatttttaaacaactcactcagtgagatccctttttgacatttaaaatgggactttggcatcaaccaccagggagatcgcgcagaatgcatagtccaaagcacacagtgtcattgagatcatctgtcatgtgagctatgagcaatcttagagtacacaaaccaggagtttgaccagttttagcaactttgccaaattgcacataggaacaatgtattaatttttagttctgaaatattatagaagcgttatatgaatggatattcatttcttgcctggaggcaagcaagcaggttatttgaaaagtaactgggacacttaagggaagaaaagaatgtccgatgcgtaactgagttgtgtggagactgttttataatgtgctcagttgtgtctgactctgctacctcgccagacacctctgtccatgggatttttcaggcaagaatgctggagtgggtggccatttcctgctccaggggatcttcctggatgagagatcaaacgtgtgtctcctgtattggcaggcggattctttaccactgagccacctgggaaagcccctgttttatagggatgagcccatatcttagaaaaatgattaaaaagagactagagagcctgatggagtgattgttatctaaactcagtaattaaaggttgaattctaaggggacttactctgtatccttaggcaagtaatattcagtattgtaccataatccatttgagaaaaatatattgtctagctgatcgaatatttccaggatatatctactatcctgttcagtgctcaggatagctttgttgatgccaattttactctaagtagctgtgcagtatgaatgagagaatggagatctcctataatgagtattgttaaatgtttagatggaaagttctatttggagattaagggactttgttgtatctctgaatttatattgcctctagtgttttttaattacaacttttaacacacccagtgttctggcagatgaaatagaaaatctaaattcataaatgtactctcatttctaatctattctactttctgggtacaacacaaataggaaactgaatagtgtggtttaattgcccaagctttagggaacgaagatgatattacaatactgaataccaacaatccttgcatactgagcataaaatctaggcaaaatgtgtattttgtccaggcctgtccagatttcacaatttgggaagcaaatgaatgtgattacatgagagcctgatgtgctgtcaaatttatatgtatatatatggtgtgaaacagttctcaatttaagaataaattgttaaaacaagaagatatgtctaatgcaggatttttctgttatgcgttttctcttggtaattccttgagtaccattgttagcag

SEQ ID NO: 43568 - DNA, 2638 bp, Bovine  19866881100663
tttcttttttttaaattttatttttattttgtgtattttttcttttttttgaccgtgctgggtctttgttgctgcgtgcgggctttctctagctgtgatgaacgggagctactctttattgtggtgcgcaggcttttcatttcggtggcttctcttgttgcagaactcaggctcttgagtgtgggctttggaagatatggcgcacaggcttagtcatcccaccacgtgtgaaatcttcccagaccagggatcgaatccatgtcctctgcactggcaggtggattcttaaccactggacccccatggaagtctctgattctcccttttaatgtggccttggtttttatctttatttcatccatatagtgtacaccgtaattctggccttattcctcactctctaggtgctcccattcacatcctgacttcccattttgctgcctgttgctcccagattcaccgcccacatggttctgcctgttcctgaaccttgcctttcccagcccgcccctgggcattttgccctccccttcctcttctgatgcacatctctacttctctgtccctaggcagtgtctacctatagccttctagggtcagcccacatcctcctctgtgactatgtcccaaactgtttcgtccgtccctttgtcactccgattgcactgatgtgtgtgcatctgttcctctggcacttaaccacatgcttcctctgtcccctctagcctttctcccatctactcaggaagtctttaaatgtctgtcttattatggtgaccccactacatacaaggcactctgctgagagctgagggacagccaagaggaatatcgggtttgcccatcaatagatgcttgagggaagacaccccagaaataaatatccattggcctgactcatggctggaagttctttcaccaacagcagaggaagccaaggcaggcatgcctctgcttttgactttcctcatctcttgtctgcagaagcagatgcctgaggaatgctttagtgttagcctgggttcacagtctaactcctagcgaggttgtgcccatcagtcccagaatccaccagctatgtgaattcagcatctcccactgggcatcatgtggatgctgttgggttgggcactttctctgaatgagagcagcctcagctcaacccaagtggagcccagaccatcacagggagtacagtccttggcagggtcagaatggaaagctggcttcagagggagaggccccttctgccacttctgcatgtcctaaagctcaccgcacccagcttctttgttgtcgtttttcttaggaataaatgagtgtgataattcatttaataaatatttgctgagcacaccattctctgatgtcctagttcctccctggcacaaagataaatatgactgtctctgctctaagtcaacatctaagaaagaaggcatatgcaaattactcagagaaagatggcaaatatgggtactcctcagtatcgtgtccttgacaaacattgctaatcaagcatagaactcaccttgaatctgaattcagttcagaatccttctcaatacattattctaggcagccgccgttattgaattgggtattgggcaagagtcaactggcttgtgagcattcttatctttgttgttcagtaactaagtgtccaactctttgtgaccccatggactgcagcacaccaggctttcctgtcctttactatctcccggagtttgctcaaactcatgtccgttgagtcagtgatgccatccaactgtctcatcctttgttggcccctcctgctctcagtctttcccagcatctttcccagggtttttttcaatgagacagctcttctcatcagatggccaaagtatggaagcttcagcatcagtccttccagtgaatattcaggacttccaatgaatattcagtgaatattaaaggactgatttcctttaagattgattggttggatctccttgctgtccaagggactctcaagagtcttctctagcaccacaattcgaaagaattctaatctttaaggcagtctaaaggccaccgagatagagggaggggactcattgtattgagttactgtgtctgtctgtttagtggaagtgctcaaaagtaacactgcttttggggaaaacccctaagatcactcctcatgacatcttcatgcttcccctgctctctcatgctcctttctgcctgtgttttaaaggattcttcttcctctctttccccacagaagtagttgtgagattcagctctcatcctttttaaggtctttgtttttgcctgttctcccacttggagagttaattgaagtggtcaattccccaatctttatcttcaggtacatgttttttttttccaaagtcttcttcctttggcatcggagcaccaggataacctaagcctgcattatcttccctactccctccccagccccaacttcttgcctccagagcctctgctgggagcgtctgggtccactcatgtggagtcagctatggggtgtcctgcccccatgcctctcttctctgctttgtcacatcctagccagcatctgcagagagggcaatggcaccccactccagtactcttgcctggaaaatcccaggacggagga

SEQ ID NO: 43569 - DNA, 2088 bp, Bovine  19866881155003
atttgcaagataggtagaaggagtcatgagtcaagccctggcatgaatctgtgcagtagctagtgggaacagggatcgctgaggtggtagagatgtgcttgaagaaaacttaaaggattccaggttttatgaaatgcattttcatcgatagcaactacatagcaagagacaatattagaactaacatatcactttcagaggattctcaactaatggatctgacctgaaaagcatggacaagagtgactgggctaagcagataaaaggctgatgtggagtaagacaacagcagactgaacagagccgagcactctcagatagtcagttctctaggctggttttgagctgtgctttgtccatggcagaggcacagttttggttcccactggctatgcccccaatctttcttctcattgacttggcaaggctggttcctgttctgtaaacctcagctctaacagctcttggactgttccagagtaacaggtaaaaggaaactggcaaacactctcccagttgagcccctcagctaatttctcaacagctgggaaaaaccacttcctggcttagctggttcccctataaactggattcctggggcctttcccagctcttctttgagcaacctgctatagaagcaaaaggagggagagattcaaatgatctttctagaaatcaaccttcatatttctgactgctttgttatatcatagtgatggctccttgggtctagtgacttgtatgctaaaagtaattgcagtctttggggaccgtccctgaatttctctctcccaacaggaaggaaagaccacctctccttccaaggcatggaggttctctcctcctgttcctctattgcagcagtggtgagatcagactttacaagatcagactacacactagagctcaggtgtgctgaaccagaagggaacttccttgattttagtaactgatctctttccactctgaagcccctgtaagagttgggagaaaaacacaaaaacagatgtgccagtgaaagagatctcagtcccttccagttcaaaatcatccctggtgggtaaatattctgatgttctatttcctttcaggtctgtttttctcttttcgagaagttgttctttgctctttcccaagaggacgtgtgagatggagggaagagaagccatatccatcctcaggggagaggggaggagccctttgtctgtgtgtggtcccctgagcctctggtctcacaaccttaagctccaaagccaagcctggtgtatctggggaatgttctcttagccctcaggatgcaagctcagccatctcccctctgctgtccccaaccctcctgggatgtcactggatctgctggtgctatgactgggtcgcatccaccatcaggcccccagacctggccagatccgtctgtggccactgttacaggagctcctcacttgtgtcttggtgagcttttgtgggcaggcttctcagttcttaattctcagctcccttcaccattcctctcactggccctggagaatgttccaggtttttatgtgctctggtggaagaggaaagagttgagagtttcaacctgaacatggtagatattgccccaaataatctatttcccctctctcagtgggtgaggattccagggagtggaatattgtatccatgagaacaggggtggggctccctctttctggcacactgcccaccctccctgtgaaggatgctggcctctgtgacatttctcagtagctgacggtagcaaagaggtcctgtggcaaacaccagcctccctcctgcctttgagggcatatgagggcttgaagctgccaacagctgtgaggtactgagggttatgccactgtgttgcctgaaatggaatctcattcacagttcagttcatggtccaagaaacaaaaataatatttaatgaggaaaatcttctttgtttaattatggtaaatgtcaaggtcaaatccgagcgctttgcttaaggtcaaatgctcagggctatcaaaaagcattttaagccagagcgggatgggttattaaagcccagactagttaaaatgaggcaccatcctctct

SEQ ID NO: 43570 - DNA, 837 bp, Bovine  19866881258409
catggaattttccaggcaagaatactggagtgggttgccatgccctcctcggaggatcttcccgacccagggattgaaccccccccatctcttacgtctccctgcgttggcagttgggttctttaccactagtgcctcgtggtgggctgccgtctatgtggttgcacagagtcagacatgactgaagtgacttagcaagcagcagcagctccacacttaatggctcctttgagtacactggacccgcctggataatctgggatactctccctgttttgaaatcagctgattagcgatcttctatctgcaactttaacttccctttaccatgaaatgtaacatatttacaagttccaggaattaggacacgaacatttttgtgcgcagtggggcagagagggcattattctgtctaccacagataatgatgtcagaaagagcagcatcacactcatcagcaacaatcaacactcagctctttgcctgcatctctcctaacagtttcaaagtaccctaaaaggagggataagaagaagccatatttttatgacatgttgatcatgtaggacagaaaggaaactttgtggaaaacaaaatacattttatctcctgcttcactttaatactcctgtgaaggtcaagttgacaagccatcgcgcttccctctcaatcatgttgccaataacaacactgaaatggtgcttggggccttcaggctggaccgtgtcaacaaaacaggcctccctgagtaagaggccatctgtctcagtctgtcagatgctacaggatttctggggcaagacaaaaagaggacggacttcccgtgtttctaccagt

SEQ ID NO: 43571 - DNA, 1102 bp, Bovine  19866881296612
tcctgcttttatgagatgatcagacaataacgcctgtctggtgatatcattcctctaacctgcttctcatgggctgaacaagcaggtcacttgtccctggaaagctctcctcccccacatcccagctgccagcacccattttaagctcttcagcaagagccctgatatattatgacttccccaccaccctgcctccccccacagctctagagaacagaaaggaatgcactaaactgtgtcttaaaacattcagaagagaaacaggatgacgatggaatccctaagaagcagacagcctgcttgccggcagatgtgccttgtgaggggagataagggaacccttagccttctttcataaaaatccagtgggtcagcagaatccttcttcctagcaacagcagcactgcctaccaggcgagtgacagaggagaggcagagacccttccttcaggaaattcacccagaccactccccaccccgctttctttgagaatattctcaaagataattggggtgtatatggagccagcctctaagtgagtggtggaaaaaaaaaccgtccctaatggcttaaaaaaaaaaaaaactaccctcccccccaaataagcagttgggagactctcctctgacagctgcagggctgtcagagtgaaaatggactaccctggccccaaagccactgcctttcttttttcacactccctggtcccttcctgcacctcaacaagccttgtacacagacgctcaggctagtacacccaagttctgggaatatctctttcagtcaccctgggccacacctggaacgtaagaatgcacatatcaggggtggggtctaatggtttgattcatcttttggaagatgggctcagaaaaagcctctgcaggccctgagagcagggtcaggacatttcattagataattcttggattctggatacttgggagagtggtctagaatggggcagggggtggtggtggtggtgtagtcgctaagtcgtgtccgactcttgcgaccccatggactgtggcctgccaggctcctttgtccatgagattctccaggcgagaatacggacggggtgccatttacttctcctct

SEQ ID NO: 43572 - DNA, 801 bp, Bovine  19866880361521
gcaggaatgtagggtagtgtttgccaagggctgggaggatatggatgataactgagggcaatagggttgctttgggggtaataaaaatgttctaaaatgaactgttatgacagatgcacaccaaattgtacactttactgagtgaaatgtattgtatgtgaattaaaatacaatacatctggtttaaaaaaaaagtcagtgcagagaattatacccaccatggagaggtaggtgggaagccacaaatctgcccaacaagtaaaaaaaactcatacttacagcgctaattctttgggggaacaaagtagcatatacacaaataactgtggcaacccatcacttaaaagttaaacagcccttctctaaatgtaaaacttcatattcatgccatctggtttgcttcccaaatgattatactaagatcagttaataattttacatacgttatacaaagagatgagaaaaagagggagggaggacagagagaggccagggggcaggcaaaaaaggacgactaacatttcataataaccactgtatgtttcccttttaaaatcatttgcttgcccatttagaaaactggggtctgggttactggaagaaacactcttaaccaccagaaggttgcccgcacctccaacaacaccgacacccacactgctcctcctggtgttcatgggagccacgtggaaccactcgttggacttgatgttgtatgcttccacggaggacagccctgtaatgaacaaagcacaatgtgcttcatctcctcctcaggttccttatatatacattagggaa

SEQ ID NO: 43573 - DNA, 791 bp, Bovine  19866880363983
cctggtcttgaagacctaggtttcttaaaattgctgtcgttgttgttttagcttttccttctctagaaaccctgaactgtattaaattgtggttgccttctttaggcttcccctccagattcagataaacaaccagctttttaatctagtataagtatttacttaactagactaaagtccctgaaaactggactccaaaatatgatacaggcagacattcaaaaatgtctgtggtacaaaagaatgaattcaagtatcacatagagttctttttctaccttagtatttatggtcatcaccaaaaggtaagctctgatggaaggatgacattaaaccgcatgccccacatcatgcttggcatttactgcctatgatcattgtgagtttctgcctttacagggcaaatctattaggaactcagatcagtagaagaacaacggaaatacacagtgatatcagtaaaactctgaatacaattcaatacaaatttcataatcttaaattagatacctgcatttcttctgcacatgttcatatctgcaacctgtctccatgtgttggtggcaggatcatacacttcaacactttttcgtactaaagggccatcatgaccccctacagcatacaataagttgtttaacacaccaacacctataaaacacacaaaaccaacctatagtagtagagtaaaagggtcgggaaatttgtaacatttttagggtttattcaaatgacttgtaaataaaatttctgaaattattcatattaaaaatcaagattaaagcattcaa

SEQ ID NO: 43574 - DNA, 1395 bp, Bovine  19866880569746
ttcaaaaacatcaatttttcgacactcagctttcttcacagtccaactctcacatccatacatgaccactggaaaaacttatatggagactcttaaataagataagatcttagttagtggttgtttcaccaagacagctaaatcctccttggaagataaatcagagaaagggaacatagagactttaatttgactgattgcttataaaatcaaacagaaattcttttattttttgatgttgctttgaatttttatcatatattggattattattggatcaaatttagagggaagccatacaaagaacattgcatgcatgcatgccaggtcatttcagttgtgtctgactctttgcaaccatatgaactgtagttttccaggctcctctgtccatggggattctccagaaaagaatactgaagtgggttgccatgccctcctccagtagaccttcccaacccagggaccaaacccacgtctctcatgtctcctgcattggcaagtgggttctttaccacctgggaagcccacaaagaacattaattgttatataatattagtaatataattaattaaaattaatacattaacgatatattaataatacataatactatataatatattttatgtgtgcaatatatatattaatatgttagttatattgttaagggggttattacaaaattttgctatttaagaaaacatgaagggattcaaggttaggtcatctggaaagtatttatttgaatagatacatattagacaattatgactaaattcttaaaattagaaagataaaaaagatgcatcaaagataagagggagtagaaagtaattggagaagtcacttatgatatttactcttagatgggatcctaattgccaagtgtgatgagtttgggtgtacaattactctaacacccaacatcccaatctatgttcagtcttccaagtttttagcttgagttgctcagatgatccctgaaccctctaggatacttgagttaggcaagagaatcaaacttcaatccaatgctagtggaatttcctggctatgagttcaagagctggtgagaaatgttccagtaaaagaatcattagtacttgtgaaagaaccctgggccaaagaggcacaaagagtcccatacaggataaacccaaggagaaacacaccgagacacatactaatcaaactaacaaagactaaacacaaagaaagaattttaaaagcagcaagggagaagcaacaagtaatatacaaggaaaacaacgtatgtttaagagctgatctttcagtagaaactctgcaggccagaagggaatggcaggctataaagtactgaaagggaaaaatcaacagccaagattactgtactttgcaagtatctcatt

SEQ ID NO: 43575 - DNA, 2423 bp, Bovine  19866880635270
aatgctagaaaaggcaaagccagagtgacatagatcagtggctgacagggactaaggttggagagaggggatcaattgctaaggaagactttggattttgatgattcataaatatacatcaagattctaactattgacaagatgaggtctatgtaattaatgacctgtttaggtcaaaaattcccttcttgttgttcagtcccttactcatttttaaaaccttttgggaacattttctaaataggaatttctttgtacagaagtgaagaatgacttgaaaaggacctcaggaataatctagtcttagttcttagctttattgataagagcctgggtggaaaaaaaaaaaaaaacaaacatatatttttaaatccatctggtggcttagatggagaaggcactggtggcccactccagtactcttgcctggcaaatcccatggatggaggagcctggtgggctgcagtccatgacgtcgctaggagttggacacaactgagggacttcactttcattttccctttcatgcattggagaaggaaatggcaagccactccagtgtttttgtctggagaatcccagggaagggggagcctggtggtctgccgtctatggggtcacacagagtgggacatgactgaagtgacttagcagcagcagcttattgataagagaaagagaacattttaatgagtatgcagtttgcatacagtcccattaagactttttgatcatggctgatgtaaagaaactaaaatcaatgatgtggattcattttgatatatggcaaaaccaatacaatattgtaaagttaaaaaaaataaaataaaaataaacaggaacccccccaaaaaaataaataaaaataaaattaaatcaatgatgttaaatcccacaaagaaaacaaaatgttgggatggtcaaatctctgtaatcacagacaatcattcatgacaatgccaatagcccatctgcaaaagtgatatattagtcctggatcattgatctagaactttgcaaagataattctaattgtatttttatccaagagaacaaaaagtttctctcaactacttcttaaaggaaatttatacattctttcctataggaatcaggattgggataattgtatccaggattttcaacacatctcacatatgtattaaaaaaaaattattatggactaaaaaggcaaaacattttacatctgtaagacaacgtggttgaaaagtgtatgtgttaaataagatgttaaagtcatgaagagcatgcatttgttgaccataaacacaaaccatcaaatctcaaaatactaaatatgagcaaaaaaggaagtagttccggaacaactttacttaacatatggagctcatttcccccaataaattgtgtgaggcaaaattggaataatccaagaagcgatggactagagctcttttgtttatgggttattaggaaaagagggtagtaacgacagtctacacagaccatcagagcaggaaacagccaaccttttccaaacatgtgttcttatgtcattgacagttcccaaacagattctgcacaatgtcatttattgcattttacctgcattggtacagtgcctggtatacagcaaatccttaatgtatattcactcagtgacaccaaataaaatctgtatatcccagcatccttcaaaccatcatttatcttcaatctgctatgtcattgctcttcagttcagttcaggtcagtcactcagttgtgagtcaattcttcacatcaggtggctgaagtattggagcttcagcttcagcatcagttcttccaatttatttaaagttgcccattatttatatctgtcattttaatacaaaaacactacttagcaaagaatctcattataccgcatcttctccttcatcctacaattgtttgatgaaattttgttactttttcaaaagatctatgagaactacaggggcagccacttcctgaataagattatccttcctgggacagtgaaagttgctcagttgtgttcaattctttgcgaccccatggactacagtccatggaattctccaggccagaatactggagtgggtagtctttcgcttctccaagggatctccccaaaccagggattgaactcaggtcttctgcattcctggcggattctttaccagctgagccacaagggaagcccaagaatgctggagtggatagcctattccttctccaagggataggaattaaaccagggtctcctgcattgcaggtgggattctttaccaactgagatatcagggaatctgccggcaatgcaggagaccccggttcgattcctgggttgggaacatccactggagaagggaaaggctacccactccagtattattggtgggagaattccaggactgtaagtccatggacgcaga

SEQ ID NO: 43576 - DNA, 2016 bp, Bovine  19866880682866
tgctaaactgtgtgactaaaaaactatctgctggtgtattctgaacccaagttagatgcagaaagatgatagactattacagggtttcctgaaataaccctaaacactctggaactattcagatcataggaaagcaaacggctcttctcaattctaaatccaatgtttaacttttaaatatacatgaaataattatgtactgagctatatttttaataaagttatgaataaattatgagtagagtcttcaggacatgtactataatattttattttgtttatagttttctcattaagtactttcatgattttcactcattgaaactattctaactttacctcccactccatctcacccattttccgttactctttgtatttcttcagagactaagacctatagaaaaaaaatttttttttgcaatgaagaaaaaaggttagtaaaataagggacaaaatcatataaggacaagtagacaactaaacaaattcacatgggcccccaaaagactagatatttctgatcttatataattcttaatattagtttgtattagtactttaccttttccttcccttagggattctttaatgttaatttaaataattgttctacaagcattcaaaagttaaaaaaaaaaaaattgaaatgtttttatgagttacctggcttcagttaaaaggtaatgaagaaataatgtcctaaatattagctaattacttttaacttcatgtgatcacaaataaaccatatctagagtcccaaaatatcaacataaaattttatattgaaccttgtcattacttttgttatcattgattttattcatgattcttttaaagctatttaagattgtatatttggatggtttgagatatcttgtcaaaacattcttatgggaacatatcttagtgaacaaaataaacagttgtctgtttatttcaagtttaatgatatgaatcatcatgtgtatcaaaagtttctatctaaaaagattttctaactgcttaacagctcagaaaaaagaaaaataattatatcccaagcccaacaagagaaaagaatgtcttttctgggaacagaattaataactaaaaacaaacagaaaaaatgcacatgaaactgcacgaaatcaaaaacaaccaaaaacttgcacaggtctatttacacggatagatatgtatacttcaatagcttcttccaaaaagttacagtaattcacacacccatcagcaatatatgacagtatttgtttacccataccattgccagcaatggagcttgttgtctatttttaattttaataataattttgatttaattttaatttcttttattacagaagttgaacctcttttatatatttcatacatttgtactggccatctgccttccatcttaaatactgtataattgcaggctttgcctatttttttcatcatatttctatttttcttattgttttatagaagctcattgcacattaagtacaaattgcttgtttatcatgcagtcttgcaaatattttctcagtttagacttatttttttactttttgtcatatatttcccacacagaaattactaattttgttagtcaaaaaattttcaactctttttaagtggcatctggatttttcctctcttttaaggaaaattaaacaaatgtaattctaaagtttcttctatttatcattttaatctttgtatttagatctttattctacctcaaatttatacatacacacacacacacacacacacacatatatgatgcgaaatagcttttaactttatcttattccagatggagaccataattggaagcctataatattttccctctgaatttaaattagacatttatcacaaattagatttccatatataacttaaatctatttctggatgtttttcttttctactagtttctggatttcatatcatgttttttgatcagataatcttaaaagtatattttaacagctggtaatacaatataattttcattttcta

SEQ ID NO: 43577 - DNA, 1466 bp, Bovine  19866880708834
ctgaagagaagaaagagggacctgggaagtgactgcgaatatatgaggagaaccaggaagaggtactcagcacaagtcaaagaaaaggaatttcaagtcacagtaaaagatcatgatgaactcataaagcaaaaaatttaaataaggtcaggtaagataaaaaatgaaaactgctcactgaaatttttagttaagagctagggtgactcagaaattgtcatccaaacctggacagttttgagagtgaaagagagctccagtagcaaatacctcaggatcatggaatattgtcctgtgcaaaccaggacataaggacaccctgttaaggggtcaccagtccccttcatccaacagtttcaatagagagaagcagtgcaagccacactgttaggcgttcagaaggaaagtgcgatgaagactagtctttcaagaacttcggtttgattgatgggtaacaaaaaggttagtgttgcagcagaacacttcctccacttccaactattcatgctctaacctattaagcatcctcggcagtcattattttaaaaaataccgtgtgagaggatgttttattgaataggtacatttttagatatataaaaattaatgtgaccatgtgaaggtgtgtatttagggaattaaatatatgtaacatatgttatttatgtagtatatgtaaagctcaaaaataaagctttttaatttctagtctcatagccaagaattatgaattactaattggctataataggcagtgatttgaagtagaatttcttagtcacttatttcttaaaacaactaatgcaggcaaaacctgtttctaacacctcagtgtgtcatcccatattcattatccaacagaactgtaccttttgaaacagctaatgccagatggtctcctcaataaaaaacagcaggaggcaacatattaatgctactcagcaagcaagtctgcagacactcaaccaatgaaactagtcttcagttgctaagccatcctgtcaccatggcaacatctagttcagaaaaaatattggattttcaggttaaaagggccacccatcttaaaatttaagtatcctccaagcttatgatgatcatacttcagctaaaagaactgcctagattttctcactcatctcaaatcagacctacccatttgccctttcacttaaaaatatttatttacactcagtttctaactttattgacttcctagataaacacattccatttaaaggtgtttttgtgtatataaatttatgtgcacatacttgcaagctaatagttgtaaatataatgacaaatgttactgccttagaaaattttcacttgtacatactcttatcagtctgttattatatctgattaaagagaataagcaaagaaataaataatgtggtaagaccagaatgacattcttattattacttgagatacctaatatgaacattcaaagtaacaat

SEQ ID NO: 43578 - DNA, 824 bp, Bovine  19866880893395
agctgactcatttgaaaggaccctgatgctgggaaagattgagggcaggaggagaaggggatgacagagtatgggatggttggatggcatcactgactcaacggacttgagtttggttaaactccaggagttggtgatgaacagggaggcctggtgtgctgtagttcatggggtcacaacgagtcggacacaactgaactgaactgatatatgtgtgagtgtgtgtctctgtgtgtgtatatatatatatgtttcttatatgctctgtaagatttgaacaggctctttcttcctccattagcacattcagtacattcaagtttttgattaactatcggcagcagagaccagacacacccttccttaccttggattgattgatatcaggctttgaaacatccctgatagcttgaattatttatttctggaagggtttaagcaaagactaggaaatatcaccaatgtcaagatcttctcttcccccagagggcttgtctttcccattccaatacagtaaagaaaattcctatttcactcaacatcacccttttggagcctttgaagcaaggcagatagaggtgggaaggagcttataaactctgggaattccttctcatgaagaaaaaaaataaagagttgtatcaagatttaaatactattgtctcaacaaacacacacaaccaagcaaaattaagctcacaaaaattcaaattgatgccctagagagaaatagctcaaactaacaggtgctcagtcattttagtgatcttatagagtattggaatttaacagcagtttattgtcttcaccagtaataacaaaaa

SEQ ID NO: 43579 - DNA, 891 bp, Bovine  19866880964831
actgccaatttgctgtagctttgggacccaggcagggagagctgagctgccagctgccagtgcatccaggattttaactgatgctaatttcaagcatcagtgaacaggaagattgtgaacatcagaagtttggctgatgaatcaaatagtaccctgccagataaacactccattgcatcttagtaccacagataattttctcctcttctctcaccaaagcaaacatactcttttggaaatttcatttttactctaatcctgagggagcaagattcaaagtcactacttcctcagtataaattagttttttaaaattagatttacatttccagaaatcttgagtgtttctagattctctatttcttttttcacatcttttgtttcaatctgtaatttctctctccatattttttcatcccattacatcatctaaaaagaaggctttctctttcaaattcaggatgtgaggaaggtcttgaagagatgaatttgatgaatatctgttcattttatgttgctcaagagccactgaaatttttttcttttgtgttttggttcctgattaaacttccctaaaactcaagtaataacatgcccatttataatgtttactttaaagcatatttaaatattgcagtaacttgcattttatttagcacaatctacttttaaagttctaactgtaagaagctatatatgttcataattacagtttatttgaatgtgtagtattttgggaacagtgaagtaccatattttggggaggtggaatgaaaacaatttatgtatttttaaatgaactaaagtttttttaatgttcactgtctagagtaattttaaaattcattatttctattttatatcataatctgtgaattaaaacatcttgta

SEQ ID NO: 43580 - DNA, 1356 bp, Bovine  19866881316092
ctcaaaaagtcactaagattcacttcaaaatgcaaatattatcatccgcaaatgatcaactattggtgcagtcatgtgacgtggtactttttaagctcaattttatttctgggtacatttttctgattcactttacccatacacacacacacacacacacatatatatatatatatatatatatatatatatatatatgtatgtatatatggccacccaggttatttttgccaacatttctttggataaacagtacaaaccaatttggatttttatcaaactactgtaacgatggagccaggcagccttcaaaggaacacttttcagctttttaacacacacacaatttattcagaaaaaatattcttaccttcctgactgcattattgttgttatttttcttacataaaagctattcttagaagcctaacaaattttgtttttcaaataagaacatctggctttaggttgtatacaactacacttattatttaaattcacccttctttaaggcaggtcatcctattccttacaagactctttaaaatttataactttgcttttatttataataaaaaaaactttctttagaacaaaatatatattaccgaaaaaggcagaactattttcaaaatatgttcatctgaccaatttgatacataaagcctcttcaaggaataattcctcaagttattttaggagaaccaatgaaagagtaaaagcttaaaatgcaaattacacacttttaaaaattctaaatccttaatgattttattttgctattctattctaggaaaagtaaacaaatctttcaagaaataataaagctaagactttttttcccagtaagctataagcaagttcagaaaatgtttcaaactgaacattcttcttacccatattagaaacagtattctccaagtgctattaataattcaacttagaatcataaatatgcatgaatggaagatcacttgccctatcccaatgctcagaaagaccttggactacacttttcagaaaaataaatgtctagtatctctaggcatatctatgccagatgctttaaggaagatgaagacttcagtggcagcttcctggactctgggctgcactggttgctgctcctctgtgttcccacagcagtatcctataatatgcattatgtgccataattatctgttaacaagtcagtttcccacagaaaagtttccaagccattttagtcatccctgctttttcatttgagaaaacaatctcagaaaggttaagtaactggcttaaagtctcaaaagtagtaagttataaagccaggattcaattaagagacatcgattacaaagtcccacagactct

SEQ ID NO: 43581 - DNA, 878 bp, Bovine  19866881498036
tgtgaattactgaagatccttttgtcaaaatgagagcatcacaagtctttcttacagctctatttcagaaagactggaagacatcatttcattttaacacataagaggaaatgatcatgagccaagaaagatttaaatatcctcagaaacaagacttttgcttgccaacttttaaggaatcagaatttgcttgtcatgatgaaccaagatgttgagcagaaaacagattctcaagtaaaagacagggaccaagcagagtgacatctgcaagtcagatgtttttattaagaagtttgggttctttaaaattttagcacttttaaattaaaaaattatttgatacatgcttctctagtcaaaatcagatcacatcaaaggggagatggcagcagcttcttggaaacttagctgttcacaccactgggtgcccttgttcttgcacattgcttggaggtttataaaacactttatcatgcattatcttagggggttctcacaacaaagtccttttgatcttattttataagtgggaaactgctcaagtgagtcacttcaacaaggtcatgagtgaatgccatagctgggaggctggtctatgactgctaactccagtgttgcctgcaatgatctctcagacagagataatgtagttgatcttcacttgaacgatatctgtgtattaacacaaaagaaggaaaactgatagtttgggatggagctgaagaactgagacaaaaataatataaataagcctgggggagtttgtaaggaggagtgaatttagcagtgctgattttgctggaggctttttatttgttatgattaggcattccaaatgccgctgcgtaaccttgaaaagggaaacaccatgatgaaaa

SEQ ID NO: 43582 - DNA, 950 bp, Bovine  19866881499679
tactgcccccctgtggagtaaggcaattctcttttattttttaattggactgaccaagttctagaaataagagtatgtccaaactaatcagtgaaatagtgctgaaactggaagtagaaatcaagacatcaggaacctagaacttctcaaagttgtaatagaatgtaaagtttgactcaatctatatagtgtcaaggatgcttaacacaagattttcttagaggatgcctgttggcatcattacatgaaaaaaattcccaaataagtatgtgtgaaccacaaagcatacatttattgtttccaatagtatggagatcttacctaatagctgttagtgttcagaaatgcttcaggtcagggaagggaaaaccaaatctacttctaaatctattctatttcctctggaacataataccctcttgaaatatatttgatacttctattaccaaatactgtttctggcaatgttgtgctatgtatttggcctcacccaatactatttcctgatactgttttattgttctctgatacatttgtcctctgactgcaaatgtaagtttccttcatgagaggcagtgatgcttttcctgaccttgtttttagatattttaccacagaaatatgtaccaattcaagagatttaatttgaacagtgaatgtcacttttgagaataaatgtgataatttggtgatagactgttttaaagggatacgtagatgctgggtgaactctctgaagctatgctgttgaatatagagttggacttggtacaaaccactctgtactaaatccctcccaatatctcttctaccctgtgcgctttttcatacttttctttagactaagggtgtttttaaaaatttattctttaattgggataaaattgctttacaatgttgtgttgattactgctatacaacaatgcaattggccataattatacctatat

SEQ ID NO: 43583 - DNA, 1247 bp, Bovine  19866881619638
atggaaagaaaaatttctgggccgacaggtcaaatatagagggcattttcatgctgcctgcaatgcaagagacccgagttcgatccctgggtcaaaaagatcccccagagaaggaagtggcaacccactccaggattcttgcctggagaattccatggacaggggagcacggtgggctacagtccatggggtaacaaagagtcagacacgactgcatgactgacagtctcactaatgctgttaagtgcgttttgttcttactaactgtgtgtatagttgccaattttaagtgcttttttgaagatctaatctttccagatgttataaaatacctgatacatattaaaagtagaagtaatgatacatcacattttgtaagtatatttttgttaaaattcgtatgaaatgtttttttgagaggaataaccaaaaacgtctttaagcagtacacaggggagggcagaggagaaggaactagagagccctgtgccagtgtatttttaccaatgtgagaacttaccgctgtctctcgtgttcctgttttttattgtgtgtacaatggacaaatgagtcctaattgacaacatctagtggtgggctgccgtctatggggtctcacagagtcggacacgactgaagcgacttgcagcagcagcagcagcagcagtcttactagtggtattgatgtaaactccaatctgatgaaaataatttttcccccatgtttgtatgctgtttgacagacggactcgagatgaaatctctgaggccacctggctgagactcagccctgttccctcccgctcctctccgctccctgtcttcccaagtaagctgtggagccgcttgggggccacgtgaccaagacagagtcacatcctctgggctgggctgcaggccccgccgcctcctgcccttggtcctggtgtggctgaggtccaggctctccaagcccatcctgcatcccctggtgcccaggacacctgcccttcctcccacatcgctcttgggccgcccacgttgctgcaggggtggcagaggctgcgcattgcagaccgggttcccagaaacagacttggagatgaggattaatgtgcaggatgtttatgccagggtgggagggtgctcttgggatcaacacctggggaaaggaagggaaggaagcaggattgggcagagagagaagctgggctgtgatgcatctcaacaaaggccttagatgacgtcatggggtggtgggtggagga

SEQ ID NO: 43584 - DNA, 3474 bp, Bovine  19866880496089
caggctcaattcagggggaaaccagtgtcaagcagagctcctcaacctcctctgcatttaagttcgttcttagaaggtgcataggtgaaatttctaagataaaacacaagcccgtttttgttggcattcctccttcgtgaattatgacaagggaattactgcaggctgtactggaatatttcatgtgtggatcattgtaaataaatcctggggcacttttttcccataataaagagggatgtggaactctcttttttattaaatagatttccttgaaaacctccaatgtaagagttacatttacaatgtccaagaggaatgctaagcttgagaatttccaggaaggtgtgaaacttcgaaagtagaggggagagaaggaattggctgccatcacggtcacccagcccggccaggtcagggacaaatctgggtgaaggaggaagtgaggggacaaaagagaggcacaatgcgtaccttgtagagtcatctgaaagaaagtacagctgaatggcccaagcaggaaacataagcctcagccctcaggaaaggaaaaaggttcacaggaaattctaagctatatttctctccaggtaggtctggagggagcatctggccccttgcgtatgtgaagcaatgagaaatagctcccccatctccagagtgcagaggaacttgctaaacacttttcatttttcactgtgatgcctccacagccacgtcagacactgagtcaaagtgtagcagagggggctgccaaacacttctggggcaaaggtttcttgctgtagctctgccaggccccagactattacctgtctgctgccttctttgctgagtcttaatcacttccagctgtgttggctcctgcagcccctcgggcccctccccgtctggcctccctgccctctgcctcttgtggaggaaaaattaagtatcgcacttaaattcccccttaggacctagggatcctgagcaggagcctcgccacagcatccatctccagcagcagacagtgggggctggctcgcctcccatagggtctccttgctgccctggggctgagcccttcccctaatcagttacagctaagcccagaaagaaaaggtacagcgtggctccatggcagagcacccctcgcctcaggctctacccaggtacccaaaccctgtcacttccttcttaagagattggttcttaagggctaaattttaccctctctccggtggctcaaacagtaaagaatctgcctgcaatgcaggaaatctggattcgatccctgggttgggaagatctcctggataaagggaatggcaacccactccggtattcttgcctggagaatcctatggacagaggagcctggcagggctccatggggtcggaaagagtcagacatgactgaacaactaacactaaaccctctccagcctgtcatcttttgaaatacacatttttcaccagggtagctggttatctccatcaagtcagttcaacacaagccttggtggattggagggattggtaatctgtggctagaaggaaactggacagtgcctggcattgtatcacgattaccctattccttacacacgtagacttcactgatcagttgcagagccattttcttgcctgatacactcaggctaaggcttcagcaccttcaacacagcataccagatagacaccaatctggagagactgatagattggggtgaagtctctgcctgtttaagctaaaaccatggggatgtatattgggtcagtaggcagggattacctacatcagtgcttctcaaaattgaccttacatcagaaccaccaggagagctcattaaacacaaatggttggaccccaccccagggtttctggttcagtaggtctggatagaggtccaaaggatgctgctactggcctggggaccacacttagagagtcaccggtctgcaccatatcgaggaaagagaactctattcatcaggcagtgtgggatccttgaaagactttaatctaggtgggagggggttatggagcaagttcacactttccaaagctcagactgtggtagtgtggagggctgccttgaagggagtgcagctgggagcaggaaagctaaacagaggctgttggcatgatccagataaccttcacgatgaggtgtttcacataatcttacagaatgagatcctggcaggagaattgggctgggcagcctccaggagtctgagaaaggtatcaatagaaagttgagaaagctggtttagaagaaagcactaaaaggagacagggagcctcgaatatgtgttggccgtttcccaattttgccaagggctggcgggttcccagaacaggagaatgcgaccctgcagacagggtctgcagaagtggcacttgccaggcagacctgccaagtctgtatgactggctctctcccctccaccctccctcgctttcctgtggggaggtgtaactggggaagggctgcttagagaacaggtggtgataattaccaggagaccagcagtttccctacctcatccttcaaagtgtcaaaaaggttgacttaggaaattacagagtgcaggaagctttcctgatctgttcagttcagtactctttggtggagcctggtcattctggtttagtggttgatgtatacttttggagggacactgaacgatagctgaactctactaagagtgcttttctaaggataggcctaaacttaccagcacacacatagtagaaaagaattcagaattttactatgcactccagatatgtaagtgaaactacatcagaatctgaacaaacagtaacaataatagctgcaaaaggcatcttatcaggcccccgttcatcaattgtcagtggattcacgtggtttttgacggcccttgactcagcaaagaagccacaagcttggtaagactggcttaccacactactctgaacctgctttgtggattttcacctctgactctccccagacagttctccagctgtgagaccccccagccttccctccttgcattaaggtctctctcaagtttaactacatttgtaaatttttgaccatagcaactcatggccatccctctcccttctgaaatcctatggcacttctggctgagtgtgtcctttggtccttagttttgaccttctggtgttagttctcattttagaaagaaagttctagctccccaggtgggtagtagattctttgaaggctggagcttctgggtctcacgtgtctgaaagtgaagcatcacagtcacatgaaacttgaatgggtaatgtggaggacgtgatggttccattcctaatctctgcaagatgaagtctgcagctgggccccacctggaaccaggaacatgaatattgcccgcacactctctctgcttcttcatctttttacagagtgcaggaagctttccttatttgttcagttcagtactctttggtggagctccatt

SEQ ID NO: 43585 - DNA, 1061 bp, Bovine  19866880501800
cttatctgggtcatgaagatcttttttgtatagttcttctgtgtattcttgccacctcttcttaatatcttctgcttctgttagatccataccatttctgtcctttattgtgcccatctttgcatgagtattgtttgccaaatttgggaacttttcagccattattacaatacatttacgtacatttttcagccctaccttctttttcctctctttttgaggctctaaagacatgacgtgttagatcttttgttatagtctgactatcttgtgtataagtaatgttattctgataaatcacagggttggagtttaccatttttcttacagttacagccatatgctgctggaggcatgtgcacaaaaataaaaaaaaataaaaatccccaaaaatccacatcctgtgaacccatttctctcacaatgcagtgccttctgttagggcccccatatttctttctttattaaaggaaaattgcaacttcacaacatttaatgggctctttatcttttaaagaaaattttataaaggagttacagaaaaggaaaaatgaagcttggaataatggaaataatttttagtgaaacagatcaaagtggaaaaagattaaatataatgctttgttaaaggtctggctttgaacataatactttctcaaaaagccttgaagagagaaaatggtgctcaaaattccaaagcagcctcacagcagagtgatttacccttgattaacagttgggaagccctgttatgaaccagtttgagcctcctctactgaagacaggtccttgcagcagaagtttatcagtttacaaaaacagccaaagtccatcacttggtaagcgctggtcccctcatgtgggcttatatctttgccctctagccaaactcaatcctgctttgatggacaactgtgaaaacatcatcatttgttccttgaatacatctgagagtgttcttttcacccccaaaatgaccccaaagccccctgaacatcccgttaccatgtttcacactcaactgatattccttctcaaacatttgtgctctcagatacact

SEQ ID NO: 43586 - DNA, 2628 bp, Bovine  19866880624658
aaacaattttacacttaatattctctgtagagagacatttggtacaattaaattatcattttggaaagtaggaagatggaggataattagaagtttgggagtttggtagagcctggcaggatgtggtacccagcatttttgccttatgcagaaaaataaataaatatgtaatagtggttattatatagctttgaaataaagaagactttaaaaatttgtgtactgatttgaagtaggtgctttgatgtctacctgagttcaaatcctggtctctctacttcttattggctttgtgaccttgagcaagtacttagcttcttattgcttcaatgttctcttctgcaaaataagggcagtaattgtcatagcgttgtgaggatcacattagatcatttgtgtagagtgctttgagcagtagttggcgagcataaagtaaatgttcagttgtaagctgttattattctttgcagtggggaatagactggaaatgatcagcctaagtctgatgcacatggctcacattttcaattcatttgtttgcttttcctcatggtacatttccagctctcagtcatgtgactggggatacaattaattcatccacagctgttctttaatctctggttactttctgactctttggcacataaattatcaacctttaaactacacaattagtcttagcttgaaagaatttgtataaatctccaaggccatgcacaatgaaacaaatcctttgttctgtctgtttatatataaactgtgagatggaactatggaagcctcctctttcctctaaaggcatttcagaaagaaaaaaaaaaaagactatggtaattaatgtttagcaacatagagaaagctggtgcatttctatcacatttcacatccttgaaactcagaaatgtctctcttcaaatctatttcctgcagtcatatgtcctaatatacgaggttatcttcttgtaattgaaacaggagggaaaggggcagggtaaaaactttaaaagaatgacataacctgaagacaccacataaactgattagaaccaaattggtccaaggtggtggacaagtcaacttccacttgagaccttgaggctcagtatatgttcatcttaatatatcagcaagctaaatgacaagcctgaagctccaatactttggctgcctgatgcaaagagctgactcattggaaaacacccctatgctgggaaagattgatagcagaaggagaaggggctgacagaggatgagatggctggatggcttcatcaacacgatggacatgagtttgagcaaactctgggagatggtgatagacagggaagcctggcatgctgcagtccatggggtcacaaagaattggacacgacttggccactgaacaacaacaacagcaaagctgggtgacacgcccagcggcaccatgacagttctgaggtcaaccatcaaagctcagtctctgggcagtggcccagttcccagaagtcctcacttcttccctgaaatagctcccattcattagcctatgaaattacccagtccgtaaaaactaaccatacaatatttcaaggccactctcaccatctttaaaaggcccacattttgtctgtggagtgtctttttctctaagcccatttcttaccaagcactttttctctcaccgaattctttctgtgatgagacattaagaacccgagcttcattaagttctgaaaccatgtgtgtgatctcagttaagaaaaatctgggttttggctaggtcctgtcctgtctgtatgagttcaagtcccaatctgggtttaggctgggttcaagttctagccatgtgggtttaagtcccaatttgaggtgcatggtttcataatggcttgaagggtatctccccaaacttgtgttcaagccctaacactctgaatgaaactaatttggaaatagcatcttaacagatatacttaagttagggatcatgagatgggatcatcctggaagtgggatggatcctaaatccaatggctggtccttatgaaagaaaaaagagaaagtgttagtcatgtctgactctttgtgaccccatggatgaggctcctctgtccatgggattctccaggcaaaaacactggagtgggttgccattcccttgtccaggggatcttccccacccagagatcgaacctggatctcccgcattatgagcagattctttaccatctgagccaccaacgaataagagaccttataaaggggaaagccaatgatgactgaggttgaggctgaagtggtctgtctgcaagtcagggaaggccaaggattgctgctaatgactggaaactaaaagggggcaggtggggtggattccctctcagagcctccagaaaggaccagccaaccctgctaacagcttactttcatacttctggcttctgtaactgttagcaaacacgtttctgttgttttatgccgccatgtttgtggtcatttgctgtggcagccctaggaagctaataatatcctcatgatgattaaggacattctgaacaattgttttaatctcagtaactgacaaaattagagggtagacctagacaatctacttctgccagtaaaaataacagtgcctcctca

SEQ ID NO: 43587 - DNA, 2239 bp, Bovine  19866880666444
ccctgatgctgggaaagatccccctgatgcagggggagaaggggatgacagatgatgagatggttggatggcatcactgactggatggacatgagtttgagtaagctctgggaagtggtgatggacagggaggcctggcatgctgcagtccatggggttgcaaagaatcggacaggactgagcgactgaaatgatcgtgtagtggaggtgtgtgtggacagcttgcctggggagagggaactcccaattccacagaaagtttagtttgggcactgcttgagtaaaaccagcactgtcccagtgagtccactggcaaacaaatcagaaggaaccctgtggtcctttccaggataatcctgattatccttctagtggacagagaatgatggacacttttgcaaatattcagcaacataaactttctaaaccatctcgaagccataatgctaatgtaggtcaggtaagaagtggatgtagtctctgcccacatcttccgtgcaaatgctatgaaaattagaggttttggtgctttggtgggctggggggtacatgggtgtggggacttactgggcgtggagcacttgaactgggcttcaaaggatgggggggctttgaaggatgaagaagaataaaagctggaagaacggaatgagcaaaagcatggaggaagataaggagaacaatctagagtaagttgatgtgtaatgcttgaattgagaatttatttggaggtggaccagaaaggaggttgagatcagatagtggtgggaaccaatcaccaggctaaggcttttcaactttaaatgcagctgaggaatgacagcaccagggtgataactcaggtcttccggctcccagctcctctccagctctcttcaactctcctgcacggcctcgcaatgtctgtcttcaggaagtatgttgtttcacttggaaatgagataatctgggcttcaggtcatgaaatagttgtgtgccttggccaaatcacctttttgggtttcagtttaaacccaaaatgagatggttggagaaaatattttctggctctttaagatggaagaaatctctttggaagactaatataatgacaatgttcagaatggttggggaggagggaaaaccaactgacaccaaaaatccactggttccatgatttatgctatatatattgtctttcatataacaaacactcctaatctctctctctctctctgctctctctctaccatccttttattttctttttaacattttaagaagcaactgtgctttacttaatttaatcttctgttactgtatctctcttactatgaggcagttttatatgtgaaatactttctgtttgaatgagctgccatcaagactaatagctcatcttttaaatcttttatccattataagtttcatctaattcctgatctccatccttaaggtccaattcccacatgtccgcttgtctttgtctataacccaaagcaggtctcaggaagaggagcaaagcagagactaggaggggcaaccaaccaaatgctggaccatgtaaactttctcttgatgtgcccccaaagtctgccaaaccaaagtccttgaggatctcaaaaattcaaaaccagatataaaataaataaatgcaaatggcacatttcttaactatagggtctccccggacttctttaggtccaagttactccccttattttttccttcattgatttcagggggaatgaggccagagtttgaccctttttagtgaaaaggttatatacatggagagagggatgaaagaataatcaggtcctatggggaaggaaaaggaaaagtaaacatctcccttggaaaataaacttcttgctctttcaaaccctgaatgccaccttttcaagaataatgtgttcaaagagtggatatatgtatgtgtataattgattcacggtgctgtatacctgaaaatcacacaacattttaaatcagttatgctccaataaaaagttttaaaaactccaaatacattcaaaataattttttaaaaagaatgaagtgttccaaactgtggtgtcatccctaagaagacctctttgtagaaaattggccaaattaaatgagccatcctaatctgtacaaaactttttcatattttcatcagtcatgtgtatgtttatctagtgttactcactatgggcttcccacatggcacagggtaaagaatcagcctgccaaagcaggagacacaagaaat

SEQ ID NO: 43588 - DNA, 2132 bp, Bovine  19866880675129
catcaaacctggactggtgatccgtttcacatgtgataatttacatgtttcaatgccattttccccaaatcatccccacccttgccctctcccacagagtccaaaagacttctatacatctgtgtctcttttgcggtcttgcatgtagggttatcgctaccatctttctacaatatggtggtttcctatcggaagaggggagtgtagacagaggccccctcatagaggaaagtcagtctcctgaagaggaggcagggatgagggttatacagccacagtccagggagcagtgggatgacaccaccaaagccgaaagagcacagaagtgtcctcctctagggcttggagggagcatggccctgccccacacctggattccaaactttgaacttccagaacagtgagagagtacacttcggttgttctaagtagtccagtctgtgcactttgtacagcagccctgagaaactatacatcatccaaaagcatttctgatacaagatgtaagtgaattctggatgaaaatgcagctccttagaagcgatgagaggttatgggtctggacccctggctactgaccagatcacgtttactgtgcaagtcacctctgtgccgcctcctatcctgagatgtgccctcccatgaggcccattgatatgggctccttctcaatttctcagctttaatttatgagttgatgtcaaaccaggagacttttcccctgaatctgtctcaggctgcccaacataattctgatcatttgctcttgagtggccttcccctctaaggaatttcaaggcgcttaaacccaattctgtgacccatgggagtggctgcgggggttaggaattcctggtttacatctagcctctgacctctccctgtccctatgacttcattaaactgagtccttttgttgagcaggctttagggaagaggttaagagctggcgtagaaaataccatggctcaggcttggcctgacagtgggccaggggtttggtcaaatagatgctttgcaattaatcttaatgtttatcttcaatctcaagagctggcaattttccagaatccattggcttgctcctgagtctgtgggatttcttgcaaggcagtcacttggtggtttacatccaggggtggctgtgttcataccctaaaacccagcaattctggcccgcaggagctctaagcccactgccttctgtcagcctcacacattggccaaggttgattgaccaaatcctagatctggttgcataactttgggagtaaccgttctaaaagacgtgttctattttcttgcctcactgctcttccctgaagcttcttgtttactgtggaatttctaagaatctaaacacatccagggacaatgctcccagtcccacagccatgagttgaactaaatggaaccatacctttgctttcctcccaaaccaatgggtggaaccaatgtaaaacctcaggatcattcactgcgtgtgcagagactcccctgtgtgtttttatgttcctcccgagaaggatgtgtgttcttgcctgtgttttatctaccaaatacaggcattgcattccaaaggtgacaggtctgaacaaccggtcattgctaacaccaattgtggtacagccatacaatgcacccctatatagccacagaatgtcaggctttggaagcaaatttaatgacatggggaaatgtttgtggtctgctattaagtgaaaaaagctgcttacaaaacagaatttacagtatgaaaataattatgcaaaaattaggtagatagccattgaaaatctggaaggctataatccaaaatataaacatcgatgaaatactctatgtcacaaacacacaatgggagaagtctgtgcacccctcaagggcatctatttgagagaacagaagtggctgacaccttggcacagaacagaccctgttgggaagggccatctttttctgaacatacttggcaccatggagactggcgttagctctgggactgtacttgctactgctatgctgtgctcagtcatgtctgactcttgataccccatggactgtaacctcccaggctcctctgtccatgggattctccaggcaagaatactggaatgggttaccatttcctc

SEQ ID NO: 43589 - DNA, 1083 bp, Bovine  19866880742208
ttggctgctcttttggacaaagcactgtgtccttaggtgtaaaatggtaagcaaaaacagacctctcacttcacatctaatgtgagatgagaaacagatactaaacactcacatgcacaaaaataatagcagcaatcacttataatgcacatcagccatagttttgtactctatataaacacaatcacactctatgaagggcctcttctttttatggatccaggaattttggcatagaaaagttaagacatttgcccaagtccagagagtctggatccaggactcccctttttaaccacccactctactgtctccacgctgtgtgctggatggcataagcaattcacaaatataaggtccatgaagggaagagggatggcactgtgagaacatatgacaaaggcatcccatcttgtctcaggtcatctggaggctgcataacggtaactaagccaagaggggaagcaggagggcaatgacacaaaactggtaacaacagaagggcatgaaccatctggatgtacttcattggtggtggtgggaagcaatcttggacggcatcatggagaaaaaagactggaaaaatccacgtagtaggaagagaacagaggaaaagggaacatcatgaattcagaatgaacctaatgaattttgggaacagggagacaatgatgttttagaattgtttcagtcatgagcagcagtcactcaatttgaacgaccaaagaaaacaaggacattaccaacttgagttgctgaaaaggccttggcagcaggacaaaagatgttgttttacatttctcagctttatttttcttcactcaagcagtggaaagacagaagctctagatattatcgtaccagctcagcaaactaaagaaggggagcacttctttccccaaagacccagggccaactctaattggctcagcgtatatcacatcctcctagctgaaccaatcactgtggctgggccatgtggtgctttcattggcctggcctgaatcaggttccttcatctgtttagtgctagcctatgtcccaactttccacttgtgtactttgcccagattttactctata

SEQ ID NO: 43590 - DNA, 1088 bp, Bovine  19866880765991
atttcaagacgctttgaaactggcaaaacattctgttatttccagagttattacaaccgaaatcctggcatagatgaggaggtcagcctgtaatctcatttagatctttttaaatttagaaactttacagtgggttaaaaatagatcacatttgtgtacttttcctcctttcatctctactgcaaaggcagtttggtagttttgacttagcctcgatattagctacagaaattctggtacttgtcacccgggagtctgctaagccaaaataaaagtgattttcaaatggattttgggatgatgctggttatataactgaggagagttacttgttatcccgcacagtacgctctagaattaagggcgcaagattaccactaagatctgtatgtggatttgtgttaagtgaaaatgtgaaccaggagggatgttttcagtagtgctaccctggagggctgtgtccttacctattgatcagaaaagatcataatacttaggtcaagggaagctagagggtcaggctgcttataagcaaaagttatgtgaagattgtacctgatttcagaaagcccagacattctcttctgtgatagtcaccagggttaaggaggtatgagcattttcaagcccagcaaagacagcattacacttaggattaccttgtcatggtgactttaccttcatgaacatgctgaatccagttttaaggagatcagtgaggcctgaagacatatgttcaatgtcaactggatctggtctctcgggattaaatatttcctccacaacctgcttcaacaatggtttataggatgcctggaaagacaaaatattgtgctgtaagtaaaagggtttgtttggtttgtctggagagaggatagctttatctgtaccaaacaaagcaaaacaagtttattttcgatcctgagcaatggctatggttttgtgtgtgtgtgaaaagacaatatagcaacattgattttttgggaattattccactacactagcactattttttggttcttatactcccttccacaagcaaacaactcttaccagagctatagttataggatggctaatttttcaat

SEQ ID NO: 43591 - DNA, 617 bp, Bovine  19866880905966
actttgccgctcacgactttgcaagccaccatcgcttctctgttcctctggcttgcagatgcgggccctccctgtcttggccccgtgttcttcatcaggcttcccttaggcttcccttgctgctaccctgggcttgtggctcctccctggcccaggcctgcctggctgccaaggccacatctgctcttgccatcagccagctgctcactagcctccagtcccagttcagtaataaagacgtccaggctggaacaggggccagcacggcccacagcccgtctgcctcagcaccagattctcgtctgtagagatgtctggctttcaagtttcctccctgctgcaaatcaaaaccatccgaacactctacagccagcctggcactgagtcgtgggctgaggtggctgaatgctcccggcctggggctccctgtcagcacctggccatcaccctgcccgaatcccaggttccagagctgtgggcctgcttgcagtgagcccctcgtgctggtgaaaaatgagatttcaacattcactttataccctgtggaggataaagctgttgctcaagcttgtggtgaaatcccttaggaatgagaccttgggtaactccgatgtggg

SEQ ID NO: 43592 - DNA, 1391 bp, Bovine  19866880920581
ccctgtttttcattttgttagaagatgaagttaaagggacagcaaattactcattggcttgtctgttaattaaaacaatatggagcaagaattccatctgtggtcagcttgaacaaagcattctctacccggtggtatacccttaaattgcagagtgcgatttccatctggtcccagcccaaaagtaaaataaaacagaactagacaaaggttctcatcttctctattagaatccactcgctattgcaataagtaacttagtaatttaacattcgtcaattttctttcttgcttatgcaaagttcaactggctataaggcaagcagtctagtggggtcaccaacttcgagcagagccttgggactctgctccatgcacacctctacccacctccctccctaaccacctcccaccataccccagcagtggattcctgcagtaaaccccaacagagtaccacaagagtgtacccaggaatgtaccctagcagaggaccccagcaatgtacctcagtagtggactcctgcagtgaacctcatcagtgttccccagcagtacccataggaaatctcccatcatgtagaatctcctactcatcttgggtcccagggaatgttgctatgaacactcctatatcccccaaagccagaaacctgctgtgcatggacagtcctagtgaccatgctgagacacccccagggtgcttcactcctcccacaaacccttactgaccactgtcatgtagcaggccacgtgcccagccctggggagacagtggtgaataggtggagcttgtctctccctcctctcatggaacctgaagcctggtgagggaggtagtcaacagtaatcactaaataaagtttagaatcacggtggaggtggtttagtcgccaagttgtgtccaattattttgcaaccccatggactgtatgtagcccaccagtctcctctgtccatgggattctccagacaagaatactggagtgggttgccatttccttctccaggggatcgacccaacccagagatcgaaactgcatctcttgcattgcaggtgaatcctttaccactgagccagcggagattcccaacagagtcatatgcaaagtgaaggacatgcacaagagcctgtaggagggagatggcgcctcacctgggcaggtttgctgcagaagtggcatttggtgtgcagatgctaagacaagaggtataaggaggagatgggactgccttataaaaccctcagagaggaagaaactcaacatctgcaaagacctgagaggtctgtgtgactaaggcacaggaagctgggaggacaggaccccagtgaagcctgacaatttcaatgacttgtcccaaggtcgaacatccaggacatttggggaaca

SEQ ID NO: 43593 - DNA, 777 bp, Bovine  19866880965686
ttgctgttatacccagagcaagatggaacctgttacttttttccacctgcaaaatgtaggcaatgcttttagccttttttacagaggcacaggattaatgagagccacaaatgaccttgacctgttttgtaactgcaaatgtctttttattgccaaatattcatgaaaaatgaaaatctgctagttttttttttttttaatgagtcaatattaggctaaaactttaaagtctggaacatgtactttatcggttgtttttaaaaattccagtttccaaatttaaacaaaaggagaataagataaatctttcaagtgataatcaaaacagtaggaaggaagtatatgggttgccttataaattgaagtctgtttttcaaaaactatgattttcagtaagattagtaagagtgtctgaaatatttatgttagtaaagccatggtgaatgaggctgacttgctggaagaaatcatgccaaaagttggcatgtcaggatgtggtattagtgtgtttacatgttaagccagttgagaagtttgtgataatgtgctaatttagaatgattgttgactactgaaatctttctatcaatcccgatactgatgctgtgggcctgggactgatggttcacaaaggaagaaaacattctcaaacgtggtgcttttgcagagctccagctagtcaggagattcttttttcatcctaggcaactgttactggtctatagcaccatgggagaatgcagtccttatttcggtgattgagttagatcacattat

SEQ ID NO: 43594 - DNA, 1605 bp, Bovine  19866880968826
ttataaagcaggcccatactacttttttcaattaaaaggtagtgtgtgtggcatctagaagccacaaaagaaagaagaaaaaataaatttccctctcactgggtcaattcctgggtgtgcgacttacgcagctgtacgggctaaagctcagaagggccttgtgctttttatgttctactgtcacaccttgaaattcttagagttttatctttgaatctgtgttttgtaaacgaagtccaggacagaggagcatgtatgtgaacaaaggaactttgtgccataggtatctgctattccttactgccttgggaatatggaattccagtggaccgacaaggcacaggagttcagtgaaatccaaagaagtagaaggtaagtgtgttacatctatagctgcaggtcacagggcgggaagaactgacaaccctgagacgctttactttgcacctgaactagacttgctttgaacgcaaaaagaaggtgtgacagtttcccaaaggctgctattaacaaaataccacaaacggtgtggcttaaaacaacagatctgtactcgctcacaattctggagcctagaagtcaatggggctatgctccgttggaggctctgggtagaatacttccttgcctcttccagtttctggcagtggctgtcagcccatggtgacttggcttccatctgcattttcttcatctgccttcatcttcatagtgttcttataggacactaatcagtcaactagattaagggctcaccccactactgtgatctcatcttaactaactataactagaacaaccctatgtccaaataaaaattaaaatactttggtggaggcacagttcagtccataacagaaggcagtagcattctgagaaatatgaacaaccacagaagcttatcacagtctttcttactggtgttgcttacttgtattaagcaaccacatattatgacaaagaaggaaaggaaaagatggggcaacccgtcgttccttttcctttcctttcttccctaccttatggagaagacaatggcaccccactccagtactcttgcctggaaaatcccatggatggaagagcctggtaggctgcagtccatggggtcgctaagagtcggacacaaccgagtgacttcactttcacttttcactttcatgcattggagaaggaaatggcaacccactacagtgttcttgcctggagaatcccagggacgagggagcctggtgggctgcgatctatggggtcgcacagagttggacacgactgaagcaacttagcagcagcagcaacagccaccttaactaatcagtgtaattgctggttatgtcaacatctaaatactgcccaagaacctgaattaggtgtcattcctgccagtgcaaacatctggtggacccattctggacagtggatgtatggaagacaccctacttcctcctatggcagggcacttggggatcccccatggaaactcagggtctgtccttcactcaggtgaggctattggagggaaaaatttctctttgcattgaaaataaaaatgtccctggactcttcttaggtacataccaaagcagtagtgaatcaagtactaag

SEQ ID NO: 43595 - DNA, 1547 bp, Bovine  19866881228917
ccagaccttagattcaattacaacgagcaggcttcagccaagcgcctgctgggacacaggttcctcctgggaaaagccgggtaaatgtggccagcatatgacatgggaccagcgagttaaattctcttttattgcaatctaaattacatgcaacagcagaactcctcctagaagccaggtaccatgctaagattccagatttaatctcactgaacctcctctaatctgcacgacagccacacaagggagatacagttactagtatctctggtttataaatcaggagatgaagccttggaggggataatgacctgactttacttcccctccgtccccttcctcactctcaacccttaagtgtttagaaaagatgtgtgtgtgtgcgtgtgtgcgtgctaagtcacttcagtcatgtctgactctttgcaaccctatggaccatagcccgccaggctcctttgtccatgggattctccaggcaagaatactagagtaggttgccgtgccctcctttaggggatcttcctgaccctgagatagaagccacagctcttgtgtctcctgcactggcaggcaggttctttacctctagcgtggcccagaaaagactaatgcgtggaaaagaaacatagggacagagaagcctcctctctggaaaggagatatccttgtctgcgtcgttctgctcctgcctaggcttctgggtgtgttgcttttctccttggctgttcatcctctttggagacatgttgtcatctattttgaaggtctgtctgtatcctctgaggtcacacccagccatcagcttcaggacccactgccagtaatgatgcaggctcctttcagcccatctctccttctcagatgtgtaacctagagcaaggaggatatatcccttcacggtaaaactcttaagtactccaacagattataaaactgagttccaagcatgacacccgtccgtatttgtcgttctcactctgagtgagatctgccagggttagtggtgggggttgttattaaatctcttctctgcaaaagaaggccaaaacatgtgctttgagtggaagctgactcttgcctattgggtagttatcagtagctaaaaataggaagtcattaaagtctgttttttgtttgttttgtgggatcttcaaaattgtccgtaatttctcaactataaagataacaggtttagcttttcaaccagctaatgggtacccaccagtcgccttcagtgctcttctgggtggcttccacatcaggtgcagctttgagtgactgccccctccacagtttgtggtcctcgttctcaccatcagcaccccaccctgtgcaccaaactcttcaaggaagagaaacatagtcttttctcaccaagtttagggactcaaagcataacctacctcatccttttcaggcaagcatagtgtaggccagtgtttaatgtttgacatctggagaatacccatttaaattaaaaaaaaaaaaagagggagagacaaaacaaatttctttctagtagaaattttcagtgccatcaatat

SEQ ID NO: 43596 - DNA, 922 bp, Bovine  19866881398347
atttttaaaaaccaaggctgagtgttccttatcattttatagagacttttatagcctagagatctctccagcttgtgtgtaccagcattcatttccctggtgatcagatagtcactggtgttctgcatggcttactggtctaccacggcatgacatgggggacctgggccagttcacacaagggcggcccctccctctcctcactgatcccgagaaccctgatttaaatcggccctctggtcctttggcagttcggaaacacatgctactgtaactccgttcttcaggccctgtacttctgccggccgttccgggagaacgtgctggcgtacaaggcccagcaaaaaaagaaagagaacttgttgacatgcctggcagaccttttccacagcatcgccacgcagaagaagaaggtcggcgtgatcccaccaaagaagttcatttcgaggctgagaaaagaaaatggtgagtggcatggagacgaatgtgtttcggatctgagataaggagaatcaacaggtctgtgtaacctcaaaatgaatccctccccttttttttaaatgggaaaatagtatggccaactactcaaatatcagtttttaaataaaagatatttcttcttttccacccagtatataaagcaaaattggataaaaagaaatatacttaaaaattctgattggaacttccctagtggttcagtggttaagactccacatttcctgtgcagggggggtgtgggttccatctctggtcagggaattaagatcccacatgccacatggccaaaaaaaaaaaaaagtaatttatcattccaaaatggaatgatctttttatttgctccacattcgaggacttttttctgggtaggatcattataagaggaaaaattgcccaaggcaggacacgacggaataaatag

SEQ ID NO: 43597 - DNA, 728 bp, Bovine  19866881434996
cagtgtactttcaacagtttttttctctttggctgcatcaggtcttggttggggctctcgggatctttctttatggcacaaggactctgtttttggtgcacaggctcagttgtggagcatgggcttagttgctgcctcccctagccctggcatgtgggaacttagtttcctaatcagggattgaacctgtgcctcctgcatcgggaggaggattcttagccactggaccaccagggaggtccttcaatcaacactttcacaatctaatctgaaagcactcttatggaagcactattacactattttgtatttgtgcatgtttaaaaaagctaatcagataaatataaacatgttttaaatattaaaaattccatttcttcattaaaagaaaaataagtaacctaagaatctcaagtaatggaaattgtctggccctctatcgccctctaagacattttgcttctccctcacccatccacccccgggaacccgcccatatttccttagttaagaaagagaaagaaaaaggaaaatatacaagcaatgattttcccagcagggggcagcatgagacagtaaatctgatgttctttttggcttccccagcccccaactttgtctgaaatcctggatttcaatcgggaagagggcggtgaggggaacaaggatggaatccaaaccacagaacccaaattcataaagttaagtggatgcagaacttgctggaa

SEQ ID NO: 43598 - DNA, 675 bp, Bovine  19866881722075
catggtgaggggctggacaactgggcaggttcagcatctccttaaaaagaattaaatggcatttcgtaaggtacccatgtgggctgcccaggtaggaaaaattaactccaaaggctgccttgattagaattttttgaagcaaaactcttgctctggatatatgaatgctcatcatgataatagagggatttcctttttcccattctaaattttgcatctcatagagttaggtgtgcttataaaaccagagactggtttttaataaacaaactggaattcttacatgcaaacagtgacaatctttcaatagtctttccataagaacaccatatgcaattcctaaaaacatgaaagtgaccttaaaatattgcatccgtatccagtttttaaactacaaaaggaaatttagacttctttcatcttttttctgtactgcaagaggttatcacctaccttgatgaccaagcagtgaaaaataggctggacgggcaagccaactgcatgatcataatcacacctgccaacccaggagcagtcactgtgtgacaagctcagagctcagtctcattgaatccacacaactaatgctgagagagaggtgtttctaacacatccatgttctagataaggaaactgagggttgagagtatgagaggagtgctctgttacatagca

SEQ ID NO: 43599 - DNA, 1501 bp, Bovine  19866881723928
ctctgtcctgtaaggcgctatattcagttacttcttagaagcccctgacagcctgttccattaagccagcttatgagataacggtgttttgtaagggaacgctaagtgtacaattccagtcaattctcatttaatccacttagtttaatagataataaagcagaagctgatcctaggctttggccaagcacaatctgtgtacttcagttgcctgcttcttgataagggaggcccccaacccccagggcacccttgagtttgtctaaaatggggtatgactcatgctcctgcaattcctttctctggagggcttggcgatctcaggcaggggtccagttacttctccaagcaaccaaatagggctcccgtgtccatgtctgccctcgccaggcccctctcacccgtctccacttactgaagtggctttcctcgggcagagagaggagagcagtttccatggctgtgagtgctgcagggacccacagttcaggcaacaacaaggttaaagtggacagcaagctgagtagctgagcgatccttttgggagggctgaaatgaagctgaacccctctctccagtctgcctactccttctgtttggttcttgcatggagcagattttaaactttctggggcatggggaacttttttcaaaagagcctggcttccagactttgggttttatttcttaggtattcaggaaaataaagcattttgcaacaggaggctgccttatccaaagcttcagtttggattagagatgtagcacctcacctaaggagcttccctagtggctcagaggttaaagagtctacctgcaatgcgggagacctgggttcgatccctgggtcgggaagattcccctggagaaggaaatgacaatccactccagtattcttgcctggagaatcccatggatggaggagcctggtgggctacagtccacagggttgcaaagagtcggacatgactgagagccttcactttcacctcacctaaggtcttccaacacacacacacacacacacacacacacacacacacacacacggaacctgtgtggttgaataagctggggagcacggttggaataggacttgaaatgcctccctatttagagatattactctcttcacagctgtaaagttccctcacatccgactaggaaaagctagggtcaaagagtatcactggagcctggtcaagaggctgttttcttatttgtacccaaattatccaaagatggcctcctcatccttcttccagcccaagattgagaacgtcaggcccatttttccaatttgcatcccgccctcctgcctctcagcaaacccttggcagcagggggacccacctctgtgggatccccaggaagttagagaaagggttggcttgggagggcaagatggccagaaaggacagagcgctgggaggtcatgaccttcctcatccatccggctgtctgacgttgccttttctctcttttcaaaccattgttttaa

SEQ ID NO: 43600 - DNA, 1224 bp, Bovine  19866880423208
ttttcttctcagaatttctggtacctgtctctaaccagagctgcttctactctgtagttcccactatgcagtgtaattaccattcattcctctgagtattcccactgcccacctcctgaccttgttttaccttcatctcattcttagtcttgacatttaaatataatacattagttacatattcctcattcatgttgaaccttaaactatttttattaacttaataaatgactgatctaacttcagctcttggctgtgtggggtgcggagaggggaccccatccctttgattatgggcatgcaggccccctggaagcagggaccattgtccctgtttcattgtctctgcagttcccacagaacccagtccagagctttgtgcacagcaggctctcagtaagcaataactaatcaattaacgtgactttcacaaaccccagctggaccctagtattaaaatcctcacccaaagagaagctattccaaaagaaatagggaaaaccagaagagtcaggagtcctggaaatcttacttgtatttgcaatgatccacaagatggacatccttagcagctggctttcccaaggtatcctttcagggaaaaggaagttgttagtattagcagcaggggcatttattgaagaccactgtgcaacaagggtcactgaacatttcatcaacatgacctccctgaagtctcagaatgcacaaactcaggaggcaagactgtctcactttataaatgaagcagccaaggctttgagaagttgggagacttgctcaaggtcacacagccttaagtagaagagcttgggctttaacttggtctgtgtgattaaatttagagtttaagcttccctggggccatgtgactcttcgtctgcactcaggaggtcatggcctgcagcacaactcactctgtgtaaatcatacggcaaaggagcttacaaacggtggctggtgggctttagaggtgtagcccacacacagattttgttgcactagcaaagtatttgaaaaataaatattcaaaccactgcccagcatttgtaagtggcaggatacttcttataaaaaccgatttccacctttcttgggaaaaaaaaaaggaggatgtggcaaagagagctcctattctccctggcagaaatgactggaccttcagtgctctctcccgctcacgactgcagtgcctgggggcatcagagtccgagacccctatcc

SEQ ID NO: 43601 - DNA, 1728 bp, Bovine  19866880501107
tccttttggttttccttcttatctggaaaagcagaactatttcattggtcctggaatactttgaactgacgttaattaaagtaagaaatcctccatatattcaccttctcttattcgataacatccaagttgttaagctgccttcatctgcgtttctaaatggtttccgtgttctgagggatgtctccatttctcagattcgcattagtcctaaatgagtgggacgtgctgtctggccagtgcctctgttctttcccttttccttgttggtatccccatagctccgccctctttactcttctctcttcacttattgcattgtcttcgggcaacttttgctactcttgtgccctcaggtaccacctctcgacagcttatttccgaagctatccctataagtactcttgtgtattgaacttggatcctgtatcctttttcccactggcagaagccccatgacaacctcaaattcagcttatccaaaccataatttgtctccttctcaaaacctaattattggtgtgtataccctgtttttgtgacaggcattatcatctacctagctgcccatgctggagccctcggggttattaaggtctgtcgggttctccaggagacaggctctgagatggagatttgcgtaaaagtggaggtttgcatacaaagtgtgttcaggacctgtctcttgccctccacccaactcgctaaaaaagtaaaagtgaaaaccgttttgttgttcactcatgttgttgtggttgtttagtcgctcggtcatgtctgactctttgcagccccatggactgtagcacgccaggcttccctgtccttcgcaaaatttaatgcctaacctggacccagccttacatttcttcttaacccacaactgtttggcacaccactggttactggatttacacatgagatgaggtctgtcatccaggtctgatgttacaatgtacatgcacaggtacctgtgtagacctctgcacacaaccatgaacaacccgaaggtgggtggcaccttgattagcgagcctgtctggacagaggttggaaggccaggagtgtggggaggtggctctggagcaggagtggacgggtgagagagcacagtcttcagtgtccctggaatacgcccgccccgcgaagtctggatcggctgtagagaacaaaaggacttcgtgctaaccttcttgccttctctctcctctctttcaggttacgttacagtggatattttgggggtgttactgccctaagtcgagagcaatttttcaaggtgaatggattctctaacaactactggggatggggaggcgaagacgatgacctcagactcaggtgaacaacagagacaggtccccttcacggggtctgctagccgtagttgtgtgtggttcctgtggatgccaggccagcaggtcatgaggcttgaacttgtcctagaggggtggcagagggcggggaggggggtgaacaagggggctcaaattgctctttgccactggcagttcagagatgacagagggtggtccggttctggcttatggatgtctgcggtccaggagtgttgatggaggtgtctgtggacttggcagcaggtcctagctactgagatagggtctccccagtgaacggaaagtcccagactagagtgtctgtaaagctacaatccgaggaaagtggccagaggtctgttctaagcctctgccttctctcagaccccag

SEQ ID NO: 43602 - DNA, 1728 bp, Bovine  19866880508020
cttggaaggaaagttatgaccaacctagacagcatattaaaaagcagagacatcactttgccaacaaaggtccgtctagtcaagactatggtttttccagtggtcatgtatggatgcaagaattggactataaagaaagctgagcaccgaagaattgatgcttttgaactgtggcattggagaagactcttgagagtcccttggactgaaaggagatccaaccagtccatcctaaaggagatcagtcccgggtgttcactggaaggactgatgttgaggctgaaactccaatacttttggccaactcatgcgaagagctgactcatttgaaaagaccctgatgctgggaaagattgagggcaggaggagaaggggatgacagagaatgagatggttggatagcatcactgactcgagggacctgggtttgggtagactccaggagttggtgatggacagggaggtctggtgtgctgcagttcataaggtcgtaaagagttggacatgactgagcaactgaactgaactgatttcaaaacacaactgtttgaagtttaacaagatacaagaacctttaaaacaagtaaatttctattataggatatggggcaagaagaagaaggccaaagaatttcattacccagacataaactttcatgtaacctctttgaaacagaaaagttaatgtccgtcttttagccctgtttccttagtaaaatcccctcctctctccttaatgccttcaatgaaaaggcctcttgacagtttctttcatttagtatttaactagtcaataatcataatagccataatattaatcttcatagactacatcatgccctcatcatcagggttaggcaaattaaccctgaattctcagaagctttaaacaaagtttacttcttgctcacacaatgttctctgtagatccaaaagtcctctactaaatggtgactcaggcatccagtctagtatcaccttgtgatatcatcaactcaacacatgggtctctacaatccatatggcaaagtgctctggctcataaatgacacctgtcacctccacttataatctactatttagaataaataagcgggcccaatgtaaatgccaggaaggcaagaaaaagcagccttggcctggctctaaaaaggaaaataaaacaggaccaggtaaccatgtaccactgtctctgtcaccaagaggcacttattctatgcctaattaactaccatgcatctgaagtcttcatatgtattagtatctttaatatccacaaccacttctagataggtattattatcattatgccattttacaaacaaggaaattgagggccaaagaagttaggtagcttaccaaagcttataagaggcctagctgggattccaatccaggcaatggactccagaatgcactacgtcacactgcttctcaaatatgcaagacagcgtgaggcactgttaaggatactcgtcttcaagtatacgcaagcccataagatgaaagaagtattcagatacgttctattaagtcttgagaggacaaaataagaggcactactgagagaaaaaattaaatgaaaagaatatttttgagtgcctattactaaaccagacatcactctagagactgtatgcatctttcatctaagcatcaaaacactcccacgaggtgggtatttttattccagttacacgaataaaaaaacagactcagagagattaa

SEQ ID NO: 43603 - DNA, 1062 bp, Bovine  19866880528995
tactgatatgtatgttaccagaccgaggccatctttttgaaatatctggttcttgtcatggcttgtttcttcatatctattgagtactagcctagaaagatctctgatggctgtcatcaagtacgactttcctcatttgaagtatgttagtatctctaacgcccttctagaaaggaaaaaacctcagaacactttaatcctaaagacagtgttctttgtggcaagcaacagaaatggatggtgattaattaaagcagagaaagtctaggatgttgggtaactcgtggaaaagatgggaagtctaaaggatcagaaaagaagccacagcccatggaagctaggtagccaaaatgacactgcaggaagaatccagcgaggactcactggacagttcctggtaccactgctgcaggcaccgtgtactggaagccgcacctggctgccctgactacacgctggtggctgggaggcggggaagcacttctggcttctgcagtggagagtgtgctctgctgcccattgagaatcaaacttcggggaattctatgaacactggaagagggtcttgatgcttaacagtcaaaaaatgttaacaatcaaaacatttgagtctatcccttctgatacccaacatttgcccacacatttttctttatgtttacagttaaaaatgggcttccctggtagctcagttggtaaagaatccgcctgcaatttaggagacattggttcaattcctgggtgggggaagttcccctggagaagagataggctacccacttcagtattcttgcacttctctggtggctcagacggcaaagaatctgcccacaatgcaggagacctgggttcgatctttgggttgggaagatcccctgggggaagacatggcaagccactccagtattcttgcctagagaatccccatggacagaggcgcttggcgtcacagagtcagacacgactgagcgactaagcacagcacagcacatactcaaaaactagaatccccatggacagaggagcctagcacgctacagttcatggcatctcagagtcaga

SEQ ID NO: 43604 - DNA, 1245 bp, Bovine  19866880618244
gaaagaaccttgtgctcatgcaagttcctctgccgctgtagggccagggtcacctgcttctcggctttcttcaccagcctgtcatcttcttgcagcgcgtggctggtgcgcagctcctggatcaactccagtcgcttctctttcccttcaaacatctgtatcaaatcaaatcagagagacccgcaaatcagcattgccagtgcaggcaccaggccttgcaggcagggactgacgaggcgctcatgaatcgcgggttctgctccgccatgcagggccacggaccaggtgtatgcaccgagctgggcatcagccctgttttctgctcctccagctgttcaggcagacaaggaactcagctacccgttaactgctgactgaatttcttaaaatgcctctcaaagacaaggtgacacctctagggtcatgttaagaaactggaaccttcccttcatttcctggctcttcccctaagaagcctgggggtggtatttttcattgtcgtttttctttgctgagaaatctgctcctggtctggaatacacgacctgctgtctgaacttcactgtggcgtttctcctgcggaaatactggcaggaggatgggggaatagcgctgaacacaagacgcccatccagcctccctgaactgactcaccataactgagtctcttaagagttatagctgcctggggaagaaaaaatgttttagctgaggctttacatcagtccctttctaagcttaagaagcacaatgatctgactaaggctttacggccaggaagaccagagttgaatttgctggcagttaacataatcccactcaggctcatattactcacctgtaaaatgggtaactgataaaaaaaaaatgtgctgatatatgtaaagcaaagaatatataatgtgagcatacagtaagagttcaaaactatagttatttatttacttagctatttcatttattattcatgcattgctagctaatatgcaaactcagattattatgactgtggaaaattagagaatccacttggtttgtgatgcttaatagtcaaaactcatgtatgaaaactgctggattcagcaattccatggaagacattagcttcacactgccttggttacacacaggaaacagcaggcggctcctttctctccttgatactgtgccactcacttgggccagctatggcagtaaaagggaaggagtgggtaactcaacagcatagttccacaggacagcagg

SEQ ID NO: 43605 - DNA, 952 bp, Bovine  19866880677141
aattaagtagccccagggtacttagtagcagcgctgggaccaagattcaaatggtaggcaaccgggctcttaattgctgggttttcttgtgtatagtgctttgtgatattgatgcttccagaagaaggagaaatgtgcctttgtgatcatttttaaattaagagaaaattttgaatgatttagatcagcacacccctctccccagttcttaaaaaatctgggcttcacacttggaaaggaggggacacagctgatgtgggtatctgacttcttgggctaggttcttctgaaataagttgaactgaaagcccccattgtgtaaactcccagcccccctgcccccagtgagaagtcatgagcaagtcttgagtctccacatctccagacgccaatggaggaaaactcttcattaacaatgcattgatttgtgactgcacttttataaaaagaacagctttaatagaggcctctgcagccttttttttttttttttgaagtgcagtgtgttggattacttgcaaagcactgaagaggaattaacttttagatgggtacaaggaatcttccgatgtgttgctagcactttttttttttttcaattgagtatataggtgaaaagaatgttacatttcagggaggattatcaggaaagagaatttcttctcagttgatgaaacacagcccaaagaggggaaaatctttcacctagctctgactttaattattccatatgatgaaaaaagttcctccgtttctgcctgaaaaagaaagtgaaaacttgtcattttagtcttgcactagaaaatttataaatatgtttaagagaggaaaacagagctaggtagaaatgttcatcagacaagaggaggactggagccttagtcactcctgtccagaaaaaggaaatgacttatcaagagtttacatgtgccagacacagtccatacatttt

SEQ ID NO: 43606 - DNA, 2244 bp, Bovine  19866880678086
gtgttggagggggagcagcaggtgggagcagaggagacagattcccctggggctcccacttccatcttgtttgtggagaagacttctcccaatggaactatttccagaggagtcaggctggcagggtctgggcgctggcccttttcggggtctggctcagatctagggaggatgccggctgtctccagcttttctctattggctgctgtggaagtgcccagtgtgctctgattggttggattcttagtccactcctccagaggggcggagactggagctggggtggagctcccagggggctccggggaagcaaaaggccctggactagattcaagaataggctgagttgggctgatctttagagcaggtggtgccaaggaggagagttcctcctcagattcaataattttcagctcctgttgaatctcagaccagatcagggcgttgaccagatcatcttcatcctgaaaaacatcaagaaactgattactttcgaaccaaagacactgggcacagtttcccagggagagaagggtctgcactaccagctgcactaccccagcacacaaaggatagggcactaatggtgactgaagatgtttattaatgctcacggtgtaccacaacacacattaaacgtgttttctcacttgtcccaagaaccctaaaagataaatgctactgtaattactcccattttggagatgaggcaacctatgttcaaacaaattaaacatttttccaaagtcacagagcagcagatcaggattgaaatctaggttagtctacacctgaacataagcacttaacccctgttcattgttgccttataaaaccaacccaatccctgatctcatataacttcagattgatccaatggctcataaaaatgaggttctcccagtggaatgaaatgttaactcctgccctgacacctgctttccaaataaatacagctatcccttcttactaatgaaatacatatttcacaatgaaaaaagatatgatacatattaaaagaaaaaagaatgaaaaatagcaaaatgggacttccctgatagtacagtggttaagaatccacctgccaatgcaggggacatgggttcagttcctggtatgggaagactccacatgccatgggcaacttacacctgtgtgccacagctactgagcccaagtgctgcaactaccaaggcccctaagcctagagcctgtgcgccacaaaaagatgccaccacagtgagaagctatagtgaagagtagcccccactcacaacgattagggaaagcccaggtgccgcaacaaaaaataaataataataaaatagttgttcttttttaaactataaaattctgagcaaatcagaagagtttccattgcccttaggttaagctccaaatcccttccaagcaaccctgcatgacgtgacccacgctttgctctgagcctcactttctctagtccatgttcccattctccagccttgttcttgttccttgaatgttctgtactctttcccatttcagattcatggcacatcttactctttctgcctgggagtctctccctccctattctgctccctacccctttctcctagcttaagttctgaatagaaatatctatttttcagagatgccttctctgacccccatgaaccccctcctccctctgactaggttgagccctcctatgacatgctcccacagaaaccatacttccatagcatcctagaaaagacttggtttgtgatctttctatctattaagctgtcatctccaagaagacagagatggtgatcatcttgtacactgtagtgatcccagtgctcagcagtgtgtctcacacaatataggtatttaatacatgtttttaaatgaatgaatgaattgctgcttttacttgttctcatgaatccagcctggttctcctaccataaacttcatctgcttctcaaagcaatgcaattcatactttatccctcccagagttcaatccccaaaataatgtttgcatctttctctttctataaatacaaacatactttacaggaacccttaatcagccctctggaggccactgtggtggccctgcactgccctaactttagcccataagccttttatacctgtcccagagaccaagttcctgaaagctacttaaaaggcaaagtccttttctcctctggcatactcctccaagtcacactcaggtcaccagaggtatttcccaaatccaagact

SEQ ID NO: 43607 - DNA, 1499 bp, Bovine  19866880716236
atgaataaataaatattaaaaaattaaagttctttaaataaaaaaagtaaatcagtatgaagaaaaagtttaagtaaaaagcgacggagagggacttccctggcaatccagtggttacgattttgcctcccagtacaggcggtgagggtttgatccctggtccggatcccacatgcctcgtgaccaaaagaccaaaacataaaacagcagcactattgaaacaaattcagtaaaaactttgcaagtggtccacatcaaagaaaaagtgatggagaaacatgtaagtctggaagaaataagctgtggcagtgtggctgaggaacaaaagtttggaagatgcaggtctacagaccagatcccaaaccccctgctctcagttcctccgcctcaccccttcaggccatggtgcttgtgctgtgcttactcgctcagtcgtgtctgactctttgcgaccccgtggactgtagcccgccaggctcctctatccgtgggacttcccaggcaagagtactggagtgggttgccattcccttctccaggggatcttcccagcccagggatcgaacccaggtctcctgcattgccggcagattctttactagctgagcccaaggcaagcccacatcctaaagaacagtcaatttcgttacatactaacatggcatagacttcaagataggttcttaagtaaaaaaacgcaaagcaagaacagtatagatcacatgtgtaatatagatcatattacacatttgtgtaataaaggtggggaatgaaaaatagatggtacaagtatctgcttatccatgcagaaatgaactatggcagaataaaccagaaactaataaaaatggttctccataggagacagtgagggtgtggaacagactggaagcaacacagggatgaaagctaaacttttctgaggtcattgtttcatataattttaacttttcaactctgtagttgttttacatattcaaaaactaaattaaatttcaaaaaacaagcctgccaagtgatgggcaggagaaaacagcactgttgtcaggtctgaagtgttactcgttccgacctcaggatgctgttactgggtctgactgagcttcaaggccatcatgtggtcagaagccttgagttaagtcaccagcataactagtggcaatgaaaagaatttgttcttaatcaataaactttcctgagcttgtactctatgtcagactctatagtaggcgctttgtctccctaatcttctttatctttacaacagccctgtaatatgttattatatagtattatgccatgtcccaagattacaagattcactgagaaactaacatttgaactcaggcttctttaattccaatgtaaataatgtcactgaggatcttctatataaccagcactgtgcaaggtatgggagactttatcctacactgtggaaacagccttatatggtgaaataggaccttcttcatgaaaggcattaggcgccaaacatg

SEQ ID NO: 43608 - DNA, 737 bp, Bovine  19866880718787
ttttgaaagctatcacaattaataagggatgagttttttttaaaaaaaaaaccctcatgcctttcatgcaacaggagtgagttgctatctgcagggttgggttaatgccactttctgtgagtcctctgagaggacaggctccatgaaattcttttttgcccttataaaccaatttaaggccagctacaggcaaggctgcagcaactgccttctgagtacttacacaggatcctgagccgggtggctgtgcccatgttagttctcccctcacctcatgtactccccatcactcttataatccatgaatgattctgatcccgacacctcctcaaaatcctccagaaccagactggtggagtcctcacccaggacgccgctgtcgggcctggacattctgacccagggaggaggtgcaggagagctggtgaccagtggaggtggggagctagggggtgtttgctggacagatgtgtgcagagcctgaggaggggttgccgctggctcacggacttcctcgtcatccttctcagactgtggtcctgcatctggggcagcagaaccgaggacgtggtagaggctggggagacggatgtcaaagcgtagcccgaacttagcgaagagcttgtcattgagagcgtagagcttctctgagatgtcatagcccagcaggaccgagaagaggcgagagatgtatcgctctttggtcagaaggaggtgagatttttccggggccagga

SEQ ID NO: 43609 - DNA, 1695 bp, Bovine  19866880815539
ttttgtttataaggaataaataaactatcctaatgttgataaatgactggaacgtgaaacactgaaaatagttctttgtaatatcactgtgatcaccttgaaaatgccgggctcagatttcctgctgtggggaacatgactgactgacagcctcagcggcttcctccagcatccaccactgcttccctcccaggcaggctttgcctggactgctcccagccagtcaccattctcagcggggctgctaatacaggcctgttcctgcaaggagtgagattcctgaaacaggtgactttgtctccaggactccccatcagcctggtggaagcttcagcaaccttgtgctgcagtctgaaacgcccccttctttctttcttctccccttcatggtggtcagacctgcactgcagtcggagccgctcccttctttctccaggctcctctctgcttcctttactgccgttgcctccagtaaacctcttgcttgtcctggtgtccactttgtgaaggagctggactaaaaatggttataatcattattgaaagggagtaacagtctacaccttgacgcacagagtggatattttctccattaaggatgaagcaaatattagtataatgggtttaacttcatttttgtattacagcatttcctcagaattaaaattcagtatttatgattgtagattctctaaaacgggcattagccaacatttcctcaaggaaggctgctcacctttaggacctcacattaatttgcagattaggctgtgagactgcccttattttggacagtcctctgtagctcttcctggtggctcagctgttaaagaatctgcctgcaatgtgggagacctaggctcgatctctggattgggaagatcccctggaggagggcatgacaccccactccattattcttgcctggagaatcccatggacagaggagtctggtggtgggcaacagtccatggggtcgcaaagagtcggacatgactgagcagctaatttaacttttttctgtagctctaggtctttaactttattttatgatttagtctttaacattcataaaccaaaaactctctccagaaaaatgatattgatagttcttcactgttcatttctttttatagccttctgctgatttctctggtttcctattttctttccgaaatcttcacttgactgttatttttgtgacagaccaggtccagggaacagtcactatccggaacatcagcgccctgtcgtctggtttgtaccagtgtgtggcttctaacgccattgggaccagcacctgtcttttggatctccaggtcatttctcgtaagtatgtgaaattccgatgtccactctggttccgaaatgccaagatcttcattaaaccagggaatgaagagtttcacttaatggtacttaggtcatttgaagagaaaaaagaaattgttttgattttaatcattattgaaaatgttaccaaaatatattagtgtacttttcagcctcagcaataggacttgttctttatggtaaaatgtcttctcctcaggatcattagaatcaaatcagttctgattgtgtagcgctggagacatataaaagtttggagtgaccttctggtcatggcaagacctttttgtattttcttctaatcccttatgtctgctaaaatgttgggtgcccaggtcatac

SEQ ID NO: 43610 - DNA, 1437 bp, Bovine  19866880816024
cctgcaaaggaaagcaaaagaaatcatctggccaatgcatctccttttagacacataaccagtaactacccagtaaagagcagactataccaaacattgcaaaattttatttctaatcttagagttgtcaccaacgttttactacagcacctatctgtaagtatccaggggttttaaattcctacataccaaactggaaccaacacctgtatccttacctaactcatcagaatatataaagtgcattttatgataccttactattggtccataaatatttttaccagttcaaaaaattaattgcacaataaaaagttaaactagcactgacaggtctcatgcttactaggtcacaaaatgataagatcaagttatagactgagtataaatgaatgtcaaaaaagggaagaagagttacaatccatgactgcttttcttacatcaatttatttattaaagtcaactattcatgagagaggactcagaatgaagttgcagaaagctctttgggctgacggtgaggtacctggtttatccaagctctctctgcctgtaaatatttgagtgtagtcaagtcttcccttgcctgtatcactgactcctcaaatgatgaggttgaacaaaatgctctcagtctaattatgaaaggcccatggactaaagaactagaagaagttactgttaaacacatctatttaaatttcctatcagaaaacctggcttatcaaatatttttaggcagtaaaaattctattgaagcagagaaacttcataacagaaataagttaactttgggaaggaaaggtatagtcatggtcacaattcactaattttctgaacattattttctgtagtgggtatcatatgatatggggtcttttacctataactgatatagcttatgaggtagtagcttctatttgaacttcctggaagatgactagtgtgcctggccttattttaaaatactcctgcaattaaccaaataaatcaagtactattaatactatctaaagttacttccttaatactattatccacctatgtcagtgctagtcccttcgtgtcaaaatatatctttcttttactgtctcagtatttcctatcaacaatgtcttctgataagattccagattcctacatattcctcagaaggatcctcctgacatgtgttaactttttttagtctttcagaaagaggatagcttcttttgatagttggctaataatgtaggaacaggacttaaaacagcacaggcatactgaagtatcaccttattctagaaatcatatatgtattcaaaacactttcctacccacctcttataaaaagattaaaatttcagtggcagcacaggatggaacagaagtacctgctcaggctggtttgcattggagagaggaatgaccatccaaatgacattgaggttaatgagg

SEQ ID NO: 43611 - DNA, 1434 bp, Bovine  19866880921692
gcttggtcgtggaaattgtgaagagatttgctgagcggcttcgtcagatcaaggacattatggaattaaagggctctaagagacctcagtggtccagttccccgtggctcacaacattacactttcttactaataagaaagacaactcaaccacgtgaatccaaagtaactaggaagggaggagggaagagcacaatatatttgtccaaagaagtacaaatgttaacatggaaactggagacatcaaagggcaactgaaacatgctttgctctgagaacaatgaaatcacaaattagcaagaattcaaagtcacattttcagcaactatttttatgacaacgaatcatgtttaagtttctataactattttggaggataaaccttaagaatcttctctgctagcatgttttagtttcagaaaaaaaattaatctgaaaacaaatcataccaagaaaacacagtgggcagtgagtttacaaaatcttataattattttggaagttctgccaatgtgactaactgtccatttgggagaccacctggttttgcataaaaacatcctctttcatgaaaatgcacaaagaacagctgggaaacactatcagtgacataagtcagagttacgacatgtccagccacacccctccaaagctttcatcactacctccttgactaaaacccattgttttttaaaagctcacaagcttttcacttttaatcaacagcagcactacgaaaatgtctatatacatcatgtgacccagtccagatacattttagacactggtggctcggtgataaagaattcacatgacaacacaagagatgtgggttcaatccctcagtcaggaagacccctggagaaggaaatgacaaaccactccagcactcttgcctggggaatctcatggacagcggagcatggtgagccacagtccatggggtcacaaagaattggacacaactcggggactaaataacaacaaatgcctggcttagaccaagagcagtcattatccaataaaagcagagaaaggtcctaaaaatcaagttaaaggatcaggatacagtgattgtggtaaaatgttttttcataagtctgttcacagctgaccctctcctggcatatataatacctatctatgctacaaaggatttaagaaaataaagatgtatgtacacagcctgagctaaagtgaacagaaattaattttaaaatataattctttatatttgaaaccactttttataatctttctacaacacatgaagatggttttaattcctagaataggtatcaccaaaaagtcttattaaattgatagggggagagggcatgctaagtcaaaaaaactattttaggaaaagctttataaatatgttaacatcagtcatatgctttctccaggttattttattgccgatactctcaa

SEQ ID NO: 43612 - DNA, 1149 bp, Bovine  19866880943597
caaagatagagacaatttaagaaactatgacagttgttggacatgaaagtgttagtcgctcagtcgtgtctaaactcttttcgaccccatgaactgtagcccgctaggctcctctgtccatggaattctccaggtaagaatactggatgggtagccattctcttctccaggggatcttcccaatccagagatcgaacctgggtctcctgcagtacaggcagattctttactctttgagccaccagggaagccctgctggacacgagcggtaataaacatctaaactttaccatcctgatcaccttcctcaatatacatctgtgaatcagtttccaccttcaaatggagcactgagaaatgaatacagactccctgctggatccaacttgttaagagtgcagtgtgggtccctcagtccatacacactctacagcctaagatgctgttcatacagcctaaaattgagccagattatcagacaactgtcaaaatgcaactgtggagcaaagagacagacatatgtgaaaagtcatacaggctggcgaaaacccctccttaccctgttccatcaatgacccaaacgcactcacttgccagatttataactctcctgaaatacagatgaaaagtagaaggtcggagggctgtcactatgattacagccttttgccataacccataaccctcattttatttctttccagttttgtttttaaattgttttctttctctgattactaaagaaatgttcaatttagaaattttaccacattcccatccagaaatatttatcaactgataagaatctaaaaactagcatttttatgcattcaaccaaagaaaataaataattatccacatatctgtttgttgctatttggtcactaagttgtgtcggactctttgccaccccatggactatagcccgccaggctcctctgtgcatgggatttcccaggcaagaatacttgagtgggcctgccgtttccttctccatatgtgtatataatagaatttttaaaaaagaagaagcagctcctaggggtatataggggccttggaatatttgttctcagctccttctcaactttgaaagtctgtagcattactcaggaaccacattctgagtaatgaggctgaaacaggtta

SEQ ID NO: 43613 - DNA, 1129 bp, Bovine  19866881112337
tcatttgacagatgaggaaactgggattccaagagaggaggtgttaaggttgtcagaaagttaaggctaggcccaggttttctgattctaagactagagtttactatgtgatgatggaaagaaaatatccatactgtaaaccacaaggcaatgctaaaaacaggcaaagccactgggggccaggagccctggttttcatcccaggaggcacaccctgccccattttttggctgctgcaatacagaccacagggttctcacccagatcacaggaacagtcatgctgctggcatgcaatgcagggtcgttcctatgaagccagtgagctgagctgctggcatcaccctgcctgcagagtagaatgagccctacatcgctcaacctctggggcagccccgggttctctatgattgctgtttccatccactcaggatatgaagaggcaaatgggaaaagacacaaaccccatcccctacattttgccagtatgtagtcttgcctttcagcttggtttactcctttcctgaaggctcggcccagagtactaaacagagaggttattagctcagttcaaacatcagtcagttgagtggaaacacccagcaaaccacttggatttatgaagcaactggcagagtcactgatgacagtggaaaagccattggccttagacacagcctcactctcttctccactgtgactccctcggtgtctatgtttgtttatgcagatggggtcttcatgtactggcttctgggccccagcaaggacccacacaatgaagcttggggacactgtggacacggcacagtcccagaacagtctgtcctttcactggccgcggtggaatgagcacagctctgtgagcgggcatgcagggcatcctctgactgctagccaagccgggcttccaagttccccactgtaaccttggatacggcagggtggggggtggcaaggcactgtgaagggcctttgtttgtcactggaggctcctcagaaggcgggtatggatggctgggttctaggcctgccaaagaaggagggaaaagaatgggaaagaggagacagaactgctgcaggccgatgaaaaaaggaccccggtggggatagatccactgcatgaagct

SEQ ID NO: 43614 - DNA, 2084 bp, Bovine  19866881140801
cccgcttgttttcatggtgtgtgtttttagttgctcagtcgtgtccaactccgtaaccccatggactgtaacccaccaggctcctctgtccatgggatctccaggcaagaatactggagtgggttgccacgtccaggagatcttcccaacccagggatggaacccaggtctcctgcattgcaggtgaattctttaccatccgagccaccagggaagccctttttcatggtagtcattttatttattttttttgctcaactttttcttaacactgaatttttaaaaaaccttttattttgtattagagtatagctgattaacagtattgtgatggtttcagatgaatggcaaagggactcagccatacatgtacatgtatccatttccccctgaacttccctcctatccaggctgccacataacagtgaagagttccctgtgctgtatagcaggtctttgctggttaccgagcgtgtgctttcccctctccctgcccttggccctttcctcagaggagggcagtgctgaagcaaatggggctcctgggcatacagaggtcctctgcgctgcctgtgtaggtgactgtggttccacctagacacagcttacgtcggagtctttccccagtcctagctgccccagatccagtgcctcagcgctggagtgttcaccgggcttgggctggggcaggaaattcggcagctgcaggacagatgtctgtctgccctgccttggggacaagacccctttgtgtctcccagctgatccttgttcccagcctctgctgttgctgattgtcttgaacctgctctgcacgggaggtgaggtctgtgaggtttctctgtattagggagtgagctgtgacaaagtggctgctcccagaaatctgcctctagggtgctgcttcaagaagcaccaacagtggccactgctgcccctcctaggctccaccatgggactacattgcctcctctgagtcccagggttgagtttttctccccagttctggctgcctcaggcccaatgctgcactgtgatgtgaagtgagcagggcaggaacgttccgtcagttcaggctggggctggaggtggaaggtgggaagcccatcacctgctggagcggacctctcttgccaagtcatcctgtgcacactctttacaggtagagcctaggcttctccagcctctctttctgtcccaacagttctctggccagccaaggggacttggctccttcacacaggaccccaggactgggatgcccagtctgtggctcaacccactcactccctggggtgagtctctgcccatccgatctcccttttcctctgagacccctcctgggggcacaggtcctgactcaactcatcttctgtcctacccaattacatgtgtatctttcttacagacttggttgtataggagtccttctgccagtttgcagttggaatggttccacctgtagatgtagtttcgacatgttctttgtgggggtgacctccatgttctcttgccctgccatcttgatcgcacttttcctgaagcatcttgtgtcagcatctctttctctattgccgttattccaactggagtccagagtctttggcctggactctagcagtggccttaaaactgatctccttagctttagactttctcttttttatcttctgaattatagtaaaatgtttgttttttttttttctaaaaatgtgagtcttattgtgacctcttaattttttcactaactgttcttggagatagatgagaagtacaaatttcttggagggcattcacagcttgcatgatttgtaactagctcatgtttctgatttcatttctgaatatatctgccattgcatccatgcctgactagtcatcttttccaaaattcaatctgtgcttttccattaatgtttattagttcatttttcccttccacctgaggtaacttttcccttgtatatttttattgaagatgtatctgtctttcaagagcttattcatttactacttactttaggatgatttcagggcaaagttttccctttctttcatgtctttgagtttggaccaccaacaga

SEQ ID NO: 43615 - DNA, 908 bp, Bovine  19866881180851
ccctagtttatccatcccccttgcccactagtattctggtgtttcttcataaagggccgatttcatgacatatttcttgtttgcatcataaacctggtataaaaacttttttctattttatttttgcataacttcaatttttaatgacattaaacatgtttaaatgtttagtagtttattgactttactgcttggtaaattgtcgcatagtgtatccatttatttatttgggtctttacagtttttattggtttctatgaactcattattaataatactaaacatgtaatggctatttcttacaaatattgtatttttgattagcttttaatctaaattgctatatttcatatttctaagataactctcttatactaggcttgtaattataggaactgcttaccttcataggtgttgagatagtggttttttactacaaagtcctctgaattgttgtctgggaaacgaccaaggcgagatagaggtccatagacctgtgatgcataatcacaataatccttgatgatgtttcttctctccaacttcccttctatattctttccctttcccatcagttttctgattgctaaaataaaacatacctccatgactatctctaaaatatttttctgaatgacccaaatgcaggctaataaaccagttgtagtattattcacagggagactaactgagctgaataaatttcatcatgatcactcactgcagcccgaatataacacttaagacaaagaacaggtggatatgacagaagctgaatcatccagtgtcctcaattggtactcatcaaaaatcttttataactgcattctaagctctgggccagaaataaaagtttgcgcaatgaatgaaagaaactcaaagtaactgaaaaatacatgtcttcaata

SEQ ID NO: 43616 - DNA, 1035 bp, Bovine  19866881263708
gaaggatagaagttctgacaggcttgagcatctgccccacgagtggaatgccccagtgtccccggggcaaggcatgttcaccctgaaaaagcagcctgagtttcccgtgtgcctgccaggcagaagtgccctccaaacactacctcagatgcggcttagtgttgaatcagagtgagactcatgactaaacagttttggtccacaaatgagaatccttctgtctcatgctggctaaaaataaaatcatttcatctcagtcccagagcaagatagggctggaagagacttttgagatcatgctgataaactcctcactgcaatagaaactcagaggggaagaagtctcctcctagggccactccgataaatgtccgcctcttagcctctgccctgtgctcattcgcccccccgccccccaagctcactgtctgtatctgtgtggatggcttccacgaagagggcatccccagggtccagacgctcctccaggctggctctggtgtactctggtccagcggggtccaggcctgcaaggacagacatgtgaggggccctgtcatctcagccacaagaactcttatggatccactgcacacctacatgggcaacccttattgttcagatcagaatcccccaacaaggacccaaaggtgagagaactagctcaggactacctttcccagggaaccctaacctgttgagtagagagaactctaacttcttcatgacccagttcctctggctctgaaatgaacttgctaacaccgaccatttggcaagggttaatgtcagtaatatttatcctcatgtagtaataacaatggctgtaatgttttgagtagctactatgtgccaggccttgtgctgggcaacttcacacattctagtccttacaacaacgtgtgtgcatgcatgctaagttgcttctgttgtgtctaacttattgtgatcccatggactgtagcccaccaggctcctctgtccatgggattctctaggcaaaaatacggagtgagttgccatgccctcctccaa

SEQ ID NO: 43617 - DNA, 826 bp, Bovine  19866881333948
aacaggagaaccaaaagttaagcctcaggactttccagtctagactgttttccacctcatagtgatacttcttatcagctggttccttatcccccctttttcacagctcaatgaggaaggctggtcacatgtaaaattccaaagaggcaggaaacaggtgaaagggaaagaagccaggctttctattacttttatagtggtatgtagctttggctttatctctcagctattattaaaatggtggtatggtgtggatcttattccctcttaccaagcagaggcaatctgtctagagacagaggttacaggtctgaccctgcctagaggtagtcacttcatacatatgggcctagtttcctcatttattcattcatttaatcaagaatcttctattgaacacttggtatgtccagaggggcttccccaggtggctcagtggtaaagaatccacctgccaatgcaggagacttgggtttgaccctgatctgggaagatcccacaggccgcgtggcaaatctgcccatgcaccatgcctactgaaccagtgctctagagcctgcaaggcacgactaccgagaccacgtgaagcctgagcgccccagagcctgtgttccgcaagagaagcctccgcaataagaagttggcataccccaactagagacccctattctctgcaactagagaaaagcccatgcagcaacaaagacccagcacagccaaaaaaacaaagaaacgaggttttagttttattagaataaagcatggtacaaaagaaacagcaacaattccatttctcttttgcagaaagcaatgcttccatgtgcgg

SEQ ID NO: 43618 - DNA, 1077 bp, Bovine  19866881343815
ttacgaaaaagattagaccttaatctccagtctctcaaaataagcctgcaaatagatcaaccctctttccaagaccaatatatagtgcaagcctcatcctaattgctctaattacagaagaacataatgagatacagcagcagatggctacagattaaatttgacagagaagaaattctcctctcttatctttttattgaagaaactttgcccggaaaaagaaaaattattttgttcacaaagccaaatatatatttttaaagtgccattctacttttctatttttatcagtagtacctttccttaaaaaaaaaaaatttttactcatttcatgtagctttcattattatatttagcagataaatttgtacctcttactgaacaaaagatgtgctcatagaaagtttgtccaaagtttatataataaatcatatatttccacaaacttgttctaaaatttctaagatatgttctatcaaatataaaatcagggactgcggttatttgagggtaacaacaagaagtcttcatctaaagcactcttagcccagctttcaaaaggaagtagaatgtcacacttccaactaccatgttaatacccttcaaactcagtgtccaaaagtgaagtcactaccttctccttataaataaatttattttcccaacttttttctctggctaatggtaacaacaagctctaacttgggcactatcttttcaaactcctctcacactgatgtcagtactatcaaatggtatctgatgatgtgcttaagtcgctcagtcatatctgactctttgcaaccccatggattgtagccctgcaggctctttagtccatagggattctccaagcaagaatactggagtgggtttccatgtcctccaccagagatcttcccaacccagggatcgaatccaggccccccacattgcaggtggattctttaccatctaagccaccagggaagcccctgactactggagtgggtagcctatcccttctccagggggttttcccagcccaggaatcaaacagggtctcctgcattgcaggcagattctttacgagctgag

SEQ ID NO: 43619 - DNA, 1737 bp, Bovine  19866881409918
attttttctttggtcgaaatagcggaatatcttaaattgccctgtgactctgatgttcaatggcttagcaatggtaacactgtagtgtgatttttttgaactcaaaacaagattgagatttttctaagaaagaaagcgaccctcaaccactatcatggaatactgagtgactttggaatcagcttttgctgcagacttggtaatatttttttaatgaatccaacctaaaattacaaagtaacacagagcttatatgcagaatttatagtatggtaaagtcatttcagtggcaactaacattgtctgaatcacaaataatggtaagctactttatatacttcccctgctggcaaagctaaaaaaataagaaggtctccattcccatgcatatttgcagtgaatgtattttctgaacttaaactataattccaggaagactttttggaccttggaacaagtgcaaagaaaatttccatattcaaagttatttaagtgtgcaatggaagcatgtccacctaaccttcaattggaagtgattaatctacattgtaatgatgtgctaaaaggcattaaatatcaagagaagaagttattggaattctataggtgccttccaggcaataaatatgcacagttaaaagtatatgcttggggcttccctggtggctcagtgataaggaatctgcctgctgatgtaggagacacaggttccatctctgatccaggaagataaagcccatacacaattattgagcctgtgctctagagtctgggagccaaaactactgagcccatgtgccacagctactgaagcccgcacgctctagagtctgttctccgcaacaagagaagccattgcgatgagaaacccacacaccaggagtagagtagcccttgctctctgaaactagagaaaagcccacacagcagtgaagacccagcacagtcaaaaataaacaaaaagtatttttttttaaatcctatgtttatggattgagatcagtattgccagcacctatctgtgaaagacttttctgaaattgaaatacagttgatttacacattgtgttgctttcaggtgtacagcaaaaagatttggtttaaaattgttttccattatatgttgttgcaagctactgaatatagttccctggctatacagtaaatcctggttgtttatttatacatggtagtgtgtatctattaatcacacattcctaatttatccctcctttgctcctttcctctttggtaagtttctttcccatgtctgtgagtctgtttctgttttgtaaataagttcatttgtactgtttgttagattccacatataagtgataccatatatttgtctaaaaaatagtttcaaaactgaaataggggaaagtctcattgctcatcaccattaacagatgatcatctgtaatcagttttaatttctgaatcccaattaatcaaaatggtgttccctaaataagagtttcattcttttcttcaggagacttgtattgcaaaaaaaaaaaaaaaaaaaaaacctgtagtcagttattattactatcttttgagttttatcaatgaatttgttttctttcttgtcattttagtacctacataatatgcgcacttttgtattttggcccataaagtctaaaatatttaccgtcaggccctttttcttcaaagtctgttaattcctattctacagcagataaaaagaataagaactaaatataaaca

SEQ ID NO: 43620 - DNA, 988 bp, Bovine  19866881443481
tcattgaacgtgaagggtttgtatacagtagttaagaaacactgaaactgggaaaagttaaagaagaaaaaggatttggaagttgtgatcagtgtctcctcacctgcatttggaacagtaattgtcacttaaactctctggaagcttttcatgtttatttgtcatgtacaatacctaatgttaaatgctttgcacagtaccataggaagaccacgtaagtcataattcaattattattgtctaaatatcctgtagcagccacattctaagtcagctctctagggatagtaggggagaggaagggaggtagctcttgtatttgttccctaaactgttaacttagtcacatcctcagactgagaaattgcctggagtagttgtcagaatatgaacttccaggcagtgccccagatgtactatctgagagccaggaatgatttatgattaactcattgaaaaggcatttggaaattggtgaggacataggataacaagagttatttcaaaaacagtttgaaggaagtgcccaaatcataggctttgccaccaaatcactccttgtaaagatcccaccacaactccagtgctatctcagtggtttttcttgtccttgaaatgctaacctagacctgacctggagctgcagaatttcagattagagagacactttaatcttttctaagaagctgagcttgcttcaagctttattaacttagttcatgattatctaaaatagtcttagtcctgtttaccatagacaactctacttctgttagttctgaaatagtgaagccaaatgtcactgggatccagacccaggaggggaactctgcttagatgtcccataggcacctcaaacccagccggtgtgtaactcgtcatcttgcccccgacctgatagtctttctctcattctttcagggtagtaggcactgagtaccttaagagaataaagacacgttcgtctggacatgaggcaaggagagat

SEQ ID NO: 43621 - DNA, 1472 bp, Bovine  19866881550286
ttaactaatagtgaataaaggactcacggtaacctaaattatttcaatgagaaaagtaatagatagctgtgttgaaaaaattccagtagtgcaaaagcatatatggtataaaataaatgctacccttagccgttttcacataatcaccccttgtcatcagtttcttcagtatccttctagagataggctatacatataccaatagcctatgccatatagacggttttgtacctttcaaaagtttgcagtagtaaaatactttagaaaatctggtataattttgtccttttcccctctgccctcctgtcttaacattagagaagagttcccaggtttagaaccatgttcagcagcttgttccattatccgagatattctgtttattggagcaaggcggatcctgttccatcgttcatcagtcgggattggaagcgacacgagcaaaggcacagggaggccctccagcaacttgccgcgtgagtgtcaggcggctccagctgctattcatgtgtttgatagatgcatttttcttcttaaaaagttttgtttattcactctgtattattttaatatgtacagttgtgatgtcatacctagaccagttgagcttaaattctctttcttaacccctttgaccaaaacaatctggattcgggagcaacagttataggtttattggttagtattaggttggtacaaaagtaattgtgatttcagactgtgaattttaaagtattaaaacgaggctcaaacacatctttattaattaaaataggaaccattacagtcaacacatctgtgccaatgagaaatgagttggtttgttcctgtagcataaaaatacatgttttgggatttgatgaattcttggaaagcattttctgccttctgttggttgtggaagcgttttcctggcaaaaagttgtcgagatgcttgaagaagtggtagttggttggagagaggtcaggtaaatatggcaaatgaggtaaaacttcatagcccaatttgttcaacttttggattgctggttgtgaaacttgcagtcaggcattgtggagaattgggtccattctgttgaccaatagtggctgcaggtgttgcagtttttggtgcatttcattgatttgctgagcatacttctcagatgtaatgaatttgctgggattcagaaaaatgtagtggatcagacagacagcagaccaccaaaacaattaccatgaccttttttggtgcacgtttggttttgggaagtgtttttggagcatcttctccgtccaaccactgagctagttgttgccagttgttttataaaatccactttttgtcacgtgtcactgtccgatcgagaagtggttcagtattgtgtagaataagagatgacatttcaaaacgatggtttttttgatttgcagtcagttcatgaggcaccgttatcaagctttttcacattttcaatttgcttcaaatgcca

SEQ ID NO: 43622 - DNA, 1056 bp, Bovine  19866881730945
tatgacatgggaaaattttatgaaattcaaatttcaatgccctaaataaggttttattggaacacagggcatgctcctttgtttacatattgtcgaagaccgccttcaccctgcagcggcagtgctgaggaactacaagcccagactgtaaggtccaaaaagcctaaaacatttaccagctagccatttacagaaaatgtttgtgacctctggtttaaaccttccaattaatataaaatatgagtcatcataagggcccagaaacacaatgtgagtttgaaaaagaataatttacacatatactaattctagtccatggaacggtctcaacattcatcccagcactgagaggaaacctaatgtgaagttctacccagctgcaatgttcctggagtgagaatgttcactgctgtagctctagtcagatgattggtgattactttcatagatttccaggcctggtttttggtgtactctgcatcaacaagttttgggtttttccgagatagaagaatgagaggatctcgttctggacttgtcctataaaagaaacacatgacatagaactacgtctcctacaccataagaccactcccaatagctgaaaggtaagcagtaatcggacccaacacgatgaccatatgcacagatgaacaactcacgggttatttaatagaagaggagggggatactagatcctacagcatctaggtggtcctggctgtttgccactgtacccttcagggcaggggagtatttggccctctctgcttgcatctagtctttaggattatgttatactacagccacatcccagggaattatttcccttttagaagcttcatgtaacctctaatcactggtactcatagctgtgtaactaggtaatcaccactcaccaaaacagctacatgacctttgttgggtgtgctctgtaaaacccagtataatatttaaattaaaaagaaaaccaaagggctcaaacacctgaaaacttattgtagaaaaagtcctagttatggttctagtaccagacgatgttgacatttgaggggt

SEQ ID NO: 43623 - DNA, 1482 bp, Bovine  19866880372438
ttcgtaggggtattatttacagtagccaaggtagaagccactcaagcaagtgtctatcaacagatgaatggataagtaaaacgtagtatgtacgcataacttaacattatgctcggtgaagtaagccaggcacaaatagagcaaatactgtatgattccacttccatgggattacaaagagctggacacagctgaacgactaacactttcacttttcactttccacttatatgaggtaccgaggcaccttccccatttcagtgaattatgtcatcatccaaccagttgcttaagcttgaaatctgggcatcttccttgagctcttgatttttcttaccacctcctacatttaatccaaagtaacagagcctctgtctgtccactcaaagacttgtatacagatgattgtagcagaacttcagacacattatgataagagaaagaaaccaggcataaaaaattacatactgtatgattccatttatttgaaatatttagaaaaggcagatctgtagagacaaacaacagatcaggagttgcctgacgttgggggtgagagcagggattaggcataagggaactttctgaggtgatgaagatatcctaaagctggattatggcaatggttgcaagaatctgtggagtctctaaaaatccctgacttatacactttcaaaaagttagccaggaaagcctggctggctacagtccatgggatcacaaagagctggacacttcttagcgactgaacaacaacaacaacaacaacaaagttagcatcttatttggaaagtaacttagatattttgtaatgagtcaaatagattttttatgggcaggatgcaaagaaacatggctgcttgtatcaggaaagagatttgaaagaagggtccacacaaaattaacaaggcccatgcactccacttcctaactgttctccccactggcccttctctttaattctctctgacattacaatttaaatgttttgatcagactcttcttactgtaaatcattctgttacttcaagttaggaacaaaaaaaggaaaagaaaatgtcttgtttatccccttccccagcctgtattgataggaacagcaagctcaaactgtgtgggaaatttcctgccttaagatttatttactctctaaagaaaagctactttgatttcattatttttttaagcatacatgggttttaatttggtgagaaaatatccttgccattaagaagattctgcctcattacctcttataaaaaagccctcctccccaaatttgcagaactaaaggaagcataaattaaaacaacattggtgtttgtcgctttgatcaacaaacacccatctccaaaagaaaaaaaaaaaaacctgcaaaccaagccagattcaaaaacagtccattcccaaagtcaaagcagtcaatataaacagcttagtctcccaactggataagaaagaggaaaaaaaatgggggagggg

SEQ ID NO: 43624 - DNA, 1610 bp, Bovine  19866880404322
tctgactctttgcgtctcctggactgtagcccatcagactcttctgtccctggaattctccaggcaagaatactggagtgggttgccatgccctcttccaggagatctccccaacccaggggttcaataggatgtattcaataaagttgatgtctatcaactatccatcctttggggccaagtttaaatcccatctcctctaagccttttctgatctctcataaatatcccctgactctcttgcacctgcaatctgtcctttaagaagtgtcccctcacccgccccccgccgcattgtgggggaagcaaatgaataaaatactacataaactgtgaaatgacattacagcaataataaactaaatagataatttaccagatagatagtttattattgttatactacttgaacacaatgcttgtggttatcacactctgtctttcggcacagctatttaagtctgtgcctgttccctgcccacagtcccaccttatccccagcttgggctgtgaactctgaagagaggaactgactccatctttacttagcccagaatgcctccccagaggtttgcacacaggacctcctcgtgctggttcattcattcagccaagattcactgagtatctactgtgtgccaggtatggggctaaaagctgaggggacaatgatgaacaccacaggcacaacagccctatttaagtcccagtttgtagaattaaatctcctctctgctactctactatttgccaatattttcagtaagatgagaatgaaatgaggcctaggaaataaccgatttcttatattaaaaaggaagtcaagaaaagctcatttgtacagttgatatgatgtttttctcatgactgatttaaggtgaaagtaaacgttaccagaaagaatggcctaaagagtttcattgtcgttcactgttctgataaactatttctataaccctttgtatttaaagagtttctcataatctcttgactttgaacagagctttgaggcttaaagtgcttacttttaaaaaaatttatgttttttaattgaaggataattgctttatagaattttgcttactttaaaaaagttagtaaagataattatgtataaaactgaaaaaagttggggctgggatgattttttggaatggtatggcttctcaggtggctcagatggtaacagaatccacctgcgatacaggagacataagagacgcaagttcaatgcctggcttgagaagatcccctagagaaggaaatggcaacccactccagttttcttgcttgggaaatctcatgtacaaaagagcctggcaggctacagtccatgtggttgcaaagagttggacatgactgagggactaacgctttcattttcactttttttaccaaccattagttgggtacttgttttgattctcaaatctctctagactctctgattgattcatgctctcttcagatttcctcactggagatgacttttagacctttcctctaacactaatcttttgcataagccttcaccctatattttcagtttcttttttcctcttcctcgtttttcctccaaatacccctcctccatcatgaaactgccttat

SEQ ID NO: 43625 - DNA, 975 bp, Bovine  19866880581092
agtctgacaggactgagtgatttcactttcacttttactttcctgcattggagaaggaaatggcaacccactccagtgttcttgcctggagaatcccagggacggggaagcctggtgggctgccgtctctggggtcgcacagagtcggacaccactgaagtgacttagcatagcatagcatagcatatatacatatatgtgtaaatatattatatacagttgtcttcgagtgctgtgctcagtcacctttgactctctgcagctacaggatcccctgggatggataacaaaatctccctgatgctatgtaaaatggcataatatttgcatataacctacttataatgcaaatactatataagtaattgctggtgtgctggcaaattcaagttttgttttttggaactctctggaattttcccgaatattttccattccagtgcaaaaccagaaatgaggcctactatgtgtgtgtatatgtatctatagatacacatatatagatatctatattgacatatgtttctacataaaacacaactttatagatacctatgaatatctctatttctgtaaggatctcatcagataggggcactgagaaagacatccccttaggaaaacaaatgctgctctcttgcatgctaaagaaaaacaaagggggaaggaggggttagaggagtcgcactaaggctttgcggactgaagcggtagtgctaggatccgctggctgcacgtacctggcgcttgtcggcggtgggagatgaccgggacctcatgtggacagggacagcctggacgtctgagcgctccagcaggtcctcagccgacatggacttcgcggccctcccagctgtggccccccacggggagggttcccctggggtaccgttcagtctctgggggccctttgatccattgttagctccactgagcagttctttcggcgcatagtccccgcgggcctttccccaa

SEQ ID NO: 43626 - DNA, 1212 bp, Bovine  19866880704497
aatacttcggtgccaactgagtgccaagtatcattctgggcattttctcacgtaacctttatgctctatgatgtaggacacttatgaagtcttactcttcctcccagccctctccacccatttctcttgtccctccatctaatctgtgtggttaatttcttatctatcttttctagtgatttgttatgcaaatacaaacagaaacagatctctttcactcccttcacaataggaaagttatgtggtgctctgctgctgctttttagttgctcagtcatgccgactctttgcgaccctatagactgtagcccaccagacacctctgccaggcaagaatactggggtgggctgccatttcctatgccagtggacctttctgccccagtggatctttccgccccagggatcgaacctgtgtctcctgcagctcctgcattggcaggcggattctttaccactgagccactgcaatttggtagttattgctaaattgctccttttatgctttaaaggggagacaaataacatgaataattaaatgtcactgtgcaagtgattcttagaggagatcatatcttctttagtatagaagaatagattatttgtatttgaacaaaaatgccttttcaggcatttccagtttatgggaaaatgatgtacctcaaacacgaaacccatcatcttccaaaatgttaaaaaaaaaaaaaaaaaggtggtaattgttctttggcaaaggcactgcttttgagatatcctttagcccttttcagcatccctcacctctagtttctgtgactaccgggctcctcaaagctatacttgagattttttggattcaaagaaaaatctaacaagcaaacctttccaaggctttcataattgcctaacctctgtgtctttaaaaagtggctcagtgggtagaaaggtatgcgttaggtaatataaccccatagcaacacacagtcctttctggaaggagaagttcttttttaaatgtcacatcctgataatatgccctggggacttttggctttggcaactgaatcacaagtaaaaggtgaagtctaacatctaaaatttgcataaaaagtaaaagcaggatcttttcttgtaagaagctttaccccattcttccccacctgttccaacatcctctcatactagttttatgtcctcctcacccttcattttgaaacatttttaagcttaaat

SEQ ID NO: 43627 - DNA, 2597 bp, Bovine  19866880785809
cctcctagtttctgtgagaaactgttgcttgcaaaaactatagctaattaaaaattgaacttattcagctgcccagaaacccgagtggggactggcaaggggcgggaggaagagcggacaggggcgccctatgagtgacgcccccagcgccattcattctatcgtccttcccttccatttaaccgtcttcgcatcgtggttctgtggggaccggcaggagagggcttacccgttgccacgagctctgtttgcaacagcgagccagcttctgcagagcgcgggccccgattgcccggggccggcgtgcccgcggccactccagaaaccggttctgggctctggccgcgtgtccttcccctgacatcagggtgcccgccgctgtcaggcaggccggccggcgattggctgggaggagggcagtaatccgaactgccttttgtacttggctaatcagggcagccgcctgattgcaggttcccagcggaggtgcctgggtggtgtctgacacctgtgtcttagctctcgccttcgccttcccggagctgcttccccgggattctttccgggccggattcgtgtctctatgtcacctccccgcggcccctgagccccctcgggccgccggcttggccccgtgtcatgctggacgaagatgtccaacagataatcaaggacagtggaaatgccggcttagacttccttaaggtaagtcctttttaaaccaggtatttctcgaccggatttctccatttaattcgacataaatgcttgtatcgggcaggtaaactaaagaaggtctggggagttgtttcagtttaggctcttatggtgaaatttgtaagtgatttgagtgtcagatgtgctggcaaaatgataccaaggcagaaataaagatgttcatggtgagggggtgggtacttgacaaaccactgtcacccttgcaggcagctggcacctcactgtgcactccttcctatttgatgaggcgctccagtgatggtagaataaagtaacttttcatcaaggccaacaaatgtatatgcttgtgccataggctcctcccaaccgtgcaatcctaggagctatcatttaattctcattcccacttctttttaaagctgtctttaactttttcctcttgtgataggaaagcagtttttctttttaaggcttgctcagcacggaggagttagtgactttcactccagcatggggtttgattgtactgcttggctcacttcccctcacctttattttccagagcaagtcaaattctagacagaaggacttaactttgagtcacagtgagatgctttggaatattaagccatgattctgattaagcttaagctctgctatgacttcattttatgtacatttatgttgatcgacagatacttcgggtccatcctgtcttcctcttggattggtgtcagcatactcttattgtagggtttagtaacccaaggttcgtaaaatgactagtggtgtggacaaacgcttacacccttgcctgcttgttgtgataaggaagaaaatttttatttttttttaatgaaaactttctgtatatgggtgaagatccatttataaatccaaagaggttctgaggctactttccccaccatattaatttcaaagataggaggaagctgttccccacttctaaatgattccatttaaccagtaaacaggaatagaacagacagaggtggtgaaaagcaaggcgataaacattcagaaaccacgtactcaagatctatgttaatcatcctgaaatatgttttttttctttcattatttataggcagtcggaagtctccatctttctcagctgttagctaactattctttataaagacattttcctgtaataagatcagtgtatttgtaatactaaatataaatactaaaaatgctgctctgatgaatagaagcatcagaaatgacattgcccatgggttgaaatgtgatcatcatgcaagtctacagaatcatttaaaatataatgtatgtgccccatagtacagatggttgctgatgattgaaaaatcagatcagttggtaggtagatattaagtgaattataaatattgaagggattaaaggacaagtaaatgtggaaagttaaataaatactgaatatttagcattgagttcaagttcaaaatgctaccttcacctatgaattacaaactagagaatgtataaatcaaagttggtttcctggtttaaggataagtcattgctgtatagggagggataaataccatctcaaccctaatcactatcttaaaaattttcactgtccataataacctcagagtcataaaaagaaacagaaaggaagagagagctaatttcaaaacctctcagtcagttcactcgttcagtcgtgtccgactctttgcgaccccatgaactgcagcacgtcaggcctccctgtccatcaccaactctcggagtccacccaaatccatgtccatcgagtcagtgatgccatccaaccatctcatcctctgtcatccccttctcctcctgccctcaatctttcccagcatcagggtcttttcaaatgagtcaactcttcgcatcag

SEQ ID NO: 43628 - DNA, 871 bp, Bovine  19866880805688
ttcaatttctatgtcagatactaacttctgggggaaagtcagtcatttctatcatttttttgtgcattttggttaaaacccatcctattcaaaacttctctcctccctgtatttttttcaggatgtggcaactggttcaagggaagatcgcggtcacctgatgttggaggacagcctggcctatttttttaattattattaaagtagagtggttgataacatattattaaagtatgttgtccaagctctgctggacagcaaaatgactcagttacacacacatatacattctttctttattgtctcatcgattacggtttgttgtaggatattgaatatagttccctgtgctacacagtaggaccttgttgtcatactgtttatctaaaatcattattatgactttctaaaaaaacttatatttacaaaaggtttaacaataattctcttgaactattcatcaaagaggattatacttctaacctcatgccctgctgatactgtctgtcagcaagactcagtgaaagatgaagcttattattttaaacccttggaccaatactggagcagctgaagaggtcactggcgttgtttgttcaatttcacctgcagagactttacttattccaagaatgtgatggtcaacaagttaaatgacttcaggtaatgtaccttgtacaactgggtgggaaatccctaacgctaacaaggggagaaggcgattatacatctggaaaattagaaggcttcttcccttctcaacttctaaatgcatccacacctttaggattaaactaactttcctcctacgaccatgtaaggagttggttttttaaacatttatagtcttttacatttcaatacatttagc

SEQ ID NO: 43629 - DNA, 1075 bp, Bovine  19866880810144
tttgtttcttctttgggcttgctcccacccacctctggctcttcttgctttttagtacctctaccactgattggggggaaggagcaggaaagaaaaagagaaaggggatgaaaagcaattagccctttggacagaataaagggggaaatgctaaaattaagtttatggattacctgtggatttaattttcttgttttctacgtgactcctgttatcataaataattgagagttttatcaagagcaacatcattgtcttcatcaggaacctgtacgtatgacctgattttacactatcaaaaactgacctataacccaccagaaaccattatatacccatattaaaagcagaaacaaatgactacccttgaagtgtccccagagttactgatatgacatgtggatgagatgtttttcccagaaagaatgtatatcaacctgattacaagccagattcctatctgattcttgggattttgctaaatgtagtaaactctccttttcttgtcatctcccgtatttccctgttgctatttcaaaagttttgccctttgaattaattttcatctttatacttcaaatatagcagttgtttctgaactctgaaggtaattgttatcagacttctcttgtttagaaaatgtcttggttaagagaggcacccagtgagatagactgaggttctaccacttgtgaccttggaaaagttaacctcttgggtgtgtgtcctcatcaatgcattggggttaacagtacttcctgaggctttgaggataaaatgggttagtatgtaacaatgccgccatgagcctgacagtaaagagtggaccaccaataaatgttcatctcctttacacctccacccccttggtaaatttaaacaccgtttgttggtactaacgctgtgcctctcttctgttttaaggatgtgcttttgggggaaaacagtagctttggtctcatgaaggatccgtgttatttgactggcccaggttccaggtatgtgtctatagttatgatgctctttgcctcatgaatgctgcggagttaaatgcttctgttcatctctactagaa

SEQ ID NO: 43630 - DNA, 2902 bp, Bovine  19866880943648
aatggcaacccactccagtatgcttgcctggagaatcccatgaacagaggagcctggtggactacatccatggggtcacaaagagtgagacaccactgagcgcgcactgtatttcttttacagatgaggactaaggggtaacctaaggtcataaaggaggtcaaatggcagagctgatacccaaagattcttccagcagtctggctctagagcccacattcttaaccaaaatgctgcatacagtcctccatccaagtggtctgcagggaccacatcagcagctgggtgaatctagatacgtagtgcagactacactaggctattctatataaggggcttgagcatccgcatatttggggatccacggggatcccggaaccagtccccacggacaccaagggacaactgtactagtatctctcagtggagagaaaacaacacaaaaaggaagggggtcatagatgtatttagaaacagacaggcctgggaaaaaaagactgatttggaagcatcctaagggaaatcagcctatcaagcagctgaagtcctaatggcctcaaaaccagttcccagagagtacagtcccagagctggggccaccagagagcagcacagaaggtctttgagaaggtcaccacccatcccttatctggtgatgaggctacttggaagttcactgtgaaagaacaggcacagtcacactctcagccttcagttcatcctggctgaacactttctccctctctcttcagtttacaaaatccagcaggaatcacagaaatcaaactgaccgagagaaatcactaccgacagggagacaattttacgaaataaggacacgtggctgtccagaagacgccctgactaggaaggggaacgtattagtcactcagttgtgtccaactctttgcaaccccatggactgtagcccgccaggctcctccatccgtggtattctccaggcaagaatagtggagtgggttgccatttccttctccaggggatcttcccaacccagggatcaaagccagtctcctacactgcaggtagattctttactgtctgagccaccaggtatggtgaaatctcgctattgaacaccaccactggcccttcctaggcgagggttgacttcccccatcccctccagcttggccatgtgaccagcagagcccctctctgcagaagactatccacctcccatcctgctgaatttagaaatgaccatttattttggccagtgaggttcacagtggaaagtgactcatctaagagcctggaaagtcagttcagggttcagcctgcctctttctcctctgctgccagactggcaacgtcccagcggagaggacaggacactccctcagctgggtccaagggtcagttcagcatggagtggatctcagaggaaggaacagacagggagtctgcgtgagaaacaaacctctgctgggtaagccaccagatcttgggagcagtttgtttacctcaacagaactgagtctccctgaccaacaggtgtatgcatgttggttaacagccatgggttccaaagccaagttgtcccactaactggttgtaccagatcaggtgagtgatgacttctttgtgcctcagtttccttgactacattatttcttaggaattgaggattaaaaaagaactgtcttgacaataatttaaacagaaaacactttaaaaagtcaagatgctacacaggtttcctgtacagagaagttgtgagttaagccttttccttgcaacagcaggtctgagtaaatttaatgggcacccttaaagagattcatgaagtttatactggcatgaaaatggtacacaaagggagatgaatgaaaaaggattaagtcttaggaggactctgggttttttttattttattttagttctaccaatttattgctaccaacccataaccctccactctcatgcacacatgctcagtcatgtaaccccatggactgcagcctggcaggctcctctgtccatggacttttccaggcaagaataccggagtgggttaggaccctggtttttaagacgtgggtcgggaagatctcctggagaaggaaatggtaacccactccagtattcttgcctggacaatcccatgaatggaggagcctcgtaggctacatacagtccatggggtcgcaaagagtctgacatgactgagcaacttcactttctttctttcctgtcttcataggatccaatgggtttttagttttctttatggacaacacacaatctgaggcgggaggagtcccagcattctccccaccccaccctttgggactcagttgcttcaggtctaagactttagttctgccttttgaggaagagctcaatacagataactagacaggggaagacctggtgattctgttactggatccctccccctctccctgcccttcctcaggcttcctctgttctttaagggctagatttggccacgaaaggaatcaactcccctgaaccttccctgaaacctgaagaattagtgttctgaagattttcagtgtcttctatcaacccagtgcaagaatctgggatactgtaagttgtggggcggcaggatagcatcgaaaatactggaaatgctgtgtagtcaataccatgtcccaaagaatgtaccacaaacgtgatgtgatctctttccatcacctccccagcctcctatctgtctaccaatcccccatcttgaatgctgatgcccctgctacactggatttaagaggctctgcctcacctcagagctttgcacacactgttcccttggcttggaacacttttccccacctcgctttccttgataaatcctagtgcttattcatctgttagataaatttgatgagagcagcaggaacagcatctcaag

SEQ ID NO: 43631 - DNA, 1442 bp, Bovine  19866880963563
actctcctgaagctatgttttatttggcccacagaatggtggtgctttttttacttgaattcattttcaacattgaaaactggaaattttcatgcgaaaattccagatggcctttttttttttttttttaagaagttggagctcaaggaacagtgagcccactttctgcaaggcccaggcacttactccaatcccccaggttcagcttagtccatttgccttctcggttctataggaaccagagtcatgacacctgtttcacccaagctgccattttgagacaccttgtcagactgttcaaacaatttcttatctgggttacacataccaaatatgtctggcacttgtttcctagcagttgaaaataatgagccagattttcaaataggtgagctacttcctggcattaattctggccatttaaaagagtgttttctctgtaagcccttagttaccatgtgggatgctcagcatacacataatttcaaaaattactcttttcttaatgggtttgcttagtcatcaggaaattttgacttcttaagtaaatgaaacatttggtatttgtgaagtcaaagaatttatttaggatagccaccttgtcatctgaagaacttatattatggactgcattgtggctccacccccctacccccaaaattcatatattgaagtcctaaccctcaatatctcagaatgtgactatatttggcaatagggcctttaaatatatacttaagttaaaatgagaccattaaagtgagccccaatccaacctgactcctgtccttataagaagaatttggacatgcaaagaagcactaagggataacacagaggaaagaccacacgaggacacaatggaaaggtggcctcctgcaagctaaggagagaggcctcaggagaaaacaaatgtgttgacatcttattcttgaacctctagcacccagaactgagaatattcatttctgttgcttaagacaagtatttcgttacagcaaccctagctaactaatagagcttcctaagtcatatttcttgagaggaacctctgtttcaccttatgaaatgtatgcaatacattgttgattgataattcctcttgagtttatgcaactagaagcccaagttgactgatggctgtgattccttagctgcacataagaatcatctgtggatcctttataactaactacaggatcatcgccccaaattctgacttgttggtttgggggttggtcctggccctctggttttataagcctcccaagcggtttgcaggtacagactaaagtgaaaattaactgatttagagggaatgatcccccctcctaaagaagggcctgggtttctgcagttctcccctggggagtccacagctgaccatgccatccaaaggtaggcaggatagatttactgcctgtataacaagacctctgggg

SEQ ID NO: 43632 - DNA, 1116 bp, Bovine  19866881035960
aatgaatcaacattaagggcttctctttctctctcccaaccagatttgtccttcctctgatcaaaagcacagagctggatctgaaatgtgttaagatcctgtcctacttaaggtccccaaatgacaggctctgactggtttctcctctctggtaccagcctctccctggagtatatttccaccttccctgctactcagttcacccctgtctgcctatttgtttgtttaaaatgtgaaccaactggtcaagtacagtaatctaattctgcatttggtctgaggccaacgcattgagggcattcaataaataatggtgctcggtgtgcatttcctagatcctggctatgtaggtctgagatggcactgggatcccaggtggccagcttgagagaggtggtggatgaagggtggtaggagtctggaggccacgaaggcaaatgtgttcggattgtctgacacagagattatacacctgtggggcttgccgaagtgaaacctacacatgcaaatattattctactgagtcggttagggtgtgaccttcttcctgacatgattttcccagattcaatctgggtaaaagtacatcaaggccttactccctatgagcacacagaccagtgtttacttgtcttcattaagggaattctctttcctgtgagtgggtggttctgggaggggcaaggcaggattatctgggcagtcccaaaggaggaagagcatgaagaagacagaaaatcctcagaatagaatttccttgacaatgtaggtccacctaatccattcattcttcttatctatctaccaagagattggtggtgaagctataaagatgaatgacataagtcctcctggttcaagggagacactcaagaaatatttatggaattaatgatttaagaatatgcattagttttactttgattaccatttcctactggagaactttctgtatgccacatgttatcagcccatagttaacagaggcatcacagcactgtgtaaaaaggatcttccagcatatcccctacattcttgaatttagatcccaaattgccttatttttaatgttcttccctatgtcttctcccaatctccatttatgatttctactga

SEQ ID NO: 43633 - DNA, 958 bp, Bovine  19866881040674
tgcatgtggaaaatagggaatctattgaaaatatctgcactttgctcttaattttgctgtgaacctaaaacagcttccctggtggctcagatggtaaagaatctgcctacaatgcgggagacctggtttgatccttgagttggaaagatcccctggaagagggcatggcaacccactccaggactcctgtctggagaaccctcatggacagagaagcctggtgggccatagaccatggggttgcaaagagttggacatgactgagcgactaagcacacacaaaactgtaaaaaatagtctttaaaataaaacaccaaattacaccaaaagcagaggtcccctggggcctctggacaaaggtgatcttaggggagagtggacggcacctagagcagcagtgagtaccttactgtccagcttcttcatggtgaccaggtccagggacttgagcgaatggccagtgggggcaatgaagtagagacatgcgtggatcctggtgtcatggtagttgaagagagaacgtttgatcttcagttcctcttgcaagtaggcctcaaactgggcatcgatatattccacgatcggcttgtagctagaaggcagaagacggttattaaaacacatttttaaatcagcatgtcgctagtctcaaactctttgtacagtcctccaggaaagtccttagtggttccctgttctctaagagctaaagtccaagctccttaccttggcagcccagacctttggccatatgacccctaaacatcaccccaggctcccctatccttctccttcctagttcatgctttctgccccgcatggcaagctcccgcctgcctccaggcctttgctcatgctagatccccacctggaatggtcttcttcctcttaatctcctggctaacattcatccttttaaaacagcaattagaaatatgtaggatacactgtcactgcc

SEQ ID NO: 43634 - DNA, 726 bp, Bovine  19866881123166
gcccggccccgccggcgatgccccgcgccgcctcctccgagcggcggcgaggtttgaacttggcgtcggccccgagccccgcgcggccccggggggcgaccgcggcccggcgagcggcgatggtgagtgtgggactcgggtccgctttccccgggcggggcggagggaaggcgggtacccagccttctgctctctaaagggtgtctatttcggtccccgcggcgactctgaagaaccctctctgcaaggataagtcctcgggcgggctttctctgccagcggccggcctgatgggggtaggtggcgccctccgagggtcctcctgacactcctggaccttggccttttttttttttaaataattttattagggaggcagaaactgctactccaagaggaaaagaattgcagattattgacagcatgaaaacttttcaggagaaatgatctgtgaaatattttaattttgataaattgcttcttacgagggctcctactgagtttagaacgactggcctttcttggttttactggatttgtttctgtaggaaagatcccaagagtgcctttgaggcgcatgcctgcccctccccccttgcacttgttccacctcttaaggcagtttctttttaaaggtgtgtcccactgtcatgttgcaggaattaaatcacgaaaatgaaatgatacctgacacacgctttactgtgagctgccagagagaggaaa

SEQ ID NO: 43635 - DNA, 3532 bp, Bovine  19866881192362
aaactaggaggagtggagggaaactcaacagaaaggactttctattgtcattgtttccgaagcataacgttcaatactgttcaaccctggcagacaaaaatttataaaaggccgttctcataaaaaaacaaagcaacagcagtcaatgtagtacactggagtgccacgcggctcacctttgtgtgtgcaatcttggcaaaaagaatttcacttaaacagatcatctgagcctctgaagcagcaggcctctgcagctgtatggagaagcagtgcttgattcaagtttcggtatttgccccagactgtaggggtcagcttaacagtaaccatagacacaaagagagagaaaaggaatagggcacacagaaagagaaagactccaagtgtgtctgcattcgtggctatgcaaatgcattttcattagtttacggccgccatgtgggaaaaaacaaaccatggatccacatgtaatctgcaaacctccttgctacagaaactttaaaagacgtccggattctttttttagatgtggaaagaaagaaggaaagggagcatacacgcacgcatgcacacgcacgcgcacacacacacaccccattctgacatcacagggggcattatactctaaacacagtagtcatctctactccagacaccaagaaagtctgaagcatccttgaggatgtcagtacatttcaaaggtgagactaactgtatttagagattgttcctgtattaactagcaggactgtccctccagaatgctccacttgaattccagagctatttctattcctataatatgaaatctaaggaaacaggattgaggcaggtgtgagatgggaacagaggtgggagtgggacagagaaccctctttcaggagagaaagctcctctagatcttacaccttggatgcattcctttgaaagtaaccttttttttctttgcagaagacaaaattctttttatcttctttaaaaacctttaattttattttggactatagctgattaacaacgttgtgatcgtttcaggtggacagcaaagggactcagctatacataaacatgtatccattctccttcaaactcacctctcacataacaggttgccacgtaacactgagcagagttccctgtgctatatagtaggtccttgttggttatccgttttaaatgtagcagggtgtacatgtccatcccaaactccctaactgtcccttccttccacactctccctcttccccaggaaggcaaaattcttatcccagtttcatgttttcttcctcgaccccacagcctccccagacaccacagctactctctatcacagctactctcaccaaaccagagttcaagggcagccaggccacaaaattcattttgaatgtgtcaaatttaacaacctgctactgctgcccaggcactggtctttccagtgcacatgacaaaatggttctacttgacatgtgtttttcacaaccagccatctagtacgggaatgccatgccctccaccagtggaacattcccactgatataaaagagccaggagtccaccccctcttcatttcaccagtaatttttttagtctagttctgcacaacctaagctcactttaaacctactcccattcaagctgcctgtgacaatatgctcaacagattagtggctccaggaattatgtcattgcatatgtcctcctgggtgacacgttacattaggagagatgatatcattacgtagttctttagagaaactaaaaagagcaggcaagtaaagagaaaagattgtactgaagcaatcaaatcacctgtccgttcacaaattatgagatggataagggaaccattgttatatttacaaagaatgaatacctatgtagtattacactgaaccatacaaaactatcagtatttgacaatttttggtagactacgacggcaatttcatgtgattcaacctgtagcggaactatagtcaaatactatataactaggacttaattctgtgacaatgggtgctatgttgtattctctaaccatcgcaattctataatgtaacactgtgattaccgttacagttttacagatgaggcaagggaagcttggggaggctaagtaatgcattgaacacctcacagctagcaagcattggagtggggattcaaaccctgatcatctgctcacagagcctatactttgaaccaccccccatctccccattacgaaggaaaatttgaattctgactgtggcattcactagctttgtgactctgggcagattattacaaaacttctctaagactcagttttctctcctctgaaatgggattgacaagaaacttaccggatatgaggacagaacgtgctgacgtaagcaaagcacgtagcctagaggaagagctcaaatgttacctccttgtggtggaagggacaggacagtcactctgccaccttcaccaggacctgaactgacagcgcacggcgtgttctcatcacccttcggtggcgcagcggccactcacgggcagaaggacagtgcagcctgcgtgctcgcgtctggaagcgccgctcttcggattcagtgatggttactctggcaaagaggaagtccttcacgctggactgtgcagcagccccccaccacccccaatctggaagagagactctccacgccatgttggtcccccagatctgactctcagccccgtcttgtatttcctgctccctctacttcagatttctactgaaaatctgcaacactttcaccgacaccttagacttctcatttatcctctcttagcttctttagcaatcagctgtagagggctaggcaatccatgctgaaaagtactgatgatccaacctgaaagtggagctgtagaacccgggaggcgggaggcttgacttttggctctgccacttaccctgctaagtgaccctgaacgagtcattttttatttctgggttctagtcttcactaacctagaacattgctaagtttcttcccagtactaatatttgtggtgaggaggaaaaaaagaatatactagatgagtttttgaagaaacgtgagttttcctttttccttttctccaagagctaatagctcatcttctcaggcacatcctgtttccttctgattaccttttaaacacccacaggcaggaggattttctgtcactctgttgataaacttcagacctagatatttaatagatggccttgatttcagaacagcagactgccatggtatttgtccttaatgattcatacatgtccttgtagggtactcgtttgtggttagagatgggggtctatggagagaaagcctcactaaagtaatgaaaaaaatgtagttttcttattttcaacttctttgggtctgcatctgtgcttaacagttacactgttctccagtagttgcaaggtagactcatccactatgtcaggtagatttgacgcctattgggcacttacttgcctatacttttaaggcacagcccagaagctcaaagttctttcacggag

SEQ ID NO: 43636 - DNA, 910 bp, Bovine  19866881279575
aatccaatattagatttggacccattctaacaacctcattttaacttaatcacctctttaaagattctatgttcaaatacggtcatactctgaactgggagttagagcttcactatgaatgggggtcagtacaattcagcccacaacatgctttttgcaccatagacagtaagaacttagtcaaaggaccagaatttactccagaatcatagaagggggccaaaaggagttgtgaaaccagtggtaaaatttgtttgaatatctcctgtgatacttatatcaatcatataaaagatatctgagtttatggagaaactcagatttctgtggatagataattgtttggtttaagcatttggtccataatttttgatttgggaagtgggattggagtgtcaaatacggaaatagaatctacactgattatgtcagcagaggaaatttaatacagggaaaagcatgaagagatttactactctctggtcctgaggagcaatttaacatgggatcattcgtgagggagccacatgtgatgttcatggggtgttctgtgggatatcaagatggtcaagacttctggggaccgtggagagatgatgtgcatagagcagaagggttgacatagccttgaggcaagacagtgaatgtatactgttgtccctcttagtagaaagaattagtagaaagcaagagacttgtgttccttgataattgtttgaagggaaaaaattagatcaagagctgtgtaccagatgctagatacttgtgttaatttgctcaagtgaagttaccatgtcaggaacagcaatgacaatcagcattgcctgatagagtttaaaataatctataagcattatccaacatgagtacatcttctgcgttacccaacatgagtacgtcttctgcacag

SEQ ID NO: 43637 - DNA, 1428 bp, Bovine  19866881341357
ctagcagtaatttctccaaagtataaagtgtaatcaaatcttacatatacatggacacagtttaccatcaaagaaagtttttgagggaagcctccctgattactttactttcttctagtgttacaaaagctaatctggatctagagtgggtacctaaatcctgcagtggaggaggaggtagtaaacctttcaaggatctgaaagaattcagaaacttgactccatcggggcagcagtaaggaagggaggaggagagctgctgaaaaaaatcctagtctttaaggggctagccttccacttcaaagactcactgatgtaaagaaatactctacaatatttcatctctttaattatcaagacactcttaagaaccctcaatatttggtaccttaggagtcattactcagacacttatgaaaattaagcattattttttccacacaattcctatcttacagatggatcatggatacatattgtggaaaagtagtatattagaaggataatagaatacacaatacacctataatacatctaaatatctaggtccacaggtttcttttttctatattattaaaaaaataaattgataaagtgatttttttaaaacaaactttccagaataaagttccttagtgtccccttcttttgaagagttgggtggaattctaagttgagtgaacctaatagaagtagaccatcaagaacaagacaaaaaactgtcctcatctagtttgcactgaagcactgtgctctgctacattcacccacaaaagagagtgacgtggacatttgggaacacagtcaaggaagagagaccttaacagcctagatctctggatcatgacatggaaataacaggtgaaggaattcagttcagttcagttcagtcgctcagtcgtattccactctttgcgaccacatgaaccgcagcatgccaggcctccctgtccatcccggagtctacccaaacccacgtccattcagtcagtgatgccatccgactatcttatcctctgtcatccccttctcctcctgccctcaatcttccccagcatcagggccttttcaaatgagtcagctctttgcatcaggtggccaaagtattggagtttcagcttcaacatcagtccttccaatgaacacccaggactgatctcctttaggatggactggttggatctccttgcagtccaagggactctcaaggagtcttctccagcaccacagttcaaaagcatcaattcttcggcactcagctttctttatagtccaactctcacatccatacatgaccagtggaaaaaccattagtattgactagacggacctttgttgacaaagtaatgtctctgctttttaaatatgctgtctaggttgatcattaactaaagactaactaacctagaaaagatttggcagaaaaat

SEQ ID NO: 43638 - DNA, 1552 bp, Bovine  19866881427174
ttggcatggatccagaaagaggtggctctgatgcctggtcattcaggcaacagaccttgatttctacctcaggccaggcctgagacaacgcaaacttgcttcttagagcactaggattcttttagaaacctgtttcaccttagcaccagttctgtttctctttgttcaacagcagctgcactgatgggctgccaacaggcctgagtcggtagaagaggtattatttagttggaagggagttttctgtcaatctggattaaaacaaactaacaaacccaaaacagaggcggtatcaattatattgcaaagtagttctccttgggaaaaaggatagaagctttagatctactgggtctttgttttaataatggttcagcttggctgaccccgggtgagacagtctaactaaggctatgaaagacagttcccccaaaatgataaaatgcaagagcggtccctaccctgctcctcccccaaccaagtgtaggccctgtaaagataaagagaggcacagaaaactctgtggctggctccacagggagtcaaaacccgagcatcactatcagttgtggtaccatcaatgagtggcaatagacactgagtcttctggtaattaatcaaagcaggccatccaaatcattcattcttttgtctggacacagacatatggtggcccctgtgaaagcactaagcatctgtttccttcactatatgaacctccaattagtcacatagggtcttcccaggcacatagtttggtttatttattttttacatatatcccccctgttttgaatttcctttccatttatgtgaccacagagcactgaacagaatgctatacagtaggttcacattagttatctattttattgttggtgtggtttagttgctcagtcacgtctgactctttttgtgaccccatggactgtagcccgccaggctcctctgtccatgggatttcccaggcaagaatactggagtgggttgccattcctctctccaagggatcttcccaacccggcgatcaaaaaccgtctcctgcactgcaggtagattctttaccacggtgtatatatgtcaatcccaatctcccaattcaacagtttggtttcttagtaacagtttatatggtacgggttatgcttgctggtataaacctcaaaaaatggatgaaaataacactctaagtactgttatatcaggacaatgggattatgagtagctttggtcttttaatcaattacttgggtcaatttttcattgtgatgtagagacatcatttctagatattttaaaagacagaaaaatattccacagctttcaaaagatttactccttctgcaacaaccagagaccttcatgtaggggccacatcctcaagtcataaaaatggcaattttacaacaagggaaaataacttttcactgccagtcctcaccctccggctgaagacagaccatatcttaggaactgcctataataaccctcaaacagataataacactcaaacagataagatccttcaccgcatcaagcttttcactcagca

SEQ ID NO: 43639 - DNA, 1049 bp, Bovine  19866881428627
atcctgtgaaggacacaatctacaagttttgctgctgcctgaaaactatgcagacatcttcatatcagaattcaaggaagtgctgctgttttaaaaaccagcacatttcccacacaaagtgctttaattgctcaaatgttaaagcattctaaaagacgtaccaaaacaaaattttaaaacttgaatgatttctttattcaaatacaagaaaaataaatgaattatttccaatggaaatcagactgcaaactggcaggcacagcccatgaacatgtgtatgtggcccacacagtattttaaaatatttgattcagttgccagcattttcagatgcgaagattgcacctcaaattcttaaatgtccatcttcttttgaaaaattgaaaactatgacatctctaacaccctcatttcaacagctaaaaccaagaggtggcacgtgcttgggcatttatagtaatttaattgaagaatcggagcgttgtcccttttggtactttttttctctcaaataaatgaaccaaacaatgaagctccccatggtcaaagatggtttgatgcaccagtatctgtcccctactatctcaccatgtctcccccttactgtgtctccataccataaataattcactccaggacaaaattgaggcccggtggttcggatggcaaagaatctgcctgcagtgcaggagactcgggttagaactctgggtcaggaagatcccctggagaagggcatggctacccactccaatattcttgcctgggaaatcccatggacagaggaccctagtgggctacagtctatggggtcgcaaagagccggacacaactgagtgactaacactttaaagactgctagactgctagtaaactacagtaaaccatggctcataactattttaaagagaacatgtaaggtaaacttctatttcttattagtgttatggttacattaaatttgacatttttctaatggtaattaagtataagaatgcttgagatctagattatatgaattttctttttcaaggcatgttattgctaga

SEQ ID NO: 43640 - DNA, 861 bp, Bovine  19866882208667
cccggaagagccttcagcagctcctccctgagggcctccatcagtaggggaggaactaaatgaggtttgagccctgagaagcatcatctgactgttgagaggcagtgggtcaaacccaggaccacctagtgacctacagggaggggatgaagagagaaacagcagaaagggaggtgtttcttcaacaactctctcttcgtgctggttatttgtgaagtgttagtcactcagtagtgtccgacttttgcgaccccatgggctgtagcctgccagggtcctctgtccatgggattctccaggtgagaatactggagtgggtagccatttcccttctccaggggatattcccaacccggggatcaaacccaggccttctgtattgcaggcagatgtttttaccatccgagccaccacttcacaggtatttgtgaagtgcatcataaagagaagaattagagctcatctttactaactgttactccacaatagacctccacatgatgctacagagaccacttcatattaatccatttaggtaaaagacttgtaaaagagataaagagatggtgtgttgctaaaatacacttaaagagccagggttcaagttctgactttctactttctaatcttgagcaagtaaattgcttaacctctccaggtctcagtttccttgtctataaaatgggactaggaacagtggctcgctctccctgagtactagataaacgatagctcctgttacattcacagaaacagaaaattgagtccctcctgaacttgcctctccttgagtcctgtctaagacacaaaaggaacaatagaggcattgagctaagaatctaggtcacatcagacctgtgg

SEQ ID NO: 43641 - DNA, 1438 bp, Bovine  19866880382852
catattcttgcctagagaattcatgggtagaggtacagtcccgggggtcacaaagagtcagacacaattgagtgactttcatttttcacttattctttaacaatcatacaattagcatcaatgctacttcacaggaaacttgccccaaaacacaaggatgtggtggagccaggatttgaactccatctgtattaaaccccctgtttctgtgttatactgcatgccacaacattatagaccattcctcagatggcacaggtgcccacaggagctagaaaccatgtctaagcccagtagtactaagcactttgtttacagctgctgttactcaaggaaccaacagaagtgtgcgttgagtgggggtgaggagactaatcagaaggatttctcacctcctttgtagattatagcagcaacttccttatttaaatccatgttataatgttataatccatggtataataatgaagagtgaaaatggaatttgctcatttattatactggttttaatgcgtagtaaaaatttttaatcattcttactcaaaagggaaatgatagtattaacaaaagagaataagagaattcacatattaaatatttttttaaagtctccataagataacttctagcctgtccaagattgcttaataccaattagtaaagaccattaaaaatcatttatggagtttttgtgagtgttcagagaactaatgggttttaaaattgcttgggaatcttcctggggtcaaaggaagaaaataaagtatgaagtgataataaaatgtataaagtgactaatggacaggttgtatatatataagggttccagcaaagaaaaaacattcaatttttacagcatacatttaaacaaatggaaatctcactgccatagcctcttgtcttcactcaagagctaagaaggatgataacattgtgtatcaccacagtccatatcagattctcaaccatttttcagccatcaggtcattggccccagccacctcttcagccactctcacctttagctgacaaaaatcttttgaaaagtagtgagaaaataatgccacatttactggcaccaataaaatgacttgatcttacacagcataaataaataactcaagcacggcttttacatagcaaacattaatactgaaaacagctctccaacagcccatcaaaggatcagctatctctctaagcttttgctacacatgtaagccaacaaaatgacaataaataaatgaaataaaaaggtgcctgatataaaattttgaatcataagagggaaattcagagtaaaagttaatttgaggatttaattttaaatcacacaatagcactcttgacttccccaatagagacacaaacgcaaaatgatgttttatcaaaaataaatgtattagagatacataataatatagataatacagaaaat

SEQ ID NO: 43642 - DNA, 920 bp, Bovine  19866880423974
tttttagccatgagaaaggcattgtgacaggaagagaaaattgatccctgggttgaaatacagagtgaagttgattttactgtctaaacatttctgaaatctgtgctttgctttccatcctcacaaacctgacttcctttctagaccacggttgtcttttgcctaaattatgcaaatatctctaaaatggcatctctgcttctggatttctcctcatctcatccatcctccacattgtagccaaaattgttcttttggaacagattggatcatgtcactcccctgctcaaaacttcaagagcataccttcgttcttggaactaaggccaaattccactctgggtttctaaggctctgcaggactttgtgccagtatttttcactcacctaggccttttccactaactgcctcctgttctagacttccaccatattaaatttcctttagttattcacacatactcttctctttcaccttgtagtctttgtcaaggctgtatcttctgcctgaaacagtcctctatccatcctgtccctcttttatttgattaaatcatttacttccttcaggtctcacctaggacatgatttcactgagggagccttccttgaatcctccaagtttggtaggtactctgtgtgtgtgtgtgtgcgctaagtcacttcagtcatgcttgattctttgcgagcctgtggaccatagctcaccaggttcctctgtcctcgggattctccaggcaagaattctgagtgggttgccattttcttctccaggggaattttcctaacacagggatcaaatctgcatctcttatttctcttgcattgccaggcaagttctttaccaccagcgccacctgggaatgggtactattcttaggtaatcttataacactcttcttcccctcttactctctact

SEQ ID NO: 43643 - DNA, 1571 bp, Bovine  19866880605787
ctccatccctcctggctactgtgggcgtgggtggagcggcaggcgaaatttattcaagacaatagatgtcttgaagttgttgtttagtcccgccgtcctgtccgactcttgcgaccccatggactgcagcccaccaggctcctcggtccatgggatttcccaggcaagagtactggagtgagttgccatttcctactgcagggtatctttccaacccagggatggaacccgcgtctcctacaagtctcggcattggtggctgatcctttctattcaggactgtcatatgaatgtaataatataatacacggccttgagggtttgaaagagggtgggagaacaaacatatacgcagagggaccagttagggactactgaaataactcaaacacgatgacggtggcttagatcagagtggtagcacttgaaagagttgtggacagtagtgaaattctgaatatttactgaatgcagaactagcaaaatttgccagtagattagatgacaagggtccaagataactctaaggtctttctagacctagagaccatttgctgaggtaaggaaggatgtgatagttgcatatttaaaggagagaaatcaagagttgggcatactatgctttggatgtctattagacatctaagttgaaatactgattaggcagtggtgcatatgaatctggaattcaggagaaaggtaagagctggagatagaaaactagatgttatatagaaaactagatgttatagaaaacacaacaccagggccaaatagtagaaagcttctgtgaggaatgtgaaatttatctgtggttatgaggagccttaaagtatttttgagtgttacagcaataatcttatctgtgtttcaggaagttaattctgactgttgggtggacagtggattggataggtgaaacacagccaggctgtggaaaatcttcaaaacagacagggaaacttggatttaaccagataggcaatgggagtcactcctgaagttcttcaatagaaaaagacatgaagacagtggtatttttcctttaaaattatactggaagtgatttacaagaaggattaaagtggtgacaaattggaaactctggtgatttgcctggattttcccttggaattttccttgctggttcgtgaaaatgtcttgctactttttataagagagattcagccccaaatatggaaaatctgactttcttgctttagtctcttcctagtgttgtagttaaaaagagatattacagaggaatgacaggcaaggcctcacctcgtaggatatcagtggtatcagaagactttctcatacactcatcagataccttcacaatttccatttgccgatcaccatgtcagcctctgggggaacaaagaaaaagaaccaatcccagcccaaaaggagtttacagtttagtggggatggccagctgtaaaatataaaagaatcagagcaccatgtgagagagtctatgcagagagtgtctggaggaaggaagtgattcattgccagagaaagttggagtttcacgggggaagataacactgggctacctctgc

SEQ ID NO: 43644 - DNA, 2327 bp, Bovine  19866880631873
tgtagctgaccaggctcctctgtccatgggcttctccaggcaagaatactggagtgggttgccatttccttctccagaaactcacacttagaaatataaataacgataataaccatacaacacagcaaatccactcctcactatttacccttgagaaattttatattcacacaaaagcctgtacattaatgtgtatagcaaattaataattgccaaaactggaaggaattcaatgtccttcaaaggataaacatcctgcagcacatccatataatggaatactacttagcaataaaaagaaataaacaacgaatgtgaaaagccgactcattggaaaagaccctgatgctggaaaagattgaaggcaggaggagaaggggatgacagaggacgagatggttggatggcatcactgactcaagctctgggaaatggtgaaggacagggaagcctggcatgctgcagtccatgaggttgcaaagagtccaacacgcatgagcaactgaacaacaacagcatacaacttggatgaatttcagaggcacaacattaagtgaaaggagagattctgaaaaggtcacatatcatatgattccatttataggacattcttgaaatgataaagctataatgatagagaacagatctgtggctgccaggagttagggatgaggtgaaagtgcctataggggacagtacgaaagagtctgggggcaatggaacagttctgtatactgattgcattgatagttatacaaatctatgcatacattaaaattttgctcaccaaaaggtcaattttactttgttaattcaaaaattaaaataaagtagaggagggggaagtggctgggaaatttcttattcactccctttactttctggtaatagacaatagtttgccaacaacttctagccaggctagattgtctgaccagacatgtattaaattgtctagccacgatgtgtctcttaatcacaccagcacattactgaaggtgttctccaagaattacaaaagaacttccaaaaaatttgccagaataagaactgccaaaaaaaaaaaaaaaaacccactcagagaagccaggttctgttattcttggcaagcttaattgccaaaccaaaccctaccaattacaaggtagtatttacatgggattggaatgattttccttcctaccaagggaatggagcacttacctattgctgatttaaatacgtcaaactgaacattgtttctgttgggaaataaagacctcaatttattgctcaattctgatttcaaagttagctttaccattataaagaccacaaaactaggcatctttttagatacatcatgactacataaagggcaaatttgggggaaaaatgctcagaaaacctgtaccttggtcatgtatacgggttggtaatattatatcatgtctttgttgaaataatacataaagtctcaacaaaaaatataaataaatgttgatttattcttaagatgaaaatactcaacaaccctaggagaaataagttgtttatcagagtaaaaataatgaaatgaaaaaacaagactatttcttgaacagcaggtagaaaatacccaccctcacaaaagtcaggtctttagaagtgtttcggtgttaagacaaaatgtcagtaagtaggtcactgagtgcaggacctcgtgtaacctatccagttctttctaactacaaatgtactaagtcacatttcataattcagtaactattcataatccaacttgtatccaccacagcaattaaaacattccagatttgaacgtcctctttagcttgctaatacagatacagcaaaagtgaacacacattcttatagcaatggtcatgcagtcatgcatgacatactatttagcatatcctcctggaaataccaggccactttacctgtctcctgagaaatctgtatgcaggtcaagaagcaacagttacaactggacatagaacaacagattggttccattgggaaaagattacaacaaggctatatattgtcactctgcttatttaacttatatgcagagtacatcatgagaaacgctgggctggatgaagcacaaattggaatcaagattgctgggagaaatactgataacttcagatacacagatgacaccacccttatggcagaaagtgaagaagaactaaagggcttcttgatgaaagtgaaagaggagagtgaaaaagtgggcttaaaactcaacattcaaaaaactaagatcatggcaacccggtcccataactttatggcaaatagatgggaaaacaatggaaacggtgacagactttatt

SEQ ID NO: 43645 - DNA, 3176 bp, Bovine  19866880681516
gacatgagtttgagcaagctctgggagatggtgatagacagggaagcctggcatgttgcagtccatggagtagcaaagagctggatgtgactgagcaactgaacaacaataaagagggaaaagaacttccctaaacagagcgtgctcaatttgccaggggacaatgacatgaaataaaaacattatctttaccaacttgcacccatgctaatatggtcttagaaatccatgttatgatgtaacctctcagtacaatagtattaccaccagttataaattcattttgatggggaaagaaatatttagttgctactactgagttcttgttctgactctttaaagctatgtagttttggcaaatctcaatgtctcaaagctattgcttagagttacctataaaatgggcatttatagtgctagccaggccaatcctcctatccatgttcagtgctagagtatacagtctttggattgggcttccctgatagctcagttggtaaagagtctgcctgcaatgcaggagacaccagttcgattcctgggggctgtgtctgcgtgtctaccagagtacttggcaccatagagagacccctcttcattgaattgatgtagttaaaatatgttaatgaatatgaaaataacttgcaaactataaagggagttaaaagctttttattagtaagattttattttagaatagcttttgatttacttaaaaaaaaaaacccaacaactgtgattttaggtcatagagttcccaatacctccctccagtttcttgtgttattaaatcttacactagtacagtacatttgttactattaatgaaccaactgatgaaccaatacattacacccaactaaagtctgtattttattaccatttccttagttgttttgctttgtaatgtcctttttcttgttccctgttctagggcctcacccatggtactataacatttagccattatgactctttaggctcctttcgactgagacagttttcagactttgcttatttttgatgaccttgacagctttagttgagtattttgcagaatgtccctcgatagggctttctcatgaaattggggttgtactttttggggaggaagactgaagaggtaaagtaccatcttcatcacgtcatatcaagggtacagactaacaacactactcatccctgttggtgttaacctccgccacctggctgatgtagtgtatgtcaggctttgctgccataaagttactcgcttcatactgtgttctttggaaggaagtcgctatgagcagctggtacttgagtagttgggtattatgttccatgtccttgagggtgagtgctgacaatttatttggattcttcttcatggtaaatttgtctacttgctcccacttacttgtttattcaatcgtttacttaaatcaatatagactatggatatatattttatattttgggccatgatacagtactattttgttgtgttgttcaaatgtaattaacattactattaatattattatcaagcaaaatccatagtagactagtattctgctgaattttagtaggttgtcagaaagctgattgtggagctcaagatttgtgcctattttgttcacttctgtacctagtgcatggcttatgctatgtccttattaatacttttagaattaaaatctaaaatacagtactgagttactgtcatcgattataaagaccatgggtaaacagatctgttgtttcaggattatatccaggatcatagatgtttggtagccatttaaacaatttgcaaatttatcattggatccctgaatgtcctttccttgcccacaccacaatctcacataatcacagctggagaagaaaatgctactctttaatgaattcccaactgtgggcaccatagagaaacatcacatgtaacactaagaaggctcatgcattccctgacattctctgttaacatatgaccagcatggttctctccagacaggctctgaagcagaatgcaatcacatggttgaaataatgagcagtctgtagaaggaagcaaagccctgcttcttatctgcctgcaaagctccttcatctatcacttacacccagtcagtttgaatttggagcaggcgccttcatctgtgtaccctgccatgctctgttagagaatgaaccttgaagttccaactggtgccagctagaacaacacaagcatcgagagaagtggactacacccccctggtggtgttccgcagtggatatttgtctgcagccagggacaagtccaagtgttggctctaatttatagcgtctggcagtttctactcccaggatcttagccaaagccaagctctctccctctgtctgtctttatccatctcatttctcagttaatattttgaagtattcttcatgaacccctaaatgtgccttttggaacttgactataatcctcccagcatctgttacacattatttctaaatcatgattttgccaaattctggttctttctggagcagaaaaataaggagttgagttctaattctgtcattcatgggccagtcattgaacctcttgagccaatttccttatctttatgggggaataaaataatacctacttgaacaagatgcttttgtgaggatcagaactgattacataaaagtattagcccatagcagaggctaagtaagtggtaaacatttgtttatctgaaagtgtacagggaactctttttatggtgttaatgcaataatacactaatgagaaaaccaaatgggaaatatatattagaaaatgattcttcaggaattattcatatcccttgttgataggtggttgagcaggttattgtgctgatttggccagtttattacttgaaggccatttctctgatgatggttgggaattttccaattaaagaattctttgggacagaggaaaattgaacaagttgaaccaggaacgtgactcaccccagatatggtcaatagtgggaaacacagattgtttttggatttcaccttaaagcctgaaatgaatgaaagcaggcagtagaggcgtcagtgggtctctgcaaggacagacagtgagccagcaaagcaaacctgagctcagggacccgtaagagaatatagaacacaagggaaggagcaaagccaagaacccaatc

SEQ ID NO: 43646 - DNA, 773 bp, Bovine  19866880715428
cccagagaaatgtgcagctttagcaaaaatcgctcccttccctgaaacaaaatattaatgttaccacttgatgcacccacttttcaaggcattcttcatttcagatgttcttaatagaactctgacactgaatccaatcaatccatattaaagggacagcaataggatttgacatgtcttctggaaaattacatgtcctaatacaaaatctgggcatttgccacagagttattttgtattaagtgaaaactgctgcttcagaaaacaaaaaaatgttgcctgaagaaaatttggaactttttattcagcttaatttgataatgaaattcaaaaaatgaggcaggatattgctttttctatgctgatattaatgcatcaaacgaaactactttttctatttgtgtccttgtgttttctgtgatacagtttatcccacattaagactaactttaaaacaataaactttttcaaagtaataaaatatagcttgaaggaaaaagttaaagtttgggtggactgggctaattggacaactaggcttactacccagtctctttttagaaagactgtggttatattgtggatagtctatatcttctaagatacaaaatattattacttgacaccaagaataactgaattcattaacttctgcctgatataatgtatgcctttaatgttagaatcatcatgttcaagatttggacactgaaaaaggcactgaatatttactgtagccctacatccttaataattgcattccttaatatata

SEQ ID NO: 43647 - DNA, 1878 bp, Bovine  19866880802089
aagagttgaattttaaaacctggatctatgtaaactcctaacctcctaaggatgtagctaactttctgcaattccagttgcccgagtctaacctttccttatttattaaaattaagaggtttgactggaaaatcttgagtgccttcttcctcttaaaatctagaatcctataactctatcatgtttcttctgtagcaaggtgtcagggtattaatgaaaacatatcacaaatagtacttctctcacaaataacatgttatctctcaaagttcattcctcaggaggccatattcttattttaatgatagtgctgttgcttaaatcatttttggagaacatagcaacatattgagtatcctctctggtggcaaattacttttccatgaaagtggatttgatttttgtaaccagaccaaaaattattcaaagccaagtccaatggatggtaaaactgaaaaaatacatagaaattgtaaacaaaatatgatatgagtttatcaaatatatgaaactgatttatttttgagcatcttaagccagaggtttaaagcagttaggagaatcgatactgagcaacagttacatccgtggaataagtgcctggcctccaactttaaggggctcacactcaatgggatgtgtaagttctgccagttggttacaaaaagtcactctctatcaagaagctagtgattcatggctcttcatgataaagtattgaaaatacaatccacatgatttattacccaaatgctcttttatcctgagacatagttcctttccgatgaacttttcaactatgttaagaaaagaaatgccaagtcctgatggttttccacctcccagcagaatacatacatacatatatacacatgaaacttcccttcgcttattcatcaaatgattttaaaagtaccaggacctatattctaccacgtaaagattctatgacaatggaagaaaacagaaaaaatgcttctttcaaaaggaaaatgtaacatgttatcattgaagatgattttacataaaaggcaaagatttgaaaataaaacatatttctagacagaaacaaaacagggataatcaaataaataaaatcacacaaatttggccgtatctctaggcctagtccgatagcatgtgttttagtgatacaaccatggacagataaaggagtagagctgaaggccttctgcctccacatttttttattttctccccatctccaattttctcttctcctttctttccttttttgatttttatggattacacatacatttttgcatggtgtgtataaaagcacatacacatatgtaaaagaacattaaaaacacaattcagagtcacgctcaagcatgatttggaaatatttatctaaaaacattcaaatttttacataacctgaactaataattctaattttagaaatttaccttaataaaactctagtgggttgaatggtgcccccacaaagttctgtgcgtgttctagcccagcatttgttaatgttactatatgagggaaaagagtcctggaagttacaatttagttaatgatcttgtgatgataaaatcattctgggtaggccctacatccaatgacaagtgtacttgtaagactaaggcagagggagattacagagacagatgaggacggggcggagtgaatgcagaggcaggtattgaaaggatccagccacaagtcaagcaacgccaaccataatgcaacgaacattatcttgcttaaaagcctggcatgtgggaattccatgatggtccagtggttaggaccctgtgctctcactgcccagagccaggctatgactcccggttggtaaactaggatcccacaagccacaggcatggctgggaaaaa

SEQ ID NO: 43648 - DNA, 1246 bp, Bovine  19866880839529
tcggacacgactgagtgactgaactgaactgaatgtataaaaaagattgaatgtggagacagtggagccttcctactttgctggtggaaatgtaaaatggtactgcctctttgggaaaaaatttggcatttcctaaaataaacaaagaattaccatatgatgcagtgattctactaagtatttaccccccaaaattaacaaatactctgacaaaaacttgtatacaaatgttcaaagcagcatttcttttaatagccaaaaagttcataacctaaatgtccctcaactgatgaaatgataaataaaatttgatatttcataacatgcaatttcttaatcaataaaatgaaattaactactgacacatgctacaatatgctaagtgatgaaaagcaatcacaaaagctcatatattgcatgattacattcatataaaatgttcagaataggcaaatatatagagacagaaagttgactggtggttcagttcagtttatgtgaactgaatgtggaggtgggtggtatagaggagaatgctagtgagtacagggtttcttttagtcatgattaaaatattctaaaactagattgtggttatgggtgaacaatgctgtgaatatgctaaaaaaaacattgccactgtaatttggactgtagcctgtcagcctcctctgtccatgggattctccgggcaagaatactggagtgggttgccatgtccttctctaggggatcaccctgatcagggattgaactcacgtctctggtggctcagggtaaagaacctgcctgccaatgttgttccgataaaagtcctcattgaaaactttcattcccgtgatttatcttcctgaaaaatataggatcacaatattttggttggcaacgggttgggaggtgtgaaagaggaagttggggctggtgagagttgtggggagttataaaatagaatagcattttgtactgataagaagggacataacagcaaatgcctacttctttcctgactgcaggttgtggtcaacttgattgaagacaggtttagagtcagcttgagctgcaaggtttcaataagctggtcaaactcagttgttgaaatttcattagaacacttggaaatagcaatttcaggagtttgagggattttcctctccccttttgcattcaagtggtaaaaaataatgcaaaaatttcaggccaatcataggctacttgagtatgtataataaggagtctgctgctgctg

SEQ ID NO: 43649 - DNA, 767 bp, Bovine  19866880912634
ctttttgtgaccccatggactgtagcttgccggcttctctgtccaggaattatccaagtaagaatactaggtggttttcattttcttctctattccatggagtatcacaatgaaaattaagtcttaaaatttggtaagacactgagaaaatttctgttacttctttgagtccttggttgcctatagggtgctattttataggttgtatgtgttgatatgcatttagagaggaaaacctctcttagaaaaatcatgagcagaatactgagtattttttttaacttccaagttcactcatgaaattctaaagagcctcaatttgttttttactgttctagtttatatgctctatcagatcaggtgtaattttgaaggtcagagtaaagttaagggagaaatgattctcacctgaatccaaaatatcttccttaaggaaggagggaaaagagtgttgaccattaaataatgaaatatatttctcccttaatcagaaaggtaagtaaaatttccctttgggcttaatcagaagcctagcacttgcaatatataatcatacaaaatgtaagcaagaatttccatattttattaatgtagtaaattctgttataagagctaaaatagcttttccaaatgagatttttcaatataagaatccttttcagaattactaccagttctgtcaggctgataacccaatactgggatgtcaccaaacagactatatttgattagaaaaactgggtacacattagcatttggggtcatat

SEQ ID NO: 43650 - DNA, 1254 bp, Bovine  19866880944681
tcctacttagtcatgactcaaaatagacatttttataagtcagagccagccttgtaacaggctccattgaaatttgtcagcttagctgtcttgagtaaatccacaaggttagttttgtctaatgtgttggtatgttccaataaacagagtccaactgacattttacaaaggctttaaaaaattaattaccagtaaagtaataccatctccccatttattaaatgaagtggcaatctaaattgcaaatgttttttaccccccagtgtcctctttctctggagaatacccctagagtgatagtcactggcaacagaagctctggcaaagcagtggggttttttctccctgaaatctgccaagagtaacaaataattctgttaggaagtgctagcttagccactaatcatggtgacgtggttcttacttgagtggatcgtgtgaagacatccctttctattagtttgaaagattttgattacaggtaacacaaactaactggctagtgttaggaaaaagggagaaaaaggtatataaatttgcaaggataccaaggatgtcacagaagcaacgtgaggatagggaaccaggcatagatactgggtatgaatgaaggcacttctgttcttttatgccaagagggaggaagccagggtcttttaaccaagcaggatggtctagagctgctgctgcatgtaggacatcactgatgctgctgttgctgctatgaatgaatcttaatggtcactttggttttgtgtccctcactacagagtcactgtcccgtgttggagcttctggttgattgagactgggacacttgcgcctgttctgtcagatgccactccaaagaaaaaagaaagatcatcagatggtactccaatgatctctggtttcttgctagaaaagggtgttgatggggaactgccctatatgataaaagtcctctacactcagaagacgagcacctgaactagaagacatggatgaaacctgccaaccttccagcatatgcttagaacccttagaacttggggtcaaaataagatgatagaaacagagtatatggtcatttgtgcttggtatttctaaaaaactgaaatatgaaataagtacctaaagtttgcaatgattacagcaggtctgaatgggtaagtgttataaactggagaagtgatccatggcatggacatttcaaggtcatggaaatattgaccaatgaggaaatatagtctactgagagtcatgtaaaaaaat

SEQ ID NO: 43651 - DNA, 1038 bp, Bovine  19866880952569
catcttttaatttcatggctgcaatcaccatctgcagtgattttggagccccaaaaaataaagtctgacactgtttccactgtttccgcatctatttcccatgaagtgatacaactttctcaaaaacaaaaagacatgaggaaggaaggaagagagaggggaagggaaggagaaaaggaaggaaggaaagaaggaaggagggaggacttccctggaggtccagtgggtaagactgtgcttctaatgcacagggcccagattcaatcctggttcaggaacaaagatgccacatgccccacgatatggccaacagtttaaaaaaaaaaaaaacaacaaccttaaaaaaaaagaagggtgggaagaaaggaggaagggagggagagggaaggagagacagaggaaataagtcagctaatgctttcctgctgataaggtcattctaatgatggactagacctttggagttaggtattacgaaaataaagtctaaactgcactgacattttcttccctacattatcagccatttgcctctgaaatcatgattctaaatatttttatgatatatgaaaaaatgtaaaaatgcaagaaacaaaacagtgtttatgtattcacacatattttcatacaggcatgcaaagtaaagattatggaaaaaaatacactagggttgtaataagtgccatctctagaaatcaaaattgcacatcaatttttttcctcctcattttgcttatctataactatctttgtaaaaacagtacgcatgtggagcttttttgctttgagaagaaaatatgatccttctgtcagtgggccccatagcccactggttctcaacctggctgaacattagaatcacaaaaggagcttttaagaaaaataccaatgtcctgacctgcttcctgagaaattcatactcaggtcatctgggatgattccaatgtataaacagagtaaggactacaccctgtaccttcagttctctgctatctcatttgttgagttttgctggagggaaaaaaagcttttctacag

SEQ ID NO: 43652 - DNA, 1153 bp, Bovine  19866880975419
atttaactctccagctcattaagaacacctttccacattaataaattcacctatacaacataatctttaatggctgcagaatgtccaactgaatcacaatttaatcagtcagtatagtatagctagatattcaagttgtttctaatttttcacaattccaaacagtatgtgatgaacatctttgtagcttaatattctcctactttgttagttactgccttggaaatttctcctagaagagatagttatgggtcagtatttaagtcttttatacataacctccggaaaggttatatcaatatacactcccacaagcaacatatgagtctccttacaagactacatgctttacttgagaaatgctaacacaccaaactttggtaaagagtctgtgttagagttaagagagtgtgtaaattacatattgattcatgtacatgtacataattctttctctagatggaaaattatagagacctatggtttttctgccttgcttagtagttttttcatggctcctgtattcacaggctttataaacagagctttaaatatttactgatttgtggcaaaccaggcaagataattattccaccacatatgaaggcatgttttgttctcaggatctagattgtctgaggctttgattagctacccaagctgccgagtcctgaagtttggcttattttcttatttgaagaaagtctaacaactaacttgaagtcagaaagtagcaaagcagatttataaagacaaactatttacacacttcagaggaaaacttggttcgtatcctttgtttaaaatcattacgaggtcaaagcacaaaggttcccagtgaatccaacaagttattattgcctgaaaataattcctatcaaagttgataatagataggctactggagagactgtgaaatttgcttttcctaaaaaggtattgaatgatgacttgaactgtcattaatacagtttatttcttccaatattataagcatgtgaaaagtgacagtgaaacaatcagtatgaattggtaaaaagactgatgacagagcaagatctgggaggtatacatggtgtagaagaagataattggacttgtatttgaacttgagatattttattcattgttttccatccatttaacaaatatt

SEQ ID NO: 43653 - DNA, 2057 bp, Bovine  19866880980750
ttattgcagtctagtataggatggagtaacagttttgaccaccttacaaaagagggactgtttttttcttaatggacaaaaatgctcaagaaaagagacacagaaaatgctccctgttttgaaagcatcctcaataggggtaaaaaaagaaacaatatcagctacctgaaaaataaatacaaagaaatctctcagatgcttggggaaagtaaaataagaaaaagatactgggtgggaggctgggggtggcggggagccaaaaagcttgacagaaaattagcatctgcctctttggctctcaaagggtgagatccctctgctacaaaatagcaagcctccccaggccccctgccctgcagacccaacagagaataatttctcctcttaccttttgctctgtagcgctgccccttcttccaggtagatggagcggtaataagcgtgagtttccaaccttgcggaaagcctcctccactttggcagggagaccacttagcagggctccgtcttcagaactgcggttcctctaaaccctcacagccttttccaactgatgacagaccatacagccgcagcagaagcagcagcaggagcagcagcagagagcctggcaaatcatagatcgtcccctaatgagaacacgctcagctctctgtctcccccctcccctctaacacacccgccccacactcacattcacacacgccagtcagtcctcactgattcatgatttcccctctgaggattttcttataaatgtgctaacgatatagttgtaatctggaaggctgatggtgccagccagggggtttgaagcagctggtcttatagttgtttatagtctaagttctagggaaactcaggcacctgcgtaaagtcctgggtaaagtcccactcccctgtgggataggacttagggagagcgaagccatctcagtccagacacagccctggaagactgaaatatctgtctgggcagagagcacacttttttctctatgatggaaacctgaggactatttctctggtgaaccagtgaggtcggctcccttctctcatggtatatgaatggagaatgagttaagactgattttaaaccatttcagctgcaatcttctgaggcttatacagattattttttttaacccatttgagataagaacattgatttaaacctacatatgatctgtgaactttgtttttcaactctgttttagcatcacttactagaatctttctaactgctctggatacctctcccctcttcacccaccctctggactacagccacatgtaccactcagcaaggttctgtgtcaatttatttctaggtagaaaacatacccagtggaaatctgaactgaggccactctgataacacacctctgaaacagactatataagccatcttttttagaaaagtatacttcggcttgatttttatttctctaaagtagcccaggaaacagtggaaacagtgacagactattttttgggctccaaaatcactgcagatggtgactgcagccatgaaattaaatagacgcttgctccttggaagaaaagttatgaccaacatagacagcttattaaaaagtagagacattacttttccaacaaaagtctgtctagtcaaagctatggtttttccaatagtcatgtatggatgtgagagttggaccataaagaaagctgagcaccaaagaattgatgcttttgaactgtggtgttggagaagactcttgagagtcccttggagtgcaaagagctccaaacagtccatcctaaaggaaatgagccctgaatattcattggaaggactgattttgaaactgaaactccaatactttggccacctgatgcaaagaactgattcatttgaaaagaccctgatgctgggaaagattgagggcaggaggagaaggggatgacagagcatgagatggttggatggcatcatcgactcaatgggactgagtttgagcaaactccaggagttggcgatggacaaggaggcctgttgtgctgcagtccatggggtcacaaagactcggaca

SEQ ID NO: 43654 - DNA, 2441 bp, Bovine  19866881038159
tggcggatgaggcaaactttgtagcctaatttgttaacttttgaagcattgattgtgcaacatgtgcttcggtgttattgtggagaagaattgggcccaatctgttgaccaatgctggctgcaggcattgcagtctttggagcatcaatttgctgtgcatgtttctcagatgtaatggttttgctgggattcagaaagctgtagtggatcaggacaggcaacagaccaccaaacagtggccatgacctctttttgtgcaactttggctttgggaggtactttggagcttcttttcagtctaaccactgagctggttgttgccagttgtataaaatctgcttttcatcacacatcacaatcctatcaagaaatggttcattcttattgcatagaataagaatcaaaacaatatatatatacatttttttttttttgctttgcagtcagctcatgaggcatccatttatcaaactttttcacctttccaattctcttcaaatgccaaacaaccatagaatggtcgacactgagttcttcagcaagttcttgtgtagttgtacaaggataggctttggtgatcctctcagttggttgttgtcaacttctgatggccggtcattgcactcctcatcttaagggctctcatctcatttgcagaatttcttgaaccaccactgcactgtatgttcgtcagcagtttctgggccaaatttattgttgatgttgtgagttgtctccactgctttatgacccattttgaacttgaataagaaaattgctcaaatttcctttttgtctaacaccatttccctagtctaaaataaatgtaaaataaacagctagtaatgtcattagcaaaaaaataataataataaagcaggaatgtgcattaaaatgatgtataagataaccacatttatttaagaatgtattccaatgtacttcagtactttggccacctgatgcgaagaactgactcattagaaaagaccctgatgctgggcaagattgaaggcagaaaaataaggggatgacagagggtaatatgtttggatggcatcaccgattcaatgaacattagtttgagcaaactccgggatttggtgatggacagggaagcctggcatgctgcagtccatggggtcctaaaaagtcagacacaactgaatgactgaactgaaatgattccaatatcaaacagcaaaatttaacaatggaaaaccacaattatttttgcaccaatgtagatacttagaagctagtcccacacatgctctccagaattctgcttacatgaatctgccactccttttaggtcttgaatttttccaactgtgcaatgttggacctggcagcagtgaaaggtagtaagtgcatatcctaaaaagaatcagcatgtccttgtaagccacttgcaggtctggccaattaaagtatgtatgatcctccatgagtttccctttaaccaactggatgttgacacctagagtggccttggaaccatgcgttccatcagcctgggtctccacaagactgcatggaaagaaccccacatcaccctgctctaccagcaagctggcgccacagtggactgtcacataagaaactaacatctattgtgtttgagctattttggacttcagatctactggttatatcattttgcttactttctgtaaaacagggccttttgctttcttttctttttacttgaaatgtggtttgtaaattattttgaaaatgggaaattaatgattcatagaattaatgtcatagatatccttttctccctgtactcctacataaatttgtagatgtgacaactctaatgataattagatatgattagcctgcatgccactcttagaatgttatttattccttcccattagtatcacagaagctacaatcttcaatgccagggggatgcaaaacatacataggaaacctttcaggaaaatatcatgttgatgagcaaaatgacctgagtgactatcaaaaaggatctttatgcaggacaaatgtttcattgtggcttttttccccggagaaaaagatatccctttatacaaaacattatcaacatgtattgcacgcaaacagctatgtatcataagtacttcttttattccttaattcagaacaagatcacaaggtaagaaaaaacattgaaatacctacagggttcccaataaccctatcaaggtctcttttcaggcagattaaataaccttgaaatttgagaccttggaaaatttttaccagaactctctttaccacatttagagtttgttatgcagggtaggtgaccctactgagctatgtgagtagaactttgagttactttatctaagtaatgataacttattctaagttatcttattaacttattatcctaagttaccttattctaagataacaatttcaaagaaatgataact

SEQ ID NO: 43655 - DNA, 1026 bp, Bovine  19866881063617
catatacggtaccaatgtactgaccttttgatatacaaagataaacttctgacttgccactaggagattcatgatttgctttgtttttaaaagttgtgataattttaagcagatctacgtgaacccttttctggtcttctcgcatccaatggcacacacttcggaaacactggcaaaggttcaagttgcaagtctctggctaggagtagaaaaacactgattaacttctgcacagatgaccaacagctccattctaattggcaaactgaacagacataactaatcagtgcattctctctatgcagactatttgtctttaaaatagagatactccctaagttgaggaaaccagagggaatcacctgaataaacgaataagtagtggaggaaatatctactaagtatctactattaaatctactgtttagggagtacaaaatgaacaaattatggctaccaggcttaaaagggaatgtagaggttaagaaaaacaacatatctacacataaatgcaatagaatactgttttactccctcagaagagcaccacatttcaagccctgatcaagtaagactgtctttctgcaatccatttgtttttttccatgctattctgcacataagtcatcctctggtcctcaaacagctgctatctgacactgatgcacatggaatcttagaagtatacttttgtcatcagacttacgcatacccagacatatacttcgtttatttacctggaattgtgcctaagcacccatgctgctttccagttcaaaatgtcaacttctccattgtcctcacaatacttaaaaacaaaatgaatcaatctggcattgttctcccagtctcattaggctaaatggaagtcagcatgagagtcacagttttagaaccaaaataggagatgcttaatgttatttcttgcagattctaatagtcaaacagtttattaaatacaggagatgaaaaattaacaaaacttaacagtggtttgtgctacctctccagtaagttaacactttt

SEQ ID NO: 43656 - DNA, 2549 bp, Bovine  19866881232202
tactctgctctctacatgacccttgacattcaaaatttccctgttctcagagacaacattcaacaatgtccactaagccatttttacagagcctctaagttacactcatttcagaaaacatttttaaaagcaagcactaaattaaatactccattaaaagaggttttattagacactaataggagatgaaaaatgtcttctgcataggactttcaataaagggtagcactaagagtattatgtctcttccactgaaacaggtaagagaggcattacagctctaacaaaaatgaaagtggagttattttctctaagagccaaaagaagtttgacaacttcccttcaaggagattcagtaaaattaatcaacccactaacccactgtgatttttaagtaaggtcaacattttagtttagtcttcctccctcccattcttccttccttttaaaagtacacagtgcttttcctattaagaagtatgaaggatacatagaaacttcagagaatcaccttaaaaaggtgtaactcacattattatctatggtctcttttagccgtgtcaggtcttccatggctgcatcccaattctgcattaagatctcagaggccagttttccccagagtgaactcaaagcatttctatccgttgctggaacctgttgaagccatcataattaattatattctgaatactctggaggaatagataatgttaaaccctacatatccacccagcctactaaaaaatctaaagctctcttcccaaaactgccctttatttggatcacactggttaagctgactcaaacagctttcatttaacttaatttactaaaaatactcaggtctttgatattcagtctagatcagaaaataaagagtaacctaaaactaggatacagcaccagtgttttagcataatccatttcagataattttaatcagggtttccctggtggttcagatggtaaagaatctgcctgcaatgcaggagacctgggtttgatccctgggctgggaagatcccatggagaaggcatggcaacccactccagtattcttgcctagagaatcccaatggacagaggagtctggtgggctatagtccatggagttgcaaagagttggacacgactgagtgactaagtacacagcacatacacaattaatcgaattttagagccctaaatctttgccaagatttaagattcagaagcaatttgttgctaaaaatttggagtaaagatgtggaaatgaagacttgtggatctcatttacaatttaaaaaaaattttcagaacaaaaaactttctgaattacgatacaagtggaaaaagtcacaaaaagaaaagcaagtgtattggctaataacattaataattatcaaaggaatatgcaatgagcaacaaaagttcattttcttatacaatcctaataccatgaaaggtaaataaaaactttttatcttcattaaaaatgagggcagaaatgatgcatggagagcataacttgttgaaaattatacctctattcataaaagctatagatttcacactgcaattttaacctacaaaaaaagagaaatgagggccatgctctctcctcttgccattggtggaagagtatcataaacccaaacacctataaggactaggctaccaacaaaaacaagtaaagccggactctcaaaaagcaaggcaaagaaaagtggattatataatgactctgaactgtgctaaagcagcagaagcaagtgagtgtactggaggcagaatacctttttcactgaagcatttacatggtggtattaattgtaaagtaccattagtacatatcataattacaagttaaataaaattatatgggcaggactggaaatccaaaaactaagaattttggctctaccactataaacagctgagccatctgtgctttagcttcctcatttataggataaagatactatcagaacccacctcaattgttgtatgagttagatgacataatatatgtaaacatgattacatcatcatctgacacataatacaaactcagaaaatatgagtcattaccaaaacaataatgagactagaaatgacgatacagagtactataggctgccttaactatgaggattaagaccacacctaattcagactcagcctatactaagattcttcctttgacggcaataactaattcaaatatactgaaaaatatataacaaactcttaaaacaggcaaactcttagaacaggcaaatagcagagactgaatttgcaaattaaaattggaaacataatgaaaccactggttcttattattgttacaatttatgtccacaaaaaacttgtatacgaatattcattatctttatttgaaacagacaaaacccagaactaatccaaatgtttattaatgaatgaacagaaaaactagtatattcctagaacgtaaagaatcaaacttctgatacatacaacaacacaaacacatctcaaaaacttgctagccaaaatatgccaggcacaagacttaaaaatatcat

SEQ ID NO: 43657 - DNA, 1055 bp, Bovine  19866881299244
ggcctcctttccattacatcattttcttcaaaaggtacatgggtctagacataaatagacatagacataaatgatcttaagaccattcctgatcttaagaactcatagtttagcagaagaaacaaaccatgtaaacagttaagaaaatacaacatggctaagaggagaccaccaagcatgagcaaggtccattcctcattaacgcttctgctttagccttctggtgtccctgaaaactctgtttacctgtttgggttttaggctgaaaattctgcctgtctccctatagaatcttaatatttacttcgacattgttggctatatcaaaagtaacttgacttgcatgctctgctagcttaattccctcactggcggtagattctagtgttggcttgagatatacataacaaagtactggggaaaatatttttaaaacttactttcttaaagagaccatatttttcatgtcagatttttcaaataagatgtctggccagataattgaagctggctgttatcacacaagagaatgtgttcaagtgataattgtcatgattagaagcctgtactgcatttcagtattaccatttcctgtcagtaatcatgctagtctggaaagcaggcagtgaacgtttatttggactgcaggaatttttaaagacagataacacaggcacagaatactctatgaaagacacacagagttaaaagtatttgaacagatacataggtatttgaattatgtcctggagtggctagtggtttatattagcttgtcaactcttagattcatcacaactctttcagattcctctgagatacttctgactactgggaattgctactttcccctcaagaatggcgtcgccacattccaggtcctagcactggggaaagataaaaagagcagtgatggttccctttgcccaatatccttcacttcacatattacaacggctccaaataaggtagatttagctgtcaatcctagctttatatgaggtggtaaggaagaaaaaaggggatttaagtcctccaaaggcaccttctctctg

SEQ ID NO: 43658 - DNA, 873 bp, Bovine  19866881335995
aaacgcttgtatgattgtgttttagttttgccaccagctaagtagggcaaagttgatcctatctcacaaggaactctctcccacattttctctgtgaacttggacgctcagatttgcttacctgcttccttgaagatactgtgctgttgaaatatctattagaggtctttgaattcaaattcttattctgatgagtcgagtcatttttccacatgttagagttttctttaggatctgaaggaatgggatttaagaagaggatcctagctatgaatccgtagaggacagtggctaggatcattggcacaacataaaagacaccaaagtccattaggtaaataggtgagtagtaattcctggagatcttgtagccacaggacactacaatagcatctttataggtgctaatattgagatccagcaagaagaaccagagcatacagtaaatggatgtgaaagcccagacaaagatgattatctttttggctctggaaaatgtgcagagaaactgggctttgatggggtgacagatcgctatgtaccgctcaatggtaaaggctgtgattgagcaagaggatgcattaatgcccaagtactggaggtaagtaatgcagagacatccaacgtagccatagacccaggaaccgtagatgctgtccgttatgttggggggaggcctgcagccaccaggaccatgagatcagctactgctagactcaccaggtagcagtttgtgggggtcctcatgtgcttggtcctcatgaccaccagaactaccatgatgttgcccacaatgcccagaccacaaataatgagcacaagtaagatggtgaccacttggtattcgagggccaccacagctcgaggctgaag

SEQ ID NO: 43659 - DNA, 1227 bp, Bovine  19866881356325
ttagatcattagtagtggagtactactaagtaagatacttttatggaagctagaaggatttgtataaatacagaatatggggccctccccccttcaagaaccttaaatctgttaggtgaaatgagctagattgtgaacagctcaagaaaatagcacaaacatgaacaatgcaattttaagagtcacaatatttaagagaagatgacccataagtacttaaaagtttccatatagagtataggtcagagactgtgtatataaagctaagtttttaactcagttaatgtcattttctttcttttttctttttcattagcatgttggcagataaactgaacatgactccagaagaagctgaaaggtggattgtaaatttgattagaaatgcaaggctggatgccaagattgattctaaattagtgagtgttgtctgtgctatgtattagatgtcagttgctgattattttatacttttgggggagtttttgttaggacattcattctagaatttttgttttaatatataatagtttttttgaaggcagtagcattctcttgttttttttttttgttgttggatgaatattgtcatctgtactgtgcataaaaatatttgcaacatacatgtaggttgtgatgttatacttatgacttaaggaactcggttgttaacgttataggaccaatttttctgtctcattttagggtcatgtggttatgggtaacaatgcagtctcaccctatcagcaagtgattgaaaagaccaaaagcctttcatttagaagccagatgttggccatgaatattgagaagaaacttaatcagaatagtaggtcagaggtaagaaccacacatcttctgttgtctcaaatttggcagtaaataatataattgttacatgggcatcatttgagaacaaattaattttggttgtgtctgattttgtatttgggggtaattttatttaagaatcacttacactgaaaagatttttcttatatgttttatgcgttagttaggaaacaaattaaattatgtgttcctagttttattacaattgggtgtttttttctcttacccttcctgtgtgccttcattatgtccatttccttagtgttttcaacacatcattttgatactggcagtgataagttaacatgtgttatctctctttccaggtgcttgaaatttgtgttcctttaaaagaactacttctgcaaaattgtt

SEQ ID NO: 43660 - DNA, 1611 bp, Bovine  19866881373622
tctagttcttatccagaaattgctgctctttcccaacccctgagagtggggttgagtgactgactctttttcattaattcagtagttatttgacatttattatgcacaaataagtacgtggacaataaaaatatgagctggagagtctgagaggtgctgtagtcagtcagtaatgcaagctgattagggatccctcagtcagtgagtaacgtaagcttccaaaaggcccaaagtacattctcttctgcataacactgagctcagaacagactttttcctggtaaccaggcaggcacacaaggacaagcatgccataacaactgcaattggatttgagtcccaaaatagactctgcttggttatattaatttacttcaaattacatatgcatctctctgaagtattactaaataatatgtttcatagatattactgatagaaaaacctcattagatcatgccattcttttttcccctggcaaataaatgagttctctagtaccctatgattagtgggatttggttatgaccaaactgtcaaccgtttggaagcacttacttaatcatggtagcaagggacaggtaaatatgtgcatttaactgagtccacaatgtttgctattctttgggctttatttctacctattgggttatgcctgacaaatagagtttacttcattctgtttcagtaagtaatatactgttaaagagtctttctaatccagttaagtcttctaaaaatctgattatgatggattaattaaaagcttgttttatatctccgaaacgttgctcctctattcctccaaggagccttctgctcatttgcagatttatcagggaaacacaagagaactaaattggcccaccaaaggttcacagtaactttggaaaaaaactgctggatttctgtgtgattggctgccagcatctttaggcaggtgcctgatcaacaggagtatttgctgagtttgagaaacacagaggttgacagcctgacatctgcagactaattggattcaaatcctgaatctactattttattatttgtgagacactggaatattacttagtacctgtctgcctttgatcctctgtataaaatggacctcaaatagaagcagtatagtgttgtttataaagattagatgaattagagcagaaagctggcacctaataaaagttccttaagtgaaaattgcatttataaaaaggtaatgagaatttctcaagtttacattttttgaaaatccttactaaaatcctaagagcaaaagttagtattttcaattcatagaggaaaccaagcttcacaatcaatcaatgattacttccaatatcacaaaactactaagaactagaaccagaatttgaactaaagtgtccttaaaggtaaagtctgaattcttgacatgatagcaataataacaatataaactgaataccaaaaattcaatgctgcttttgtgttcacatacctattcagcattacttagtgcatgtgtcaaaagtaaaaagacatggttctgtccttaaggccaaaaacaagttaaaacaatcacttctaatgtaagatgggaagaattcatgaagaaaatgtcattaacctgag

SEQ ID NO: 43661 - DNA, 1965 bp, Bovine  19866881393880
caatcaccacctctttattagaagagaaaatggaggctcaaaatgtttttttaaaaaaaagcaaaacaaaaacccacctggaaagtggcaaagtcagggttccagtggctgattgcctgatttcaaagccctgcaggacaacactgtgttcattctgtttgctctgggctccccctcctcctaaggagagggttatttcactctgctcttttgtatgtctaatctcccttttcattttccatgtgaccaaacctcctacaaagcaaacccaaaacctccttgcgtgcatgtgggctcagtcacttcagtcacatccaactctttgtgaccctgtagccagccagtctcccctgtccatgggcttctccaggcaagaacactggaatgggttgccatgctgtcctccaggagatcttcctaacccagggatcgaacccatgtctcctccatctcctgcattgcaggtgaattctttacccactgagtctcctgggaagcccccacacccccttagtcaaatgtttttaggtaagagaaagacctattactcactttggaaactcaaccttttgaaagattttccccaccaaagatttgacaattaacctttaaaaatattttaacaaagtcataaggaaaattggctgaaattttgccagtatctattcagagacattcaaatgtgacaaataatgacacagctgggtattaaatttgcttccatagataattaagaaacacacatactgtgtcatggaggtaaggaaaatctaaggtctccatgactatagtgtttccattagctaaagagccacttttaaaataatgactgtgcttcccactgtgactaactttatctttgaggtgacattctacccaaaagggcataacatttctctcaacaaatccatgattctcctgcccattaaaaaccagccattccataagaagtctgacccctctttccactgatatgagaatctgctgcataccacttcctttagtgaatggagaaatgtggatgtatgatcaaaagctgggcactaacaggcatggaccaaggctgtgtaaagatttagaatcatattcagtacccaatttcgcaggacggagctcaaaaaaaggaaagaaaagagaaacctactctaacaatgccttgcaggaaagagtctcatcagggtcaggaattaaggtcacaggagaacttgtgaattactcttacagaaaacttctctttcagctctctttgcgaatggtttatgtttctcataagagagatgatttatttagtgatgtctgcatcagcctcatcctacgtgatgtctctgaacactaatggggggaaaaagttccctgaaaaaactatttctgtggttaaagttgggaatgttgcatattccatcacacagtttgagatacacaagatattaagaccctaagaaaaaatcccttaaatttttgtttaatgtagtgtttccaaaacttttttgaccactgaagtcttaaaaaaaatactattaatatcctacccctcacccccaaacctaccatatgattttcatttattaatcaagggatattttttaaagcataaatccagttatgtctcatacacacactcaaacatctccaatggcttcacatcaactcagcatggaaatcagagtcctgactgaggtgcccagggtcctgtacaatctggtctctcacctctatcaatatctgtctagcatgcacctcctcaggccacactgaaaaccttgttctctctagactatgtcagatactcttttgccttaggaccctttgcattgctattattcttcttgcagtattcttccccaggtatttctatgcctttcacacttactccattctgattgccactcagctatcactttttcagaaaattcttacctttctatataaaatatcatatttaaaacaataagattttcctctgtc

SEQ ID NO: 43662 - DNA, 2254 bp, Bovine  19866881439354
gatgaaaaagacaaaaatgagtgtaaaacgacatagagaataaacggtcgagtttcgatcagagattcacgtgccgaaagagtgaagcttttctttttccttttgggaagggaggaaaaggaagctttttctagcttctatgtataagcagacaattttttttccccctctgtttctcatctctgagacagactctgaagtttgtatgcaaaagacatttgacttggctttcattgtattgcccaggggtaaaaagtggagtgtggggaaccaaatgatcattatttttgctttttaagtgaatcatagtaatatgcctctgatccaaatatcacattttggataagtgaatattttaaaaacccaaaagttagaatgaagaaaagaagctagccactgaaaaatgctaatgtgtaactgtgcgagtccatttctattgttagctaaagaggcaaaattataccagagtattttgcgatactggtgaaataatgtgaaaagcaaagatgtgattaccataaatttcaagatagaggctacatattcaagggagggaggaaatagtgatttggagaaagcaaaaggacaggctttgggacaccacacttttctatttcttgacctagatatgcttatatgagcattcttcttgagttaaatattgaaggtgactctatctcatgcacagttctgtatgtagtagttcataataaaagatcagtatacttttggagagagttcaactttcaagtacctgatttgaatctctaagagtttatattataatctaagaattttattctctcatcttaggaagaactagaaagggttttctttggcttggaatcacccagcatcttgctgtgcatggagggtgggagagtatacagtcgtacggtccctcaaacaccaagtgaccacgctctcctttgtcattttttcaagaaatgttcaactgacttcaactttctccctgtcctttcacttctctttttcaagatatgatccagctaatgggtctattactgcaccaaagtttcttgctgaagtcattaataatattcaataattcagccactcactcaacaagtattaattaaatgtcaaaggattctatggtacgtgccagatgtataactgtgaactgaatggatacatcctaacttttggagaatttacaatctgatgggggatgtgccaatttaataggcaagtataatgccaattcatcagtgctgtgataaaggaatagatggtatggtgggaccataaaggaagaggacttaattcagaatttacaggtcaaagtagacttttcaatgatagaatttccaagtgagataaatatagaaagaagttagtcctttgaagaatgaggtagcatgatgaacagtgggaggcaattcagaagttaaattactggagctgaaaacgctcagtatgtctatagtatgaaatgtgagggaaagtatgtcagtaacgatattggaagtgtcctagaggacagatcatctttggacttataattaaggataaggtgtgtggacttaattttaaaaacaacaaaatgtcagtgatggtttttgagcaggataataaggtcatacttgaatttttaaaagaccatgcgggggaacagattgaaaaggaactagtttagtgtaatcaaatagcgtataaaaaccatcttcaagctagagataatgacagtgaaatttagatataatgatacagataagttacaagaaaaaaaatatgtatcacgcagacattaatcagaaggaagctgaagtggccatattaaagtgggcttcaggatgacaaatattaccagggatgaagggaaataaaaatgataaaaaggtcattcatcaggaagatacaccaatcaaagctatgaatgtgcccctcaacatctctgtggggccatatttctggctctggtaaatagaatgtgtatggaaatgatgtgtgttaacttccagtataagatagttaaggatctgatgtttctatttcatgccatgtgctatctggatgatgctaaaatgaccttgaagccacaatatgaaaacagcctgggatgctgaatcacaacttagaagagtctgatccatatcagactcagatgtgagcataaaataagcttctattgtggtggtgaggttttgaacttgtttagcacagcagttaactttctttccttaattgcagcccctcctgagccaaaaaggagctcaaatgggagacagaa

SEQ ID NO: 43663 - DNA, 1149 bp, Bovine  19866881478789
tttaataaagcatattatgaacctagggatggggggattcaggagagacacaaatatgatccaaatttataaaaggagatgggggtccctattactccaccacatctgtttgccacatgttcataaatcacatcagtgttttgaacatttctcctagcaccttcctgtcactctggttttatagttcataattttacccctcttctctacatacacacaaaaattctcattattatatttcaggtttgagagtgacatttgacgaagaattaagtcaagcaactgcagcaaatgactgtggctagtgcccaagggccctccagtttcatgagatttggccacagtaagcaaaagtgggagcaaaacgttgtgtttattcttaagaagcagagaaataatatgaagacactaatgacctctgccaaaccaaaaagaaagctgcactttgagtctgaatctacgagacagagttgccaaaaagaaagttgccaacttagataatttccctgcaaatggaatcctcggaactactgtggatactacatttattttcatcttccagtggtgctaatgcatgtcggcacggactgcagcgcttgtcctctaggagtttgccatctctgacacccatgacacgtgaagacagagcaacaggatataaggctacatattcaagacagactatgtgacctgttggtttatttaataggggggaaaaaaaagtaagcaaactgaagatacagaaaaagtcaaattagacgaaaccggagtctctggctcagtcattatggctgattaacttctccctcccctttgcttcaaatctagcactgttgaatggaacataacaaccatgaaaacatatatatctatatttatgcttgaaaacaaaaaagaaaaccacatgaaacgaacagtcagtctgaagccagagcaatgaatgggagctaaagccaaatgggccattcagctatgggacctggatattctaagtcactgaggttttcacccaagagaagagagtttggggaaaagcaggggcttccaggcctgtgggtgtggggagctataggtgcatgctcagcattaaagcaggagccttgaagggattagagaaagttcttccactggactgggaatttggtaaga

SEQ ID NO: 43664 - DNA, 946 bp, Bovine  19866881608121
ttttattgtctgtatttttggtgtcatattgaataaattattgccaagacctggaggtggttacattttagaagtaaggtgaacttgcctaaaattggaagtcaaaagtgagaagcatgtcaccctactttcctactctgttcctgctgttgcttttgtcttttctgtcaacaaagattgtagagtcgtctgtttttctgttggctacattagaaaaggttccagtgtccagtcattaccttcatgtgtggtaatactgggcctccatttcccaggtacaggtacagatttgaagaagtggcattggggacttctctggtggtccagtggttaagactccatgcttccactgcagagggcttgggttctatccctggtcaaggaactaagattccacatgctgtatggtatggccaaaaaaaaaaaaaaatgaaggttgttggtggtgttttacctttggcagcagtagccaacaccttcctaattgtaggctatcctgactgcagaaatggtggctggactgaaaccaacagcttactgatcacagaaaagtcagctgcatttttaaaagcccagttttgcatgtgactttgggattcattcctgaaagcccaacatagaatttgttgcttcatcccacccaacagttgtgtaagccatttgagaccctagaataaatacttttctacataatcttttagccaggttagattctagatatatatctgggatagaatttttttttccccacaactgaattgttgctagtggtaaagaacccacctgccaatagaggagacagagagaccagggtttgatccctggattgggaagatcccatggaggaggaaatggaaacccactccagtattcctgcctggagaatcccacaggcagaggagcctggtgagctatggtccatggggtcgcaaagagttcagaggtt

SEQ ID NO: 43665 - DNA, 1151 bp, Bovine  19866881907309
cacgtattatgtaacaaatgagttctgtgtttaaataagtatggaaaacactgcacactatatttgactggaagatctcaaatctgtgtattaaagttcctagaaattcatcagtaaagaaaatgagttaactctaaacatatatttcattcactcaacatttatcacacgcccactgtgtaccagcagccaatgctaaggtgagagcaagttcgatattcaagcaaaagtaaggggaccaacatggctcaagtgaaatgagccagagggagggtcacaggtgacgagatggagagggttgctcatgatgattcctctgggcagttcaaagcttttggctttatctctctaacttcagtcaaataaagttctttgcttttaaggactcatgtgattagattcagccaatggagataatttagtatgttctctctgtaaccttaatcacaactgtaaagcccatttaccatgtaatttattcacaaattccagggattatggcatggacatctttgggagagggagcgttttgcctccccaaatctttaatgtaaagattaaaggcatttttcaaaagatatcctataattttaagctttttctgtgagataagagattatagataataccccatttagacaatcaagaagagaagcaaaaaaataattgtaatatgcaaaatataattaatttcctaaatataatttctttccttttcttctttttcatttgcatttgatcccatttcattccattcaattccacagctttaggtgaacaatttctatacgccagacaccaatgttagttgcaatggctatgaagatagaagacatatttttagctcttaagaagctcacagcttatttggagaaacctcacaaatgcaattttaagcaacatgatatagcaaatgaacgttagtggccaaataaattgagttagaactacttatacaccctaaagtccctaatgctatactggaccacaggaatatgtccgaagtaactagattttcaagaagccgcagcagtctccgtaaaacatttttctcctttgcttgtatcttcagctgccggtataaaatcttttggggcattgccttgtgactaaaagggaaaacatttcagacttggcatgagcctgctcat

SEQ ID NO: 43666 - DNA, 1917 bp, Bovine  19866880209597
tttcccatgaagtgatgggacccgatgccatgatcttcgttttctgaatgttgagctttaagccaactttttcactctccactttcactttcatcaagaggcttttagttcctcttcactctctgccataagggtggtgtcatctgcatatctgaggttattgatatttctcctggcaaccttgattccagtttgtgcttcttccagtccagcatttctcataatgtactctgcatataagttaaatagcagggtgacaatatacagccttgacgtactccttttcctatttggaaccagtctgttgttccatgcccagttctaactgttgcttcctgaccttaccatatattaatttagatataaaataggatctgtttatgaacatccaggtgtgataaaacagtaaagagaatgcagtaagactccttccaactcccaccaaaaaaaaggtgttatacagactgaaatccaaccagggttcctttccagccatgtcagtggagctcatctattagtctgtagaaaggggaatcttttctaactataaagacatcctccgctcttagctaaacacctgcagagcttccttggaagagttctcggtgtttttctaatttacacaaaactaccatatgggctagcagcagtcctttgccatttatctttcagtgtattcctgcaataaaacattattaattgcctcagcctataattgtttaaaatatgtgttcagtaagttcccttaactatttcttcttcaaaagtttcatcattattctctcctttatttttctaagtgaactttggaataattctgttaagtttccttatcatatcttcttctttcctacctttgatcactaaactcttctgttagaattgtgttaaacttatatattagcctactcgaatcacttcattattcaatttttccttctgatcctgaaacagaagatgcatttctatcttgaaaagagtggacttctgcacccattcatatcatgccttccagcccattagcccataaaactgccacttgttgggtcctagttttctgctgagaatgaaaagacttttattctacaataactacagaacacaaacaacaactgggattgtcacagcccgactttacagtagaaaagagggaaaacaaagatcttgatccaggtcaggtttccacttctagttccagttcacatgcacccgagactgtagtgagtgccttataaggaagccggtcatgatcaaaagagaaaaacttgtagcagctttatggagaggcttggcctaatgaccagggctggtctcttgagacatgctctcctgcctcagcatttgtaggccagaaaagtttgctcaaagtagctttattttcacgaaaagctgcagaattcagaagatattttgtccacttgaagactcacatacttaaaatacaagaaatagaacaaacaaatcttactgcaaaaagaattaggttatttttcttttaattaggttggaaacaaataatacattctagactgtctaaaagtgattttgggcacaagaaaaccttttatttgaaaattatgatttgtgttctttcatgagaatgctaatttcttaaatgactttcaaagttttatatcagaatttacccagactgggtgagcagggcctgacaaaaatgtaacgcaagtgacggcacctaaacacttgatcttgacaaaatgtgatttggggaaatgtcatcatcctttaaaatgcaaagggacattggctcctatcacaatctaacaacaaaacactgagtctctttttcattacagggataaaataatattaaccatggctcttctgcaaaaggcaatctatggtatgaaattgctagaacacagatttgtcatgttgattccctgtcaacaatct

SEQ ID NO: 43667 - DNA, 1648 bp, Bovine  19866880340576
atagtttctggtcttacatttagatctttaatccattttgagcatattttggtgtatggtgttagaaagtgttctagtttcattcttttataagtggttgaccagttttcccagcaccacttgttaaagagattgtctttaatccattgtatattcttgcctcctttgtcaaagataaggtgtccatatgtgtgtggatttatctctgggctttctattttgttccattgatcttagtaaacatcagtattcctaaatataacttgttacccttgcaaggaagtagaacagatctttaaaatacccacaatatcttccataaaattctatcactaaggccatagattttaatttctgagaggccaatagattctttcttgaaagcatttattatttataacacagttgtaacttatgtataatactcaagccaaatcaaattttaaaattacaaaaaatagacttaaatttgtagatttacaagagaaatcaattaataacctatcatgtaggctgacacaggaagatgaagaagcagatttagggtaagagatggaattcgtattgatgagtctatgtatgcctgaaatgtgacatgcagtttatattagtcatcaagatttctaaaaatacaaaaatatttaaatagctcattaattttaaataattaaaattatattagagtgtatcaaaattttgaactagttaaatcattattatactgaccatcattacattaagttcaaagaacaaaatgaaataatttcaaaagaatatgaatgaaattgtagcttgtaaatattcatatatgcatgcataaattctaatcactgtatggtttttatattagggatggtgacatagatgaatacagcagtgtattggagaaaacagatatcaaaaccaatttctagtgtagcatgtaaccgctgatataatcactgtgtgagcatgactcctttgggagaggaaaacagaacaactacttgcctgagggagtgaggaaaggccacggatgagattcatttgaactggcactgactgaggagcaggagtttgccaagaggaggagatggagtggggtattccaggcacaacattctcaaagcatgttgtgtgttcagggaacaaggaggtcagtgtgcttggcacaaaaccatagagaaaggaggaaaaggttggtgtagaaatagattttaacattctgtgcaaaagattttgaactttatactgcaggtaatgttagggcagaagttttaggcaggaaaaatgaaatgacccaatttgatgtggttaaaaaagattgtaagtggggagtaacatgtagataactacctaaacagaagtgagatcagccaaaggaggccagacaggaggaagagataatacttcaagtgaaagactttaagggactgaactaaggtattcaaagaaaatcagaacaatattcgagacattagtaagaaaaaattaataagcaatggagattgattgaatatagatagacaaaaaggggactgtattagaagtattcttaaactttgaacgtaagcaaaaacagaagataacaatgctcattaaatataaaatactggggggaagatgattaacaggaaaggtaagtagttctactttcaggtcagttcag

SEQ ID NO: 43668 - DNA, 2008 bp, Bovine  19866880406878
ctatttttgaagccagtaaattttttattttccccatatatcctacccacttgaaatgactgttggtctatgaaaaattaagagtgtctatttaaacaaatcacatagatttctagttgctttagtcaatttcaaagtaatactaaagattaagtcaccactgaaaatatgttttaactttaccacttgttattcttatcccaggatattagcaaaatagcatcttaattttcaagctacaacaggcttatacagtgaattaatgtcatattactgagatccattgattgtatttctctaaacatctttaccaatgttttattttaaattaaactaccaaaatgaagaaattagtttgactattttattagtttcctttaatcattctaattattattctgctattttgtcagtcttctaaaatcaaattcttgttagtgtaacatttgctacagtttgtttttctctgtttacagtaatgaaaaactgtgaggataatatgaaaagccagtgaatgcatctcttttccaaaagctatcacacgaaaatattcatgtgaaactaatttagtatcttagcaataactattaaatcagttgagttctctttgaatgacagcatgtcaaaaaatttgactctcttttctgaaataggtctgtatttacataaatttcttatatccagatgccactttttctggttagtcttttatagctagctaaatcagcatttaaaattttaaaacataatattaaaagtagaatgaattttccttttatgtttaatccttgatttttttccctaaagtttattaaatttgactttctgcttatgtttctctcaagaaaggtttaatactttgaagcattgaagagacatcttaatgaactaataagtatgaaatattattattatgaggcaaaatgcactttccttaatcttatgttcttatataaagaaaactttaatcattttaccacatttcgtacttgattttcagtcaaacaaagtgctttccctattagccaaggtagtgtctgtgtttgcatcttggaaaatatctaggcctcttagtatacacagacctaaaggagatcattccaataaatattcaggagtaagccttggtaggattttcaagaatacaggtgttgaagccaactaattagaatggggattttataagaatttgctcagggagttaagacttatgaaataaaagatgattaggactatagggaaacttgtaggtagttctctcattctcattccaacaaaaaggctgtgatctctgtctagttattgtacattcttcatagcaaatgtaattaattccagctgggaagatcccctggaaaaggaaatggcaacccactccagtatttctgcctgggaaatcccatggacagagaagcctgacagcctacagtccatgggggttgcaaagagtcagatacgactgagcaactgagcatgcaaaacttagttcatggcaaaattatctagacacgttagcctcgttttcagccatctcacttggaatcacataattcagacactcgtgatacgctcagaaactcttgggaacttcaagtagaaaacatgtgaacagcagatttgggcagtgaaactataggctgcagaagctctgggtataattccttgacagatataaagatgttcattaaagcacatgtaatacattaaatttaatacctaagattgtttgatcctcttgtttacaatcaacagaaacatgtcaaattatcttaagtaatcagaagttgttgtaagaataaatattgtggtgcatgagtattagtttatctattcagctccttttctctgaaatacccaacttcaatactggaattacccccacagtctttgatctgttgtgtaattcagcttccctaggcatcataatagaatatttgggggaagaaagctgagctaatcaaatattttttctctacaaattagtaatttaaaactaaatgatagagaa

SEQ ID NO: 43669 - DNA, 994 bp, Bovine  19866880687237
ctttatgaatgaggtggcattttaaagaatggttgaagtctagaaatcagaaaaggtaaaataaaacagagtaaggacagtttaaaaagtagaaccattcgtggtgtgttaaggaaacatccaggtgtccagactgactgtagcacagcatcggtgaagaataatgagagatgaatctggaaaaacaggtggaagccagatcactgagtgccttaaaatgcagcctaacaagtttaaactgtaggcagtggaaggtactggcagtttccgttttgtttgtttttagcagatggctgaagttattagagttctacttaagacagaataaccttatattcctgtgcagggtgaaatagacaggaatggaggcaaaacaggtcattattctgtgcagaaacaagccctgaatctaaatgatgatagtgaaaacagaaaggggggaactaatgggagtgaaattatcgcccttttcgatatcttgaaataaaatctttccacatttacatgtgcagctattatcttgtcacatttttacaatgaaagtctgtcattaacatttttctgcagtaatttatcttgttatctacggaaataccttgtttgcaatgtgaaactgttttctatacagtctttgtgggtgtgaaagtggtcttaaggtgggaaaaatattgaaaatcaaagagatatttggtgatcaattatattcatattcagagtttcacttttttgtctttcaaaggtctttataagaatcaacttgagtttcaaactagaagttgaaagaatatgataaaagttagaagccatattcatgtagggtagaaaaccagtaaaagagaagaaactcaatacgtaatgagatggactctgtgggagagggagagggtgggaagatttgggagaatggcattgaaacatgtgaaacgtcatgtatgaaacgagatgccactccaggttcaatgcacgatgctggatgcttggggctggtgcactg

SEQ ID NO: 43670 - DNA, 1271 bp, Bovine  19866880720549
agctgtcctggagtagtataatatttactcactctacagtgattagattattattattattttactacaatattcttggtagcttttctgagatgggaggatttgtatacagattacaataaaattgaaaatctgttctggattatcacaaaagaaaaaaaaaaaaaaaaacccgcagaagggaggtttagaattttttgtatagtgaattcattgatttactgcatttagtaggtgtttaggcttccatatcatcctaccttttaaaaagaaagatatataatatgtaatgtaattttatggatatcacatggacatctttgagttttattcctagattgtctatttcttaattgttttaaataaactttaatgtatactgtcatgcttcttaaacgtgttgccttatttattaaggcattaggaagagaaaaaaaaaattcactgaagttttttagtgagtttttaaaaatctactcactgtagatttttacaactataaatcaaaacctaaaaataagctttctaagtatatatatatatatatatatatatatatatacacacacatatatatgtatgtatcaagatagtatcaaatctcaaaatagcattattttgcaaactgcaatattttgttgtatgtttacaaaaaactaatgaggaaacttttcctttagtttagctttccatacttaatggatttgcagtaatacagcattactgagatataaaaactatagcattccccctcagaaaatcagaattaaacaaagtaccttaaaaatctagtctaatactcttactttacaaagtaaaaaaaaagaaaaattgagactacctaagatgaatgattttcttcaaaatatatagagcttgtttagtgacagaaaccaagacaacatgtagaggtgaaaatccttgtaatcgcattgcactgtgcacaagaagctttaggtcacatctgtaggctccttttcctctgtgatcctcaggttgaccaaatttaaagccctgcatttattcagcactcgactcaaagctattgaaatgctttaaatgcagtgttttacctaaacatatgcatagctatatgctatgaagtagcatatatgctcaaactcctgcacaattgcactcatctcacacgctagtaaagtaatgctcaaaattctccaggccaggcttcagcaatacatgaaccatgaacttccaaatgttcaagctggatttagaaaaggcagaggaacccagagatcaaatttccaaca

SEQ ID NO: 43671 - DNA, 1159 bp, Bovine  19866880823825
tctcctgcactgcaggcagattctttactgactgaactacaaggggagcccaaatagtactttaaagtatttaaagaagttcaaatagtactgtgtaaatgcaaatcaaggtatatcttgccttaaacattattttgagtctgaaaagagacatgtaaactacatttatatatgttaactcttagtttggcagtggatgagtctcacttgttagtaataccctatatttaaggagttctaaatctcattactgacatggtctagtctctagcttcctttgacaagatctgtgtcactctttccccctgattcatttcagtttgatcatgttggctttttttatatgcttgaactagtcatgtcattccattttcagaatcattgaccaagctaccctttcctccaggaacaacttttctcctgaatatttgaggacatccacttcttcctagtgctaagatcttgaacaacaggcaccatcctccatgtgcctgtgccttaaaatcctcattcttaacaaatgaggttcaagaacaaagttcttgattactttcaggttaaaatggtggcaacctaaattacctgaaacaatgccttccagcttcccattaaaatagatgtttgtgattttcagaaagcacactagtatataactttaagttatgtaaaatcccactatccacttatattatcaccaaattcacaagaatgttctcttgtcatctagggtcctacgatgatacaccaaccacttgtgctaccaccagtcaaaactatggatggccccaccttcaggtactgcatatgaatatattacaaaaggacactcacgccttaatgaaactaacatgttagatttacagtgatattgaggacaatatgaatatgttaacaatcataagaaagatttcacagaatgatacataatataactccaaataacttctgaataaaggaaaactttgaaaggcaatctaacaaactactaataaagatggatttatgggcatctgtcaaacttacagtcatttccttgggacctttgggtatgaacttatcccacatgtttttgttcccttggccagaggactaggaatgttaaattaatacaaatggctcttataagatttattaatatccttaatttgggtagtattag

SEQ ID NO: 43672 - DNA, 1582 bp, Bovine  19866880897606
gaaatctaacagaaaacaaagtattttgaaaagtattatggttaagatcaaacagattaaaacggaagggtcaacactaatggaggattaaagggaattgtataacctttactgaatgagaacaaaaagaactgaaaaccaaatccaattatctctgtgaaaaaaatgaaaccaacacaacattgtaaagcaactataaacaataattttttaaggcattgtggcaattactgaaagctgaatatggtgagttttagataatagtaatgtatcaatattaatttcctgcttatgatgttgtaatatggttatgtatgagaatgttcttgttttcagttaagtacaccaggcctttgtgttgtcaatttagtctcaaataaggaataaagaatcctttgtattgattgcatggataacttttctgtgggtttaagatctggtttttttaattctaaaatttacagggaaaaatctgcatcggtaaggggattttactttttaatcatttaaatattattgacttcaagttagacttctttaaaaggaatcagaatttacctgcatgatcctttgtataattataactggatcaaatcagtcagtgcttcagaatcagctttttgccagacataaatgaaagaacggtgtttactttttaactgtacttcctctcctattactaagcatgaagttatttttttttaatatgttttgtctttagccttaagttccaaaaattcattgcatgtattaactatgcttataaacttgttttgacataataatgtgacttgatatgatgtaagagaaaaatagaaacaatgcctgaaagactatactaattgtacttaacaaactgtatttctgaagatttatgcttaattataatgattgtcggctttaagaatctacatttgatatattgtgatttcatcaaaggtggattttattttacatactttaattgttaaaattgagagaaaagtgagtgaactgcactgtatattactaaaatactttgattttccttttaagaacaaggtgttgatatttatcagattttacagagagacctttaattcttcacaaagtaaattactataaaatttctccaaatgatattctagcagtgtatttattttattataaacaagaattttgcccaatcaataaaatttggcatattctgtgtgaaataggagttaatttttcactaggataataatggtataaaaattaagaaacctgacaattgaactttgaatgatcagttggatcagtattgtcatggctgtaattacttccacaaaaatatcatttctccttttaatatgcactttgggtgaatggcatgacttacaattatcatgaaattgttttggtcatcttaacaatcactacatacattttctgtttaaatgaggaatgaatttccattaattcattaaggatgtttttatcaaatgcttaatttgtttccacatgtggtacatgggaattattgaggatgagagagagatacagttaagacatgagtattttcttatgactgtaaaaaaaaattctcttttcccttcaaaaa

SEQ ID NO: 43673 - DNA, 1630 bp, Bovine  19866880945129
tattgcagtactccagatctttttaaaactatgatttgcaccagaaataaataatagaaatggacggtatgtctttttgtgaggtagaaacaaagtgagatagactggatagtttaaatgtaaggaaaaggaaaagaagtgtcaaaggatcccaggactgacttgtgtatttgggtaaatgattgggccatttactatttggaaaagtctgtaataaaaatgctcttatgaagggacataaatggaaagagaaatcaacaatttagctcagtcatattaagcatgagctatcttagagacagtcaagaagagatttgaaaaaagcaattaggtacacaagtgcagaggttagaagaggggtttgagctaataacagaaaattgaggatttttttcattagtatattatctcacatatttctaaataatttgccttctagacataatacagcataatataaatatatagtaattctaactctttctaataaggtgtcatattttgattattgtagaacaagaggaaaagggctaataattattgagcatagactatttatgaaacattgacaggtgttttacatttttttgttttctcaataatgctatacatttaattatttacacttaaaccatgggaaaactgaaattttaaaaggttgattaagtttccctaagatcaatcagcttatcaatgacagaaacaggattcaagcacaagggttttgttattaaaacccattttctttctgtaccaccattgtgtaaaccatttttcctttcttccttaatgagagttaacaatatccataaataatttttcaaaatagaaagtaaaaacaatgatgttgctataagaacatgtgtagctacagccggtaaaataacctttgttagaagttataaccacttccaagtaaagtgtatacatattttattagagtagctgaagaaatggtgatatgatttaagcagcattttcatttacttgtaaacatgagtgtgtgaatacttttttgtgaccattttttaaaagttatagttttcctacaatttccaaaagtctagaaagtaagtttgattatcttaacacacacatatacacacacaatcacagtaattgtgtcttagtagtgattagttatttccaccacagaaacttggtatttgagggcttaaataattccttaaggtaagaattaagcaatcaaaattctggtactgtttattattagaattacctggagggctggtatttgttcttttttctatttttgactgggggcaggggcaatggtaaacattttctcctagtggatttttctgaaatgtgatcatgcatttttttttttttatagcatggggaattctattccattagtttacataattccatctcatttggaatatgaagtgatatttcctttctatctctctctaagagtttggaaaaaacaaggttgcagtgtgagcagactagagatactacttcgtgttcttaaatgaaaataatttatttttattatcatattggaaatattacagcaaaatttaaacattgtctttgatataccttctactttatgtaacccaagatgttgttctatttcatccatgcatgtaattctgcc

SEQ ID NO: 43674 - DNA, 1965 bp, Bovine  19866881024427
tgaaattaaaagatgcttgcatcttagaagaaaagctatgaccaatctagagagtgtattgaagagcagaaacattactttgccaacaaaggtctgtctagtcaaggctatagtttttccagtggtcatgtatggatatgagagttggactataaagaaagctgagtgccaaagaattgatgcttttgaactgtggtgttggagaagactcttgagagccccttgggcttcaaggagatccaaccagttcatcctaaaggagatcagtctgggtgttcattggaaggactgatgctgaagctgaaactccaatactttggccatctcatgcgaagagttgattcatcggaaaagaccctgatgctgggagggattggtggcaggagaataaggggacaacagaggatgagatggctggatggcatcactgagttgatggacatgagtttgagtgaactctgggagttggtgatggacagggaggtcctggtgtgctgtgattcatggggtcacaaagagtcggacatgactgagtgactgaactgaactgaactgaactgaaatgaattacaaagaatttaaaaccaagtggtcaaaggctatcttatttccaaagagaaattagttatagcagaagttagggacagggccgtttttattttcaaaagagaactttttcactgccaaattctttggaaaattttcaatgtattgcaacataaaacatggaagagctcgttttgtcataatttttcttttaagatatgccactattatttgatcttcttgttcattaatatctgcaagttcctaacacccccactttgctttttgtaggtgaggagttcagtaaatcttttaggctgaattatagcaaaacatccccaaatggtagaattaatctgctagaagagacatttaatattaaacattgataattcagtaaaaaatcataattgttttaattttattgatacaaaattgttctgcctggtgaaaattagccaacaatttaattttcttttttatacagaaccttgtcatttttttaagtaatgaaagccaccaacattcaagaggacacttgttttgtctacttgatataggcattaatctaaaatagcttgtaaattatttagatgttataaaaacacaaggatgaggctaattcatgcattatgacatatagtgaggggattttagcttccagaaacttcttctgggtctgagttttagaataatattatggtacatgctttgttgatgcattaatagcgtaggatctattacaagactgttcatgctggaacacagtcagaatctatttgtggaatcaaggcaagatcaatgagcacagtgaagagcttattctattattagccattttcttgatgagaatgaggttagacacagttgtggcataattgtgtctaaaatcttacttcccctgaaagatattaaattgaattattcattcttataacctgttgagaaagaagcttagtattatattaaggtgacattcaacatataaaaggaatatttacagcctggggtgggataaggagttctcttcatgacagtaaattagattgtattttgagactaccttaaaagcttctagaataaatagctttgaaggactgaatttacctttcaggggaagacaaaaaattatggttgtaagaattgcccaatttggctttttcaacttaaggaaattatgcattttatagtagataaaatgatagaattcccagaaccataaaaaaattcagagagatcttccaaaactatcaattcaaatgaaatgtttcacctaatcaccaatacagcagttttcattgtgagttagaggctttccagatagaatattggctctggagactaaatccaaaggctccctttagaatctgttatgaaagaatctgttttattatttgaatgcttacaaaaattctaaga

SEQ ID NO: 43675 - DNA, 993 bp, Bovine  19866881031822
taaatgtcagaaacaaaacccccatttttatctatgaaaaatgaaaaggtttaatcattttttaaaaattactacaataaacaagaaaattctttaagcaataaatacctctatataaaactattactgaatattttgctcaacatgatattagaaatatgtcattgttttcttaatgtaaattattaaatttttaagaggtttagttttatttccagcaaaaatacaaattttgttattctatttactgtcatagaaaaatgctacatgctataaatcaaccctgaatattcactggaaggattgatgctaaagttgaagctccaatactttggccaactgatgggaagagccgactaactggaaaagaccctgatgctgggaaagactgagggcaagaggaggaaggaaggagagaagatgagatggttggatggcatcattgactcaatggacatgagcttgagcaaactctgggtgataatgaaggacagcaaagcctggcatgctacagtccatggggtagcaaggagttggacaagacttagcaactgaacaacaacaacatctacactaatacctctccctctctctctctcactcccttggtctctctctctctctgcccttaacacatactcgtgagactttacccatgagacagagagttcaaacttgaattttatctatcatgccaaagaactagcatctggctcaggtgtcgtccagccctacagaaatactgcagacaaatctctaagattatgtctatttggatgcattatttgcagagcacttttgaaacagatgtgagggcaaatggacacagttctatgggctaattctattgtttgcaacctctaaaattatctttagaatagaaaaggaatatcagtaatgcttgaatgtgttaaagaagcatgcttcctacaagaaaagagagagaatttctcttaagttaatattaatgtatcatcacaggctgttcaggga

SEQ ID NO: 43676 - DNA, 740 bp, Bovine  19866881038667
aaggtcttctggaggagggcataggcacccactccgtattcttgcctggaggatcccatggacagagaagcctggcagctacagcacgcggggttgcacagagttggacacaactgaagcaactttgcacatagaatacatagataagggaagctgtgggatttaatggattgtaaagatttttcttcctgattaagtgattatgtatgtttatcgcttgtggaggagaaaaagcaaaatattaaataaaaattgtcctaacatatacatcactttataactctacaaactttctcactgaacagtggcagatagtttaagtaaaaactggtaacggtttattacttcatctctggagtagaaacttcttggcaaaatgggtcatttaggtagctcacagctgttcacattttcaaactctctggaaatctccctagagtgatttataaattttgtagaacattctgttgagaatggggaatatgttaaattcacttttgaaagtcaaaattcttgctttctgattccaataattgactaagaaggaagtagcagtttcctctggcttgtaatttgagagcacctgcagcttaagagagaggtcagcaagttgaaattaaactctttatgaaaatacagatcaaatatgggttaaaatcccaaagacacccaggttcataactgacttagctgatgttacttcattgtaagaagagcaaatgaaaagttatgttgacaag

SEQ ID NO: 43677 - DNA, 1891 bp, Bovine  19866881077724
tgaggaggctgatatttgaaggtgaccttgaagaactaatcagctttttacttcacagagaggcggaacatctttcttcaaagtgaagatcagggaatgagtagttccatgtgaggctgtggatcgagcagcttggatcagatgagctggggccagcaactgtgactatggaatgttgctggcaccttgtgaaggacatggctgtgtacccatggtgatgaatgaatttgtattttaggacataaccctggtagaagcagaggagattgactggagtaaggagagctgctaaccagacattttgtttgttgtctggcttgaatgaactagtgaaccacagtacagagtgaagatgaagagacatattccagttctgtgatgcttgaagctttttacaaatttcaaggctctcaaaataaaaaaaagttcaaaattataagcacaaatttaggtacaaaaacaaacactttataataaggaaaagaatctgaaaacattactaaatttaaagggttgatgaatgctaaaaattttataaaatttgggaaaataacacagtatttctatgacataccttcctgacagttctacctattaaagatatagaaactttttagattcatgctctttaatatcttcatatgaataatgttcattatattaatacatatacaaaatatgaattataatagcattctgtaaggagagattagaaggaaattaaagcttttttcatattacagttgatcattttttttaattgatggttcagatgcaaaagcatgtggcttcacacagctgaatctgctgcttatatgcaacaggaggtgccctacacacaggaattctggtaagtttcagcacttttcatcaaaagaaggaagaaacagagtatggtgactgaactgtacatgctgccaataaatcgtatttctaaccagaaatcactgttgttttggttaggcattttatgggaatcaaatgtccctttaaaattatagatgtttgaaaactggaagaattttctatatattaacttctggttctgtacatattaaactgtgtttctctattctcatagtttcagtgccagatgttggaggataccttcttacagtgacacatttaaatctttctggcttcttgctgttacgctgggtgagtcagcacagtgtgtggtagaagtacttctggaagtcattcctgtagcaggaatgctgacaattatgtaaccctttataaaagtgactgtaaaccacattggaagagaccctgatgctgggaaaggttgaaggcaggaggagaaggggacgacagaggatgagatggttggatggcgtcaccaattcaatggacatgagtaaacttcaggagttggtgatggacagggaggcctgatgtgctgcatccatggggtctcaagagtcggacataactgggcgactgaactgaactgaactgaaaccacattggtatgttccaatacaccaaaactgaaatattttcaatttagttggcccttagctggattccaaacatgctttgttgtccccctaacactacttaatatgaatggaagtgttatgaggagcaatcagtgtggacagccatcttaattgattgtgatgtttttgaaatttttagaaaaacatatgaatatatgatggcgaaggaaatggtaacccactccagcattcttgcctggagaatcccatgaacagacgagcctggtgggctacagtctatgggtcgcacagagttggacaagactgaagcggcttagcacagcacagcatgaatatatgaacacattggtaagaggcatctcttagagtgtaggaaggtgtttgtgcatgcaagatgcaccaaaatttacactacattagttcat

SEQ ID NO: 43678 - DNA, 820 bp, Bovine  19866881722933
ttgcaaagttacagtttatttgatttctaactacgtatatccaaaaatgcattgtaacatttaatcatgaagacagctttttctctcttgctccatcttttggtcttcacattgtttatagcattattttaaattcaagaattcagaacaaatgcattttcttacggtttcaagactaaaagaagctatcattcatatgtatatgttaagacaataagagcagtaagtgagacctgtagaattattttttaaaaatcaagcaataacttattttggtttcatgtgaaaaaattatgcaagtaatgaaagaaagttaatgcattgtatgttggcattttcttagtgaaatgggagtctttttctgatcaattatttggaaattgtaatagagaaacacattgtttagaaaaataatggcataaataaaagcaatagcaaacaagatcttcataaaaaaggcgagtagaaccagcagcaaaggaaaactataaagacattatgtttgagaataactcattaaagaagtagaagttgctgatgcgttacttcaaagggaaatatgtttaatgtatttggaagatgaaagaatttgcagcagaaggagttagctataggctgtatttaagtcttacacacccaccttaatattgggtatagaactgtaatatcttttccaaaacgtgtattttttttcctttcaaattatgatgacattttttttccatcagattatataatttcctcttttaagtatattttcaagtaaactttatattttagaacagtctttgactcacagaaaagtgatgtcaatacatat

SEQ ID NO: 43679 - DNA, 1710 bp, Bovine  19866880366443
ccccctgcattgggagtgcgagtcttagccctggaccccaaggaagctcatcacagactttgtatgtaggtcactggctacaaagtaggtttgactctctctgggacagttctgcctgcacacgactactcttgcagtttgtcacggtgtctaacaagacacaggagagagaaatggaaacaaaccacttctgagcaccagcagtagcggtcgtcactcacaggttgtgagagttggaccataaagaaggctgagcaccaaagaactgatgctttcaaactgtgctggagaagactcttgagagtcccttagatagcaaggagatcaaaccagtaaatcagaaaggaagtcaaccctgaatattcactggaaggactgatgctgaaactgaagcttcagtactttggccacctgatgcaaagagctgactcattagaaaagaccctgatgctggaaagattgagggcaagagaagggggcggcagaggatgagatggttagatagcatcacggactcaatggacatgaatttgagcaagctccaggagatagtgagggacagaggagcctggcgtgctgcagtccatggagttgcaatgagtcagacatgatttagcagctgaataacaacaaacagtagcagatgtcgtctgtctgcctgtctgtctgcccattctctttccccctttcctcatagcatccacagagaagaacttacaaataactttcatgattattttcctgtgcaaaacaaaacacaaatgagtatctcaatgaattacactgcctcgtaaaattttgtgctaaatccactatcatcttataccaaacgctgctacaagtcagtagcaagaaccagtgatctagcaggaaaatgatggaaggaaaagccaaaactataaattctattcattcaggatttgattgttttttttcccctaagaagtggaaacaagttgatttttgtagaggggagtgtctcgtattcagtaagagcagtcacatatgccggacaccaccctgctttgaaacagagctgttatatctctgagagtggccagatgcctggcttctcaaaacaaagaaaataatttgttttcccaagagaatgggagagtgatccaggaaaatatccccttgcttcatctccatcaaaagtatcaaatgcatgaaaatttagtacggataatttgcatctgttgggggctttcagcatgtcaaaatggtttcacctcagctgctatattatgcaagactgctagtgtcagaaacccaactcaaagtgattaagctttaaggagaatttactgtctggtataacttggaaattcaagcatggcttgatccaggtactcacaaggtaccatcaagacttggttcttttctatttgttcccttagggaggtatttaccagggaagaggaggttccctggtagctcagtcagtaaagaatctgcctgcagtgcaggagacctgggttcaatccctggatcgggaagatcccctggagaagggaatggcaacctactccagtattcttgcctggaaagtcctagggacagaggaacctggtggggtacagtccatggggtcacaagagtcagacacaacttagcaacaaaaccacaaccacctaccccaggataaatgacagcaggagctccttgctgtttacagtcccaccagctaggggcccaagaagaaaaaga

SEQ ID NO: 43680 - DNA, 1154 bp, Bovine  19866880386235
ctgcaggccagagaaaagggtcaagaggggagttcccgtaaaagtcaggacggaggctccaggaactcaagtttctcccccttcatgacttgctgcaaactctaaacaaatcccggtctgatttacatcccctgccccgagccaggccccgccgggcgctgtgcctcttacggagataaagatggtcgaagatgagagagggcttgtccatctgtcccaagataaggagcatctcgttgtctatgaattccttgaattctttcaggttacagttcatctgtttctctaattcattacgaatctgcagagtggaaaatatcaggagggtttaaaaaaacaaaaaaaccccacaacaaaccagttccttcaaagaagtaaagtcacgacatgaactatgctgttgctgctgttcagtcccagtcgtgtctgactctttgcaaccccctgaactgcagcccctcaggctcctctgtccatgggatttcccaggcaagaatacagagtgggttgccatttccttctccaaaggatcttcctgaccctggcatcgaacccgtgttttctgcattggcaggcagattcgttacctctgagcatcctgagaagcccaactgtggctgttttcataagaagtatttgggggcttttttcaagagtcatcacatatgcatttagacatagcgaacacacgcatgggtggcaggaacacagggctgctgctgctgcaaagtcgcttcagtcgtgtccaactctgtgcgaccccagtagacagcagcccaccaggctcccccgtccctgggattctccaggcaagaacactggagtgggtgcaggctactcggcctcaaagtgactctgactgggggacgtttattatttcaaagaaggaatctgattccctggaatcttttctactgagttgaaagcacttaatgcttttccaatgctcaaatctatcaccatgaaaacataagatcagtttcatctagctttggaagataccacgatgggcttcattatgtgttatttcataagaaaactgttttgtacaccgttaacctgctactgaattcagctgttactataattcacagcattccgtggacgaaaagcaacagaaagaagaaaacaagtcatccagaaaaacgttaaag

SEQ ID NO: 43681 - DNA, 3418 bp, Bovine  19866880500716
gctagagggagtggccgtctaccccgggcatcgtgcccaaaatccctgcagttagaagacctcctccactgtgtctgcaccaggacaaagtcacagcgaccctttgcaattccctcttctcaaccttagtcttttttctgcacattaacagtgatgtgtgagtcagttgcttaatgcccgaaaaagaaaaagaaaaaaaaatctgactctgggaaacccacacacgcttaaattctaggactggaattctgttcagagccctaaatgaatggcatcctcacgtcgccttcgatttgtcctctccatctggaatcattgtaataatgggtcacggctcatgtgtgtaatgcatgaactgtgggaaacaatctatatgcgcccatcatttaatccacacaaaatcctcagtctctgttttttaaaagagtaagaccagagatgttaatttacctaaggctacccagctaggaggtggcagagtcggggctccaccccaggtcaggctaactcccgcatccttcatcctaagcctctgacctctgccaggatttgcctagcatttctggaggcaagctctcctcctttctactttagaaaaatgccatcaagggggggagttacttatcacctgacacagcccactcactaccctcacattctctctatttgcatcagctactcaggaaattagagcaaatcctatttttagatgctggggttcaaatgacagtgatgtatgggttagtggctcatttttatgaaagtggctcagaggtgttacctgatctgatgtttggaaactctcttacatcaccgttttgatctttaatagagtttatttcaaagatcgctttgtttcttgcggctcctctgtgagtcctacaacagactttggccagaaacaataatacttggagctggaatagatggcacggagagagggtgagacttttctcagaaacttgaaacacaaaggatggcggggatgagcggagagcggggcagggcctcaaagtagagtttgcccggtggctgagcagcaggcaggcccttcctgccgaaactgactgtgtgtgtatgttagacaaaagctctacaactttactactcactcttcatagctaatcgcagtctcttagttttgaaggttccaccagcaggggggccacacgatgtctgtggggcgctcgggcaaccctaagacttaggcaagaaaagaaaagagcagaaaaagagggatggagatgatagagggaaaggaacaaatacagagcggttgatgcaccctggcagaaaatctgatttaatcagtttcaccctcttgtcagtactggaaaagacctttattcccatttaatagattaggcaaccgaggccagagtggtcaagcaaggacttattactgcagagcacatggctaatgactgtgaaattaggatggcaagatttggaaaacaaaactacaggacacccagttgaatttgaattccagataaatgattttaaaacatttagtttaagtttgtctcatgtaaaattacagacttatcctaaaaatttaactggacatcctgtcttttattaatacctggcaaccgtcactgagattcaaacagttctgtccattatttctcagatactcgtttgctttatatataatacttcatttatattatacttttatatataatacagcagaatataattgatgatgatcatcagccaatattggttgagggcagtgctttgcctctcctatttcacttgaaaccctgtcatcctcacaccacccccatccaatgggtacaattattatttccatattctggattaggaaactaagtctcagtgagatgcaataacttggccacagtccacagccagaaagtaccagagctcagatttgaaattgttactgtcttgcctaagcatggtcacttaagaaacagccttttcaaaagttgagttaacacacatgtagaaaagtgctcaatatctaaacagaaggttcaatgacatgctgcgaacatctgtgtaggtaccaaccaggtccaggaagaagacgtccagcactccaggagtcccacgcgctccctcccagttgcaatgctcatactcctccttggagattccgtcactctggcctccaacctccagctgagtttgcctgcctccaaacgttatgtaagtgaaatctttacaggaagtacccgttggtgtttcatttctatccctcaacactgtgcttgttggattcaccctgtggtggtgtgtatctggaatctggtccttttcattgctgtatagtgttccaccagctgattatacataatgaacccatcctattgttggtgaacatttatgttgtttgcgattagtttaaaatgtgatattttttttgtattgaagtacagtccatttacaatgctgttattttctgatgtacaacaaagtgattcagttatacatattatatatatatatattcttttcatgtttttccattataatttatcacagatattgaacatagttctctgtgctgtccaataggaccttgttgtttatccatcctatttacaatagtttgcatccgctaatcccaaactctcaatccttccctccccccacctgccttggcaactacaagtctgttctctatgtctgtgagtctgtttgtgttttgtacgtacattcatttgtgtggttaaaatgtgctcttataagcaacaagcacgactgctgtgaacattctcctgcgcgtctcttggcggacacaagcattcatttctgttgggtatatacctaaaaggggaaatgctagccagaaaggggtgtatattcagagtgcgtagatataccacacaggttttcaaaatgtttgtaccaacttacactcctaacagcagcacattcaatttccagttgccccacattctcaccagcacttgggggttgtcagttttggtaattttcgtgtaacggtctccccttgcagttttaataggcgcgcccctgatttctaattaggttgaacaccttttaatgagtttattggctctctgaacactttacttttgtgaagcctctgtcccagtttcttgagcatttgatttggctgtctgtcttttacttattgatttgtgggaagatttttaataagttctgaataggagcccatagttctgggtattggaaatatctgctcccattctatgccttgactcatgcacttaaatggtgtttattagtggaggtcttatgattttaatatatgaaatatatcagtattttcctttttgaatggtgcttcttaaacaagaagtcttctcctacccccaagattataaaggttgcctctgctctaggcttctggaagctttgttcttttgcctttcacatttagatctacagctca

SEQ ID NO: 43682 - DNA, 1009 bp, Bovine  19866880618001
aaattaaatttcttaaacaaggccaggaatttttgtgtattttgctttctgacagagctccagcccagtgcctggcacaccgcagatgcttagcaaaggtttgttgaatgaataaatgaaccaatgaccttaaatcatcctccgtgctttggggaacatggagaccatgcataggaagtgtgcttggcttttggcccaaggtgaacatttgataaatgttggctataatgattatgagctgggacagccagaggaactggggtccttgggcaggaagcccacctgccctgaccccagcccccaagcagccatcttcctgcccttttggtgagggggggaaggagatgggactcaaatccactgaacccaagacaacttttgtttcctctgagtcctcgatctggatggctggactgagctgaaccttgacaacgggagagcagccatgacatctcgatggagatgttcacggtctacgaaggctcagggtacacagcggccagaccagtcctcggccactatttattatcattgcaggcacttttctgaaagagacggcaggagttcgggcacatcactgcttccagctgtcccccgtgaatgctgtgtgcccactgggtttccaggaacataaaacccgctgtcaatggacttgcccagagcctgcattcgctgcgtttttgttcttgtttagttattacattaagtctcctgtgattacagagccgacagctggtaaggatttgcatatggcatgaaattaagttagttcattttaatgtctaaactgagcagggtgtgaatttgtctggtggaaactctgtctcccttatctgtgtttgcacatctgctttgggcactagcttctgaggtcttcaagtctcgtttctcctcactgtgcccaggcaggacagggggttggctgcccctgcgagaattccagaagggatttctgcacttggggcttagaacgttctcttttacatttcaggaggaattacgacttaag

SEQ ID NO: 43683 - DNA, 1005 bp, Bovine  19866880646735
aactccagcagcgagtaccgtcatcctcatcccattttatgagtgcggaacccgcagcttagaaaaggtaagtggcttcctcaccttctcaatgctagtaagtgatgaagccaagattccagcccaagttgtgtgtgtgtgtgtgagactcagtcatgtctgattctttgtgatgccattgactgcagccaaccaggcccctctgtccatgggatttaccgacatcaaagcgcacgcattctccatctctttctctgaaccccaactgactgtggaaaaagaaaatacagataaacaaaacgaagaaaacaaaataaaaccactcctccacctaccctgcgagaggtaacgtctttatgtacattggtgagtttccacccagctgttttccctctgccaaaggggaggttcttgctccaggcacatgacccttggtggtctgtaattgccaagcaattaagggatgacaggaaatatataattcatgggcacatctttcatgctggttgctggaaggcagcgaggcatggccgtctcccagggagagtttcaaccttgacacgggaggagacaggatctcaggggcttagaaaagaatttcggaatcagagaacctgccaacattgaaactgaccctggaatcccagcacagaatgctggaggtcagggatcctaacatggggccttctcatagagtcttatgaaaaagcattaggataaaatctagaattaagctttagaagcggagacgacaacttcgtgaagctggagtcagatgggtctaaggatggtgttctgatacacacctctctttactcccacaagcaaaatctagaacactgtctagagacattcttcattgtcataacttggggggcggggtgggagctgttggggggacaacgctggcatctaatgggcagagaccagagacaccaacccctacaatacacaggatggcctccacacccctgccagccaggaattgtccagtatccacaatgt

SEQ ID NO: 43684 - DNA, 816 bp, Bovine  19866880666506
atgtaatactttgtgcagtgatctctcgttagtatgtgtccgtcagaatccatcaggctttaatgccccttcccacaaataactgaaaacaaacacagacagggcacattcctgattggtcaaaaaggtgtgtacccaacctttatactaatctttgttcaatccccagcacacacgacaaacatctaccacagaacgtggcacctggaggcctaatatacaacacaattcccagttttatttcactttctccccctatttatttatgcaaactctcagattcaagagttactattaggcttcatatccaaacatggtgctgtgactctgaaatgtacctccaaggcaaaagaaaaaaaagtttcctttaaattaattttctgaaatacatagaatcaagtccaaaatagtcttcccatgtcttcagttttacaggcagtgcagaaagtgcagtcctataaacagctatctatttgccttcacaattgaacagcagacggtacaaagcaactgcttatacttaatcatgtttctgtctattctagcaggctggtgtcaggagagagttctgccagataaggacaatgaaatgtattattatagagtgactaccagccctacaagtgttgtctgaggatggaacccggggcaggaaggctgaagtgagagggcctactattttgttgtaaccatttccaaaagtatatacattcgttccccaaacgcgcactatattcaattctgcttaaatgtcttataggaaagaaaggcctctatatcttgctcccctgggggaagatgagcgacttgcaattt

SEQ ID NO: 43685 - DNA, 1814 bp, Bovine  19866880704749
ccccataccctggctcaaggaacaaagatttttccaaactgttcatccctactttatattcatacaggttttcattttagggaaaaatgctgatcaaaatcacttgacgtgtccaaagttcagtaactatcatactgttgatacatcagaagatctttccagaggcacggtcatctctcaccaccagccttggaataattccctgaaaactcattctccacaaggagaatggtaagttaaacatgtgctcagacgcaaaggaaaagtttgcagagcctgggcataaggcctccattcacactgtgcagagttcaaaggagtcaaaaaagggtaactattgaagtgggtttttctttcttttttttttttttcaacttcctttttcttagagcagtattatttatgtggatatgcgttctattgaaatctcttcaggccctgctcctccacaggaaggagctacagtgactggtggggggcagggggtggtgcagggagagtggtccacagggcaaggctaggcgcccagcagctggccgggaagaccaatgcacacaacacagggcctgcagacaggcggtcaccaagagtgacagctcatacatggcccaggaatggaacattctgaggaggtttaaccttaagggaaccagaaacgccagccttaggtggaggtgagaggaggggctcaggaagagcacacacagattgggttaccaggcgctggaaagtaagctggccaccacagccgccaggcacggtgtgggagccctcacctgcatgtgagcaaaaagaaacagtctctatgggcacaagtgaaaatgccaagcaaaccattctggcactgcatgtcctctttaaaaactggattgaagagtgaggagaccattttaaaagtccatgaagaatctggcggcagttactgtaaaaatatggatattttatcatcagaaagcagaaaggtagaagagttggcatttcctggctcagccacgcctaaatatacaacagcaaatggagaggctctatctcctaacttcttaacttaacagaaaatttataaagcaaaaacctcatcactgcagacaaataattccatatactacctctggtctgagaacctaaaaactaggaacccatgatgaggtagaaatgagtcaaaacacagttcagcttgaaaggaaaagctggagagcaaaagaactatccatgtaagagcaactacaggaaactaaaacaaagtatttgacacccactcagaaaggaggggaactggttgccgaacccctgtcctgagtgtcatctccctgaccctggggtttcctcccacaggaccctccacgaatggggaaaagccccagaaccaccccttccaatcccagctctgcactggtttacccacaagcctcagagcagaaacccacccttccttgaagtggggatgaaaaccagaaaaatatcacagctctttttttttttctttctttctttaggcaaatgctttgggctgcatggccaacgcagctgacatcttgcagtggttgtaaacaagcaggagcaccagagcagagacccaattcagtagcctgtatcatttactcccgacttatagctcagccagaaaggaaacccaagtccccgctcctccgagaaggccaacacgtgctcatcactgccctccggctcagcctggactcagcttaggtcccacccccagtcagtgcggaattcaacttggcgagagcagaacgtctactacatatggttacaaagaggcttcggacaagcggggacggcaggaatctgtctacagc

SEQ ID NO: 43686 - DNA, 2219 bp, Bovine  19866880765492
aagaaaacaatcgttttgttcttgctcccctcaggacaatgattttgttcttataatcagtggaaaagacactgctcctgccattctgatcagtctttctgcaaagagattaacaagatctgacaaactttcctcttccgctgaaactgaaaacaacaaaaccagaatttttattatgaaagttctcaaacatccacaaaagaagaatagatatctaaggaaccccaataacaaccgtccccaaattgaacaatgattcaggatggggtgggaggtggaagggaggttcaagagggagcggacacatgtatacctatggctgatttatgttgatgtaatgtcagaaatcagcacaacattgtacagcaattatcctccaattaaaaatcaatatttaaaaaatgattaacattttgctacatctgtcccttttatgtatttattttggctgaattttaatcaatataagtagagcaacattgacaaaaggaggcatttttaaaaataagaaaatagatttttttgttaatgaagaaatgaacttgaaaacatttactagtgactatttactagcgactagcagccatttggtgaaagcacaaagccatcacacaattaggcagctgtacagctgaaaaacacaatagctgtaataatgaggacatttagacaattaagccacttgaaatttctcattacgaagcatgtctcaaactcacgcccttagtgggggtgaaatataaatctttttactacaggatataaaataatgagtcattaaaattaacttctgcttaaaagcaaatactgtcgacaaaattgaagacgcaggagaaacacacatgtcctccccctttggtaatgtttttgaataattaaatgtttgggtcgaatctacagactatgatgcaaaggcttcatttcttaccttttctacgcttctttctttctgtaatgggaccccaaataacatagattcctgctgcaagagcagcggcaattccacctataacaccccagttcttcatgactttgtatctaaaaaagaaaataagttgactgtctttcctcataacaaatacaatacatgtatatatagggacaggtacacagatataacgtttcatcaaaataacccattggcccgccacatacctagctttcaaattaaagtaatatacagtataggatatgtcttgaaaatctgcacacacaggaattaggatttaaaacctaagtcggagcacaacctcaaaaagccccacttcactggagagcggggtccagggctttcctcctgctctgtctctcatcctaccgccacactggccaccaccccagccaaagccacgctcccgccccagggcctttgcatggctgccctctctgcctggggtgctctccccgccagtcccactgcttggctcattcccgcccctccttcctttttttaaaattattttttatttttttgccttgccatgtggcatgggggctcttagttccacaaccagggattgaacctgtgccccctgcagcagaagtgcagtcttaaccactgggctgccaggaaagtctctccctctcacatctaacaaactatcagaacctgctctcatgacattttacccagctctactttttcttttcaccatagtgctctccactttccaacataacattcactgattcactatgtttattctcagtctccctcaaataaaatgcaaagtccccatggacagggatctttgttttacacactaacatattccaagcgcttccaagtgtttagatcacacagtaggtttttgatagtatttactgaattattggagaaatacagacatggatttatcttttaggttattaaatggtgggagatctttatacacagtataaagatagatagataaagtataaagataaatagatgtaaaaatagatctttatacaatcatataaagatcttctaaatatttattacatattaaatatttcttcatttgaagcttgacttcaaccactgaagttattcttttactacaaataaagaaatttcaccagcaatttaaaacactgtcttcacacacagttatgtatttccactaaataaggcaaacaatatacgaacttttgcaggaagtgggggctgagggtagccacagtgctcagtccgaaactgcagcccggggaggagggtagacagtagaagggac

SEQ ID NO: 43687 - DNA, 1289 bp, Bovine  19866880782901
ttgattaattttttgaaaacgtctgcccaaatacacacgtctgagtcactgtagtttttgtcactcaactgtcctctcaagtgaaaataatgtcccatgaaaaaaaaggaagcagtccagcttgcagctcagacagtaacctgagatttctttgctccaagccctgtacttgggtatgaagaggtgcttgatgtgtgctttccgtttgtcacccagaatatcaccaagatggcactgtcttaatttgtgccaagggccactgtagctgtggtatcctcagtccaaatgtcagcacagtgaaaaagtccaataagtatgtcggtgtataaatgaaagtagttttgactttgcaggcctcctggaagggtcttggagacccttagccgtccatggatcatactttgagaactgttgccctaaattttttcttagtgtcctaatgtgtatttacagtgtttatgtatgtttataaaaactttttaaacaggagaatatagtgtcttataacggttgggatgaacagaatattgttttgtaactattgtgttgagcagcatctcatttcacgtcagtgtgggaagacttgtatgaccctgggcacgaaacctgctagtcgctgtgttggtggctttcccctcaagggggtgacatcctagaatctctctggggactttcccctgtcgccccagctcttgggtctttccacacaccttgcacatgtaaaagcagaaggcctggctgtggaccgctgttcccaggtgcctcttgcaccagcactggcttctgagggaaagagtggtttagaagaaagccttcacttttgactagggagctttctgagacaaggaggaagcattaaaactattggcacgaagagcgcggtgtctcctcggcgctgaaggtgacgctaggctttgctgccgtggtgttagctgtgtgagggtgcaccccccctgtgtcttctgctgggtccctgtggccccaactctgtgttttccatcccagggcccatggggacacgcagcactgcaggaaggctctgcaccgggccgtccagtgtaccagcgactacccggagcacgtctgtgaggtgttgctcaccatggagaggacagaaggtggggacctcggtgctgcctcgggctcggggcttgtccctgaggccagtgtggtctcagggcagtaggcgtaaggacacatgtgtttaccagcccgccccaggggcctctgtgatgagaccatcgtgcggtgctcgccactagaggggagtcccgctgcctttctcacac

SEQ ID NO: 43688 - DNA, 2584 bp, Bovine  19866880842984
attcttgcctggaaaatctatggacagaggagcctgtaggacttcagtccatgaggtcacaagggtcagacacagcttagcaattaaacaatattccctataagtctatctgaattgtgtggcctcagctccttcacccatgacaataatcttacctgtaatcaggaaacatgtctagctctctgagagtcagcttccgaaatcccagaactatatccttccagtaagggtcctttagaggaagaagagaaggcggcacagagatggatgaacatcaacaagagtgataataacaaagacttacgtaatgtttaccatgtgtaaggcactgtgccaagcattttactcataccaatccattcaatcttcacaacaacccattgaggtagatgctatttttagtcccattttacagatgggcccattcaggctcagagagtttaaataagttgtctgtggtcacccagctaataaacagtggcactgagatttgaacccacacagtggggcttcatagtccacgttcttaaccatggtgctacgtgagggtaagaataaggctgaggatgaatgatatggtagggtcataaataggggaggaaaaaaaaggggcgacagtgaaggtcaccaagggatgagagtgggaagttgcagagggaagggtcagacaacccagtagggggagattttggcctcaccactgaccaccttgaattctctgagactcagttttcttgtctgtataatggagttaatagtcactctctctctctttttttaataatcactcttagaaggcagtttaataataaaatggaaaacaaaaataatttttaaagcaaaaatagaacttttttaaactttagttatttctttctcctttttttcaagacttttttttttaatgtgaaccgtttgttttttcaagtctttattgaatttgttacaatattgcttctcttttatgttgtagttttttggctaggaggcatgtggtatcttagcttcccaaccagggatcaaacccacacctcctgctttgggaggcgaagtcttaaccgctggatcaccagggaagtcccacaaagatagaacttaaagcaaacctgttttgaaggcaggagtctgcctaagggccttgaaggacctccccctcctcccaccctgcctgggcacgccttgatctgtgatccagactctgctctctgtacggttcatggccaaagacgtctcactcaccggaacagcttcacggaagaggttgtagcctgagaccggggccaggcccatgtttgcagcattgggagaaccgatgaggctcaggagatagttgaaggtctgctggttccagtgcctgagaggatcccccagagtcttggtcacctaatgccctgagctggacaagagagctcccagggtcggcttgcacaggatcattctcaggctggtagggtgtgtccaaatccagaaattcaccccattcactctgcagtgactcaagtgctagtcaccccccataacctttttcatatttcgacattaacagagaagaggagggacaaaggattctccaccaccacagagaacaggcttgtggttgtcaagggagaggggctgggggaggggtggactgggaggctgggggtggcaaatgtaagctattatatgtagagtggataaacagcaaagtcctactgtatggcatggggaactacaatatactcatatgcgcgtgctaagtcacttcagttgtgtcctactttttgcaacgctatggaccatagcctgccagacccctctgtccgtgggattctccaggcaagaatactggagtgggttgtcatgctttcctccaggaggtcttcctgacctggggatcgaacccgcatctcttatgtcatctgcattggcaggcaggttctttaccatgagcaccacacccactatactcagtatcctatgataagccataatggaaaggaatactttcaaaaaagaatatatatagattatataaatacataactgaatcactttgctgtacagcagaaattaaaacaatattgtaatcaactatacttcaattaaaaattttttttaaaaaatgctccaattttcagggcagaaatggagaaacggacatagaaaacagaccaaaggacacagcagaaggtgagcagggagacagtgagatgtatggagagagtaacatggaaatttaagtaccatatgtaaaatagacagccagtgggaatttactgtgtgactcagcgaactcaaacacaggccctgtgacaatctagaagggagagatggatacggagatggaaggggaggttcaggaggcaggggacacaggtgtacctatggctgattcttgttgatgtatgacagaaaaactgcaaaattctgtaaagcaaatatcctttaattaaaaaaattaagtggcaaaaaaaagcaaaaaaagaatgttccatcacaactacgaatatttggagcccacttccagcttgggatcatgtagctgccagtttaaatgaaagctttgactgctttagggactgtgagtccccgtgggttcagg

SEQ ID NO: 43689 - DNA, 1545 bp, Bovine  19866880856263
ttactgttgggtgtgtaaatatgaaactgttttataggcatataccttcgacttgaacctaagtcctttctgtatttcctgcaatttatgtttcagagtcccgttcgattcgataccttcgacagtctttccctcagtattccagcctccacatgggtatgtacccatctctggtttatttcgagtctgtttcagagacatctgaatctgaaagagctttgaggcatctcgtgtaactcaggtactacacatgactcagacacatagttggttgaacctgtcttagttttaatctgtggttaccacgacctgtcggggaagaaggtggtttctctctcgctgcagaaattttggctttttcaaatacatatacacacacctctcaagttcagagatgcgtaaaacagcacagaagcgcatacttttctgcagtattgggtcctcatacccttgaatccgtccagaataacaaatctaggatgctctgaactctccattttgttcgggaaacacccacttgtgtctgtgaggcctcgcagcctacctaagcagagtaaagctctgggcttcaccctgttagcggtgtcagtccagctctccttgacttgtattcatgaacgtgcttcttgtgccatagggtcatccactgaccctggaccactgccttcaccacttcatctcgtcagaatccgtgcgggatgtcgtctgtgacaactgtacgaaggtatgactttaaccctggctgccatctcctgagctggcccccatgtccggatacaaggcctctcatacccttagccctgagctctgttgactggcccagaggctccctgcagccacagccacctccacctaacttgcttagaaagttggcagcccacggactatatcttttcccagatgagttgtttcattcacagaatgtttaaaggaaaaaaattgaatcatatgctttgaggtgagacatgcccgctccaatttgctacagtcccctccatgcccacctgtctcactcctgcccaactgccccaggaatgtcatcctctgaattaagagaaagtgtacgggaaagaatttttgaagacacaaaacaaaacagatgacaggcagccagtgcagagtttcattgcggcctctttgtttctcttgctgcaacagtcacaattatttaatgactcttgtttttgttcagttgctaagtcatgtccaactcttggtgaccccgtggactacagtatgccaagcttccctgtccttcactatctcccggagtttgctcaaactcatgtcattgagttggtgatgccatccaaccatgtcatcctctttaaaacagtgaaagcgaaagtcgctcagtcatgtccgactctttgcaaccccatgggctctacagtccatggaattctccaggccagaatactggagtgggtagccattcccttctccaggggatcttcccaaccaaggagtccaactggggtctcctgcatcacaggtggattctttaccagcttagctaccagggaagcccatttaaaacagtaa

SEQ ID NO: 43690 - DNA, 1742 bp, Bovine  19866880884557
cccagaatgcctgggaaaataacccccatatcacacaggaataaccatggttcagggcttgagtttcattgtctctcgctggctggtctttgagccacaacttcagtgtggtctccagggatcaaaggaagcattgaatccaccagtacagtcaacaggaaagaaaattgtttcttgtggcaggaaagaagaaaaaaggaaattatttggtccagtgcttccagatcccatcttgaacatgtccatcacccatcacctcactgggtaattgcacacacagttcctaagttaagctcaaattagatgctgtggcctacattgggggaataacataattcactctgttaaatttggccccaggattctgtgtttataaatccagcccagcatgggatgcaggacaaataaaactctgttccctggacaggttcagatgaggcatccattcttattaccaaccccattaaaattccccagaatcccaagacttctaaaggggtggtgatccatgtcagagttctcaaactcagatacctgcagaggctaggcaagtaatatcagtaaatgaagaggcagggtgggtattgtgtgaatactcactcagtctcaaggagagagccactaccctgccaataattgccacgtgggagatgagcccagagttgccaaccccagcttcatctcttagcagctgtgtgacctcagtcaagtcacttaacctccctgtgactcaatgttatccacaaaatgcctacctgttagggtgactgtgaaaattaagcattacactgaagtccttagaacactgcccaacccctaggaggaactcagtaatgttgactgttactggtttctaatacttgtttatttgtctgtgcccggtcttagttgcagcacacgggatcttcagtgttcattgtaacatgtgggatctttagctgtggcctgcgggagctaggtccctggccagggatcaaacccgggccccctgcattgggagcatggagtctaagccactgggccaccagggaagtcccagctgttattattaagtcagtagttttcaacaaaggattctcataaccattaatgtgaacaagggtattcaaactattctcattgtagagaggctcatggcatgggacaagaccaggttgactaaacaattttttatttgggctggaatgctgacaacacgatgcacagtcgtattgggacttccctgctgatcatcaccttattcaactcatgcctttaatgtgttaaaatttgaacaacttattaattcttattttccacagtggacttagcaaaatattttcagttaaggagtcttagggaatagaatagctggattcttgatgagaggacatttggagactgttgttctaaaaccagagtatagatctgggtttgacaccaaatatgctaggagtcagacacgactgagcgacttcactttcacttttcactttcatgcattggagaaggaaatggcaacccactccagtgtttttgcctggagaatccccgggatgggagagcctggtgggctgccgtctatggggtcgtacagagtcagacacgactgaagcgacttagcagcagcagcagcagcatgctgagatccttgacttcataatgatactcaaaaggacactcactggttactcatggaggatgcaagcaagccaacgctttactgtgaaaaaatagaaaaataaagggaaagaaatctttat

SEQ ID NO: 43691 - DNA, 1831 bp, Bovine  19866880945140
aaaatttgacaactggatctgagcctgatataggctggctcctgcatcctagtgtgcccttccacttgtctggacctcccttgcccttgaacatcaccccaggaattgccccatccatccactgaacacgaatatctgctatgtctccatggatccccttatacagcctatgaaggaactaggagtctccccattttacagaagaggaaactgaggctcagagaagtgcagtcacatgtcccagatcatacataaggatctgagattggaatctaggcttgaatcagaaagacacattcttaccactaagtcatgaggtccttgagatcatagcggggttctgggggaatcccgtgccccaaactcccgctcctgctgacctgtcctggcgtctggaagtcccctcagccaccctttgtggctcccagttgctgagagaaggcgctgggacttgttagttgctcagtcatgtccagttctttgcaaccccatggactgcagcctgccaggctctcctctgtccctgggattctccaggcaagaatactggagtgggtagccaatcccttccccaggggctcttcctgacccaggaatcgaacctgggtctccttcattcaggcagagtctttactgtctgagccactagggaagccccgggatgacgaagttgaacccagcttgcagagagcaggcacagagcagacccgggattcaagactgagagagggggctgcaccaaggcacgggcgtttcctgggcactcagtctatgcccagccccacggcaaatgctttatctgcctgatcgcattcaggtctcacaacaacccgtgaggtgaggacaattattatcccacatctctgctagagaaactgaggttcagaaagctgtgacttcagcaagttgcactgctgagaaaccagactccgctgacttcagctctggcagtagggaaggaaggagggtagacaggaaatgggggacagggggtggcatgctgaatttactcttgtccctttggaggggggttgctgccagccctgcgggtgcttcatctggctgtcaatctggacaaaggctccccaaaccttcctccataccccacccctgcctgccacccaaccaagtcttacctgatgcctaagcacgagatatgtcctccataaaccattttcagatacagaaaaatgactggaagtacaccaaatcgttaagagagattagccaccaagcgtgggattataagtgaattttatttggttcttttgactttcctgtgttttcctaatatttttcaatgggcagaacaaaatcataagtgtttaggaagtctgggggtcccaggtctccccagctagtgagtaaaaccatccactctttagctatgaatgcccacacaggaaggctctgagctggtggtcctgacccgggggcaactttgcccccccaggggacatctggcaatgtctggagataagctggttgtcatgacttgggggagcattgctggcatctagtaggtggtcagggaccccgacaaacatcccacagtgcacaggccagtcccccgaggcaaagaagggtctggtccaaatgtcagtggtcctgaggtggagaaattctgctctccccacttggcagtgagggcccttggagttccccttctcaaaagtgtttggaaacccgaactgtgtggccatgagcttgattgctgtgtctcctcttggtggctggaagcctgtagccataattgctcaggcttttgccctctggggtcccacggggccagtgccccatgcccaagcctggcacagtaaggatgctgctg

SEQ ID NO: 43692 - DNA, 1651 bp, Bovine  19866880950913
agcaggcttgtggcagaggtttggggggagtactgtgtgagattaccataggagctatttcatcccgttggcgttttacatgccactctctagcctttcttctgcagctcgtctttgcccattttcctctgtgaattccagcctaactgtgctctgttttttttcctctccccagcttaagtgagagctttttcatggtgaaaggagcagccctcttcctacagcagggaagcagccctcaagcccagcggagtcttcagcacccccacaggcatgcaggtgatggctctaaactgatgctcttacccagggagttatcttctatgcgactgagcaaccctccaacactggtgttcagcacttggctggttttcaaggccagggaaatagcgcagcacaggttggtgatgacaggtgcaggtcagaggctcttttcttgaggccatgtgtgttttcctgacggcactgggagccagcacccttataaggtcagcagctttctgtttggatgtgaagtttccctactcagtctatcagttaactgcagattttaagttacggtatcctgggcttctcctggtggctcagacaataaagaagttgcctgccttgcagaagacccgggtttgatccctggtttaggaacatcccctggagaagggaatggctgcccactctagtattcttgcctggagaatgccatgggcagaggagcctggtgggctacagttcatggggttacaaagagtcagacacaaccgtgcatacacatacacacacacacacacagaataaaatcacatgaaagaatttactggcataatgcaaggaactacaggttctgggacacccaggctttcagataaaagagaatactttacttataaccaaattttattatatgacaataaaaaattctgttcagataatgtttgggatgtgctgttaatcactcagttgtgtccagctctttgtcaccccatggactgtagcctgtcaggctcctctgtccatggaattctccaggcaagaatactggagtgggtagctattcccttctccaggggatcttctcaaccaaggagtaaaactcgggtctcctgcatgcaggcagattctttactatctgagacaccaaggaagcccctagtttttatgggaaaaaaaatgagaaataacctgcagtatcttattttttgatgttaagtttttaattttaatttatgattatctttgggtatgaaggacttttaaaaaaagttaactgtgtatggactttggtacctgacatgctccaagttagagagagttgtcgttattcagtcaataagacatgtccaactctttttggcccaatggactgcagcatgccaggctccactgtccttcactgtctcctggagtttattcaaattcatatccattgagttggtgatgctatctagccatctcatctctctgcagtccccttctctttttgccttcagtctttcccagcatcagggtctttttcaatgagttggctatttgtatcacgtggccaaggtattggagcttcactaaatttaaaaatgttagtttgacttttctatgtgttatctcaaatggactcttaaaaaacaaatgaatctccaaaatgcgtctttaatat

SEQ ID NO: 43693 - DNA, 1532 bp, Bovine  19866880962291
ggactgagttgcatctctcacgtccccggcattggcgggcgggggtctttaccgttagcgccacctgggaagccagatgaccatgtggatgtacggatttttgctgtgcaagggcggggcctctgtccctcacattcactctctctatgactgcacagtgcctggcagtccgcaggggttcagaagacatggaccgcattgacaaatgggcaagggagtttggcaagggggtgaagatgcagagacagctgtgggactggcaaaaatctaagcaccagaagcagaaatcaaaagagccttagctttaaggcttagggtcaggcctgggtttcaatccctgctctgctgcttatttctggatgtcgggcaaggctaacctctgggagcctcagcttccatacctgtgaaatggggagaaaagcccttgctattcatacagctgtgacatggctggcacacttcaggtgaccaactagggcccacgttagagaggcagtccctggctatgggagcaggcgtagaccctctgaggggcaccgtggggcctccacatccccccatgcctggaagtccagcccccctgtggtttggggagcaagcccccgccctgctaagcacgccgtcttttggcctaaaattagctcacaaattccatggctgcctggtcggtgcttccaaccgacaattcaaaccagatgtttccagctgttggggcccttcctccccctggcccagcctgcatgtgccctggggaggtcggactctacccgggggagatggatcggagcatgcactcgggggccctggcaggatcaggagccagcctgggcctgtgggctcacccctctaaggatgggggccgccttgccagctgacctgccagcgagtgggggctgggtgggtgaccgctctgcctttttcggttcaggagccttgtggagcgcctgctgtatgccaagcctctgttctcgctgctgtccagatgctgtgagaaggagtctcagtccgaggcgccacttgcgttgctgttgttattattagcatatgtatttagtgccaggtggcgctactggtaaccctcctgccagtgcaggaaatttgagagacgcaggttcgatccctgagttgggaagatcccctggaggaggatagggcaacccattccaatattcttccccggagaatgccatgggccgaggagcctagcgggctacagtccatagggtcgcacagagttggacacgaccgaagtgacttagcacacacatacacaccaagcctgtaagggcttccctggtggctcagtggtaaagagtccttccccctccaaagcaggagatccaggctcaatcctacagttgggaagacgtcctggaggaggaaatggcaacctgctccagcattcttgcctggaaaatcccatggacagacgagcctggtgggctacagtccatggagccacaaaggagttggacgtgacttagcgactaaacaacacccgtaacagataaccagggctcgttacattcgca

SEQ ID NO: 43694 - DNA, 1940 bp, Bovine  19866880979953
ccagcgcacgcaggtgtggaagagctacaactggggccttagcctccagacgctattccgtttctattatcaccgtcacggtcactattttccctaccacgccagagctccttatcttcgtcattcctacaggcaaacaactcttcttggaggaaaagaatcttatttctaggcctggacacagttgaccggtatggctaagagcgggagttgcggagtcgattcaaagttcaaagcctgactcgccacttgcaggaagtgtaacggtgagcaagagaattccctccaccgggagcctcagggtcctcccacaaaacgggaaatacagcaattccctcgccgggttctggcgagggttcaataggataacgcttgcgaagcacctggcgagcagtaagcgctccgaggaccggagacgcgctgggaaactgaggtttggaggccttggcgctttttattacctccgaggaccgaggaggtgggctggggcctgggaacccgagggagagagcccgccgcccccgcccacgcccgcgcccacctgctcctccagccgctctatctccagctggttcttctcctcttcgtcgtacccccactcgtactccccgggggagctctcggccgaggaagccatggcgtactcctcatctccatcgctctcactcacgccttcctcctgctggtcccactctggccccatggtcttgtacgtcgcggcggccacggcccgcgataacaccttcctcctcgcccgagccgccttagcctcatcctgctctccctcagcctcgggcccggccttgggctcagcctccgcttcagaagccgatgctgcggccgccgtcgccatcttggactttcagagactcccgggtcctcacttggccgccaaagacccgcagtagtaggagctgcccgcggcgcgcgcctggtcaaaatcccgctcgtctgccacctgaagagaaactatgcgccttggatgacatggaaatctctagatacacgagattcatgttattttatatactttcagtagctcttgttcggaaaagaaagctcaccaacagggcatgccttccggcacaacgtcggacagcacttgggcccttaggcaggaagtggaagccatagaggcaaccacggactgagcgtgatggttgtagttaagggtttggcgccatcttgagaaggtcaaaaatgattcttggaataaataccttaccacctagtctgacctggcgcgtgattcagtctccccagcaactgagcctcaaacgcgcagaaaagtcttaagtcctcagggaaggatcgattgcaccattaatgagaataactcatttcccagagattccttctctttatttaatgcctggcgcctagcacttaaatacacgtgtgagttttgatttttaggatcatattctgcaaaccagtatcaataaattacattaataaacatttacttagaatctcttcattgctatatcttgtgatttaatctgtgccactttgctttttaatagagacataaacatatacactttttaaaatcagagcaacgtattcttgcctttagttaagcttctcactttagagatagaaaagccttgatgggtctatttattgccttgctccctcattagcaagcttaatcgtgtcgttttgggttgttttcccaaagcaccctaagtagatactcaacacaagatttgctcaatggatttagaactgtccttgaattagtacaaaaaagatcgaggtttacaaagacgctatctttcacctaggagcacacagccagttaggagcagaaacgagattctaactcaggactgttcaagtcagaatcccaactgggcccctctgcgcaacctagggcaagttactaaaccgttctgatcctcaaattcctaaactgcagaatagagccaagaagg

SEQ ID NO: 43695 - DNA, 720 bp, Bovine  19866880991989
atgctgatgacgaggtattttttttagccttaaatagattatttacaatgtatctagataattgggcccttactgttataatgggttaaaaccagatgtatctgtgtgattaggaaaaaatctagcatgtgtatagtctgctttccttattttgcggaagcgtttccctgctcctgcatcatctcacagcatccctggagattcaggacaactgccgctcccatggcagaagaccagggggacggggatgatgatcagtcacccagcagcccacatatctggacttccaggcttgcgaccatctcaagaggtccctggagagtgggccttaggaaaaggaagggtacatctacatgatggtctgggtcccccaggggatggctctggccttggatgcagtgggagggagatgtggattccaaacctccctggggtgggaatgtacattgcttgaacacctactgtgagctggggggctgtgccaggcacttcgcaggccctgtcttgggcagtgcacacaagaagcctggagaggaggaattaccagctcctttatatacacgggaacaagggaggctctgagacatgcagccacctgccccagcccacacagtgggcatccgtggcaggattcgaacttgcatctatcccagactgagcctggctcctgccctcctggcaaaccctttaagagcacctaatctgcgcatctccagtgtt

SEQ ID NO: 43696 - DNA, 1180 bp, Bovine  19866881207944
actgattcctcagagtaagatttggaataggtgcatcgtggtcacccaggtcaggctgaggaccatgcttccctggcgggcaggctggcgacactcccagacaagaccctggtgtcagctgaacccagcggaggcccaggcagtccccattccactgggccaggtgtgtgtgcgtcccgaggactgggaagtcctgctacggacacaaacagactgtgagttctccagaccgcgagcatcagggagaaaggagcagcgtgaagcttctctgctcccggcaggtgtcccttcccgacttcatcgcagaccccagctctgatggggaaaggagcgtccctgtgatacccgagcctggggcaacacgtgcccaggtcacgtggccttcacctgcctggccaaccgtagctttgtgcacctgcccttctgccgctgcgtactctgaaatctgccatcaaagagaggtgccgggtgtgaacagtgccccctttgaatgtttggttgtaagcagacctttggtcagaggccagggactgggccacggctacggctgtaaatgtgaatgatctctaggcacattctctacccctgcttcttcacattgtaaattattaggcgttagttagcagccaaataatcttatttctagcattcagttatttacagtcacttcttttttttgcaaaaacccgagtcaaactcatagtttatgccataataactgttgatttatgtatttgctaaggtaccttttgtatctgctgtattatagcaataaaagaatcattttgttaggaaaaacatcaactggtattctttcataattcaccagtctgatacaaatgtcctctttctctgagttctgcgttgtacccgtaagaagccctgtgcttgggtgaaacccgttccgtgttccctgttggtaaaagagacagcagctccctctaggagtggagagcgaaggagccaacagaagcgcttgctgttaacaatgttgttcgctttgtagtaggcaggattttccgaaatgtcagattgacccggggagccagaaccttctttcggactgggagactgtggtaccagtgagtgttggtcgggtggttcatcatgagtaagctgccatgggccagctggagcctgaccacctccagcctccgggacgggtgcttcccccgggaat

SEQ ID NO: 43697 - DNA, 1756 bp, Bovine  19866881241794
gttacacttgaactcctcaattttatggtggaagccgaggctgataggaaagacggggccatgacacaaatccaagtttctagattccttatccaccaacacaacactttctcaggtaaaagtactttgggaaaaggagtgaggagcaaggagggaaaactctttaaaagccatcttttattctcaagacaatttctggatccgttccatctcagttatccattgccgtaagaaatagcccctaaacttagcagcttaagacacgggaagtcacacactgtcacttctgccaagctctactggtcacaacacagaccacacttggtaaaaagtatgggaggggactacctaaggttaatggagaagtggagatcactggggaccatctcggaagctgccgaccctacacccacggcccctgcccttcctcggttccaagaggtctgcccaacagcccgacagcttggactgcaggttccctgggcagggagtctttgcaggtgtgagtttctccacctgtgagaacagtgggatcccagttaccaaccgccgttcctccagttgtttaatgaaagctttctagccatgttactctcattggccccaggagctgccttgcctactcctgcctgaaaacatggtcatgtcgatgtggagaccggctctgatactcgagaccctgctttagatcacagcttctaaaaggtgtggctaacacccgctcctcttcccacacggtgatggtgactcagggtgaccactaaccagcatggagtgtggaccctgaggtgccaccgcctgcatcctcagatttccctgcctcacctgattccaggttgcccttcccgccacgtccatcagccaggcatctggtgcctgggagatgctgggtagaaggctgcagaccacctgggtgcagacagcaggccttttgggcgcatcctaaaaactctccgtgaaagcttcctgttgccatagtaacgtgttgacatgggaattaacatgggtcccttgctagccaagaaaaccaagcttttaaaacccattcctctctttcaaatagataagaattcctaggaggcctttggagggacatcaaagcctctttttcaggtgttgaggaaatgctcgttaaaaattactgtgaaatgagtgcagccctaatcagggagatggtggagggtttggagctcttagaggaattagaggcatcagcttagagccaaggcaacttaaaaaaaaaaaaaaaaagcttttctgagatataatttgcacagcacagtccacccatttaaaggtatgcaattccatggttttttaatacacttagaattgtaaagccatccccacaatgcagagacctgggttcgatccctggatcaggaagatcccctggaggtagggcacggcaacccactccagtattcttgcctggagaatcccctaggcagaggagcctggcgggttataatccattaggtcgcagggagtcagaggtgactgagcacagaattgtaaagccatccccacagtcaattttaggactttttatcactcctcctgaaaagaaacccccatcccttcagcagtcactctcatttctcccccactgtccttcctcagcccccagtgatctattttcggtctgtgtaaatttctctattctggacaattcctagaaatggaatcatacaatacgtggtcttttgtgactgtttcctttcagtgtttttattcttcttgcttccttaagctt

SEQ ID NO: 43698 - DNA, 2421 bp, Bovine  19866881245361
ttgagcggctgttgtgtgggtcatctcagcctgttgcctggtctggtgggagggttagggaagggatggtacagcatttaaaagcccaggctttggggcagatggacctatggtcaagtattaactcctcttccaaaagaccctccgtctcccatcattcctccaggaaggtctctctggcgggatggagaagcctttctcccaagcctagactaagtgtggtacacaagaaagggcagcctaaatagggacatagtctgggctcccccagctgggtggactcgagcaacttagctcggcagtcagcatattagtcagtgctcctgtgatggcaggtgacaaaaaacccaccttcaatcagcttcagccaaagaagaaaatgtagtgtgtcttgtccccaaactaccgaagagcctaggttgtcaaatgaatgaattgtgccattctcttcctaactctcatctctgcttgcttctgacttagcttggttctcctgcacagactgactttgttccagggatcttggctgttggtaattctgggcttagaaaataccagtgtcacaactcaagggagacaggcttctttctcccagctttaatctaaaagaatccaaaaggtaggtcctgtgtccttccccggagccatcaatcactggctggtggcaggtgaatatgatcggctcttccaaggtcagcgtctccccaagatgagagcaggtaggggctccccaggtggcactagtggtacaaatccgcctgccagggacggaggcgcaggttccatccctggctcgggaaggtcccctggacaaggcaatggcgacccactccagtagtcttgcctggaaaatcccatggacagaggagcctggcaggcgggctacagtccatgggggttgcaaagagtgggacatgagtgagcatgcacacgtgtgtgcaacagaagaacacaaggacagggtgctttgaaggcacaaagagtaccaggacagcccacccattcacccgtgtgtacatatgctcacacacctattaatttgattataaaactctcatctaacacaatccaaaatcccacctatagtcaaatgcacccaccctcaccctctggcgagaccacccatggtcatagtacttccagctccaagcccagcatttctgggttgtgagcactcatctccctcaggactcagtgtggcaccttatgatcctgaggcctgtggatcaaatggaagtgaagcctcctcaaatgtacaatggctggaggacagatctgggcttaaatttgaagcgagatgcttccaagccataggcacacagacagattgcatcatttcgaattctacttagaaacaagtaagatggagtaacatgagtggggaccagccagaaagcatatacgtatgccagatacaaagattcacttctaagacagggagatgggacagtcattaggatcagtctcttcatctataagatggattaataagaagggtgtgaggaccaaatctttctaaatgaggaatggcacatagtagacagcacatagtaggtactcgatgcatattctccctctcacacacacacagcttttgacctgatgacaatgacctcattctggcaaaataaacaatggctccctccctttccctttcccttcctctccttcctcctttttctttctcctcctgcccatccttggacactctgtcctctagtgaactattgaactaaggttacttgccaaccatggcccatggaagttctctctcccagcccagatgcaaacttcacacacacacacacacacacacacacacacacacacacacacccccctccccgggccatgcttccctctgtgacacaggagagtcatccattgttgaacaagcacagggacaagatgtcggcttttccagagctgtcaccgtctgacgtccctgctccagggaggcaatgtttcttttaaagatggactgtttttagttgaccaaatcacctctgtcttatgaaagaaattcaaggtgatcagggttgagacacatctccagcgaggctgacaaattctgcacctcctagggcggcgttgaggggacacaatttctccttaacgagcctgtatcctctgctagaccctgttctccatcacgagttggggcaggggagtggcgaggagcccacagtttaaatagacagcagcctaggcctgaacgagatcaagtggcatgtagcattttcctcaatcattctccaggagggccatttaattccaagggctggctgggtcctcaggctcacctccagtgactcccaaatgcaagagcactgggttggggtccgatagacctaaatttaaatctttattctaccgtcagttagtttcaggtctgggacagctcacttcacctttctgggc

SEQ ID NO: 43699 - DNA, 1650 bp, Bovine  19866881253899
cctcagtttcctcttttacattgatggggaatattaataattccctcacaggctcattctaaggatccacagagacagtatgagtaaagcacttagcaaagtgcatgtccaaattaataatgattgtaaggacccacgggaaaagccttgatagactgtaaagtaccgtcttcgtgtactatttaccatgacgtgtaagaacacacgtactaatctaagaaaactaagtgaatggtgtatcattggatggttgtttaacataattcaagattttcctctgagggactcccagggtggtccagagtttaagactttcctcttgcagtgcagtgggtgtgagttcggtccctggttgagaagctaagatcccacctgcctcacggccaaaaacccaaaacagaaagcagaagccatattgtagcaaattcaataaagactttataaaaatgatccacatcaaacagaatctttaaaaaaaaattttccttctggatgaaagcctttaccttggctcacaaggtgggaaaagtgggaagaacttcaaacagcgccgtgaatggctggtttcttatgccactcaccttaacgacgtgcctattatatgcaagaccctgtggaggacatgtttatgcagataagtccattttaacctcactggcccgatattttcatccccacagtgaaggaaactgggcctcagagagattaagcggcccaaatgctctggaatgtccccaaagtgagacagtgatttggatattgaggtgtccaagtccagtgttccttccaagaaaaaaaataaccttaagtcatcttgtagaaatgacggcaggctgtcaacggatcaagctcttcagagctgtcttaataagagtcccgtgtgcttggcacttagggaatgaggctagctcgggttgctgggtgcccagttgccatcagtagagcccaggggtgtgcccttaaccctggctatgcaaggtcccttcctcccctctgttggcctccaaggcccacagccttacccacgggactccactgcccccgtagaccaagctctgccagtgcacacgagtttcaggctctcttgtttccactttactgctcagaggaaggaactggtaccaagaggtcaacaaagccacatagccagaggcatactcatcacttctgaaacgctttcagctttgtctccttcccccaccaccccagatcttacttttctcatcttcccaaagctaagtacattggctgctacctggatgacacccagagccgggcccttcgaggcgtgtcctttttcgactacaaaaagatgaccgtcttccgttgccaggacaactgtgcagaacggtagggtcccaggctccctgcattcagacctcttcttttgcagcttcctacctgtggtggtctttctttttttccgtgggagggcatatgaaggatgcatatgaaggactttaagggaagggtgaggcaacggtgtgtgtgtgtgtgggcatgcgtgtgcacattctcttgcctgaaaaatcccatggacggaggagcctgtctcatggacgctggagatcaagagtagggagttggtctgtaggaatctgtgtgcagttatgtgaggctgtgcctaggtgtgagtttacagtgtacact

SEQ ID NO: 43700 - DNA, 2435 bp, Bovine  19866881283340
ggggtccctgagcaggtccccctgccaccaaaaccaggctcgcggctggaaggagaatcacccagaggacaatgcttttccgttttttggttttatctccaacttggctgcggaaaccccagcagagtccagttcttgtgggctggagccattttctcctttataaaactaggccatattgagaatgtcctgccgttcagggccacgggccgcagttgccaggaggcaaggtccgtgggaggagagttgtgagcaaagaggagggaaagttgaatttggcccttctgggcacaaaaagtccccttgttctgccttagcaggagccggcaaaatatttccctgctgtgcacggaccaagcagcttcaaggtcaaaagctgctaggtcttctaaatttctgaggacacccagcagcccagtatccccagggaggcctggaggtgatgcactctgaaggtctgagttctggggccaaaaaatgcatcccagatactcacagctgccagcctggcacacagtaggtgtgcagtaaatgcgtatcgagtttacttgaattaaaatgaaatcctggcagcagcatttactggctgtgtgaccttctgtaagatactccacctttctgagtctttgtttccttatctgtagaatgggatcgataacaccagcccctaactcttaacgtgggagatttaggtgcagtgacgcacaagaagtgtttagcgcagggctggcccacagtaggtgctccagaaatgtcaggaaatcgcttcttttgccctggacactgtgttaagctttttacatctgctgccttgtgaaaacttccatctactctctgaggcatgaattcgttttctcatttctccagagaaagaatttgagtcttgagaggcatcttacccaaggtcatggccagcagacagcagagctgagacctgagatttgaagcccactgtcctaaccactggactttcctggtagctcagatggtaaagagtcagcctgcagtgtgcgaggcccggggttcaattccaaggttggcaagatccccgctgcccccggagaagtgaatgactacccactccagtattcttgcctggagaattccacggacagaggagccttgagggctacagttcatggggttgcaaagagtcagacacgatttatagactaaacacacacacacactatcctaaccactagactacctagccaacagctgggctaggcactctgctgtgtactttttattctcccagcctggggacaggatactcgaggaggctccccagagaaagctgcatcatttactggctgtgtggcctcaggcaagtggctttgcctctctgggcctcagttttcccctgggtaagggtcaacacaaggctcaagtataaaaagggctgggcagtgtcaggcatcttctaagccatcagtggatggtgttgataacgatgaaggtgacggtgagggtggcccacctcaacccttccttcccgcaggctggcacgatgcgcgtggtcgtgatcggagcgggcgtcatcgggctgtccaccgccctctgcatccatgagcgctatcgctcggtccctgaagtcgctggatgtgatggtctatgcagaccgcttcaccccactcaccaccaccgacgtggctgccggcctctggcagccctacctctcggagcccagcaacccacaggaggcgtgagtgagggtcctagcgggtggtcggggcagagcctgcagagaggatgtcccttctcagggttcctgtccccaagaatgactcttccttgaggctttgtcctgacgtgctgtaaagacaatactagcacacattaagtccttgctgtgtgccagacagatgctacacttgaccgtggccgaaaggccaagaggccatgtgtgtcagacagatgaaggttttgtctccatctcttccttaaactgggtggcagtcagtgcccagtgcatccggctatcaggaagacgtctaagtgggtggactgatgttcaagtttagcaaagaagtggcagaggtcattgtttcagtttagaaactgccgactgcttcaacacaggaaccctcaaatgaatattggctcgattagaagtttcatcttcatgcccataaattatgaaaccaatattcctgatcagtgggtggcatttcaggggcctgacctccttccatctcatggctctgtcatcctgctcgtggctttcaatgttgccaggagccagtgaatgactgtggaaggagagagcatgagggccaccagggaggagtctttagagtccattggccagaatgcggccacatggctgcagccacccctaactgcaagggagtctaggaaacgtggtcgagctgtgtgcccaggagaaagataaagcgtttggaagcagtgagcgatgtcttgggcgttta

SEQ ID NO: 43701 - DNA, 886 bp, Bovine  19866881353426
aaaaaaaaaaacttccttaccctaatcgcgtctcagaccctaatttaaggtactgaggtgaattacatgatggttcaagcaaaatctttgggttgacagttatttcctcaagctcttctcttctttcaatagaaaaattatgtaaaacaaatgttccctgctattttggtaaattatatgctatatatacacaacaaatgccaggaagttgtgagccagcttgtttcaaagccctcgtatagttaacatatgccactgctattttctttttctttcacattacactttttttccccttggaaaatcttggctcatgtcactgataactgcttttaggaacccatctgattcaaaatgtcgtctggctttctgagtgtaatttaatgtcagaggtctctctttacatccgtcttaagacaagttttaataaataaagggccctggcttctagtggattgccagagaaggaatgtgaacagatcctggcttaaagcgccagggagctaagccatttctcaaagtcaaatttcacaaaggtcagtgtcctccatgctcaaggtacaaaggtgacctgaacgcagctgggttggagggaagccaatattgacacaaagcctccacagttttctgttcatcgagctcagtttatcttcacgacgttcctgcaagcctgtcttcatcccgcttcacagatgaacgtgtctgtaacatgcttagctaatgttacagattgacaagcgttctgtgaatagtcgctattgtgatttatgttgattatttaagttaatagatgtgcaggtttaaaaatttacatattacagagggatccaaaatgaaaagtaaaatttctttccctcaaaactccccatccccatccgtcctcctt

SEQ ID NO: 43702 - DNA, 789 bp, Bovine  19866881367890
gcttgctttttatgagtaggcgacaggcgtggctggtgcttatcaaggccctgtgcgtgtggtttctccactagaaccttccatagggcagagctggtgggctcccattgaacagatgaggccaaggaaggggttaaccagactcaacttcctgtcccatgaaattgctggacgccatagtgtatatccacctttaggttattatcatacttttgagaaacaaatgtttggcagaaccctttcacgtgtttttacagaggctggactggagttggtggcaggggctggtggaagggctgagcctttcagtccaggcctggcgtgcttgctcgccagccgaggggcctcagccagctccctcggtgcctctgtttcctcctcctttagggaggggaggtggtcagtactgacgtgcacgtgtgcacacacaggtgcgcacacacagtcacaacctttgatgtgagtggcatgtggggtgtagctgggttcactgagcccccgccctccctcacttttccttcctgcagtctgtgtgtaaagtgcctctttgctttctcacccaggagaaggagaaagcacacgaaggagcccgacccatgagagccatcttcctggctgatggcaatgtcttcaccactggcttcagtcgcatgagcgagcggcagctggctctctggaacccggtatgtaccatcgcggccctgctaccgcttcgcagcctcgagctctcccttttctgagcgcgccttgagatgggtcagtagatgatagggttcttggtgtcatatg

SEQ ID NO: 43703 - DNA, 1376 bp, Bovine  19866881489441
ggccccactttcctgacggcaggggactttaagaggaagcctgtttaggacatatttcgtaactatgagcttgggcactacccccactacccccacttgggcagttctcggttcctggaaggcagagcgcttagccacttcctggaagcagaaagggagaacaaaaacagaagacccaacccaccggctcccgggtcagggaggtacctgggtgagtcagggagattgggagggtactgtggaaggggccaggttgtgttccccaaggtgggctgtccccctgcacccatcccttcacacggaggcagcctggggtggaagagagaccactgagctgctgtataacctgagcagatcgctttaccaagtctgagcctcggtttcctcatctgtaagatgggtggtattgtctcaaagatgagaacagaatgagatgctgcaggaaggtcccttgatgctggcatccagcagggggctatggacagaggaacagaggagatggggggcgggcctcttgactccgggagggtacggaggtggcgacctccctacctctctacattagggaagctgcaaagacctatgtgagagcagagacttccctgcctgttcgggatgcaacagggagccctgggaaaagccagtatctccctgcctgggcctaagccgaccagctcgtcccaaatgttcccagtgttagcactgaccatccctcgtccccatcagtctcaggcaaccaggaccctgggacctgccatactgtgggcttcaagaggaaggttaccggggatacagcaccctggagccaggctgcagctgggcaggcctcacccatatgactgaaacccgcacggttcccagaggctctgtgactgcaaagagcctcgcaggtaacaaggagaggagcagagtgcaagcagcatctgtggcaggtaggataatgactttcatctttgctaggacacgtgtaccctaacgaaacaagacggcataaacccccactgtggatggatcgtttcaccagctcatcatgtgggggacccgttcgcctacccacctggcgtgggccgctctggttcctgttacacagattagggaagcgaggctgagggtagtgaagccatttccttcagcccccaccttttgcctcttctctcctctgatggcaggaaaatagttgcttaccaccggagaggggtgggtggggcacagagaggggcagagagatgccacatcctatttatctcatcgcttgcccgacagaggtgatcagacactgcccgtttccttccaccctgaactggggtacttctgcctgagccgctctcaggcagtgtagactagagagctgccagggggccacccccacacccacc

SEQ ID NO: 43704 - DNA, 2102 bp, Bovine  19866881619430
tatggttttttttttttggctgacaggtatctgatgtcctgaagaactaaactccagtcgctctgtcagtttagagaaatgtgaattgtagctaaataattccagttaccagaggaggattacaaaagtagtttctaaatggaaaaatatttcgacatgtaatggattagtcaagaagcatcatgagaaagcagagatattctcaacatcgtgtttaaaaagtaacacacacatgatttccgattaaagtggaaacggagaccatctttaaagaaaaggggggtgagaaagccttcccacctcacttttctgagtttttaaatgcctctcacttcagccccacagtatggggagtccaaaggctctggtccaagggatggacagtggaggcggcggtggccagcacaaagctggccggggccagcctggaacactagcggatgggaggaggtgctgccggaagtgcacacccacgggggcgaaactgtcggtccccagagcttcacgctgtcagccccagcgctgtcttctggagaaggggagaaggtagagtcactcacgtctctctgaaggcctcacgtgtccccatcagccactgaagtgcaaagtcactcgagaactaaaaagatctcccctccctggcgacagcgtgcctacgccctgtcctgtgaatcttctctgtccccaatcacaacctggtctcaggacactcaggctgtctgaaacgtcacagaaacatccacacaggcctggccactaactgcaaggtcaaggctggcatttactcctcccgctgcagcgaagcagctgtttctggagctgaggccccagctcatgaatgggaaggagtctccgaggaaacctgttttgaatatcgtgttcacctgctcttcaaacgaagagatctgccatcggtacattcttaagacgtccaacaagcagcttgcatccaagacctcttcgtcagtgacctcttggcaggataaagctggaatcaaaaaaggcaacagttattaagtgaaccaacacaacaactaaccaagaaaacctgtgcagaaagatgtgtcaaagctaattaaaaatggaaggactggaaaattcaccctggaattatatctcttttgttactcttccctgtagccttacccagttaggacgctggtagacacctggaatttgctgaatgaatgtaatttttcatgcggccgcagcatttagtaaccgactttcagatatctgaattactatcatcaacagaaacttactgttgcaagattaatgttgaataaaatgagtttaactctcaacttggagggacaggagggcccttaaacatctaactgttcccccctacactttctgtctagctccttctctacaggactgtcccaggaccattaggccttgtttgcatctgaatttctattactacaaagcatcaagctctatgaggcagcctgaaggagtcctctgaatggtttacttttttctttttgtcattgttgtttttcgtcgcgccacctggcttttgggatcttaactcctagagtagatattgaacccagccttcagcagtgaaaacaccaaggcctaacgcctggacaaccagggaattcaatctgagtagaatcaagcttaacagatacacataaaagtttgatgagcttatgaatttatactgcaattaaatctacatcaggggttggcaaacttttgctgtaaaaggtcagctagtaaacattttaggcttggcaggtctctgtagcaactactcaactctgccactataacacaaaaagcagtcatagatgatagatatataatatgtaatattatatagatatgtaatattataaagatggtacataatagtatatattacatagatacataagcaatattacatagataaaatgtaaacaaatggacatggctgtgtttcaataaagttttattcacaaaaacaggtggcatgcaaatttggccctggggccaaagtttattgattcctgatcctgaccacccccttccctgagcatattattaagtgttgggggccagagtgaggtactccgcccatggcaaaggtcatgaggaaggag

SEQ ID NO: 43705 - DNA, 995 bp, Bovine  19866881804602
ttcccagcatcagggtcttttcgagtgagtccggtcttcgcatcaggtggccaaagtactggagcttcagcatcagcatcagtccttccaatgaatattcagggttgatttccttgcagtccaagggactcacaagactcttctctagtaccacagtttgaaagcatcagtctgcttctgtccaaacacccagggatgactctgggggcctcttgatccactcagcacactccctgacttcttagcaatgcctcctaccccagcagggtgcgggttgagatctttcttgggttcatcaaacatccccagctcatctgcccactgatccgaggggctatcatttatcccaaagcatcaccgggagtttctgatttattggtgacgggtcagctgtgttctttaggcagtttatggccgtgccattaaattttcagagattaagagcatgatgggaaagataaatgtagtgattctggggatcctgggagaccagttcctaggagaggcccccataccccttcatgctcacatcacgagtccctttttgctgctttcatgatgaaaggcatcctgtgaggaggagatttgctctcagaacagaaggagggccattcctggagttatagggtagtctcatgctagaatcatgaatatctgaatcagagaatcacagatggttagagcaagatgagctcttaaacccacgtagtccagccctctcattttactgatgaagaagcggaggtcccaggtggggaagtggcctaaccaggagcattcaaccagaaggctgtatcctgactctatttttccagtccccctcttgtggctccaggatgctcttcttctagagatggggattaacttcacagttgaggaaaaggggatctcacatcttcatcagcacccccaccaccttacagaaaaagaagctgaggttcagagaagatatctgacctcctgagtattaatttcactgagacccctaggttttg

SEQ ID NO: 43706 - DNA, 1894 bp, Bovine  19866880488700
ttcaccagcccgctctctccccagcactgacgtcttcatttgcacgagccccatcaagatgtacaagtactgtcccttcgagaaggtgagacacctgctgcggggcctctgctcaccttgcctgcgtcctggggaagggttgggaccctccccatccagcccacctgggggtctgggccggggcctcctcccaaacgttaaaaaaaagaaggaaggaaattctgtcaactatagatgtttctctgacttttcttgatttttcaaaatctctttgattagccattactttagcgataaaaaagtaaatacatttgtcactcaggaaacagttaccaggcccttgctacaacactgggcatctggggctgaaaaatgcctctctctgctcttgggagctgaggacagcgcggcaggaaaagagacaggtgtccccggctctgtgctccagcagggaggaagtccagaagcccaggctggctctctggggaagggaggaactgggaggaccagttgtgagtggtgggacagctgagcaaaggccaagagacctgggggaggcacaggggcagaagcaggaaggggagggagaggctgaaaggcagggcctttacagaaccattggtttgggcttcaagcaacaggcaccccaaggcctctgaagggtttttaagcaaagccaggcctggagtgtccaagtcctggatggcccagatgtcagcttgtactcacccagcttggcaaggagacagccttgtgaacccatttagtgaacctaacagcacccagttattctgggatgttcatgttactttgtgaccatggaggggctttaagagaagtgggccatttgtgcagattccccatctgctggggaaggtcacttggagcagggtgttggcggagcccccagacacgcctgtacccctggctctggcactgcacacccactcccgctgtgggtccagttctcatgtggcctccagaccaaagctcaggtagggctggaaggcaggctggtcagggcttctggaagggacgacgcacctaagggttgcatcccttttccttgagctggagccttgcagggtgcatgggggacctgagctgggttggggtgtttggtcagagccgcggtactgccgcttcgtagctgtggactgggacggctctgtggtcccctgcacgtgggtagtctccctggtggtgccctggcctcatagcgcccccccccccttcttggcccgctctcgttccagtatgcctgggtggagaagcactttggccctgacttcctggagcagattgtgctgaccagagacaagaccgtggtctccgctgacctcctcatagacgaccgggtggacatcacaggcaagtggcctgaagtaggggaggggcaggcatgggggccccaacccgagtgcccatcccccagccccatagtcaccagatctgtgtgaggcatcctgtccagccttgaaccttgagctgagcctcctccctttcagagagacaagcttcttccccacacgcacccccagggagtcagggagagtggtccagccccggggtaatgcactggggcagccttgatcgcgtcaccatacaccttgaagccttgccttcctgttaaatgagggccagactctggctgccaaacatttctttttagcaacagaatcctttcttttttcctcaaaagtaatttggactgaatctaatatgtaaaccaggaaagcaaaacctaatttctgtagttgaaggtggtttggagctgtatttttcccttttgcttatgggtgtccccctccccccaaaataaacaaaccttgagtttgcttattaaggcgagggggaatgattggttcaccaaactgaaaagctaacgtgggag

SEQ ID NO: 43707 - DNA, 1290 bp, Bovine  19866880524901
ggacagaacatgcaaaggcacaggcaagagccggtgggggcgcagcccctgggcacacccccagtgcctgcacacctccctctggatggggcagccaggctatgaccctccttcctgcccgccctgtttgcaggcgactacttcgggatcctcaaggaggccagagtgaccatgttcccgttcagcgtcctggacaaccccatgtactggggcagcacagccatctacctgggctgggccattgtgtgagtcagccctcgtgccccatggagcccagggtgctggttagggttcctttcctggggagctcctcactggtgggagcagagaacatcctagaatgaggttggcagactttctcttaaaagagtgggaggctcctgggcagcaggtgacggagtggctgtggttgtgaaatttgaatttcacgtcattttcacaagtcacaaaatattcttttgattttcttaaacaactacaaatataaaaactgttcttggcctagggaccacaggctgccaacccagtgctggaactgggcagggaggccccctgcccacagccagcctgcaggatccacaccccacagactagggctcctccggccagtaacccacagtccaggagcctggtacacgtgccccccacggcatctcccatctgtccattttctggattagaatttcttccatagaaaggttttctttgtagaaacaattctgcttttactgaacgctagaaaacaactttccaggaaggtcacaggtgcccccagagtccagaaggacgaaaggacctaaaggaacaaaccttgatggtggaccgtctggagcggacgttcccccaccagccccaccttcaggggtgggggggtacatgggatccaggctctgggctttgagtgacaaggagctggaggggcacttgtgggtctgctgggaccccccgcctgtgcccacttcagaccaggaagccccccatccacctgccttcagcctggcccctctctcctggactagggcagtgggatccagggaggcaggctccccccacaggcttacccactccccatagtgtctcctacctgagactggcagggtgaaccccacagaggtccttctgcaaacttccctgccagcacacccacctttcctctcactttcactcccagtcaatctttccaaacccaacttgaggtgtcccctcctccaagaagtcctccctgacctcctgatatacacacacatacaggttcttcctactggcttagacggggcctcccagggcaaa

SEQ ID NO: 43708 - DNA, 2673 bp, Bovine  19866880749669
ctccctggtcggttttgaggacacttccgacctcaggggcactgtgttctcgtctctgctggggctgctgtcccccagctcctcctcccctggggccacgtcctccagccccgagcagggcaggcccggaggcatgacagcagtctggcactgcaggcccacacgagcaaggctgtcctcaacatcctccaaaggactctgtggccactcgctgttcgatctctccctctgcctggagtttcccgtctgcctcatctaggctgctccccagggtggacggccccagcacagcctgctgcaggccccgcccctccctctccagcgccttctcgtgtgcgtcctgcaggcgccgcagctcctcctccttctcttggagcctcgtgtgtgcgccctggagctggccggccactctcctgaaggagtgctccaggctctggtagtcagcctcccttcccctcagcttctcctgcagtgcagctacatccccatcggacagggtgacacggcccagcagctcttggaagcgctgttgcgtcaggtcgcgctcatcgcgcaggctctgcacatgctcggccagcttctggatgctggcctccttcatctccagctgctcctccagccgctgcactgcctcgctgccctcggacccggggctcagcttctcctcctgcagcgcctccacccggtgctcgtgctcctgcagccgcccctcgaaggcgcgggccctgtcctctgcttccgccaggctccgaagtagctcctgcttctcccgctcgcagctccccagcagcagctcatagttcctctgcagtttctcctccatcagcctctgggcccgctcgctggcacccagctgctggctgaggtcggtgatgcgctcctgcaactgctgtacctccttgtgccggtcccgctgcagcgcctgctgccgttccaggtcccgcagctcctgagtcctccccagcagcagggcctctgcgctctggagctttcgctcgctggtgcgcagctgggcgctgagcgcggcctcgctctgctgccactcctccagctgctctcgcaccttgtccttctccagcttcagctcgccctggagcttggccagcgcctgctccttgatggcaagctcggcggcagcgttgcccagccgcaccttggaggctccggatctcggcctcgtgatgccggatcgcatccttggcctccccgtagctgcgcttcagggcctgaatctgccgtgtgatgagctcctggcgctggcactgggcctccagctcgccgtgcagatcctggttgactctgtggagcctctgccaggtgccggacggggaggtggccacttcggtcttaaaaaaaccgatgaaacacgtgttagtaacactcggcctcccagttctgagtgtcacacctctggccagggtcaaccacagaaaggctcctttgtgggtctgtcttttatcctttgcacaatttttttttccccatttaaaaaaaactaacaaatcatctcaattttttggtaagcagctgtttccagataaacagaaaacatgaacagtaacatcaaaacagctctaactgcacagcttctaggagaaataaaccaaacaaaactgaataatggagcagagtggtaagcaaacgaagactgcgggacgagagactctggcaggaggcgggggcaggagcagagcagagcatcatttgtttcgcaaaacaaaaggcacatggctctagaccacaaaccccacaagagcgcagcacccgacacgttgccccttccttctgggacaggagaaggaagggcggcaccgctggtggacgtcagtgaggtgacatccgagacactcgtgtgggaggtggcgcccgtcctccacagtgacaggaagaactaacctctacctgcaagaagacaaaacgagggggaacggaaaccatggagaaaaacgtgagagttaacaaaacaaacaaacctttgtggagttcaaaataacaaagtgaagcgtgcagaaaataaaacaattgaaacgaaactcctcaaactgaaaggcatgcaaaatacacagaactaattaacggaggaaaaaacaagaacacgaagggagtgagaacagctcagcctgagaactggcctgcccatggctccctcgaggtatgctggcggggaagccacaggtgtgacactcagttatgtaagttaagagacagtccacagccacacgtgccagctcctcctcccggctggcagcacggcgcccacccgccaccattaccgtcctcacccgtaaccctagaggccctcctcgctcacccagacttgagatcataagcacagtgaaagcagaggaggttaagaataaccgccctctgacctggcagggaagtattaacatgtctggcctggggtcagacacaggtgggttctgaggttagcaatgtgcaaaatctgctgccagtatcttctcggcctgatgtcggcaagcagcccaaccggggttttaaaaggtgctccccaaacctgcagggtctctgcacagatgtcccagaaagtcctggagtgacatgcgcaggaaagaggggtgcccccataccaggtcccagggcctcagggtctgaactgggcatggcaacaaccaggctgaaggctggaggagggcccagggcacatgggca

SEQ ID NO: 43709 - DNA, 1087 bp, Bovine  19866880945289
tggagagaaggaacacgaagtgagggctgagggcagcgaaaggccccaatcctgcagagacggggacacggagctgctcagcgccggctgcggtgacggggctgggagcgcagctcctgccggggctgtggaaacctctggcccgtgcacacggcttccgcacaggtgtcacagctcacgcgctcgctccgacgcccggctgcgccgtgaccgcagccctaggccgctctcagagcagcctgtggttgtgtcgctgtctccaggagctgaacaaccgcctggctgcagaaatctcacggctacggacactgctgactggggacgccggtggcgaggccgctggttcgcccctcacacagggcaaggacgcctacgagttagaggtatggctcggagccaggcccttcaccagcttgcggcacacgagtcgcacgtgggaccaggggtggccccagcttatgggaaaacccaagtcacgccaggacacagagaacagttagccagacagcatgggacctctcgaggccccagggacctttacatttaacccaccctcactcccttgcccctctccctggtttccaccacatcacaagtgctgacctccaaaacggaacactgagcagctgcgtgacactgcagctccctcatttctctctctaggtcttgttaagggtcaaggaatcagaaattcagtacctgaaacaggagatcagctccctcaaggacgagttacagacagctttgcgggtaatgcacgtcccatgagggcctggagggtggggccacgtgggtcgagatcacacacacaggctcaagtgcgttcactgtcaggagtgttctggatgctggccctcgggcggggcagcggacatgagggagggcagtcctgcccccccttggcggggcccagggccccagcacacggccatttcctgcgggtgctcctggaggcggactcacttggggtggccaagaccggggtttccagcctgaagcacagaggtgctctcagggtcaaggcagcaccagcctgcccagagccggggccctgccatgcctgttgtactttgtgtctggtttctgc

SEQ ID NO: 43710 - DNA, 1446 bp, Bovine  19866880954164
aatggtttatctgggacaagtcaggagctgcctgtgagaaaaaggcctgtggctgtcactgaatgtaggctccaggcctgctctgtgctacgcaaggagcaccatggtaaacttctctccttggtcttgaaaatcaggcatttgcttagaataacttacagtttgctgggtaacagtaagggaggctggacctccttgctccgtagttagtgccatgtttccttttgcatctcacacaggctctgttctgctaactgtcgaatctggtttcttccccccgcacacctttagcctcttagcaatgcataccacgagttagcgcaagtgtactccaccaacaacccgtcggagctccgcagcctggtgaccaagcacagcgagatctttacacgggacaacaacatggggctggtgaagcagtgcctgtcctcgctatataagaagaacatccaaagactcaccaaggtgcagtcctgtgggcctccagagccaggctccgttctcctgtccttgttggcactgaggcagcagcgcagggtcccagccggtcctttggggaccttgaggggtgcctttccagggctagtatggggtatttgagaagaagagcaggtgaagaagaagtggggaggagatgtggctgctctgggaggcagacaggtagctgaagggagggaggtggcctgggcagatgctaagggtacagctgtgcggcccgggacctcacagcaggctaacccacctgtgggcgcttggctggtgcacttgcgctggggaaggtaagccaactgtgtagtttttattttttaagatgaaaatagacccagtggcttttgatgctggaaaatatgcttgttatcaagtgttaagactgtccaggaaagtgtaaaaagaaaacgaagccttatgttagccagggagatggaggtgttcactgcaggtaatgggaaaccggcaaagaacagctgcaatgagcagggaggggacagctcttccctcgagacacagccctgcaaggacgcagtggacaagatggctggctgccgggcaggcggggacacgggattgtcacgggggctcagacctgctccacaatcatgttctggggacgtttctctggatccgtctgctccatgtgtgcgaacactcccactgactataaccagggtcacatgctatgtgctgttctatatcctttcttctggtttccatggcaacgtaagcctgtatcacagtgactgtgcgttgtgctttgttgtacagacaatcataattttctcagccagttctcttctgatggacagtcaagtggaagtttcttactttgaaaggaaaaatgacagttctgtatatttcgaaatgttcacttttctagtcctcactggtgctaaactgcctagatactgcttagaattcacaggagtttcatttgggaaggaggtgcta

SEQ ID NO: 43711 - DNA, 814 bp, Bovine  19866881388834
ccttaccctccttggagatgcacaccctgggagtggcttgggcagcccctgccagggcaaggagccacatgtgctcatctggcacgtggaaaagccccctttcctagggcccctcactgggagagaaatgcctgcctcatcagtctgcttctgcacagatccagacaccaggctgcttttctctgagctgttctttattcctctctcttagcccgacctgctgaatttcaaaaaaggctggctgaccaagcagtatgaggatggccaggtgagtggctggaactgccgtggccccaggcactggggagcgggtgcaaggtctagctggccttgtccccatgggtgtgggagcgctggcccttgtctaccacctccaggattgtgaccacgaccccgtctcctcagaagtgggggtgtggtgggcagtgggtgcaccagcctgcctgctgccagcatgtggactgcttccccgctcctggtgggcatcagcctcaggcctggggatgcccttcaacctgagcttcccgcctggccacattctgcagaggtttcctgagagcccaggttccccaagaacaggctccctggttgtgaggtggtaggcagcagctgagatgcagccacaggtctgggaggagctggcggacttgagcagaaagaacgagccactagtggctgctgggggtggagatcaggcctccaggaggcaggagaagcctcgggtccctctgcgagacccccggatgcccctccccgccctccttctctctctctctctctctccctctctctctccctctctccccctctctcc

SEQ ID NO: 43712 - DNA, 1310 bp, Bovine  19866880263728
ctggaattagattgccggagaaatataataacctcagatatgcagatgacaccacccttatggcagaaagtgaagaggaacctaaagcctcttgatgaaagtgaaagaggagagtgaaaaagttggcttaaagctcaacattcagaaaacaaagatcatggcatctggtcccatcacttcatgggaaatagatggggaaacagtggaaacagtgtcagactttatttttttgggctccaaaatcactgtagatgatgattgcagccatgaaattaaaagacacttacttcttggaatgaaagttatgaccaacctagatagcatattgaaaagcacagacattactttgccaacaaaggtccgtctagtcaaggctatggtttttcctgtggtcatgtatggatgtgagagttggactgtaaagaattgatgcttttgaactgtgttgtttgagaagactcttgagagtcccttggactgcaaggagatccaaccagtccattctaaaggagatcagccctgggatttctttgaaaggaatgatgctaaagctgaaactccagtactttggccacctcatgtgaagagttgactcattggaaaagactgtgatgctgagagggtttggggtcagaaggaaaaggggagatgagatggttggatggcatcaccgactcgatggacatgagtttgagtgaactccgggtgttggtgatggcgtgctgcgattcacggggtcacaaagagtcagacacgactgagcgactgaactgaactgaaccaaggggtaaggcccgtgctctcatcagccacaatgcatactgatcatctggatggtcagaccagtgaaaacagctgagcatcagccctgagttttggctaaccttgatgtactaatagcacaatgccacaggacctttgcatgtgatattcactctgcctgaaatgatttctctcccttcttcaccaaacttgcctctgagtcactgaggtaagctaattccagtcaacctatgcatgagggtgtcccaggaatactaattttccatgtagacccaatggtccttggtctcactacttcagcagcagcactgattaaacactagcagtatgcagcacattgaaacatttatatctgtatttctctatgtggggagacaatgatggaagttcagcaacaattcccaaggtgattccttggtctctatccaccccattgccaccacaatccccaagaaagttattactttgactaggcatgatctcacatgtcaatgaattatatgtataaaccaagggatgctattgaa

SEQ ID NO: 43713 - DNA, 777 bp, Bovine  19866880355054
catcgagccaagagttgacttactgagtgagataaagtggaactcagttatagcctgactaattatctggcgggcacttggctgcatcgtcttaaatacaggctaccgtgccagggccgctggtgttacttacagccctgggcacattattctttggccggcattcaggcagtttcagatttctgccatggttcacattgtgacttgagcacagttcaggccgatacctgtagcatctgccccacacagcaagcactctctacctgctgagtcttgtgtaaccccaggagcccgctgagtggcgcttcatttcacactgccagtcagatttcagggatgttaacatggtgggcagtccctagagcctttagtaaaaatggattacaggaggttaagggatgtgaagcgagggaggaaggaggaagaggaagcaaccagagaaaaaggagaggatgtggaatacttttggcagagaagacagacaaaaaaaaaaaaaactgatttattattggactattgtaatagtagacttccctggtggctcagactgtaaaagcgtctgcctacaatgcgggagacccaggttggatccctgagtcgggaagatcccctggagaaggaaatggtaacccactccagtattcttgcctggaaaatcccatggatggaggactctggtaggctgcagtccatggggttacaaagagccagacttgactaagtgacttcactttcacttattgtaatagtggttgttaaatcccatatcccagcatt

SEQ ID NO: 43714 - DNA, 1357 bp, Bovine  19866880372608
ttcctgcctgctgttggtattgtggggtacagttcactgaggtttcctggctgcgctgaactaaggcaggtccatgcagcaggaattccagaggctgtgagaacagctgaagggcaggacccgggtttgcttgttgctagccacctgtatgtcccttagaagaaaagggcttccagagtccttcttcttggctagcaggactcttatccctggctgtgtaaccttgctcaggtgactccacctctctgggccttggtttttccatctctaaaatgagaaaacttgaactaagatctctatggttgcttctgccacaagtgtttcatcatagctctcccatctacctgctgtgggttagactgagtgacggtagagcatgaaagtgtattgacaaagaccacatgctatgtaatttgccgtcaataaatcataattaaactgagctactgtcttacatcaccttttctaccttctagggaagtggcatggtaatttgtatagtgggaagggctgcccctttaattaaaaaaatgaagaaaaagatattaaaaaaaaaagaaaggaaaagaacagagccagtgcagaaagtgttttgaagtgtattggattttggtaaatggtttcttccatcaatgtcacaggcgcctgtgaaggccagtggtataacaagtctggagatttaattagaatggctttcgagtttttaaaacaccacttcagtggaaaaccatccattttttcctcctgatctgcctcaggatccttcaaatgacatttgtttccttgtttgcagaaatcttttattcttggaccaccactgtcgagttaaattccagcatcttatgcctttgggtaaggttggttggataagagattttgttgttgttagaatgcattttttaaaaaaagaaatggaaaaatacactttttatgaagaatgaaatatttaaattttgaaagctcttcccatcagcatttttaatttaaataccttgcttttggggatgatcctaggggattgttgctcttaaaacttttaaataagacacttgaatgtaggtcactttgcagtcattgtacgtgtcacatcctggtaggagcttcaacttccctctgtgctgagaaagatggtaaaattgcagccagaaattttttttttaattttaaaaattaaaaaattaactgttactggagtatggttactttacaatgttgtgttggtttctcctgtacagcaaaataaatcagccatacatacatcctctcccttttggactttctccccattctggtcaccacagggcattaaggagagctcctgtggttctacactgtggttctccttagtgatctattt

SEQ ID NO: 43715 - DNA, 2758 bp, Bovine  19866880458143
cctggtgggctgccatccatggggtcgcacagagtcggacacgactgaagcgacttagcagcagcagcagtagcagtaacttaaaggatgtgtattttagtgttttagattgtcacatagacttttaccagaggtgatgttactggggtgagtgcatatatatgaacctgtggaaagagtgcctttacatgggggaatccagcccaggcccaatcacacacatatacacaaacatattttttatcttttcagttaaaatgaggaaaacatagatttggagagccattctttcattttataaacttaagaagctaggactaaattgcatttttttttcttctatgatactgattttttcccctacttctctcatgacatagcagtcaccttatatttatgaaaatttgatgtaataaaatagcattttacaagctttaaatggagcagatgtttgaattcttttcaagtgtcattgatcttttgctttcaaaagtaaggtctgttcctttgtgttgcttaagcactggacactcaggttaagagctttattgagatacagaaataattcacataccatataattctcccgttagacgtgtacagtacagtgatttttagtatattcacagagctacagccatcaccacagtcagttttagaacattttcattaccctagaaagaaatcttgcacccgttatgtgctacctccccaaccccctgtaccctccagccctagccagctactaatctactttttctctttatggatttgcctactcagaacagtttttgtaaatggaatcatccaatttggtcttctgtgacttctttcactaagcctcatgttttcaggcttcattcatgtagcatatatctgtacttcattctttttagggctgaataacattccaagcattgcattttgtttattcgttcatcagttgatggacatctgagttttggctgtattacgaataataccactgtgaacattcatgttcagatttttgtgtgaatgtacatcttcatttctcttacaaataccaaggagtggaatttctggatcataatgtaactatgtgtaactttttaagagaccgccaaactgttttccaaagtggctgtaccatttgatatttccagcagcagtgtatgaaatttctgatttctttacagtctcatgaatatttattattatctgtcttttccatgttagccttcctaagggcatgtgacgtggtatctcatttatggtgggttttgatttgtattctctgatgccgtgtcaggtttgttgttgcacacatatatgtaagggacggggcaggcagtgcttctaaatcacagcagtagtttggccatctcatgcgaagagttgactcattggaagagactctgatgctgggaggggttggggacaggaggagaaggggatgacagaggatgagatggctagatggcatcactgacttgatggacgtgagtctgagtgaactccgggagttggtgatggacagggaggccccggcgtgctgtgattcatggggtcgcaaagagtcggacacgactgagcgactgatgtgatctgatgatccacttaaatttattcccagtcactagatattatgtgtcttacatccccaggtcagataacttagcaggtctttagtgcagtcttctgttcaaatgtccaatataccatcaacacagtgacctgtttctcttcctggattactgtttcttggtgttgatataaacagtgtactataattgagccttatgaaaaaagaatgccaaaatttgactactgggtgaaagagaatatcctgaaggtgttgacagtgatctttataagacacctttgttaagtaatgggtttgtaataaacttagaagagagtaaggaaatatgtttaaacagatgaaatcagaggtaaattgttgattaacccagggatggagatcaggagtatcatttggatctgagacaaaaagaatatttaaaacctttggttactttgaattgtctttatcaacagctcagattctgaaaggaagatgtttccttttcagtggaagccttaattttatcatccagtataacagatgaaacctgttatggtgtagacagtgcacagtgaggaggcagcccgggtttcagtttagcagtatagtcaacagttaagtcttttggtgtgagtgctgtaattacataaataatccatgtggaaaggagatttgctgaggtgtttaatgaatcgtgtttactacgtctgtagataagagtcgcagtgttttaaagtttcatctttgtggttatctgtgatatgtgctcctggtgttagcatagatctaaagaccatcataattacgattgtttataacatattgtaaagaacccttggttaatttttaattactcttggtggagttgggggtatgttgagaacatatttgaacccaggaaattataagttgtattccctcctcccagaagatataagattatatatgggccatactaggttaatgatggagaaggcaatggcaccccactccagtactcttgcgtggaaaatcccatggacggaggagcctggtaggctgtagtccatggggtcagacagagtcggacacgactgagcaacttcactttcacttttcactttcatgcattggagaaggaaatggcagcccattccagtgttcttgcctggagaatcccagggacgaggaaccctggtgggctgctttcta

SEQ ID NO: 43716 - DNA, 1438 bp, Bovine  19866880531770
tgggttggctactctataggactgtagcatggcaaggactcccaaaataaccctaaacacagaaagcaaccccccattcctagggtggggaaggaagttccactatcagagaccccttctcctctggggaggaggctccaagatgtttgtcatttgtcaaaaggccaatttagcgccctcagaaatcggaaatcaacagatttcataccatccgtcactggtacctccctgttacggagtttatctgaaaggacaggaaatattccatatggctcttgtcagaatggccctgaagaaggagacaagatgcccccaagagtggtgaagagagagcaaggacgggaatttaccctgagattaaaagagtgggaggaggaaggaggcaacaagaggcaatggaaagagacgcagaggagagggagggcatggggcgccaaggagagagagagactcctgccggaatgatgacgtcatgttttccacttatctcatctggcatcagccacccaggggcttgttttcatatgaatgagaatgttactcagcttggtctttgtgtatttcccccccaaaagctatttgtcttaatcagcatctctaaccggaaggcggaaggcgaaggcaccccactccagtactcttgccggcaaatcccatggacagaggagcccggtaggctgcagtccatggggtcacaaagagtcagacacgactgaacgacttcactcacttttcactttcatgattggagaaggaaatggcaacccactccagtatttttgcctggagaatcccagggacagaagaccctgttgggctgccatctatggggtcgtacagagtcggacatgactgacacaacttagcagcagaagcagcagcaggaggttttcacacaggatccgttcaggtgcttgtagcagggctgcacagctgcaggggtggatgaactgctattcatgatggtgctgttaatagcatgtaaacacctggagatgttctgcccttttcaatcacataaaatagagcagttttctatcttctgaagagagaggagtctcttaactaaatacccatgttacagctatcaggtattatcataatgccctgtcatatatctgttttaattttaagctcagaacatatataataataatttatgcaagttaagttctcaataaatactactattaataattactattttatttttattctttagaatatagttgaaaacaactttccatatccaataagaatttaagcaaatctgtggcaaatttgcttttgccacaataaatgtcttgccttgtaatttatgaaaaaattttttacctggactggatattggatttattcctcattggcaaagttagtgagatacatgtgatttgttatttattagttacctttactacccccaccccctcaagaatgt

SEQ ID NO: 43717 - DNA, 4162 bp, Bovine  19866880544563
gaagctgagtggtccttgtagcgactttgcagaggagtacaacacgagcaggctgatgtcccttggcgtttattttgtcctgtatgttggcatgggtcacacccgccttatgttacacttgacttccgtcttctattatagtatcagctctttcagagaagggatcatctgtcattcaactttgtttctcccataaccatgggaggtgtttctctgtgtcatgggagaagctctatgatccaagacagccaagcccagttcttaaagagggagccacagagcatctaggaaccagaaattactaaggatgaaaatatattggtttaatatccaaagaatattatccctattatacccatgtgttttagtttttctgttctaaatctctgaggcctaagatcttgagtcattttgctacttctccttcctatgtgactagattcaggctgtgctgggtctggcatgctccgcaatagtgtttctcaaccctgactccaccacagagtcacccaggatcactcctcaacaccctgatgcccaagtagctgagaccccctaggtgggacctaagcatcagtagctgtcagacttgcaggtgattccagcgtgaggccaatgctgagcatgaggtgtttgaaggaggggaatctcttcattgttttatctccagggcctcctagaatgcttggcacagagagagtattcagacgtgtcagtgcctcctgtttcaccatgtcctcacgggtgtcacataacttcagtgtgattctaagaccctcccatccctcttccggggcttccgcatctcagcatttgcatccccatctgtctagtagcacaagctagagcttgaggttcatctctgatgcccatcccagccctccccagcttcccagcccttcgttatgggatgtacatgctgagtcgcttcagttatgtccgactctctgcaattccagggactgtggcccaccaggctcctctgtccatgggattctccaagcaagaatactggagtgggttgccatttccttctccaggggatctttgggacccagggatcgaacccgtgtctcttatgtcgcctacattggcaggtggtctctttaccactagcgccactatggggattttacactaaatctgcctcatggttacgcatttgtttccatcctcacccacatcctcatccgtggtcccgccctcagtcccctgaactacctcagaactgcccagtcagctgcctgcacgcagcccggcctcaccaatccactgcccaccccagtcagaatcatctttaccaagcgcaaatgtgattgtgtggccgtcgattgaagcacttcaggtgacgtgccactgcgggttggcgaccaaactctttaatcctgtggacgagaccccatggtctggtcctcgcatccctgtggcctgtccactagaccccagggtctgacccgctttcgcagtctccgttcagtccactctctgccacatctttgctctccagccactctcgctttctttcccttccttcaatcttgcactccttccagtcttggggcctctacatttaaaagaaggctctccccacatgcccctccctctttgccttgttaattgtcgctgcttcttcagttctcagcttaagcgcccttatccccgtaaagccttcttagacctgttaaaaactcctttgtctcatggtcctgtggcctcgggctcacttctccatgagtgtttttatctcagtgtgtagctcactttccatctgagtgattttctgacctgtgtctttctgccccgcctgactgcagccacatgaaggcagggttgtgtctgattttgctcattctctcccccgtgccaagcaaagggcagaacacctagaatgtgctcagtaagcccttgtggactgaatgcctggcctcttttgtcccagagctccgtgcctgggagtagctgtggcttctcttgcctcctcttctgttaggtagtggctacctcgcctgcctgagaccccatgctggttcctagccgcacagtcctatgaaagattccacgtgacgcatctgctttgccctattttcagcagcctcctaaagatctattaatatccacgtccatcaattgcttttctatgggaatcttttgatgtttctgaatctccttagaactttcccaaatcttaattttttaggcttaaggtgtatcttctgtcctgccctttggcccagtagggatttcaggagttgctctttttttattttagagcccatgccagagcgtcttacgtcatccatgtgcttttacacgtgtttgtggcctcatagtgatgctcagaggatcagtgtttatagaagagaaacacagggtccaggactgcagtctccctgttcccatcacagcctcctggttgcctttaatccactgcacaacccccctcccccactttaaaaaccactagaaactaaagcctgtctccaacagttgtttctttgaacatcaatggatagaacattagcctcgatcctgattactggtttttgtgaccttctaagacatttcccatttctcgagctcactttactgacttcataaaacgaaaagttaagaccagattattaaggatccttcagtcttaataatggtaatagtaatactaacggggaaaattgtagtaataatgatattagctagtatttattgggcacttaccacgtgtcaagcaccatgtgtcagtattttaattgtcttggggaaatgctgtgtttttcctttgttctttctcacaacacttctgacaccagattgtgtgggcttttcttcgacattgaccagttctgtggcaccagctgggtgtcctgcaattcagttctgacactgtctacctagagttaacatcagattctacaggtgaagggcttggtcctgcaagactgtctccacttcagatgccaatcgcaagtccagattttcacctgtgcttctgaccagttggctgtccatcagaagttcccatgactgcctacttagattcaggtaattcgctaggatggctcacagaacccaggattctggtatattacaaaggatattaaagaatacataggtgaggtccagaagggtcctgaacacaggagcttctgtctctgtggagtttggggtgtaccaccttccaacacttggatgcattcttattcaccaacttggaagctttccaaacccgtattttaaggatttatggaggcttcaccacataatcgattattaacttctagcccctgtctcctctctggaaaatgagaagtggagctgaaagttccaagcttcttatcatggcttagtcttgctggtgatcagcctccatccaggagcccaccaagagtcatcgcagtagaacaaaagatgctcttatcactcaagaaattccaaagaatataaaagctctgtgtcaggaagcaagatcaaagactaaatattagcaggtaccagatgcagagactatatatatatatccttttatttcacacatgttttagattctttaatcccctctacaagcaaccaagtagggctctttctgtggctcagtcttacagatgttgaaactcagacacagtgacgttaagtaacttgctcaacaccacagagccaggaaatggcagagctaggattcaaaccacccaggatcattggctccaaagccctcactcttcaccagctaaagtagaagtcactaaagtaaagcataccaagctttgggtcaaactgatctggtttgaggactgactctgccagttatcagctgtctgattccaacatgggctcttctgtacacctgttttcccatatgcagaaaatggaaatagtacctgtagtaggtgtatcagggctcttgggctgctataacacaatactccagacatttattttctcacaatctggaagctagaagtccgagatcaaggtgtcagcagctctggtttctgctgaggcctctccccttggcttgcaggcggcacttctcactgtgtcctcacatggtcttagctccatattcctgcgtgtctgtgttctaatctcctcttctaataaaggtaccagttgtattggtgtccattagggcctacctatagatctcattttacttatacagtcacat

SEQ ID NO: 43718 - DNA, 732 bp, Bovine  19866880590606
ccaaccagggactctttacttaactttcagtgtccagggttttaactgtggatatgtttacatggtttgcagctacttctacatagagttaagttagtgccagcatcttggtgtaggaataacttccaggaatacctctgtggctcaccaaatcaactcatgagtgtcacgacaaaacagcagggcccaccctttagctcacagtacaaatcgagtaggacatcacggacaactgggttgatgagcgtcatggattcaaagaacagatgtttagtcaccatgtaagaaaattggaaatgcccccaaatctcacagctcataagcaaaaggatatctaagtaaggttttcccaaatttgacaataatcttgaaaatttatacattggtgataacgagttttgaaggtaaaagaaacttctagactatctacccaactaaagaatcgactgtattagaggaaagactgagttaccttttcaatcatctgtcaaacactgtattacctttaaattctgcctgtaaaaaatattacaaagctgtcatagacaagatcagagattatgaaatccattcacgtgtttgctacccgcactttgccaagcagctaattagtaaaaatgttatttttatgaatgttgtgatgtttgtgctatttgccagcttttcagaatttttaatttgctgcacttttctgattcaaaaataaatattcacttccatacccaatttcat

SEQ ID NO: 43719 - DNA, 3839 bp, Bovine  19866880591898
gaaaatttagcaccctagctctgccccactaaatgccaacagcacccctggttcctgtgacaacctcactgccaaaatcccagagggtgatgacttctcccacacccatccccaccgagggccataagtctaagtcagtcgtgctaattcaactcccatttgacagtgggtggtttagaggtgtcatatgatctagttctggacaatagccttatagcaaagatcactggagggacttcattgaaaaagttctttccttattccctgtccttagatgcagttgtaggatgcagttgtggtgtcggtgccacagtagctatcttgagaccatgtggggacaaagccagcacactggagttggcagacgagcatggggcctcgcagacatcgctgagtagctaagctaagactggaaatgcttgcctccagctttcctgccaagtgagacggtcaagttctatttttgtttaaggcattttttactgccttgtttttaacctgaaatacctgatagaaagtatatggttggtctaagtgggaaataaagagatgtggaacacatggctcctgaccttgaggagcttatattcctacagggagagcaggcccacataacaattacagaaacggtgcaaaaatattcgggggccagcttcatgcttctcctacaagggcagtaggagttaggaccaggcgcgtcagtcagagaagcctcctggaggagggggaaagtccctacctcctggcttcaggccctgtggaatcccctcccctaagtgtgtatggacttggtggctcactttaaaaaaaaaaattattttttggccacaacaaggcatgtgggatctttgttccccaaccagggactgaacccgcatcactctgcagtgttagcatggagtcttaaccactgggccaacagggacgcccccgactcacttctaaggaatatggtgggagtaacgggatgttacttctgagatcgggatacaggaagactgtggcttccagcccaggtggagccagaggctgcgtcgtgaggcggccccgaggcagggcccacgtgcgatcttacagtgggatcttctgaggcccactggccgtcacatgagtgagctgggaagcggatctttcccccagtgagcttgaggggactgcagcccttcccggaggccatggccccgctgaagtctcacccagaccttacaccacaggcaccagctaaaagctgggcccagatttctgacccagagaaactgtgtgatgtcaagtgctgcttaagttcgttaaatgtggggatgtttattgtaggcaataggtgactaacggaggggagggagctggaggtctcaatttttgacatggccaagacggaaaaggggcagacttggcctgagaccttgcgtctaccgggcaggggttcctgggtcagagctggcttagatcccatcagattccagagccagacaggaccctggggagtcagggttgctggggaaccttacctttctttattcactgacataaccccatgggtgagtccaatgtctgacacacagtaaggattctataaataaatgccagttgacatagggatggatacctgcttgcagtaagattaggttatgacaaagtataacccatgtggaaagacaactgcccccgagcccagattagaaagctttttgaatccctccagggaggagtgggtagaggaagctggttagggttagggcaagccacagtccatggggtcacaaagagtcagacatgactgagtgactaacacacacacacatacacaggcggtgagctggggataaaggcggggctcaagcaaggatgccacccagacctcagaagagaggtgacacgtggcctcaccaaggaaagggctgctgatcccgaggcagtgatcactgggttctctctggtttttagcactgagcctctgtgcgtcttgcactaggcagctgccatggggcgcccaggaatcaaggggaacaactcttcctggtcttttgactcttgaagtaccactccctcgacccaggaggtgaacaggctgggggggcgttcacgggtagaaaggtgtctgagcccggaagccctttctgtttgtgggaacccacgtgcaggggcagctggctctccccaggggtcgacacccatgatgccgactcaggctgcaggtcctacgccccaagcctctctcacccccaggaccactccagccaaggtcttcagataccccttcacacaccagccagcagttcagccaccaaccccaggcccaaagcattgcttggcctaaaatacacgtatgtcccaaacggggagccactgacaggcctggtccccaggccaggccctagtgagcatcttcccctgagatgtgcaaacaccttcacatccccgcgaggcagtgatgccaccagccctggctggtttcccgtttacagcttcctccagaacatgccagtggggatgccaagtgtaagaaacaggaggggaacctgttttatcatcatctccttgaggggggacgggaggagagctccagaggggctggaaggataaaaggagcggaggggacatcaaattctggggttatcacctcccccagaagcagactctggaagcattcagttcagtctctcctctgccttttctcttgaaaattacgtaaccagccagggagaacaaaggcttcccaagcctcccaacaatactgaaatagctcggagagaaattccagcgacctcattggagctccaaagcccacatcggtgcagagctgggggcgggcagtctgggtcctcgagtggtggggagtgggtgctggtcgccacgggaacagcatgggggcaggagctgcacctgcccaggctcgaggctgtgagtgtgactttcagatcacaagtgtgtgaggctatgtgtgtgtgccagcactgaaatccttctgatttgacacaactcctccatttgacctttatcgatgcaaaggaaaaacttctcattttttttttcctaaggaagaaaacctgggatcgcagaagatgttggcctctttcaaaatctaaatcaggacagctctgacttcagtggctaaataaggtgagccctttggggcttgctttgtttggactgtgttctaaagggcagagatcccagccagggtctcagcctctccaaagcagagcctgcctctttcatttctcccacactcacaccagcacccactgcacggtgcccacaggccactgtgccttcctgaattccgggactactctctctgagcccagacttcatgagccatcgtggtccctggaggagttcagcgttcagttctgattgttcctgccaaacgctggggcccatacagggagccacttcctccctccctgtagggtcagcggatggcaaggatgctgaaagatccctggtttgtagctaaaggatacagcgttatcttgcctttagatcagaaatggcaacttgcgtcacgtgtactactatcaacccacttttgcacccacagcagatgctgataaccagtgatcacccctctttcctgacgagccaggaagatgagaacccttctccatcagcattctgagaggccctgtcgacggcccacagctggtgctcagggcagagcctctctgcgtggacgggcaggctctctctgagctcctgcccccactgggatcaacccccaccgtgttccccaggcacgcagtctgacttgctggtgtttattgagggcctactatgtgctgggcaccatcacacacggtcaacaatgtttgaggctccatggcacatggcggggaagg

SEQ ID NO: 43720 - DNA, 1621 bp, Bovine  19866880617989
ctgtagcccaccaggctcctctgtccatgggattttccaggcaagaacactggagtggtttgccatttcctcctccaggggatcttcctgacccagggggttcaaacccaggtctcccatattccagacagattctttaccatttgagtcaccagggaagccttctaaggtgatggtggctttttatcagttgctgttcaatgtaaatagttcttacagaaattttagctccttaacatgttccaagaaacagagctaaagttttaacagatctctgttctcaaatactacacaaaaaataaaaaacaccctcttatttgtttcattttcctatctcaaaactttctccttttaaaaataggcttagaacatctgtgattgccatatactttaaagtagccttgttttatttactcaaaatataacaagactgaaaaaaatttaatacagtatacagttttaagtcactcacaaaattatcaatcataaaaataagttcggctgaaatgaagaaaaatgagaatttgggtgtttttaaactatgttacacatgattctaaattatcaaacacattatttatacccactgaaactggttctgtgagacttacttctaaaagtagccagtttttaccaattcaaaacttactctttctgtgtatgttttatgttccccatcacattttttagactacttgcagtcataaatagcagttcaaattcaaagagtcaacagcctactaaatccagttttaaatcctgatgcatgccccccacccctgcaaaatgtacattttcaaagcagtaagtacttttcttgtaaatgttaccagcactcacccatacagactagttctaggtcaataaaaattaaaggggatggaataaaagaagagagaaagttaaaagaaagggattacctaccattactctgcagtgttaatcctgagagatcttaaatttttaaagggggaaaaaaataaaatattaatcattatcatgaaaataatttccatcatatttaaaattacagaatataaatttaagccagggattcaaaacttccatgaaccatttcaattcaagcatagtaatataaatgctatctaacaatgcaaaagtgctttccatcttatttttcaagaacagtgttctaagcaggcaaaataccaagtatgtataccttagttttagtagtcaaaatataagcttgctcagaattcaaatttaaataaacatatttcattaaaaatgtccgacttttaacattagttgaaatcctgggctatctccaaatttacaatttaacttagaaaaattaaaacactattgatatcttttccctttattttatgcttctaagcataaaagtcaagtttacttaccaattccaggtgacacaactcgttcatagtgatatggattcacacagacactatcacattttaagtcaaatgcatactgacaatatttaacatgttttagttcatttttgtgaaggtcaggccacctccagagacgggcatagatcacatgaggaaatcccttgcgaccagccacctaagaaaagtaaacgaccatttaatgagcatcacacattatgcaagtcacttgatacatt

SEQ ID NO: 43721 - DNA, 857 bp, Bovine  19866880645425
atttaattatttgtatctctttctttccatgtaatagcacatgaatgcatacatacaaactataaggaaattttattgccaccctagacaaggaactttctgcacagcaaaacaggacataggcttcttagcaggacagtagcattggcacgatgaactgtattctttctgataatggggacctcgctctaaggggtcgagaagagtcggacacgactgaatgacttcactttcacttttcactttcatgcaacggagaaggaaatggcaacccactccagtgttcttgcctggagaatcccagggacgggggagcctagtgggctgccgtatggggtcacacagagtcggacacgactgaagcaacttagcagcagcaacagcagcaactcttgaaagcaatgagtcagatcatatcctgattgccccctggtggttcctgactcaaattgcaggcaaaggacttcactggggaggaaaaaaaaaatggcaaaaatagcaattcagatctctgaagaaaagacaatattatagcttcttagggagtcacaggtttcctaagtttgttaaatctacacatatacagagaacaaatactgtatcctgtgcagaagagtgaatctagccagggctgctgcttcattctcttcatactgtagggtcccctatagggctacgtacacatctgaactttgcagatggtaaatgaagcaagacaattgtcaactcaatgctctaaaattaagaggacaaattagaggacacaagtgatctgaaatggtaaacaatcaaatgctctctgctgctgctgctgctgctgctgctaagtcgcttcagtcgtgtccaactctgtgcga

SEQ ID NO: 43722 - DNA, 1308 bp, Bovine  19866880651342
caattaaacactggaaaaatcatggtaaattaattttatgtagaagaaggtatatcaaaaaaacaatggatcagtccatttcattcataaggcagatttaactcattctctgtttttaagataaattcatttttataattcatcctttaaaaaataaccaaacaatatttaaaacacttaacctttgcagcttccaggaacacatggtcactaatatgccgggtgttacagagaataacagctaaagccacacctggaatacatttaaaatagtttttttagtaaggtcacttcaaattatgaaaggagtgaaataaaattcctagatttaaaccaaattaatggtaaggcatccctcccccaaacaacctatctgaaaaaacaaagcagccaagagaaaacagaaatctgagtactaaaatcaaatgatctttaactattacaattctcatttactagaaaaaataattttagaaatatcaaatggcttttcgcaatttagttttcacatttatcaaatttacaaatgtatataattcatcaacagttgttacaaaaacattaattcccagtccatctctaatcctctatttcttgctctacagaggtgactgtttttaattctcttagccgattattttattagtttggtgcaaaaataactgcagttttgcattgttgaattttgccatttgatattggaatacattcttaagtaaatgtgatcatgttatatatagttttaatgtacattttttgctttttttttgctaatgacttattacttgctgtttattttatatttatttcaaactacagaaatgatattatacaaaaaacaaattcaagtgattttttattcgagttcaaaatggattgtaaagcagtagagacaactcacaacatcaacaatacatttggcccaggaactgctaacgaatgtacagtgtagtggcagttcaagaaattttgcaaaggagacaagagccttgaagatgagaagcatagtggccagccaccagaagtcgacaacaaccaactgagagcaatcatcgaaggtgatcctctcacagctacacaagaagttgccgaagaacatcgaccattctacggtcatttagcatttgaagcaaattggacaggtgaacacagctcagtaagtgggttcctcctgagctaactaaaaatgaaaaaacatagtcatttggaagtgtcactttctcttactctacgcaacaacaacaaaccatttctcgattggattggacatgtcacaaaaagtagattttaggcagaaaggaagaagaa

SEQ ID NO: 43723 - DNA, 1735 bp, Bovine  19866880652944
cttcttgccggaacgagggacaagatcacctttcttattaccccacagtaaatgagtcatatctttagtttacagagaaagatggtcatttactacctcttttgaaaccctgggccttcctgagagctgttactctgttgtccaagtcttttcaggctgctgtaacaatcccagagactgggtggcttacggacagcaaaaatgtttacctcacatcctgaaggttggggagtccaagatcgaggcgctggcagagtaagtgtctggtgggagatgcttcctgatttatagatgctgtcttctcagtggggctctctggggattcttttataagcgcgtgaatcccactcctgagagcaccaccctcatgacctaatcacctcccaaagcctcccacctcccaataccatcactttgggagattaggcttcagtttacgaatttggggtggaggggtacacaaacattcagtctatagcaactgtgaaatgatttcttggggttgaatgcctcctaggaaatgatgcttaaggaattcactcactcttcaagaattcaagcacaatcccaataactgacaggcaacaagtaactgacacatcagaacttctgtgaaaacaaatgcactagtttacaatgcgcaagcccacattcctaatacattcactaatctttgctttccctcctggtgagcgcatgtcctggccatgagataccctttatgtggactcagtttgggctgcaaattctattcacaaaataatggtacttccttagagatttaggttgttatattcttgacttagttgaatagaatgtatattctgctctttgatagttgactgattgccctggagaaataactggaactcattatgctttcactgcagatttgtgtgtctgtgtgtgttatttataataaaaatattaaaaacacatttgtgtgtaatctactcaactgcaattttctttctccatgaaaattattcacataagctgggctgctcattgtatctgtcattattagcaaaattcctgatgcctaggacagaggctggcttagacgagtgctggtatcatagaaactacagtctcttcttgcctatatattttataatggtctcatataatggtcttcacaatttctggtgaagcaaaaatgatttcagcaattaagaaaaaacttcctaaatgtcccttgagattttttcattcaactacaaaacctctcgggtgcatttgcaattgtagtcgtgtgtatctccttctgacattgggagattgggattcatgggctagagatccaattccacatttactgagtgcttacagaggtggtgtgtggcttcccccaaaccccatatttgtcaagtccacattcaggttcagaaaaactgggggtgatgataacaccaatctggaggtggggagaggaggaagggcaggaagagaacaaagggaccaagctttaaaagttagacaactcagagcctttgtcctgtgggctgtaactatcagagtttaaatacagaacactagtctaagcatgtagtaagcactcaataattgattgaggcaaaagtcagatcagttgttttgtagattcctgggggctaggaccttattagcttggcataatatctgttactgatctagcacaatagagtattcctaatgaagatttcagggatcaaaggttgaagttcatggaccattctagggcggcaagctcaat

SEQ ID NO: 43724 - DNA, 1170 bp, Bovine  19866880702267
cgtggacattccttcctacagactcggctgtcaggtttgacagatggcctggctgcaggagtggggacagagggcaagctcgtggttcaggcggcaccaggcaacgagagccagctgggctgatgcaaggtctgaaatctgagctggatcccaggatccagccagggcgggtgggacagggagccctgccccccagccccctccccccgccaccccactgccgctgcgccaggcaggtcagcaccttttctcagtgtctgtgacctggctggaggcagatagggtggcaagggagagcagaggaatggggcctcagagagaaggccggaacacgttcaaggtcagagatgccctccccactcattgcccaccccagccctgtggctggtaacaggttatgatgcacccatctcctgaggaatgcacttattctcttgggttggccagaaacttcattcgggtgtttctgcaaattgggacgaactttttggctaatccagtagtaaaaattcatgatccacaagttttggcagaaggccggaagtcacagccaccccacagctctgttgaggggtgcctgcctgagatgctcagaggctcccctaaagtcagaggaactggggtaaggagaacagaacttcagagaactcctagcttctgaagggcccagtggattaggtaagaagaagtcaggggccttgagaacgagtgtcagtgtggccggggcagctctgatctctgcagctgctggtgtgtttagctgaccaccatgtggggtctcagcaccaaccggaccctgtggcttcaacatcacactgcgggcccagggcatcacgggacctgggagagctgagcccctagctggataaggtatgccgagaatgagtttatcagattcaccgtttgtgccactgtccacagagagaatggaacacagagtggggcaactttgatggaaggaggaggcaagatgagccagagagtaagactcaaatcctgggaggcctcccgggagtcctgagtagagggtagggaggggaggaggttaggcggatggcagggataaaacggtgccagaggcaaattcaccagcagcacatttttttttttggctgtgctacaggcttacaggatcctagttcagccagggattaacccaggctgcggcag

SEQ ID NO: 43725 - DNA, 1245 bp, Bovine  19866880857682
ctttgtgatttttttttaatttcaaggataaggaaaaaatttttataaatatccaaacagaaaaaatgaaaaaggatatctataagctggtaaatggagttgtatgcctcaaatctctcctctgaaacactaaatgccactagacaatcgtgcagggagccccctcactccgccagcttgaggcactgggaggaccacagtataactctacgtagagagagttacattcatgactgtgattcattacagagaggagacaaagcaagtcaacaggggggcagggggagatgcatggaacgaacaccagggaaaccgggcacacactttcaagagcctctccccggggggtcacacaggacacgcttcttcccaggcaatgaattgtgacaacacagtgacatgccctgactagacactcagggcctgatagtcttaccgggtgctgatcctctaggcaccctctgcctactgtgtaccaggattccagacaaccagaaggaaagtagacgtgaggcatcaaccacgtgctttgtacagtttggacacaatgattcacccttataagttccggaagctatgggaacccttcccaaattcaagttcccagataccagccaagggtcaacctagccagcaggcctttctaagagtaacagtctcaggtctgctccattaactcttttctgcacgacaatgagacaatatctgcagatttttaatttaaaacacggcccaatatttttttaaatttaagtatagttgattttagatattatgttagttttaagtgtatacaagcttccctatggctcagtgggtaaagtgtctgcctgcatcgcaggagacccaggtttggtctctgggatggaaagatccctgagaaggaaatggcaacccacaccagtactcttgcctgggaaatcccatggacagaggagcctggtgagctacagtccatggggtcacgagttggacaggacttaatgactaaactaccaccaccacatagtgatttaatatttttgcaaattatactccattttaagttattgcaagataatggctataattccctctactatagagtatgtgtattcttgttgcttatctattttatacacagtattttgtatgtgttaatcccatgcccctaatttgtcccccaccttccatctcccctttggaaaccacaagtttgttttctatatctgtgagcctgtttctatttttcatatacattcattt

SEQ ID NO: 43726 - DNA, 1042 bp, Bovine  19866880928606
tacatttaatgcccctaacttactgaacatcatagtcttacctagtttaccttaaacatgctcctaactcttagcctacagctgggcaaacacaaacctattgtataataaagtgttgactatcccatgtaatgtttttgaactatggtgttggagaagactcttgagagtcccttggactgcaaggagatccgaccagtccatcctaaaggagatcagtcctgaatattcattggaaggactgatgctgaagctgaaactccaatactttggccacctgatgcaaagaactgactcattggaaaagaccctgatgctgggaaatattgaaggtgggaggagaagggaacgacagaggatgtgatggttggatggcatgagtttgagtaaactctgggagttggtgatggacagggaggcctggcgtgctgcagtccctggggttgcagagtcagacatgactgagcaactgaattgaactgaactaatcccatgtagttgattgactactgtactgaacatggaaaaacagaatggttgtgtgtatggctgactgggagctagggctggatatcacacaagtgcattgaaggaaaagagcatagtccaaaattaaaatacaatttctactgtatgcatattgctttcacaccatcctaaagtcagaaaattataaatcaaaccatcataagttgggcaccacctgtggtcaactgagtcaacaaggatattgatctcagaaacaatgagtaaatgaaacaagatgtagcattatacaatttacataaatttaaatagcatcaagaccttcctcaatattactatacattgatatggatacatatacacactataacattatttcaaaaaagatctttaaaaatgagaaagagagcacctttatgattgtccctggggaccatgatggaatcagttagtctggtttattgagacagggctacagtctagtgcccctgcgtgcaaaagtcatcttctgaataaacttctaaaaactttgcaaaagtacatactttaaacatta

SEQ ID NO: 43727 - DNA, 1704 bp, Bovine  19866880945328
ggacacaacatgtgatccccctgttctgcgaggtcggcgaggcccctgagtggcaggacttgaaccagatcctgagcccagtatggcctgcccaggaatggcgcagagggcagggtctcccgtggccatgcatttggagggtgtttacaggccaccccagagacctggctgcacggggtgctctctcgtggtttcctgggccctggaggaagcatcttcgtgaggtcagtgagacaagtctggtgacggccgcgtcccgctgcggtgttaggttctgagtggagccacggggctggggagtgggcgagctgacacaggttcttctctccaaagcagaggtttagtcaccagggaattagctcccccaggccgcccccacccatctgggccccgtggtgacttgtgactctcacgctgagctgcagttcccagggggtggggtccagggtgctggggggaggctggttcccattgaagcgctccccagatgccaagttgcagccagctcagctaattggcaagagaaggagaagcaaaaatagtgaaaatctgtgaattaataaaacagccttgaagcaaccgccaaaatgtgtacaaatcatgaagtaattagaagtgtgaagaattctatcgggttgactgtttccaaatccagcatctgatcgctttaggaggccaagggctggcaggccaggggagtaaaattctttccattgcattctcatctggccttcttggagcctgggtttcttgaaaccctttcggggtccaggcagtggctctgggacctgcttgagtcaaatgtgcaccttgtgaaggccctttaggacatgcaagatcttgtcccaatagcatctcatattttagaataaaactttaaggtttcacaagcgttttttggattgatggtcgtatttaatctcactatcaccaaatatttttatgtcagtaaaatactaacaattactctaaaaaatttagagtaggaaatcaaagtccagagagtgaaatgctatcaacccaactcccaagagctaaccagtagcagaacctggggccagatccagggtctcctggtaaccccgccactcttcccctctcctgtgcacttctttcctttggaacctcctgtgtctctcagcccatctgagccaccagggaagctggctcagacgagctgctcagcagtgctggatatgtctatctcatgattctcatggctgagagctgaatgcagttttgtttggccaaggtattaaatttagataagttgctcgacccacttgtttgattaataaactaaggctcaggcacagtcacctatttgttgatttaaatttcattttatatccagattagagcagggaggagaaaaggatccatttttcttatctttttggaaacactttacggagacagatttcaggtattatgtcttgtcatttacccgtgagcagagatagaaacagtacgtggttagagtttctttgtttggatttgttctttctgatctgaggggactttaagggtaggagctcacattcagtaattgaagggcaggcatctctcagggctgaaatgcagcctgctcagggttagaaattctgagagcagacattggagcagaaccctgggagagtcatgtaacgagcttgacgtgtgttgttaattccccaagcggcagcgaaagctcccgggaggatg

SEQ ID NO: 43728 - DNA, 1828 bp, Bovine  19866881012975
acttgcccccagaggaggaggcaggaggggctggcacgcccgtgtcagtgctgggggacgcccccactctgtcctgaccctgctctaggcccaccagtcatattgaccctgatgttaattcttccccagatcacggagattttcagcctgggtggaacccgcctccgggacacagcagtctggttgccaaggtgtgccccgcactgtgaggggtcgggatggcggagggaggggttctggccagatgtgggccctgagtcgtgagagcagccagcgttttggcatggtgtagtgggaggtaaaggcccagtacgactgctctggtcaccatcagtgatggagtgtgtgcaggaccttagaaatttctcctgaggtctgggccagggccctccttgaggagggttacaggaggtgatggtgggagaggtgatggtgccctgtgataagattggaaagaaaagggaagataaggaaagcttttcccccgtattcttaagaaaatccacaggggtcagacttagaagtttttattcagagaatcatcatttggggtcttgaaggcctgtggagtttccaagagatgaatggatgggctggtcagtggggggtagtcaggagatctggtcctgagatggctttgtgattggggcccacacacaactgaagtatcctcagtggaaggaatcaggctgtgtttcttgagattttctggagcctgttgaggtcattaactgtttcagctgctgcacagaactgtcctacaggtgtggcagtggaaggaaggatagggaggtgggaggactgtaggactgggctggtgggaggaggtcaggggaatgctgcctcctgcaggactgctgagagccctgaccagagccagacaggcaggcgtaaactgttgacctgaacccctggattccctttgtcctgcagactagtgtctgcaggccagaaactgctccacctgtacttgggcgagtactgaggtactgattgagggcctgctgggcacactggtgaatcagtgaccttgggaggcttatctttcgggagacataggattcctgccttcagggagcttataatccaagtggtgaagctgtttcccctatgcatgaaatcattacatattaacagaaaagtaatgatgtgctatgttgtctgcaatggaagattgtagaagagagggaagggataattaaggggaaatggaagagtaggaaatggttttgtgatgcttcattttgcacatagggaacctgattcaacatacagacctgctccctcttctctaggtccaaggaccttaaaaaacctggaggtagaaagcagtagactggaggcttctacagactgtaggactcaaggtgatatttacagaccgactttatcagagacaacactgatctgctcagaggctggaccatagatggattgccagggcttgtgtgggagtcaggaactgggaaaacctaccaccaaaccagaggagcaggcctgttcagtactctgagcttatagaggaaataagcagaaaaggaagacaaagagtagaaagtttgtgcatctcctccaaccagtgcaaaccccaggagcctgagtgtcataagaagtgtggatattaaagatgggggagctgggatgggagagccgacgtgattaaagccaccttcggcctaaacaagccatcatcataaataattctaaatggatttggatgagacctggtagtgtctctaaacatttcctcagggagacagcagttcggaatgtattgggaatggaatgtgaataaatgaggaaaggaactgctattcgttgagttcct

SEQ ID NO: 43729 - DNA, 899 bp, Bovine  19866881032527
gagacaggaaaggctacgcactcccagtattctggcctggagaattccgtggactgtatagtctatggggtagcaaagagtcggacgtgactgaacgactttcacttcacttcacttaaaactccccactgacagtaattctagaatagcatttatttttcttactctgaagaaatgagatactttaatcataagtacttgaactccctctttgaataaagacagattttgaactttggtgaagcttattcagtgtttatggctgggaccgaattcagtttaaacactcatgagctgtgtgacttcattttttaaaaaaggccctttctaaacaagagatgcaatctgctggatgacaaaggaggttgtggaggtggatctggcaactttatgggtcatggaggaaactttggaggtggtggaaactttggtggaagaggaggctatggtgatggaggtggtggcagcagagggagttatggagggggtgatggtggatatagtgggtttggaggtgatggtggcagctatggcgctgatcctggttatagtagtagaggaggctatggtggtggtagatcaggatatggaaaccaaggtggtggatatggtgatcgtggtggaggatatgatggtatcgatgaaggaggacattttggaggcaactatggtggtggtggagactcgaatgattttggaaattataattgacaacagcaatcaaattatggacccatgaaagggggcagttttggtagaaggagctcgggcagtccccatggtggcagttatggatctggtgggtggaagtggtggctatggtagcagaaaattccaaacactcagaagaaaaggactacagttcttagcaggagagagagcgaggagtgtcagaaaag

SEQ ID NO: 43730 - DNA, 1662 bp, Bovine  19866881041688
acttgggtttaggttatctgggaagtgaagtcaggaggctccagggaggaaacagggaaagtgagatggagaaagccaaatgcccgtgcaaggaagcgccaaggagcagcctccatctgttggcaaactgttgccttaccctgagtaccaggtggaccatgacttacgagcatctctctggagaatggggggaggttgaggcatctatcactggctcctatttcccatttacttcccagagacttgcctctgtgagcattaaccccactttgactttctgggttgtgcctgggaacagtccagtgatgcctggtgaggacggaaaaaggcatcacacagagaagaagagagggtcaggtgcttgagctgggaagccgacagcatgcagaaactgctcaccgtagctgcaaactcgggtggtttccagggatatgggacaaggcatcaaaatgtctgctaagacgctatgcccatcttaactgcctggagggtacttcatctgggcagctaggagctctcttaatttcttctcacctatcttggactttgggcacaaaggtattgtttattccacttgattcaatgtgatttttccatctccttgataaaaaatggtggaaagagtagaattatgtcctgttcccatgatttattcatattatgtcacccacctcaggcaattgaattctatcctctccctaactcataactaggaagttcaagatgcttcatctttttgtggtttttcttattcctcccaaatgtactaccccaccatggccacttgtttctataagcaagagagaccatttagaaagttggagttgctgattccagtctgctttgacagcgatggtccggtgtagggtgtgtgtgtgccagaaaatgctgaatgttcctgagactcctcaactcactatcattagacagacttggcttcatagaattttgaaattttgaacttggattcactgacctggtaggtgaggggaaagtcctcactttggaagactgttccgagcttgcacacccttctggggactcgttttgtgtgttggtcactcctggggcagggggtggaccgaacattttataattaacctcccacgagaacaacttgttccttaaattcagaggccaagaaactttgaatagaatcagttgagagggactgggttgtttttttaaaaaattcaagtggagcaattcttattcagtcagaaccaaaatcccgtctaactttatttgcatcacacttgttggcacagatcgcctggtgatgaaaataaaagagcctgtgtaaagatctgggaataaaaacagcagacacgagagaaaaggaaaaggaacagtgaaaggagacagtgccgaagaaatagagcaagaagggagaaatgggggcgaacaggcacagggggagggaaagggtgtccgcagagaacgcttgcgttgcaggttccttcaagaacggtactgccttaaccacttatcttaacggtgagaccatcaagacacagtgtcacccaaatagttaatgacaaagcctgaaccacggtctcccagcgcttgttcagttttcttttcttctttctctccccccatgtgggttcattcattaattttttaattgagttgactcagtgtgagaatacaaacaatcac

SEQ ID NO: 43731 - DNA, 1220 bp, Bovine  19866881209355
tgacattgggggtgggggagggcgctcctggtgtatgtgcaccgcaagcagaggggtttgcagggaagaggaaggccttgtgtccatcatttaatacaagtttggtctggagaatatgcctaagagtaagaagattcctgttcacataggaatgataaatcagccattcatggaacgagtactgatcaaacacctagtgtcacaataacaggatggcagtggaggtcactggactctcatcagcaagccagatccccacgcccaagatggggcctgcagagcaccgaatgggcgccagctgaatacgtgcagccacgtgcagtctacacctgtactgcagccgctctggaacacaggtgcgcccctctactctaggaccgtgggaacgtatctgcgactgaaaagttcagagaccaccaacagttatcttttttgtttcatcaaaattttattaagaaaaccagagttcggggaggcacgggagagcagactccacagtcccacccaggcacagagaacggagagacgtgaaattccgaggccctctggtaagggcagacaggcagtcagacggtggacggatgggcacagggactcggggaccgtcggagaaacatgaatggcagaccagacaaacaggggtccagggccaggcccgcccgcagcgcagggagatagacgtgtgggccaccagggctcagcgctcggcgtttgaccgcaggtcggtggtgagcgggtcatgctggatggtttggtgcagcatcagggccagtaagcccgcccggttggtcatggctgtgcgaacgttgcgctcctgctcaaacagctcgtccagcttgtaccactgcgtgggcagcagaagccttaagaagcggctctggagccccgctccaccctaccccggctgcatccacattggcatccgcacatccgcggtcagggcctagcacgtggtcagggcctagcgcgcagtcaggacctaccacgcgcacgcgctccaggtccacctcggcgcgccgcagcttctcccagcagtagtgccggttgcactggcgcttgggcaggcggcagaagtcaccggtgagctcaaaaacatcccttacaagggggcacccgcatacctcgtcagctggcacctgcagggaggccggggtgggtgggggaagttgcaagttcggaggagagtggaaggaaccgagaggggaggcgggggcagagag

SEQ ID NO: 43732 - DNA, 778 bp, Bovine  19866881298150
gcaggcagattctttaccgtccgagcctcattaacctctaaagtggatgccccttaagtgctgatctgatgccctcctttctcagggctgccccctccccactccctgctctggatcctctccagtgaaattcatctctcccccggtttccatggaaataaccaaaagcccagttaagttcctataggcctgcagcccccatgtggtcccttccttttacactaaaaaaaaatcagaattgctttaaaaaatgacttatttttatttgtgataaaatacacataaaattcaccgttttaactgtttttaagcacaaaattcagtagtattatgtacattcacattgttgtcccagcatcacgaccatgtgcaaaactgagtcaatgcctattaaacaacagctgtccatactccagcccccaaagcccccgtcgaccagcactctttctggcactactgaatgtgactattcatataagtgggatcatacagtatttgtctgtctgtgactggcttctttcactcagcataatgtacttctccctgctttaaacagcaggaaggtgggagcaatggagctgagcttctttttaaaaagtactttctcaaaatgtggttgtcttctcactcaactagagctcacatcacagataaaagctttgcatgttatccctctgggatcctaatcatcagctctgagtcctgttacagtgcaagacatgacaaaatgtttcatttgtttgggatcgccagttctataaccgccgtccttgccagg

SEQ ID NO: 43733 - DNA, 831 bp, Bovine  19866881322155
gaggaaagaaaaggtaaataagacagtggcagttccatcagacatggctgtgccctgcttgctagtggtgttaaagagcagaggcctaggatgagctcagtgtcttcagctcttctgtccgctgtgagttctttactcctcacagagcattttacaatctatatacgtgtatgactgctctaaaaatacggttaaatcataatagctaacgcttgctaggtacttattctgtgtcaaaatgatctacagatattgtgtcatcattgtcataatactcctacatggtaggtggcattatccacatttatcagatacgaagaaattggttcctggagaggtcagggaacttgcccaagattaaggcagctgggaggggctcactattgtttaaatacctaagtgtcataaaagactgtaagccctgctaaggcagtgagctttttttgtttattaatgtatcccaagtattagaacagtacctggaacataggtgctcagtagatatttttttcaatgaattaatttgttgactgctagtccataaagagaaatacttaatagtttgatatctgtttcctggactttaaaaatatatactatatgtttttttaatttttttttgaataggcaatacatggtccataaaatcaaaatactataaaaaggtatacagtgaaaagaagtgctcccacccctgtccccattcccccctacctcaggtaatcacttttattagtttctggtgtttccttccagggtttctttgcgcaaaaatacatgttttatttccctcttttcttacacaaaaacatattgtgcacttttctggac

SEQ ID NO: 43734 - DNA, 977 bp, Bovine  19866881393647
ctggaagcagtgctctttgtacatgtttggatttcctttatttttgtaccctacaagattgtgtagttaggcagaaatttttgttttgctttagtgatgattaaaagtgactattatgtgtaaaactaatctgatggaaatggtttcaattgatttcattgttttctacaccaaagttaaaggagttagataaacctaaaccagaatttaataccattttgttaaattattaaattttggattttttgctccacagttgatgaagatttaattgttttaaaaagagaaattaaaaaaacatcaaaaaagaaaagagaaattcaagcagttgacaaatatgtctagatactattcatttgagcaactttcagtactgttagcacagataatatgccaaaacatatgcttagtaatgagtcatatttagagtttttggatttttttccccctcatcctaaaatgtgtaattttggtgataggaaatgtggctaaattccagcttctcaggaacaaagtattttaggttgtgtcaccttgacactattacatggtgtacttggcatccaggaaaatttgttttaaccgtgagagtggataaaaactagggtagcacttacctatgtagaactgagatggtagctcattagaatcttaaaacttaagttttgattatttactattgtgaattatatcataggtcagatggctactacatactgtaaagagtctgtttttacatcttaatttaaagttggtgataattctaaatacctttaaatttaaagtctatacttcattgtttacattttaaatgagaattgtttgcattttggaaaacttgttactgtgtggcgttcatctttttgttgttgttgttgttttttactcttaaggtttaaggcagtgattctcaaccttggttgtgctttgatgtctcttggggagttttgcaaaatactgatggctggatcgcactt

SEQ ID NO: 43735 - DNA, 811 bp, Bovine  19866881429045
gctttctcttttaatacaaaacatactttgttacagagttctcaggaaaggttcaactgttttttagccacagacttcaaccaggcaaaagcatacagaaagccacaaaggacctaccagagcccttagctgatcagttttccccaaagcagaagctaagtgtggctcgtctcttgagttacggcatggctcctctgacttcaggagaggagacagaattggcagatactaccgccaaatctgtccccaacccctagtcgcctcttccaaatggttctgcagcccaccaggttttcatcatctacaagctttcacacttttcccttaaatcacacgtccaaggcagtggccagaacccaatacttggaagaagtttgttgaatccgtgtttagccttttaaccgatccaagccctgagtccttctatcaatgacaagcagccatagcaacagcagctggtttcatcccttcctttccagctaccactgagctggcctctaccaggactccccaacccccctacccttgacccacccccaaagaaggcttgatccttgaaaaagccaagtccattaattatactaatccaaggatgggctggaagagaactctgaaaggaatgctccagccaagttttctgatcaaaatggacctaacaagagccaaaaataaagtgaataatcatccactggtattgttttcttgagtcatataaaccattttaattgatacagtttaagggaatttccctattttgagaggagttaagaaaccaaagacccaaagcaacgacctctaatatcactaggca

SEQ ID NO: 43736 - DNA, 718 bp, Bovine  19866881469201
tttgcattgaacttcttttatcttcttttaagaattataacccccagtcacattcaaatgtgttgtgtactagcacactcaatctgttaatttgattttagctcacctgaaagtttattctgccatctctttttaacttaaatataatttgagattgacagagtgaactatatttttttttcaaaaagctattaacacaattattataacttatctctgtgaatcaggacttttttcaataatataaatttaataaaatttagacataaactggacaagtattacataagaatcaggttcaatgttctcattgtctttataatgattagaatttatactgaaaatgtaataaattaaatagcatagttcagagtctgtctgatagatattgttagaagttatttagaatgttagtgtttttccatcatttgtatttggttttctgtgagatcttttttttaaaaaatgttctgcaacattacctctgggaacccctcagacttgacattctatgtaaattacatttttatatgtaaaacaaaatgtatttgtggccttccaaacattatagtatacactaatggccttaaacggttttagtgaaagacaggggattaaaataactaattaaattaagtaaatgataaccgttataaaggaactgtaagcagaatcataattagtgaatttgctaattattttccccactgcttggctg

SEQ ID NO: 43737 - DNA, 1634 bp, Bovine  19866881753926
tgtattctattttaaaatccacagcaacaccggagtgcctttcttgatcttgttgtctcctctagtctctttattgccttccttttgcagtaagatgccttcattctctctctccacatagttccccagctctgtagtctagcttcttttccccattgaaactgcattttcagaggtcacctgggtgcccgtgtatgcccagagagggttttgttttagcctcattcttattttttcaaggcatctgttttctctccctctgctttgtcttccaaacttccactctgatttacttcagtttatatttgtccacttgtctcccagttagatctcccaagcttttccactgcccagttatcgtggctaacgggctaagctctgacatgagcccacctgtggttgaattataactctgccactaattaaccatgtgaccttgagcaaggtcatctctgtgcctcaatttccccatgaaaatgaggatcataattaagagtactaacctaagaatcaaacaagatagtctacacactatctaccccaatgtttggcactcagaaatattcaataaacattacctgttagcataaccataagctcctagaacttaaaaaaaaaaatagaactttttcctttttctcacacattgcccaagttacccaacacacacccagacagtaaataattatcaacaaatagatttatgcacttgggtggagaatccagggaagaaagaatgatggaagggaggctctttaattgcgcgagtattttttatacacaggcttttttgtttggcttggttttcccaataaatcatttacattattgaaaattcaaatcagtcctttcaggacctgtttgctgggcaggaaagggcatcaacggtcaaccctctggctggtggtgcagcagtcagtcacaatgaagccgcttggccgggaacacagtgtcccgtcctgagattcaaaagtgctccaactggattagggagggaagcgccgcagcggcggccgtgagcgggggctccctggaaccggtccactgagtgatgccgccatctagtgaccgccctcgggatcgcggctgggcagggccctgtccgcgcaggcgaaggagcctcagaattgcagtcctgtctttagaaactgtgggtgggactcggagtgaggggcgaataaggggcgaacacagcacagagaggtgggaaaacacctcatcccggtctggggaaggaaagggtacaagggggcttgtgtccacctaagacaacgttgtggttatcagaggtcggtcccctcccccacttcaatccatctaaactttgatttgttttgtttttcctcatatgagtctcactttccagcactctgcgctgacccgttatcctgaacagactctgcttctcgtttcctttctcctatgttaggaattcagggctgggaaaattgagccgagtcatcccatctggcggctaccccgggaacagcagctctgcgcggtgacccggctccggccgcacctgccgcatcgccacgtgaccgcaggtaagggccggctgcgggctgggaccacctgggctgcggctggaagaggccacggactgcttgcgtccccagacctttctggaatgt

SEQ ID NO: 43738 - DNA, 730 bp, Bovine  19866881816512
ctccttaagggtgaggtggtggttagttgctcgtcgtggccgactctgcgatcccttagactgtagcccaccaggctcctctgtccctgggattctccaggcaggaatactggagtgggttgccatatccttctcaaggggaatcttcccaacccagggattgaacccaggtctcctgcattgcagtcagattctttaccggctaaattactagggaagcccctaagggtgggggcctcatggtaatttttgcatttccagtgcctggttcagagcctgactcacagggctcagtaaaggttagctgttgcttctgattcttttcatcatcatcatctaccatttaagtgcatttttattttttaatcctgggtattacataaggatatatagggttttgttttccagggggaggggatcctcaattgtacatgtttaaatttcatttcaaaggctaaaatctttaatgctgtctgatgtagacattatttactgtgctcaatttcagatacatctatataatgggaatacaagaaagaaatgagaaattgttttacagaatactgcaagatgatattgaaactctaatgccaattgtgtatacaccaacagttggccttgcctgctcccagtatggacacatctttagaagacctaagtaaggcttatttttaaaatatttttgcaaattaactattatataggaaaaaaaccagcaccgattacattt

SEQ ID NO: 43739 - DNA, 1490 bp, Bovine  19866881994012
cccttggcatggttggtaagagcattgaaatacttataagctccttaactctcttgcaaggttggtggctacctgggagaccaaaacaaaataaaaaagaataaatgacgtttattgagagcttcctatatactatgccaagtttacaacaatatgaaaaagcattgcatacttagcattcccgttttatagatacgaaagttgaggcttcagaaaggttaagaaatttaacccatgtaagtagcagatatcaatgataggattcaaagctaagcaattttttaaaaatcatgaacatttcttaaattgatgagaaactagttaatggaatcccatgtatccatcactgagattcagtagttaagattttacatttacgtgatcagttctttttcctttgtttctatttaaacaagacctaaatatcctgttagatgcttctgtgcagctctgagatatgcccttgtttcgtcacatagtgacaatgccttttattcattcctccaagtagttagaatgataaagaaaagaagctgaccgtatgacctaggccgtcaattcaacctacagaaaactcttcatttagttatgaaagggtgggatgatttcttaacttcgtttcacacagtggtgtggtttttcacaaaggcactaatggctgacccacactgaactcagatgaaggatacagaggccagtggcaaccaaaactgtcctaatagtgagctgtgcctctttggtgagcttcattcaagccagctttcctaagaacttaccatctacataaaaaaattaaacaattgaattaattctttaatcctgagagctaagtcaggctgtgagttttaagtagattgtgcattggtttttgacatacggaatatttctgctggactcacggcatgaaacttacacttaattttttctttaaggtctttgatttgcgtcagtgtcaccgtcagatgcagcagcaggcagccacggcacaagctgcagcagctgcccaggcagcggccgtggcaggaaacatccccggcccagggtcagtaggtggaatagccccagccatcagtaagtatgcttttgattttttttgttttttcaagtgtagtagttggtgctttatcttgattgactcagttaattagttactttaaccagtaatagaaagtgaagttctttttactgggataataacatttttgaatttgtacaaaaaaaaataaaaaagcctgttcatctataatagttgccctttgtttatggccctgtgttcattctttttgtatcaaaaaagggactgtgggataaagaagaaagggggttgttattattatattgatcagtcttccctatttttgttgatgcttttaattcttgcttcaccagctagggtgggttgtaatcaccagtgtgctttgcttcattctacaaggaaagcatatttcaatttcagaattacacgtctctccaacttttttttaagtgta

SEQ ID NO: 43740 - DNA, 1175 bp, Bovine  19866880410152
gagcgacttcctttccttttactttccacattggagaaggaaatggcaacccattccagtgttcttgcctggagagtcccagggacgggggagcctggtgggctgccgtctatggggtcgcacagagtcggacacgactgaagcgacttagcagcagcagcagcacgtactgtgctctaggtccttgttgttcaggatcgtattgttttttaaagactatggctcggttggccgtgggaggtctgaaaggttattccacttcagggacttccctgttggtaggagtggagaggtaagtgaaaagaggaatatgaaagacggtgtcatgtctcctatctgggaaatcttgagcaagaggtaaaatcccgactaggcttgttagactggctgtgacgatagagggacagggggatggctgaaatgacctagaaactttctggccttttaaactttcttgatagacaggtgagaggagggccaaagagagaggtgtgtctccttttattcccctcccagtcaaccaacttccgcccaagccagggatctgtcacaactcgagaggtggaaattctggtttcccttgcccagagctcccagtgcgggctttgccactatgggtacctggagggccgcactcctggcccaaccgggctgagcctcccgtcccccacctctggggcctgggagccctcccttctttctcttggatggcaccccccgcccaagagtctggatacctgggttctatgctgtgactggctcaacggtatgtgagatgtgatggctgactggaggggtggcagaccaaggggaggattatgcagagaccagggggacagatagcagcagcactaagaccagagagagagggggcagctgcagaggctgggagacgaccagcctctccctgccctgggccgctttccgtgtgatgctactagtcagcctggagggctggtctcccatctcctctctgcaagaagaggcctgtaggcctcagagtcagagaacagagcaggccggttcagacctggtcttcttgtttgggtcatcagagggtagggctgagtacaaggccctgggtatcaagagatctgaaagagccaggagaatcaagtctgaagaatctatactgtgagtacaggaatctgctccccagaaagtcctggagccag

SEQ ID NO: 43741 - DNA, 2711 bp, Bovine  19866880445700
attcgctgtcttctgcaggcaaaggcctgggccggaaggagaatggtatcacccaggccctcagggtgacgctgaagcaggacacttatggggtaagactggacagactgcgggaggtcagtggggatggaagatgggggccttgaaaataggatgagggaggggaatgacaagccctgagttcacatttctctggcaggtgggacacgaccctgccaaggagttcacaaatcactggtggaatgatctgttcaacaagactgcagccaacttggtggtggaaactcggcaggtataagctctaatagtaggcatgtaaaacatgagggcctgggacacgtgggggtgagggtgacgtggcatccactcacacatacttcccccaggacggagtacagataagacgcctatctaaggagaccacccgccaggatcatgccaagcccaacttgctgtatcagaagtttgtgaaggtattagaggctgggggtgagagggctcacccttttcccttccctggtctcttggggtctgaacaattgccttgcatgccctacctgttctcaggactgtcctaagtggggtcctgtgactaacctcgctgttgctgacccagactgcccagatcctcagcaagaattgaaatcttcaggctgcctggatccctgccatctgctgagggggctgcaacagggagtgggaggtgggggacagtcaggagctgccagaggagagcagggcggggacatctatttcaaaggacttagaagccaggagacctgagagattattggacccattgtcttttattttgcagatgtggccagaagggggcaggtggctcactgaagagcccacaggtggctagtaacaataaaaacctgttctagccaaggactagaacccaggtgttcagacttcccttttctggcgtgccaatggaagggagctgacatttaaccatcttccattacctgcttaagggctctgcatgttatccagcagatctctcccattcatcctgtggccatcttcagccccagttcagaccatcatctcctgcatgatttctttcacagcctcataactagctaggctcctcactgtagtctcaatccccatgccaatcagttcatcctccacaaagcatccagagtgttctctgtaaaacacaagtttcactgtgtcactggctcctccttgacctaggatgacacagtctacaggtgtcagactgactcggatggcccttcaggccttgtcctcgccttcttccctagcctgtttcttgccacttctcaggacctctatctacgctttagccagattgattctgaatctttttcaggtatcgtgttttttcaccttcaaatttttgcatatgctccctctgtctgggacattctgcttcctttacctgctgaccttttccttgtctttcaaagccaagttagttgtaggaactattccccaaaccctgaagcctgagtcaggtacccctcctctggcagagataattgttgttcagtcactaagtcatgtctgactctttggggacactacggactgtagtccgccagtattttcttcatagttgcctacgttctgccacatctccttccctgttaaccacgtaggatctatgttggctgcacccatttcattcttattccactctgtatccctagccttttaatccatagtaggttcttaacctggttaaataaagaactgtgcataggtattggggcagggtcagggggcgcacaggttgtgaaaagaaccatctttattgtctgttgctagaaccataagatgaccgccagggggcacttgtcccactgtaaagacctgatgacccaagcacttgtccctcccttctccttgttttgcccactagctagcttggctgtgggccagggagccaggactgcgcctgccccacccattcccaactgcagcccacttcctgcccaagttgacatatgcaggttggcacacctctctggaggtctgtaaggaatgacgtcgggggctgacagatttgtgcctctggctacttgagatggtgtttgggagtggtttccagagggaagtgggatgacggtggtgttgagtgggccttgtccatccccacaattcctccttctagacggccacactgacttcaagtggggagaagccagacaaggactgggaaagctgcagtgatgacgacagccaggagcccaagcctccaaatgtgtgagacttctttctagtgctggggcatatgggaggagatgccttcaaatctcagaagaaaggaccagtataacgcttgactgtggtcttcttggtgggtggaactgttgtactaatctttggcacttccaggttctaaataggaactcactggtgaatgttttagagggaaggagaggtcaagcctttccaccacttgtaattcctgattcccacccctctccaacagtctgaccgatgagatgctgctccaggcctgcgagggacgaacagcacacaagtaagtagtggttggcttcttgggctcccttctgttctccccatcacaagcccaccattgaggtggcctgtgccactcttcaccccagaggaaatgattcctactctttgcccatttctgaagctgcctgaagataggtagctcctccttaccaacttgcctattagggaaagattaggcctctttt

SEQ ID NO: 43742 - DNA, 726 bp, Bovine  19866880468042
cacacacacacaactaccccaaggaccaggatacacggaatgttgtgggggatattggatggccagaattagggcctgcttctttggacttggaagatggtgagaggcaggctagatgcagtttctggctcacattaggctgtacattttgccaaactccctctcaatcagggtcggattcacagagggcagggcaggcagggaggctgggggaggtggagggagtcccctcctgtctcctcctgggtcttagccacactgtaacttccatgcccccgatctgctttctggatcttcacaaggatggttagagtcagactagactggatcccattcttcactcagtcactcatgccctacttcagtcacccttgggtcactagagtcacccttggccagcctgagagtttcctctagtttttcctcttctgtaaaatggggtaacactaattccaggggccgttgtgagcaacaagcaagatgtgcatgtccagtgaggagcaagggccctgccccttgtcagggctcgattccccgcgaagcatctgaaagagcacaggtccaggagctgtggttgggggagcgtgtgctgaataccaagaaggagccacacggcatccggtgcctggcacccagtccctctagcagctttccctttcctgtggtgaatcactcctcaccaaccctggggactcaagagtccccagcttaccacaaacactacca

SEQ ID NO: 43743 - DNA, 1471 bp, Bovine  19866880555241
ggtggagggtagaagtgcttcgaagaaacgacctagaccacgtgaggggtggtcggaacctctcaccagggggacgccatctgaccacaggaaatccccttcgatggtcctgtcattgagcccgatccactggtactcccggtatcgatctgggggacaaccgcagagacgaaagtgtgcagtgagctttgctgccagcagagggcggccattccccgtcactgagcggtctgtgggcgctagcgggccaagtccccgcagccccaaatccacccttcccggtatccttatttctccctccaacctctgcacacggcaggaaggaagacaggggcgtaggggtgaaggaagaggaaaaataccactagggctagaaaagggaaagtctggaaaaagtaaaaactttcaacagcgccagagtcggggagagtagatggaggcaggagagccagggaggtggggagcgattataaacgagcccccaaggaaccaccaggcttatgcaggtgtgttttctgcgtacttctcagccctcctctgccagaagccccactgcccacgtgtggagtgggaaggagggagacaggaaggaaaagtgaatgaatggatgaggtaaaccaagtagtgagtacctgaatgaacgtataagggagttaatagcacactctttaactgactgactgatgagtgagggaatgtgtggatgagagaacaggtggcgagggtcgcctccctccctgtccccagcccactgttgatgaagtcctgtggctgtggcgtgctgatgctggccaggtgcgcgccgtacatccggcacttgttctccgcctcctcccagctccttcgggcagaaaagtgcttgtaacaggcaccctggaaaggcgtcccaaccggggctgcagaagtggaggcctgggacacagaagggcaggcagcttatggggaggaccccagaactctgagaggctgggtccccagacagggagactgggctcctcccaccgccgcagaccgaggggcgggcctgagggcaggagggcgcgcccaagagcgagcgcccgcttaggagctggaggggcctcgtgcagggcggccctgatgccttccttctctgcagcgagagaccagggtgaaggctggagtcccgacctgggtctctgccatccgccatccgaaagaaaagccgaaccttcctctcctcccaggagaatggagaccgacaagtactgagtgtgcctgccaaattccaggctcacagactccccgagagagtcgtttttggttccacttaacagataaggaaattgagggtaggcctcggagaagttatgtgatttgtctaaaatggtaattcattatctgcgtttccactgcaggaggcctgagttcatccctggtagggaaccgagatcccgccaggcgcgcggtgtgtccaagagcaaggacaacaaatggaggttcactaatgaca

SEQ ID NO: 43744 - DNA, 1068 bp, Bovine  19866880599389
caacaggctcctctgtccatgggattctccaggcaagagtactggagtgggttgccattgccttctccgtctggtatgagcaggtgacaaaggcaggcaggacatgctgtcctgtcctgtctggctgagcaaggacaagcccccagggcttttcttagcccaattccaccttcccttcactggttttctgctcttggttcccttccccagagacaagtcaattcattctaaaaatctggttatttgaagagagcaggtcctgaaatgataggtctgctcatcctttgcccttttgccccaacactgagatcgtctggtggtgatggtggaatgtccttcctgttctctgtccttcagctctcctgtggtgatggcagcctgtccccatccatttctaaagtcttggaatgactgggatccctcacatcttgccccaaacccagggtcccacagtgctgaggccattctgttcatccttctgtctccaagggatggcttctctcctgagcctttctttaccagtctgtctaaagtagtacttcccatctccttactctgctgaattgttctttagatagtaaagttataatgtatgtttaattgcttatctgtatctagaatataataataggggcagaaatcatactatttggctctgcactccgtcctcagtgcccaggagattgcttggcatggtacatagtggacacttgattaatgcttgaggaatgagtgatgaagtcctggggtgctccctgggccccatgagtgcttcacagagaggatgagagagaattaagagaattccatgatctctcagtctaacccagagccctcacatgcaggcatgggctggggggagagccacctctctaacctcccactggcactttccttctgccacagactctgcccagccttctgccatccctgaggcagccaacccagcctctgacctggcctctgatgcactggaagccattgtcacagtgactgagaccctggaggaactgaagctgccccaggaagctgggaaagcgagtcccgaggagccatctactccatccc

SEQ ID NO: 43745 - DNA, 1678 bp, Bovine  19866880599390
gggcaagatgtgagggatcccagtcttccagactttagaaatggatggggacaggctgccatcaccacaggagagctgaaggacagagaacaggaaggacattccaccatcaccaccagacgatctcagtgttggggcaaaagggcaaaggatgagcagacctatcatttcaggacctgctctcttcaaataaccagatttttagaatgaattgacttgtctctggggaagggaaccaagagcagaaaaccagtgaagggaaggtggaattgggctaagaaaagccctgggggctgtccttgctcagccagacagcacaggacagcatgtcctgcctgcctttgtcacctgctcataccagacgggagaaggcaatggcaacccactccagtactcttgcctggagaatcccatggacagaggagcctgttgggctgccgtctgtggggtcgcacagagtcagacatgactgatgcgacttagcagcagcagcagcataccgacaagctaacctgtgccctaggctgcttctgtccccacctgctccccactctagtcatcctcctccctagttccatctcctgattcagttcctctttccatttcatcccagaatagtgcttggcatataattacaatcagtgttagaagtgttagctactgttattataattatcatcatcaccattatccatgttccagtaagcctattcagatggacctgtcttcctgtggacttgactttcctactccgcccagcctcaggccaaagctgtctggagatcagtcccagtggaagtaaagcttttctcctagtctttcctcatgctgggagtgagacatcttgtcttcagtcagactcggggctcccatggcagcagttgcatcttcctccttcagactaggggctccctgagggtaaagactgtttcttctaccaccatttctgcctccagcagaaataccagtattagtacaactaaagtaccagtactactgaaggctcccagctggggcaaggactcagatactctacggcaatgcctccctaactgtcagtcacccttggcctgggccctgtgcctctcctctagctctcaatataagacgtgggcaggaagctgtctctacacccaactgtccttaaggatctgctccctgtgaggggtaggggattacatctgtccatcagtatttggtgttaaagagttgataccttcaagcttaagctgaaggctctggaaaccctgctgagggctctggaggctatttggttaagtgaagtggatcattccttggattcagagaatgttggtcatctctgctctgttcatgagctgaccagagatggagacatgattggcagcccaataggggagaggggggcagtttaggcaatgcagagaggtgagccctccttgaggccacacagaccaagtcagagggcaccacccgcagcaccaggaggcaaatggcaaagacccaggagaaactggtcagggccagggtggaactggagggctcgactctgactgcctgaggttggtctcagcctctgcaagggagtgggctcacctcggaagcagtagacgttgaagcggctgtgcttgttggggaagccagtctggttggggaagaggaagagagtcttgacaccagggaggcccccaccacagcg

SEQ ID NO: 43746 - DNA, 1170 bp, Bovine  19866880677209
cccgggccagggggtgaaggtccagtggcctcattagatgtccccaccactgtgccccttctccagccctgcccactcctcaagtcgcccagatcgctcttccctttcagatcttaaaacccaacagaaaaggagaggtgttgtttagatctcagtatgcagccttagctctttcagcttccccatctgacttgctttctccttgtgcaaacagtaaaggggaagccatgtctgttcttttgcccaaggacagcaagacaacaaacggggctgggtcacagggctctgtgcccaaaccgctccagaacttgtcttaaatagcaataacatttacatctcccacctgggggttgtttggaatcaaaactcaatccagtggcttttcacctggaatctaaacaccaagaaatctcctttattcgttccattccgtggaatgttccacacagacattctctgtgggctgtggagggtaagggggtattccagctggaggcagggggatagatatgatgacccctcaacattcccttcaggggatccctgggtcaagcagcatggagcctgtttcccatcacatccccaacgcctccaaactcatgcacctttggctggagagaagataaaagccctccagggccaccctattaccctccctccttcccttactgcctctccccaaccccaccagatgattcctgaacaaggtcagactgtaggacaaggggaacagtgacagctggggctttagcatctcacagagctggctttaaattccaacacacgcatgcacacacacacacacacacacacacacatccctacacttctcactgtgtgaccttggacaagtcacttaacctctctaagcctcagtttccttgtctgtaaagaggggatataaaatatgagtagcaggaaaaagggagtggtgagctggggaggccatctctccccaccactctacctccacctgcctttaagagggcagatcaggctgtattctcctagaagagttacaaaccactctggtcccagtcacacacactgctacccccacctcaggaagatcctgtttccatctgtcctaaatccctcttcttgcaagtaaggtctcagagacagacaaaaaagaacctgtccatattttttcttagaaccctttctcat

SEQ ID NO: 43747 - DNA, 1527 bp, Bovine  19866880810298
ccctgaccttgcctctgtccccccactaaccccctacccaggtactatcgtggtgctgtgggggccctcctggtgtttgacctaactaagcaccagacttatgctgtggtggagcgctggctgaaggagctctacgaccacgccgaggccacaatcgtcgtcatgctcgtcggtaacaaaagtgacctcagccagtcccgggaggtgcccactgaggaagcccgcatgtttgctggtgagagcccaccacaacccagccggacccctccggctgctctgccaatgtaatcccagcccttggtccccctgtagggctctggcctggacttcctccccaggctccccacttccattctgcctgcctcagaatctcctagaccttcccctcagtgaccctgtgtccctcgttatgtcccacccatttgccctgtctttatgggcaattattcatagctggttttaaggcagcccacattgccgtgctcagagatcctaagtgtggcagatgggcttcccttgactgtctcctgtcacactttccccaggagctttctggggtttagaggcagcaggatacagggattaagggtgtaggctgtggggtcccgtggcctagcccgtgtctcttggtgatcgtgactagatgtgggacacaaagcaagttcttttttcattctctctgtttctgggctacagtttcctcttctaaaagagaggaatagtatttagacctaccttccagtttgtctgtaggtttaaatgagccacacatgccaagggtttagcgcgtaacgaacgtacatggtaaaacgtgaagtgaatatgattgtcttgacccttcacaactaacggtgtgcttcctctctgtcagaaaacaatgggctgctcttcttggagacctcggccctggattccaccaatgtcgagctggcctttgagactgtcctcaaaggtagagcccctgcctccattcgacaggcaccgccatcccacccctgaggcttctgcgggcagcgggaggaacgcagacacccagccctcgcccgccccagccgattcctcatcccctctgtgggcccccccagcctcctcagagcctccctcatacacccccacccctggagcttagggaaagaaccagaaggccacactcccagggacctgattcttagtcccgctccacccacgtaagtcgacgggacccaggtgcccaaactcctcttccttccagcaaaacccccagtgttcagaaaggggcacgcagagtgtttatgaggagggtgggcttctaatcttcatctgccctgatcactgccctctgccctcacagagatcttcgccaaggtgtccaagcagaggcagaacaacgcccggaccaatgccgtcaccctgggcagtggcccggctgggcaggagctgggtcctggggagaagagggcctgttgcatcagcctctgacctgcccccactgtgttccggtgccccccagccctgcccagctccaggagctttctctgccctgttggt

SEQ ID NO: 43748 - DNA, 796 bp, Bovine  19866880824183
gtaccctgcacttaaatatgcctctatttaaaatatttatttatttggctgcaccaggtcttaattgcagcatgcaggatctaattctctgactagggatcaaacccaggcctcctgcactgggagcacagagtcttagccactggaccaccagagaagtccctgctcttgttatttctgatgttgcaaaattgcccactgaagaggttgtactggtatctagtcccacccattggaactaagtgcctgtatctcagactgggcaccaatcgttaggaaaagaggacctgaagcgcctcagggaccagcaccagggtggagtggggtgggcttgaaagacaagagtggcatgcgagtgtggggtgatggaagtggcaatgtttcagagaagagaaaagaacaggggaatataaatccgagcagatggacctgagtttaaagattttcttccccttatagcggtggagctttgcgcagttatctgaccctttgaactgcagtttcatcatctattgaatgaaaatggtgactgcttccctttgtagttgttgtgagtactgcgtgtgtgtaaatatcccacaagcacagtagccattgggacttttctatacctggtgtatgtggcggagatcctatgattgtgggggagcatcacagggggatagtgttggaatcatttggtgaatctaagtcttttaatgatgaccgatcatgtgtggaaacttggatccactggtacatgtcactgtcacccagagcgaggcggactttgaagtctttgctgtggcatgttaag

SEQ ID NO: 43749 - DNA, 1606 bp, Bovine  19866880831151
ttttctttcccaacatttgagaagtaatagactatgcctcctgctccccgaccctcgccccaacgccaccaacccaaggtctccaaagtggacacccctcctgtaacctaactcctgtttctcatgctgtcacgtctggcccccctctttccccaaagggacagaccccaggccccagagtcccaggtccgagaggcccctttggtcttctcctcttgcagtcataagctcccctccccacagcccttattcactctccccacccccatgactcagctgtggcaccagaaataaaccgaggcaggtgccagggggccactgtcgaggaaccacctcccagcagctgcgggctcaactgctgacaagcggagcccaggggcccaggaggggtggctgggagacttcagtttcaggggtggggagatgtctggccccctcctccgtcttccctgctaaggagagacaccccctcgctgtcagcctcacagaccccctctccttcctgtctccccctttctgcctctcctcatctttcactcttccacttcctcccctccctcctccctggctgcttcccaactcttgaatcctttgatgtctcctggattccctctttttctattggcctcatttccctggaagttctgtgttgaaagagaacttcggtttaccttgatggggataaaggtacagaaagacattcttgccaaggatactaagaatcctaagatgccacttggggtccaaagaacatgggcccaggggtgtgggctgctccttggctcgagtccaaagtggtcaagcaacaggcttccctctgttaacggcttctaaagacctcgaggaagaatcatcagggaataaacacagaggtcacaagatctacccactcagagtgttgataagagtctagagtctttcagcggagaatttcctcccagagttcttccttctccctctttgcttttctctcctctccttcccaaccttttctcctgctctgcctcaggcttccagttctcccttcccaggaggaagcaggcagttttacaggaggcagacaggaagtgagatctcaggaaggacctctagcctggggaacagaggaagctttccactgctggaagcccggtacctggaccctcactcccggcagggtctgactgccactcctggggaaagctctcccgcccacgggggtctgacaggctgagcatttttggaagtctttgggagctactgtgtctcagaaggcagccaggacaatggggccctgtctctctctgcacaggagacaggctcacagacagagcctcaggactgggacaaaggcaccagtgaggtcagggcagggtgcgggagtcgaagtgggagagtaggagaggaatggggaagggggatgtgggtcagagcagcctgagcaaagccggggactctggtggatggaggacctctggaaaacccacctccctgggctctcaggcccattctcaatgctcaaacccctaatctaggctgggcctcctctctccacatagactcagacatcctccgacctccctcaaccccaggggaaaggaaaccctgtgggggaccccattttaga

SEQ ID NO: 43750 - DNA, 2985 bp, Bovine  19866880856461
atctagaaggcaagtgacaattagcctagcaacacactcagagcaagggagggaaagcatgttccaggataaaggagcattgcacaaaagcttagtgggacagcattcagaacagggatgatgactctcccaccacaagactgccgtgggaacttcctatgggggtccagtggtaaagactcagtgcttccaatgtaggaggcacgggttcaatccttggtcagggaactaagatcccacatgtcacaaggtgtggccaaaaaaactaaaaacacaaaacaacaacaacaaaaaactcgtaagaaaaaaagactgctgtgaaagttaaataagccaagaccctaaaaagtgcagcctgatgcttgcacagtgtagacgccacaaacgctcgtggccgctgaccaggtgctccctctgtacctcaggggaaggccctcagaagaaatgtcttgttccaatctacctgccctcctagtgggtgctggattttctagtttccaggagccctggcagcacctgggatagcacaggagaagttgttgctacagtgttgtgtggggaggaaaaccccaaacccacagggcaaggtgggaatgggaggagaataggaccacaaaatcagctgggagttgagaatgaccaagtgagcaggagaggggatctccagggaaaagctcctgggccacactacaggcagaggccggaagcaaggcagcaagggtagggatgagaagtactcggagaaaagagcagcctctctcaagtgagtgctgacagtacataggtgtggacccgcagaacaatggagagaggcccacatacctggctctgaaggcttgtccacatctccattgacacagcgcctgagggtggccgagacgggtgcttcagtggtgggctggaggagcaggttgctgaaggtgggggccagtcggaagcagcgtttggtctggaacatctgggtggacatggcttgtagattgctggcaatgctggcctcgctggggcccagaggcccattgagggattcaggagcctctgacctggcccgagatggctccagggctggggaccgtgtcccgtcctcatcctccatatcttccaggtctgatcgggactcttgactgttcatttctgaatctgtctcagcgtcaaaagctgttcccccaccttcaagactcttgtcggagccactgtccgagccctcactggcccgggccgagtcatggcttgagtccgagtcaaagccttcactcaggtcactgtcatcacctgctttgggtgggtggcggcggcggcggaggcaggagaggcgggagaacttccgactctttctgacctcaccctctggaggtactacaggaggaggctcaggccccggctcctcctccttctccaagggttccctggactccggttcatctgtggaaagaggagggtcaacgctgggacactggcaggcgttgacagcccccaccccgccacacctgtgttcccctcccaggatccccacaccccatgctaacctttccacagccacaacccccccatcctggtacctgtgccatcactctggaacgccgggacgggattctcgccctcttccagctcagcttgcagccggatgttgacgtgattgacgaggtgggagaagagggccagggtgaaggcaatggctgcactgtactgcttggatcctaaacccaggaaagccagtgttaggggctaatggccctgaagagtaggaagcaccattaattccaacctcatctcacctgttctcaactctcccaaggatttaattacctctaaaaactttctctaaggtaaaaaaagatttctcaggtctctgcactcccaccatgtaatgtgcaatgtgtcagctcatcctgcttcctcttgtcccacctcatcctgcccagctctgatgtgttcacacaggcccctccccaagcatgttcacacccagtcccgtctctccctcccttccatccaaccttgctctacatatacctctggcagaaactaactgcccccggccccactgccaccaagtctgaattccatctggatcaacagttaagcatctcaaccactgtctgccttggtcccagacaagggtgcatgtatctgtgcgtgtgggagggtggagggggtgggaatatgcctgttgcctttgtttgttcactaggagctccttcagggctctctcctacaggcagagacacaggtagtgaagggactacttgtggaagctactttatggataaggagctgcagaaaagggtagtgaggatcccagaagccagtgggagagaaaagagggacatagggagagttacctgctctcttcaagctgtgcacccccataaggcagatgatgaccatttgaaagatgagaagatctgggaggaaagcatatccactctcatactcctcctcatcctcactggccaggctgaggttgggtgaggagggcaggtagaagagacagaggttgaagtcctccaggactgactggcaaagtgatgtcagctctgagtccacggagctgtggaagcgcaggagtaatgggaggtcagtgatgggggctgaggcaggcacaaagagctgggaatacaggattcagagaaaagactatgggatcctacaagggagacttcagagaggaggagggggactcagtgctggctgatctctaaagcagacagaataacacgggaagggcagacatacagtggaagggatgtgggtgggcttcccattcggccattccttcaacttccagtaagcgcctaatctgccagagggtgagccacccagagaatgggcatggaacctagggtgagacagtgagggatgccgagaaaggactaaccagctcaagaatttccaattgagagacagaattcaccagcccccgccctcctctccaagtcccctgccataaaggagccactgggacggggctcccaggacacagtt

SEQ ID NO: 43751 - DNA, 2133 bp, Bovine  19866880887421
tggttgcaatcttagcaccccgctcctggcagtatgtccgcgcctcctccaaggtcagcttgtctggaggggcacccaggaacagctctcctggggaggaaaaagaggctgggttaccaggaaggtagctccttccacccggggctcccactgggactctgggcaagctcctctgggcctcagtttcctcatctgtggcatggagcccatcgtcctacttcacaggatcaaagtcttgacagaaccttgctgctgctaagtcacttcagtggtgtccaactctgtgcgaccccatcgacggaagcccaccaggctctcccgtccctgggattctccaggcaagaacactggagtgggttgccatttccttctccaatgcatgaaagtgaaaagtcaaagtgaagtcgctcagttgtgtctgactctttgcgaccccatggactgcagcctaccagactcctccgtccatgggattttccaggcaagagtactggagtgggatgccattgacagaaccttaggatggatactactactcaaaggaacctggcccaacttcctcattctgcaaggaaggaaactgaggctcaaagatgctaaaacgtaaagggatgtatggaaccttctggtgggtctgatggtaaagaatcagcctgcaatgcgggagactggggtttgatccctggatcaggaagatcccctggagaagggaatggctacccactccagtattcttgcttggagaaacccatggacagaggagcccagtagtgcatggggttgcagagtcagacacgaacttgagcccctaacactggatatccaccaaagagatgtacagcaggtggcagcagagtcaaactcaatctcctatctcagccacctgtctggaggctttggctgtgaacctgtctctatgacagtgtttggacttgtctctatgacagcgtttggagagagggacactgtttcccttactcctggctacacacttaaacacagtatggtaaggtccagcagaggcccaggaggacctaagggcagccctggagaggggtctcttcccctgggaacctcccacccccaatcaccatttagttcttcagcataacagtaaacatcatagaggtcatcggggtcgaccactcccgtagttccggaccccaagggaagccatccatgtctccataacaggcctctcgtggcgtctggatgggatacctggggcggaggtacaaatgccttcaccaggagccgtcctgtggtgacccccggccccccaccaatcacattgctttcagtgcagccaagtgtcttctcagctctgcagaaatgcatccccgccagcacacagtcctaacccgcccgccgcagaccaacttcgtctcccacaggcagggagccctatagggcccgcctgtggcagcagccggcagcccctggtagaatcagaagccatagccccctcagaaacaactagaaattcgtggtcaacagccccagcccacctcacggtctggtcggacagccagccagcgtcacactgttcatagcccccgaggtaggcggcatagagctgctccggagtggcgattcgggctccgatgcgggcacaggcctcctgggccccagcgaaggagaaagcgtagcgggcagagccctcccggtagagaaagacgacccctgaggggcagagaggaccctgaggcgggatcacccagcacactgacttccccttactctccttgtcactcccctgtagacaaagggtaaagtccagattgtgctcactctacagcatgagggacttaatttagactgtgggtagaattttcctccgcctgaagaaagaaaggaggtaaactccttttccagttcggtctgcgtcttctaggcgtctgcttccgtcccacacagtgggctcccctccccttctctgggaaccctctccatctccgacctctcacctttgaccttgacctccaccgcgtcgctgctgtcgtcgatgccgtgctggacctcgcagcggtaaatgcctgagtcgttgggccgcagctcactcagcaccagggagacgtcggtgagtgacgccgggtaagcaggcagtgccacgcggaaccggtaggcctcgct

SEQ ID NO: 43752 - DNA, 3481 bp, Bovine  19866880892112
cagcccagacagaacgggtattaaggaacccttccgtgggcctccgaggagtggttcccgactgtgccgatggctaccagcggctcctggaagatgccatggcaaagaagcagcgcccaggtagtggcctcaccttgcctctccccttcttggccggccccagctacctctcaccacctctgagccttctttgcctatttggcttctgcttaggagatacagcactctgggttcaacatgccatgaaggatggcactgcctactactttcacctgcagaccttccaggggacctgggagcgaccccctggctgccgcctcaacacctcccacctaacttggaaggagatccaggttggtggagcccctgtgagagagggggctcgtggtggggaggtttcctgtgggagaggctcccacccaccaggacaccacaggccctctcttcttccacttctgcagtcagctgtcaccaaggtcaccactgcccatgaccgccagcagctctggaaggccaacgtgggcttcatcatccggctccaggcccgcctccgcggcttcctggtccggcagaagtttgcgaaacattcccactttctgaggacctggcttccagcagttgtcaagatccaggtagcggactctgcccttctgaggtggcacagctgggcttccctgaagttcagaggttcctcctgctgcttctttgctgagtggagttggggagatcttttggcctctgtgcagtagtagtaagggatggatgctggagcccagactccttgggtttgaatcccctctccaccatgttaactaattactcactctctcccagtttcctcatctgaaaactagtcatctgaaagttgtagcacccctctttagggtgttatgaggtgatatctaaagtacatttaaacagtacctggcagataggcaagaacacaggcaaatgctagttactgttgtcctcatcatcaccatccagagggtatgagagctgctttttagcttccccacagagagagcggaacaagatttagcatgacatcagggtttagacaccaggaggactagaaaggagtagtgaagaggtggtagtggtgattgttaaacagaaaagggatggaatcccttggggaaagaacttctacctttctctccagccagccctttccatttttattcttccaccctttgggtggttcagtgtggcctctgagaccgacccataagtcactcaggcacgaggcgttgggctgaggtgctttccaagccaggaacagtgggagctgagcaaacagaggcctcctcaggcagacatgctctggagggtctcatggcaaggtgggcagtgtaaagagactttatttaatgaacacctccaaatgcccagtatctgcaaaggataccatttggcactgggcaagggtgagagatggtgtgtgagacacagatgcgtgctcacgtgtcttccattgcaggaactggaatacagtgggtgttagatgttgtgatagtggggacacacaaataatagcagagaacccagggttcctgagggagccagaggcacagagacgggcaaatgccctcgatggtgatatggaatacgtggtcactgagcgtgcaggctttaagtcctgaggctgcagtttgcgttttggtcctgttacttatgggcgcctaccgagcccttgccagccctcggtttccttattcatatggtgcttgcctcatgctggttgtgagggtaaagcaggaaaattacatgtagcacttattgtggggacatgctctattggtgaaagccgttatgagatgttaaatttgggggcattgatcccagaactcagaaaccttagccatcagcatttagtgtctcaatcaatcctcctgaacacagcctggaatttcacaccagctaaggagcagagaagccacaccaacagtgggagaggggacagagtcagaaagtgagttcgccacccatcctagagctgtgctgactctggcctgggtctgggaggcagagaagggagagggggtcggaaccccaaggccacctgccctccagctagggagagtgagagtcagaaacgaagcagcttgggtctcctgagagctctaaccctggccaggactccagtcagggtcaaaattctcaccaatccagactgagaggctttctctcttgaaggagaagccatgtggggatgggtgggtggtaaaagcagagaggagacccctccgccttttcctataacaactaacagtgtgtcaggcagtacctggagtgggaggggaaggggtgctgagaagggacatagacttggggctccctggcctctaggctccaaaatagacagctggtaccatgggaccaagctgcctgttttatatctttcccaacagaaggacggtgtgagtcttaggtggaaagcctgcccaggagagttggctttaggaaaggctggaagagcagttggctgaaagggggtgctcttttaaaaaatgttttggctgtgccatgtggcatctgggatctttgttcctcgaccagagattgaacacataccccctgcactggaagcacagagtcttaaccacgggaccaccagggaagtccctgaaagtcaatgcacttaacacactaaaccatgacatcttcagcggcagagtgtcctccagggtctgagtgcccaggagaagtttaatatgtgccctaaaagacaggtatcagtaggtagagatagggctggggtaagggcatagaaagacaaaggtttggggcagcagatcataaagcatgtttgaaagaaagtgaaatgtctgaggtggctagacttcttaaaggatgtaggaaccagtagacagtcagacaggagtgtgggatcagatggttgagatgtcctggaaactggggctatgagaagcatgatccaagtagtgttttaggaaaattcacacaagcttggggtgaagggggaaaggcccacaggaaggacaccaaaacagaagggagtcatgggatttgtgtcttagagaccaaagcgggtgtgattattaaggagagggtcatttagacacctttgcagcagactagtcagcgaggaaaggccatcagcctgacagctgaattactagggaccttggagggaagatttgctcagagctgaggttcagagctaagtggtagagttgtaaagagaagtgtgagttatgagaacatgaatgacccgctgcccagagggccgttggcagagatggtgggcacacagctctgtgcctgcacacactttccagccattgcaccatgcacgtctccagactttggattgtgtgatggtgtgtgggtagttttttttttaatatgtatctgtttggctacattggatcttaattgcagcacgcaggatcttcgctgtgtcacgcagggtctttcattgccgatcacagactctccagttgtagcacgaagg

SEQ ID NO: 43753 - DNA, 1511 bp, Bovine  19866880936044
tttcccggccctggacattgccctctgtctcctgctaaggtttccttcctccaagagaacctttttcaatcttggcttttttttttcttttcagaccaaaaagaagaacctacttcatccagttggcttcagtgccctgtgagaagccttcctgattgacggaaagatgagactaaattctagcaagttgagtggctccttcaagaagcctgtgtgcagggtagaagtggagaggccatagcctccagcctgggcagcccattggcacctggagccacctcaactttgcctcccctttgctcctgtgtctataagctgcccagcccagcccgtcctggtttctcctgtgtcttctgagctgagatttctctgagatggaagccccatcccatgtctaataaagactcttgaatactgaacaacattactggtggtagtgggtgtgcctgggcaggggaggggctggatgagaggagactagttaccaggctccctctgagacacgggtcccctacctctgggatctaaggcctgatggtctgaggtggagctgatgtaatcataatagaaataaagcacacaaaaataaatgtaacactcttgaatcatctcaaaaccatccacccactcaggtccatggaaaaattgtctttcataaaaccggtccctggtgttaaaaaggttggaatcactgctctgagagacctgtgctgtagaagccaccatggcaacaaaatggggaagcctcactaagagagaacctccacctgtgcagggctgggcggggcgcaggtgggctccttccacctctctgagccgccccaggcttccgggaacaccgtccacgatctggttacttccagctccgagcagtgggctgatgctcccagccaaggaggcctctaggtgccatcccaagaaccaagagaatgagagaggacggggatgctcccctggagtgcctgtgtggaaagtcaccgggtggccctctatcttggccgcaatgggacacatccttagaaatgttccccagggtttgaacagaccagagagaaagagcacccctgcttcacagggtcacccactcctgcttcctctctgtccaccctgagtggagacagaatgggatgaatgtgcccaacaagaaggattcaggttagacagcaggtaggacttcccagcaatccctgggagggaacctgagggagtggggaaacacggcaagaaggacctgtgctcttggtctcatttcccccatgacacacctgtataaaacatgctcccccagagataggccccctggaaagtgttggcagagtccagagtgccaactccttttaagcattctgctgctgctgctaagtcgcttcagtcgtgtccgactaccactccctaaaaagtccttcctcccatctaacaatcccttcatggaactatagcttgaatcctagaatttttctaaataaaaagacttaagataacacacatggtacaatttcaacagcacaaag

SEQ ID NO: 43754 - DNA, 1584 bp, Bovine  19866880945507
ccgtttcaacctgcttgggttcctttggcttccaaaatatagtgatggcccagatgagagagaaactcgtgatgcagctaagtttcccttaaaattatgctatacagatagaattcttcagtaaaagaatgtgagttagtgattgtctccctcccaggggatcaacctggagagcaagcatgaaggaaaacagagccccaagcgtcctgcagaggcctgtggtcaccatacctggcgcgaatacttgcctctgtctggacttgcttggtcacctttcacctttgtctggcaggctctgcagagcccccaggtcactcttggctaatggtctgcttatcactcagttctttcctcgtgccagagtaatctaacaaatctgatctaatcttctttgttgcgcaccttcagaccttcacgggttcttccatatttctccaagacttgagtcccttttcctcctcctcctggtatgtgagaccttccgaatatctctccgacccttctcttcacatcccaccagcctagccgggtcagacaacttgttcttgcttgatggccgcagccttgcccactgccaggctctgtcctctagattacagttcccccacattgtcaccggtgggaaccagatgaaaatgtcccgcagagctgcctcacagcttcctcctctgtgaaatcgtcctcctctctcccctgaagtctcccctcccctgcactgccagggtactagtggggaaaggaaatacctttcatagccgtgacagcaatgccatgtagtaattctgtatccttatttttttccagtagattttgtgctccttgatggcaatgcccatatctgcctggcattttataagccccagcatttgaaaactaaaactacattgatgcaccatggcccctttgcagcccaaatggctccgccttgaagctggttccctattcctgtgccctgtcatcaagatttggtctctggaggttgaccaacctcatcttagctgcgccccataacctcctgtcagtcttgcgctcaccaccttaggaactcacctcggctatgacagccactccttgttacctgctgagctattccacttctaggcctgacaaattgcttcttccagaacctcttcttaaagcgacccagccccttttcctcctgaacatttagaaatacatttggaacctagcagaggttcaaagctatttccactcagagattgccagcagaatctatttagctaggagaatggaaatggcactggatgcccagcctccacagcctctctctcctcccctgcagtgctccgggctgtgcagaggatcaacaaagctatccggaggggagtggcagctgacactgtgaaggagctgatgtgcccagaagcccagctgcctccagtgtacccctttgcctcggctgtgtaccagcaggaactggcagtgctccagcagcagcagcagggggtaagccctagaagtgagggtccagctctcgggttcccaagcagctggagggatcagagcagtcagtccagagcacccatgagagcactgttaaatgctggcaagtgactaggggtg

SEQ ID NO: 43755 - DNA, 848 bp, Bovine  19866880973068
ctccgcagtctttgcgaaggctgggagcacattttcaggaactgtcttctttcagtcaacgtgagttttctggagaaggggccctgggctaccattcttacagaggttcttaagagctggctcctttccctagggttccttcctgtggaggttaaaactccagccctccgaccgcagcttcacttgagtagaactattctctttctgtcacatctgcccctgagcccgggctatgacagtcaccattcgggggactgtagccccttaccgtcattgcgaggtcctctccgcagaaacatgtgacaaacgcgacttgcgcgcagccatcttcccggaagtgctgtttcgacccttctaggctgtggaaaccatagagatgcacgctagaactgagtctctgtggttcccagagaaactatttcggagaggccggctagccctatggttgccatagaaactccgccccagagcgagcccatttctggagattcgagtggtattctacttattgcctcccagcaggccctgagcagctaagggacttcagtcctacctggctttgttggggttcggagaatagctttgggtccgacattgactagtcccaggcacaaatacgagaaaggaaaaatttaggtgaaagcattgagagtggcctgagaggttcgtggaggcagagaaggaggtagtacctctgaggtgattaataattcaggggatgaatactcagactacagggacagttgtttttttttttttttaaataaaatcctagaggtaagaggtttcaataggttcatcaaacacattttgattcaccactgtgtgccaggacctgttctttggta

SEQ ID NO: 43756 - DNA, 657 bp, Bovine  19866880976706
cgccgagccctgcatgcggagccctcccaccccatcccccagatagagggaaataaccaaaaaaactaccaaacaacaaaaaccccttacaatagactgagacccagagtcggctcaatgagtggtggtgtgttttagggggaagaggaggcagaggttctgaaaagggtctctgcctccgggctgttcttgtggccacgggcccatggggcagaatacccaggcctgggccccaaacgcccctgtgcacgcgcacgcacactctcccattcttgtgtgagctgcgcctccaaggtgtggaggtgctggcctagcgagcactggggctggaaggctgcctgggaatccggggctgtcggggagggggttgagctggggccccctgtgaagcacagtaggagagagacagagccatgaggagagagctgaggaggggccgaggggctggggcagggggtgagttgggccccctcccttccccagcgttttctctaagatatacagtgcaatagctccctgtccctcagctgacaccagcccagcaaagctggccacgaagtgcagggcgaaccgggagagggaggtggctccacaggagacgcctcaggcaccctggggtccttgcatccagggactagagtgagtgaggggactcgc

SEQ ID NO: 43757 - DNA, 854 bp, Bovine  19866881003821
tgctagcacaaagtcagatgacagcagaatctgtgttttgttcgctattgtcccagcacctagattagtatctggcacgtgagtaggtactcaaacattagcaatgaaagattaaataaatggagggaaggggaatgactgtgaacccaaccattcccagaagaaacacaggtcagggaactgcaaaaagacccagagaccgggcctgggcccagaaacaggacatcatgcagaaggctagcctccgagcacaagaacttggggtcttggctacactctctccatcacccatcccctccctcagcatgctgctacacctttcttaccgctgagcgttctccctgtccacctcggccaggcccgtggcggggttcaccagactgctccagaagccactagcatccttggcttccagagcccagttgatcaggaccacggctgagagcatctccacagccacaaagagctcctcctgggccagctcctgcaacacagggagggctgagtctccacgggctggtgaagggcttgggggcccagctgccctcctgcccccaagcctctcccacatcccagagtctacatctcaaaacccctacggcctaatccactcactaataattaaacttaataatgcttactacgtattcaatgtataagtacttagcgcacactatcacttaatttttctaacaagccaaaaaagtaagtaccattgatatccccatttcacagatgagaccatagttaagtaatataagttaaacctaactgccagacaccagagcccacactcaaccagtgagttctactggtccctacggggcgctaagaactgcactcagccctgggca

SEQ ID NO: 43758 - DNA, 1972 bp, Bovine  19866881036539
ttgcctgagaaatctcaaagtgtgagggaagaggcagttaaagagacattgacctgttgagagaggatgggaggtagacagggagggaggaggagttcagagaaggaggcgcacggtagagacccacagagaactgtcccctagagaatgagaggggagagagcacatccttggagcactgctcccatcctgtggctctttggggaactgcagctagagacaaaaccacgtcctgcaggtctggctcagttacctttgatggtgtgcatgcatacaagtgtgctcagtcatgtctgactctttgggattcgatggactgtagcccaccaggctccttctgtccatgggattatcccagcaagaatactgaatgggttgctattttctcctccaagggatcttccaaacccagggatggaacctgtgtctcatggggctcctgcattggtaggtggattgcttaccactgagccacctgggaagccccatcttcaatggggcctttggccttcacccactgggctagttaccaatcagccaaagccctagcacagccctggtgttgggggacgtgccacaatcccccacccacctccccacccccaggtggcctctggaaagtggtatgtgccccacacgtaggccctggggcagatgaacacagatgagcagtcaagtgcagcatccttgacatcagctccacttattcaccacccctttctccgggtaacctccccccccacccactactgcttgtctcaggtgtcatctcaccagggtgtgagtcggaagcagtccaccccgggccaagtgggtccttatggcatctgtcagcttggccaccagccgctctcgcacagaatctgactccttctggggagagagtggataatggggtagtgggaaaagcctgggcttcaggaccggggaggaaatagaagaggaggaggggaggggcctttgtctcttctcttctctagcccatccccatgcctttgccagcatcctgccaccgcctacccagaaccatggacagaggtgggttcttcctcacaatagtgtcccaggacccagcacactgtgtgcccagtgcacatttggtgggtgaatggatggtggggagagacaggaatattagctggagaaagcatgtcaggagagcaactggagggctattgggaaacagttcgattctgggatggagggtctcaccggactccgggccagcgcttccttatagtacttcagagcctggtcatgctgtcccagtctggctgcagcagcccccagaccctcacaggcctgccactgccccttcacgtcccctggggaagacagtctgagaagtcctcccctggctcccaaccccaccaaccttcccctctagaggtcctcccaccagccccaaggatcctcaggctttgccccaccccaagccgcctgcaagccgctcccctcaccagtgtcccgggcagcctgcagagcatgtaggtagttgtctctggcggccttgtggtctcccagctggctcactgcaaatgccaggctgccaaagctccaaccctgctccctccgctgccccacagagcctggggacagagcccaccccatcctaagagaggacttggcctgctggggcatcagaaccctgccccccaacgaggaagggagggttgccaagagtccttggtgtgcaaccctggcacacctctagaggcaccatgaaggcttgaacccttgaaacccagcctgagtttttggtctgaatgcctccccaggctactctgagccacataaaaacccagggaggcaagcaaggcaggtattaatagcttcatttttatacacgtgcaacctgaagctcagaaagtgaaggtaatgtgctgaaagtcacacaatcatttagaagaagcgctgggctccatttcaggcctccccttccagctaggttcttctctctgcccattgctgc

SEQ ID NO: 43759 - DNA, 1601 bp, Bovine  19866881042403
tgagagttcttggccggatgcccccgatcttgctgaaggcaggcagctggaggtcatacttagccagttcagaggccatgttgctgagttcctcagctgcaatgataggacaggtgcccttcatcaggccccaaacccccaagaccccacccagactgtggaggttgggggaggagatgggcttacctgtgaatttcaccttcccatatagatcatgtatctgaggagccaatcccagccggaagaggaagagactgggaaagaatggaaggcattggggcctattcattttgacaggctgcctagaataggtttgcaggagatactacgggaatttagagatgaagaccattcagcacctgcccacaactcatcccccatttacagggagataggcaatgtaagtcggcccaaggcaatgctggagcagataagtaagatgctataggaggtctgtggggattgggaaggctttacagagaaggacacattgcagcagcaggtcattggatgggagatgtaggatgcaaagggcatagcaagcagagacccactgagctaaggcatggccacgtgaaaggatgcgggaaatgaagccaggaggagatgacgtggtggacacagaaacaggtcaatcactttctgtgacttagccaactggttgctgatggctggctgtaagcaggactaaacagccgtctctcttcacactgactgtgacagcatgtgaccctcctgatacatcctaatcggacttctctgcaccctagtcacaagctgaagactcttcgctgcctgccctttcccttcacccacagaggtcacacgtaaaggtgccctccagcacacaccacaaatctaaacaaaactaggtagatggaaaacgtcagtctgaggagtgctccccgtggtccaccctccgtccttcctgtgtcggtgtctgttgctgttggctcttggttgcatccacccatggaactcagatgataaagtcatggtctctcacctgagtgcatggatgcagtagaccacccgtggcatgttcttcttgtcataaatgtccgtggtctctgggaagaaggtctggaggggaaaccacccaattactgccactggagacttctaaagcagcaccagatatggaaagaggggctgaggaatgggtcttcctatctgacctgggatgcgtgttcctttgttgcctggggcttctgggtcaatttccccaactctttacagccagcactcatccacatactcagtgtaaaagaaaggcactgggacacactccagctgaggcccagccacagacacacagccaaaccaaacattaacccaacatcagacgagactatcaagtctacaggatgcaggccacatgctccaggagaaataggtgcctccattcatcctacagacacagccagcctctatccctcaccttggactctcaccagaggcggcatgctgggagctggccatgaccccaaaaagggcccagtgagacacacactgccaaggaccacacaggatcaggatgtgccatcactgtgtccaagccagaggtctctaaccagtggggacccctctaagagctaagt

SEQ ID NO: 43760 - DNA, 1500 bp, Bovine  19866881057646
actgctagcgggaacagctggagctgggagtagcccaggcctagatcgttatagagttgccctagagggcatggccaaggtcactggccagatgctgctgaagctgtactggtgcagcctctgtcccactctcccagggttctcccagcccctcccagccctcagaaaggcctctgcttccacccgatgtctcagagtatcacccggtcagaaatccccccagatcccacacctcagccccaaggcctcacccagcagtccccgctcagtgcttctctcagcaagcctccgactttcctccagcacctgcatgacttcacccgccccatgctgcccgctcttcagcatacaccccgctgcagcccccaatgtcagggctgcagcctggggctgccctgcttgggcataggcccggctcgcttcttgcaggcagtgggctgctagcccaggctgtcccagagctcggtagcaggctcccatttttgcctgggcttgtccctggtcacctagtggctggtagtggcacagggccttgtggtaccaggccaaagcttgaggcaggtcacccagggcatggtaggccaaagccacattgaaacactggtcgccatgacacccgccctgggccgtctcttgaggttgagcacgtaggagcagctcaaggcctctggctgggtccccagtctccacgtaggcagcccccaggttgaaggcacaggcccggagaacaggggtgtctctggtttgtggtgacttggaagccaggaggaaggccctctggaagctggtcaaggcctcatggttccagccagccaatagggccctgtggccagccctggtgaggcttggaatgggtggcctcttgctgaggccactttcttttcttctttttcttcttggagcttgaggacgagagtgagggttcttggggggtatcctcagtgttatagggaagacatagtgctgacaatagggagcagaggggtcagtatgttatctttggtcttccaaaggaccactgtccctctatagcaattcagctctacttctgccctggtgtgaccctcagggtttcaaggatttctctctgccatctcactttgctccacctatcccattggacaccacatcaactctcactccaatgtcctgactaattgctcatcctccaagactcattttaagacaaggagggggcagggcacagtctttaaaaaagtgacttagcctgaggacacaacataaactgattagaaccaactgggtccaagatggcggactcaacttccacttgaccttgagcctcagtatatctcaatgtaacacaccctgggtgccatgatggttctaaggacgaccacaaaatgtcaaaaagtgggtgtggcccaattccttgaaatccccaccccttttccaaaacaactggaatactcctcccaatcattagcctgtgtaatcacctcaatactaacaatacccaccaagagcctatgtaaaaat

SEQ ID NO: 43761 - DNA, 1491 bp, Bovine  19866881146638
tggaagactgtggaaacagccggcagtgggcagaggtgggtgttgggggcagggcaggagcaggagtcaggagagagcgagaggctgcttaaagggagcgagggagggaggaaggtcctgggattggatgtagtgctgtggcctgcccgagcgggtcacaactactctcatgctctcagctggatggaggcctgcctgaaggaggagctgccttccccggtggagctggaggagagcctccggaacggagtgctgctggccaagctgggccactgtttcgcaccctctgtggttcccttgaagaagatctatgatgcggagcagctgcggtaccaggtggggagcagaggtctctaccctctacattcttcctctcaaactccctcttctcaaagctgttagagtgggatgaccatacaatttattgtccagacctggttactgttgaggatgaaaaggatgctattaatctttgcactagaacaacaggtttcaatgggtatctgccagccaggcaatgtgtatcacccttaacaggcatttgctaggtgggttttgagaggccctaatatgagaacctccaagcaggcttttctacctacagtctacacgcagaggctgtgggctctactaccttgaaggtacttccagggcacgcttccccttccctgtgttctagccagcccagcctgcctctccttcccatcccagctctggactccccttttctcggaagccatactagcttgctaatcccatccctgtgccatccttcccaaatgccccgctggggcatccatacctggtggtttctgtctgtctgtgtgtctccatcctgggggcatgggaaatccatagggcagggtcctctgccctcaccccttgaatcttcaaattccggtctggactctacccatagcaaaccccaagaactgtggaaatagattctcttctctttccttccctttcaggcaactggcttgcatttccgtcacacggacaacatcaacttttggctgtctgcaatagcccacatcggtctgccttcggtaacactgggccttaagattggggttcatctttgctctttaccagtacccccaccatacacatgctttatctccctgggacccttcagtgttcatctccatgtgtctttgaaccttgttacttggtctctgcctctgtttccctgtgggtatgtcaagtgaagggaggtggaggctccctggcccaggatgcattgttcccattagtcagtgaggcccctgtataatgcaggaggtgggccttgtgttgacgggctgtctttccaccagaatttcatagtgtgaagtgaggacgcaccacactcctaggtgacaggcttggaagcctgggccaggaccccagctggacacatgccgtgtgtcctccggctctttgactcccggtctgtctctcacctgtaaaatggggatagtgatccctccctatctaccatacaaggtt

SEQ ID NO: 43762 - DNA, 755 bp, Bovine  19866881161574
gatgctgacaccctttggggctctggcagctggcttcctggctggggccatctccacactggggtacaagttcgtcacggtacataagcccctgggccctgagcagggcagggcgtcttcacacccttcctcctctccagcaggcctggctgagggggacacacgagactcatgattggtgtcctgtctccagcccatccttgagtccaaactcaaagtccaagacacatgtggtgtgcacaacctccatgggatgccgggggtcctgggagccctcctgggtggccttgtggctgggctggccacccgtgaagcttatggagatgggtgagttctccccaccctcaccccacccccaatccaatggaatcattatccccctgaactaactccctcagtctgttcctccttttgtgggccacaaccacctcctctggtccaacctgcttctttccctcctccccggctcctgctcctgaccaaaaaaaagctgtctattctctctcattcattcatccataccctggaagctgaagaaactggggtgaacaagcctggggactgccttcttggtcctcggtcgagtgcagcagaaggtcgttgaataaatgatttcaacagtgtcattattaaagggtcaagggagagacactgacccttaggatagatttttgcacatcagggctcagggggagatgggaagcaaaagtgaccctcaaactgagccttgaaaggtatgaagggtgttgctggca

SEQ ID NO: 43763 - DNA, 780 bp, Bovine  19866881176174
gtcacgcgtgggcagtgggggcaccctctgactcttagattgtgcccctagaatgacgtgggtggcgaaaagttgctgcagaagaagtggaccaccttcctaaaggcccagctgctttgcacccagccggaacaacttcccttcaacgttatccgtcacgctgtcctgctggcagacaattcctccaccgatccccaggtctacgcagtctttacctctcagtggtgagcaactaggcgagagcgtgggggttggaagtgggatttggggtcagctccctggcccgccagggagggtaggaactgatgtgagcgaagtacaaactccacacttcacatatgaagacatttgatcatcaccatctcccaggaatttgactcacgcccttaatgtagggctcaatgtagatagggaaaataaagctcagaaaggttcttattagtttatgtcctgcctggttccaaaaaggataggaggcagcttacaaaaggcaaacgttaaaataaaataaacctatgaggaaatggaaataaaaggagaatgagagaacccagggatggagtccgcacattacagatgattatcacttatacagttggggatgctgggacacctgtagctgtgaacttcctagtggtcatagcatagagcgaaacaccatcaacaacataagataaaaataaagtcattgcttggagattgagacttatttgttgtggtctggctcccacagtgttcaggtgtctgctgacaatgtgtcaggtaccaaagatatctttt

SEQ ID NO: 43764 - DNA, 810 bp, Bovine  19866881251631
cttccctaccttgagcttgacgaaatgatggaatctggcttagatctcaaagacccttgcagaacagaagggcactcagttcttcacatactctgatttctactgggtctgatttactggacaaagagtcaattctaggttaagggttgctaagacaaatatatccctgaaaggggctgcatgttatggtgattagaggcatcaactttgggggagtcaagctatcttggttcaaatccttattccaccatttattaactggaaacacaggcacattacttaacttccctgtaccccatgggtaaaatagagatgatgataatagtacctaactcataagttggtgtgaagattaaattagttcatacaagtagattgctttgaatgatagcccatgctgctttataataaactcaagggcaagaccccgttaggcccattatcccacaggagcctcggaggaggcaagttcagtggaattgctttgcaaataggttggaggcttgtctatgttttaagacaggaagccagcaggctatttccttggccttggtttctgtctcttccacctgactgctccttctggaaacctgatttaaactgtcccactttgaccccaaaagtggcttcttagttccccattagatttaggagttggggccccagcaccagaagatgtctgtcttccctatcaggcacagctggcttacctgaaggacctcagggtaagcagggggagcccatctgcctggtccccaaggactctgagaagaacagagccttgtgccaggtttggggctgtggcaatag

SEQ ID NO: 43765 - DNA, 2877 bp, Bovine  19866881268521
ttgtcttcctctgtctgacttccttagtatgagaatctctaggtccatccatgttgctgcaagtggcattattttattatttatttatggctgagtaggttccattgtatatatgtacacatcttctttatccattcatctgttgatggacatttaggttgcttccatatcttggctatggtaaatagtgctactgtgaacattggggtgcatgtatcttttcagattatagttttctccagatatatgctctggaatgagattgctcggtcatatggtagttctatttttcacttttctctgtactgttcttcatagtgcctgatctagatattctcattcaaactgtggtatgctacccattaatgggttgaaatcaatttaatggttttaacttacttaaaaaaatagtaaatgcaggggacgtgggttcatccttggtcagggaactaagatcctccatgtcgtggggcaactaagtctgcatgctgcaactactacagattccacatgatgcagtgaagaacccatgtggcacaactaagacctgactcagccaaataaattgtaggtcagttgttcagtcgtgtcggactctttgcaaccccatggactgcagcacaccaaacttccctgtccttcactatctcccagagtgtgctcaaactcatgtccattgagtcggtgatgccattcagccatctcattctctgtcgcctccttctcctccttctgtcaatctttcccagcatcaggatcttttttaatgagttgactgttcgcatcaggcggccagagtattggagcttcaacttcagcatcagtccttgccatgaatattcagggttgatttcctttaagattgacgggtttgatctcctttctgtccaagggactctcgagtcttctccagcaccacaattccaaagctttgattcttcagtactcaaccttctttatggtccagctctcacatccatacatgactactggaaaaaccatagttttggctatacagactgtcagcagcaacctgatgtctccgcttttcaatatgctgtctaggtttgtcatagttttctttccaaagagcaagcaccttttcatttcatggctgtagtcactgtccacagtgattggagcccaagaaaataaattctatcactgtttccaccttttccccatctatatgccatgaaatgataggaccagatgttatgatcttagttttatgaatgttgacttttgagagggtaacaggcaggaaggccaggggtctctaaacagaggaaatagacagcaagtgtcagacatattttctctctctcttaagcggcaggacgaaacaaactacaagtgtccagattttttcaccttttctatgcaaatttaaatagggtggccacatgcatctcgaacctccttgcaagcacagaggctcgggctattggcccgcacaccactacgcatgtgtatcaactacaagggtgggtgatggagttgaggctttctattaacaccacagccaaagaggagggtaatactgtgcctctttgtcaagccaaaccctcccccagctttattaatcttcaagcaagttccccaccagccactttgctgaaaatcctgccaacaaagttgcctgcagtattgaccacagcccaaggaatgcctaggactcctagaataggtttattttcctgtggaatgtggagaagacgaaaggagtgttagacctgaatacagagatgaggagaaagtgagaaagcagtgattgagaagagaatttcacattggcttcaactctttgaatggtttttcagagacttctttttttaaaaaaaagtttttattaatatttgtattggggcgtaaccaattaacggttgtgaaagtcctgcagtcaatcctgctggccttccaaagtcacattctctgggaattcctagtcctttgtcattgttgggttccagtgtcctgtcaattgttgttaaacagctagttgcgattttggtggtctcacaggagatgagtgcatgacttggtctcataggagaaggtgagtgccatcttaaatctgtttctagagagacttctttattctgtatgaataaggaagactgtgcagtgatgtatgtcataaaccatcacaatattgttagttatcctccaattaaaaataaagttaaaaaaaggaagactgagcaggaataaggctaaagtgaagcttgaggaattggggttgggcactgaaaaaattttggctaagctattatctaagaaaaaagagaaataatcaaaataattttagaaagagaggggctctgacatttgtggataagtttggacctaccctgcttggaaagaggaaggatacgttatgtttggacatatgtttgtttcatcatcttcatcaaaatgcaatttttgaataagatctgaatgggtttccctctagccttagatagtgatctctccattcacacttaaaatttaagagttatgctcccattagaatggcatcaagaaaacaaagaatgacagttgctgttgaggatgtggtgaaaaaggaacctttatatactgttggtggaaatgtaaattggtccaatcactatggaaagcaataaagagattcctcaaaaagctaaaaataatctgccatgtgacccagcagttccactactgggtatatacccaaaggaaatgaaaacagtattttgaagagagaagtgcactcccatgtttattgcagtgttcccaatagccaagatggcaaatagatggggaagcaatggaaacagtgacagactttattttttagggctccaaaatcactgcagatggtgactgcagccagaaattaaaaggcatttg

SEQ ID NO: 43766 - DNA, 1964 bp, Bovine  19866881386776
ctcccagaactgtggagtcctaggagctctttctgacaataacggttaagagatggcacagccagagagcaactctggagagatggtgcactctctctgggagaacaatatgcatgagaggtttctatggcatttgggggcaatgacagttgactttaagatgctgaaaaaggctcccagctgaggtatgcgtcctttacacgcacagagttcttattagggatgctgacagggagctgagtgaggttctgtgaactctctcttttcacttaacagcatagcaagactaccagacttagaaggaatttcttcagaggcctctaaggcaactagtttgtattcaagaccttcccgggctgagaatggagatgacagtcacaacttatctacaggctagaagaccaagctgatgtttattcaattttgtatagttagaaactggcaatctatgggctgaatttacatgtttttcttagccttcaaaataaaaagtcagtatattttccatagatctacattttcagcttcttttagccaagatgtctcttcagatgtctgcattcccattgccacagctccccgtatcctggtcccttagctgcctggcccctgcaggtgcctgagtgcaccatctctgggttagatgctgtaagggggacttgcctctcccttgactcagacacggcactaccactctcctctcagcagactgctgttccgcagctgattcctcctcaggagggactcctcgctgagagggtgcctaagactgcgtcagctcaggcccctgaggcctcagctcctggaggggcatcagttgggccccgccgtggcctggccttcagtctctcttcttctgtttcttcttttttgctttctgcgcagtgttgactccaggtccatccaagacttcctcctcctgatactgccgtcttttcttcttgcttctcccccttttctgatcactgcacgatctgctttctgcttctctggtcccactatctacgagagcctcttcaacttctttcatcctctgtgttcaagtcttcttcctcatgctgccgcctcttcttgcttctgccacatgggtgagtgtatactctcctctctgcttcctctgtcccaactccactgacagccaccttgcctccctcattatctaagaccgccagctccgccttctcctcttcatggtgctgccccctcctcttctttttcctgaaggaccggtcgacgtgctctctgtttttcaattccccaagcccacctgttcttatggtctcttcctcattttctgtggctgtgccctctctctcatctgtgactctttcttcttgatgccgtcttttcttcttcttgctttttctgatgctctcgtcagtgtgttctgagtacttttctgcactcctttcagttgttgtaggctcttcctcctctttctgcttccttttctttttcttttttttgggggacttgctctcagactgcagttgagggaccccagggtcctggcctttgagccgagccaggaaggcctgctcctgggcctctaagcgagcaagcttagctttcattgtgatcccaagacgggcagccctgaaatagatggggcccaagtcagagggggagaaggcaatggcaacccactccagtactcttgcctggaaaatcccatggacggaggggcctggtgggctgcagtccatggggttgctaggagtcggacacgactgagcaacttcactttattttttcactttcatgcattggagaaggagatggcaacccactccagcgttcttgcctgaagaatcccagggacgggggagcctggtgggctgccgtctatggggtcacacagagtcggacacgactgaggcgacttagcagcagcagtagcagcagcaagtcagagggaggctatcagggaaaagaggccaatctttcccaatcaggcaaaggtt

SEQ ID NO: 43767 - DNA, 1159 bp, Bovine  19866881393894
aaattggacttggagaaacccactagtataagtcatggagaggcagagggcgtcagggagagagagacagccagaaatagaaattcaggctgagaaaggagtgaatgatgaaactcacttgggggagagactgaggaaagggaggtgaggagagcagggggccaggggcgttgtgccttctggttctccagagctggtgatttctctttccctccttcagtgtcactgttatcaaactgggcacttcaaacccataactgctttcatgcccctaggacatttgaggcttaagggaatccgtggacctggtgacccaggacacgcaagtgcacagatgatgctggaccacgctgtgtccaatactgtggacaccaggaatacaagaacccagagtagcctggctggtatctgggccctgggaccctgtaggcacagcttgactggtttcttactgaggctgtgggggctgctggccttccacctgcagggaaaagactcaggaaaggacatgggccctgtcggagttgcaggggcagggtctcctgggcatggctgagtcttttgcatctttctggggcaacatggtaaaggaaatgcatgttgcccattgatggaagggcctcccttgtgttaggtgctgggattacaagcataaaccctgcccccaaggtgctgatggtccccaggggcaggcaggtgggctgtcacacaaccatacttgagggtgatcagttcagtgacagaggggtttatacagctctggggaggccagcctctctggcaccttgccacatgtttccccaactcctcttcgtggttggtactaagattctctgagcctccagagctaacagttagctcatcagtcctctaatgcgaaagtgcaaacgtgctcatgagagagagagtttgagaagctcatctctccgtgccaggggccctatgtgccaggggaacgggcacacacgcccacctccgccacatcacagtgatggggagacctcagggaatctcccacagccagccgaaatccccagtctgggtgatatacaggcgcctgcaggaaactcaggagaaaaacattttctttctgttccatccacctatggcagtggttctcgtggtagaaatttcctgtagaggagggaaggaaagtggg

SEQ ID NO: 43768 - DNA, 948 bp, Bovine  19866881535819
gcggatgagcccaaaagccctggcagactcccccatgacccgcccgcacccctgcctctggggcacagcccagagagtataaaatggcgctggaggccgggagaagcagactggccaagtccacgcagccgctgacagacacaccatgagaacccccatgctgctcgccctgctggccctggccacactctgcctcgctggccgggcaggtgagtgccccaacccctgccccagatccagcccatgggagctgggagagtaagtgcccgggactcacgctctcctcaccccttccacgggcagtccctgtgacagtctaactagctttctgtagtcttaatccatttgcccccttctctccttgtggaggaagaggagggaagagcaagctgccagaggcaggggagggtggggagggctctagggatgagcaggggtgaactgggctccttttccttgcagatgcaaagcctggtgatgcagagtcgggcaaaggcgcaggtatgaagtgggctggacgggggtatgccccatatctccgagggtgctgcccactcccagcacccgctcttaccccagtcctctcagtcccgttctcccctcctgctccctcccatctggctctcaggaaggccagcctgctcctcatcttatccacccaaactgggagccacctgacccctgcccctgtgctccacagccttcgtgtccaagcaggagggcagcgaggtggtgaagagactcaggcgctacctggaccactggctggggtgagaggaggggcggtgctgggccaaggccctgcatctgcaggatgggctgggaggagcggctgctgtgggggcaccctggagccccaggtcccgtgggaggaggggcgggcactttgcatggaggctgatgcccggtgtgggtgggttctcagagccccagccccctacccagatc

SEQ ID NO: 43769 - DNA, 1392 bp, Bovine  19866881607883
ggagagcccacgtcggagggtgacgggctctccccactcctcctccctgttcccttatgcctcaacacacagcttctcaggccagtgctgaccctgacctccaccttccccttcctccccaggcttctctgcccacaggtcaaggtagcctgtgcgcacctcgctgtcaggcttgttccctccctagatttacccaaccccaaccccagaatccgctccctccccactctcctcattcatagaggaactttctgaactaacattttattgagccctggtgttccaggcagtgttctaaagcacttatgaactaacatttgtaaagcacataagacaatatttggcacagggtgagaactcgatcaacattagctggtgtccctgccttattatttcacttaaaccttgtatctctgaggtaagtttatgattataacaagcttgtaggtgaggaaactgaggcccagagatggtgagtaacatgtgcagggtcagatgccaggatccaaactcagctagtgtggctcaggactagtagccctcagccactctctatgctgccaccgactccgggcattacaggctcaaaaccctgccacatccgtcagctcacttggtttctacccccattccagtggggagatacgaccagggcatgtagtgtcttacatagtgtataaggagagctcagggatgttagggatttgctgtaagtcacatggccactgagcgtcagagcagggaatgcagcctgggttctcagccccccagacctgtgctcttcccacacacaaggtgcccacaggccactctgtgctgtcaactggacctctgcccttcttccccaaggccagatcagaagccccctgcctcccacccccagaagggaccatgtccatcagactggctttcccagggtgcatactgggcacagctctacgcacaggcgatattcttcctgtgcttgtgaccaacccagccagcccaaacctcacctgggcctttcgccttttggccgccatgaggaggagatggtaccgaggggcaacgggaaggctgatatcatccaggctggcagcaggaagcagaagggaggagagggtcttctcagggttgtcctggtccagagcctcattgatgaggctgaccgcaaggatctctgggaaagggagatggaggtgggcggagggcacaggcttatggctaaaggacggggctgtccgagttgggccgtcatccccctgtcctggactccactcacgatcagtctcttcctggacctgggcgttgacctggctcactgcagcctgtaggtcattccagctcaggaaggccccatccactccacatatctgtcgcagcttcaccagagcatcaaagtaccggcagcca

SEQ ID NO: 43770 - DNA, 1498 bp, Bovine  19866880498103
tgatgtgggcgtgatttggatcctgtgcattggctgtgtcccgtccccatctccaggtcactgctggcccccggcctttatggggatgttaaccatcagcccctcgtgctgtctacctatttacacctctcctgagtcagtactgaccttagagtggcaagagcctgggcattaaaaatcaagcccatatagtccacctgctggcataactaacgtccattaacctcacctgaaaccattcggttcggacaagacggaaaccaagcttcagttcatttacgagagttagccaaagccttccagggcagtgcatgaagcctgcagtgaaccaaagaccatgcaaaggccacagaatttatttctactagaattgtctcctgatctacaaggagctataatggcaaatagcagggccttgaatattttacaagaaaagttttccactcgcagtaactgagctgttcaagctctctctccatcattcttgtctcctttgctcctaaatgttctggctcttgaacacacacacaacttctttgtgtgcacgtgtgtttagatgtttgagaaaaaaatttcaagaagacaaaaataaaaggaatacagcaaacaatcaataactgttagaacaacaacactgactattgctaagcattttatctcatacactttggattttttattttgtaaaataaaaatagaccacattgtgattttctttgaccatcttctcccaatgcagagacatccattagcataaattgcttttatgctataagtgtatatgtatgtatgttatgtatacatgtacatgccacaagtgtatacttctggtccatttattctttaacatacacacaaatgcctattaaaatgtattagtatatgtgtgtatatatatacatattaaagttacatgaacagcatcatgctatactcttctggaagttgctctttctactgtatagtctgttttggagacatatacgtgatatgcacagatctaattaatttttcttgatttccaggataaggtccaggacaagtttgtgtaaaagaaataaaaattgcccattttattaccaagtggtacaagatactagggactccaaattacaatcagcacacagcagtggccttgaaacaagtgtccagctaatatttatcaaattactgtactcaccaagagtgctcatcacgccgtaccctaagcttgacaaactaaaaccacaaaggggcagctaccattaccaaattcacaaatgagtaggaaatgccaatctagcacctggaggaaatgaaagatagcgtaattagatttttaagggtgttgctttgaaggacaaaatcaattcagagctgggaaaggtctctgaacaggtgtaaagaggtcttcttggaagaggcagtcgtggagacaggtagtgaaaagtcagaaaaagttcaaacaccttgagaggctaggaaaggcagaaaggactggggcctgtaaaatagggtt

SEQ ID NO: 43771 - DNA, 1300 bp, Bovine  19866880600059
ctgccacacctgagcacagcctggaagcgtggaggcggacgcattcagtttccaggcactaccactagcagccaaagccggcccctagggcccacgtttgctcacggagacatctccgccaccatgtgaatgaacaggagtcaacaatccaagaacaagaaagcaccctatactagctgctcctttagttataattctctaacttctgttttgaaatttcctatttaaaaatgtgtgtgctaatgacttgataattgtttatggcttttcaatgaagcatgaagggctgacaaagcagatttacaaatgtcaagtacaatgagaattactgtgtcttttttctctaagatgcaattttctattggaatgctttcataagttaaaagcaacaccaagtacatggaagaactaatggcaggccttctggagaggtcatgagacagaagatattctgtacaaaagccccatgacctgcaccctaatccctttcagtatggcagccagggagagagcagtcagtggaggaggaggactctccgtgtcgtcctaggagctctgctctggcctgactcccagcagcttcacttttaaactcttgagaaaccaagaaaacagaaacaggtgaaaagaaaaatggagtacctgaccttactttcagaaacactttctgtgggagcaataacatcattatcatccagtaagtatcctccactttaagctcagcttaaactcagaacaatgccaggtatatctgccacaagaaaactgagaagacatttaaggtactaccttgaatatattttttaagacttaaggcaactaatggaacctccagaatatttgttaccaagttttctgaaaggcagtcaaaatattataactacaaatctagttaacactattacaattagtagtatccactgtagaacagttttttaagaatgactttatgtgctatgtacattttctacctatgagaatatctataaaaagatattcactttttaaatctaagaaaatcagatttttaatgattttaaaatattatcaaagagtaatctggaagaaatactaaactacggtgaaacaataggcaaaactcctcctccaatgtcagaatctcacctgcacagatcctaacgaatgatagcctcaactctggtatgatgatggaaatctcactattacaaaagggtacgcttattgggaagcacagtttacaaattgccctgctattctgagccaaagccagtaatcactggtttctgatctgcaatatgaaaataatggaattctaccc

SEQ ID NO: 43772 - DNA, 1139 bp, Bovine  19866880617655
aatgacgctggtatttcttttcttcttgctttatgggcattggctaatttagcacatttatctgaactttggtttgttaatagagttgccagatttagctggggaaaaaagaaaacaacaggctgctcatttacattttaacttcctataaacaatgtatacttttttacgtgtgctgcaaatatcatatggtacacgcttacactaaacatttattatttatctgaagctcaaatttaacctgtcatcctgtattttatctggcactcttaaatgttaaaaaattttggcacttgtttttaagagatctctagaattggtatattgatattcctttttagagggaaaaaagtctgattgggctctcactagactgtattccttaggagcacaaatgtcaagtagcgcctgaaatgtaggtaatcattaaacgtcttccagttaccctattttgattacttttgtctgtcttcaatcctgggtgcttcagagctcaccactgtgctggctatacaactaactgctggtacagtggaaacttaccgtgttccaggcactgttctaggtattgtgtgtgtgtgtgcgtgtgcgtgtgtgagtcgtgtctgactcttgtgaccccatgcgctgtagccctctaggctcctctgtccatgggattctccaggcaagtctactggagtgggttgccatttcctgctctgggaatcttccctgacccagggatgaacccagatctcctgcactgcaggcagatgctttactgtctgagccatgttttgaatccatccatcctgtcagcgactttatgataaaaatcgtgttttcaccctcatttcacagatgaaaaaacaaaacaaactgagacagaacagaggatgagtgctgggtctgtggcagggctgggtgtgaacccgagtcatctgggtctggaatcaaaatccataactacttttaatattgcctcttgcaggtaatgcttgtaaaaccacataaagagcttctaggaagaatgtctttaaggttttctaagccaaatgtcatctactttcatattaatcatataaaacatcttagtgaccgctgctaaagtagacacctcactacactgtatgctatccttttcttttcttcatgtc

SEQ ID NO: 43773 - DNA, 2071 bp, Bovine  19866880618688
caaaaatgtaaaggacacagattcttcaaattcttatcagaacaagggaatttgatctcaacaaatccactttacactttgtgatctacttttcctcctttctgtccattcaaatgacatttctccaagaccaagcctctcaaaagctcactttttaaaatcaaatcttccccaacttccccaaacctcccatgacttactgtgtaactgggcctgcacctgtgaaggagatacaccactcagtatgtgccgggctttgtgtacattagctcagtttacctccaacactctggggaagactattactgtcaccgtttgcagggataatgaaaccgagaccgtgcaggtcataaccggcacaaggtcaaatgaagcaggtgtgagggctggactggagggccctggctgtccctgcggcctgggctcttgaccatcatgcgcccctgcgcgtcccgccccggcccctccgtctccattgagctcggcacacacttgtggaggatgatgaggtttcctgttaggaagccatgccttcagtgcagcagctgccgtcaaacagcccccaagataacctgtgagctctgaatttgtgcaaccagaatgtgtgtatagtcccttaaaataaccttccctttcatgcctgtagggaataatcagattcaacacatagccacttatttcatttttttcttaagttccaattaacagaaaaaaaaaatccttagcagtcaattgcatattatgatattccaaaaatgttttaattacctaagtttgcctagtcataacatacttaatgctttttactcttaaatcaagctaaatatggaatgtagtcctgggaaaaatgagaaattgattgcaaaccattttaatatcctcatgaatctttttatggaaataaaaacaatttcagcgaagctctgagaccttgttcgtgagtgcaaggactccagggatgaggccccagattcaagcatccttagaaaatgaattcagaagcaagaagccaagcaccaaagaagctccatgtgaaaataagtcttgtgaagacaccttgatggtgatgcctaattgaccatccggtctttctctcttaagaacttacagagcaaaccaaagtcattctagtttgcttagaggcaaaactaaaggttcagatctctaattcccagtgtgaactctctcaacatgttgaactggataaagttcatttcgattctctgaaagttaagggtcatgttatgaatccatttagattatatattcaaaacagaaggaaaactaagcaagctctctttgattaccaaatatgcccatggaataaaattatcagtcatttcagccaaaggaaaatcttttcttccatactttttgatggcagttcattacattttacccccaggctactctgtactttctttgccaaaatccattacatgctacacttttataatatgattggtggaaaacaggtaaacgtattgcattttagatatttctcctaagggtttaaacatggtttacactgacatactcactcactcacaaatagctgcctagaagaacacagttctgagggagggaaaggccttgcaggtgtatattataacagatctgagacccaagccgagtgccagtgactacgtgcatgacacactggcaaccaaccgcaatctaagagttcaaagcagcggctgatgtcagaaaacgagggctccaaagtctataattacagctccgaagacaagcgaaactaaaccggtgagtgtcactcactgatgatcgctgcaagacaggcattttttggtgccggtaaagtatcaaattactataactcaggggggtttttggcttgtatcatattctatcttctaatccaagcttaatgataaaagctaaagtagcatattttggtaacacttaaaagtttcagtttaatgaaagatgattacactacaataaaaaatgaatccctacctctttcacctgttcctccagaaaaatgttattttctacaaacaaaagaatattttagaaatcatggaatgctcttaaagggcatttcatt

SEQ ID NO: 43774 - DNA, 1415 bp, Bovine  19866880710775
tgtttggcaaattttagcagtggtgatatatcgagattttaatttgcttggtgatggatctgttcacacatgaggtatatctggcttgattttgtcgtgatttactactgctggtgatcactttgattcgttagctgatgtctttacagaaattcagaaacagatgattgggattcagcagtgtctccagcatctaattcggtatgcaaggagggcatgtgtcatatttataggaactccgttatgttcatgattgggtgaatattttccctggacaacagcttaaagtttaccagggaaattactatgcattcataccacgtatatgaaggtatgtaattctgagtttaaatttctccccctgcacttgttctttctgaagcatctaagtctttgagaagcaaaacactgaatggctttttctttataaattctcagctctgtttcccagcatcccagtggagggccgtaatggtttaagtgtttggaagccgtgggaagtgaaagtcttcttggcacgtctggagcgggcccagtaggagcctgagtgaggcctgaatgatgctgctgggtgttgggatggagagctggtttattctcctgggtctgcaggccttgttctcactccagggctgtgaacaagatgctaaaacatattgctgatcctttgcctcagggagctgcatcaaggcttaaacttgatttaagcacataacacctggaaatatttttgtcctcttcaccccaggctggatttgaactactgacttagaggtgaagtgttctacagcctagatccaaatccctggagtcaggtaagctccttctcatgcattttttaaaattgtgctgggttcaaaaaagtgatggtaaatgttctggaggaaaaatatggtgatgttgctactggtggcagcgatggcaatattgatggaatatagtctgtccaaagttatcctgtgcattcaaaataaaaagtgtaaatcccccagcacaccatacaccaaaagcaaacaggtgggcacagtctacacgggaggagaccgtgtggctataacttctgcagaagaaacaggcacgtttttctgcagaggcttgtcagcgccgcacttcgtcaatgtgtgttccacggatggtctggttgcctcctctgtagtgatggggcacgctggctcccatccacagtgttcacccatcccttgagttctggagcagacagtgagactgtgtttcacaccggagggcttcttgacttcagcactgcttctgcctccaccacaagggttttattgtcacttctgtctggattcctattttgttcagtcagttgtctgtctttgcagagttcacaagtttcagcgaagattctgagaatgtttttaaacccttcagttaaaatagatcttcaaaaatca

SEQ ID NO: 43775 - DNA, 1681 bp, Bovine  19866880824392
acggagtaggaagttagattcaaaatgtagttatcccactagtaggtaagagcaaagcttacctagctatttccattctctccttagtgaaagacaagtctgatttcctagaggtcaattatttcttcagatctttgcgggaaggaggcaagacacatgattttcagtactgtgcttagtcactcagtcatgtccaactctttgtgaccccatgggctgtagcccgccaggctcctccatccatggagattctccaggcaagaatactggagtgagttgccatgtcttcttccagaggatctctcaaatccagctctcctgcattgcaggcaaattctttagtctgagccaccagggcagcccaagaatactggagtgggtaacctaacccttctccaggggatcttcctgacccaataatgacatatctaaaaactcctacacagtgactcagcataacctctcataatgacaaccatagaagcaagaatacacaaaccttctttatcctactccattcgtttttgtctttcaaaccctgtaattatctgcctcattgttctttgtacccagtagccattctttcacagtattcagtaaagaaatttatacattcatcctagccaaatccttgacaagaatgtgcttcacataaaattgccagatgattttcaaagaaactaactttaaaagtcacacatttgaaggttgatgtttaggcttcacaaagagaaatcactgaagtaaaatgatgctcaaaaatacttgcaacttacatctatgacaaagataaaaaggattcctggtcagaactactactcgtcaggaatcctgaaagcaatatgagactcaagctgtgaatctgaaaaggaacgtaaagtattaacaagtactagcaatgtaccatcatcattgcctagaaatattttccccttgcttcttaaatatcatccatttttatctggattataacagctcctcttctgtctcccttgttttgctggccagtggaatagatgagtcatctcaccatctgggctggaggaaagagagacgtatggctgaataaagctgaatattatctacataatgatggccctgcagtccaaaatatctctttctcagtgtcctcatctacacttagtttttcttcaaaacaaaattagggggtattctacaaaagcaatttctggctacttcttcccacctctaagtcaacatttccaaacttttggcaatatagactccaggcagcactgacttttcaagggcttggtaatggctgaaaagcctagattaaattaattaagcaaaatattatagcaccatgttttttgaggtgccattcaaaactcttcataacgccattcctcaaaagtaaagtcagcacctgaagagacaaatgtctgtctttgctttgagataagatttaaggttgcacaaatgttgcaggttttcagtttatcatgtatgcctgtctctctgcgtgtgtatgtttatatagtctttgctaaatgccaggatatagtggagaaaaaaaagccgtatatcttgccttcacagagtttacagatgagtgtgatcaaacatacaggctatctgtagaacacacatggatttccaagcatattaagacctgtgtttaaaacactgctgctgctgctgctgctgctaagtcgct

SEQ ID NO: 43776 - DNA, 1977 bp, Bovine  19866880864849
ttcctagaaaacttgcaagagaaggaaaactatacagtgtccaagcttgggtaagcatggatttcctaagcttgcattattcagatggacatgattttcctgccttgtcacttgccaggcattgttgcggcttagtagaaataggtttacattgaaagtaaattcagttgaattaaagacctggatttaaaccctagccctgcctttttaactaggtaattaaaaatttctttacccacttcaaacttactttcttcacatttaaaatagggatattagtccctactttttggggtcacacacattagatcttctaatatatccagcacattgccaaccactttgctgatgcttaataaacattggccgtatctgtagaaatacaatttaagctctcaactggagagttaaattggtcaactcagatttttctgtcctcagctccaccagtccagaaggaatgaggttttctcccactcagtaacacaggccggcaacagcaccatccgggctgggtgttcatcgccatggcaacagccatcgtctccctgcctcctgctcagtgtttctgctcccatttcccctcctcagagccagactcagcctcacagctccccctcagatgtccttttgaaaagaatagacaaactgtagcaaggataaattggacctctctctttttccctcaaagtaagataccactgtggtccaattttaaagcaatgtaacaaaatattgtgtttccattctgataacaacacaagattctcttaattggtggaaatatataagaagtaggcaagacttttgatacttagctctggtggatttttgctctttagagccctaaactgggggtcagtccaattgaagtgactgcaagagcaaagacacagatgtaggagagctattggtgaatctggaggtgtgtggggtagctggtttgttggaggaaaaggctgacacaggtgaggaatagagaatacggctatcgtgctagcttgtggtcaggctgtgatgtaacgggtactgctcatctcactggcctcccaggagacgtcgtctctcattgtcccaaatttctctgtaataatctctatggagtcctacagtccctgtgtctctgtgattctagcatcttcaagtgatccaaacgtgtagaaactcagcagtatttggtcttaagcagtttatcctctatgaccctgcatgcaatggtaatactcgcataaattattcttttagctgacagttgccaacaagcagatatgtctaaattttaatttttacaggaataatatttttgtaaacattaaactgacttttttttttcattcccagaaatcatgtagctatgtagctctgtatttaacagatcaatggacttcaccgtgtcatgggagtttgaaactgagaagtcatttcttggcagtgagtggaaaaccatattttaaaaaattcacagtgagatcatagtgttgaaatccaggctctgttgggggagatggagcgggggaaggtggtttaaatttgccaaaattcccattacaaatcaaatgctaagcctacagaatctggatgactgtattttatcttaagccctactgtagcgaggactgatattcgctataagggacatttcccccttagagagacagggaaagcccttccttttttgagaggaggttgccaagagaagaaagcagaagaaatacaagtcatcagatgtgaatatcgcagcggcctggccccttggggtttaaccgttggagtacgtagcacaaacatgttccagaagagtggcttatcctagggtgtatttcagagcatctccacagctggcatgacactgcatctagccagtgccaggctgggttttagaaatggctgaggaaggtgtctagagggctgagctttggacatcaccccatttcttcatatcctgccgtgtgctatatcgctggcagggatggggga

SEQ ID NO: 43777 - DNA, 1369 bp, Bovine  19866880887077
tgtttttgtgaagtgctctgttgccaggatacccagggtgaaggtgtcaaaggaagacacgttgaaaggacaagctatggtgaacatcccagaatcagccccttgcatactaatcgttccgatttaccctacgctgttcctgtctgctataggaaagatagaagagcccagtgtctaaataataaactatggggagaacagaaaacatgtattattcaaccgggcaatgcacacttcactctcttctttttcctttcctttaaaatgtagcactaagaccattagagagaaattctggtatttcattaaggcaagtaaggagatgaaatagatttctacactgacaacttcaggaaatttacaacagagtgaaaaggaaaataaaagggtgagaagaattaaagccacttccaacaatagcagaaagactccgtgatcactcattatttaaaaagcgtatactaagcactttgttaacaagcatcttgtaagcaccttccggggacatcgtatactaaataaagccctccttagacttaaactagattcatttgaagtagtagagatgtatggttctatactcaaataaatataaaaaaaagacaaggcaatgctacaagttgagagtaaagagctgagattgtcttggcagtaactcccaaggtcgcagcagacaacagatttattataagcaaataatatggtgtgccaggctcccaaggtggcttggtggtaaaaaatccacctgccaacgaatgagatgtgagttcaatccctgggtcaggaggatcccctggtgcaggaaatggcaacccactccagaattcctgtctggaaattctatggacataggagcctggtgagcgacagtctatggggtcacaaagagttggacacgactgagtaactgagcacgcgtgcaggacttgtcagggggtgggggggaatttgaccctggactctctcagtaatatcatcctggcctcgtgagttcactgtactgttagaaggtcggctggccatgccagatgacacccagactatcacgctaatgcagacaccgcatgtcaataaaaatgttggctcgctacctacattccagatgagaccaaacaggcctgaggacgtgcaggagggctaaccagagggaaaactctagaagttactctactggaataatcaagaaactgagggtgtttaaaccagagaagttcacagtgttggtgaaaatgctattgacacggcagaaatcgccaaaatcaactctaaacgtgtccgtcttggccaaaaattgtccgagctcaaaactggctttgttctctcactgtctgacagagtaagaacttgaatggcacatttcccaaaggaa

SEQ ID NO: 43778 - DNA, 1210 bp, Bovine  19866880918830
gcattcttgtgatggttaactttatatgccagtttagctagattaccatacttagatacttggtcaaacatattaagatgtttaaggtaccttttacaaaggtaacaacatttgttaacatttaaactttgagtaaagtagatatttaaactactgttaccatttaaactttgagtaaagcagattattctctcaaatgagaatgggcctcatcaaatcagttgaaggctgtaagaagaacaccagggtccctgaggaagaggacattctgccagcaaactgccttcggacctgaactgcaacatcagcaaggattcttcccagctccacagtcatggcagctaatttcttaatctgcctctgtcactgtcaaaccggccatcgctgattttaaagacaaaagtgggccacgaaccaatgaatgtgggcaccttgagaaactgaaaaaggaccaggaccctgagttataacactggtcttgcacaggagagtgatctgtgttaccagagatccctatatggcatggttttcaggaacacattgtagacataaacaagggttgttccaggaagtggaaaggacacgaaccagtgaaatctgaaacacacttgcaaccaaccacaggatctgggttaagacaatttatgattccaagggaacttggggaagaaccctaaatgaaatttaatatattgttccctgagttatttttgtttatgactctataggtggttatttgttttcctcaatcttgttgcaaaaagaactggaagagaaaggaagagcaggaacaatttgaccctcagtgaattctcaataaaatttatatatatgtcccatatatgtacgtattttgtgtatatattggatatatgtattttatgtatcccttatgggttctgtttctctgaaaaaccctataacatcttcctagacttttctacccaaccctgcccttatcccacatcttctgattgagaaaggactagtcccagtcagtgggtccataactcaatagtgaatgcaggtgaaagggatctacaaactataaaatcttgtgaacatgtatgctaacatcattattatcattttagcgttatcattttagacattcgatttgaaacactagatacaaggtctgctcagtattacataatgtgaaaggctggaatctgagagaaggaagagcacacagggcagagtgatactg

SEQ ID NO: 43779 - DNA, 698 bp, Bovine  19866880946652
tttgcacagttcgtgccccagaaccctccatcccagagcagtcccagagtaagaaatctttaggtgggagaagagaaacaaattaaacatgtcaagcatatcagtgctataacacagaagttcccgaaggacatctgaaaaaatctatgaaacatgcagacaacaggagttttaaaccatactctcaaaacacaaactaagtttgagtaatgctaacctaataaccagcttacaagaattttgtttgtttttaattagcctacgtctgcttcaacagatctaaccacactgtttgcttccaatgttaataacagagaaatacagtttaaagcaggggttggcgaacttctgcaaagagccagacagtaacttaggctttgtgcgctatgctgtttttgtcccaactactcctctctgcccttataacacaaaaacagccagagacgattcgattcacacaggaacaagcgtgaccacgtcgtgaattatttaaccatttaaaaatggaagctccagtctcccattgtggtcctacaacaacaggcggcaggccccactgggctgagttacctgacttccccagagttcaagcccagagccccgggcaaaaggaaggagagcgcttgcccggaacttccgtcactcttgtcccaccccatctccacccccttctttaaaaaggcctagttaggacaaaa

SEQ ID NO: 43780 - DNA, 597 bp, Bovine  19866880974092
ctttcctttaggattgactagcctgagatcaaaccgtaaatcctaaagtgggagctaagattgccacaattagacccacaggaaacagaagagagattgaacgatagcacgtggcagacaaaaaagacagaatatttgtgtaggaaaatgttctttatctttggcggcttagagctacactaagaggcattgctatgtagccaggagcaacaattattctttaaatggggttttcaagttagacaacactattactaacctcaactgaaaaacgagcaggaaaaaccaccgtcccaaaatggattcatacaggatggcgattaaccaactccagccaacagatcagatttcctgctctttgagaaacttaataaaactctaggacttattgattttgctcttcctctagacagaaatatgccaagaatatacacagagaaaataaataatctcgagcttttgtaagcgagctaaagcaaatgtggagttacaggctctcagagtgaacccagggacaggctggttcagcacgcagcaaacaggataaagattcatggccaggtgcttgtcttaacaaagatgaaacacctatcatat

SEQ ID NO: 43781 - DNA, 1992 bp, Bovine  19866881046368
tttctttggcacatcggtataattagccctttcaagaagagaacaaaactgtgttggaaacctgatttgaaataacaaacacctacgtgcagtgatgcagttttgggggtgggggactgttttttccctcttgcttttccttcctggtaagacatgattttatgcctttattccccattcagtgatcctaatggtcgtggcataaattttgcccggtgggtgaaacaccgcctctctgggtacttcttgttgttttggaggattttcttggaaagaaccaaacctgtggtttccttagagggctgcctggaaagtgaggggtccctgcccagccaggctccagacaagtgtctctgtctcttcttgcccaccccactcagtgactgtgactccctctcccctcaatttgcaatctcttcctgttcaagaaaaagatgctgtaagaaagggctttcagagtcaagagaggtctgtgaggcacctgagaaggctttaggggagagtccttgaaagagttgagctaggactcttaatggtgcttttgaactgtggtgctggagaagactcttgagagtcccttggatgcaaggagatgcaaccagtccatcctaaaggagatcagtcctgggtgttcattggaaggactgatgctgaagatgaaactccaatactttggccccctgatgggaagagctgactcactggaaaagaccctgatgctgggagggattgggggcaggaagagaaggggacgacagaggatgagatggctggatggcatcaccaactcgatggacatgagtttgagtgaactccgggagttggtgatggacagggaagcctggtgtgctgcgattcatggggtcgcaaagagtcagacacaactgagcgactgaactgaatgaactgaactgaagggtttttttggtagaaactgacagcctttcaaagtttacaaggaaatgcaaaggatatagcataaacaaagcttttttttttttaaggaagacttccagtactttattttaaagctacagaaatcaagggtgaggtattggtaaactgagggccacaaagacccatgaaccagaagagttcagaagtgggtccacaaatacacagtaaactgattgtcatttgaggttgaaatttggttgggaaaggatagttttttaataacaaacattgaaatatttaataaaaatggaggcaaattagatatacatgtgttaaaaaaacattcgtctcttaatctcacatcatacataagaaataatgcaaactagatctcagacttatacataaaggctaaaaatgagaggggagatctttgcaataaaggagcaggccaagatggcttaaataataactcatgctctgaatctaataaaaaaaacctcaacacaagacaaaatgaaaattataatacaacttcacttaaatatatagatatatatctacttgaattccgcaagagtaaaatattacaaatatttccattaaaatcagaaacaacacagtgttgtcttctaccatgcctactactgaacatcatagtgtaacttaattcatgcaaagagagaagagaaacgagtaagagataaaaatatttgaaaatagacctaaaaaaaaaaatatttgaaaataaatctgtcataacttctggatgatgcaattaactatacaaaaatcaagcaaagaaaccaaaaaactatcagatttaagaaaagttcactgagaaggtcaaatacaagaacagaaaagtcatttgttctcctatacactagtaataattaattttgaaaatataacgaaagggaccattcataatggcaaaagaaactgaaaagtacataagaacgaatctagcaagggaatgttcaagattccttatggattagaaactataagatatgaatataatggctactgaaagacaggaaaaggagtgggagatggaaatacacaaatttcctattaccctaatcaaat

SEQ ID NO: 43782 - DNA, 1229 bp, Bovine  19866881060120
aaatgaccccctgaattttaggttccagcagtgagtgtggggacttaggaatgctgataatgaatggaagtggagcttgaggttttctcccgagagctcagagggtctgtaaacccgggccttgtggttatttcccaagtttccaaaagcatatttggcaactggtcaaactctcacttcctggctgttcactcgagggtgattatgatgggaagggccaagaggaagcccctggaactgtcccctttctaaaagtagtaaattaatagtgctacaaccctggggaacctttagggattgatatgatcaccaaaggcttgaaagatgcaggggtgatgattcctatcgcattccaataaatctctcctgtttgtgcagaagaaagatgacgtttggagaaaaacagtacattatcataaacttaatcaggttgtgacactaattacaactcctgcctcaaacgttctgtcttctctggagcaaattaacacatcctctggcatccagttatgccgctattgatctggcaaaggctttcttctctgcaccagtgcacgaaggccactcgcggcaaatggaaattctgtattaagcctctgacaaagccagataagagaattacagtgcaaccgtcagggttttcgagcaaaacatgctctcttcgacagacaattcctcttttgagaaatagctcttggaataagtctggatccaagtaaagactgaatgacacagcattcacgcaatggcacggcctgagctgcctgtcacgaactggaagttgctgagttcactgagccacagtgggcatggggcggcatcgctccagaatcgagtggaagtttatgaacgagaccatgttccccgaggctcgaagacggaaaagctgtgtgagcagctggctcagtttcttgtggctcctcctccggcgtctttgttagctctgccttgacccacacgtgcagtccttgatggcattgccccgagatcatccggcttgataaacgcccacaactgggcctaattttgagaggattctttttttttttttttggggggggggacagttgctggagagaatacacgttggaggggttctccaggcaccaacagaacatggacctacatctaggtgctggctggttagcagatttcaggtaccaggggggaggcagagaagccttgggaagggagggaagagggaccagggccatacgaggggaggccag

SEQ ID NO: 43783 - DNA, 2434 bp, Bovine  19866881077991
gtagctatcaagctacttgaagaatttaaagctatgccccaactcacatagtattagtgttaattgccagccccctaacaagaaaaaaaaaaaaaaaatagcccttaatgttagtgcaattaacattctgatccaggagtagtaagctggctgagagactgagagcaataaattcagtgcagggacatttcctgaatataaaatgacccttagtattgaccctgagatgaaatcaagttgaaaattgattggggaaaaatcagatgggatagttataacatattcatgattttatcgttcagaagaaattagaggccgtttctctcatcactgtatctctaaaacgacagaccccccgaaatagtctcgggctaagcagaggagtgcccaagtaggatgcatggctcatcgcatgtcaacatcagttttctgggcttttggcgcctcatccccagtcttcatcgatggaaaactgtctgcagaaccttggcacaaaaattaccctgtggattccaggagggtgtatagctttttgcagcagtttgggattcctactgaaatcgccttactaacctgacctttaaagtccttgggcgagtggatgagaggatggaggtcaaagaaaggagatgatggaggggcgctcacccattgcttcactgtggcgtgtaagaatacgcaagatctgtcacaaagctgcattctaaaagaagcttcgattccttattagaaactgatcaaccaggttccagagcgctaagggaacgcatgtgttctgaaatcggcagatgggtggaaatcttctagaggtagaagccagagagtgtcatatttgtctttgtatcacctatgcgtgagctacgggaagcactcagagttggtggaaaggaaacctatgggggaggggcccatttttggtaaggttgcctaaaaattcctcacactaattaaataaagagaatttaaaataaagatcaggttggaggtacggtaaaatctttgtcctctgggcttgtatgtctggaaatgcatcttttctgagcaaagggcagaggtgcatcagttaatatatgtttaactggaaatgtcaaagtatcttggaggaaaaaatgtagataatctgtagtcttaagagtctggttattcttttgtgctaacattatttataatgtaagtgagagacatcaccaagactggcctgaaaagtgataggttcaaaaggaagtttataatttgcattgtgtgttgatatgccaactattgtccaaattttcaaccaatataaaatatctttaaagttttcaattgttagatttgttggaaatgaaactgaagctggcaacatagtaatattataccatttttatgagttctacccaaaagattggtacatatctagctacgcatgttattctggaaagctgaaatcatagttaatgggctgtattattacttgacattattgaactcagtgagtaaatttttaattaatgaagctgataaagttacagaaaaatgttatggactccttttttttttttaggtcttaaaaaaatgcttcctggagtccacattctacttaaatggactccctacttcatggaaatgagataaaaaacatttaaaatctgcttgggcatttaagatatcaatggttcgtgaataagaaaaaataaatcacaagcggacactaaaagcatgtctctggttctaacttttttaaaggaaattttatttacacaccctagaatcacgtaatggactcacgcaattcacatgcttgtcttacctctttccaagtgggtttcactgccagatgcaggcccaggggccgccgtggcccacctgcacctctgtgcctcctcccgggggccgcggaggagggagcgatgcccgccacgccggggtcaatgagggcagctgcgtcctgcacggcgaggcgtcaggggcaaagggaggcagaggacggttacgtgggccgcgcttgcgtttgccgatgccgtctccatggtggtgcgtaaggcccaacatggccgaagtaattaaagggtaatttaatacgaaccttgtgaataaatgaagactaaggatggaggtgtgttgagctgactttagacttacagctgtgaaagcaagatgtggtctccatggaatctgatgtttcactacagtagaagtgagacatatcctgattccagctgttgatctgagtttgctaaagggcaggatttatacgtgcagggaagttagcaagccgcactcccgaggatctgtccttcagcctcttgggggtggcagcttagatgccacgttatcttgcaagaccacagactgcagtccaccaggctcctctattcatggggttttatgactctgaaaaaaagaagaaaacaaaccacagaaaaggtggtgaggtccgggatggggagaagga

SEQ ID NO: 43784 - DNA, 1282 bp, Bovine  19866881094197
ccgtaactgctgcgaactgtgcacggtgcctgtggacacactgcctcctgaggaagagatgggcccgactgtggcgggactctccacggaggtactgaccccgccctcctcagggacgcgccaggcacgcacagacgacgccacggctccaagctgctcagattctttggcgatgctaaatgcctctcatatttcagtgcattctggcaggtggcaaggctagaaaatctcacactgtgttacaagtcctgaggcaggaaataagcagtagaaatgcattttccagggcacttgttaagatgtcaataacagttatcctgttttaaccaacaaggtagcatgacagaaagaaaggggaaggtggatgggtgtcctcagataagtacaacaaagaacattttttcccaacaattttcacctttccagaaactagggagatcaataaagcaccaatcaattcttttaagaaaggcaaaataaagtataaaccttaaactccctcttacaagaaaaggagggggtggtgaaaacaagttgagagagaagactttattcagtaagtggtgcggacattgaaatgactggttaactccctataagaaacagttaagcccaaaccaaaataaatcccatacataataaagagttacatttaacacatacagatagagaggagagatatacagacagatgtctagggatgagggcttccctgggggctcggatagtgaaatggccacccataccaggatcctcatctggagaattccatggacaggggagcctggggcctacagtccactaggccacaaagagtcggacacaactgagtgactaacacttttcacttcacaactatggataaatgaaaaaaatatatatttgaatataaaagcagggaaaacaatctgcaagaagagcggatgtaggtatcactgctcaaagcatcaaggcagtatggctccacgacgcttagctaaacagcttaatcaagttcctcctcatccctggaaaatcagcattctagacggaactttccattctagcttgatccatggctcatcctcccttgagattctcccagcatgccctctcccaaggctctctttccctaaatcacttccctctcctgagggtgtggttttcccagttagtgcacttgagtggtactcctattccccagttttgaaaccttcacagaagtttctgtttataactcaggctgttgatagtgcaagaaaagggagtgatgaagagaagagagttggacaccagatacaca

SEQ ID NO: 43785 - DNA, 1588 bp, Bovine  19866881100872
cagtggtgttttgttcactgcaaatatgcctgggagcacaggctgaatcttcagttgaattttctctttgtctctcctggctagtattattttgttgtttctttctaaccactttcatcttcagaagaggacgtctgaaattcctggttgttctgactgacaaactcagtattatcagtggacctttccactaaaggtgctgaatctacctctccaaacgcatctcttaattcacagttgaaagagggagctgttggtgagagaccagtgtatgcctctgcctctccattttccagctcaaataccgtatcacccagtgctgcctgatagctgccaccttccacaacgcctgcagagagctgaagatggccattatcctctccgtgtctgccgtctggatcgtaagagtcagtatgagccaatgtaactccatgctggacgcctgaagcattacagactcctggagtacactctccctcagagtgactgtgcagatctgtgctgctccctaagggctccctgccttcctcgctatgacgcactgcagcaaaggatggagtgctctcaatggtttggttcaatgctgtatcacaaatgggaatttctgcttcacttttttcaaataaagggtcactgggtacagaagaatgaacttgatccagtggactggaaccttcacagaacaaaagaaaacatatttagaggggctaatttagataacatgaataatgactctttaactaaaaaccataccaattattacctatttgagaatatgagtgaatttctctgactggtgcttctacactccctaacttaaccgggagcggcagactggttaccctatgagttcatttatgccattgtatagcctctcaatatcctctctctcggacatcttctgcaggtttttcacccaaatcctaatacttaaaacgttctaaacaagatatttaaaagacaaactaatgagagacctgagagaagtcacagggtaatcaatctactcttccagttgttggaatgggcaattcaaacttaaaaattattttattacatgcagatttctttaaagtgtttataatagctataagaacggcagatctaacagaaatgagactgtgttatatgtcaattcagaaaattatatctcagtcactagatacataatattaaaatttctatccccaaaatgaactgttataacatatctacaatgagttaacttcagttatgttacagctatgactgaaaaacaacaaaaaagtcaatatattgattctctttgtcatagtttctaagaactatgagacaagagtaaaatgctatataccttacaaattacttccagcacaactatcttttacactaatgtataactagaaaaaataaagacaccaagacctgtcgaaacaaaattttacaaattataaataaagttgtcctgtcatatcacaaaaaggcttctttagcagaatgaccttagctaataattcatattcttgaacataaatgacagaaaaaaaacaaccctagaattatcaagtttgctcaggataaaaagaaactgacattccagtccaaaaat

SEQ ID NO: 43786 - DNA, 797 bp, Bovine  19866881124420
ctgcatgtgaaatcacaaggacttcttgcaggtgctgctgctaaggccctatccctgggatctgacgaacttgctctgaagcacagctgggcctctatccatgtggcctgaacgctgagttcatttcctcaggactgcaattcccaagcttgctctgttctagcgtataccacttgcccagtctccttatgaccatcatgcactggcatgaaatgtttagctgggtttcgagggatcatgggtaactctctcggggtacaggttgtctagaggagagcgcaactaaacgggtgcactaaccgcctgaactaactacggataactacgttagcttgtgttacaaaaggacagtagcagcatctacccaggaaagcaagaacatgttcagtactcaatacaagagccaaaatgatcatacagtgttctaggaataagtgtttacaccaaaatgcttagaatcaagtggaagagaccaggataatatctgtaagacaaagaagaacatgtaatgcatatgctcaattggcatgcagagagattctaataatactggccacagttctttttaaaaaatgagagaggtcaggggttggtgtaaatgaaggaagtttcccaaaggcggtacaacctgaaggccctgagagaggctgaaactttctcaaatgtaaggggatgagaagaatcaatagattttaccctagaagcaattgcctgtttttcttctcatttgcttccttatacggatgccccccattctagaagaatgcacttcactgcacacaccccaccaacagggg

SEQ ID NO: 43787 - DNA, 891 bp, Bovine  19866881143564
gttgtgaaacctgaagacatttgattggactgtacagaatccataatctttgctttagaaaggaagccacattttttgctctactcacgaggtcatgatggtcaccctgtggctgaatatggatcggtttctctctcatttcccagacagtccataaagatcatcctatttatttaggactcctcattcttttcttacctacatttcgggttacagtgaagattttatctttctttaaaaattgttagtttcatttgtatttgtactataggtgtatgtgccacaaaatgacagttactgcttctttgtcttagaaaaaaatgttgcacacttttttctttaaagtaaatattttcagttctgttttgtgccaggcgttgtgctcggcatcagaatgcagtgggtacagtggtgagtaaacagctgtagtgcctgttctaaatatagtgattcatttagtgatgaagattgggaaaaaatacatgaataaaataggcaaaaatactgtggaagaatcaaaacaataagctgacaagaagtgtgacacgaggaggcctattttagagaggacgcctggagaagaccgggcagaggggcgtctgggaagcggcgaagcgctgtttacagacagggcctgcgcaggacctgggtgaggcgggggagctggctgagggcagggacgagacaaggggtgggctgccatgccggcgcagacggtaaggacccacctgcagcctgggagacctggcttcagacgcctgagcgtctaaaagcagcacagcacaggagaagggtgtggctacgtagaaagcgaagaagaactgaagagcgtcttgatggaagcggaagaggcagagtaaaaagtggtcttaaagctcaacattcagaaaa

SEQ ID NO: 43788 - DNA, 701 bp, Bovine  19866881154918
cagtagtccattctctaccatgatgcccggttaacactccagatgataaacacacttgtaatgacagtttttttctgttctaaacttgcagttcagaatgcagtgatggagaatggtctgcttctttgcctcatcgattttctggtacagaaaaagatcagtcctcaagcgatgaaagctgggagactctgccagggaaagatgagaatgagcctgaactacagagcgacagcagtggtcccgaagaagagaaccaggagttgtctcttcaggaagggtgtgtaccagtaggatttgtgatttttatgtgcattgcatgaagtgttacgcatcacatgcaaatgttgggtatgctgttaatcacatttgcaagccctatgtaggaccagtagatcctgctgaattttgttatgcttttggttattttccaaagaacaattaacttgaaaatactggtaattacagtgtcttctcttgaagtacagtctgtgtttccattttgctttattaaaagaaaccgtgggcagttaaacgattgttttggttaagtcaggtatgagtgaatcagagccacctgcttctctggagatgctgacgaggtggaagggacggccgtcgggggagtcagtggttgttcctggggacacaggcagttgtaaaagccggaagttttactgttgctgtctgattgcattggatga

SEQ ID NO: 43789 - DNA, 1302 bp, Bovine  19866881196146
ttaaaaattttaagtattttgctctatttctcactcaaatctgagaaagatacgaggcaaatgtttattgccaatgtattaaccaatagctactacgcaaaaagaaaggtcagtctagtattggaaaaataacagaaatgaaaacaaccactgccaaaaagagacagggttgctaagcaacaaaaacaaaagcaaagcactcagtttgcttgttattcatacttgtttttcacttatttacaaaatgttaatgttaaacctaaaaggaaaaatcctccattatacattatatcagttcatttttcaaaatgattaagtaagtgcacgctagacctaggaaagcagagatttctcgagactgacaggaagaaggaagtgtgctggttctctaggagtgaaacatgtctcagtcaactccaaataaaacaaagctgagcactcgatctgaagaagcggttatgctgtggggagaagggagacacttaacgccgttgatctgaatgaaccaggaggacggatgggtaagaacgactgagagtgtgcagccacggggcttccctgaaagcagagggcggcagtgagagagtctaagctccctgggtgtgcgatgctctttcccgcctcatgtctttgctgcgcagctactgcctttacccagcatgaccctagtgacaagcctctctggctcttctttcaagatgccaaatgtcacatttctcattaataacaaataattaagtttttaattttcaaaacttctttctaaagatattaccacattgtatgagatcataaaccactagcataatgggaaaaaactatttaagcactgcaaaaccagactccaatactgatatattccatgtggtcacttaaaatttgtttaactcaacgaagttagtaatctttaatctttacgtattctatttctgatgcaggttatcatgctgtgccagtatttccgtgtcagaatttggcaaggcaagttatataacctgggaaaagtcctaagaatatataattctgtctcatgatgttctaacttttcttctagtatatagtatttccccctcttccagttttactgcaatataattgatatacagtaccatgtaaatctgatgtatatagcatgatgatttgacagagataacattatgaaaccattatctcaacaagtgtagtcaacacccatcatctcaatagatgaaaaattaaagacccagaaaaaaattatttccttgtgatgagaaatcttaagatttaccctcttaacaattttcacatataatgtcagtataa

SEQ ID NO: 43790 - DNA, 1025 bp, Bovine  19866881236673
ttgcccgtaactgtgcgatgcagagcaagtgcgtttccgatgaaactataaaatggcaacagaaaatggggcaaaatgattaaattctcaggaggcttaggagccgatcagatctggtttcaaatttgcttctttcacttaatcgtgaacttgggcaaattagttaccctctctgtgtctgatttcgcttccataaatggcaggaacaaggcctgctccgcagaactctgtaagacaaacgtaatacaacggaggaagagtgtagcaggttatttaacacatccacagcgctcagaacacggaaattctattatttacctttattgttgttaacaaatgtgcttacattttacttggaaagatacagactgaataattaaggacaattctttttaattaggatgttgtgaataagctagaaatttctcagaatgaaatgctggatggtttattgctgatgacttaattataatcttgcctaaggaccatggcctgaaaatgctttctagccacacaattctattttttccatgttttctcagcaataaagaggtcagtcatagtattgacctacttcataagttttttgaagaatgtcaaacttgagtgtcttaaatagtttgaaaaatgcaagtaacatatacattaattatcttttcttctgaggtccaatccaaaactactctggtaagccactgactaaacagtctttgtctatcaggcacttgccaattggaagaacggaaatgcccccaagtagtgttggaatatattttggtgagtttccatggcaacgtatagactgctttagaatgccttaactccataagactcagttctgttacagtcaagataatcaatcacagtattagaccaccttgaagtataagtcaagccaatttccatttttattgagtatattatactttaataatttctcttcatagtacacctttcaccttatgtgaaaacacaaataacttgcttcatcttcaactgccatctcaccacttagtgcacaacca

SEQ ID NO: 43791 - DNA, 807 bp, Bovine  19866881263370
agaaatgtgagccagaccctcacaaatgtttcctcaatggggtgtctttcctcagcagtttagtattttattcttctttgcgtataactttactatttttagagaattatctctaaatatcctgtgagcaaaagattctggaaggaaagttattatacctgattttttttttttttttttttgcatttgaactgcagaattctgtagcagaataaatattcttgtttgttacaggcaccttatctgcagaaaacagtactacactttcagataaggccactggatgtatcagtgtttaagtcataattatgatgtaaagattaatctctgacttttttgcttagatttttctttgatacagcttcactttactttttcataagttctctaccataaataaacataactactgaaatccttttcctgcataaaagtcctttacttatttattcactcaaatttttgctgcttactctagcagggacagaaagataaagagaacataggctattttctatattaataaactaataatgaaaatgttcataatcaactcttaacagttaaagtacagaactatggcatgctgctgctgctgctaagtcgcttcaatcgtgtccgactctgtgcgaccccatagacggcagcccaccaggcttccccagtccctgggattctccaggcaagaacactgcagtgggttgccatttcctcctccaatgcatgaaagtgaaaagtgaaaggggaagtcgctcagtcatgcccaactcttagcgaccccatggactgcagcctaccaggcttcct

SEQ ID NO: 43792 - DNA, 593 bp, Bovine  19866881270166
gaggttgctttcttaaataatacaattgcaaacatattgcaaacttacatacattctatatcttgagttcactaggaaaaataacctttaaagttcttacactagctaatttattatacattttatacaggtcagattttatggtatttaaggaaaggctgctataaaatttgcagagcaatgagaagttacagtgtgtcttgtgatgttcagagtaaattgcaggtttggatcgaatttagagcctaaagatacatagcgtttcatcaaaggagtcaaagcagtgcccggtgtctcagatgactttgattctagtagtgaagcagaggtgtaggtttatttcagaaagtacgtactccatcccggtgcccgccctccagtcctggctcgtccctccccctctcattcagttcatcactggcttccgctgcatcagataggggcaaaagcctggagcgctgatgagctgctctgtctgtgggtactcttcagtcctcctaggggatttcttagcagtgttgacactgaccactccattcgccttgaaattctttccttttttggtcttctgtggcccagagctcttctcctgg

SEQ ID NO: 43793 - DNA, 2797 bp, Bovine  19866881340157
gcgctgctccttggattagcagatactcgttgagaagttgcttggcgtcagacacgatgctaagcaaagcaaggcctgaaaggtgaagggacccagacgcccggggagctgaacgcctagggaggggcgccgcgagccgcgtccccgagtggcctggagagctggcaggaggcggcgtcctctcagcccttgggttctggggaggccgaggtgtggaagactcactttgagcggcacaggatccggggagtgttaggaggtgaagaaaggtgaacgggcagggagaaggtggatgagtatgacacagtgtgtttctgagcgcgaggtccggaggaggatggagatgagaaaagggattccagatgggaattccagaagaaagcagaccgctgaggtttgcgtcgggttgaattccgcatacgcgtgtgtctgggtcagtgtgcggtgccactgaaatgtcctacctgagggccgaggagacagaaacgtgttctcccgaagccctgggcctggacaacaaccgggtgccgtcgggtggggccgtgatgagcgctcacttcacagcttgcggacggcctcctcgagctctgcgctcacgctggcagagcgggagggtgagtcccagcgggagtgatgcggcagggacccggcgctctgctctctcttccgttgcttcttgggtctcagttgcctcctctgcagaatgagcgagtggggtctagactcggcccttggaggattccaaaggccgtgtgaccctgtcttctttctcccctcagtcccttccattcttcaccacctcttttctgcccttctctccttcctttctttttttcccccaaaatattgaacactcacaagccctctgctggaccttataagatggatgttgtgatggtctggcacatctcattttctcatctgtccctcctaacgcagcgcagatgaacctgtagaaaggcccaggagattgtgttgcccagtctgatcacttcttgtccatgtccagagttcgccaggccctttccctccgtcgaccagacttcctactcctcagtcttgctttggctgggcctcgcactgggcagaactctattctagcccatgaagaaggcaagtgaacctttctgcacatgtcaagattatagattggaagacacaggatcgcttgtgatggcctgcctgtttaccaaatcagaatactcgatttgtatatttgccaactcggagaaagcgacctccacttaccagttagttgaggctccctggtggtccagcagtaagaatctgccagccagtgcaagagatatggattcaatctctgggtcagaaagatcctctggaggagggcacggcaacccactccagtattcttgctggagaatcccatgaacagaggagcctggtgggtaacagttcatggggtcgcaaagagttggacatgatttagcaactaaacaacaacaaaaacaattatttgatagcatgtttatgctgacaaatatcaaatattaagaaaacaaagcctctatggatccaatggttagtgttacaaataagaaagtacctgctatatgcctgctgaagtcagctagactcctttctctggcgtctcagctccttctctcctcccagaatactcaccttctagacacaagtggggagcagtttcctgtggctgaggtttctagggagtcctgttcctgagaacttgagtttctggaatcttagaaacttttctgaattgccaagaagaggtgactgtcctgattattacttcttttcttaaaatggatagtactaaacaaatctgtgccatttcccctcttcatttagataaactgctctcgactaccaggaaggctttgagaatccctgggtgggtttctgagcagtttcggccaacaaagtgaaagggcaaatctccatgtgcgagatggcacacagattgcaccgtgcccatcatccactctgcactgccctctcaggggcaggcagcctttccaggcctccttgtccagacccctcctccctggggaagtgtgactctgcacagagttgggctttgctgtcgtcaattgccaagagctcatgattagctggacctgcacccaggtctgttttgccccaccagaccgtcttcttgtctgggatcgctcctccctgcctgaggtcatcatgccctggttattcacggtccatagtaaagctcttttcagcttgctttactttatatccactctttcatggctgttttaaacacacaattactagggaagaatatctggctttgaggtacaatgtcaacatcaaacacctaggccccgcggtaacgtggcagcctctaccttgcagaattagaggttctgttttgataacatgggttcgtctaatcatttgaaatttcatacaaacacatacctatacacacttttccaggagacaaccacaatggccattttcaatgacataagaacttgcatttcagtgactatacaaacatcgacccaaatcatctgccaaatggtttttgttcataccaaatctaaatatttttaataatagtagcaatggtaacagtaccatttatgtagcattcactatatgctggaccagtttctaagcagtttaaatgtattggctcttctgaaaacacactaaacccagctgaggggatatctaatgtaggcagacgctgtgtgcccattgaatgcagagaattattgatattggactgtcttgtagactcacgtcccttcggtcatttttggtaaattccttctctcttcccagggca

SEQ ID NO: 43794 - DNA, 1329 bp, Bovine  19866881344139
aataagctaatgaacaaaggaatatggaacagctgacttactctttggcctatactcttaactgccctctttcttgttgtctacttatttccattcctttaaaaaatagcttctttaaagtgcactgtataattttgaataccaataacaaataatgttaagctcttaaagggcagggactgtctctgccttttaaactttgtttgcattaagcttcctgttccagttagtgtgttgttctgtgagaaggcattctgaataattgtccctgactaataaatgaatctgtctgttggtatcctagcaaccacagttgaatctttttgtcttagtgaaagaggttaataacctttaccctcaggcccttctccacttgagtcaaaagtaatggtcagaaacagaccttttaaaactaaagcaattttttgctatcaagcaaaatgctagagaaaagaacctcctgacttaattttcattgctccttaacaaaaatagaatttagataactaaattattctgtaaaaaatggaatcattcagatcatgaaaaaccactcttcagtagaggaaaagagatgagtatgtacacatacattccaagttaaaattcactctgtgacaggaagtatttgtataatactcctaaatgaacgtgcagtttacttgtaagtgaaatttatagagagcttttccttttctgcagcaacaatttaaaacaaactttagcccagtagttgatttcatcagtggagttttgtctgttggggctagaaatatttgaaataaatttttaggaaattcctatattaagtcaccatacttaaaaaattatgttcctgcatttttgtgtgtggagatatttttctttttgggttgaattgaaaaggtacatttcaaattatatttatatattaataaaatttctaactatgtctttttctagtacataaggacatgtaaccattatcatgtaatattttatgtggtttacatgagttaaaacaaacttggaaagaaattaagtaaatgctgataattgtgtactgttacgcttttgaaaagttttgaatcatagaccatgaaattaaatgttagttgattgatacatgttcatgttgtatttaataagctgattaaaacaccattacagcacctttatatctacaatcttaattctttgcttcctgctagttaactgtggaaatagttaattttccttccaaggaaaaaagtgtgtagagagaagataaggtatactaaatgaaaaattggacggcatattggttagtcaagcaatttgtaaaatgaacattagaaaataatcccccca

SEQ ID NO: 43795 - DNA, 1936 bp, Bovine  19866881366071
taaaatctagaaattccacggtttagtttctcagatattctttttatctgttgcctttatggacttcctggtgtctcagctggtaaagaatccacctgcaatgcaggagacctgggttcagtccctgggttggggagatcccctggaggagggcaaggcaacccactccggtttcctgggctggagaagcccgtggacagaggagcctggcgggctgcagccaggggtcgcacggagtgggccacggcgggtgactgagcacacggccgttacacctgcctctactgtgctgtgtggtgctgactcgcagaaagaaaactgtaattgttactcagtgttttgtaaagaatattgtaatagtgtgatttcataaatattcactgtgtgttgttatttgtggtttcagataaggaagtgcaggcatttcatctgattccgactcagacgttgcttgagaaggactgaaagcgtgactccacaacagtgggcctggttctctgctctggagtaagagagcaggctttaagacatcttgttatatgttttactattttgtatgtcaacgttttcaagcacatattttgtatctgagctccatttgcacagcttcctaggtggtttatgtggagtcaaggcggaaatcctgacaccagctctcccccttggcttctaaaacgcctcacgctcagttatctccttccttctttgcgtggtcctggacgaggagctcagtgttcctcattgcaagtacaatgcaatccatttataaataattcatatttacattgtacatcacttacacactataaaatattggatatatttttggctttctacttacaatttcaggattcttattgcaaatgaattaattgcattttctccttttgcaaggttgaggtgaaaactaatgacagagataacagattttttttccctcttggtaattagaaaggctttagcgtcatcatttaatccccaaggacagggaaagtgattactctcaatgaatgaattgcagtctacagttccattttaattaaacatttattttttttacaatatgagagattcattaagtaaattttaggaacataaatgcttgaagacataggaattgttttaaaggttcctataaaattattatggaatcacattgtgattcctaagaaatttaccgtttatgaagtcgatttacaaagggaactcaggattttcccactgttattttttggtgatatttatattctaatttttgttgttgttgtcctgcaattgacaaatcgtcagatgtgtaagggactacccttttcacctgagaagtgcacttctagaaacgtttctcaaggagaggaggaccaggaatttggtgtttctaggacacatttgtcccgtcgtacacgtgggcgtctctgaagactggagaggacttgtagcgtccgtttcaccacgcagggccttgctgccagcgtgctgcgagggccctgagggcctgtgcgcggctatggcccacctggcacagctttggctggggctgtcaatcacggcaggccagattaaatcggttctgcaagagcccacaggccatcttaatagctgccacctgatcaatgaagcaagctgaattgttacagaacgtggaggctgtgattagaaggcaggtaattgggtaactgtccattttcaggataagctagatctgtattgatcatgaaaggaaaaagtctgacttgattaacgaatcttctcagcatccataagctaatggtaggttttaaaatgtaattttgcttctggtcctcagcaagtggccaaaagcagctaagggaggggctacggagaaagagacagtgtttataaatccggagcttcagccatcatttggggaaagaggcagaatttctgcttcgggcaaagggtgcctctaccctctgaa

SEQ ID NO: 43796 - DNA, 1019 bp, Bovine  19866881401179
tcaagatactggcaaacacataaacctgttttaggttccaacagttcaatgggcttcttacttcaaccctggtctcagtagcagaagcaaatgctatgtaaaaacccctttccaatatctcagagcccagagggaaaatgaatatgtaatatgctgggtgacagtcaaaggaaatgctaaggctaataacgtttcagctgtttgaataagggtccacatttctatgtattataaatatcacatagtatttaaactgaatttagctaaaaaatattcaaatatgaagtttaaaaagtaaaaagaatgttaacatacccagttattttcaaaataaaacaagagtagacagaaaatgggctgatgataacaaggcagtttctgttaaatccactgtctatgtgttacaagtaggaaccatgactatacttgattgagtcacataaaataaagaaggtagatgttgtctgcatgaatctccttttagttaactagatttttcattttaaaaagcttatagagctgaatactgctaccacagggggaagaatcaaacaagtcattgctagcatagattatgaagatcacttgagctatgtttctgttaaattcccataatcaattggtattcttcagggacaataaaagcttacagagaactctgctagaattaacaggttcttctctgcaacagctagcttgcaaatttagctacagacatttaatccatagattcatcttcaaaaagggaaaaacaaaccattgcataaccattacactagcagtcaaaacaaaattctgtcagtaatgtcactagatgttaataatgttatagatgtcagtaatgttaatagtataagctcagaatttaaaaaaatgggaacaaacgtatgtgtctttttttttttcctttctggaaccctgctctccaacaaaggatttgaggagaaatatttcagctaaaacatctacttctgcttcattgactagataaagcctttgactgtgtagatcaccacaaa

SEQ ID NO: 43797 - DNA, 1124 bp, Bovine  19866881424174
ttgttccacttcttgtagtagaagagcaaataaaaacaaacttcgaaaaattaccttggtaaaacaacaagtatggttttttcagataaatatttaaaagaaaataatagaaatgggtaaaatgatgtgaacgcatagataggaagctgttaaaatcagcacactgtattttattgtgatcagtgatttatttggccacatgataaaggctataaatgcgttccactttcctctgaatcctaaaaagaatgtttcttgttcacattagactaatattctttagaaaataatttgaatttaagaagctaaatatttagaaaaattttggttagattgcctattaaagagggtttatatattcagcattagtaattgccagtgaggaaactctgaacagctgccatctaggattctaacatatcactgctgccatctaggattctaagatatcactccttgttaaacgtgcgacacaaactccatagccccacaaggaagtcgattttctctccagtcagagagcaagttcaagattagttatgcattaaacagtccatttggggaggctaattagagagagaagaccttgaaatagaagtcatcagaaaaagctagcagatgagtcttcccggagacttgatttgtcctttgtcaccaacaggatcacctgcgaaagtgcaggttggcctcatccgtgtctgggtgtgaggctcacgaggcttgctgatcctgagggaagagccacgctggttccggagactgtctttaggggccctggagcctctgggtatcaggtttccaaatgagtagagcaggtgtgaagaagtaagtgccaaaaaaatagacacaggcacacaagaatttggattgttctgttttccccaggactttattagtaccaggaatgagcagaacagacagcagtaagatagtcacatttttaacaggaaacccaatatgtgaaaaaagtgtctgaattctatcccatttacatatacttggattagtgtaattctcactccagccaaataacaatgcctctggaaactggcctagtttaacgtcacgttatttttggtaacattttcatcgaggataagaaagaagtaattctgtataagttg

SEQ ID NO: 43798 - DNA, 812 bp, Bovine  19866881613470
agttactatgtggactaaatgtgttaatcccattacgttttcagatggtgtctgactcatgaaaaaactcaatagatgatatccaaattgcacacacacggcaacaaagtcattttaatgggcaggatagattgagacaaggcgataagctcagtattaagacatttctgtattgtaaccttgagaaagacttggctaagaaaagagtcacaaggtgcctggagccagggtctgtctcagcacaccacactgtgacgaggggtctgctccgcctggggggtcgcggcagagggggtcacctgcagccccacacctgctcagaagaggccgtgctctgagctgtgcgcgtgcagctgggacgggacaggtgctcagtacacgctgggcagtgcgggcctgtcaccacgcccctctctgtcactcgctctgcccagtgggcaggcttagagatagcccaggacacaggtggggaacctgggaaattggtcatgttttttagttaggacagggtctccctgggacagagcattgaggattccaggtcactctctctgcaggctgctgaaacctctggttgagcatcggataccctgggagctgtgctgaatccccagggagtcactggcttcactctgggcagttagtgcatcactgcagttatggccgggtttctagagagtccctaaatgggactctgatggccagaaaaagatgattttcagccctgtacacctaacttcctattagagggttacttaggcactggagacaatctggctcattaataaataaatgcatttttatatttttta

SEQ ID NO: 43799 - DNA, 1898 bp, Bovine  19866880464588
aacagacatggccacttcacacagagctgcataaaacattccagttttcatccagcctttctgtcttaatcctattaattcatgcagttctattattttctcagtttaattataggcttcatgagatcctgtctctctcacaggtttgggtgctgcatagtacatgaagttcgtttgtcaaggagcccgaaaaacttcccttcccttccctcccagtcattccacccactgacatagcataaggctttgggtccctgagcggaggcttgagccaagatacactggcccctttgtcagtctttatctaggtaactaggtaagtctgctcactccactgtcatcccagctgacccccaggtgggttctcattgtaatctttgcctcctggcttttaaaattactccacactgggttaaatagagtggaaaggcatgtttgagaacccatgtccccttggtccactcattctgtgatagtgttccattaagacttttgtttagatccctttaatgcctgctctattcatcccattctcaaacaccgtgcagagatttcctttctgcagggatttgtgccttgattttcctttctgctttttgccattttttaagtctgtttcttaattagcatctataagactcataaggggaaacagaaaaatctaacaagtcattttgggctgttgtttgatttgacagcagttaggttacacggcatgctgatgcaaaaggggtgctttaatcacagcacttaccatgccctgagtaaggattaaagtcgcaattgccataaaaccagtgtctgccaaagatgcatcccccacattagccctcgcacgttccatttcagcaggcttttcaggaagctgataaaaacaacccaagaaggaaaccacttcagactacaccccctggtgtcagtgggttcttggtgttgccatcttcctcacctttaatcacagcacttaccatgccctgagtaaggattaaagtcgcgattgccataaaaccagtgtctgccaaagatgcatcccccacattagccctcgcacgttccatttcagtacaggcttttcaggaagctgataaaaacaacccaagaaggaaaccacttcagactacaccccctggtgtcagtgggttcttggtgttgccatcttcctcaccaggctgacctttttgatgaccagaggtcaactctcccgtcccacagctgagcttcgtcagctccaagacctgaccccagcactttctttcaattcagttttagctatcacaggtaacagtaaccccagggactgcatacttaactgttttcttattattctacaattcctatacatccactgaggctcaaaccccaggagctgggtatatcatctctaaactctgttgtttacttttgagtaggagatggcagcacagctgctacttcatactgtgaatgacctagtggccgtccaaggatcaaaggatcctcactgcctcacccaccctctcatcctttctcttcccaaaccgcatgtctcagtgagtcaggccttgtagtagatccctcacttttgacacaaaatgctgtttcctcccttttctgggcatacagtaatacgaatctgatgttcaccacactacctggagttagcatcagaccccacagtgggggacagagtccccgacaagacggtccctccatcagaaaccatatgcaatttggggattcctagctgttaggggtggagtaggcgatggcaccccactccggtactcttgcctggaaaatcccatggatggaggagcctggtaagctacagtccatggggtcacgaagagtcggacacaactgggggacttcactttcacttttcactctcatgcattggagagggaaatggcaaccca

SEQ ID NO: 43800 - DNA, 1045 bp, Bovine  19866880639230
ctctttgcatcaggtggccaaagtattggagcttcagcctccgcatcagtcaccttacagaatgaaaaggcaagaagacaagaccctgaaagatgagcctttttattactttacaccaagcggctgcatgtcctcctcctggtcccatcataatgtgcttgctgtagcaaggcaccccagggtgggggcacagacctgtgattctcagtcatgtcaaaggtcctggccgtgacagcttgctgcgtccagccgctgggccaggacaccctcggtcctagggagcagtgttgcacttcagtttccccgtgctctgtgaaggatcctataaccaaaatattcttgtagatgacaagtagtaacacccttaccaaaagccactggtttctagaagtgaggctggatttggcctgtttcatgtctgtttcctttctctcctgtcgcagcagggggaggcacgtgatcattaaggttttccgtcctgtcatctgaagggctgagtaggagcaggacgccgtatcacagtgagacaggatggtcatagagttaagtgcctagaaacaaacagccgtagaagcgcttcgtccgtaaaatcaatggggaggagtctggggcatttgctccagaaaatggattcggagttctgcccaagggaatacttggatgggatcaaggtggagactctgccgcagggtaaaacaaggggtacaaaacaagggcagcagtcaggaaggtaattgagtgattctccacctaagaaagcgtggccctctccactgtcgttcagtcactcagtcacgtctgactctttgcaacctgtgggactgctgcactccaggctttcccgtccttcactgtctcccagaattcactcaaactcatgcccatcgcgtcagtgatgccatccaaccatctcaccctctgtcgtccccttctcctcctgccttcagtcttttccagcatcagggtcttttcctcttcactgggccttcttcaaaggcagaccccacccacctggagtcaccagggggtccataccacagagcag

SEQ ID NO: 43801 - DNA, 1170 bp, Bovine  19866880915987
gcttgccgtgttaccgcggaggaacttaatgacacttagtatttcatgtgaagtacgtggcccctcgtcttgtcaccctctgcgcttggtctttggggagaagccagggggtcaccgatcctgggttcagagggactgcaacggggggacggaatttagcccttgtttggggttgggaaaatctggttgcttgggggattaggcaaaacgtctggttggaattggtatttaaatggagcagatcatgtatgtgtgtgtatgtatatatattcacatacaccaacgcataattatatcttcaagccttatgacagtttcagacctaaaggcacccttagaaagcatgaatgcaacactttacgttttaagggggagagaactactgcccagagaagaagtatgtatattcacgcttatagttaagaaaatgaaatctaatgtcctcagttccgcccattgcctacctacccaagtcttcaataaaaggactgaggcaggaagcatggcattggagttgatgccatgggaccttcctgggccctgctttactttctttgaacctcagtttcttcatctttcgaagtggagacttctgggctagattaagcccacctgaggtttgcaggtaccttttgaatacagatctccagcccaacacacgccaaagaactcagtgcctgagatatgttcatcttatttcacgataagacagagcaaaagaagggacaaaagctaaatactatagtcatcttgcccagactccctgccagagctgtcttccgctttggggggacctggaaaggaactagacacagaatcatgccgtgggcagcttaagggctgtatgtgatgtgtctctttgaattggtgagccaagagctaaagggtcatggcaccactttgcgacgtttgagtgaagtgagcattgggttttcccaaagttaaaaaggctgctgtgtctggtcccttgatcttctgagccttgctgtggctcagagtctgaagcagcgtgggtgtctggagtggcaggagcaaagcaaggtcaccccgcacggaaggggcctccctcctgcgtcagggatcctggtgattcctgggaaccatcatggcagagaagactgcgggaccaggcacctagtaggcgctcagatgtctgttaccagactcctc

SEQ ID NO: 43802 - DNA, 1642 bp, Bovine  19866881270322
attaccagcacgggaaccatgcgacagtatttatgtacactattcattggataccaacaccaaatctgcaagaagacactattctacacattttcagatgaagaaacagaatcctaatgagatcaagcaacttagccagttagtaagcaatagaacaagaatttgaaccatgataacagtgcttctcattataccagtgagcatctccctgaccaaacactttttcataatccaaatactatttttttaatgttctctcatgaatatacagttaagtttttcagaagctatgcattgacaatactctgaacagctaatattaatagaatgtgggcttgtatattcttgtatgtaaaaatcatcagttttaatttctaatattcattcatggaaataactcatataaacaaaagctctttggagttctcaataacttttgagagtacataaagcagttctgagatcagagagttcgagaacaaagaattatattggactaccttccatagatcaaagacactccaacttcagagtcttagtagcctagtaaaaaaacagtgatcaaagtaaagaaaactagtcaatacggtatcaccagaattagcaaataaacaaacaaaaacacaagggtctttattgtattttatgtggtgggaatttttcatttcaaagttgaagagaaatcacaggttgcttaccagacataaaactatgtctgattttcactgaatcattgattctcattgagatgccaaatgagctgttcttgtgagcctcctcattgatgtctaacagagcagttccctcctgtttgtgacaaaggtacaaagcttaatagccagggggggaaggggggagggataaactacgagttagggattaacagatacacactactatatatcttgtagcatagataaacaagaaggatctactgtatagcatggagaactatatttaataccttgtaataacctacaagaaaagaatctgaaaaagaatgtatatatataaaaaactgaatcacttggctgtacacctgaaactaatacagtattgtaaatcaaccgtattcaatattttaaaaatatgcagaagaaaaaaaattttatttaaagcctggttaaggatccagactcagactgcctggtatcaaatcctggcttacctgcatgaaacaagaggcaagttatacttaccctgtttaaagttatttcctcatctacaacatacaataatacataccattataatataatacttatgaggttattgggaagattaaatgaaataatgattctcaaaagtgagtggaataaaatgtggagcacatggtaatcagccaatgcatttcagttatctttgctgttatttttgagtcagttggtagctacatggactcctcaatgtggtcttatttttttttttctaaactccattcaggcttcagtgaacagttggttcttcctatggcaaggaactaattcctcctcgtctataatatcacatttttagcaacaaagtgacttaaaataatcaggaaaagtttcaagaggcagcttagctggttgcttcttcctttttgaagaaccatctgtcaaagacagtgattgtgaagaagatataaattactggcttcgca

SEQ ID NO: 43803 - DNA, 1271 bp, Bovine  19866881273559
gagataaatagtggcgggcagactttgggttgaacccagagcctggcatacagcaggtgcttaacatacatcgttgaagaaatacacagatggcctttctcttaactcaacaggggtagaactcttcagacattgccaaggactttccagacattatcacttgcacagccccaagatttcctgcagcagaaagagaagttgggaatgagtccgggggtggtcagcacccgccagagctggatgacagctttatagaggaaacggctgggacggtccatcctcacggtcctgggactgggtggctggagaatttcaatcaattatagtttttacttgggagctagctcactttgagggagaatttgttacttgaaacaaactacactgtaggcaaaatacattttgtgatgcaaactgggagccacctgggtgtcccgctgtggtttcccatgcttttcttgtccgtttctgccatctactggccacaatgcaaattactcccgggtttcttgagattctacctgagaggaagggcgttttattcctgtaccttctggatctgaaatgcaatttcccagatagttcaccaagacacaaaatgtatctctccataagtcatagttctgaggggactgaattatctgtttattcattcgctttattagcttagttttgtcagagaggcagtgtttgaattctgcccacctgtgtttaaatcaggccacttccctggtggctcagacagtaaagaatctgcctgcaatgtgggagacctaggttcgaaccctgggtttggaagattcccctggcaaagtgaatggctacccactccaatattctgacctggagaatcccatggacagagaagcctgggaggctacagcccatggggtcgaaaagagttggacagaactgagagactttcactcctgcattggcaagtgagttctttactactgggccaccagggaggccccttccttagtttaggcaggcattagtttggaacatggcaaattccgtaaattagttattatttataacctatgcccaatatttgcagaggaattttgtttccaaactgtttccattttatctcttgagactcagctcagaagctgcagcttccattttggagccttccttcatacctccttctggaacaatccattgtccctctgagttcccatagcacagtatctagacctctcttggactgagattttcacttggaatataaacctgccggccagtatacatgcctagatctc

SEQ ID NO: 43804 - DNA, 1953 bp, Bovine  19866881696543
actattagtggtagcagtaattataataacagttgaatgaaactggtataaactcatcacagctttcagactaccctcctggtgccaaaacatttcaatagttcttttttggagtggaaatcttcccattcacaggatccatttctataagattagtaagtcattttgcctgggaaaacttttcattcagaaaagggcaccagttccttctgaattcttaaccactacactttcaataatgtcaggagatggggctgggggagaaccaggaggctggtcactcagtccttgcaagatgcttacggatcgaacctgatggcttatttaccctgacaccttggtggctcagacgctaaagaatctgcctgcaatgcatgacacccaggtttgattcctgagtcaggaagatcccttgatgaaggaaacggcaacccactccagtattcttgcctggagaatcccagggacagaggagcctggtgggactacagtccatggggttgcaaagagtcggacacgactgagcaactaacacacacacacatacactcacccagtcacaccattttctcctaccctttccttccgaccaagtactcggcctatatttaaagacaactgtgagcaaggaaccaaaagttaacctcctccagcgaaaacaattctgacttttcggtcccactctacaggccagccttgagagcctctggttaccctgagcaggcgaactggcatttcagcaagcacctgacccaggctgaacataatggaactatgacctcagaggttggaaatgttctacttctgtttacgaggtcgaggagcctaacttggtctggggacagatatgagttgatcattatgatcacgtgtgatttcgatcaaaaaaaaaaaaacccagaaagttttaaatggagggaggtgtggtaagggaagatagaaagaagaggcagatgaaatttcagcttttaagatttccagtacagaggccccgcccgcagcttatcagtggcaagcagctctgcggacattcgccttctaagctccgtgcagcccatttcactgtgtcacaaggacacgtcctgtggcattttcctcccctccatttaagctggtcctgtcaagatcaggcgtcttactatcatgcaaccagtacgggactgagccaaaaaggggtcaggacagccagccctggcttcatctttggaggaaactgttgatggccacatcgttcccaccccaccttctggcccttgatttttacttttccgctcctcttgttcctctcccagcaggctccatgctggttgtctcaccccgttccctgcccaccgaggggggcaagtatggggacagggaagagcaggagccagcccaggacagggggtgaggggaggcggcaacaggggtgcacgctgtaacagaaggaaagagaggacctcccaaagctttgaaggccagtctggttccctaggacgctctcattaccgtcactcaggttttcatgccctgagaagccatatttttctatgcaaacctatctcataggtttgctaagaaaacaaagcagtggctacgtccctggcctggcatgagtgacatcctagctgcacaaggcagacaagccagctcactcccggagccttgcacttatctctgtgataagtgatgggaaaggcggtcccagaatgctgagcgagagatgatcaccacgggtccctcactcatctttctgacctcaaagaaaaaaattaaacacatttgaacctgatcccaattcctcacctgtttggccagaatccttgctgtcaaccttacagtctcagagggattccagttttccccaaaaacaaccatgggagaacattccagcttgtgcatgggccaatcttctctctgggaaagttaaaaaaaaaaatattacacacacacacacattgcaataaagtttga

SEQ ID NO: 43805 - DNA, 864 bp, Bovine  19866881735225
atgcctgcttgcatcttcccatttggacatccttctttccttaaaaaacagaaagggcactgtagtggtgagaggcggagaaacatgaagccgcgcactttgtcatgcaataacagcagccatctggtccgaaagcggagccaagagtcaccttaccttgctctcccactggtacgtgccattttcccaaaggagagtttgaccagactcagcccttgagtgggagtaagttggtcaaaggggatacgagccaacactgaccgaccccgacagcgtgaagggcactttccaaagagacaaacgacacgatctctgacccatgagcctggcccgggacatcacagctattaacatcaacctgcactatgactcaatgctttggggcaagtcagaggctcttatgccctgattttctcacctgctagaaagggacagaaataaacaaagccaccttggaagcctgagtctgtaaagacagaggactggggtcaacctatatactgctaagaacacaaagtgggtgacaatctttagtatttagagatgcagaagacaggatggagcatgtcagtaacaaatgttgtctaggaagcaaaatttaaaaacaacgctacccagcaactagagacatattcttaaataaaatacccctggatctgactggtacacacatctaccttgtctgtatcccactgaatgattcttctgctttgtcataattaggtcagtcctccccgttcatcaccatagaattcattttcctgcttctcataggggatagggacgttgctgttccctaactgttagttgctggtgtgtttgctgtgttagacaagccacggagttttcaaaaactgtaagcca

SEQ ID NO: 43806 - DNA, 1238 bp, Bovine  19866881931354
tatgtcagtgtttcacaatgttgcccttatcttatttctctttgttggactagtttgctcaggagctcatcctggtggaaggcttttattttctaaaagtggagaacagttccttgaagaccctcactgattgggtatcttcctttgggcaaggcaccttactgagggttttgctgggtaacaggtggaaacaggcttataggtagcaggtcatttgcccagggcacgctgttcagcagggcagggttttgccccaggtttgccagcacaatccatatttttaaccactatattgtagcgttttcttgggttagatttgtactgaagacagaaaaccagtgaaaggaaattaaagtcacttttttttttttttttttttctgagcgtaagtaagaaagaactttgccgtgttggagaatgtttccttaagagctttagcaaaagttcccagcttgggtgaggatttagatttaaacagaagattgaagattttttttttattctaatcaacactgttcacagcggaaggaaggctgtgttccctgtggctaaaattctttagttgtgtttaacagctgaggtcttccgtttttcctagttttttttccttccagaaaaatatatgggtcctttcacttgcttggctttctgtaatttactttttcagaggtgtagctgggggtggagtggacaaaacagtaactccttgccccatttccaccgccccacgcccgccccccgccgtcagcccttgggaagcctcctccggaactgccaggcctgtcggttccttgactccatagcaccccctagtgagctgctggagatctgcgagctcagccaggagaagatgagctgcgtgttcgaggacagtaacgtgtacatgcttcacatgatgtaccaggccatgggcgtctgcttgtacatgcaggactgggagggagccctgcggtacggacagaaaatcatccagccctacaggtgattgcactggctcttcccatcagcgtagctcagagtagagttgggtggtttggaacgcgtcccttggccattctgtctatacgctcccatgttggagcgggccaggagcagctttctctcctctccatgacatctgcaggtgcatgctcagggtgcttcccctgggcccagcctgtgccctccaccacctggaagagacacccagggaggcaggttgaggtgacaccgggtagcggggggagggctggggcagg

SEQ ID NO: 43807 - DNA, 1588 bp, Bovine  19866880122828
acactgatgtatagaacagtcttatggactctgtgggagagagagagggtgggaagatttgggagaatggcattgaaacatgtaaaatatcatgtatgaaacgagatgccagtccaggttcgatgcacgatactagatgcttggggctagtgcactgggacgacccagagggatggtatggggagggaggagggaggagggttcaggatggggagcacatgtatacctgtggtggattcattttgatatttggcaaaactgatagaattatgtaaagtttaaaaataaaataaaataaaaaaattttaaaaattaaaaaataaagtcaccaggaaaaaaaaaaaagagagagagaactccttgggcaagtcacttcccctttgaggatttcaatctttttcatgtgataaatgaagtaacttgaagtggatgatctctgaagttctttttatcttcaagtctccatgaatctgtgactctataatatccgccttgcaggaattcttcaagaattaatgtttgtgaaataatttaagactcaaggatgaaaggttttatgctagtgccccaaactatttttattaaatgaagcatgccagggaagtctgttgtgtttggggatagctgccgtgagagttcccagcactgcctatgcccaacacagactcagaaagggacaaaaaagaacaagaattcctctaatagatccagaaattatgatgagtagagagcacaaatattcctgaaattcaaacatggaagtgataacatgtacattcaaacattaagtttacagaaaagggtccatgaaaagatcacgcattgatagcctgctaacactcattcacatgccagggaagaagaattgatgtctgtatgcctgcttgtgtagtgtatctccaaaaacttccactttgtgctgaacctttctttgcctgattccttctgcaaaacctcttttatgaccctgttttgattatctaaaataacaagtgattactgaatcactgagttggaattcaagacagcataaaatcattaattcaattttccccatatttctcttgtcaataaattgagcttcagggtagtcaatgaactatcaaaaaatcacaattaatgcatatttataccaggactgaatagcatgctgtgactcataaccaatgcttatttcaccacggcttaatatcttaaaaattaattctagtctcaatactatttgagagcataacagatcacctaactgcatgttgacaaaagctttcaatgagttaacacaaaaggttgaatgaagaaaataatctaccccttggcaagggcagtggagaaaaaattgtacaccaatctaaaagtgtgggtagaaactccacttcaccatttaggaataataaacgaaccatagtcaatagacttagtccattggtggattactgggttaagttactttctaggtttcattttccagcaatatgaaatggcaagggttagaattaaaaccatcaaaaacagagattcattttttggtcataatagtgaaacattccgcagttttaggacagaagatagaaatatattgaagccagtt

SEQ ID NO: 43808 - DNA, 1008 bp, Bovine  19866880428521
aaaatgtgtcttggattatttgcagtgtccattaatgagatactacagaagaccagcagcatctataaaaataagtttaggagtgctcagaagggcaagcatgcttaatgcactgcatgaataataatagcagactataagtcttactggaaagccaaagctttgtagaactgttaacaattataattcccatttagtaggaatgggtagaaggataaattttggtgggggtttggtgagaaattccatggcataagaagcttgtcccagggaaagtaaaacaaccaaacagaggagaaaaaatactcattcccattcattccccagtattgtccacagatggctgtagcaggagaaagtaaataaatagataattatactgacataaagaccaattttaaaggtctcctatattttaaaaaaatctataaatcttaaaaatgaaagctcacttgcctaaaaatgtaatattatctacttggcattaagctcttaatggttacaatgatttcaactaaaccctattgcctcccctgtgtcataaccactactaccaaattcttgcaccaaaagtagaaaattagtttttctttgctagtccctgatcatttattttggatacactttctatcatgggagttaagagaaaagctgcaaagatactagagagtgctcatcttctctggtcctgattgtttgtgcctgacatttccttggagccttaaggtgactatgtcactttagacctgaataatatgacacccttcttagaacgacctttaaaggtaataaccaacccagcattttgttggtttctctgtggtgtttgttctggacagaagtcataagaaaaaaataaaaaaacagtgaatgaggccttttcgagatccaatcagtttaacaggccttattcatgggaaaggttatgtgagtaggttgcagaacaagacagtgcttctctttcccatatacttcctgaagtcttaatcccctctttctctaaatgtc

SEQ ID NO: 43809 - DNA, 1010 bp, Bovine  19866880512328
tccaggcaagaacactggagtgggttgccatttccttctcaaatgcgtgaaagtgaaaggtgaaagtgaagtcgctcagtcgtgtccgactcttagtgaccccatggactgccccctaccaggctcctctgtccatgggattttccaggcaagagtactggagtggggtaccattgctttctctggaatcttgctttaagtccgaatatttttgccatcagtttgtgtatctgttcagtattctgctgttttatttctgtttctatccttggtggcttgttataacctcagagcagtgaagaaaaaatatgtgagtgtataacagcggtagagatcaggcaatccccttaagtatatttggcattgctctatctttaagcaatttgcccaacctgtataattacaccgcctctgctgggcaagggtttttcctaatcagcatcagtggactgtgtgggtctgaatgttggcgcaagctcagcatatttcatcaacacagtgatttccttggaggtgtgccatcatcaagatatcaaaacatcaagaagcagaaacatgctttcactgttagagcaaaatggagaaaattcatttaaaggagtccttaatctagaattaaacttttgtctaaaatgcctttccttccccttgacctaatgttacctgctctttgaagcctcattgtcctgcctcctccaataattcttgagatgctgctcccacactcactgtgttcacacaacccacctgatccaatagatctgtttgttggttcagccatgtgcccttcgaagccctggtgtccctacagacctcccttcttttcagtggttgtagagagctccacagaaggcacagctgcctatggcagaacctcagccttcctgtccacagtgacccttggttgattagctcttttcatgacccaaaagtgaaagtcaagtctgactcccaccctgtgaactgtagcgcactggtcttttctgtccatgggattctccaggcaagaa

SEQ ID NO: 43810 - DNA, 956 bp, Bovine  19866880547853
ctcagggttgtaaactaggcagagagatcagcatcttcatttcttaagtaacttggatttataaatttgtaaatcttatataaatgtataaatttataaaatacttataaatttagatttccattagtcatattttaggattggagtcctgataaaaaggatactcatgtaatttaacacattgtcagagtccagggcagatcaaaaatagacataaattatatgttttacattattgtcactctctctctcaacttttgtttggtatttctgaaaaaaaaaatatatatatatacagagggaggaactcagaataaatatcctgtagatatgttcttatgaaaatattgtaacatagataggagacagagttactggcaaatagaattgaaatatggaaattttacacccaaatgtaactattaaataattgaagattttatttaagctaaataaagttggagtgaagagtttacatctaaaaacaaaaaaagtgaacttatccttacttaaaagcaactttctccaaagaactatgcttagcttgaaaaacactttataacagatgacttctactttttgatttcaaattcttctcagaaaagcactctaaaatgagctttttgtaggacaaatcataaatagaagcaatgacaagaggtgtctttctctcagtgttcattgccattgtctgaccttcaagcatatggagagaatctggatttgtggtctgtaccttttgacataaactatgctgaacacatggcctttccaaaaatacttcagggaacagttctctgagtatcattcatcatctcttgccacaatgacatctcattgcaaaggaaagcgaaattgttgctatgagatggagagttgatggagaataggaaaaaagttaatacggtagctaataaagggcacttgaagatactcttcaatgatattgatgtatt

SEQ ID NO: 43811 - DNA, 760 bp, Bovine  19866880613142
ctcctaaatcttcataatagatgaagcaacaggtgaagtgaagattgctcattctctgagacctgtccctagctgccactccacaaaggaagtagaactggaaatctcttcattcccttggataattacagcatcactccccttcctgtctgttaaaactcttatcatggtattgtgttgacctcttgctcactcactctcattctctgaagactgtggtacctacttacagccctccggtctcccacacataggaccatcaccttggttcactttagcaactatcacatccaacttgcaggctttatatttctttgacttgtcatctgcagtgaattctgtcctcatccatcatttaatctcatcatttaatttgacttcaacatatatgctccattttctttcttttttactcaatagagaagtcccaaccatgaacaaattcaattatatgccttctatgaaatgtcacatgtcaaaacctgctaaagaaaagcacacagctttatagattggctttaacataacctagagactcaggtgtcctctgattattcagccttattcaacacaccttctctctttctttctctctctctctctctctttttctggccatctaattctgcaacgtgactgttttaaaccttccatgttttcttcaatgcttcaaccaaataaatatcattttctcatccttcatcatttttgccaaactaaactcaggtctgctcacctgatctgcagcaaagccaatcta

SEQ ID NO: 43812 - DNA, 1742 bp, Bovine  19866880685162
cacctggtggttaggatttggcacccagggaataggtgaaggcaaggcttggatattaatgggaaagatatttgcgagaaggcggaaaccttcttggtaccagcccagcaaccattctgacataaagagaaagccaagactcacctggaccccatccttctgcctgcaactgtaacgtcctgtccttctcctctgttgtgatctagtgttacaagtctccacacaattcacaaagaagagcttttagctgataaagcacacatcactcttggttgagtaacagatttttgaggagttactctgttgtaggcaattacacaaaacataagatgtattctgcctctaggaaacttccagtttaaaaaggggaagaactaacataatgaaaataccatataatgattgtaaatgccacaggagcagcccagaacatatcataagacttcagaggaaagcgctttcttccaatttaaatttcttaaaatgttttatatcagttctaactttttatttaccacggataaagaaaagttttcttacagatgttagctcagacagttctgaggtttcctaagaaatattgtggccttactggtcatattgattcaacttgaaaatttgtccattttattatttagttataagcagcacatgtagcaagttgctaaagttattcttattgtaaatatgctattgcttcataaataggagctcatttttgttatttccttactatttaaactaatgtctctctcttgaaggtgttgctatggcaaattaaattagaattttggacccctctcccctttgcatactcacacactgctattttcatgctgactcatgtggccctgagtgatcaaaactcttttacaaataactcttagcatattcaatgatctaacctaacttgagtctatttctgacctgttcagtcttcacagatgcctgactgtgaaactggaaattcatgaggtcacctctaagaattttctttgtattgtgtacagcagaggggagggtggtatttttcatacttattttcttttaactctgctttttaaaaactttctgaatctgtcattgctatatgctaagcatatggtccaaagcagttcctgcttttgtggagaataaccaagtcaaggacagagggtacattgtaataatgaaatgcgaagttctcattaaaaggcaaatccttcatctcaaaagattgaacaggatgcaacctcagttgactggtgggaatctcctatgaaagcactaaaaaagtattccaactgaagactattttttggatctgtaccactttcatttcaatgaattgaaatatttgagtgtactttaagcgtacatcctataaaaatttattctgggatacataaatgtcagcaaatgggttgccagccattataattccttctttgtttaatacatattttcccatcagggattgtgacatgtttcatcaatatagactctacaagaaatgttgccagttttctgcatagttgtgcctcttaatgaaatttcctgaccttatttttctcattcctgtggactcaccatcttccttgtcttcctgcagtctgttagctgcacaataattttccaagtgttcatctctagcctgtcttaaacactctacccataactttacgcatttctaaaatctccaccttgatgttttttcaggtgcctaataaagctcaaaccccattcccctcatcccacctaaa

SEQ ID NO: 43813 - DNA, 1983 bp, Bovine  19866880697848
tttatatgtacatgtgtgtttgtgaacatgtgtgtgagtgtttgtgtgttgggaaggtgggaagttttagatttcctttgaaatagctgggaagaatccaaaagataaggaattagggatagtttggatattaaagtaaaggcaaaaagccaaaggagtgaaaatcagttggttgggaagaaaatgtagtaataatagtaacaggatcagtaacatttgttgaaaattactatatttcagtcactaaatgatgccgaatgtactttcagaaatgcaatgttcacatcaggacaacaaggaaatacataagaacgtgaccagaatcaaagacaattgcaaagggtattggacaagagtttaggagacatgaaccatttaactgtgtagaggatcaagtcaaacgagaatatccctaaaattatcacaggaaaggaaaggatccaggttctacagggatctaagaattgtgtgtgtgatgtgtgtgtgtgtgtgtattatacagggcgtgggagagggagaaagagagagaggaggagggatcaacaagatgtcccaacaatgatgagaaaagaaaccttacaaaagaaaaacaatgaaggtgccttaagaatctttattttttaaactatgccaagtaaggagagcttgtatgatagacaccatgtgcagctgaaaaatgaacactttgtccctgaaaacttattctggtataaaaataactgcacactgcagaaggttctaaatattttgtgttgtagaagatatttgatatagaatagtatgttggctgaactgaaaaggtaagagtattttaaattcatgcgatgagttgcgaaactatcaagtacttactaataaagctctttgatttttggctttgcttttagtaagggtaaacattttggagactttgaatatatttttatattctggataatggcaggaagattaattattcaaagtggatattggtgagaacctctgactgcttgagggtatcctgtttttccacaaggtaatttctactttatttgccttgtctttatgaaatatttaacagatgcatcagagctattctcagtcactcagtaatgagtttagtaaatttccaagctgccagagtaacatctcactatttgaaaagagagaggttgtgacaatggcatgaataccttaataacaaatctatcacttgtcatatttcaccaaacctgagaacatttacgaaagataagaagcttaattccttagctttttttacatgaagctcaagatatttagaagagttgaagaataagaatttcagagtgttatcagattatcatcctacctctcaaactagagagaagttaacattatttggattgcttggaaaagataagagattatagaaaactcaaagttgtatatacactccatgcacacacactcgcaatcgactagcagaaaagaaacaaatttttaactaatcaagattaactgttttaagtatttactttttaaagcaaataagccttcgatatacttattattataatgtgacaaagcttcatttattacaacatcttgggagatgttttttaacattattttgcatcaggattagtgagtggcagagaaagtgtttacatatgttttgatgagagcttagcagagactgttttaaactggctcttcaagtgctccagaaccagaatatccaggctgtatgaagctgaggaaaagtacaattacttgttgcaattcacaatcccctactttctccctccaaatctgtccagttggctctcaaagtttaaaaatgaaacacgggaaaattccggtgtgttcctttcttgtcttttcccatccctccattatatcctgagacatttgtgattactatcaaaatagccaaaatgaatgacttcttaaacattggttgtttgaatatgacagctttgtattcctaagaaacttactctccaaacatgttatctctat

SEQ ID NO: 43814 - DNA, 828 bp, Bovine  19866880840079
attaatttagaaaatatttattttctttaaaatgacagaagagaactgagtgtcttttttcttcacctaatttacccatgattatgaaaaatcaggataaaatacaaaaagccatagtcaagacataacttggtttcaatgtaaagcactttctctgaaaaaatagaagactatagagtgctgattcttagcctgggctttacactaaagtgacatggggaaatttttaaaagattagatgtctagattcacccataatgattccgatttaattagtcagtggtggggatgagcattatattttcaaaaactccaggtgattctaatctgccatcagtgttggaaaaggctgccaaaaaatattaacctcaaaaccctaattgtgaaaatgaatattaaattacagtttggaatataaagtggattacaaagtcatattctggcagttaagaaaaatgctcaagcattcattttaacatttaggaatttagcaagtgtagaggcataagccatatatgtatgtatgactgaatcactgtgctgtacacctgcaacatcgtaactcaactatacttaaaaatttttaaagaccatttaaccttgattggttttaatttaatcacacctacacagttttcttttcatttaaggtaatatatctactggtgccaaagagtaggacatgagcattttggggagggggggcattattctactcaccagacttcagatcaattttatttacatattactatttatatggtcttttggcccagttattacttttccccattggctgtgtaatctatggtgcatttccaccttctt

SEQ ID NO: 43815 - DNA, 1728 bp, Bovine  19866880856399
acatagtcgtttttcttttcgcaattaaagactactgacctctaaaaatttccagtatcctttcagtgtctactgtattgaaaatctatgagatcaaaagtacaattgttctagacaggagctatgctgccaaattatgttgtacagaaaataacttaatatcaacctaacacatattctgagcagatataaaacttagtcccctataatttcaaagcatcattgaataatttgtttctctgcacaacagtttaaaacattaacatctctttcctcttgtatttctttgagaatttattctttgatcttgtctctaaagagtttgatttcatttcctactgcagaggtgtggattgggtgggagtaattttaaaagctacaaagtagtagccataaacaaaataagacccgaagaatggaagatttttttttcctggcattactgctcctggagagttaatgtgatcatgtgatgagcttcctggctgtgagacagcgtcgtgacctgtaattctattgattcactttggaactattcacctaccagagacatttttttttttcatgctgcatcgagaaactgaaatactgcagggagttcctaactgacctcctacgtttagagtcaccccaactccctaaatcatttcacacagtacagtgagagagcactccagaaagtaaatcatgtcatcccctgcttagaattcaccggtagtttcctattacaagacagtaagtccaactcctttaataaagctttcacggtccttacagaagagggcctgctttcttgtctagtctcaaatcccatcacttacctcggttccttaaacatcatttgctgttccatgacgtgcatgatccatgatccagccccatgatgtacataaatgccttttccaggtactccccaagtcccctgtctgttcactagcttatggcacatgcttgcttgtgcagtgaaaaatataagaggaaacatattttggactaaggtcacactagataaaagagattgaaaaaaggataaagtttgttttcttctctaccaacttctaatctctatatatactatacctctctacatctgactgcctactaatctcagacacttatactatcttttactttccctgttcttagggaagcaggctctaaaaaataatttgtgattagttaaatacactcagcgtgaatcactgagtcaaatattacagaatgtttattatataccaggctttgttctaggctcagggagattaccagcgaacaggatggtgccagctctcaacaagcacacattctaatgaaggaaatggaagaggagcaactaaatcattaaataagatgatttcaggtagaaatagtagggagaaaacaaaacatttacatcctatggaaaaatctgaatgaacttttgggccaagctaacaggactaagtgctgggaagaaggggtctagtttagattacgtggttcaaagggtccctttgaagctaagccctctgtgaggaagaagcctcggccatagaacagaagcacccagcagaggggtgggtagtgcacaggccatgaggtgaaaattaacttggtgtgtttcagagtagaaagaaagaccaggatagctggagtggagttcaggagaagaggcctgagggcttggccagcagcaagccatgcagtgcctagcagacctagcaggggctcttatttattcctagtgca

SEQ ID NO: 43816 - DNA, 1397 bp, Bovine  19866880946869
atacatatagtcaaagctatggtttttcccgtattcatgtatggatgtgagatttggaacaaaaaggctgagcaccaaagaattgatgcttttgaactgtggtgttggaaaggactcctgagagtcccttggactgcagagagatcaaaccagtaaatcccaaagaaaatcaatcctgaatattcattaaaagaggtgatgctgaagctaaggtctaatactttggccatctgatgcaaagagtcaactcattggaaaagactctgaaagcaggggtagaaggggatgacagaggatgagatggttggatggcatcactgagtcgatggaaatgagtttgaccaagctctgggagttggtgatggacaggaaagcctggcatgctgcagttcatgggatctcagagttggacaggactgagcgactgaactgaactgagtgcatatgtgataagaagctctggaaaagtcttttaaaaatatcattttcctttttattagattttaaggtcactcaactgctgcataaaaaatagtctggaaaacacaatgtattttcttattacttcaattcactacacgtagatgggggtggtctctgtgatgccataagtgctgggttaaggttctacgaaaacacggaaatgtatttacttttttcttttcttgtaatttcaggacagggaagaaaagagtacaagaaaaccagaaacatcattgaaaattaattgtttcacaaactcaaatgaatatttaggttcttaaatgattattttaatagacaatgtccagaacttattttggacaatttctgctgtatttgttccttaataactatttacatctaggtagagcaaggggcctccagaattataaatgaaatattttagaaaatgggttataagatacaataaaaacccttgggagagagaaacaaataacaaaaacaaaaagcaaaacaaaaaaattctgatcctttaattatgcagaagtacggatgattccttctgttacaatcagtgctaaacgacactaagagtaataggtctacctgtaccttttccaaataagtttttttatcagcattgttttagttcttcactttctatttttaaagcattttgagacttacattcagaatgtagccaaaagagccagatttgcctagtgaaatagctgttttagacaagtgtgacttgtttctgacatatgctatacaagcaattgtgttaggatgacatccatcagagataatagcaagctaaaaatggcactatcatatttcatcctgataatcataaaagcatacacagaaagccctaatatttcagcccacaggagcaaaactctccaattggttttcatagcggtagatgtatttaaaccaagatagaaaaa

SEQ ID NO: 43817 - DNA, 1127 bp, Bovine  19866881003088
attaaaaaactgtataactcccttgctaacactagcaaggggggaactctccgtcccccttctgatgtctatgtcagaagttttctctgtccatttttcactttcataaaactctgctacacaaaaactcttgagtgatcaagcctggttcctggtcccaaagctaaatcttcttcttcagagatcagtaatttgacactgttcaccgtaagctatcaaaaccatggagtgtttagagtttacataaaggatcccaatacagaaattttaaagatattcaaagatttgcattggtggctggagttcgtttttagaaagtgatggtaacgctggcaggacagagtgaaaggaaaggctgaggagaaaaacaagtttgtcctaaagctgagaaacacagaagacttggacaagtatttagaaagagtagtgcttcatactatggacttcatatcagaaaccagtcttgtaatcagggtctgatacgagatctatgatatcaaaggatttgtttacattctatgaaagttagttaacttagcagtaatataaaattaatattacctttctcatagagtcttgttagatatgataatatatatgatgcatatgataatatatgatattaggttagtttacttgctacacttttcggttggtgggtttttttttatttttattttttttacttttgagatagggtagaagggaacattgatgtttgtccttctagagagatttcctccagtgagcatgctttcatggaagcctttcatcttttcaattttgatctttattatgtatatgccagaggtagagaaagctgtaaaacctctctgccctacattacatccatttcaagatttagatcagaggctggaggaagacccagagtgctcagatatatggatgatgtaatgctgacataaataataaattcactggctagaaggatgaacaggccagacaaataagcattttaaaagagggtaaaaaaaatactgaagcctaataggaatggaaataaatgttggtatttggttctcatctcctcaaaaaaaactacacatgcgcaagatagaggatattaatttatggaaaatacttgtgtatagaaatgaccacaaggt

SEQ ID NO: 43818 - DNA, 2623 bp, Bovine  19866881049166
actgagatgcagtatttacagcaagacacatgtctgcatttctgagcacttgaaaatgattaagctttcagggagactgtcaggatcacttactgtgcattaaatcctatgtcccttccttgagattgagggcatcctttctatatgctgatggactagactactgaggactagacattgactatctagacaatgctagtccgttactacagggtttattaacactttatatgttgagagtacattggtcctcaatgaaaaccctacctttgctttgagacaatgtgagcaacattcagcctgaggagttgtagataatgttatctgtgattttcaaggggaaatacatagctagtttgctattcacaatttagcagagcttaacaaatgaccaccagataggaatttagtatttcacaacagttgtactaattattttcactaattgtcacacatttgtattctttgaaattggtttgttatctccttattactttggtttaaaataaagattgattttctcagctaattcaacacacttgcttttaatttatttggtcacatgaattagctgcaatcacaacatatatgggatgaattgaatcatatcagcaccattaccaacaactttattcacactaaatcttcgctggtcagaactgaccaccacttaatgtcattttatatatatgaatgtaaacatagcttaagctgaggcaaaggaaaacagacctaattcaaatgagtggttcaacactttggatttggattggaaagatgtgaattgaatcagaagtgagcagataaaaaaggaagatgtgaacaaataactaaattttaccatgagatcagttccctatccagccatgtggctttgagagtaatcctccagctgctaggtagctcttctttgcatctcactgctctttgcatccttaaactcatatccttagagctatataagtgatttttatgctattttaatatgtgtgtgagctttaatactttttaaaaagttcaactgaatggaaagtaatttatgtttcttgaactagctgctgctgctgctaagtcgtttcagtcgtgtccgactctgtgtgaccccatagaaggcagcccacgagtctcccctgtccctggggttctccaggcaagaacactggagtgggttgccatttccttctccaatgcatgaaagtgaaaagtgaaagtgaagtcactcagttatgttcaactcttagcaaccccatgggctgcagcctacgaggctcctccatccatgggattttccaggcaagagtactatgccaaagtgtcttagtagtttgaaaagttaagagaatttatttcttgttagattaaagctgtgtctgcaatggtttgactgcaggttggctgtggctctgctgggtatatctaggactgcttccatgtgtcttcttatttttatcccaaagtgaagaggatatcattgtttaggacatgtttcccccatagtgtggaacaggagcagcagattctgaattagtacatataactgcatggaaagcttcaacctggctgtggtgtcatctctatcaacttgccactgaccaaagccagtcacatgactgcagtcaaagtcagtgaagtgggcctgatatttctctaactggctgtacaggcaagccctgtgtcaacatatagggatatatgttcaattctattaaagggaggaatgaacagatggcaataatcatctatctctttttatttgaactcctccttcattgtacttccctcacattaagtttgaagtggttataggcaatttgtatctaactaaagtgaacttggggagttggtgatggacagggaggcctggcgtgctgcgattcatggggttgcaaagagctggacatgactgagcaattgaactgactggctgactgaaagggaagaagagtttgggggtacatttagtttgagtttagtggagtatacagtttatattcatttctatgactagttaaaatattttccaggtgtgggagtagcttctcggaatactcatcttgcccactgtactaacctatctggcattatcacatgaaaatcaaggacaggcatgagtgcagctaaatatataagataaagtgttatcttggtgcatggaacatacctgaattttcataatatttctgatatttgtccactttcataaatttgtaatttatagctatttgtgatctcattgtaagtataaattctgtacttaatttcatagtgtaattttatattcttttacttaatgagcacccacaaaattgaataagcttctagagaaaaatgataggccataagaatacgtcactgcatttcttttagaaaaagatgaatgtgaaaatttgtttagttctcagtgattgataacatatcctccattccatcaccagttgggttttactcaaaggatcagttttccaaagtgaaagtagaagtgttagtcactcagttgtgaccaactctttgggaccctatggacaacagcctgccaagctcctctgtccatggacttctccaggcaagaatactggagtgggtagtctttcccttctccaggagaactttctgacccagggat

SEQ ID NO: 43819 - DNA, 1282 bp, Bovine  19866881183601
agatgtgaagcctgattctactgagagaaaatttattccctttttaagtgtaatacttattttaaatcgatttgtagttttaggatgttctggtagtgtttcaatgttcatcattacttataaacacattgccagtagtatttccttacctggataaaatgtgggaaaaaacaatgatgcccctaaatttcaattagaaaaaatggaacaattatttgactgcacagctgtgtctgaataaaagtaatgtattactctaaggaaaagatatttattatctctcctaaaaaaggatgaacaactggattataactaccaaagagaagtaagtttggataaagtaaattgaatttacatgcaagtaagtaaagtcaaaaatattaaatgtcctcaagtgtcactaagattatcaaagcaagccaagaggtaagaaaaaaaattatattaggtccctccataggagtgagaagacttttataggctggtgactaatatcataaaagcactctacacaagatataaaatgattaaaaaaaaaatccactttcattttattgggtaaaggaaaccataatgctgaagtttatgagcacctttgaattattgttgctttgcctaattggtcttacaatttacatttgcaaatatctaacataacagtcttcacagacatcacttgatgtcaaaactgtaggaaatagggcaaaagagagtcttttttgatcatctgtattgttgagttgttgctttcaggatcatcatcatcgtgattcctcagcatctagcacttccttgaggaaaactttgtgtcctggttcacaaacacaggggagctttgaggattgctttcccataagcagttctcaataatctgtacattctcccaataagccaactttttctctatttttgaacttattttcaaaatgtaccttcatagcatggggacagtattattactttaactagtgaagtataatattcacattaaaatttgcatatattaatatacagatcacaaaatcttcacaaactgaactgagtgccagatggacagattatcatccacaccaggaatactcttgtgatctccttgttactgcccaacctaaacaaaggtaacaagtctccagacttctaacatataggttagttttgtctattgtcatactttataaaatcgcaatcatacagtgtttcttaccaactgacttctttcatcaaagtatctttgttaggtttatccatacgcttgggcatagttgtaaaccatatattctca

SEQ ID NO: 43820 - DNA, 859 bp, Bovine  19866881374457
tatatatatagcatgatatgagtaaataccccaaagttctcaaagacccatctacacatacataagctcaaagaattctctgacattagcttaaggatatcttaagtagtgcagttgttcagacctggatcaagataagtaagaaaagtttagaaacattcaactctgtgagagccacaaattagtctttttttaatcaatattgtatgatctgtttgatgtcaaaccatgccagctgctacccacaccaccccaaatagttcttcccaattattgtctcttctgagagtcaccaggctggaattgatttcttccacggcagacaccaaaatccagagcccaaggcaatgctctgcctcccttgtcagcagtcttccttgttactagtgacttatgtctatttctctgcttcatttgtcctgcttatttggtgtctgcacacagctggttcctgttcgcccaggtcttacaaaaccgtcctacattttggtgtctaagacagcctgggcactaattgttctgcacagctgatgctgaactttaaacaccatccctctgtgtgacctgattctgacatcagttcttggatgaacctcctcctatggattgcttcagggatatcagatatccatctctgctttgatgacaggcttctagtctgatatatctaaatcacagccatatttatgtgtttacttcttggaagtcattgtgttttttgatttgttattcttgtcctcattatgaatctgcgtatgtttaacaactgactccctccccctttttgaattccaggtgaaatctagtatacaaaagataaatgcactgctctgctgaatcgaagaagaatgggagtttt

SEQ ID NO: 43821 - DNA, 791 bp, Bovine  19866881703659
tagcagcataaattggggcatccccctggggctcggatggtaaggaattttccctgcattgcaggagacctggggccaatccccttgttctggaaaatcaccctggagaagggattggcaagccaagtcccaggattcttgcttggagaattagatggacagagggagcctggcaggctacagttcatggagtcgcaaagagttggacacaacttagcaactaatacacacagcatgaattagctaatggtacaaatctacgtttacttttccttttaattttggaaagaaaaatatacctttaaaagatatattttcagtagcatccctaaaagaaataaattggcctatataacacgaaattttccacctgcccctgtagtattctgttagtgttgccaggaggttatttaatcaatttgtaaatcacattgagaacttttccccaaaattacagtgaatcttccaagtctttgagcattatgatttttaaaaatcatgtttatgaatccagaacagagcagtagatgcaaagaaggctttgcaatgggtcatcttgaagttaattgactttcttcttgctttttttctcctgcatttagtgtgattttaactttcttgaaatctgctttcattactttttaaaataattctgtaacataactgatgtgggatttggaccataaagaagactaagcactgatgaactaagaactgatgcttttgaactgtagtgttggagaagactcttgagagtcccttggactgcaaggagatcaagccagttaatc

SEQ ID NO: 43822 - DNA, 1538 bp, Bovine  19866880456152
aaaacatctcactgttctttgttgtgtaaaattcaaacagtaagttttggaaggagcttcttcccggggtcagacgaatctgatttcacccccacaggtccagcaggcctagctttctgatcttggcgggagtgcatgtacgcatgctcagttatgtccgactctgcaaccccatggaccaggctcctctgtgtccatggaattttccaggcaacaatactgaagtgggttgccatttcctcctccaggggatcttcctgacccagagatcaaacttgcgtgccctccgtctcctgccttgccagtcgtattcttaccactgcactgcaccaccgggaagtttggggaagtcactgaatcttgccagcctcagtttcctcatctgcaaatagtgattatgatattctgtagttgtaggactgctgagaggatgacatacgtggaacccccatagtcatcgctgtcataaaagtgatgcacaggaaatattaaatctttggcagtattgcaaccttaacaatcattttcgttgtaagattatgcatttgccagacatgctccctggaaggtcaaggctttctctgagaccggtggactcgcaacgctgttgagagcaccaggtggtggtggcgccccctaggggacctttgatcaagggttctatcaacttcccagcgctaagtgaacagcgaggttgtgtttccagtatgtttctctccatagcatgataaccttactgaaatagtagtctctatagactaaacacaaacatgagcatttaaaaataaaaaaatgatatatattatttgaaagagaaaaaaaagacaatgaaaaagagctacattgcataacttcctgattcccttaaacggtttttaattatttctcaactgaatctaaccttggttttaactccctcaccttaattttgattcattcttatgtgggcagaaggctaacagcctctggactgtgcttaaccatagaatttggcaaagtgctctgtggaaaaagccctgggtcatttttcacctgctgggggattaaatcccctcattaagaggcttaggagagccacttcagccagtacttacaagaaaatctggcctctacatgccgtttcagaacttggccctcttcctggtgtctttgtccacactgaaacagaaaatgctccctgggttctccaagctctgtgacccttgacttctaatcaaaacgcggttaccagagttaccctggcccccgcacaggcaccctgactcttcgcttgtggccagcaccactgggcacagccactctgctttctcctggcagctcacacaaggtgcgctttgggatgctctgcatgttgctgcggccttcccaggaagcactagtggaaaaccccgcctgcctatgcagcagatgagacctaagagacccaggttcgatccctgggtctggaagatcccctggaggagggtacgcaacccactccagtattctgcgttacttaatgcgtaacacagctcccgggaccctgtgctcactgaagc

SEQ ID NO: 43823 - DNA, 2590 bp, Bovine  19866880466438
ttatggcagaaagtgaagagaactaaagagcctcttgatgaaagtgaaagaggagaatgaaaaagctggcttaaaactcaacattcagaaaactaagatcatggcatctggtcccatcacttcatggcaaatagatggggaaacagtggaaacggtagcagactttattttttgggggctccaaaatcactgtagatggtgactgcagccatcaaattaaaagacacttgctccttagaagaaaaactatggccaacctagacagcatattaaaaagcagagacattaccttgctgacaaaggtccgtctagtcaaagttatggtttttccagtagtcatgtatggacgtgagagttggactataaagaaagctgagggctgaagaattgatgcttttgaactgtggtgttggagaagactcttaagagtcccttggactgcaaggagatccaacaagtccatctcaacggaaatcagtcctgaatattcattggaaggactgatgctgaagctgcaactccaatactttggctacctgatgcaaagaactgactcattggaaaagaccctgatactgggaaagattgaaggtaggaggagaagggaaggacaggggatgagatggtttggatggcaccacccgacttgacggacaggagtttaagcaagctttgggagttggtgatggacagggaagcatggcgtgctgcagtccatgggatcataaagagtcggactgagggactaaactgaactgaactgaatttttactacaggcatgactcccaaaatttgcaattatgttttgtgaacttatttaagccaatgttcctcaactgataagccacactgttttcaagattcccaaatttctgtttcccttgtatttaaaatttcaaaataaattaaacctggtacagggcatacaacaagagaagcttaaatactgtgtgtgccacttcaaaacattcaagctcaattctcctcaccttcacacacaggctggcgatcaatgatagaagccaaggtaatactaacactaaggttatgtttaaactatctgctgttgaaaatctttacatatcctaattcttatcggcaattcacactatcataggcacattgttaatgtaaagacttattgtcttattatatgccagatcctctgatgtatctagcgatacaaaggaagatctttactcgtcctcaaagaactcaagatctactggggaaaaggccaattataaatgcagacatgcaacatcagagacagagggttacaaggccagaatggcttcctggatgatggatgaccattcaaggcggagaagagagcatgaccaaaggaaagacagggccggtgcgggaactgcacaaatgcagacctggacaggcaggatcaaagtcaggcaggatcaaagtcgtacagtgtcttaattgttcacactgaccttctcttgttggcctggggatccatggaaagaccaagcaaaggtgtaaggtgtgtaaatgaaaaatattatgtgtcttaaatatcgaggaccttttagctactgtgtgggctgcaaattttaggggaacaaaactggaggcagtccaaaggccatttaagtgaaaaatcaagaggatttgaatgaagactatagacatgtgtttttttttttcacagaggatacacttgatatgtagaggagatagaatcagggaacttttcatcacaggatgtgggggatgaagtcgtgggaagactcccagatttctggcttgggacgtgatgccaccaaacaggatccaggaagaagagcgggtttaagggcgggtgtggcagctttagaacaagctccagtgagctgagtgggccaaggatgacattctgggtgacactgagcaccaaggacggatgacacagagggacagagcttggaaccaggggcaagtgctgacgccctggcagtccacgatgtcaaggagaaaaacaaacaataagctcacttgtggcagagaggtctggtgaggaaaagactggagaatgcccacgagatgtagaaagcaggatgcatgaaggacctcagtaaaatctattaatatgtcagccaagctatgagaactaaaagtcaggccatagtgagttaggaggtgaaggagaggtgagacgcagggaggtacggctgaggagctcctaggtggagaagcagggttcaaggtggggtttgggttggtttgtattttaaatcagttgaaagctcaccacctagagatagacagcattgacatttcacataggcatacctcagagatatccgacaactgccacaaagcaaatatcacaacaggtgagtcacccacattttttggtttcccaatgcatataaaagttatgtttacactctactgtaatctattaagtgtgtattagcattatgtctaagaaaaaaatgtacataccttcatctaaaacggatgctgctggaaaaaatggtgttgacagacatacacactgctatgcgtgaaacagttggtgagaagctgctatataacacagggagcccagcctggcgctctctgataacctagaggggtggggtgggg

SEQ ID NO: 43824 - DNA, 3018 bp, Bovine  19866880645052
ctggagaatttgagcattactttactagcatgtgagatgagtgcagttgtgtggtagtttgagcattctttggcattgcccttctttgtgattggaatgaaaactgaccttttccagtcctgtggccactgctgagttttccaaatttgctggcatattgggtgcagcacttttacagcatcatcttttaggatttgaaatagctcagttggaattccatcacctccactagctttgttcgtagtgatgcttcctaaggccccttgacttcacattccaggatgtccagctccatgtgagtgatcacaccatcgtggttacctgggtcatgaagatcttttctatatagttcttctgtgtattcttgctacgtcttcttaatatcttctgcttctgttaggtccataccattttatgtcctttattgagcccatctttgcatgaaatatttccttggtatctctaattgtcttgaagagatctctagtctttcccattctattgttttcctctatttctttgcacggatcactgaggaaggctttcttatctttccttgttattctttggaactctgcattcttacacttttataagtgcatcattaaaaactagtcacatttatttcaaattgctacagagtagtgcgtaagtgctcagacagtggaaactttcatgatcttcttcatccagaacatggagaaaatagatattaaatcttatgtactttctgatgatgcttatagcaacttacagctcggatagaaaggttatcttcttcatcgcccaaatttcacagctgatggaaatgaaggacatacacattgatatccagagggaagacaccacagtgatgactgtgtcagagtgatgttggaagaaatcgttgatgtcgtggttgatttatttttttatttacaaagtgccccatagcgtggtttagttaatcaggaagaaattaaatacagtgtgtttattttaaatcatacctgacttaatacccccccacacacaaaaaaacgccttgatattttcaactaaaaagattgtttattagctaccatagaattgttatccttccattaggattgacatacattcaccaccatgtgtaaaatggtagctagtgggaatctgctgtgtggcacagagagctcagctcggggctctgtgtgacctcgagggttgggatgaggcgggcggtgggagagaggctccaagagggaggggatatatgtctaaatatacacgattcatgtacagcagaactaatacaacactgtagaccaattatactacaattaaaaaaagaagacaaacctccatgtaggcttgagatgtgtatgtatgcctgtgtgtgtgtatttaacctgcaacaaataacattatcaacaaagtctttgtcggtactgaaaatagaagggaagttacaagttacaagttactaactttcaaagcttactaagctttgaaaacctctctacaaggctgatgtctcactatctcttttctgaaacatgctggcaaatatttttaacctaagcagactttcagtcatttggatcattgtccaaattcaccatgtggaagtttttccacatcgtttaaaacaaagcttatgggccctgaaatgcgaatctacatccggcactcgttttgtctttcgctcattctcagaatgtctgatagcgggtagccgtgccagaatacaggcacccttagagctgacgtgtgggaaagacgatccaatgaaaggaacacccaagctgctgtaacagtgcccatctaccttcacgaggagcaatggtgtaggtgtaccattcaaatcaagtgcagactaattgttcactttctaaacggacaattactacatttcatgttgacttcccaaagcagatttttcatggttagcaatgcttattttttttttttaaggtttttttccttatgtggactgtttttaaagtctatcttgaatttcttacagggttgcttctggtttatgttttggttttttggccctgcggcatcttagctccccaaccagggatctaacggtactctctgcattagaaggcaaggtcttaacccctggaccaccagggaagtcccttgatgagtgatatttaaatgaaagtgctaagctccaggaatgccttttgtttaatttcactctttattgatagggaactagatttctcagattcctgatcaaaatgcagaggctgtttttgaaaagccatattcttgttgcatgtgcttggggtgagtggagagggggaggaggagaggaataccatgtgaatgaatgaatgggtcagagggtcagggagtgatgtagacacgtggtggtgaagggtctttatagattcactttcacttccagatatactttacctccttaggactcagcaccagggtctgctgagacttgatgaccttaatatatgacagacagagttcccataacctaaaaggttatcactgaggcagtaggaacagtgatgcagaagagaagaggagaatggtggttttaccaatgaggaaatattgagacatctctttcagtctctggcacagcatttttgcctgattttctatgaaagttacttgtctggcaccaactgtgacacataatgaagggatgtgaagatccagagattcatagaagttctgtcaagtgttgaaataataaatagctcagttttcatcattggtcctcatttacaagcagcattcactaagcactttttccgcctcggtggatgaccaaggatgtaggcagtgaaactactcaagctgttaccgtcatggtaggtgcatgtcactacacatttgtccagacctctgcagtgcacactaagagtgagccctgagctgtgcacttcattgtgtatgtgtcggttcatcagttgtcataaatgtccccttctggtggggatgttgataacaggggaggctgtccttgagtagggggcccccaaagtatttgggaaatcttggtacttctcagttttg

SEQ ID NO: 43825 - DNA, 1359 bp, Bovine  19866880739965
tcaccatctcccagagtttgcccaagttcatgtccattgaatttgtgataccatccaaccatcctctgtctccctcttctcctgtctccaatctttcccagcattaagggtcttttccagtgagtcagctctttgcctcaggtggccaaagtattggaacttcagtttcagcatcagttctttcaattaatattcagggttgatttcctttaggattgactggtttgatctccttgctgtccgagaactcttactactttgcttaagaagatgatagttacttggctcaagatcagcagttctgagtggttgctctacctgtataaaacccttattcgaggaccatctgaaaattttggggatattcagaaaaactcaggccaggctgagtggagggtgaattactccttaacatttggtgtcagcccaagttctccaaagatcatctagtctggaaggcttttcatacctcactgggttttgggagaaatgcacggtgtttagacacaagtgaaagattctagtatcttaggtaaccaggtagattaggcattagggatttagcgctaagaccttaacctgcatcaatataaaagcctctcctccttttactgtaaactaccctgtcagctgctggtcttcagtggggaagcaacttactgggattcaagaactgtccatcggagagggctgcgacaaaatagcaacggttcaacatgagtttctccatgcgcttggattctggcatgaacagtcacggtccgatcgaaatgactatgtcagcataatttggaacagaattatttcaggtacgtttatcttgttgttttacgttgttttaaacttaaatgctgaatttctaaacacgtgctttcttctgccattggtgttgtctattaataatgggaaaacgctgatgctttgatcttaacttcatttggctctgggcttcccaagtggcggtagtggtaaagaatctgcctgccaatgcaggagatgcaagagacacagatttgatccctgggttggaaagatctcctggagaagggaatggctactcactctagtattcttgcctggagaatcccatggacaaggagcctggtgggctatagtccatagggtcgccaagagttggacatggctgagcacatttggctctaattcagtaagagatgaagtgcctgaaggcgattgggaaacagttttccagaaccccagtttgagctggatgtgatgttaggaaccagtgtttcctaaagagtattttatggagcactgttccacaattttttcgcaagtgttttgtagaaaggaatctgtggtcaaattaatttgggaaatcctaggttaaaagaa

SEQ ID NO: 43826 - DNA, 1888 bp, Bovine  19866880819670
tttactgagaacaaattggtggtgttgatcatcactgggacagagcaaaggcaatggagagcctgctggaatcgtgttcatggagactgatctttgtagcagtgttttattttcaagtatcagtagggaacaaccctctgctgtgtggtttttgctcaacattttctttatataatatagctcggccagattattataatctctgaggactgtatgaatgactgcaacctagaatttgaagtcttttccaaagggtttgtttttaaccattgtgtctgtctcctgctgcttaaatccctcacagatgcagggagatgggaagaggatattctttgctctccactgtctatccctctctgccttcttatttattgtctttactatatgcctgcgatgcaggagacgcaagagatgcaggttcgatccctgctgtctaatccctggctcaggaagatcctctggaagaggaaatggcaatctgctccagtattcttgactgaaaaaccccatggacagaggagcctggtgggaaacagttcatagggttgcaaagaattgggcacgactgaagtgacttagcacacacacaagcacagaggtcagaaactctgggttgttggcccctgcctgactctctctttctgcaaggccaacattcatgctttatttcagcaccagatgcctggaattccattttttttctttcctgaacccctgcaatgacctttggctagtctccttgccaccatttttgctcccctagggttcgttcttcatgcagtagagagaatgaatgtattaaaatgaaattcaggcttcctcttctcctcttttgccatttcagggatgttatgaatgctttagtatgaaattctgctcatctgcttttggcagagctagcttctcgtccttcaaatctcacctcagtggacaccttctcagaggggtcttctctgatcagcctgaagtgtttacatcctcatcttactctttgtctcaggccctgtttttgtcccttgtagcttttattgcagtttgtacctgttttatttgtcttctcctatagtattcaccttctacaaaagcagggattccagtagtttttgcttcctccccattaaatctctcctacttaacatggaatcttgctcgtgctcaatcgctttggggttgtgtccaactctttgtaaccccatggattgtagcccaccaggctcctctgtccatgggattctccaggcaagaatggggttgattgccattcccttctctagggcatcttcccgactcaaggatttaacctgagtctcctgcatcacaagcagattctttaccatctgagccacctgggaagtcctagggagatgatctaaatgagaagcaaagggagaactgcccttctccagggactgcacacaaacccaggatttggagccgcatctggctgctctatctctgacttatatgtgagaggggtggaaccactaagcgttcaggtccgcagacccaagatcacaaaatattcatgaagtctcccattctatgcacttctaccatctctgcaagcagcacagatcagaaaactcatccccttcttatacccggagaacagaacagatgtagagagagatgaaatcgtttgccaaaggtcacagagttcatcatgcttgaggacaaggaccaggaactcaaacatttctttattccaaattcagagctttctctagcagatgcttctgcctgaaaagctggtgtttcagttcttgtatgctaagctctgttgcagcatttcttctgatgtatggcccaaattctgcttcagtgggtcttgctcaaaactcatttctttggtgaaccatcttctaatctcaaatgaccacaggctctc

SEQ ID NO: 43827 - DNA, 2900 bp, Bovine  19866880936971
atcagtgcttatttcgataataatcactttaaaaatcttttttggcacccatacgtatcatcgaaacagccttgggaggtagtattgttacagttttcatcttacagataagaaaactgagattcagcagttaggtaagtgcccagagataaaagtaaaagttaagttccatcataaacttataaatcagccaaagtcagttcctggttttcgtgtttcagtatcatttgtcaggatgaggacttgacaagcttttgttcttgacactctgtagttccagggtcaggagagaatggggtctatcttctgtttctgaccccccctttctcagcacagtttgtgagattcatagctccctgaggggaagggtcaggctgataaggggttcagctgcctccagggccgaggggccgtgtggagaagtgctagctgtcatcatgggaaccaggcatgccgccaaggtgaggaaagtgtgagggcttagcaagaccttgtggaaggaagttcatggatcgaagccataaattcacagggctgatggctgtcccaaggctgctagtttgcttgtgagccgagggttcgaccagagcaaacagactttctctgccagataaagcatatttatttttgtctcttatttagttgtatgttgtaggccttctccctttcctatttttcgctgagagttgaaatggcagctgaagttcgttccttcccaagtgaaaaagaaagaatatagaaatgggggggcgcactgtacatgttgagtgtctcgtgtttttggtggcaacagtagttcaatttattgtttttattctcggctttagagtggattttggtaattctgagccgtgtgtgtgctcagttgctcagtcatgtctgactctttgtagccctatggactgtatcttgccagggtcttctgtccatgggattctccaggcaagaatcctggggtgggttgtcacttccttctccaggaaatcttcccaaccctgggatcaaacccaaatctcttgcttctcctgcactggcagacggactcttgacagtagcaccacttgggaagcccctattctgagctattggctatcagttcaccattgtgaagagactagtccagttcactttggataaaacatgagggtaataaacattgcataaaggtaagctcaatttgcttggtttaatgatgtaaagagcacagttcagttcagttgctccgttgtgtccgactctttgcaaccccatggactgcacagtacctcacaattacacgctaggcttccctgtccatcaccaacttctggagcttgctcgaattcatgtccatcgagtcggtgttgccatccaaccatctcatcctctaccatccgcttctcctcctgccttcaatctttcccagcatttgggtcttttccagtgaatcagttctttgcatcaggtgctccataaagagcacagggatggaataaaaacccttttccgagaaagttagaacaaacattctttaaaacacctgtttgaattatttgtattggatttttaaaaaggaagtagacacagcgactaaaggctcatttttggtcccattttctggtgtttgaaaaccgcctcatttctgtctgtcggtaggtaattctgtccctgtatctgaaggcaggatggccttggcctcagggtcattcagcctggtagcctgtttcaagatgtaattgtcatccttgacgttcatcatccccggctttcactttcttctttacctctaaacagtctagaaagtcagcttctaccagcatctctggttgtggcgttttagacaccagagagcttggaatcatgtgttgaacggttgtaaaggctagagttgccttcacctccttcctttccatatagaactaatggcagacagtttccatccctttacgcatggtctcactcagctctttagctctttatcaggtccccagtactacgtaacaaaatccaggggctagaaggaaactccagggtaatcccaccttgtccccatcgtatgatgttatgggaggaggcgagagctggaggttacgtcctgtctccaggtccctggctgagtaatggtcgaaatagaactgaaacccatgtctccggctctgtctggtgctattttaaccataacacattactttggttaaacttgtttgtttcccagctgtcccttttgtcattgtaattatcctgtatcattataatggcttaaaatccatgtgtgacaggaagagccacgtgatactgggactttctctgaaccgtataggaagggctccctgtgttgcagaggcaggatcgacagctagacatggcatttctccgttaattccatggtaacttttaaagtcagcgagggggctcggatttgaatctgtctgtcttcgaaatctctgccccctcagtacctcacaattacattttcagaataaataaacctcttatacttgaggttttctttttaattttaaatctaatcaggataatgtatttttcttgaactattaccttgctttgttttaatttagacatagaattcaagacaaacgcttggaatgaatagtgggatgcatgtaagcagtcctgataatgaggctgcttgaagttacagaaatgacatctgacttaagcggcttcatcaggttgaataagagaggacattgataactggcaaaaaaagaggccttgtttttactcaggatttatgttccagcggttagcttggagtgtttcttttacgttagaaagaggtagataaatataagtccttttcatgtcatagttaattttcttgcttgtgaatcactgggtttaaaacactgatagctttacacacgttcatctaaatgagtagtaaggcagagctatag

SEQ ID NO: 43828 - DNA, 807 bp, Bovine  19866880947189
aataagttgacaaccttcatttccagtttattttaaactggttttgaaccctctgtctctgattctctatagtagtaagataagaaatggaaaagtgaggtgataatctaaaatccaatttacttcaattatttgaatatttaagataattatttctttttttaaacttaaacaagggataatttccaacatgggctaagttatcataaaggatttgtaaaccatcccaatgtagatgtgataaataaggttgccatggcacttctctgaatagccttccctaagtctctctgccctctattccagggagcctacaagtcatccacaatatgctattgtccagaaaaaggcagctggacagaactcgaaggagatgtggcagaaccgctggcagggccagcctgtgcaacagttatcctgcccgcctgcgtaccttacaacaaataacaccaggaaaccccggaacgacacattctaggaagcagtgacaagtgacatccctattgtagccagaacaatgcattctaatggtacatctgccgaaacccactttagtgtctggtgatttacaagaagctacaaaaggaaaagacctgttcttgaacggaaactctgtctgtaactcggatcacatcaaacttcctgtggtgacagactcttccattgcagactggttttaacttgtctcagctttacgaaatccctcacgtggatctcgactttcaacaggagaaagaaaatacagaggagtgccccccgagagacctgaggatcagtattgtgcattgtagtttacctgcatgtgat

SEQ ID NO: 43829 - DNA, 1154 bp, Bovine  19866881041361
tagttgagcagttttatttaggcgattttcttgggctttgcagaagcccaaggaatatacatagatatgttttaagagaaagtgaagtgtgtgccatttctgtttggcgtgggcctttttgttgttattgctgttggttttggttgataggaatcagtttgaaactctgaagggcaaggttatagattaagaatggtagcactgcgagaaggcgtagggaagggctgagggtgatgaagatgctgttctggtagattatcaacttgtccttgtccatgcacccagcatcagtaacttctctccatttaagaaaaaaaaaatttaaaataaaaagttctattatcctttagagtagttggttttctttctttcttttttttttaaattcagggtgttcactgtgaaactcttgaccttcatataatgatatttggtttctcaaccttacatttcacctgttggccataaaagctgtgttattactgaggactgaaattccacccactggtttttccagaatatttgtagaactttctcaaccactaagagctgccaacccagctttggtatgtagacctcccagctagccggaagcaaaatataatttaaatcacttttttctgttgcataactgccgttgacttcggcacttagttttccttaatggctgtaatcaaagtttatctcatattatgatgtagtggttagactttcttgtaaaaaaataaggaagaggattaaaagctgcattggctcggctttctagtctttgtcccttttggtttttgaatggatggatctgtgtgaacagaatgtttctctatgatatacgggtcccttcctctaaacatatatatatatatatatatatatataatacatttgaaagacttttctctttctttctcctggggcagcctttgccataactttatttataaatccatttgtacagcagatattgggcgaggatcttctctgccaggcagtgtccccatctctgaaacactagagaaccataagcctgccacgggcgtgtgttgcactgtagctaaaaagtagcactaaagaacattatgtagagctccctgcgccatacagtagtttctcattagttatttattagttattgatacacacagtatcaatagtgt

SEQ ID NO: 43830 - DNA, 715 bp, Bovine  19866881085851
tgtgctttgcaggattctaatgcacaattaatctcttactctagcatgacaaattacttccaccttctaaaaatagttttaaatccctacagtaaatcccaaatatcaaattagcatatataataatcccagaatcaagttatatggtcttaaactagattcatttttctaccaaaaaatacaagatcatagtagcatgatagaaattaagtctcacaaattatttcagttgcgaaagtgcgttatcccaggaaatgtaatgttgaggtaaaaggcatgttgctcatcataagaattgctctaaattttaattcctgctctgccacaaggcaccagaggcttcaatttaattcaaataaaagatagggacattaaacaatgatatacagagctgtgcaagtgaaatttctaatgatacacaggagtaagcactcctttcaaatcagagtattgattcctgatgcactataaatggtcatcaaaatattctctccatttcacagacagcaatttccctataatacatacgtatgtaaaagatatgtacccatctatcaccacttctgaataatatgtatacatgaagataactatcaacaaaattattcatcattggtatagaattcaatgtaattcactgtaacaaaaattttatttttcattttttgtaagccaaaagaatcatgctgggcattttcatattggttcatataat

SEQ ID NO: 43831 - DNA, 1521 bp, Bovine  19866881200527
gctttaatggtcagacttgacttcagtggtgaaatttggatttatggtaaaattctagatgtcaaaggataattatttgtcctctctgcagttcatgttcttatttaaatatgatctttaaatattaaaatattaaatatttgtttaaaattaaaatattaaattaaataatttaaatagatatttattatttaaattaattaaaattgaattgagttaaaatttaaataaataaatgtttaattaaattaaaattaaataaacaaatatttgattaaattaaaattaaatatttaatatttatttaatatctttaaataataaagataatcaatacagctttttaaaataaaaagtaaaataattttaatactattttttttaagagaaatttcctagaaggaagcaatgccaaaagctcatcatgtcaaagaacatttgatctgagtttataattttcacagagatttcttgtcctcaatataatctttcagggctcaagtttggagtctcatttttgaagatctcagttcaactggtctgtgccacagagggctctagacccccgactggaatcaagtttctatgagcacaagcttgttgacacatgtgtgagtgtctgttgcatggaaacatttaataggaatgttccaagacaaacaataggacagtagaaaaaacaaaataaaaaattatatacagatacatgaactttaaagaactaaaaaaaaaaaaatttaattaataaataaagataatctgaatggagccccattctttctaggccccaaacagtgttctccatagaaatacagggatttaaggtcattttgaaccctaagattaaatacagttcactctatccctggaattttaaaggacagattaactcaacaatataaccaggtaccaaaatgtacagaagagtaaatgaaagagtgaatgtgcttccatgggtgtttaatgacaagggcatgattttgcctatgaaataagaggtaattaaattctatgcaaagtatgaaattctttatttgaaataaagaatcatttgaaatagcacagtattaaatgtcttagtagaaaatctgtctctctgtgcaaaattaaaataatgggaaacatcttaaatttaaaattcgtttagaatctcttaattttaaaactagtggcccacaagaattgaaaattgtgattatgccctaaccatagggcagtgccactttagctggtttccaaaaatacccactgtcccttgtcagtcaaaactggtagaaacaattgatatcacaaacttgcaatcataggcctcacaagtctgacttgacaaccatgctgcatggcaggcctggaaccacagaacgatgcttccacaggaaaaggtctttagatgatcaaatccaacctcattttacagggtgcaatattccattaaagggacctactatcttctttgaaccaatgctaaaattctagaactgccccacggagaaatagttagttacttaagcctcaggctta

SEQ ID NO: 43832 - DNA, 615 bp, Bovine  19866881485328
gacgaaaaaaaaaaaaaaaaaaaaatcaacattagggaaacctctgcagatagtaatcttggaggcgagctgtccctccctacccgcctgcaagaattactcaacctgagaaaccctgaagagttagcttaggtaactttctcacaaaataattgtgctttgggtggcatctttattttggcaactctccccctcccctccccaagaaggagcagattttagggggaaaggtcctgggtgaccaatgaaagagatcacatttctcagagaccttttattacagcttgtctgttttgtttaagtcaactgaaagtaatttagagctgtgtagcaaatgtttttagtagaggtgatggtatgcttaaggttaattattagcttagtgcatttccagcctggaaaaaaaactgaagtcccgaaaacctgtattgacctggaacctgagctcaaaactaagacatgctcgtgtttcctgaaattgacaaccagagactaaccccacgtctcccagctgtttgttctgcaggttgacatctgcaaacaggtagatagatgtgcatactgttaagatacttttcggtttgagagctgtgacagacaaggggcagtttaggt

SEQ ID NO: 43833 - DNA, 666 bp, Bovine  19866881520144
ccttgaaaatccgtctcctattctgttaggaacacacgttatttgtggacactccaaatttcatactaacccaagctatcatctagaacatatggaatagtatgaggccacctatatctttctccaatgatggcatttctttcttgtatctgtcaaaaataagtgggaaaggtatcagtcaaaaattatgaaacaagcaatagttaacccagaaataaaagaagttttaagctttcccaagcaacctaaggggttccttgtagctcagtggcaaagaatccacctgtcaatgcaggagactcaggttcaatccctgagtcgggaagatgtcctagagaagggaatggctacccactccagtattcttgcctggagaattccatggacagaggaggctggcgggctacagtcatgaggttgcaaaagaatcttgacaggacttaggaactaaataacatcaaggcaacctaaacaaattttctgtgtgaagcgacttagcagcagcagcagcagcatgcacatatatgtgtggtatgtacatctactcttatcacaacaaaagttttaggaggaaatcattagcttctcttttttaataaggagaatggcaagcattaatatttcctttaatcttatttcacttcaattattcatatttttacatat

SEQ ID NO: 43834 - DNA, 754 bp, Bovine  19866881521296
attctcgcctgggaaatccctggacagaagagcctggtggggctacagtccatggagtcgcaaaagaggcgaacccgacttagcaactaaacaacaactatgtataaaagatcgatgagggaggagaaaccagagccatggggtgtgtgcaggaaactcagaaggaaaacacagtgccattcagggaaaagagaaaatgtcattttctgcaactaaattgttgtatcataaaaacggttttaattttattccacagtgggctctaaagaggcagccaagaagcaactgcagtgaagttagtcagaaaatttaacgtgaaattctcccgcttgttgatgcagtaaacactctatcaagaggattcagaatgattgctgaagccataaagtggtaagaaaccaatgcctatttttcagcttatgtctttttcattttttaaaacaactgaaccaagtgcctgcttgaggcaaaataagtctcacaaaaattgtctagaaaaaaaaagcttaatataatcacttaaaatatccttgggcaggtcactaatagagacactatttaaatgaattcatgaagtaaacatttttttggtgctataattatcctgttggcttaagtactatgtataacatgctaaaacttacatatttagctcaaagatgtagtaaaaagaactctcaaagaactggtgtgttaaattccaaaatacgttagtgccatcctgaaatttccccacatctggatataattataa

SEQ ID NO: 43835 - DNA, 1152 bp, Bovine  19866881574698
ctgccatcatccatccctccttaaacaaatgctggttgtcatcaaaatgattattattactatgcaggccagatcctctgatgaaatgaagctgatgaaacactcctctcaagtaaagagactaaactattcccaggtggcctgatttattccctggaagttgtggttttccaagtggaaccctgatggttgaaaggcattccctcattgctttagaatggaaagttaaccctacagagtacacgtctgcagggcaggaaggccaggctgcatccaggtgcccaagcaggtgaccaaagaacttggcatttcccccatggtttcttgtccagcagcatcctcagaatctactagagattttaacccagactcatttcactcctgaatcacaaattgctatgtccgtggagggttgcagtccatcggcacgtggtggaggacttattaagaaccataatccactgtggaagaactccatgcccaagcttaaccatgaacttgctaagctagagaggaaaggttgacctcttaaatgctaaaacagacataatttacttaagttttgctttgttttattttgaagtagtccttttctttgtattttgaatgtatagaaaagatgacagtggaggataattttcatctttgtatgtgatagatgtatcaatgtaaaatacatataatggaaaagtttaaaaaaaacaaagcaaaagaatctactagcaagcatgtgaagagtttcctggaccccacccccagagatttggatgcactagtcaggcagggcctgtgtgtgtgtgctgtgtgcttagtcgctcagtcatgtccaactctctgcgaccccatgaactgcagcatgcccggcctccctgcccatcaccaactcccggagtccacctaaacccatgtccatcgagtcattgatgccatccagccatctcatcctctgtctcccccttctcttcctgccctcaatctttcccagcaccagagtgttttccaatgagtcagctcttcacatcaggaggccaaagtattggaacttcagcttcaacatcccttaaggaggaaccaaaggtccttgacaatttgctctcctttgactgtttttctttgtttctgcatgttctcacttctctgatgaaatttatt

SEQ ID NO: 43836 - DNA, 1810 bp, Bovine  19866880117724
tccaagtccagttctaactgttggcttcctgacctgtatacagatttctcaagaggcaggtcaggtggtctggtattcccacctctttcagattttccacagtttattgtgatccaccacaatcaaaggctttggcatagtcaataaagcagaaatagatgcttttctggaactctcttgcttcttccatgatccagcagatgttggcaatttgatctctgggttcctctgccttttctaaaaccagcttgaacatcaggaagttcacggttcacatattgctgaagcctggcttggagaattttgagcattactttactagtgtgtgagatgagtgcaattgtgtggtagtttgagcattctttggcattgcctttctttggaattggaatgaaaactgaccttttccagtcctgtggccactgctgagttttccaaatttgctggcatattgagtgaagtactttcacagcatcgtctttcaggatttgaaatagctcaactggaattccatcacctccactagctttgttcatagtgatgctttctaaggcccccttgacttcacattccaggatgtctggctctagatcagtgatcacaccatcgtgattatcttggtggtgaagatctttttgtacagttcttctgtgtattcttgccacctcttattaatctcttctgcttcaatggtatgttaggtccataccatttctgtcctttattgagcctatctttgcatgaaatgttccctttgtatctctgattttcttgaagagatctctagtctttccctttctgctgttttcctctatttcttttcattgatccttgaggaaggctttcttatctctccttgctattctctggaactctgcattcagatgcttatatctttccttttcacttctcttcttttcacagctatttgtaaagcctccccagacagccattttgcttttttacatttcttttccatggggatggtcttgatccctgtctcctgtacaatgtcattagtttgttacatatcaaataaccacaatgtctcagaagctcagaacaatcagcatttatgcttatatgttgaggttagacattgaatccagaccaacataactgtgaatgttggttggcctcaattttctcatcagagaaaaaaagacagtagcacctgtcatgcggtgtttgtgtgattagctggtatacactcagggaaagtgttagtcgctcagtatacaactctgtgcgaccccatggactgtagctcaccaggctcctcttcatggaattctccaggtaagaatactggagtgggttgccatttctttctccgggatctttccgacccaagcatcacctccgggtctcctgcactgcaggaagattctttacggtctgagccaccagggaagcctaatacagagtctagcacacctggtaaataagtctccctctttgtttttactcaaggagatttgaccatcagaagctacatctgataccttcaagcaccagattttagagccaccctgtgtcagactttttgggacaaaagaaataatgcaacagtttgactcatgatactttgtggaaccttcatttgagtgaaaaaaacttatatatgtgacagctgtacagtgaaggcttgatttgtgtgcatgggttagaaaagagggtgtgcactggaggaaacggaacagagctaatatgttaccgtctgtgatttgacctgctctctgcctgactagctgcatattcatgtcaatttcctcccggttacctaggacaagaaatgaagaggaaagat

SEQ ID NO: 43837 - DNA, 2268 bp, Bovine  19866880363660
ttatgtgagcatgggatggtttatcccaggtgttgatatcaaaaggatagcaaaagggtttaaggccagttctttaaagaaatatgaggacccaccttccctgtccctcttccctctctcagggccagagttgaaaaccagagggcgtgtgttggcgggctactcccaccatcaccgaccatccccgagaaagcagtgtcggaagcacaaaaagagcccacgtacaatggttagtcttcaaaggggctcatttgttatattgctcagagccccaccgagttgctgcaagcttataaccgccgctaatttcaaagggagctctgaacttgcatacgctccgcgaggcacggcgcgggatgagaaacagcctgagtggcttgaagccatgctcagacattttttaatgttcgtcaatgtctttggcaccatcactttcacagagaaacccacttacctcctgctgcaaagtgtgaaataaagccattttcaagcctgggtatgggatagtctggaaattgggctaaatcttaaaaccacatgaagactgaaaacaggattcacaagctggagctcagctcccactaacccacttccaaggtcaggtcaccgtgacaccctgctcggttagatactgtcagtgccacctttgaagggttaaggcagtaaactgtggttgtctcaggagctaccaaactaaaggcccatctccaaggcatcccaggatcactggtccccagaataggagagaagcattatttcagttagtgctttgtcaggacccaattggcacatccctggggaaattcaagttaggaactggcatttcttgccacagtgctcagcctcaggaggtgctgtaagtgtcccgttggtccagaatgtttgtaggagacagattcagatccatcagaggtcttcccctgatcacctgcatagtgaccagctcttctccagttgtgtttctggggctccctagtcaccaaggcaaggagaaagagatcccttagggactcagaaatgaccctgtacactccaggaaactctgcgacatgcaattctccaaggagcctctggatgagtctccatgagcaacttgtttttagaaagataaaggaaaaaaggtgtcctttttgttcactgttcaatgaatattcattaagtcttggacagtggattggatgctgtcttttagtaagaaagagaaagttatttatttggaagaaaaggaggtaaataatgagacatgagatgtggtttttagaaatcggaagatgccctcaataagtttaaaactgcaacctcttctctaaagttcataagaaagtattgctgggcgtttatatactcacatgctcactctttcatcgctcctttaaccagtgcttactgagtacctgctccatgtaggtgcaattccacttgttaggatcagcagtggacaaagcagatgaaagtcccctcggcttgtgtccaagcggcaaacacatgctgtttgttcagtcactaagtcgtgtctggctctgccaccctatagactgcagccaaccaggcttccctaggataacaaaataagtaagaaaacttttaagttcctgttcttcacacagtgaaagctgttcacttacacgtaagatctgtggccttaaatgaaacctaaaagtaatgttttttgacaaaaaaaaaaaaaaaattctctgtgtttctgtctcacctcaagaggcttgtgagtagatgtagccatatatagacagatgaggcaccacgagtagtttctagaaatgtatcaagtcatatctatccacagtggcatccctaaatgttcccatcatcagtgtaaacacctttgagtaatctgtcttcacttactgctctccttaaatactcatgcaatatgccagcaggctgtctcccttctttctgttgcatcttcttatcactaaaaggagacagccacctctacccctaaaacacaatatacttgtatatttttccctctcatcctctttccctttatctcttcttttcttcctataggatctatgttgtaccagacatggtacattcccataggcctcatcttaaccacactaaaaaaaaaaccacctaaattttaatatggttgcttttagaaacactgaaaagaactacatagaatggaaagacgtgaaagtcagatttctcgtagaatatatgactaatgccactgccagtggcaacaccttccacttactgtacctgagagtttacaagtcctttttaaagatatac

SEQ ID NO: 43838 - DNA, 1253 bp, Bovine  19866880420597
ttatccaccaaattgtcactgaatttactgctgtatccactgcaaagctcatttagcatcatgctgtattgactatcctttcatgttagtcaacatcaatcccacatctttaattctgggtgcaatgtgggctgtcgcccagaagaagaccagccccctccctggtgaacatgttcgggtgggtttctattgtgaatattataaaatcactcttggttggaaatatgaacttgcctttgcaagcagcagcaatataagagatgaaagcgtattactgagcttgtgttcaaagacaatggttgagagtgaaaacttcccattctgagtccatttttgtgaaagagactgtaaacaagatggaaacaaagaagtatgatggatgacaacatttcttgaacttcaacttcacagactagcagcaaatctcatgacattctctatggtttctttggttatttttggataagatagcaccttcttgtattaatatatatcccctcatttatgaaactatgtctaaagttcctaatgaactttaaaataaaaaaacacgtttcagagaaagaatgaactgatgcttcatccatcaactatcttcctttaagctgttttttaatgaagaatttggttatgcatgaaaatgcctttgggggcttccccagtggctcagaggtaaagaatcctcctgaaatgcaggagataaatgcctttagtaatgttcagcagataaaagataatttctaaacaacactggaacgaagtctcttttgtataaaaatgtttcacctctaccccttgttaaaggcaatgaagtgttgtaattcatacaacaaaagctacaaatgctgtaaattaaatgggtattcatcttggagattaattgttaaagttacagtgctcacttaagtacctttcaggatctatcactaaatttatgcatcagcgtttttagttttgctcaaaaaccgagaaactcacagttttatacaggctgttaatggagatatgtgtcaagtgttaatatcttgtctctttaagcaatgaggtacactatctaaaaagcaagtgaactaacttataaatgactgcctacatagacagagagatgcattcattattaaagaaatatttgtctcttgttcagttactgaaattggaaattgtacctttaatggtgaagtcattcagtcatgtctgatcctttgcgacccaatggactgtagcctaccaggctcctccatccatgggatttt

SEQ ID NO: 43839 - DNA, 2431 bp, Bovine  19866880491190
cccagtatccattattattggtattcaaggtacacttgaaattcataatcatttccctgtagcagcaatcaagttattttgtttgaaaagcaccatgaatgatacaactgggtagaagaaggaaatacttttgtttccatcattatattattcaccactgaatcacaggggcctaatttgtgggaaggcacattgtagaaacacagtaattatttgttgaataagtgatagaaagaaagaatgaatggggtaggaagaaagattcagacttacaggagtgtgggtcttaattgtagcaatcatagtgaatctgtcacacaaacagctggataagggaaagtcaaatgtctccaggggctaaattctgggacataagaacatatcattatagagacctcatataacctctgtccagcctgaggctgccctggttggctggagccctcactgcatttttttctattgttttttaattaagcagctaggttcctgggttaataatattaatgacattctgagttttgattttttctcaatttttaatcagaaatggagacatgtctttttaatagttttaatgatttctaattttaggaatgttcatgaaatcaaacagtctgaattttaagtggagctgcagatatcaaaattgggtatttaaaaaaaaaaattaagaaagacactagtttccaaaatgccaaatgtgtataagatttgcctacctttgtacaatttccattcatttaccctcacaaaaatgagataaattgaatgtcttattctattaaccttttataaggggattctgattcttagctctcagtgaaatttaaagtattgttaactcacaaatcaacagtatgattataaagcttcttgaaggcaatcactggaatgcattaagtaactagcaagattacatggtgtttctagcctaatgtggcacaattcagattgcagtaattggtgcccagtgaagaaaagtaccagtcaaatcaataaacttagactcttgtacattgataactgagcctggctgttaaaagtcattgattaccaagagaacggctattaaaagaaagaggccaagaagctgactgggatgttttactctaataaaaaagtagctctgctgaagtaaatagttgttgtttctcagcaataagtcgatttctgcaagagcacatcagtcatttgccaaatcagatcccctcggccatgccgacctgctcagcccacgtatgtttcttccaattccgtttcactgggtttggtggcaaatgacagaatggagggaatattttgacatcttactgtagtattgttccagatttggggtactggtgctcttggcatgaatttctaacatgttctgattccagcctgtgattcatccagcccagcacttcaaatgatgtactctgcatgtaagttagataagcaaggtaaccatatacaacattgatgtactctttccctagtttgaactagtctgttgcttcacgtctagttctgtttcttcctgacctgcatacaggtttctcaagaggcaggtaaaggggtctgctattcccatctctttaggaattttccacagtttgttgtgatccatagagtcaaaggttttagcttttggtagtcagtgaaacagaagtagatttttcccccctgaaattcccttgctttctgtatgatcccatggatgttgatagtttgatctctgattcctctgccttttctaaaccaagcatgtacatctggaaggtcttggttcacatattgataaagcttagcttgaaggattttgagcattaccttactagcatgtgaaataaacacaattctgtgctaggatgaacattctgtggcattgtcattctttgggattggaatgaaaactgacatttttcagtcctgtggccactgctgcgttttccaaatttgctggcatattgagtgcagcactttcacagcatcatcttttaggattttaaataactcaactggaattatatcaccttaactagttttgtttgtagtaatgcttcctaaggcccatttgacttcacattccaggatgtctggctctaggtggatgaccacaccatcatggttatctgggtcaatacaactttgtttatacagtacttctgtgtattcttgccatctcttcttaatctcttctgcttctgttaggtccttatggtttctgtcttttattgtgcccatctttgcatgaagtgttctcttgatatgtccaaatttcttgaagagacttctagtctttcccattctattgcccaaacatgtggtgctaatccacaaaaacaagccctccttcccagaaccatccctaatcagctactcaaaaaactagctgaactttggtaggtctctcctgctaaagtcttacaaaggtttccaccttctt

SEQ ID NO: 43840 - DNA, 1503 bp, Bovine  19866880503535
gatacgtcctggtcttcaggcatgactggatccagagcttcaaattctgttggagctagcccctggccatctctgatctctgttctctgcctcgattctcaggtaccacgtggctagcccctcatagtgctcctcaagagacagtctcactccccagggttacatcactgaaggaccactcagcattctcagcactgctggtttacttccattcgttttcccaaagtaggagtttgccccttggatggcagagaacaggtaacatgcagggctgccagctcatagccctgtgcagaggtccatgtggcaagccatggaggcctcctgtcaacagctggcaagaaaatgggacaccttgcccacaatcatgtgagtgagccctcttggaactgggatttccaaccccagcaatccttttatgatgcagccctaactgtagagactcagcctgaattgtcagctaagtttttcttacatacttgacactcaagaaactgtgagatgttaaatgtttgatgctttaagctgctaagttttagggtaatctgttatgcagcagtggatcactaatacaaatcctaaaactgaacaggagatctgtacaggagtaaacacacaaattagagttacattctggactagacattggtaaagttagcttaacctttgctccggttcagctggagaattgtctaaattcagcaaaggtggtcttccaattgtgataccctgtagtaaagtatttgtgcctcattcatctctctcctgctcgctctatcacaggacttgaactgacaaagggacttgatgaattctggttgaatgatcaactgaagaaataatgaatgcttctgtttcctcacttagaaaaagatgaggtctcattgctgtttcatacccttcttcatgacttgttcaaagaaagttaaaggatataaaacaaagagggttagagcattttgacctagaagacaagaattctcagagatgccttcgtcttcaggaagacctggaatggtggattatcagcatcattatgcttcaataatagcactttgttaaaattaaatcatgcaatatcatatcatgcaacaatgtgaactattgcagaactatatttttttcacttggagagatacttatgatattgtgattacaatggagcatgatgcattaagtaaggtcttgatatttgttgaataagtgggtgaacaaaggttcaaaagaacatgtcctgtttttaatataaaatattaatatatccatatatgtaatgaggtggtgagaaacatatttggtataatatttctgatttgaatactctattttgggaatctattggagtggtgggtaatgtgagggttggaggtgaggtccctaatggtatgcagagtgaaaatttatgatcagtaagttgttatctaaagagactggttaaatggactctttggtttttttgtttgcctgagccatgaggtacgggcgtaagcaaacttcagaaag

SEQ ID NO: 43841 - DNA, 2661 bp, Bovine  19866880516302
tggagcggcagcgcgtcatggccgcccaggtggcgctccggaggcagcaggccacggaggtgcgtacccgccagccggctcaccccctcccgggtgtttggggccgcggtgggggtcgggagtcggggaggcaggtaacgcacactcttcggcccgggtcttccaggcgcctggccctgcctcagaaggatgtgaggacacctctgcccacgctggcctgcggtgtcgggaggcaggaagccatggccatcgctggggaacttggcagaaaagattttgtgtgaagaagcaggcagagaggtcttgaaagtggtttagttcctttggggacattatgggacataattttatttcgattttctgtattttatcgtttattttggtggtgttgggaagcggaggacagaggccattgcagctccctaagtccatgggcgtattacccagctgatcgagaaaaagaaccacccagcacgtagagctcacagcacttccgcagtcacgggccacttaggaaagttgctgcctatttatgtgtttgtcagtcgtgtcccactctgcgaccccacggactgtagtccaccaggcttctctgtccagggggttttcccggcaagaatactggagtgggttgccgtttcttacagatgagagcaaaagtgacgtgggaattttgaagagacgtctgacttccaggagaactacctaagaaccagttgacagatctctgccgccagcgcggggctgtggctgtgacgagagcctgaatcttctttaagggaaagggtcttcttgaacctcggcctgggactgtgtgtttcttgtgtccctgtgcaagcgcgctccgaagagagcgggcagctcccacttgggggtggatggagaatttttgatattactttttggcgagaaggggccggggagtggaccacaggcaggccttgggcagtgatcctcatgggaagcctcccaaaggccctagagagcgcggcgcgctgggctccagaggtgcctgggccgcggcgcggcctcctcgggtgtcccgcgtgttgcaaggcggtctctgcgttcgctcgcgctccccgcggcttgcgggcggggacgcgggtggggaagggcccggaattccacctaccgggcggtgacagagggtgcgcccgactctggttttgctcaccttcgggtgcccagtgaacagcttggagttttgggcagacctggaaactttcgacttttccgcgtcgactctctgtaccggatcccatcagccctgcttcgaggagaaacctgctccacatctctgaccaacgtcgtcgggtgcccggcggagtctttggccctaggctgggctccgaggttacagcggttcgccgcagctctgttttagggcccggctcctaccatctcatccactgtggatttcacgtcctccccgcctgtccctccacttctgaatgtggactatgtctggatgactctcgaaaagtggccccagggaaagcccgggcccttgccccacaattggagggttcagacagagcatctagctcattgtgctggaactaagcggtgctgatattaatttgtttagaatcatctttacatgggatgggaaaataaatacatttagaacgaggaagattactcatgcctctcccttctcttaaccaacctcccccccccccccaccctagggctctattgattatgtttcttgtatttacaggacaagaaggggctttccgggaaacagaataatttcgagcgcaaagcagtgtatcagaggcaagtcagggcacccagtttgctggccaaaagcattttagaaggtaaagcaacgcagaattatcctttagccttttaaactgtgttctcagtgattctcattattcaggcacatggcatttttacttatctgtgaaggagcaatctgagggggaattgctttttattggaaagtttgggtttgggaaggaaatcaggatttgggaaaattaatctcacatacctcctttttttcactggtaattttgttttctgcctagtagttaatgggttaacatggagtacatgtgaaatttgccctagtgtgagggatgtacagatacattgccaagtgatcccagagcagatgtcctggaaggaaataaattaaaagaaaagaaatctttagtttcatttggaactaaatagaatgagtcaagtgagtttaacagctacccactgcctttagtctgggcagtccagcctttaatacctctctttttaattgtactccttttctctctggattatctacttaaattgcagttattccacgcttcattttgctatattgacagtttatagattgtagaatgtggaaaaagttttgaatcacacaagagaagtggaggttgaatttgaacagagtgatgtctctctctccgtgtgtttgttttctctaaagcttgggaatatgttactttttcttacaatactactgatttttaaaaatggttcagtttgggtatggaatttatttattgatataataatatattgactgtttctcaccatttaaagaaagggaaagtttatatttgctctaattgctgccatttcataaggcctcagcgtgaaaagcaggtttgttttttttttttttttaaagtaggcatt

SEQ ID NO: 43842 - DNA, 2158 bp, Bovine  19866880522680
ttaatatccaaaatacataaccaactcatacaactcaatatcaaacaaacgattctattaaaagtggtagaagatatgaatagactttttaaagaaagacatactgatggctaccaggcacatgaaaagatgttcaacattgctaatcatcagttcagttcagttcagtgcagtcattcagtcgtgtctgactctttgcgaccccatgaatcacagcatgccaggcctccctgtccatcaccaactcctggagtttacccaaattcatgtccatcgagtcagtgatgccatccagccatctcatcctctgttgtcccctcctcctcctgctcccaatccctcccagcatcagggtcatttccaatgagtcaactctttacatgaggtggccaaagtactggagtttcagcttcagcatcagtccttccaatgaacacccaagactgatctcttttaggatagactggttggacctccttgcagtccaagggactctcaagagtcttctccaacaccacagttcaaaagcatcaattctttggtgttcagctttctttacagtccaactctcacatccatacatgaccacaggaaaaaccatagccttgactagacgaacctttgttggcaaagtaatgttgcagttaggacagtcctatgcagtattttattagtctttctctgcctctttgtccatatttggtgtctacttttttgagctaattagggggttcactctctaatggcacatgggtttaagttatagcctctccattttcaagtcataaggaacattcataaatagcttttacatgtaaagacttctggaactgattcaaattaatacaaccttttttttttttttttttgagctcttgctgtatgaaaagctcttgctgtatgaaaagctgtgtgtgaggtactgagagaagatgggatagatgagatgtttactgtccaggagctcacagcatctcactagggaggccggtacaaacgcagctgacaaagggagataagaagtgctgtatcagagaaagagttctccctcatggattcaagcctatctttttattttttcatatttgttttctgaaaagcaggggattctaagacttagaattgcatttttacaatcaaactttgaagagggaaaattcttaaactgactcttctgcatcaccaatatactgttcaaatggaagaattgtatccttcattactaaaaggctactttcttagagatgacaatttgaataaagcagggttttactagaggttcttttggtaaatgaatgtgaccatttaatagacttctggacagttgagggactctaatctctatgattccttggtttgtatctggtttaaaatttggcttatggtcaccaaatcatcctctctgcaagaaaatttgctgatatgtagatccccatgcaaattgcttttcattgagctcccagtaaaattccctctatgctttttgactgttgtcatgttacattccgggttcaaagaactatggcaagctgagacatgtttatttaaatggattttgtggaaatgtaacattagctttctaacacctgtttgcatttccatacagactcaatagaaaggaagctttattctcatgctgaacatgcagaataatatctcaaatcctctgcttctgattgaggtaggaaaggcaagttgtgtcttttttatttattcattcagttaattattcatccatccatcctatactggatacttgcattgtcccatgccctgtgggtagtcactggttacataaggtaactaatcattaagggggcaaaagcacatgctagttagtctttacttcttccaaaactaccaaccattgtgttcatgcaggattccagctatgtttttccaaatgatttctcttgtattgatcaattatagagaagctgttgtattctcattattgagagcactggagtagactgtttaaatcaaagtggaataatgtaaatcaatacttgtgccaccttggtaaagtggttaagttttcttacctataaaatggggacaataataatgatctgaaaggatttttaagaagagcatgcctggcagatagcgaacaatgaagaaacatgagtggctttacttttttctgcagaaacga

SEQ ID NO: 43843 - DNA, 2645 bp, Bovine  19866880656266
tagaatttttccagagcttattgatttgttactgttttagagtctgtgcagacttttgtctcccttaaatattttagaaaagaataactgtatgctcttgtgttgtgcactgttattaatatcctgtagtgatattgtctttaataattcttttcacatcagggaacacttttccataaagcaatagttctcaactgggggctattttgttctcgggaacatttcacaatgactggagatgcttttttattgtcgtgactgggggtaagttcctgctggcacctagtagggattctccccaacatccttccatgcaacaggacagcatccacaacattaattatctgcttcaaaatgtcagtgcttagtttgagaaactcagctgtagagcagagcgttgcaaattgtactggtcatcagtcatctgaaaggcttgttaaagcaacaattgccccctaccaaatttctgatctagtaggctttggaggaggctgagagtttgtagttctaacaagttgtcaggtgatgttgatgctgctggtctgagagccgcgctgcgagaactatttccatagggcttaataagttacatgactttaattgagcctgtatgaactattagcttcttaatttgggtcctgacttatattcagtagttaggcttatcatatcgctggtgtgttgcaaacatcacttgggcccaggccaggtctcttcctttcttggtatgtcctgggatgctgagaatagaaaataggtctcattactgtggaccagatggtttcacttggctgtgtggactcggcaccatataaatggctccaaggacatatgaatgagttgttggcctggggaagattgatagagagaggggagagatggagcaagtgaatgtggaaaggaaagaaacatccattttttattgtgcttacgacactctctcactgtatctcgaaaccacaacacacctgtgcagagttttgcaatttcttataaaaacatggccttttagtctggaatggtagattctcaacctgacactatcttaatggtattgcagtcaggttaacttttcactgtcatcacaccagagggaagatttatcgcttgtgtctccgggttcataatctcttttccaagcatcctttctcccaccttgcctcctgttgccctcagtccattcagcatgagcagagctcactgccccctctcataatgcatcatatcgagaccttgcacagaggtggcaactgaattcagggttggggaagctaagtcaagttggaactgagagggctgggggtaaagcacgggttagatcagaaagatcccagaagctgtgggtcagaaaccaaggaaaaattgtgcttaagatgaggcagtatgtcaaaaaccagataaaggttagaaaagcactggggccaaagcatgcaggaatgggagtgttcacaactgaagtgaagcccttttttcgaagcctcttatgatttttacttggaaatagtgctggtctgtgaagtgctaagccagttcatctggttgacggggtagacctcagagcataagaagaatagttgataattttctaggtggagcacagagatgggcatatagggatttcaaagatactgctaatatttctttcctcaaggtgttaaagcaagtggattattttattactatctactacttagaaagatgttaatcaaacacctcctattcctcaagataattttctccccctttcagaaataaggaaatggaaactgagaaagagaggtcatttgctcaaggaagtgtggggctggcatgggggtacccagtttcctccgtccagccctgctctcctctctcactgaagtatgaggctgtttgggtcacaggcggtttcccaggtttcctcctgatcattgtggagtcctctctgtgggtcgggggtcaccctgttgcccaatcacgggtgctcacagctccagtattccagcctgctgaaatttagccacctttctatgaagattttttaccggtttctcttcaaatattaaacaattctcaaaccataaatacagcaactcacttcctttctaacctgagaatttgaggggtggtgttttgcagcactgaaaattaaaattggtagttccatgagtatttggcacagccatccctgacgaaacgtgcgagctgcagtgcacgtgggaagtctgctgttaagtcaggcccacacctgaccacgtgggagcctcgctcccaccgtcgtgggtcatgccagcctttcctatagcacagtcctgctgcacttagcagtgctctgccctcactcacttcacttgagcagggtcttagtggcactgtacaaccgagtttacggcgcccatgagtcatggagggagagagctgcatggtggctggagccagcggcagaatcaaagaggcagaaggtggggaccatggtttagggatctcgagggcctgggagtcatagattaatgcccccatcagggcatcctgggggaattgcagcatcctaaaattttggaacaaagtagaccgcctagtccagagtttttacaggacacaccctgatagaaaaaccagggctgtgttactttagctagagccaagccagagatgtgtgtctttat

SEQ ID NO: 43844 - DNA, 692 bp, Bovine  19866880656952
taagaagactgggaaagtaagaagacatggagtcaccaagggcaaggggaaaaggatagaagcaaataaaatgaagctgcgtaacatataagatgagagagataccattagaaaataaataatgcttatgttgatgaaaatcaaaaactgcatgtgatcccgaagaaaaatcttcacatcagaatctaaaaaaaaatatagccatgcaaataagggcccattattttcccctctgcacagaatgactggctttgagttttaacatgggaggaaaagccagatggcggcagacgggcttattatagaaagtccacttgcactgaagttttctcagcactttctgtcgttgctgagtgaggttttgttttgtttccttcttaagtgtagggcaggcaagtaccaaaatttgtataaagtctgcaaccttttcatgcaaatgttctattcaatacctccaatacatgatatatgatgccaccacaggaaaactagtgttgctacagacgttaatcataattatgaaaatttttaatttaaatgtaggtctgaacacacaaaatacagtgcatggccatctgttagttttccatctgggctcatttgcaaaatacattctgtttcactccccccttccccctctatttataatcttccctggaaaacaaatatggctaatctatggcatgccagag

SEQ ID NO: 43845 - DNA, 1456 bp, Bovine  19866880719553
actctctatgacttaaagtctgtaaagtaagtagctagtatgctgctctctagagtgaccaaagccagccctgagtattctttatggaatcccattggaaatatgtttgcacagagtttaatcacagatgtattcaaataagaaaatgcctcatttgccaatgctttcctgaacaaggaataaatacacatcaggaaattggcctcaaaagaattaattccacttcatgtcactggtccatttttgataggattaggtgaacattcatttttgggaagatggactacatatatttggcagaatctcagggtatttagggacctggaaagagtgatattagaactacacccagggagttgtaaaccttttaaaatgcttcaaggtggttttgtatcactttataaagctgtgctataaaagataagctaaaaatcagaattttatatatggtctatctgccaccaaagggcactacagccaggctacaggtcatggttacttaaattgcgtttgatatatttagaattatttataaattcttagtaaaaaaaagcatgttgattacttgctatattcaaagagcaacattagacactgtgagcatatgaggttttttaagaccgtctttagttcagtgtattacaatctatttggggtcatggtacatgtacacaaagataataacaaaaataataaacaggtaacatttatctggcatatctatgtgcaagatatttcctatacattatttcacttaacctaatcctcagacagttcaggtggtctggtattcccatgtctttcagaactttccacagtttattgtgatccacacagtcaaaggctgtggcatagtcaataaagcagaaatagatgtttttttttggaactctcttgctttttcgatgatccagcggatgttggcaatttgatctctggttcctctgccttttctaaaaccagcttgaacatctggaatttcacggttcatgtattgctgaagcctggcttggagaattttgagcattactttactagcgtgtgagatgcgtgcaattgtgaggtagtttgagcattctttggcattgcctttctttgggaaacctatatgcaggtcaggaagcaacagttagaactgaacatggaacaacagactggttccaaataggaaaaggagtacgtcaaagctgtatacttgtcaccctgtttatttaacttctatgcagagtacatcatgagaaacgctgggctggaagaagcacaagctggaatcaagattgccgggagaaatatcaataacctcagatatgcagatggcaccacccttatggcagaaagtgaagaggaactaaaaagcctcttgatgaaagtgaaagaagagagtgaaaaagttggcttaaagctcaacattcagaaaatgaagatcatggcatctggtcccatcacttcatgggaa

SEQ ID NO: 43846 - DNA, 1622 bp, Bovine  19866880750954
ggcctgcagagcctcttttaatgaaacattgaagtcaccaccaccccacctccccatcagcatcgccatcacccaatctctaagagcccgagtgtgttgcgtgcctacatgcagacagataaggagagaggctgaggcatgcagcccagcctgcctttgttggtgctgcagtgcagagagagcctgcagttattggggtagccaacctccacagcccctgacatgctttgctcctctaggagacagtaatacattacaggtgttataacttttcctcagaatcagactgcctggggaactgtaaatctaaatcatggctgccctcaggaaacctgtgggcctgtaaacacagtgaaatgagtgagatgaaagcatctgaaggagaaaatgaatttctggcatcccactgaagtctatttcatttttacagtccggtcaccctcctgtggcaggggcagcgcctgggagggacaggctgcctcctgactgacagctgacgagcatggctcctcctggaagccttggctccagggcctaatcaagagacaagagctgcagcagactctgagtgtccccgccacaaacagctcagagtgccacgtaagacgtcgccaaggcatggtggtggggtttttctttgggggaggctgggcctgtctgagcaggtatttgtaatcaaggccattcttcagttcaaaggcagagcttagcgtgtgaggcgggatgtgtgagagggaagagaggggataagaaagaaaggcagagaagtgactccccagagaatgtgcagatgcttcgatttcagggcacagacctgggcacctgcagaaaggcggcagctggccaatactgctcagagcagtgagcgccaccccctgggctgtagcaagcatagggccagagccaggaagtcatcgaattataatttttttaacgtggcaacttgaatgtcacaccagccaaaccagaagaagctttagctctcagtggagaagagagccagaaagctctcaccggagagaatgatgggacatttgaaatggaggaaaacgttaccctctgattttcaaaataaacttccctctgatttcatgaacgtgaatttttaacattaacaatttaatgttaatgaatttaacaaccattctggccttttgtgacatggaccattgactgactgattaaatgtttcactgaggtcatggggaaggagttagttcagtatattctctataatggatagatacatgactcagttgtaaaaatctgcctgccaatgcaagacacaggagttgcaggttcaattcctgggtcaggaaggtcccctggagtaagaaatggcaaccccctgcagtattcttgactggaaaattccatggacagaggaacctagtgggctacagtccacggggtcacaaagagtgagacatgactgagcactgcatgtgcaacgtcaaacactgacagtaatgaacccagagtcacctctcccattaccagggaattctacaaaaaggatctaaaagtaatttttgaattcttagtaaatcccccaaactcacattttacatgctttggcaatgactgcaaaactgcgaaggcctgtttttagaaaatcacct

SEQ ID NO: 43847 - DNA, 970 bp, Bovine  19866880921173
cttgatatggttttataaagtattcagttttaatctgttatgatataagcatgttgtcctctgagggataagaaaaaaacttactgagtcatcttggaatgtagcgagtaagaccttgatgtaacattctgactctctctagaatccttaataaaagtctttcatccattggtttacatttccctgagataagggtcttccattcatagcttttctcctctctctcttcctacaccaaagaccctgggaatgtaaacctacccgagcaagaactcctgccctgctgggtgctagagaatctggtcccatactgaacatcctgttctgggaatgcgcaaagagacattggaggatgagggaggaagtaactgacactgcctggagcagtccaggaaggcacggggaggaggttcctctggagctggaccaccaggaatgaggcaatttctcccagctttgaggatgactgaaggggaagaacattgctggctaaaggcataatgagtatcacataaattggagacctacatgcacttgtttgctagcaatattgttagacaaaaaaagttttgtttaggtgaagagccatgtgtcataattaactagaaacttctaatactgatgataacatgtatcacttattatataccagattctgtcctgtttaaaccttcagcagtcttgaggatgccgcaatttttatacccatttgacagatgagaaaactgaagccaagagatgttaagacactcaccaaagattacacatttagttaggagaagattgggagtttgatccaagacagtctggctctggattctaggctggtatccacagcactcttactgcctctatagcaacaatctggaagttgaaatatcaagacgttatttccgactctttaaaacactatttacactacaaactagtcgagggattttctaaaaacaggccttcgcagttttgcagt

SEQ ID NO: 43848 - DNA, 1514 bp, Bovine  19866880934124
ctacaaacttcctttaaggcctaacccaagagttttcaactaccaatggacttagggagctttcaaaattactgacgtcccagggtcccactctcagagactaatttgattggtccagagtgaagaccagactccagcatgttctaaatgtctgtatagaatttagtgtgcaaccagcattgagaaccactgtcacagcctatcattcctgggacaaacctggcttgcttccaacgtgcactgtaatattctggtctgaattaagttacctatgagagaggagaggaggaatggaaaaagaaaagagaaacctaaagagattccctgggcaaccttcttcttcttcctcccctctgtccctcagcttcaaattatgtctctatgttgcctgatgccaaacttaaagagttttgaggcagagtgacttttaggggaggggtgggaaactcaaaatgtccaggggctcggtaagttccatatatgagagaggcagcccagcaggaccgagacagatgactgcccacagggccctcattggctctaaccaaacactgatgtgtaataattattcgatcccaaaggccccagagaaagtaattttctaaagaggctaaaaatacaattttacccgaaatgtcgcaatctgcaaatgttggaaactaactcctttctttcccctcttttttaaaaattctgaataagctaaataaaacacatctgcaggttaaatgaagcccaaagcctaccagcttatgacctatgacttaaggaaccatccatttttcatgattcaaatctagaaacaaagatccaaagactgaaaacagtaaaatacagctggaacccagtgacaagtttgcttaacttattaaagggcaggtttgagtctcttaaccagatgatgttcataaaaccacaggcagacagtgcaggacttgcatgtaagacttaacccacatggattgggaggagctagttaaagctgcatctttcctgaaatcatttccctttcatttccttcccccataaaactccaggtgtgcctttcgtcttgtcacatgtcaaagaagagactctttccaagtgatcttcatttctttggctaccatctgtgctcccaagcctggcttctaataggtatgcggttgtcaacaccattgagaggaagcattttacataataaattcagaattcttctgaattcccttccctgagattagactgataggattttgcccagaaaatatacaggtaagacagacccatgctgacaaatcctaaagggtagaagacaagagccatggcatcaattaaactagtaaagagaaaaaaaaaaaaagttaagcgctaggtaaactaaagaactggaacaggaatatactggagagggctgcagaaaggcagcctgtggctggtaaaagacagaggaaaccttgtatacctgtttcccttctctcatctaggaaagagggatttcagagccctaaatgtctgctttccatggtaatggggga

SEQ ID NO: 43849 - DNA, 1235 bp, Bovine  19866880947394
tcttgggtcagagagattagtgatgatttctctactgccttagagaaatactctatataccaaatcaaatcaaagcatgcagataaagctgcttgtaaagcacacagtgctatggacctataaacttttataactaaagtggaacattaaaaaaatacaatgggagaaattaattttaatgaaaaaccaaacagagtgatcgaaaacccaaggactggttataagccaaagaatcttggttcagttctagagtgtaagtaccttttattaaaccagtaaattattttcaagagattcctaatgccaagtgcttaaaataaaacctaatcctatgaattatgaacaaatgtaaacatttaaagtttctgttccaggaattaataaaaagctagactggggcattcatcctaaagaaatttttccagacaactgaaggattaaaatgttgctgtgcaaacttcaacacttggctatttttgtagcaatgcctttaaagtaatttttgagaaagataacacacaattaggaaggtgcagacaacacaaacatggatctagatggattatcataaagcaaacatctctggacccaccacaggagtcaataaatacaacacaggagacatcacagaagactgctgttagcctcccaatcccgaggcctcttctctcccagaaaaggcagtctctaacaaagttgtcttagtttctcttcccgtttctccaaagttttaaaatcttagcagacccttcacatttaaagttgtggacctctttctatgctaattaattcatcactccttttaatgactctattttaaaaagagaggtacctgcgtacattttttaactgctcagattttaaatgtctacttgtcatattaacgtgaattgttttactgtgcagtatgcagatgcttccaggtgccagtcatttggataagcattgccatttgcccccagttaaatggccttagacctctgaaatacttctaattcattcctttgtgccctttcattgtagaaatctgtcacctgatatttttgcaaacctacttctcacttcaagcacctctctctacatcaacaaattccttttagggctgattttccctagttaacatcctggacaaaagagcaaacatccagtcttctctccagcttgtagagaagaattaccagaactgcttgttaagaataaaaattcctaaacccatggaacgtttgaattctggg

SEQ ID NO: 43850 - DNA, 1923 bp, Bovine  19866880985855
ctgtgaatgtgtgattcgtttctccaatcctggtaagtatttagtgttggcgctttttcaaattttagtcatttttgtaggtcataatgttatctcattgttttattttgaatttctataatagctcatgattgatagtaatcagatacagagcatgttttcctatctttactggccatccatatatcctctttggtgaaatatctacttatgtattctgcccattttccaattgtattgtttggggcttttaaaactgttgagttttgcaaaattccttatatatcccagtgcaaaatctttgtcagatatgtggcttgtacaatattttcttttattctgtaccttaccttattacctctttacaaaggagatctttaggagaacaaaggttttaattctatgagttcaaatttatacattttctctttatataccacgctttttaggttaaagctaagaagaatttatccacttggccatctctaacttttacttagtgtgtttagaccattcacatttaacataattgttcatatgttagagcctgagttttccactttattcgtttttaacttcgcttcctttgtttcttactcctgtgtttctattttcttgcctttctgtgggttactcgaacaattcttagaattcaaacaatgtttaatagtatttctgagtgtatctttgggcacagttttctcagctgttgttctatagtttacatttttttacagggtcacaggcgtccgtgtctagaatgggtctgaaggtggggatactaaaagagagaccaggagaaatgctactgagggttatcacaccactgtgaaattgctactctaagtgttgtccttggtgaaaggtcccaagaaagcacatattcttctctctggatgaaatattatttctcattctttgcacgtcaactctcactcagcttttgttattttcatctaaaagcctatgacttctaagatgggatttctgtattgctccgtgttggcccacatcgcccctaactttcctattatagaactaaccgcatgcatttataatttctagtttgctcatttgttctgcccattacactgtgaactccttgagtgcaggaatcatatcttattacttcattctgggtactaacccctcatacagtgcctgagacctagtaggccctcaagaagtatctgttgactgaaagaataaattttatgagagtcatttaaattgcctcccaaaacactgtcagtttactcccgcagatgttgtcaaagtgttttaataccagtatacagcaaattaaaattcaaatattaataatttaaaaccacattttcaatttaagttttcttttagtagactccactgaaattgggttataaacaataaaagaaaccttaattagtatgcttattatatataatagtactctgtgtgctattctgggattcttcttaatgttgttttggttacttttgaatagaatagaccagagatgtaatattgctgcagaagctattctaggacaccaagtcactatttcaactcagagaacacaacagattaatcacctaggcatccagaatgagttctgggtttgatttccctgagtttcaaaggtaacaaaccaaaacctcctatttttatgttccaaggaaatataaccaaacccacaatattcacataacaccaaaaagtggcccaaacagctgctgttggtgaaacctttatgtgcagattgtaacctagaggaaacgtttttggacaagtgtagatgagagctttctgcacaggactcactgctctgagtgctgacacaggatgacagtgtggcatgggaatcagtattccaggctacgatatttttaaaaagtaacgtatgactgcttcccaaggaaagcaaaccacagagccagactg

SEQ ID NO: 43851 - DNA, 1671 bp, Bovine  19866880996177
tcacctactgagcatgtcacatttttggtgacatatgtgtgagggaattccaatcagatctcccactccgctcaggcccagggctttgctgctgtcctgtcagtccattaaaacccatgacctcagccaccagggaatggtaaatatcttcagggcaaagcagactctagtatttgcttatcagttactgggcttgtcatttctagcctctgagattcctttatttttctggcagcttaggtatacattattaatatgtcattaatattttatgccacatctttaggtgtgaggtctctaaaaatctagtatgccatatttttttgtaaagctctttgaattagttagctacttccgtgtaacaaattatcccaatacttagtatgttcaagcaataggttttatctcctaggttctgtgggtcaggaatccatacgcagtttctctttcatgaggctgcagtcacggtgttggcaggcatgtcactcatttcaaggctcaatttggggaggatctgattctaagctcacttgtgtggccgttggcgagacttatacccttgctggctggtggttggagacattagttacttgttaagtggttctttccacaggaatacctacaacatagccacttgtttcttccagagtgagggctctgagagagggagagagaaagtaggaacacatggatgtcatggcctccttgtaactcaatctcagaagagacattccatgacctttgccatcttctgttcactagaagtgagtcactatttccagccccttctcaaaagaggtgatgacagaagtgtaatcatttgaaaccattttaaaggctgcctacctcacttgtataaatctctttttaaaaagtaaacaacaaagtagaaaaaaattaaaaagtataaataggcaattttttcaaagaagaaatttaaatatctgataaatatataaaaattgtccaatatctctagtaattaaagaaatgctaattaaaacagcagttggataacaatcttacctatcagactgattgacaaagatctttttaatatcgtgtagaaaacaaaatatggaaactagcaactttgtgcagtgctagtgggagtgtaaattagtatttactgtgatttaatttgagagtgggtcactgtccttaaaagtctacgtagcctgaaaaaatacatatatatgttaaaatttattgtctaacaattttacaatgagagacttgccctaaggaaaaattataaaagcttgaaaatagtcattgaactatgttcatctttttggtaaacccttttaaaataaatgtctaaaagaagtcattggtaaataaattatcccacatgctcataagataaaactatgcctctgttaaaaataacaagtctgcatatgttaacatggcaagatttacccaaacatattgttagtaagcaaaatagtgtatattgaattatttatttttattacatataatgttaaacacatgtatatacagaggaaatattagcaagctatggaaatagtattattacatcatctctgggtgatggaattaagttgctttttattacatttttgcttactgtattgtctaaattctccagaaataatatatttatgtatcaattatcataattttaaacaaaaaaaagtttat

SEQ ID NO: 43852 - DNA, 1777 bp, Bovine  19866881035813
gccatggaatgggctatctttctgtgtctacttctcactagttaagcaagtaaggagtaaatcagggcaagttatttgccttctttgggcttccatttcttagtgggtcattgtgagaaagtgggattaaaaacttcctgtaaccttgcagaaaaaagcaggggtgtataattatattactaagtgattgtaagcattttacaaacatgacaatatgaataaaagttattgttatcagtaataaaaagaatgcaacagtgagtgcttcttatgaaccagacatttaatatacatatggctgtctgcttttatgaaggcagagatgccggttcaagaaattgcataatgtgttcaagctcactcagctgatgagtggctgatctgggatttgaattcagaccagtctgactctgaagcccataggaaggtacctcagggacccgatgtcactagattcctccttagcagatgtcacctcagaggaacctgccatcattttgactcagaaagccctactgactgcccctccgctgcatgcatgactggcctgcccaatgctgacagtccctggagagaagccccgcaggggaccccttggacggtcacccaccaaccaccactgcctccccagcagcagccgtgcctgctggtgtcttcgaccagtagcagactgaggcagaaggagcaaaccgttccctagaaaccaacccttcccgctccttttcccagagacctggaagccaaatcccttagttaattcagggaaagtgtcatgtgactccactgtctccaaggctgtcacttgcccattcactcactacttactggcaaaaaatccttctgtctggatgccatcgagtctttttccttcagtgtctctatctactccattccagatttaaaatttgcttccgttattgtatcaaaacaatcaatagaaattcgatacaaaacataggagtttttaaatgaaccatcctttgctctttacagttaaacaaactcttaaaagactactaatgaccatagtcctttaaaaatattttaatcatctacatatatgtatgtatatgaattcataaatatcatgtgtatatatgtgtatacctgcatggtaaattaagtgccaatatctacaagcagatatatagcttaatagcacacacacacacacacacacacacacagggtttatcttattgggttgttttttttttttttggatttagcaggtttttttcttttttcttttaaattaattttatcttaattggatgatgattaccgtataatattgtgatggtttttgccatatactgacatggaaagtcctatcttattgggttttaaaaaatatttatttatttatttggctgtgccaggtcttagtcgtgggacatgggatctttatttgcggtctggtggatctagttccctgaccagggatcaaacccaggccccctacattgggatgaaaagtcttagccactggaccaccagggaaatccctgtcttgttttttttgagggatggaacctgggccgttcacttatttgctctcagatgaattccctgcccttgttctaccttactatgttttaaagagggtgataacctacaagtatttttaaatatttactttttaaatattaagatgttcatttgtgccttatacctatgttgttatagatgttgagcctagaactacaacaacaaaaacgagggatctaatcttgggatatgaggtttagaggagctaaccatatccacagccaat

SEQ ID NO: 43853 - DNA, 854 bp, Bovine  19866881079807
aatcttacctgggagagttctcctgccaggctgctttaagggcatgctgttagcatgcgtctccatttgtggctggagctgggatgcaggctcatagattcatgtcgttgctagggaagaatgctgtaatccattgccaccataggcaggtttctgcatctgtcagcagatattcctcttctgaacctttacattttgatgctgtctttgggcctaaacataatgttaaaaattactgctcatgatggaaaaagataacaagagaaagagtggttgtttccatgcccacttaaatgggaccacccctgcccatccatcacgtgccttgtgactatggtttggaaggagagaaacctttactgcgtagggcccccctcctttccttaatcagctcacactcggtcctttctttatgttcacgacctgctgccaacagatcttagaattgcagaaatataaataaataaataaaatggttgtcccttacaagaatatcagatacctctgcttttagtaaagaaaggaaaatacagcttccggacattgttaaagagggcaaaggagttggtagctcatggtatctacttatggcctgaattcacactaactagcagtcaactactcccttaaccttgaggctgttcttgcttagattctcaataataatttctcccttaaccagggggtaccattgccacttacttaaattatcctcacagggatgataaatgcctgctctggggttcctatttgctgtattcttcttcagaaacttggaaatagaagttttcatcttgtttcagaccactctgttgaaagttttgaaagagctggaaaaagaaagggacagaaat

SEQ ID NO: 43854 - DNA, 1736 bp, Bovine  19866881107231
ttagaaacccattgctgtaaacctgagtcacctatcaatccattgtatttgttctccaataacccaagtagtgaagccttttcgatcacctctttcatttaacatcttttctctaacctagaaaatgtcagaatgctttattttttttttttttttttggagaggctggtttaagttctctgaagcttatacacataagcccatacgttatgcgccagtacaaaatgcccagctgagaatagtggtgccttcactgaatgatggagcttaagcttcttgaaacaactgcaacttaatgtttaaatgcagatattttactgtcttattcactacacatattcttgaatccaaatgaagaagtaatactttttactctacatttttgattcatggtgacctcattaatcggcaagcaagttcatcctaattataaacttttgagacattactgcattaataggatgtggaagaggcttactgatggaatatctcgttcctatattttgcggcttaagaaactgccagaatagttgaatgtttcaaattcttttatgaaacaaatggacagagtgacggcaaaagaaaaaaaaaaatgtatgacctaatcactactagaaaatatatgtccttggggctgagggagggggaaagttcatgagtctggcaaacaggcaagatgggcctgccgttggtcaatttgtatgatgagctgaggagtttcccagttgtccgaatggaacagagacacaaacacgagctcagtcaggaatagagccagagacgggtgatcatgaatacatcggagcatctgtcacttggatgagctcctggcgtagtccttcaccctgtgtctgagtccagagatgagctgggataatatgcatgaaaatggtagggctgctccggagagccatcctaaggtgttaaagcacatgcattactgctttgggaaccctctagtgtaacagaaatctaaagagaagaagcaccaatgcccccaactcacagcaggattctgaacagttgaagcatctcacaggtacttacttgggccttggtggaggaagacccctgggggtagtaagcagccaaagcagcaatagctcggcccatccggggccacagtcccttggtcaggcgtgtgggatgggcaaagatgtgtggacatctagtggaggaggcagagataggacatgttccacacaccaagcacagggaacagagagtcttatcagaagaacagaaatgaaggtgatacacagtaactaatttgacttatttctctttaaaagccttttattttagattggagcatagccaattaacagtgtgatagtttcaggtgcacagcagaggggctcaaccgtgcatatacatgtatccattctcccccaagggctttcctgatggctcactgggcaaagaatccacctgcagtgcaggagacatagggacgcagattcgattcctgggtgaggatgatcccctggaggagggcatggcaaccctgtccagtattcttgcctggagaatcccatagaaaaaggagccatggagctacagtccaaaggggtcacagtcagacatgactgagcgagtagacatgcatgcaatctcccccaaactccctcccatataggcttccacataacactgagtagagttccctgtgctatacagtagatccttgttgttatccatttgaagtacagcagtgtgtacgtgtccatcccaag

SEQ ID NO: 43855 - DNA, 876 bp, Bovine  19866881120481
cagatggttttagtgttcctaatggagtcaaaggttatcctatgcattgctgatagatcacgaattctctttagtgatgtgttgtttcagcagcactgggttagaagaggcaaattctgaacagtagagacacatgatgctctagcaaaatgaacgttcgagtattgatatgcggaaagtgttagtgtacaaagatgttagagacatgaatttgaaagtgatctgtcaacacaaacaaatcaagattatattctaagttcaaagcagaagttttcctggttctcatttactgggaaaatgagcaagataaagagtctagagatactgtttttttttgttgttttttttttatgttgacgtatactgagcaatttcccccaatgcagagaaattgccaatgaatgtttaaaattaattgattcaacaaattcttaaggagtacttactatatgctagggaatgcagctaggaatgacagacaaatagcttggattttttggatacttacatttttgttggagaagagacaggcaatagacaagtaacttaaaaaaaatcaaacaaggtaattttagctaatgataaatgtcattaaaacataaaactacatagtgtgaaagagtgtctgtgggtggagagatgggctgaaaacctgtatagtcagggaaagcctctctgaagaagaggaatttaagctgagatctgaatgacaagaaggagccaactttgcaaagccttgagggagaacattccagagacaggaagcagcaaatgcagaatccctcaggtaagagcaagcttggcagcttcggggacaaacaaggccagtgaggactgagggctgttggtgagggggagtgatgcacttttatttaa

SEQ ID NO: 43856 - DNA, 1072 bp, Bovine  19866881246806
cttggccttgtgccctgctttttccagtgagttttagtggttatgatatatgcagaggcttgtattgtgcttgtgtggttggaattgctctgccattggcatgagaagaaatactttgggtaccatgaacttgctggagaagggcatggcaacccactccgtattcttgcttggagaatcccatggacagaggagcctggtgagttacagtccatgggctgcacaatctgaaacgactatagcaacttagcatgcacgcaccatgaccccaagcctgggagtcagaataagatgcatgtggcaaagccaccctagcctcctcataggcaagtaagagatatgcttattgttgtaagccagtgtgattttatacttgcttgttatgcagaaataacctgactgatacaatcctgacctgttagttgtgtggttttgtagccatgttttctttgcccatagaggattgaatatgtcccctcttactgagttgtactgaaattgaagtgaaataatgtacagtcctgacacaggccccaaggatattgattaacttatccttggccccctccagagttgatggtcaacttttccttgctagcatcagttctaagagtagtaagatttttgtcaaaaaagtcacccctgccaaatgaaaggggtgggtatccaaggtgatttgtcagttgctttcatcatttagaattgtaacagaagccacagcaatataatttcttaggttccctgataaacaactagaaccattaacaccagcaaatctagttccattgtttcttcatgggacctcctatctttagaaataccaatataagcctgtttcagcagtgcacttagcataccccgtgtcccttgagaaataactggcttttgtttttgatgagccagaatgcatgcacacgtgcatactatgcagtacacactgcccttcatcagctcaggcttttgttcatcaaaataatagaaagtagtggcataaagccattctctgagaaataattcattacaaacaaaatcatccaaatgccagttcttctgccctcaataccttcaacaa

SEQ ID NO: 43857 - DNA, 1127 bp, Bovine  19866881378208
ctcctattgctctaattatcgaatacttaccctgaagaaattatttcctcatttccctaacccattcctgccacaggcctcttctgtgctgggttaaaccctaagctaaggaaaacacctgtggactgcaggataatgagagaagagaggattgcctggctctctgtgaagctttgcacatttgtccactgatgtgcctatggtacaaatggaatgaaacaaaatctgtaatagatatgaaagagatatttctgtcactgctacattatctatggaaaggtttatccacgaccgaaactttaatgtcagtgtagaatcctccaatgtatttttcagctttctttttcctactattaagttgtgtgtaaggaaaccataggctgattctagtagcagcctgacaaaagcatagttaaagatgcaaatgtggtgtgggtcagacatcccaagtgccaacacgtattatgttgggtaatctgctattttggattatccctttgtttctctgggtaattgagagttttctatatccacaattaactcccgcatctatatataactaagcccttttaattttgtatccaacctacaatgggacctgctctacccaagaattaagctttttcccagccaccttttcagacctctgggtctccccattcagccacttgtgacaatctgtcccagaaaattggaaaaccgttcagtttaattggttctaaaatggaggattcagtgcctgtgctgagtttgaggatgaaactaacattttacaaagcccagcccagcagcagctgccctttgggatttgggaggtagagcagcaagtcactctggaatttagagctttattacaaagaagtgctaactcttctggttctgcttataaatggaataaagggagaatctggctcacccatgagtgctttaaccttgtacatgctcaatatccttatgaaatgcaatatcttatgatcctttaaataacaaatgaccttattcccttttatagggtcattaaggcctctaacggtcaaggtataaatcccagccactactgcacatcttaatttactattcatatgtaaagctctcttggttctcaattactatacaacagcaaccgg

SEQ ID NO: 43858 - DNA, 699 bp, Bovine  19866881529028
catagaaacaatggttctttcaacacagcatcctttgtatgcatattaaacccatacgccttttctcatttttcttgtaatgtggcattttcaatctgtcttttattttcctacattgatatagatgcaggttcagagaaataattctctactatcaggggaaaaaaatgggtgagcatgatgctaagtggcaagtgatattaaaccccaaagtcaggaaggcgagaggcctgtggaggggtctgcggtgacctggagagtccatggttccttccaaatcaggcagcccctacccagttccagacaactgctgacactgttgacatgtaggaatgtggactctgtgttactaatcttctactttctaaagaacagctaggaatctggattttttttggtaaaatactctttttttgttttctatttttaaaacacagtttgggcctaataaaacatggctgtgggctagatgacgttggtgagcagccatttcaccttctctgggctattctaggggttggcaaactatattctgtaggcaaagtccagcctaccatctttcttttgtaaatgaagttttattggctcacagccgtgctcatttgtttatgtattacctatggctgcgtttgtgctataggcgtagaattcaatagttaggacactaattgtatgagctaaaaagcatactatctgtac

SEQ ID NO: 43859 - DNA, 731 bp, Bovine  19866881772661
aatttggagggtacacagttgagcccttaatgacagaaaccagggaatctgagtttctagcagtgtcttcaggtaattttgatatagccaggcatatagccagggttttgtatccactgcagacacctgctagatctgaagccctgtaagcacaatcctcacttttctcctttgcaaatgagagctgctcagccaagtcaactgattttcaacaggactgtaacaaatatgctccagaaggactcagtaacccaatactttgctgcctgcagatacaatctgggttcatctgtagctggacttttgggtgtcaactcagagacatttcatttcatgtccagtgaattacattctcaaaagcaaagcaggtttggtctttgtagaaaaacatgaatctgaagacaggttatgagtgaagcttagtgtgctggaaaatggatcagatgtagactgaattgcatttattttctgtggctacaatttggtctgttttccaagaatcctcattaaatcttaaaccccaggatatacccctgtcctttaaggaccagtacaacactagcaagcatttgcctgaaaagtcaatcttcagtatagatttccctcaaataaaccctttctttctgccaactgtcaaagttgtctatgtgaatacaaataactcctctaacagagggagccctcctctctgcatgtgtgtttttgggggtaggtcagttaggatagcctct

SEQ ID NO: 43860 - DNA, 1305 bp, Bovine  19866880948145
ttttttctcattttaactctcacctcatatggtcccttggtttgtaacattttgcagctgttttgatttcttttcctctccttggaaattctttgcaaattcaggagaaaaggtgttgatgttttttccttattcagaaattatggtggatgaaaaaaatctgattaggtgactccattgcagctggtcccaactttttactaaaataattgtgagggaactgaaaaggtgagaactcaggccatgaaaaatttagaatataggatgacagtatgccacaatttgaagaaaagcatcaataacttagtgagagatggtggtgaatttgtaaaaagcaataaatagaagaaaaatgccttgattccttttttttgtgacaaagaaaagacatcctgaaaataagtaagaaaactcttttatttcatttatattcaataattgtttcctaacagaatatgaggacctatgccaataggaaaaccgtgtagatatatctctttattcttctggcgctggtgttgacataggagaggaacttccgtcttcattattcctctaacctccattttactgtactctatattattttatcaaataatatcaaaacatttaaacttaaatagactgccaactctctaaacaggatctcgatctaagatgtagcagaagtaaaaggattatgtttgcacatgagaaatgaaagtaagaactgtgaagaaactctggagagtccacaagtctttgagcctaatgtctggaagaaatggcagctggaggcggatgacctctcatcacctttactgtttctcacataacaatattgcagtaagcacctaactgattgtgcttctagcttggcagtacagtatctactccttaaaatagaataatccttttgaaatataaggcagatcatttcacctttctgcttaaaaacactattctgctttctatggcttcccattttatccagcataaaattcaaagttcttactgagcctataaatgcctttagggtactgtccctcagctatgtctctgaaaaactcaccagactccccactgatcattcttgtcagtcacaccagtgtccttggtgttgttttgaagtaagccaagcacgatttcccttcacggtctttatcctcactgttttctctgtatgtcttactggatgccttgggcgttccacatggtttacctcctcgctccccagttctttgctcatatactattttaatacagaaatatttagaactaaaattgtactcacacattcttattcctcttttttatatgcttaca

SEQ ID NO: 43861 - DNA, 1174 bp, Bovine  19866881008184
ttggtagtaagtagatgaaagaaaataaaaatgcccagtttgtctatcaatataatagctggtcaataaaaagaaaagataaaatgtcattatttgctcatttacatggtactttcttaagaccagatagattacaaaggacatattatttgctttttaacactttgatgtacagagtattaaagaatgacatgatttgcaatttaatggtgaaatagatatcataatttattaaacaagatatttataggcatacaacactgcctaggttttgaatatttctctgaaattgcataatgtcttttctgaaaccagcatgagagagaatctatagttccatatcttcatagcaattcaatcaggaaatatttttataatgcacaaaacgactgcacagtctcctcattgccacattcatctccttgttcctgaaagtatagatgactggattcagaaaaggagtgataaatgcatcaaaaatagcaagatatttatccaagtgtgatgtgggagaaggccaggtgtagaaaaacattagtggcccaaagaagaaaaccaccacagtaatatgagctgacaaagtggaaagggccttggataacccacgagaagcatgtttccaaacagtaaacagaatgaagatgtaggaaatgaccagcaagacaaaggagcccacagaaatgagcccactattgacagttaccatgaactccagttcttgggtgtttgtgcaggcaagtctgaggagccgaggaaggtcacagtaaaaactatctaacacattaggaccacaaaaaggtaaatctactacaaaacccaattgaaccaatgaatgtataaggccaatggtccaggaagtgactaaaaagtgtagacacattcttggactcatgatggtcaggtattggagaggcttacatatggccacatatctgtcaaaggccatggtgatgagcagcaccatctcagtgcccccagcagcatggctaaagaagatctgggtaatacatccacaaaaggagatggatttatgcttcttgaaaataccataaatcattttagggactatgattgagcaaaataccatgtcaatgactgaaaggttagccaagaggaaatacatgggggagtgcagatgagaatccaaggctacagtgaacacaacgacaaggtt

SEQ ID NO: 43862 - DNA, 1076 bp, Bovine  19866881553299
actgtgggttccggtgctttttgctcttccccttttatatccatcttcctttcctcactgcctgtcctgtggacttcaaatggacttcaaactacagcattagatgcaaggacgatagactggtagagactgctgaatccgcttctgcaggatcagtaagatcaagtcactgtcacagatctcttggtatattatctcctggtggttctgcttctccattggaaccctgagtaatatggccagtaatccaaatttcttatttttcctattttttcagggaaatttggagcccaaagtgactgagaccatggggggaggaaatcgttcggtggtgtctgagattgtgttggtgggactcaccagttctttggagatgcaacttgtcctctttctaattttctctgtgttctatgtaacaagcattttaggaaacctcctcattgttctcacagtgacctctgactcccatttacactcccctatgtacttcctgctagccaacctctcctttattgacatgtgggtttcctccattacagctcccaagatgatatctgatcttttcaaagagagaaaagtaatctctttccaaggatgcattgctcagatgttcttcgttcatgttattggaggaactgagatggttctgctcattgccatggcctttgaccgttatgtcgctatatgtaggcctctccattacctgatcatcatgaacttcagaacttgtatttcactcttggttgctgcctggaccattgggatcatccactcactcatccagattctatttgttgtaaacctaccattctgtggccccaataaagtggacagcttttactgtgatcttcctcgatttattaggcttgcctgcacagacacttacagactggagcttgtggttactgccaatagtggtttcatctccctgggaacatttttcattctgattacctcctatatcttcatcttggccactgtttggcaacgttcctcaggtgacttgtccaaggccctctctacactatcagctcacatcgcggtggtggtcttatttttcggcccatgtatttttg

SEQ ID NO: 43863 - DNA, 1827 bp, Bovine  19866880345953
tagccatcatggtcaacaagagagtccataattcaggacttggatgcaatctcaaaaaagacagaatgatttctgttcgtttccaaggcaaaccattcaatatcacagtaatccaagtctatgccccaaccagtaacgctgaagaagctgaagttgaacggttctatgaagacctacaagaccttttagaacacccaaaagatgtccttttcattataggggactggaatgcaaaagtaggaagtcaagaaacacctggagtaacaggcaaatttggccttggaatacggaatgaagcagggcaaagactaatagagttttgccaagaaaatgcactggtcatagcaaacaccctcttctaacaacacaagagaagactctacacatggacatcaccagatggtcaacaccgaaatcagattgattatattctttgcagccaaagatggagaagctcatacagtcaacaaaaacaagaccaggagctgactgtggctcagatcatgaactccttactacaaaattcagacttaaattgaagaaagtagggaaaaccaccagacggaggcttcataatttagctgcccacaggacagacacctccactagactgctggttctccaagggcagcacctgtgtcctactcaccttcaccctgcctgctccatgagagctcagcacagaagagacactgagtaaaggatgaaggaatgtgcgaagggacaaatgaaggaaaaagcaggtatcagtggaagaactccccaagttcagaacacctctgggagggatgccctccagtcacctctcttggaatgctgtggggcgttttcaaagggccctggtccagacgacctctgaagatgcttctcatcctggttcctgaaatgtattccaactagactagagaaaaccacgttcagtttagagtgtttctttcttccttctttattataagctctcagcaatactaagcatcagaagacattcaaatattccttatctaagaatgcaattcagttcagtgatgagggcagaacactgcccatgatttgaagaattccttctaaccagaaattaacaggctgccccttcatcagactttgggaggacctgtgtcacttgctctgtgagacagcatagtgcaaatgaccacggctgaatctccactaatgagtaacttggtacagtcttctatcagagacatctaaagatttttttaaacatacaactaccttccaggtacaaagtttcagttaggcaagataaataagttctggagatctattatacagcatagtacctagagctaacaatattgtattctatacttgaaatttgctaaatgggtgtatcttagctaagcactgcaccacacacacatgcatacacccaacaataacaataaagggagcaggaggaaacttaggtaagtgatggatagtttatgaccttgatggtgatttatacacttatcccaaaactcaatgagctttatatatatgtgtgtgtatatacatatgtatgtgtatatatgtgtaaatatatatagctttttacatgtcaatcataactcaaaaaagtatttttaaaaaaaaactattttccagatagtcatttggaatggaaccacatctactcatacattcagcaacaatttactaagtaacatctactgtgccgggcatgaggccaggtcagctcaaatccccacggggggcgggtggggagactggaagtccctgtgctcttacccggtgttcgttgatgagaaggtcccgagcagcattaaatatcagtgtgtggaggtgttttgaataaaacaccaa

SEQ ID NO: 43864 - DNA, 963 bp, Bovine  19866880374781
tctggcttttttatcagcagtcaattatgaatttttgaagtacatggaagttgtggaagtctgctccttttcgttttagggcagttttgccgtgtttagtctgtaaggctctctgatcttagaaatgttgtgacttaaggataaactcgtataaacagtgttgactacattaatgaattgcgatgtttcatagaatagcattggggcttggagtgggccacccaaaatatgcactatggcacgttgattattttgaattaaagttacttaataaacgaccagtgggacactctggccctcctttctgttgcctgaaagcaggaagtacgtcacatgaaaggtgcactccctacatctaaggaagtagaaagacaccctttccacaaaagatagggaatttggggctgagaagcctaatgtaaagaaaattgttacttctttacctgttatcccaaacccatactctgttttgattcttaactaattgagcacccaaaacgtcagtttctttgtcctgtcagttcctcacaaatgtattctttctttgtctaaaaaatagaaaagctgtttcatttggctacttcttaggtcccatttctatgaaagtgtcatgtgcacaaattaaaatgtatttctttctctcctgttgatctgtctcatgtcagatttgtttgtctaaccacaagaactgaagaggggtagatggggaagttcccctctcccttataatgataataaccattggcccttttctttggaggattgtacatcatgctataaactgattttgcaatgcttttgtaggtcttggaggaacgtgtgtgaatgtgggttgcatacctaaaaaattgatgcaccaagcagcgttgttaggtcaagccctacgagactctcgaaactatgggtggaacgtcgaggagacaggtacgtgggggaagctgctcttccatttgtgctgttgag

SEQ ID NO: 43865 - DNA, 1927 bp, Bovine  19866880468927
ctatattgctctcccttatactgccgcactttgcataatcctagggacataccagatctccaacactgctgaattaataaatgaaagagtgaaccaaaaaatgaaccgagaaattcaccctggagctcagctccacacatcagtgctctcagatgccaactgctatcctgtcttcatctccccagtctgcatcctccctgactcagcagtagatgacccctgtcaaccaggtgagctatccattgttcctaatgacaccccagtgtgtgtctggtttttctctcccaagttcaaccgcaaaggaaggtgctatctagtggagttaactgtgctcaagaaaaagcttaacaacagcaacagtaacaataacacaaacaacaatggtagcctttccagtagtattcgtggacactgtcaaaagggaaaaactaaaattaggaaggaaaggactcagatccaaaggtcaggagcttaataagaacctgaagtgtaagttctggagaagctaggccaagacaagacctgaggatcaatcatgggtcaagtggcaggagaggtggagaccacagggggagaaacagagaggctggaaacagggtaagctgcccatcccttggacagggtgcacagccatgaatcatgtcttaaagggacagagttgagcctgacaacagccaaccatctttttccgccagtctgtcttgtgttctgactgtcttgtgcattcattgtttgcagaaacatgtgcccacaaacaatggatctattttggagggcccatctcactctcagtttcctccaggtgcagcacaagtgacccaccactgaccagttaagatggagtttgcaatttcagaattggttgcttacttgttcagaactagagaaaaaggtgaagcaaagttatgaaatgcagaaaagtcaaggcagtcatctttttctaaaagcaaaaaataaacaagagttgaaacacacaaaacacaaatactgagatttatgaatgtaattcataccctagtatactcttaaaaaaaaaaaaaaaaagatgcaagcacagaagcacgacaaaagctttgtaagctaaacttttcttactaacgacaaagacaggtaattgaggcagatgtaaatgaagcaccaccacaatgggtaagtgctgaccacagatttaagactggcaaacctaaacaggggaagttataaataaatatgataacctgtcattgaaaccttgccttcaggaattcggatgatgatctgaaaacaaattcgaatttcaattaccctgtaggaagcagtaaggaaggcagtgtttttatcagaaactggggtgcgagtcagggcggggggttatgtaaagattaggttaaagagacagagaaaatattttccaaggcgcaagcttagggtgagggacttccctcacacgaaagacacctggtctttctgtacttctacgaagttacaaagctgtactccctctctcatttgcagccccacaggttttgctttcaaagatctgcaggtgtatcctcctgcacgtcaaactgaaagtgtttcttcttttttgtgctagactggactttactaccatgctctccacctgactcacagcagggactctgggaccaccgggtcaccgcctttgaacttcatgagggagtcggggcattaaagtggctcgcaatttccctcaagggaaggtggagggagccccgctactctcttctggaaatcgaatctggaggcctgggattccggtcgtgaaaggagcagacgtaacagggattccggctgcccaagtgacgcacgggaaggcagattcggaaaaggctcgcgaacgagcacgaggctggggccagactcaaagaggccgccccccagaacacgggaagggtctcggccaaggccttgggggctttctagg

SEQ ID NO: 43866 - DNA, 927 bp, Bovine  19866880471092
tcttaactttgaaattagtatttccagccaagaactgccttctagactccagacctaagtatccaactgtccattagaaatctttaccaacatgttcctcaagtgcctcaaaaacagcaagttcaaggttgagcctatcttattcccaaatctgttcttgcttctgtatttcttatcctgatgaagagtatcatcatccactgaatatccaacccagaaaactgggagtcatgttcgacttgttttcatttatcatatacaaccagtttcctagtctaataggtgctactttctaaaagtctctgaactaatgtattctctcctctccatctcacccactgctttagtctctatgcatctctttctaacaagtctcccaatcatctcctataatagctcttcctgatggtgaggctagaatgtcctttccaaaataaaaaaacaaaaactaatcgtgccactctttcacttttgaaaaataccagttactccaacctacggaggaaaagcccaatctgctcttgttaacctgagactagctagccattcatttacatatttgaatatctacgatgtgccagatgctgtcattgtataaccactcgtttccccatttgcctaatattaattttatccaaactgccttataagtacgatttagagtacatgatttagagtacattaggatcctaaaatctcaaagctcatatttgttttcaagaatgtaaacttctttacatgatggacatagaaaatcactataaaaattttaaattgatgtctagtaccaagcttttatagttctgaccaaatgagtcgcttacatcagcaaatcaacaaaacaaagtctctcctcttccacaagtaatgaaatcagaaaaactataggaaactatttttcttgaatatttttatctaccatggatt

SEQ ID NO: 43867 - DNA, 1440 bp, Bovine  19866880488391
accatctgaagggtaactgtcatattacacagacataccagtgaggactgtgatgaacatggcactaccacggtgtgcaatgtagagcttgcacaagtgagcagcctcatctttgaacaagaatacagggtgggaaaaagagacaggaaaacatgaaagagtaagggcagtggtgtttgtgagtcaacttgcactgactcctcaaaagctgcttgtgcatatcttcccccaactctgctctcactaatggcacgttggaagctggaagtcagtcatgtttggttggagtatttacatcatggaaattggcaacaaatcaggactttatcctcccagagagctggttgttaaacactagtaagggcacaatgggacaagatcatatcatggagggttgagataaccctgaaggatgtggatttagattgtaggcaaggaagagacaacacagtgacctaatcggaacccctttgcattcctggcctcttcattcaaaggtccctccacttctgacctaactaaaacttgttttcctttgacaggatgacttcctttgcacccccctggggcagaagctgttcatcctcacttatctttgatcagacacagaagaaagaagggaacaatattcttttgtgcccctactggctctttcaaccattaacaatcccctctcctttgacatacctggtaggttgcccaaacatcctttgcctgaccactgaaacttagtagagttactgttcattttcccaaatgagagctttggtgcctcctttcccacccttctcatcgactctaaggtcatcagtttcctgggagactcagtgctcatgtggatgatccagcattctaatcttatgattgtaaacttgtcagtgtcagggatacttcactttagctccacttcagacactcacctgcagccatatcctggattgcaaagccaacttaggaactgttgtatctttgaaatgtggttatgatgacaccttgtctacaagcttgaattaaaaggattaagtgacatgatgtatggaaagcatctagaagatgcctggcatttaacaggcatccagtgagtattacttttcttgccttttcaagacagaaagcataattttgaaactctggtatttcttctccctttattttagagtgttatttgaatttgacgtaaatgtctgatgcttatgtagtaaatcctctgctaggtgacatccttagagatctgtgttctagcactcaggagctgctggcatccaatgttatgggtggcaattgtgctaacatgcacaacacaatatccacccttttaattacagaacattcttgcagtaaagtgacactgattctcatctgattaatatttatagttttcagttttggctaaatgccagctatcttcatcatgtgaatttcctcagcttctcagctccc

SEQ ID NO: 43868 - DNA, 768 bp, Bovine  19866880498658
aaaaggaaatccccccaacctctttcgaggaagagcgatggacacccccattggcccaaaccctaaccctgttatcccctcctcccaggctcaacgcccccagaaccttcgagaagaggccgcgcttgaggagaggggggcgtcccggggtgccctctcctccaggaccactcaccgaaggtcagcaggacgcagcagaggcccagcacccacagggccctcatggcgcacggccggtgagtctcaagtcccctttgagctcaggagccgcctccgccccctcctacgccggagttccgaggctcacacctcaagccgcgcgatccgcccactaccccccgagcgggtccggccgcttttcacccccacttctcgcgggcgggggacgggaaacacgaacccaccaatcgtaccgcaccacgcacccgctgtacccaatggggactcgtgggggggaccgcagttcaccaatcgggagctgtccaggtgcggtgcccgatgcccgaagcgtggctcctcccgattggccagtcctggccccttttctccaatcaaatggttccgcgggcccctctcactcggaaccgcccctttacttgggttcttctggcctctaagggaaaccgtccaatgaacgtcagcacagaactcatccccacttgtggagaggtcgcgcggaaccacttccggatcctagagcgcgtttattccgtgcccaggggaagcggtagccatggcaacgagttctccaccttttccgtgtccacg

SEQ ID NO: 43869 - DNA, 987 bp, Bovine  19866880507765
tgcccacacggagcttacactgtaattggtagaatgctcatagcagtgtcattcagaatagccaaaactgaaaacaatccaaacctccatgaacaggggaacagataaataaattgtggtacagtcatacaatggaatactatacagtagtgaaaacaaatgaaatacacttacatgcataaacattgataggaatctcaaaaacaatgtcagaaaaagtcacagaagaatatataaaacatgataccatttacatataagttcagaaacaagtaaatctaaataatatattagggatacataacatagaatgcaaagccataaataaaaacatgagagttgttaccaaataatccagaataatgtttacctcatgtggtatgtgtggaaggaaggcaaagtgggggagctgtatacatctgagggtattctaattcttaagctgaagacatgtgtgatcattttattctcaacaaacattttaaaagaaaaaaataaaaggttatgtgatacaatttcaccaacaaagagagggaatatctgatatttcagccactgttctgcattgcaaatcagccaattactgtaactggtggggaagaagtacatagtaagaaaggaataaatacgagctattcttcacagaagttaattacgttcccagaaagctgggatctaatgagatggcagtattacagtgctgttctgccaagttggttcagccactggcatgattctggttaaccggttactttgttcactgggtataattatttgtataagtggagaataaaatgataagtgatgcaaatcccaaaataaactgagaagacattgattctactgaattctgttgactttcaaaagtacaaattccctttggcacattctcctaatagtgcatttatgtattaagcaattgaaaaataaagtgcatggtagctagtttctccacactggtcaataacaggtgcccaagtggtcaca

SEQ ID NO: 43870 - DNA, 767 bp, Bovine  19866880523247
acagcgggcacgcggcgctcgcagacgctcggtcgtggtccagattccctcctgccctcagaccggctccccctaccccccacgcccgatcacccccgcccgcctcccctacccctcattaccccgcccgggtcgccccatgcccccgccttcgtgggcattctcgccgccctcgcggcgcctgggcacgcatgtgacgccctctgcggagaccaactctcctctcctctcgccccgctcccggcacttcaaaacctctaagcgagcttttctcttgctgtgctgtcattgtttaaagggcccgactcgcttgcacatcttagatgctcagttaaagtgaccgtaaagggaaacggtctatcttctcctgcaaacataaaactgcaggtactgggtggggaggggagactggtcagcagtaaatttccttccatcctaaaatccgttgcccctggtgcccagaccagacacgtcgcccggggataggggcggtagtgccctccagtacttcgccccccaccctgccccgccccgccccgctccgctccgctccttccagccttgcccctggacccccgcggtcacgtgaccatcatcccccaccttggggtaccgtcccccgccccaagcgcacagctggaggccggtccccgccctcccccgggagcagcggcgccggagcgggcgcagtgcattgtgggcagaggggcgggggttgggaagatggcggctcccagcctcctcaactggaggcgggtttcttcctt

SEQ ID NO: 43871 - DNA, 2166 bp, Bovine  19866880629006
tggtttcagaggcctcctcactcgggccagcacagcggcctggattcccagctgcttggagcaggggtggaagaaacccggacccgctccaaagtcgacgcaagcaagggaggtgcagtgggggagcaggactctcttggaaacggaatattggcctcgaggctctccagccttttgagatttccaatgggattttagaagcagctgaagcaccatgaagggcagtaccctggggccagctacgatttgaacgctctgccctgcagctctttggacggaggaacccagaatcctgatctcaccgctcaccaggtaaacagaaatttacaacagggtgacagcctgtctatttcactctggcctgctggcagctgtccttcattttgctgtagacgcaagaaagtagatctgaggtggactgtcccatgcaaaccaccttcaggcgcccccagctgatgtttgtagcatgccagcggaatctgcttcatttttttgccattgctgcaaatccaaaatagtgtgcaagtttttcacatcctgcattgcttttccagacctggatttatctccatctccctacccgccaaagagtgttgatttactgttttcctcatattttcagtgtggaaatcatcggttagctaggacttgataaatgctagcatttaagacaggtatgtttctgagccacaaaagatttaactgagttatgaatcttgttttcggaatctgtcctaggaagctgttctgagggctccaagcaccgccccacttcccccgcaaagaactagcaatcatatgaaatctaaataaggcttattgtaaatacagtagtcatagtgttcaggctgaaaaatgctttttaatgttcaaaaaatgtcctcttatgttcactttatgagcaagaataatacattggctaagcctgataaaaactgataagtaacttatgacataacttaagaagggatacttaatataagaggaaaaggaaaagaagaaaatatgatatccaaacatctgaatgtgctgtggaaaaggcagtccctagctgtttggccctgtgcagccaaatttcccaagcgacattggtttgtttgtcttttcctccgaatgttttggtgttgcatccatacacggaatgcttttgcatgctgcatgatggaattctgggtctctatctaactcagagctgtgcagggcagtggtgagaacatgggctctggggtctgactcacagagatgagtctttgcactgccactttgaagctttgactctgggtgactcttcttatttgtaaaataggaattaagggacatcatatgtgtgaatgtgttgtgtgctcagtctctcagttgtgtccgactctttgtggtcccacacactgtccatgttcctctgtttgtagaattttccaggcaagaatatattccagggattccctgacccagggattgaacccatgtctccagagtctcctgcacctggcagtcgctcagtcatgtctgactctttgcgacttcatggactatagcccgccaggctactctgtccatgggattctccaggcaagaatactgcagttggtagtcattcccttctctaggggatcttcccaacccaggcatcaaatccaggtctcctgcattgcaggcagattctttaccagctgagccatcagggaagcaccaaggctttgccaagtgacaagtgactaccacttttactttactgtgtctggaagggcataatgcaggatcagcagagtactgagccctcagggagggagggaagcttctctagtggtgcatctctagtgatgatgatgctgggggcggggaaagtgaccacacatcctgcactgggccatagccccactttggatacacggttccccctaatagcccagtcaccagacgttcctcacatccacccaagttgtctctccagggcccgacgttcttccttctcttcaaacacctctccttcttttttccactctgcctctctttagttctcctgcctcttcccttgatgagagaaagatgtgctcaccaagccacagccttcaccatttcattcctagttcccagggagcttgattctaaagacttcttttatttcagcatctgccaaagaatgttccaaagaagatagtcccatga

SEQ ID NO: 43872 - DNA, 986 bp, Bovine  19866880775353
gaaaaggtctgtttattccatcctaaagaaaggcagtgccaaagaatgctcaaactaccgcacaattgcactcatctcacacgctagtaaagtaatgctcaaaattctccaagccgggcttcagcaatatgtgaaccgtgaacttccagatgttcaagctggatttagaaaaggcagaggagccagagatccaattgccaacatctactggatcatggaaaaagcaagagagttccagaaaacatctatttctgctttattgactatgccaaagcctttgactgtgtggatcacgataaactgggaaaattctgaaagagatgggaataccagaccgaccacctgacctgcctcttgagaaacctgtatgcaggtcaggaagcaacagttagaactggatatggaacaacagacttgttccaaataggaaaaggagtaagcacatcaaggctgtatattgtcaccctgcttatttaacttatatgcagagtacatcatgaaaaaggctgggctggaagaagcacaagctggaatcaagactgccgggagaaatatcaataacttcagatatgcagatgatatcacccttatggcagaaagtgaagaagaactaaagagcttcttgatgaaagtgaaagaggagagtgaaaaagttggcttaaagctcgacattcagaaaactaagaatagtctacggccataccaccctgaacgcgcccgatctcgtctgatctcggaagctaagcagggtcgggcctggttagtacttggatgggagaaaactaagatcatggcatctggccccattactttatggcaaatagatgggcaaacagtggctgactttatttttctgggctccaaaatcaccacagatggtgactgcagccatgaaattaaaagatgcttactcctggaaggaaagttatgaccaacctagacagcatattaaaaagcagagacattacttgccaacaaaggtccgt

SEQ ID NO: 43873 - DNA, 1235 bp, Bovine  19866880785810
ctatgtcttgtgacgccatggcacttggtcggacatcctgggagtgccagcatcctaacaggagcactttaggtttctactttactaagcacttttgtatacagtcacgtatttcactcttcgtataaatgaattttatttatatataaatatatatatatatattcattccacaaggaaccaagggtggtaataagtatgactcactcactcctgtgccaattataaattaagtcataattcaagtcctgagacattccagtcattccaaagggcatgaaagcctcattttcacctactagccatttcctagaaatagctattgtactttttacattttgtactctttcaaaatgactatcaggcaaaagaaactcagactgatgtttacaagcttttacagaccatttgtatgtttctgatgcttaataaagaaaggaaaaggaaaaaacactgtcatttatttccgacctttttaaatggaaagacttttttctgagtaaagatttttttctgataacctaagtacattgttaatttccatcattttcccaaaattcctctacttcatgactctgattcatttggtttggtaaaatatgagaaattcaagaaaaagcagcaagaaatgtggcccagtcctcatttttatgaaagcatgaaaatagtcttaaataataaataaactcctcaataagtgggcctaacactgtacccaacaaagaaataggaaataagatttctcaccgccaggtcactatatatgtggtcaccaaaatacaacactttggagcccctccatccagtaagcttcaaaaattcatataaattgccctgcaataacagaaaaatacaggtgttatattgcattattatgacagataaaaggcctgtacaccccatggcccaagatatctacttttttttttaaacttaaaatatttttgcttttacagtttaagtatcgaaatattaagataaaaaacatttatgtgaaatctttgagccctttcttctaagtcaaatgcacttttcaggagggattcatattgtataccttcttaaggatcttttttttacatttaatattctgtaatttattgaccatgtcaataagtattcgcctgccatgtaatttcagcagctgagacctacccatgattcgtttcatcaattatctgatactagacatttaccttcctacctattttgtaagtaacatcatgataaacatt

SEQ ID NO: 43874 - DNA, 2931 bp, Bovine  19866880813466
ctgcctggagctgattccttgacaccagtagtcccccctagttccaacctggcactaagaggcagtgtggctttacaaatgttgtaatcactgaagttaaattgcctttaccacattctccttctgggactttgctagttacttaccctccctgcccagttgccagatttctcaaataacactagaggatacccagttaagtcagttgcagataaacagcaaataggcatacagtatttgggacatgcttattctaaaaaattattcattgtttatctgcaattgaaatttaactggcatcctatattttatctggtaaatgaatcctttggtctcagttttctcatctgtaaaatggagatggtagtggtaatatgcatgggtgctaggttgcttcagtcgtgtccgactttttgcgaccctatggactatagcccgccaggcttctctgtccatgagattatccaggcaagattactggaatgggttgccattcccttctccaggggatctttcagactcagggattgaactctcacgtctcctgcattggtaggctggttctttaccactagtgccacctaggaagccctggtggtattatgcctacctccaaaggcggtgctgaggactaagggagctggtacacataaagaacctaggatgtgcctggcggatagtaagcattcagaatatgctacttaccaattctgtttctgtggttctcagatcactggctggcctctttagttcaggaggtgtgtcttggtttagttttatattctaagctactgatcttgtatactccggcttggtgttaaggactcaaaatcttgagttgggcctgattgcaatggcaactccaacacttaccagacctgtgatcttgggcaagttacttacctctctgagcctcagttttgttatctgtaacctggaaaggaagataaggatgagagtttcctgtacagttgttttgagaatgaaaccacacatgcaaactgcttagcaataatatgtattcaacaagttctctccatctattgttgagctgataactacctccccacttaggacatttctgtgcatctcattttttatacggcttgtgatcccttgggtttattattttccttcccaccagtgtctgcctttctgtggaccccctgggtcaccctgatgcctcaggtcaaagcaaaggcctgcccttcagaaatgtggggacagtagtgggttggcctgctgaagttgctttaacagaataccataacaacagacatttatttctcatagttctaggggctgggaagtccaagttcatcatgccagcagtttttggttcccagggagggtcttcttgctggcttgcagatagctgccttctctctgtggcctcacatggcagagagaaagctctggtccctctttctcttataagggctctagactcatcatggggttcccaccctcatgatctcatttaaacttgatgtcccaaagcctcccctcctagtgtcatcaggttggaggtcagggtattagcatatgaactggggagcacagatatccagtccataacagtaagcaatcactttgccctttagcctggtgggtcacaagcccccagctgagatggctggccagaatgaggaacatgctacagagaaagcctcatgtcccctgaagaacatgtgatgcttaggctcaggaagactcctggagacagccaattccagccagcaggcgacccacccttagccctgccataggcagacactcagtggacaccgcatggatcaggctgctcatttcagagaaggagtcatcagggcacctcttgagaaatcagcctgaagcaccgaggttgccttatcagcccctccctgcacacaggcccttttctgtcctcactaaatcttcactttctggtgaggacatggaggaaacgttaccagctttgaagataattgagggcacttagtgaaggtttaactgattcattaaatgaatgacttataaaatatttaagccatttaaagtaattataagcaattcattcagagaagcacaatcacctcctgaacatggatagttttacaactacactggagtattcaaatgaaaaaatttaaaggttgaaggtaggaaattgtttaccatgtgtttaaaaacagccgtttctgactctagtgtcttaatttgttttcctttccagtgagtataaactatggaagtagacacccctgaggtctacatggaagtaaagtgtgtttatggggacattgactactttttccaaacctgtcattgaagaacatgatctgctaatggatttttcatttatgcttaagtcataatttacatacagtaaaattctccttttttgatgtaaagttatacacactttgatgaacctaaacagttatgtaacaaggaccacaatcatgatagagaacagctaggtcactccccaaaatactctttgtagtcaagttctccctcaacccccaacccctggcaaatacatgatctgttttctgtgcccgtcacggtgcctttgcgattcctatgactggaatcatacagtatgtacctttgtgagtctggtttctctcacttagcacatgcatttgagattcatccatgttacaagatcagcagttcattctttcctaatgtttcatagtccaccatcatctacccagttcatctattcaccagctggaagacatttgggtttccaatttggtgcaaataaggataaagctgctatgaacattcacatacaggttttaatgtaaatattagttttcatttcacttgagagtaaatacttagaagtgggagtcatggattgtatattgaatgtattttaaccttataagaactgccaaactcttccaaagtgcctgcatcattttttcattccca

SEQ ID NO: 43875 - DNA, 851 bp, Bovine  19866880861102
tgctcgattttcaaggacacacattaatttagttttatttttccttggtgttttaggacaatcagctaaagcttaaactctatggaagcaaaaagacggtaaaaattatacaagggaatatacttgcttccaacgggctcttgcatatcctcgacagagccatggacaaggtggtgcccacatttgagagcaatactgaggtgagaacttcaggtaaaagtaatgtcaagtcaaatccatcttcccttgttcctcagagagtcatgttcatgaagaaatgcaagccagcaccatgggcttgtatttctgtttttagtagaattctgacacctctgtggagaaagagaaaggcatcgcctgaagtgacttagcagcagcaggtgtaggaaagaggttgattttgtgatctttttcatagacactcctgataactcagaccaattgtcacataaatttatcccttgtgcattatggatgaaggcgtatcttccctgtgataaaattcattccctctaatctatttgatgatggccaaagactatcctggggcttcccaggtggctctagtggcaaagaacctgcctgccaaatgcaggagacataagagatgcaggtttgatccctgagttgggaaggtcccctggaggagggcgtggcaacccactcctagtattcttgcctggagaatcccatggacagaggagcctggcgggctacagtccacagcgctgcaaagagtcagacatgactgaagtgacttagcacgcaaagactttcagaacatgcagatctgaactactgttgaaataaacacaggaagcacatgtataatgtgttgtggttagccagat

SEQ ID NO: 43876 - DNA, 1703 bp, Bovine  19866880869286
tcctagctatccaagatttacctcaccctgtctatggctcggttcccttaacttcaagaaaaatattaatagtattataaaggtcttatgagaattaaaataatacatacagtatattaaacttatagcctggcatatgagaaatgctcaaaattcgttcttatgatcactagatgataaaccccacggggtttttttagagcagggattcgttcttttgaactcgttctgaactcgcttgccttgttcgctgctatgtcagcagtgccctgtgagtccatgtcccagggaaggcacacagttacaatttgctgaaagcatggatgaaggttattactgtttaataagccaggaaataaaggattagagagtgagagagagagagagacaagaggggcctactgtggagagcaaaataaaaaaaagaagaaaattaaccaaagtgttgtctaaacccaagtcaatagacagaaagtcaaagaagaactgtcccagtgtggactgaggccacacttgacagcaattgcatgtttccagcactgagtgatggatagattagtggtaacaccagtagacagaggaactgaatagagggcaagcttgaagcaggtcaatctgaaacagtttaggctttgcatctctttaatttgcactggtcattcaggaaagccattggtcaagcaacaaaattattagcagctctcgggaaagggggcatggaccctgatactacaaaaggtcacaactccaaacacagataaaaaaggaaggtgtcaggggtgtggctgaagccatgagaaagtagagagaaagaacacgactcacgcttggagaaatagccaccacaagacaacaaagaggagccatttccaatttcatactaactctgcctatcttcagaactgtgggtttaagtggtggggagaagggctccgaggtctggtgagttgatcagaatgatgtgtgaatacagaacagtaaccctgggccacactacagcccagcagaatggaccatggagacatcggtactcactgtacctgagagcgtacatctcttcttcattttctggcactgatctgctttgatcttggccgctgtgagcaaataggcttcagtagcatcatatcccatttctgataatacattccagtagtggatgaggtgcagccttgtccagaagctcgggctttgggtctttgttataaagtcggtgatgcttgtaacacaacgtattagtggaggttgttttagtatttcatgccttcaaggcagctgttctgtttaccacatcccattagcctctctgtaaacttcttcgctaatgtgactttagtagatcaccagataaaccagctgaagccaatgccagtcctctggcccctcctcaggccaggctccctgaatctgccagcagagccagcccctccctcttctgagctcacctaggtctgtgtgaagcatttcccaccatggatagcaattctctggctccacaccttcccttctagaaggagagccatagctccttcactcctgaattcccagggcctggaacagcctgggagacagcagaggtcagtgagagatgtctgctgaatgaatgtgcaagggggacaaggagaaaggggagggacggaaggaagtggggtggaggggaagagaaggaaagaaacaagggaaggaggcaggagggcccagca

SEQ ID NO: 43877 - DNA, 1437 bp, Bovine  19866880874544
tgttttgagaacttgttggcagtgatctggggaaatgcttcaacggggatttgattcaagcctttaattcactgtaaacaactggctacaatgcctctttcattttcccggggttcagactgcacacccaggagctctgagtgcattggcaatggcccttttccttttctcctcatgaacttggggaagaattgagtcaaaaagcacattatttatgattgttctgagactggtttcaggtactttttatccacctactattttagatgatatgtgttaagctaactttttgaggcattgtcaacctaacatggtctttgaccacatgtctgttccattccaaagaccatctagtaccacgggagagaatgagagggaggccagaaggctctgggctctgaattcctgaggccagctcctccctggatatcccagtcagccaacccaataaattcctgtcttttccttaaacagctttgaaatgacgttccatttcttgcaaacaaggatccttacaaatgcattccttgtaaccaaaacagtacgcacatttagagagaagcttgcaggggccagatgataataataggtaccatttacagagcttaatttgcacccagatctatgttgaccatttaggtacattattatcttttttaattcttatgaataaacttagatgaatatattactaattccatttttcaaacgaggaaactgtgacttagagagagtgacttgctcaaaatcacacagctagtatataaatggtgtgacagggatttgaaattagggctttctgacttcaaagctgatgctctttaaccacaggactctagaagagctattttggctaccccaaaggcaggggaggtgggctccaggtaacagatgtcaatgtgtgttgatgaaattcacagctcccagggaagttggtccactttcccctgagtgctcggttactctaactactgaggtcatacatctgaaaagggtggtatcttttcctgtccagcatgttgtcaactctaaactctgtttgagataaaataagaggctttagaaacctgatatggcacatctaactgcaaggcacagcagtggtgagccaaggaagggaattcctgaaacaaattcttataggaaaacttctaaggtaattttgaaatgcaaggttgagaggagttcttgagaaggtttccaagaaaaaacttcttttgtttacttttttaaaagaatatgagattgttatagagattcagtacgcctgattggcatctttctccctctctttacaatttcatctcatctctgacggtggcacattccatttaaagctgctgtaaagtggtgtttccaatacttgcaggccaaagcgttctaattaagtaggtgcccaagagatgtttgcatcttttagagaggagctgatggtgt

SEQ ID NO: 43878 - DNA, 4443 bp, Bovine  19866880882890
tgtgcctatgtaatgaagcatcaaagactctgatgctgggagggattgggggcaggaggagaaggggacgacagaggatgagatggctggatggtatcactgactcgatggacgtgagtctgagtgaactctgggagttggtgatggacagggaggcctggcgtgctgcgattcatggggtcgcatagagtcagacacgactgagcgactgaactgaactgaatgaagtgtccattaaaacctgaaaggatggggttcaaagagtttccagtggatgagcactttgaaatttggggagactgatacacaggaaagggcatgggagctccaagttcctttccaggtaccttaccctatgcatctcttcacttggctgttcatctatttcctttatgataccccttatgataaattggcaaacataagtaaatatttctgagttcttttctgagttctgtaagtcactccagcaaattaattgaacctgaggagggtgttgtaggaccctctaatctttagccagtggttggaagcacaggtgacagctggacttgtgactggtgtcttgaagtgggatgcagggagtgtatcctgtaggtgtgagcccttctcctgtgggccctgacactatttcctggtagatattgtcagaattgaattgaattataggacactcagctggtgctgggaaagattgaaggcaaaaggagaaggggatgacagaggatgagatggttggatggcatcactgactcaatggacatgagtttgagcaagctccaggagacagtgaaggacagggaagcctgtgtatgctgcagtccatggggtcgcagagagttggacacgactgagcaactgaacaaaaacagctggtgttggcacatttctttttggtgatgggaaaaaaaaaccaacaacaaagtttttctttttcagtccattgtgatttgatacctttgcaaaatacattaaaaatgtactactaaggtagtgtaataccggcattaagaaagacatatagatcaacagtcgagaaacaaacccttagatttatggttactggatttttaacaaaggtgccaagacttttgctgaaaatcaattaatttaatggggaaatagtaggcttctcttttcaacaaatggtgctgaaaaaactaaatatccatatggatatttaaaagaatggaactggattccttccttatacggtgcacaaaaatgaactcaaaatcgcagacctaaaggtaaaacctattataagaaaacataagagcaaacttttggaatcttggcttaggcaaagccttcttaaaggatataacaccaaaagcactagagaaaaagaaaaaatagagaataattttaataatattaaaacaaaacttctgtgcttcaaaggacaccatcaggaaaatgaaaagataactcacagaatgggagagaatatttacaaaacatacacatctagtaagaggtttataaccagagtagacaaagaactattgcaacgcaatgataaacaagataaataacccaactgaaaaatgggcaaagggtttcaatagacatttttccaaagaagatatataatggccaaagatgtgagcaggatttgtaaatcagtaggagacactgtgggtcccccagggttagcaagaccaggaaatcatgagcaatgaaggagcaatgggagggaataatttcagaatctttggagagagacttccctggtggtgtagtggttaagaatcagactgacaatgcaggggaaacgagttcgatcccgatccgagaagatcccacatgctggggaggaactaaacccgtgtgccacagctactgagcctgtcctctaggtcctgtaacaactactgaagcctgagcacagcaacgaagtcccagcgcagccaaaaataagtgaataaattaaaaaaaagaatctatggagaggagttgaagggtgagggctgcccagacaggactgtggcctttggtagagagacacagcaaatccactgcttccagcgagaaagtaatcaggaaaatacacaccccaaacccactctctttctgcctttgatttccttccccattggtcaaactcaggagtagagcttgcatcccccagtaggaaccccagtggaattagggtgagtatagaataggaataggaaatagagctgtgcatgtaaaataggagacagagggaaaatttatgcatgggatggaaagtcaaaatgaaagaaaaaccacggtgaggatcagggcaggaacaaggaaagtggggtgggaacagtatatactgtggctgcctgtggagtgtcaggatgttctctgaggggtagaacccaggggcagttgggctttgagcagaagtgacctaaaaactattctgctgtttcctcacttctgtttggagcattgtcctgggccagaggtgatctttctcaaagggccagatggtaactattttgttttttttcgtcacagttactcaactgccattgtagtgagaaagtagcctcagacaatacataaatgaattatttggttgtgtttcaaaataactttataaattacagagctttataatctgcagggcttccttttagctcagacacttaagaatccgcctgcaatgtaggagacctgggtttgatccccaggtcaggaagatcccctgcagaagggaatggcaacccactccagggagaatcccaaggacagaggagcctggtggtctacagtccaggggaacacaaagagttggactgagccactgacaactccactgtgtttacagcaagcctgaaagctataaactcttaagaattttttttatcattttgcctttaggtagacttgtgatgtatctattcaaatgacctttcccagttctggcttctgacagataaacaatctggacttctttcagtgtaccaggaatgaatgagtcagtagattctgccttaattcctacagatgtctaagaaaggaagcatgagtgtctgaggggccactaataagtgacatgcggcagaaatttccagtgtccaatctccaatgtcttcatctcaaatattttcctaaaaataggtgagactaaaggaaggaactccaggagacagtgaaggacagtgaagcctggctgtactgcagttcatggggtcacaaagagttggatgtgacttagcgactgaacaaaaggaaggtttgcttttcatgccaggaacattctctagtctggagaaatgaagatgaagcttggaaatcacacagacctgagtttaaagccagtcacttacaggttgtttgaccttgctgagccagctttctcatctgttgaacgaagataatccttaccttatagggagcaatagctgttattattataaggagtcaccaaaatattgggttggccaaaaatttccttttggattttccatatcatctgatggaaaaatctgaacaaactttttggccaacaaatatattcctgtttagagcttttttctctccttactcttttcttttcccctcttgaagactattggttctaaaagtttgttcccaatctacaggctttccccttaggttctctgatgctccttgggcaaatcaaaaataggttgcagacagtgtataaactgatggagatcctttgtttttttattttttatcttattctttcatggaaaggcattttattttcaatatagcggggtgtacaagtcagtcccaaactcccaatttatctgttcaccccgtccctgcaaccataaatttgttgtctaagtctgtgagtctgttgaagattctttgcttatagcaatagaaactgaattcaaactaatgtaagaagaaaaaaaaaagaaagatggagtaatttattggatcctggagtggttctccaaattgaaacataactattcagcctcaggaaagcatggatttcaggaactgaactcatattctattttctctgcatttcttatgtggacgagtattttctatacttcaagagaggtgtctgctgagaaccctcagtcatgtcacagcttcaccacctgtgaggaaaggaaagttctttgcctcttcttcccctacagctgtatttcaaaaccccacgaaagggtcctgtctgtcctgacttgggttggcacccactccccgagctacttgctgtggctatggacctgaggcaccatgacctgctgagcttgtgtccagcacacacagcacctgattggccacacccgctcagaccacacggctggagtgggggacaagcacttgtcactaaaggagagtgatgtgacctgaagaaggatggaaaggcgtgctcggcagagagatgcgtgctatatgcacaggccaaatctgctctattcagcacatcgacacagcgattttcccaagtgcctgccacgattacag

SEQ ID NO: 43879 - DNA, 1825 bp, Bovine  19866880948162
gggagtcaacaagcatttgagaagcaagtatttattttcttaaataaagtggagtcaatctttcatcattttaatgcttaccacagagtctacagtgttccgtccttccctctgctcacctttttctcacattatccacttctaaagagccacctgaaatatccaaaaagtacttactttcacagggtgacaactctaattagggggccatatgagccacagtgacatattctgagcatttcagaaggctccttaacaccggcagggttggatccctttgagaacctaacagaagccatagaattctcgcccctcagaaaaacacaaacacaaaccttgtggaaaacttcagggagcttgactccgaagcctattcatggtcaccaagaaagatgccacattacactaactttaaaaccaagccttcacatcccccacacagcatatccagaccaaagacagcaaatgaaggaatgaacgaatgaatgaatttctctcccattgacaacctagatatgactgagtctactgaaaatcacagtcaagattcaccaacgatttcatttcttcattagtttcttttgtcaaaatcaatgagataataaccctggtcttgtttttcttttttacatataagattcatctgaaaacaggaaacacattttaagaaacttgaaggcagacagttcacaggaactaatcctgaggaagggagaaaccagtggctcttcagcatccaacatcgaagagcatctggccattatcaacaggtcactgcccagaatgtcactttccgaataggactgcatggcactgtccgaacgaagtcagtgaaacaggatcacttacagaatgaccaaaagctcctctttcacaaatgacctttccaagggaagttctcgcagcctgctgccattagaagtttctatttagaactggtgctgacaggaaagtctctccccctttctgctacctgagaagagtatgcaaagccctcaaggaaacacgactatgctggaacacggtgctgacagtcagcacatctccaggggctgcccaggaatgaattctccactggcgggaaagcccgcggtgtagccatcacatgaacatcaccagaaagcgtgcgtgtttaattagtcatcacttgaaataaacaccaggaacatcagtagcttaaaaggagctcaacaccccatgcaaccacttcaagaaagtgctaagaattaatgcaagtcattacaaggcaaaagcaaagaatgccaaccactcagacagagagaaacggtctgtctaaactgtggactccaaatataaacagaagggcccttgacgagtcagttatgtacttgcccaaagcagagacaagagtgggtacgaattaagagagcgaatttcttttgcactcaatggatgataagagcaagatgccacaatgaggacaaagatgtggagagacagttctgtcactctgcccaaagccccaaccatagccaagtttcaaggcagccaccctgaaccgggaggtgactgcctttcctcgggcaaggcagcaagctgggcaacccccgcacactcacaggtcacccacttgctcatcccatggagcactgggacacccagtggaccacctacaggagtcatctgtcagctttctgagactctgtttttgcttatttttatggtggtaaaaaaagcataacctaaaatttaccattttaaccatttcagtgtacagcacagtggcactaaggtgattcacactgctgtgagaccatcaccaccacccatctccagaactctttcatcttgcaaaactgaaact

SEQ ID NO: 43880 - DNA, 1263 bp, Bovine  19866880951009
tgaaggttaactattctttaggaagatcaatccaggtcaatttgggagatggattggaggagcaggataagagagagataagaggcagagagactggttagtgcttcaagataattaggtttgctctgatgcgggtcacttacaacacatggactgtgtcacagttaagttaggggactttcccattagaactcctcgggtactggtcatatttcaggaatagaggagagcagtcatgtttatgtgactcttcggtttatgtccaatgttgactttctcctaagtgttcaggagggtaatttgtacactgaaaagtactgttcttgagctgaaaccttcaggtagcttttgttggagtgacaaatgaaggcttagagaaaagatacaattatcaaagtctaggtttgagattgggggaaagaggggcctcttctcttagtaaaataacatcagcattagaaacctttgtcctacacatactggttgtgatatcttttgtgtaactaccgtgaaaacaaatatttgactcattagtgatatagcttgctttgaaaccaatgctggggatatggaagactaagacagatgaagaattctaattctgttctcaaggtcaccaatttcaaaggaaacaaagttagaatcatgcaaagtacgaacagtagattcctttcttacagggtggatagcctgtttgcaaagttgtttgctattgttgctatttagttgctaaatcacacctgactctttttgaccccatggcctgtatcctgccaggctcctctgtccatggagtcctccagtcaagaatactggagtgggtagccattcccttctccaggggatcttcctgacccagatctcgaacctgggtctcctgcattgtaggcggattctttaccatctgagccaccagttacttaagggcaagaatctctgttctctctgaagcaagctctgttttacctgcctgcatgcaattgtaaacagcacagatacacataaactccttcattttgggggagtgggctgctttaatgctttcttccattttaagagaatatcttgtccctacccattgatcattcctgctgagccttgttaaaaaacaaccaaccaaacaacctaaaacttcattgcagacatgtgcccttggttaccactaggtttccagcctcccaagaaaatgtgcctatttccctggtctgtggagctctgcccagggccacacactgtcagctcccctttgcctataatgcagca

SEQ ID NO: 43881 - DNA, 878 bp, Bovine  19866881081794
ccattatcacacctaagaaaaataagagaaaggccaggaagaagacccaagccctctgcttttattcttggcctttctcttaccttcacaacaaggatgcccagaactgtatcctctgcacctctgtaagctctcctaggctgagtgacttctgtgttgtggtttctctatagtaacagtcaagccttgaacattcagagcccataggcctgactacaggatggcaagaaagaggcagctggggtgtcacctcacagtcagtgttggaaagagggaatccttaggaaaggccctgaatggtggcaaggaggatcttgcatggggagttgtttaccagatgccagactttggggctgcggccaaatctggaaagaatgttttgagacctggcagttgctaaggggattagctctgccttggaagaaaaggcaaaactgggaaggactccagaaaagtattccaaaaatcagagcccataaattttattttacatgccaactctaatcagttggtaggagctttcagaattgataaatggagatggcgtctaaagccatcaccagactcagtaaaagaaagaaagagagagagagaaaagaaggaagaaagaaagagaaagagagcactgtgattgattaataatgtctgccatgggttcaggtaaagagtaatgggaaaggatctgggaatcaaaaggaagataaaagtgagggctcctaaaatgtacttttgaatgacttaaatccagcagagcatataccctgagtggaaacaacacaggctttgtgactttgaattcctggttctgcctcatttcttactgtgtaatcttgggcaatttacaaaaccccgatctgtgaatggggactgttttgcag

SEQ ID NO: 43882 - DNA, 1401 bp, Bovine  19866881105734
catgcattatgggtatacctcatattgttagcatcctacctgtcctccatgactgctctccttcctgcagttgcaggctgaggacaggaaggaacctttctccctacatcttggcatacctatcatacacacagggcttacagaattatgccttgatttctcaatcctgactagtctgaacattgcaaaagagtagtgatgtctactgtggagcatcagtatatagacacagtaggtgctcaaatgtttgttggatagaaggtaccatcctgttaataaatgactgaaaagatggacttaaatggctactgtactgttgcaatggaatataagcagaaacccattttccacctgacatttacaatctagccaaggcacaagacaaataaaacagcactttggcatctgattttataaatattatacacttgagccatgctaattatgaaatataggtatattttaaatggagtttagggattgagacaatgtaaactacacttcggatagaagaatccttaagctacggttggggaaaaaaagtgtgacaataggtagctagttagaagacagtccaggtagaagagagaataaaagcaaggaagaagtcattttcaaaactatggttgttacattaaaatataaacctgaaatacacatttcttaaaaataaagggtaccaaagacctagtgtacctccagtacttggtccttgagttcaattgctggttgtgcatcttctaccctgtatttagtggagaataccacttggggtagaaggggtaattaaaaaggatttaactcatttaagaaatgtaactgtccttaacttcatctttaactattatctgaaaatgtaaaggcagtccacatacaagcagaaaacctaatgctgaaagacattatatgtaacagattaagaaaatttccatctgtatataaaatactaaatataaatcacaagtacaagaccttttctttagtaaatctaatcattttgtcaacttctctataatggagagtggtagacacttaaaacccattagttctttgtgtagaagctgtgttatcttctaatgggaggctgggcgagagcttacatcctggcagggccttccctgaggatgcttacttggttgagatgtccttgcctgtctggtatgcctgggctttcatgatcctctccatgttgccagaccacccgtactggctggctaccagagcacacggagactctgtcaggcgctgagacaccacagccttctcgatctttggaggagaaagcgaaagttagttatctctaaatatcaacaataaaggtcgtcaagtaattgcatttcaactccttaaggactcatcacttaggatcacaaacaggcagttcagaaaaagtacctctta

SEQ ID NO: 43883 - DNA, 1511 bp, Bovine  19866881126822
cattatctgtagcctaggcctcggttactttttaacccatggaaggtaataaaaagagcttaagacctcattatgtgcacacattgtgagaagtgctttgtgcacctgcttatttcaccctgttaacagctcaggagacagatctcagaaccctcaacaatgaagaactctgagtcagaggttcacattcttgccaaagttgcacagcattaagtgccaaagcactttaaatttgggtcagtctgtaaatagcccaggctcctgcactactccaatgctaccttctaaggacacaaagtattgcaaattcaagttagctcattgattcatttgtcacatttactaagcactgaagaggttgtaatacagcatggaagataaataagcacggcctctgcaataaaggggcttgcagatctagagtcttacgcatctctttagatggaattccttttagaaagatgtgtgttgatgggacacagatagacctttatgagaaggtgaaggcctttgttttcaagcaaaaatagctttgtcttgggttatactacccttggtccaaaaactactacaactggtaaatagtttctaaagggccattaaatgtcatcctaagaacagttatagttttatgttatgagtgaaagtttcattgtattcaacaagcccaaaagtttctattttgggaaatgtaaatcaataataggaacaagataatcaaccttccccaacatctttctgaaaagtataaccaactctttaaccagtattttattagtttatttcaatcactactcacttcaccccttgtttttttacattcctcttctccaaaatgacacctaggggtattcattcattcagtcgtacctcccatctatttattgcttgtcatcactaatacacagtttggggcacagattaaaatcaaagattcttcactgatcaacataagtaatgattatttattattcattacttcatctctttgtggatgaaattgtaagtgaacaaagataaatgatacctgaaaatatctaacataaatacagtagaggattttaaaaattatttcccaatttacctgcagtaacatgttctcaatgctcaagaataactcttccgcttcactggtcttgcccagaagcttcagaaatcttgcaataaagaatattaatcggcatttgtcagcagcagtaaccttaaaaagcctgcattccaacactagaatagaaagaaaagtcaataatcctaaagcatatttggagaggaacaaagaatgcctatcatttaatcttgatgaaagagttaaacattaaatacttatctctatttcactgtttttctctcaaaggatcagcacacctgcttttattaatattaaagtttacatatattactgagtatcttaaactaccacatgaaaaataagtcaaggcctttgactaacttccataagtaaattttgaaaaccaaggagtcaaaaaagagtatttctatagctcaatcca

SEQ ID NO: 43884 - DNA, 1871 bp, Bovine  19866881213399
atttcaccactcctgtcttcctctcctctatttttctaccattaaaatcctgcctgatactttaatcccagtgttcatccatctttctgaatctgatttaccctattctgtaagccagaaattagtgttcccgtctttgaatccccaaggctcttaccattccacatattagcctcatctttgatgcctataatatgctagctattctcttatttatatgtataaaaaatgaggggggtaacttgctagatacatcccaaaggttttttctagttctaaaacttcctactaaaatttcaaaatagtttgtagagcataagtaagccagtgaacaaatatttaccaagtaagcacctagtatttatcaggtctgtaccatgtgctgatgacctaacaggtcaacaacaaagacaaggtctctgtcctgtcttgtagagaagacaaatattacgtaaactgggggcaaggagaaggggtggggagcgcagcccattaacatttccaaggcacaggctctggaatcagatcatctgatttgaattccctgctaataactggcaagtgggatgagcatagtacaataagagtactcagtaaatgttatatatagctattaaataattataaatcattaactaattgctagtgcccaatgctgaggaaaacaaagatgttttatgatacacttttggagctgactccataaggaacctcaatcaaggaagggcatcttaagaagatgacatttacactgagactgaaaggtgaacagcaatcaggcaaacaaagataggacaagaatgttccaggcaaaggaaactgagacacaatactggtggcctggaatgagctaagtagaggctaggtcaagcagtgccttgtggacaagagtaaatcaaattagagttttaacagaagaatgccagcccgatttctttttaaaaagatcactctggttacagtcccgtgtagacaatgaactggaaggaaagcaagaatggggtcagaagaccagtaagaaccatatgctgtgtttagggcaagagttcaggccagatgacgaactttcccagtattgacaggaaacagcactggagagcagaagcagagactacaaagctttttcattggtaaactcagcagacttggtggctgactaagagctggagcaaaaaccaaggataacgctgggattcttacagctggggagacagatggctttccctggagaatgcaaaagcaaggggagtggagtgctgggtgatgaagggagcccagctgaagctggtgaccaggcatgtctagtggaaccaataggtccagctgtgatacttacaagcttgataagaacagagaagctaaagtggtggattccatccagacagcaaacaggaaagaacacaagggatactgataagaatgatcaatcattagatccaagggaaatgagaaatcccaacaaggagttaaatcccattaaattaactatcctaagtatttagttgaactgataatattgttctctaaaatattaagtgcaataaatggtcagctgattaagtagtaaattttattctgtaattttttgatggggcagtattttaactacactaataatctgttgatcaaattgccaacatccgctggatcatggaaaaaggaaaagagttccagaaaaaacatctatttctgctttaatgactatgccaaagcctttgactgtgtggatcacaataaactgtggaaaattctgaaagagatgggaataccagaccacctgacctgaaacctatatgcagctcaggaagcaacagttagaactggacatggaacagcagactggttccaaaaaggaaaaggagtacatcaag

SEQ ID NO: 43885 - DNA, 710 bp, Bovine  19866881246350
tagaaaataaacaaactgcattctatgctaagaacaaaaatctttagtacgagtttgtgatcatagcctctgaaatttcgaaagctgccacaatatttttccagtcttgtaaactcaaagatataactccctgtttcctgctgtggaaactgggatcatttccctcaccggctaggttaatattaattggctctaatattggcagcctgtcttggtcaagccttattcttgcaaaaccatcccttataatgaaagaaacataaaatatattctccacagtacgagagaaagagtttggatcaatcacaaactcaaaataagacacaggagtatcaggatactttcgaaagtacgtttgcaacaatcccaaaattctttctacttctttttctgtggcttcttgattaccactcagatccagcttcctcagctttgtaggcataaccccattctcttccattttctgaacttttctccggtgattacgtcgcggctttcgcgcagcagactctggtttgaacgaaccaaaaagaaagtggaatgtttcagcttgtgagtatacacgatgtcgcttccttctgtactgtctcccagaaggaaagagctatgttatcgtcacagttattcaacggatcacgttcgtcatcttccatccaatttagacccacaaatataaacagaaagtcacagaatgccacctgattaaaaaa

SEQ ID NO: 43886 - DNA, 2847 bp, Bovine  19866881257692
tatagcactttgtttaaaaaacttatataactgtgcctggtgacggactgggaagtctggtgtgctgcagtccatggggtcacagagtcggatacgactgagtgactgaactgaactgaacaggtggaacagttctcagagtcttctgagatgctctttccgggttttaatcctcaaatttgacttgaataaaatttttcagttctttcttagatcgactgattaatttttcattgacacttctaaatatagaaggattcaaaccttctgacttaatgtcagtgctcttccaattacatgtgggatgtgaggaatggcttgaccacgggatcatctgtgttacaaagttcagtgtagttctcatagacagactaactggctgacacttacattgtctcttacgggccccccaggtggcacagtggtaaagaattcgcctgccagttcaggagacccaagagacacaggttcaactgctgggtccagaagatcccctggagaaggaaatggcaacccgttccagtattcttgcccagaaaatcccatggacagaggagcctggtggtctgtatagttcatgcgttcacaaagagtccgacacagctaaggctaaatttcactgtgtggatgaacatccccccaattctcagtggcttaaaagagcaaaggttaatcatgtccaccgcatgttggctggaaccccaaatccaggtggatctcctcaacccaggatggatggagcagtcaccatcttgaacatggccagtcagcactcacaactcatgggcagaattagccacaagcaccactcaataagaggcagagtattaatttcaaacaaaagcagcctgcaggtatatgtgcctaagagaccagtttgcctcaaaatgactgacatgacatctggacaaaagacgtaaaaacgtagcccttcaccaaaatatcacagcagacaaatgctgtagctccaggctttgggatatttttcatcctttaggaatgggcttgcttcttataccaaggctgcatggaagtgaattatcgaaactacaattcctggtgcttctaacaaaaactagtattcacagcctgattctgaagcaagcaaacttgcagttctaaccacagtgaacagtgccagcagtgctttatttggggctcatgttacagaggagtacagcatgaacccacaattttaccagtaacaccatgccccttcaatccctaggcctccaagaatgttactgttcttggtcagatggagagattgagagccttgtaaaccatcataaaatggagtgaatagaaaagctgacactacatccgagaacatcctcattcctcaccctgctcttctctgccttatgtaacttaagagatggtgggaatgatgtcaatgtgggaggggaaaaataaaaaggattcatgtgggctttttgaaaaaaaaaaaaaagtaagagagaacacagtaaactggaaaggaaatttaagcttagaatcttgccagaggctgtcatttaaagggttttaaagtcctgagacgtgaggtcccctgtgtgagcgatgctcagagagtgctctgactccaggtaaggttctgtgactgctgtttctctgattcagatctgcagttcttttcaggaggggataagaattttatttcagaacaaaggcagagactgctaattccaccctaaatccatttccctcatccttcttagtgacagagtcccactttggttgaggggagcaatacacccagttgaaacctctgtccccaaactcccttgtaactgtgtgctgtgcttagtcgctcagttgtgtccgactctttgcgactccatgtaactagctatggccaaatgacgaagtcccgggtcaaagagacttaagtgaaaatgttggtggaaaacttctaggaaaactccttaaaaggaaacgcaagcccttctcccacaccagcccctgtccttcctattgtttgaaatatgatggctggagctccagcagccatactatttccagtagtcatgaacatgaggtaaccttgagactgtaaaccagtgtaacagatcagggacagggaaggagctgggctccagatgactctgaagagcaacagcataggcttggactgctgacctccagaagtctttcaaatgagagaataaaccctggtatattaagccattgaaatcatgtctctgttacagccacatacaaatcttaatttatacaaccattttaatgcatatttatagactcatttctactcaagaaatcccagctataactttcccttggatgcgactctcacctccccttagccagcaggtgtctgcacagattcgagccttacccagcagcttgtgttccacggcacttcgcagggactggtgccggaagtacaggaggccattgggcttctcctggagccagtgtctggtggcattgcggaaggcagcccagtgcaacgtggtcactttgtaatgccccttgtagcccagcatgtccaagagctggtatatctcgtcttcggccagcccacaatgtgagatgctcagcagacacagggtgtcagacacccagccgtccaaccctgtgcagacaacacactgatgatggtgacaaaggacggctcacacatgccaggcatcattctacatgttgtgtgtgatcaaccaactcatttccttccatcatcctttaggtagatactataaccgccccatcttacaaataagaaaaatgaagcccagagaggttaagtaacttagcccatgtcacacagaaaccagtgcagaactgggatttgaatgcagacggtgcggctacagaatccacgtt

SEQ ID NO: 43887 - DNA, 543 bp, Bovine  19866881327023
attaaaaatttatgaactttgagggcaaagagggatgaaataaaggaaagaaaggtatactcattctgattggaaaagcttcttgatttaagatagttgaaatttcattcccattatgtctgtttgttgctttaataaaagaagtatgtcctaacactaattatatcagacatattaatagaggcaattatgcttatgcaaatttttctctggttttggatctgaaatgattcttccacgatgctgttggaagcactgagtgtggttccattttttttttttctgctaaagactaaaagtacttgagaagatgagagacatctgcttttgagatgcacagtaatagagcagcaagtttgcaatttagcatcttccctaaaagcagatgtgaatgttccagcctcttcataattatccattctctcgtcttttgttaaaagagagtgagagttttttttaaagatttatttattttttcggctgtggtgggtcttcattgctgcatgcaggctctctgtccgtgcagtgagcggggcggatggg

SEQ ID NO: 43888 - DNA, 2233 bp, Bovine  19866881327116
tctcctgtgtctcctgtattgcaggcagattctttacctgctgagccctgggaattatcaaacacaggaaatttaaccattacacaagactgttatcttacgtacagttcatatgcaaatattccagagtgtcccattaaatgttccttatagctgtttactttttgatccagaattctgttgagaatcttccattgcatttggttgccttctttagttaagaacattttagtaggacttgttttgcctttcattgacattgatatctttgaagagcctaggtcagtttttaccctcccctccctgtcccgtatgtcttgaatttgtatctgattgttttctgatattagactcaggttaaacgtttttggcaaaaatactacaataggtaatgttccagtgccacttttaagaatactttttattcccttttaaatgtttgaagccaggagtcttttaaaaatttctaatattctcattttcaaatatctagcaggtcagttactggtaagtgactcctgtcatcaagtcatgatggaggctgtgggctatttgtacaaatcacttgatttaagggccacctacctcggatattctcattcatcgatccctgggatcctacagtgagtttctgttctgtgtctcaacaagaagtatacttcaggttattcttgtcctgtaaatgacctcttgacaactttcattcctttgcagccttctaagggaaattgagcggactcggggtaggagatattggcctcaaggtttgagccagcagtcttctgaaggtcctaggcatggcgccttatttttggagcacttgcttaaattaaactatcacagtgctcagagttcagacacggtgagctcagcaatgtgcaccaaagcagataagctacagggggctaaaagcttggactttgtggctgagacaatttcagataaatcaaaacatgcttcaggacaaggaaaaaagctcttgagacccattgtttccatttcggctgtggaaaagactcgatggaagacacagagtaatgttgaaatatggaatggcccggaaaaagcagcagtgaagaaaaagaaagattattcctctaaaactttacctttgggtaaaatggatggtgtagtaaagctttcatggcaacggattttgtcagctaaaagtgagagtgaaaaaggcctaattaatgcaaattaccagcatcccctggtagagtctcttagcgcaaataatccctggaaatctgtatctgagctcatctcagagaagtggctttttcataacccagattacagttcagtttctcacaagtgttttttgcagagaagatctcagtttgaaacaaagttgatggaagacctcaaatgatactaataaagattttcatgggctcttctgtgtaacttttttctacttgtcattatttagaattcttcgatgagatattttctggtgataatcaaggtcggggattttatttttattttttagccccttgaaatattgtaactgactgtagctaaaaagaacactttttaagtcattcatatttctgtggtaagtagaaaactgttgatatcacagggttccatatctaaaaatatgtggagataatgttactaaagttctaattgtgttatttactatttgtctatgaatttatgaattaatgtttcatgtacacaaaatttataattgctgtcactgcatctcttaagtaacataaggaaggacataaattggaataaactaaaaccataaagttagtttaaagtactagagtccacagatttgataccttatctatcttaaacattttaattgcctctcattttatcggtgatttgtaagatattacctgttaactgctgaggattaattattgacttccttcttgcttatcacccagcgaaatcctacctattacattaggaatccaagtgaaagaatgggcttagctgtgcgactttaacagcactattgcacttaacctcagtttcatcacttagaagatgggggaaattatagtgccaactttttaggatttctgagaggactgcatgagaaaatgcacactgcaagccttcagtgaatagtaattactgtctgtcacgatctagcccagagcccaccttttcccatgaaaacaattgatcccctcagcccacaacttaagcatacaggaatgctttgggttatttgtcttaaatcgtgccccaactatgt

SEQ ID NO: 43889 - DNA, 858 bp, Bovine  19866881509573
ttctctgaaatctttgaacagaagtttctctacacaattcgtgggacttgtctctgaagtcagaaaaacgtggtttgaaatgtaatttctgcctgtctaacgggcagagatttcccatctttgcctttcagctttccccatctcagtaaagggggtgatcattccagacatgaagcccctgttttaggaatgggcacatcctaattcctttccctcactctagcctcaaatacttcaacttctaactcagctaggaaacatttgggggatggaggggcagagtatgactttgttctccagaacattagacttccttaaaaccccacaacagctggctagtgccgcaaacaaaaactacggtagcttacatcccccgaggcaacttttctcctaggcttttacctgaatcaagttgctaaatttgccgtagccgtggttcatggccactgtcgtaagattttgctgcaaagatagtaagaatgggaatgaaacttttattcgtacagttcacaaagcactttaacaaacgctcaactgaataaaatgaggggaagataacataggagactctaggttgtacgcctgcctttctgtaacacaggggctggatggctaagcactgcattttcccagactgccctgcagctagagtcccacatgtgatatggcatcccccaagcagaagtgcttgtacaaaacttataggtagaaagacatgacacgaggaagtggtggctgctagcagggatattagatcttctgatggtcacagggctggaggcatctggtgtgcagactcttgtttcctagagatggggctggagacagagggcacaggcagaagctggttctgggcag

SEQ ID NO: 43890 - DNA, 873 bp, Bovine  19866881599901
aggatctctctttaaaaaaaaaaaagaaagaaagatgtgctaaaaatattcattgtggttgtcaccgatttttttttctgtcgctacttgaatttaaaacagtttgtaccataagttcataaaacagtcattttgtctatgaggtgggaaaagtatgtatttgttctcaatgagagaaaatttcataagaaaggaaagtagctgtatctaattttgtttaattctccacaaactcctgacacaatgacacagaaacttcttggctttcagatctccgacctccatggcaaaatcaaacgttgtcatctgccgtcgtactgctatgctttattaaattatcattagtacgtgtgacctactaactatgtgaccgcgtgcaggagaatgaggatgactgctgtcctcgttccagtggtctccgggcttgccagcctcctctgaacaagagggtgaggcacagcattgagtcttcaaagaggtcacatcaaaccacgcttgcaccacaggcaaggtgaagcgtggatcacagggacaacggggaattgtgtgtctgctggcaggactggaaccgatgccaatcacacaaagacccagccttcagttcagcccttgacaggatgcgattcctttcaggctgactcggccaacagagcaggctcctgaatattttctggctgcgtttcctaacactaacgatgtaaatgaatatttagcctcggatattaactcggagtaacaatgctggttatgtcctctaagtcagtaatcactgagcttgttgaatactgtggtgatttgtcatggctgaaagcagcaaattagttttggggaacttgaattttctcaaattgtcccttcagattccagccagga

SEQ ID NO: 43891 - DNA, 2017 bp, Bovine  19866880374235
taagctccggagagtgaccaataatgaggtctcaagacctctacacttgctgcgatgtaactctcagattgaacgaatgtgatttgctcagtgcaaagaatgactgctgaatacacacacatatcctgcctcccataaaaggacatacatcatgaagtattagcaaaatgaataaaccaaggaagaaataaattcaccaaatttgttcaaatacacttaggaagtgttataaattaattcctaaaaaacgacagcaaaatagtccttctgtcaatcaggacagaacagccctcttttgagtaaaggtgcaacattcctgaggggctgctgtggccataaatcagagaataacctttgtctgtacatcttacagaaggaacattcatcatcggggctactgcctgaatagctttagaggcagtactaggtaatagttaagagctttgagagagaggggagggaggctcaagaaagaaaggatattcatgtaactatggctgacttgcggtcttgtagggtaagatccaacacaatgtacagcaatcttcctccaattaaaaaataaattaaaaaaagagcttcaagcatcggagacagcttgaaaggtgagtcccaggtcagccaattattagctcagtggccttgaacaagcagcttaacccatctcaacttctggattctcatctgtaaaagggggacaactgcatctgcctcagagggttgctgtgaggatgactacgtgtctgcaacatggaaagcgccgttattacaaacaataacaccatcagtagcgtcatcttctgagtgttcagaccacgtcacctttcaaccagaggcagatgaataaccagagtacacaacaaaataaacaaaagcaatttaactaagctacatacttccaattttctggttaactcaaaactgacaccacaacatcttcataaagaagtactcaataatttctaggaaattatctaaggaagtcctttagagggaaaacacagtactgggctaaaaattagatcttatttctagtaggaaatttctgggtatttcctaactacctgtttgagcactcccaatttacttaacttttatattactacacgtagtaaaatactgaacatttttggtggtcttgagtctcgtcagactgcaaccccgttttctgtaacaggacaagctccaggggggtctgtaggcaagaacactggagcggatggccatttccttctccagcggatcttcctgcacaagagactgaactctcgtctcctgcactggcaggcggattctctatcactgagccaccagagaagcccacaatacttaccatactttgttgtaaccttttctctacgttacttgccttcctcatcatctccctacgtggttaagctctccaatgcagaatccatacgtatggcttcttcgcaccttcactgcaagtaatggtccccactagaagggcccaataattaactggtgtcgttttaccaacgaagcgtttacctgaatccagcgcgaataatttgctaaaatttcaggacaaaaactcagggaaagagctaactgttctttcaacttataggaacgactcttaaattcataaccggcggcccacaggcccgtttgcagaaacgcaaacttgctttgtgcgccgtagtcacgacgttcactacaaaagccagatgccacgtcttactaaatgccttctccatgcttcaaacggctaagtatattcttagtatatgttctaagaatattctacgtgtatattctaagtatactctaagtctctcgagtttcattcatcgatgaaaccctaacacagcagacaacgtgctcctctgaggtgctgtttacctaggccgctgggaaccaggcctgacgccccgcctccccaccacccgcggtccctgcgcgcgcgggctctcacctcgcagtggccgtcgccctcgggctcagggtgtacagcgaatccaaaaaggacctgctcgtagcatccagcaaccac

SEQ ID NO: 43892 - DNA, 2312 bp, Bovine  19866880567145
tggaataaggtagcagggtgggtttatgatgactgagactaaatgctggtgatcaaactgctaaaaaattctgatatatagaggacgatgctgctgctgctgctaagttgcttcagtcatgtccgactctgtgcgaccccatagaccgaagcccaccaggctcccccgtccctgagattctccaggcaagaacacaggagtgggtcgccaattccttccccaatgcatgaagtgaaaagttaaagtgaagtcactcagtcgtgtcggactcttagtgacccggtggactgcagcccaccaggctcctccctccgtgggattttccaggcaagagtactggagtgggttgcccttgccttcttcgatagaggaagataattataggttatagaaattctattttatttagaattgtagaaattctgaagtttttaaatatgtcatttagtaggcacatactccaaagttgtagttatctaacataatattatttatttaataatagcttccatataattcctatccataactgatgataatctaaagatgtagggatatgaaacctaccatgtttatggataaatgccagcccctgcaatatctgatacataatatttctgatgacagactcagggaacaacttgtttctgtgaagaaatgaacaaataaacagtaatgtaattcagtttgtaaaaagaatggtatatactcgaaggtacagtcatagaatcagacacaatgttttgtacacgggtcttcagctgaaatggaaaaggttacttgaataggaaaggcttgtaaattaatcctcataaacaatatttcaggaagttaagctaccaaaaacagtgtcaaaatggcacttaccctcaaatagcccttttaccatgcacagtcattagtactttcgtttatacttttttctttctttttttttaaattatgaaagtatgataacacatttataggagacttggaaataagttgtacttttatacttggaaataatattctaaacaatatcacttttatttccatttaatttagaaatccagaatagaatcatgaaattccaaagctgcctctttttcagtgctcatttgcaattgtattaattacttccaccaaaaggtttatatatttttttaaaatcagatgaatatatttgttatatttatatgtacttaattttttcttcaaaattatatctcaacgtatcttgtttatcatcttatatatttaaaagagcataaattattattcaaagccaagattacccataatcataccacctgatgaagaaactatattgatttttcagtattctaatccagtcataattcacatgtataattcttatataagatgtcagtgttacataaatataactttggtttctgtttttatggggtcgctgagggtcagacacgactgagcgacttcactttcacttttcacttttatgcattggagaaggaaatggcaacccactccagtgttcttgcctggagaaccccagggacgggggaacctgatgggctgccgtctatggggtcgcacagagtcagacatgactgacgagacttagcagcagcaagcactttcataatcttcatagttatcacttctaatggctacaaaataactacatcagtattatccattataattaccaaccttttctcccattgatagttacttattttaaatagttcagagataggtgaagctttgtatagtcgtttaacagaatattctaactgtggtcactatgggtattatgtatcagcattaaaaagaaaacctgtaagtggataaatcaaataagaaatgtatcaccactaaaattacaactacatataaagcacgcatgcctgcatacaggagctaggaagaacttgagaaaaataaacactgatttgagaggtagaggttttctttacttttaactgctattaatgtcataatgctatcagcctggaagataacatatattcagtatttttgaaagaaggaaaaataggattaaataggatttctcaagttcatccttagaacttgagaaagtgtgtatgtgtgtgtgtgtgggtggaagaaacacagagagagaaatcagcatcaatccactgggaaattcatctcatattttaggatcttttgctgaacgcctctggctttaaagacaggcaaaatggacattaaactccagatgtgatcagtagctaccatgagttgtttccatgctcatggcacatgactgaaaactgcccttgtttagagattctgtccgtatgtttaaaaggagaattttc

SEQ ID NO: 43893 - DNA, 1640 bp, Bovine  19866880681043
tacctgcctcctgagaaatctgtatgcatgtcaagaagcaacccttaggactggacatagaacaatggactggttccaaattggggaaggagtagtcaaggctgtatactgtcaccctgtttatttaacttctattcagagtacatcgtgtggaatgctgggctggatgaagcacaagctagaatcaagattgctgggagaaatatgaataacctcagatgacaccacccttatggcagaaagtgaagaggaactaaagaacctcttgaggaaagtgaaagaggagagtgaaaaagctggcttaaaattcaacattcagaaaactaagattatggcatgtagttccatcgcttcatggcaaaaagatggggaaacaatggaaacattgacagattttattttgagggtctttaaaatcactgcagatggtgattgtaaccatgaaattaaaagatacttgctccttggaagaaaagctatgaccaacctagacagcatattgaaaagcagagacattaccttgccaactaaggtctatctagtcaaaggtatagtttttccagtagtcatgttgtgagagctggactataaaaaaagctgactgctgaagaattgatgcttttgcagtgtggtattggagaagactcgtgaaagtctcttgtactgcaaggagatccaaccagtccatcctaaaggagatcagtcctgaatagtcatgggaaagactgatgttgaagctgaaactccagtactttggccacctgatgtgaagaactgactcattggaaaagaccctgatactgggaaagattgaaggtgggaggagaaggggacaacagaggatgagatggttggatagcatcaccgactcaatggacatgagtttgagtaaactccaggagttgatgatggatggggaagcctggcgtgctgcagtccatgaggttgcaaacagtcggacgtgactgagcgactgaacaacaacaacagagatatgtcctgtgcccatctgttgcttttaaaatggaatcttacagcctttattcacactgagatataaataactgataataaccacaaataagaagtttcggtagagctggcatatcctgaaagagacaaaggccagctggaagaggctctgtggcagctgcgtaactggtagcacttctgtagcacctaagaatgggcctttttctacatgaatcatcgaaaaccaaagtccacagtgagtgcagatgaactcaaactttaccccagcatcttgtagcacacacagcaatttcctggcataactgcatgtttacaagactgggaccattcagctgtgaaatgctcggaggccagcacgtgcccgccagcaaggctcaggggcttcgtccagccctccacggcctgcacatcagcattttgtcacaagagaacaagatgagagcggagctccagcaccccgatgggttttgctgtagaaggtgtgaatgctcttctctgaactttgcttacttaaggatttaacgcgtttgctatcaagaatttgaagggaagtggttttgtggggtttgaatacattttttacatttaacttttgggtcactcgtttattggtctaaagccccattttttaattttttttttttttt

SEQ ID NO: 43894 - DNA, 1931 bp, Bovine  19866880755788
tcagaggaactgaaatttctcctttttattcaggagcagaggttttacattttttaaattatttatttacttatttgaccttgctgggtcttagttgcaacatgcaggatctaatttagttgtggcagaactctaagttgtggcttctgggatctagttccccgtctggggattgaacttgggcttccaccgggaacgtccctgagattctatattatttagaggatttgtacagaaacctgggaaacttgcgctttacaatctgaaataactgagtgaaaatgagccagaaaacaggatgtggtctagaagtctgcttataagcaacctccctaagatacagaggaaaagactgaaggataatgcatcagacgaagcaaaagcagtttgttatcctagagtcttttccatggaccttggaatccttggatcaagctcacccctctgagaatgggactcagtacatccttagaaggaagacatatggtgagactccaacatttcaaatacagattccatcacacatctcctgttttgtcttctttcgtgattcattcccaaccagagttcaggtcacactgataaactgcctacatgtaaaacacagcttagaatactcagactttattatatatacaaaataaatgtatttggctgtgccaggtcttcacacgtgatcttcattgcagattgtgggatctagttcttcgaccagggattgaaccccgggccccctgcattgagggcaggcagtcttagccactggaccatcagggaagtccctggaatacttagacgttgaaggcttggtttgacatataactgatttcactttgctgtatagcagacactaacaacaaagtaaagcaactaatattccaattaaaaaaatttttaataaaatggaataaaagcttagcttgttttgacaaaatttagtataattagaggctagacaagattatgcattaaaaaactgaaatggattttatgtggagaagaaaagagaactaattatatgcaaagttcataaatgtaagactgtctactcctcagctggtaaatataccatattctctggaattcttgtttgctactcttcggtattaatagctaatgaggttgctctacactgcactgctggtggaaacactgaagagagactcaggattttcatgagaccctggagattcatttctttaacgaggacaagatgccttgaatctgtgaaacgttatactaagcatttgctgaacctgaaggtgtagcaagtggtgacagaataatgttatcagtgacctgtatccgttgtgcaaatgccaggaaaataatttcaaggggatttctcaggtatttgtaatagatcgtaaatcaaaaatggctgctgactagtaacatcagacattccaaaagagtttctagagtattctttgaactgcaaatgtaaaagttgttctcaaaagtataaatatatctactttaggtaatccagaaaagaatggataaatataatttgagtctccacaattatctcttaaagtgctctccaagggaaattctaaagtaagtaagaagtcaattctaaaatgtagaaaatggcatctttcctggtagtttagcagttagaactctgaggttctactgcagggagcttgggtttggtccctgatcagggaactaagatcccacaagctgcatggtgcgaccccccaaaaaaaaaaaaatgtagaaaaggagtaaggaatgatgaattatccttttttttactggacatttgcagtggtgatatatatcaactgagacaggtgttgagtctgcctcaaggccacaggtgcaaagccctgtaccaaggccacagaagcagaaagcagaaccaaggtcacccccagaactgactgagcccctttgtaaccattgccaaaggccctccc

SEQ ID NO: 43895 - DNA, 2246 bp, Bovine  19866880911516
tgctgcacaggcttttctctagttttggggagtgaatgggcttctcattgaggtggcttctcttgtggcacacaggctccagggcacgcaggcttcagtagttggcggctcccaggctctagagtgtaagctcaatagtcagggcacacagacttagctggtctgcagtatatgggatcttcccagaccagggattgaacccatgtctctgcattggcaggcgggttctttaccactgagctaccaaggaagccccctgacttttttttcatggctgcaccatgaggcttataggatcttagctccccaaccgggaactgaacccaggccctagcagtgaaagcacggagtcctaactactggactgtctgggaaatcctagacaccttttttaaatcacattttccttttatttatatgtaagatggaaaaggaaatggcaacccactccagtattcttgcctggagaatcccaggtacagaggagcctggtgggctgccatctatggggtcacacagagtcggacacgactgaagcgacttagtagcagcagcaagttggatgtaagtgaaacaaactggctatttcttgacaacaaatacgcaagaaaacatggatttgtggtcactcttctaacaacaaatatttattcttgaaattcaaattttttttgccatgctgatttgtttgtgtctttttcactccattgtcaaatcatagtgtaatctttttgtgtgcttactcacattcgactctttgtgaccccgtggactgtagcccaccagactcctccgtgcgtgggattctcctggctggcgtgtaaaacaggatcaactctaggggctgggctcccctgctggtctctcctggaatcaatctggggttatagtcagcggacagtccaagatgtcaggtgagtggggctgtgggttggctgtttactggggcacctcagttcccccccaacatgacctctaatctttaggtttgagtgggtttcttggcatgatggtggaagtgttttgcaagagtaaaaccccagagtgaaagtgcttatcaaccaatgcactgaagttgcacagtggtgtcactgggggtccacatgctctgtctcagaaggctgacaggctgtttccatcaagcacaccctttccatgctgaggactcaactgtgacaggtgagctccactgtcttctatcatctagtgctcttgtaagagagcctgagggtctggcgatggagatcaaacatctcgttctaatctgcatttttctacaccagatgcaggcaagaaggcttgcactgtttgtgaacagaaagtgaaagtgaaagtgaagtcgctcagtcatctccggactctttgcgatgacccagggattgaacccaggtctcccgcattgtaggcagacactttaccatctgagccaccagggacatggccgtttgtgaacagagtgagtgagtgacgtcgctcagtcgtgtccgactctttgcgaccccatggagtatagcctaccacactcctctgtccatgggattttccaggcaagagtactggagcaggttgccatttccttctccaggagatcttcccgattgaacccaggtctcccgcattgtaggcagacactttaccatctaagccaccagggacatggccatttgtgaacagaagaaagcagcaaatcattcagtgtgtcagagtagctaatgccaccatcagtttagatcaggcacatgtcatattaaatctattaccttttttttaaatatagttttatatagttgatctacaatgttgttttatagctgatttacaattgaaatatagttgatttacaatgttgttttaggacacctattttcaaacgccttgcagtgcagcctggtctaacttgatagttctgtggcctctctttgtcgttactggttcagttgctaactcttgtccgctctctgtgaccccatggactacagcccgccaggctgctctgtccacaggattctccaggcaagagtgggttgccatctccttctccaggggatcttccggacccagggatggaacttgagtctcctgcactggcaggtggattctttcccagaaccaccaaggaagctggacgtgacctctgctggcacccatgtaatacaacacactcccagaagtgaacgtgctggcaacgtttatttacattacactccctcaagaatctgtatttatacacacaatccagtgccttc

SEQ ID NO: 43896 - DNA, 1766 bp, Bovine  19866880945697
cacatacaggatttaccacatttcccatcccactagaattttttcttgtgatgagaacttttaagatctagtctcagcaactttcaagtatgcactatgacttacttaaggatagaaatttaaaaaaaaatacaattcaagtgaaaaagtgctgttatttcaaaagtactggtacctgagattttggcttgatgtatgtcttggcacagccttcctattcagacaaaatatatgatctcacttttttaaaaaaagcgaatagtatcaactcagggtcagggctgaccttgactacggctttgagcaccactgttccccactgctggactatggattccttcaagtttcaacaccaagatgattcccttagtctgccagcaacgttcatcatttttttttttttttaggagaggggtggctttgtttggttctatcaatggttgctgctttagaaattctcaaaggaaacttttatctcacaggagacaaagcctcgccagtccaatttccaaaacacaagagctgaaaagctatcagaagttctgctcccccagccgtattctgtataaaaccaccatacatttgctcaaagtcaacccaaactaaagtcagtgggcacttgtttgtttgcaggagaaaatacagccaatacaatttcagaagtactgttctgaatgaactgtatattctcatttttcttacgaagctttctatttccgcagcccacagaggagcaattcaaaaccgaccgcccgaggcctgtgctgtcactgctgccaccggttctttagaacagagttgctctgaaattgcgttttggaaatcccttccacgtaaattgttaaaaagaaaatggcacctaaggaaaagtcaatgtgaccttctcatcctggttcacttcaaaagaacattttcaaataaacagtaagtctacaaccttgcagtagctaatggcaacaggttttcaccattaggttcatttagtcgatgttttcctccattcatagagatttcctggatctgtgttactatacacagtgtttaactttcagaggtgagactttggcagcctggtgcaaatacaggattcaaatacatagtatttttgattaaacttcataggcatgcattgaaaaacgtttggcagaatgcccaccagagcagtaacaggggttagttctcctgtggaggaggtgcagggagatgagttaggaatgcaggttgcagggtggactctgtgcacctctgttatctgagctgatcaacaagcctgcactcccataacgtttaactggtaaaattaaaaacgtaacgcagaggtgctcagtctcatgtttcgctgttgactgagtttaaacgtacctgaatgtagaagtttaagaagaggatgaccagcgtcatcatgtaagaagactggaagatgaggcagcccaaggggaagccgcagggcctgaccacggcgctcatggtgtgggtgatggtgagcaggaactgcacctgtgggcggcaggggcggatcgctctggctctgctgcaagcctgctcccggggcgagacagccccaaagcgcccgaggggcccactctcctctctgggagttttgtcagaagttagaagtgtgtaaaattggccatcgttaattttctctggggaacatctcaggccatttagctagaaacacttcagcagagtaacttcaaaagtattcgtctacatttcacagcaaggagtgagctagctgcatattccatacgcacaggacgcat

SEQ ID NO: 43897 - DNA, 1444 bp, Bovine  19866880948511
caaaagtctccgaaaatgcatcccattgtacacataaaatataaagaaatggtatgtggtaatttaaaaaattatctttcctttgatagtatgaattaaaacgctcttttaaaagtgagagtgtactttcacggctatatttaaaatggatagccagcaaggacctcctgtagagcacagggaactctgctcaatgttatttggcagcctggatgggaggggaggtttgggggaggatacacatacatatacgtgtatttctgtggctgagaccctttgctgtccacctgaaactatcacaacattgtttgttaatccatacaaaattaaaagtttagaaaaataataaatggagatcactgacattaaaaaagtgagtgtactttcaaatgtgagggtacagttattttctgctctccactgacattctgatgagaaattaggaagataaagaaaaacataagaaatagaattatctttggtctgcttcccacagagaacgaaacagtctccttagctaccatcctcggaaatgagagacgtgtgaggtagaactgaggtcttctcaggttcttttcatctctggggttttaccttaacttctctcaagttcatacattcatcccaagaatagaactttctcttcattctgaaattaaaaaagaaaagtttagtgcctggggacggagggtgtgaagacacaaattacactgctggctttccactctattattagtttgcttcaggcaagctgtgtatctgtcttccctcctccttaaaagcagatcatctccattctgtgcatctcaaggccacttcctgcacgctcatgactatgtcacttcttggacaaattacctaatgaccctccatgccgcaaattccttagctatagcgtagaaaccgctgcataagagaagcttattgtaaaaggcttaggtaaggacttagtaaatattagatgttcctatttttaccagtatctgtgaaagtgaaagtgaagctgctgagtcgtgtccgactcattgcgaccccatgaactgtagcctaccaggctcccctgtccatggggttttccaggcaagggtattggagtgggttgccattcccttctccaggggatcttcccaacccagggattgaacctgggtctctcacattgcaggcagacgctttaccatctgagccagcagggaagcctcaccagtatctgtggttggctacaatgagaaaagaagggcatcactgctattattcctaaaatactcttagtgaatccgaatttcacttatatgtattcaggtgctaaaaattaagggcttactgacttaccaaaagatacttttcagtactatagccataaatgtcttgctgaaatgaagaaagtccagtgctcaatttgaaataaaatacaaatcaattcaaatatagtataaaagtattt

SEQ ID NO: 43898 - DNA, 1410 bp, Bovine  19866881160076
acacacaaacccgtacatacacaccctgaataatattggggagaatcagagtttgacaaggtagagggtaccttcagtttctccacttataaattcaataaaatatgacccagttccagaattgtgcatttctagatagctctaatttaatgaatttttccctcaatacgtggctctttggggtatgtagaaaattggactttcacctaaaatctctaccttcaaagtcaagataaaatttaaatctttagggacttccctggtggtccaatgattaaggctctgcattcccaatgcagggggctcaggttagatccctagcagggaactacatcccatacgccccaactaagatctgatgcaaccaaatgatttttttttttaatttaaatcttacacaaaattggaggtccttgagcatttcaaggactctgtgacatcactttaaaaatgaaaagtatttcttcactgtcagctcacccacgccagtggggtgagcaaattgtaacaccttcaaacaaaggtctcttttgtttggtcagtgccaaagccttcaaacgccgttgcaactggttacaaagctcagagataatgcatatttctaggaatgatttagtcacttcttacagactcataccaaagcaaacagaggtagtgtcccgtccttctagaatgacttcatgctatgtgactgtgcttatcggagagaacgggtcagcatcataggtagtgtattgtctgggccggtagacaatgctctatttgtgagggagaggaaagaatatataaattttggagatttgatggtaaaattgagacactattggttgaacacatctttaaaggcagactagtttgagtacattgtgctcacagaggtaggtgtagtcagaaatgcccccgggcgactttcctggcagtccagtggttaagactctgctcttccatcgcagggggcacaggtttgatccttggtggggagctaaaattctgcatgctgcacaggggtggccaaaaaataggagaaaaagaaagaaagaaatgcacttggttctgaatagctgtgccataaacctcgtggtccaggcccccatccagagaagcaggctgctcctatctaaaggtgactcactgcacaagtgtgactcactgcacaggtgtgactcactgcacaggtgtgactcaggatagtatgtcttccttcaaagttgtgactctagcaatgtgtgaagagcacaaggagtctccccttaaagggatcccacagtatattaacttttggaacaaagaatcccttagcaaggtcatactcacatctggtttatttgaatcatttttatagtgctcggtttccttagagcagagcacacttaaaccagctatttcttacaacagtttttgttttcacat

SEQ ID NO: 43899 - DNA, 1452 bp, Bovine  19866881303082
attgtaggtcggaatttggggagggcacagctgggcaatttgtctctgtttcggccactgagttctggcatccactgagttggctgggctgaaggttggagatgcgtgacgtaggtatataccttcatgtgtatgagtgccttagtgtttcccagactttccttctcttcctctagggtgggagcttggcaaacttttcctgtaaagggccagatatgaatattttaggctttgagggtcttatgctctctgccacaattattcgaccctgccgttagtgtgaaaacagccatagacaataatgtaaacaaatggctatttcaataaaactttataacgttgacatgtaaacttcatatacttttcacatactacaaaatgttattcttcttttgatttccccccctaactgttaaaaagcattaaaaaccattcttagctcataggccctacaatacgggtagtgggctagatttggcccatgagccatagattgctgactgcctacttcagggcctttgcatacagcttgggcttgcagcatgacggtcacacttcttcatgtaatggctggcttctaacaagtgttctagagacagtaagtggaggcggctaggcttttaaggcctgggtcctgaaactggcacaatgtcacttctgccatatgctcttggtcaaagcaatcacagagcccacagagatcaaagcgggtggagaaattaacttcacttgatagggaagtagcaaggtcacagtgcagaggagccagtggggaaataaagagatcttactgtggctacaaatacaatctaccacatgaggatcaggaataatgtgtataaagtgaacttagtcgctcagtcatgtccaactctttgtgaccacatggactgtagtccaacaggctcctctgtccatggggattttccaggcaaatactggagtgggtagccatgcccttctccaggggatcttcccaacccatggatcgaaccaaggtctcctgcataccttgcagattctttaccataagagccaccagggaaccttcttcctaacattcactcagtgtatgatgactcatgttcctattaatagtatcattgttaactctgagaggagagcagttagcattgagattcacactttgcttcttttaggagaaatgtagtgaaaattattcaaatttaggctttgaagaactcacttatactttcctcatctacagtaatgggatttataagagtacttatatttcagagtggttttgggaagttagtgaaataaaatacgaaaagttcttaggtagaacaggcctggtatgaatgaaataactgttattattattgttattattttatggtttgaaaaaagattattattttcagtgatctaagcttttctaggacttctaaaacctaggcctctaaaatgcaacaaggtcccaaatca

SEQ ID NO: 43900 - DNA, 860 bp, Bovine  19866880430830
ctactgtcttctagcgtagggtgccatgaccagaggtagcccctcctctgggagcagatgcaacaagagtaacagggactgcatatttttattactgttctgaatcattggagatattttcatcatctcagtagtcttgcctttaaagcttcattgattaaataaatgtttacaacagttacttctgttgtttttataacactccacatttacaaaatgtctaaaaataaatgcttagctgtgggtagaagcagtcattcccacttaacgtgatcaatatccattttacatcagggaatacataatcttgagtggctagttgtaacttattattagatttggaaatcacttcctgtgtgcttgccatgtgctgagtactgtcctctgggttgataaggtaacattcactgaatgcattttcctacttgatcctcaaagctgacaatttttaagttaggtcttgttattattcctagtgtagggatgagaacagagaattctctcaagtaactaaacaacttgatcaaccttgtcttcataagtggtacagatgagacatagtcctagtctatggcagttaaaaaaataagctcttttaactctaaagctccatcttctaacctttacacaattacagttcaacaccccttctactggcataatgcagaagaattgcaaatattacatatgcatgtgtataaatttaccttgaatataaaataggtaaagattttgtttaactcttcaactgtaaatgtaaataataaatcttgaaattaaaaaattaggttagtatctcttaaaataatataaaaccagatatatcctgataagtacataggaacttaaaaaaaatattt

SEQ ID NO: 43901 - DNA, 3505 bp, Bovine  19866880756261
gaatttgaagagatgcttagtgttaataaaaattttttaaaaagtgatatcatggcgtcaatgctatgcttggccataatctatccatgtgagcctctttagaatgtggaggcaagttgtagttaacagaaaacaatccttcaaatgcagtgatgcttaaaaagacacaaatttattattttcacttaaacatagaattatatgtaaagcaatcacatttatcaaggtatagtcaagaaatatatttatttggaaataaacttaatctactatttcattgaaaatatcatatgttctaaataaacttttaacttcagagaaattatgaccatctagaataatttggtgccaagaagtaaaatatatatctagacttctgagaaggtatacattttaaagaatgcgacaacattgtacatataagttggttgttatggctgcaagggtactttaattctgagatataattactttaatgaattctgccactgtgaaatattttatctggtcacatttcatgctggaagaagcagctaagctgggatcgatggaattccaaagatttcacatgaagtgagctttttcagataggggaaaatgatccaagaacaaaatctttggggttctcaggaatatcattctttgtaaaatatttttaaaaattattcctgtcactccttagaccttaatagtacttgaaaattatcctgttctcggtggtgttgcctaaaagtggacttcagtgctagtcagatacccctctccatggtgtacatccctagatatggtgccttccttctttatttacccatggatcaaacaaagagctatttaactaagggagaaggtgggaaggccatctcagaagacccttatgtaatctgagtgatggaaagttgcttttctgtgctctcccctcctccacactacctgttctacttggaatactgcttcatatttgcatcttccctcacttttaggggagatgggaatgtagaaaccaagtagtaaacttaccacctgagaagagtagtgtggcttataccacagggatcacaggctgccaagagtcctttttggaatgtgaaaaattgtgtgtgcacacacacacccagtgaaggaaaatgtgaaaatttgcacacatgtgcgtgtacacacacacagtgaaggaaaagtaataagttgcttggagatttctcttggcacaataacctaagttgtgcaaaagtatctctgactacattttaagcaactctctctgactcagagcagaaaagaacataaaataatattatccactgctgtaataaaatgttttggtactcaaaatgccacatattcttttatttcttagagatgggtacttccgtttatactccaaattctatgaaaaaagtcctattcttttttaattgaataaacatttattgagtatctattatatgtcaagcattatactgttcctaaacttacaaagtcaaccatctagtggaactttatgtagacacaatgatgctactgatgattattgcagtgaggtgcccatggtaatgatggagatgaaaatcgagcacaaataggaaattactaagtatccctgaatatctgtagagatttgctcttcaaagtttcacctcaaaaactctttttactttgatttactacctttttatgttgactctgacttgcagtcctcgggaataaagctatgtgtggcattttaagcattctctcttgttggtttcagttaagtgctctccagctacaatcttttagaatcttttactccatcctattttgtatttacctgttaactggtctctctccaaatagccacatctcttaagggcagagactaggatttgttaattttgaatcatcaaatataaagtttcaaaaaattgttgttagatttgcgtttgtggcagaaatgatttgaagagaaagaagtttggcatttagatgaagaggtaatctttattaagctggttagtgtttatcatagctcccaatttgtggatcacttttaagggtactagggccggtgaagctttggtgaacttgttttgacagatgcgatgatcatttagccttttattatataatctcacaggaaaagttcagagtgagatgatgtacagcagaaggacaagaactccaaaagcttaaaaactccaaagattaaaacaaagtctgggagaaacagaatccagagggtacggggcttacagggggttgtgttggaaactttctgtgtgaccaggtgaccaagagcacaagctaaactgacaggtgagttaattacattagtttgaacttcaaatctaatcagtatcttggggtttgaagtccagatagggggagggaataggcaactcaatgactttctgaataagcaattgaaagagtctataaaacctaataataagaatagtgacccccaagggcaggaccactattcctgaggaatgtcaagaatcaaaaaggggacttcctggtggtctagtggttaagacttcaccttccaatatagggggtgcaggttcaatctctgattggggaactaagactgcaactatctggtggccaaaaaaccaaaccatgaaacagaagaatattgtaatagatttaacaaagacttaaaaaaaaatggtccacatcaaaaataagaaacaaacaaacaaaaaaaaaccttaaaaaaaaaaaagtaaaaaaggaagcagtactttaaactcatgtccaatcatcagaatgatgtagtctttggctattattatcattatggttattattactgtcatcatcatcattattattttgccataacttggtgtatcaggaggaattcttgtgcttcctgataagaattaactgtgcagctgagctgactaggctgggttgcattggctagagtagaagaagatattacaaaaagaaggagaaaggagagaaaaatgtgaacatctgtggatgatatatgtaaagttcttccatttcttgaactttataagatgatggcagcaggaacttgacaagagtaacattctctttggaggttgccctccatggatgctcccatttatcacaacttatagaagtcgtatgtgggagagttactttagacaaagccaacccagctgtaattaatggctcaggccaatactgggtctttgcaacaggtgacagcaagttgcctgaagtagttacaatgaaagagaataatctagtggaagctattatcctaagtaatatattttatacaaaacagagttaaggaaaatgaataacagtatttaataatgcacaatatgaagtcaaagagaattttgaaaaccttaaaagatgctttattgctaagttccaccattgctagagaaaaattaaattttatatagtagtcttttgttgtatgttagtaaaatattgaaataaaggaggaaaataatattgcttgaaatttttatttttagaatggatcaggattatacaatgaggtgtatcgcag

SEQ ID NO: 43902 - DNA, 884 bp, Bovine  19866880791113
atcggagaaggtaatagcaaccccactccagtactcttgcctggaaaatctcatggatggaggagcctggagggctgtagtccatggggtcactgagggtcggacacgactgagcgacttcactttcacttttcactttcatgcactggagaaggaaatggcaaccctctccagtgttcttgcctggagaatcccagggacaggggagcctggtgggctcctgtctatgggatcgcacagagtcagacaggaccgaagtgacttagcatagatactctgataaaagagacaatgtaaaatccccattgacagaggagcctggtgagctatagaccactaagcatagcacaacatattatcactaatcacagatcctagtgctttggtgggcaatgatcatgtatatcagaatgtgtaataataatgcttctaagaccaataaataaatgaacttcaatttgaacatatgatattggctttctttagtaaaaaaaaaaaaaatcgacattgtttttctctcaattaaaatagtttaattcagcagtgttttctgtttaaattatggtcagaaaaacaatcaccacaaaactgatttgtacttcataaacattagagactcaaatgttagacatgggaaatcaaaagcatattttattataattatttccagtatatattactctacagaggatctccttggcatggagagtaagtcaaaaattttactcacagcatcctcaaagaaaaagtttatatgaaatacatagtttggttcagggctttccaggtggtagagtggtaaacaatccacctgccatgcagagactcaagagacacaggtttgatccctgggttaggaagatgcccggagaaggaaatagaaa

SEQ ID NO: 43903 - DNA, 1550 bp, Bovine  19866880803052
aaaaatgcattatttggcttcagcatgaaatttcccagatagtccaaggcaaatctgccaaatctatgccaatacttttctaagtattttgcaaattaatctttagaaaggatgaaagtttactttcttaactttgcaattaaatgaatattttctcttcataaacagaacttaatgaaccaatgtttatgtaattgtctgtttgccaattaaacacttatcctagaactcataactacccttcttcgtcaaggagtcagcaatagaaaattctttcttttctgtcttttttttttagtaacctttcttctgccaacttttcccttattcttcctcctaactgtttttgctcatcctctttgctttttactccttgctttttccatttctccaccctgctccacttccagtggagcaggaagtgagggcatagtgatatctcataaacagctaagtggggaacagcaggtgaaggtgtagatcaggcaggagagggaagccatgatcataaagcttgatcgccttggtttaaaacatttagaagctgagatggaggaattttcctggcccagaatctgggaactaaaaaaaaaaatttccattagatttttctcaaatgaagagaagattacatgttcagatggttcaatgtcattggcagtgatgctgaggaaaagccagagagcgaagagctaaaaaaaaataggggcaaactgtctagttgtgcacaggagggaagttgagcccaaagttgagataatgagagtgaatttgaaagagacagagactatcgaaggaatacaacattaaaagaatccctggaggagtcagcaatcagttgcagaaaggacagaagtgagtcacagattagcaatggaatgaatgcacatttatgcgttctttcctagctcctttcctgaaaagcacatatatcaccggatggttatctgaacaagagccccgctgaagagggtgacaatcagcctaagccaagcagacaagtaactctgctacagggaacagccctagaaacaggttttacgatttagcatagatatgtcttttttcttaaaagaaacaatctcagcttatattttattcatagaagccattctttactctattgccttgagtgattttggcggtgagtagatgtgagagtagtagctttaaattcacccgtgcccttgaaacagcagtgtgcagtacattcagcattgttaccctgtcgctcttctgcctgctttgtgggcctgttatgaaactcctcttttcagaaaattgtattctggtgctattattgaattaacattttacttaaatgtacacacacacacacatatctctgagagaccatgtaaataatcaaaggacagcaaaaaggcatactctctaggaaaaaattttaaaatgtctaaaatgccctgcttaccttagtttcaagggagatgcaaggacctattaatgaggtttaccaggtgactcagtggtagagaatccgcctgccactgcaggagatgcatattcagtccctgggctggggaagatcc

SEQ ID NO: 43904 - DNA, 1036 bp, Bovine  19866880949277
tgaatctgtgtctcctgcattggcaggtggcttctttaccactgagcccctgaggaagtctgttactgatattacttggttattactattgctaattcattaacaggctattggtgaacatctcaatgaacttagagagcatgtatcattatttgcaatcatgataaacaatgtcatattttgcttcatattattctctaaattttaaaactatgttcagtattttataaacatattttaaattttcttgtaaaaaatgtgagctggtattagggtacaaatttattttccttaaaactatttgactataacacaatttccccaaacctcctatctctttattcaatttatttctctaataaggaagcatgccttgaaattgctttctctcgtttttccctatcagaagtccaaatatgttgctctttaacaaacatggtaataaaagcaaagccccaaggctccacttactattatgcaaagactggttatagaatgcaattcttgaagaacatttgcttgcctagaatctattcagggctcaggtaagagtgtcaatttcatcacacttgtctcttgatcattataaagtatgaacttcttgaagagagaaattctatttaatcatccttggaactctcatttctggcacagaatatgacccacagtgggtgtgtttaatgaataaatataaatacttgatactttttagtcactgagttactgatgttcaattttcatttgacttttttttttttttttggtgcactggcagatgactatttaaagaacaagcaataaaaaatggggattgtatctgtatgaatcactctatgagttatttgtatatggatttcagtacatcttatagctaggctttgtagtgattttcaagggaccttggtaagttcaaattcctaaaatcagatcacaagtctatattgcttttttatggaaatgcaaaggccttaaaaatgtgctaggaatgcaaatgcttgctttggtttccaattatactttgcaagataaaggacat

SEQ ID NO: 43905 - DNA, 1770 bp, Bovine  19866880985618
taactctgggggaaaaaagtgtgcacacataatttaccaggtcaaaaatctgctgggaaggtcttgccctctggtataagaaatcatgttatgctcaccttttcctggggccagaatacttacagctctctcagcaacactgctgttccttttatgtatttcccagaagactaaaaagtgcaataacagaacacttatatttattattatctaaaacattacagccttcatttccattctttaaaaattaatttctctgaagtgaaatctaatgatttatctgttttaaaactattcaatagatttgtatcttctttaagataaatctgaaattcttggcatgacatacaattatcttcagtatatatctctttcctattttgtccatcatttctcacttctctcctacctcaaaacttacatttcagcaaaactgaggaatttttagttgcctaaacacggtgtgttgtctaatgttttgtgctgttgtacatactgttccatgaggtttacctggtgattcagtggtaaagggtctgtctgcaatacaagagatgaggatttaatccctgagttgaaaagatctccagagaaggaaatggcaatccactccagtgttcttgcctggagaatcccatgcacagaggagctgggcaggctacagtacatggggtcgcaagagttggacatgacttagcaactaaaccaacaccacaagtgttcttgcttgggaaatcacacagacagagcagcctgacaggctacagtccatggggtcagtaaagagtcagacatgacggaggaactaaacaacaacatactatcccatatgtccagaatatgtgggcaggaatcccttagaagaaatggagtagccatcatagcagcaaaaaagtccgagatgcagtacttggatgcaatctcaaaaatgacagaatgatctccatttgtttccaaggcaaaccattcaatatcacagtaatccaagtctatgccctgaccagtaatgccgaagaagttgaagtcgaatggttctatgaagacatacaagaccttcttggggactggaatgcaaaagtgagaagtcaagaaacacctggagtgacagacaaatttggccttggagtacagaatgaagcacgtcaaaggctaatggggttttgctaagagaaagaactggtcatagcaaacaccctcttccaacaatgcaagagaagactctacatatggacatcaccagatggtcaacactgaaaccagtcagcaaaaacaagaccaggagctgattggttcagatcatgaaccccttattgccaaattcagacttaaattgaagacagtagggaaaaccactagaccattcaggtatgacctaaatcaaatcccttatgattatacagtggaagtgagaaatagatttaagggtctatatctgatagacagagtgcctgatgaactatggatgggggttcatgacattgtacaggagacagggatcaagaccatcccatggaaaagagatgcaaaaaagcaaaatggctgtctcaggaggacttacaaatagctgtgaaaagaagagaagcgaaaagcaaaggagaaaagaaaatatatacacatctgaatgcagagttccaaagaatagcaaggagagataagaaagccttcttcagtgatcaatgcaaaaaatagaggaaaacaacagaatgggaaagacttagggatctcttcaaaagaattagagatactaagggaacatttcatgcaaagatg

SEQ ID NO: 43906 - DNA, 1079 bp, Bovine  19866881099206
taaacctaatgttttgactttattgtgctttgtcctccaattgttctctgataaggtccttcaggacagctgccctacacacaccatactcacaccttcttatgctctagcaaagtgagaagtgcaaacagagaactcagtaatgattcatgaatgccttaagagtccccaagaaaatatgatcagaggtcttgaccatgattttgcttatagaataataaaagttaaagttgatcctttagaaaagttatctttcctagggatagctacccattgaaagggtagcttacatatatgtatgcttcccaggtggcattagtggtaaagaaccgccagctaatgcaggagacataagagaatcaggttcaatccctgggttgggaagatcccctgagggagggcatgacaacccactccagtattcttgcctggagaattccatggacagaggagcctgacaggcttagtccataggactgcaaaaagtcagacacgattgaagcaacttagcacacacacatacacatattcatatatacacattttaatgtagcatcagttttagctatcatggattaacacaactctaacaatattatattttgaaatagaaaactgaaatctcaatttactaaaaatataatctgatagtaataatttaaaaaatattctttcacaaaatagagaataactaacctagtaggccactgtcagcataataagccccagtaggagaggcacacagattcaagagtcaagcaaggcagatgttaatatattctgttaaacatttgtcatctgagggaagaatatgccccagtgatcaaatatatttaagttgaactttaattctactgccccagctgaaatttttcttttctacatttcaaataaattagaaaaccacagggggaaagctctgggaaaatacctgctgtgctttatggattggccacaattaataaataaaatgaactcttgtctctgaaaaaattgcacttcaatggcacatatttttttcctcaacgctgaaaacacctcagattgacatgaaatactgcttcttatatttcttttaa

SEQ ID NO: 43907 - DNA, 897 bp, Bovine  19866881203383
cagtccatggggtcgcaaagactcggacacgactgagtgacttcacttgcacttttcactttcatgcattggagaaggaaatggcaacccactccaatgttcttgcctggagaatcccagggatgggggagcctggtggctgccatctatggggtcacacagtgtcgaacaggactgaagtgacttagcagcagcagcactgtagttaataaatctcattaacttcgtttaagaaaccaaagtttctaaagatttggttttgtttttaaaccactgggtttttatattataaaagttgctaatatctcaaggacttcgtattcctcagaggacaaataagggaatattattgtaaaattaagctgtctgctataattggtttagtacaattgcaattagggagatcacttcagaaatctagggaggcattaatgaggattttgagctggcattgaatgatgtgagtattttgagcattgacaaaataagatattctgggttgggatgcaagttgagagggttaacagaataaataaaaatggagaggaggaaaacagttcatggttcaggtgtgtttaaacgacaatgagaaaatcaatatgcctggagacgaggtttttgattgagtgaaaatcaatttggcaaggttgattataaagatccttgcatttggggttaggttctataaagattgaaatatgcgttaattgcatccagaggggaacaaatggggaatgggtgtttagcattctgaccaaaccatttctttaattaaaaaaaagaaagaaagaaaaaattactgttgtttctgtttttttaaaaataacacaagtatacagtgaaaaactcataatataaaaaagggaagcagagtaaagtcaaaatcactcacaaccc

SEQ ID NO: 43908 - DNA, 930 bp, Bovine  19866881218903
taggatagtcctagctgtggattgttctataccagaatggaaaaaaggcattgacaagaggcatgggcagagaattaggttagcagagtaaacagatactccataaacttcaaaagtgctatatctgcttggggaaataatactcttagaaagtcttattcttctgcataataaattagttatttgcactaaagaaaccaacaataatgatgcaattttttctgaatgaatcttcctttgttgctatttaatcaagcttcatttttaatctgcatatagaaaagattaaatgctgggtgcttaatgactttagggggaaaaaaaaaaaaaaacattgcctgaatgtttaatatcaacccagggcttcttgtacacctatgtgaaaaaccaagaattacagtagagattggcagtggtaatggttatttgaaatcctgcttctacaaaacaaatggcctctttcaatgctttcattcttcaaatataacacttctctgaatggaaaagacgcccaaccaaaccatctgtcagagaagacagagttcggctgcaaaaggcagtttgttttgctgcactcttaaattttcttacttcaaactagatgaactgtagcaaaacagaaagtactctgcttctcagatgcaataactgatgtagaataacagaaatagtacggggaccgagagttggtttcatttatgtataatctaaataccatcattccacactagggacattttatatgttccctgttgattaaaggtcagctatattggaggtcaaacacctgccttcatttaaaacacagagtgttatgatagtatttgatccctaaagtgtcaagtagagagctttgcatactatttgacatatattcaaactcatatatatagtttatagactatgccttagaaagccggatatattaag

SEQ ID NO: 43909 - DNA, 995 bp, Bovine  19866881342246
atatatatatatatatatatatccccccatatatatataaaccttatttttttcaattattgacaagtgggaaattcctttatttgattctattaaattgttgacaatatacatggggaaaaataatcaagatgatgagaacagagaacagttattctggatgtctcatttaggaatttttaattacatgacagattccaccagttctttctaccagttttcaaatttttatttttattttcttttttttcccagttctttattttaaagtcttctaagactcaaaccaggatatggacgactgagactctgttatcacaggacaccaggtaaaaattgaaagggctggggaacagtcaaggtgattattttctatgagtaaagaacaaagagtagtgttttgtcttttactagatgctatgttcagagtttcttgagaatctctctacaataccaacaggtactttccctatgacagttttatgaatgatgtatcctcaatctgtaaagaaagctttgtcatctaaggcagtgcttttctaagtatggtaacctgagttggcagcatcagcatcactggccatatcccagatcaactggacaataatcatggattttggagcccaggaattcatgcagatttgtatgcattctaaaatgtgagaaccatcagttgagctctccaatatggtagacactagccacataggatatttagatttggatttaaattaatttaaatagaatagaataactcggctcttcagttattttagtcacatttcaagtacttaaatggcacattttgttagtggctacaatgttagagagtaaagatatagaaccagttactgagatttttattggagaacattgcctatcaaggcaatgattcaaacaactgctgagtttatcatgctactttcaattattccaaaacttctaacatcctcacttttttactttcttctcattgcttcattttttattagttt

SEQ ID NO: 43910 - DNA, 1078 bp, Bovine  19866881472076
ttcttacctggaaaatcccatggactgtagccttccaggctactctgtccatgggggtagcaaagagttggacacgatttagcaacaaaacaacaaatgacaacagacacagtacatccagaaaagaattcatctaactttggaacttattttattggaagtgcatactttgacctataaattctgaattggcctttcaactaaccaaagttagagccccttgaaggccaaaagaggcgggggaaaggagaaaaagaaagaaagagaccttacagcctgactataaatcatgtcagtggtttcttcttcactctcaggatgaaatccaagtcccttagcatcacacaaaagacctttcatgattttacctcttcctgatctccagattcatgtctcaatctgtcctcatatgttttcaatacttcagactgatcagcttgcagtaactccaaaagcaacagccctttcatagcctggtgcccttgaacttaccacttcatcttcctagaacccctatgctcttaaattttttacctggaaaatttctattaatccagaaaggctcacatcagaactcaggccatatctgagtgaattgcctttttccctgatctcccaatagcacactcttatattgatttaataacccttacaaaaaagtattttctaaactactctactcatatgtttcctcctctagattttggaaaagtttatgtcccacatctcagcatctttagtatatatcagaccatcagacacatcagagatgctcaataaaggaaaatattttgcagagttcttctactattctatccaggtcagaaataatctcttgcacatggtaacatttttattcagagaatagtttaggctccactcagaatgttgtgttgtggatctatttggatgctgcctcatagcatctaattgttcgatttgtctgtctggttattggcagcctgcagggtgttaggagggaaaactcacagctattttaagagctacttattgagtcagccctgaaagttttgtttatcattttctttattctgcttccttttatattcctgggact

SEQ ID NO: 43911 - DNA, 1323 bp, Bovine  19866881524775
tacagccactatggcgaacagtgtggagatttctcaaaaaactggaaatagaactgcccatataacccagcaatcccactgctggatacacacgaaggaaatcagaattgaaagagacatgtgtaccccaatgttcatcgcagcactgtttacaatagccaggacatggaagcaacctagatgtcccttggaagatgaatggataagaaagtgtggtacatatacataatggaatattactcagccattaaaaaagaacacatttaagtcacttctaatgaggtggatgaaactggagcctgttacacagagtgaagtaagtcagaaagaaaaacaccaatctacagtatactaacacatatatatggaatttagaaagatggtaatgatgaccctatatgtgagacagcaaaagagacacagatgtaaagaagtcttttggactctgtgggagaaggcgagggtgggatgatttgagagaatagcactgaaacatatatattatcatatgtgaaacaaatcaccagtccaggttcaatgcataagacagggtgctcagggatggtgcactgggataaccctgagggatgggatgggaagggaggtgaaggcggggttcaggatggggaacacatgtacacccatggctgcttcatgtcaatatatggcaaaaaccactacaatattgtaattagcctccaaattttttaaaaagggaaaggctacccactctaatattctgacctaagatttccaggttaatttggaaaagcaaaagactaacttaagagatgctgaattaaaatgcacaacagggttgattcctcatgataaaatcaaatgatactgctacccagtctttgtgtataaaaatgtagtagttaacacattaagatttattttaagtcatattcattcacttcgtatgaaatcaggaattcttctggtattgcttcatatatgttttctgattaggttatttagagatcaagaaaaatgaattataaaacctctatttccatcaatgtacctcttaaaccgtacccactttctcctaatatcccaagcaggacatcaaggattactgcctgtttcagattctaataactgcttcccatttagtggcctgacttcccagaaccattagaaatgaaatgttttcacctaatgtttaaagattacctgccacaagtatgctctaccataattcaggaagtgcattgtaaaaaattgatttttctttaaaattttttgagaaaaaaattgattttaaagtagactctgtaacctttaggaattttaaaagaaatttttaaaactttt

SEQ ID NO: 43912 - DNA, 691 bp, Bovine  19866881535183
aatgtttgcattctgaaggtggagaactgagtatggatttgcctttcctgattttttcccctccattccatggttaaaaatcctactcatacttatgatacattctacatttggaatgctgtttcattcctattcagagctgagagctgtaatggtgaatctaaaaaaactaatatagaatcacagatggtgcaaatatttgaaaataggtaaatacaatctaggattagctgtttgggctcagaaatgtcagcttcgtattgcttattggtcacacaagacagttttagctaaggggaaatccaggacaaaagcatcatggtataaaatttctggtttggagctatgcagtataacaagcccatgattattacataaactccagaatgagtctctatgtagctagaaaaggtgttttagacaggtcacaaagtaccaagaggttatatatatgataaaaattaagtaaatataatagcatggaactgctatcattaatatctgctaaattacatttaaagccaatttttgaggagaaaatatccattcttatagaaatgctgcagtttcacagtacatgacctgagcatgggaactactagattgccagcataaaatctgtagatggtagttattagtagtaagtgctgtgtgtccctatttctgactgagagttttaagcaatataatt

SEQ ID NO: 43913 - DNA, 1815 bp, Bovine  19866881601605
tcccttacccaaaagtaaaattctttgacagcactccattttataaagctaatgaaagcctttaactatgtgtgaaggctaaaatgaccataggggaatgcattttatattataatgacttaatggaaccaattatattatattaccataaaaacttttaaatagaaaattgtattcaccagtaaaattgtcttacatttcagtgaggatgtgcatatgccaactgcttattataagtcaagattcaagaaatattcaccagttagtattgttttatgatttttaattcaagatccattaatacttcagaagcaagaagagcttttgtaaaattacatttaattataaaatagtcttaaatataaagcatctagggagtatgtcaaacttttcaaaaactgtaactaattaaatctttctagggagaaattggatcatctaacaactctgattcctgaaaaggacatttctgcaacagtgaagaacattagcattctcttcatttccaattttgcattcacttaagacaaacacaaaattaataatcaaattcataatgcaccattagctctgaacatattaatgaacaccattaatattgtttcaaagaaaatgggttttgatatcaaacctaaaatcactagaggatagttaatatatagaaattgtatcttagtaggataataatgcttgagtaatacaaatggtcattcagatttgaaagcgtaatttgaaaaattctatttgaagcaaagaaatagttttgatcttctttaatattttgttattttcataaagcttcattaattttaaaaaagggcttatacttttaatcaatcactgttttacttaaaccattgctactgcttcaacaataaaatgtgtgagattagtaccggaggaaagtaataaaggattttatcacaatttattggttctgggccaatgaaatttttatagataattataaatttatattaaggaagaaaggttgaagattatctaaaataaattgttgtaactgatcaaaataagcaatagaaaatgttaatagtctacactggcattaattaaaatttattttagttacaatgcttaaagaaataataataaattacattaatacattaccatcccctgcaaagaaaaacatgcttcatatcattgaaagttttttaaatatgacaactaaaatcaatttgactgccaatgttattcagttactacaacaataaaaaaatgacattataggtttagataaaaactgcatttatttaatttttttttgaaataaaagacaataagaataatatattgctctacactatgggcttccctggtggctcagacagtagaaaacttgtttgcagtgctgaagacccagattcgatccccaggttgggaagatcccctggagaaggaaatgacaacccattccagtcttcttgcctggagaatcccatggacaaaagaccctggtgggctatagtccatagggtctcacagagttggagtgactaacactttcacttaacttttatgaatataaaatgttattggcattaagctaaattaaaaattgcaaatataaaagaagctcattgttaaaaaaataaatctagaaatcaatgaataaatagaaaatgataaataagtctctcacttagctacctgttccaatttccagaggttatctaggaggagcagaatatatgaccccaaagtggaataccactttgagttattttgagatgacggcaatcaaggcctaatagactgaagaagaaggtgattattaacttctctcttaactgc

SEQ ID NO: 43914 - DNA, 792 bp, Bovine  19866881705020
tgggggggcatgtctgagttgatgtctgcatgtattttgtctctcaatcatcttttaaatgaatatactccccaccctcttgagcaatttataatgtcattattatatctatacactgcattctacagcaaagaaagtagaatgtgatttacaggtaggaagatcaaagaatatttcagaagtgaggggatatcatttaactgaagagtgacagatgattacaccttgcctcaagtcacctgtgatattaaaaataaattaaatccctgaagaaaagcaaagccattcagtttccacacccgtctgtaagcttgatgtttattacctttgcactagcagcttagagaaatatctttacatagattgattctttcaaagcttgaaagggaagtcctttgtgtagagggtctgagcaatctttccaaagagcttaaatcctagaattcctaatttttctgcattcagattctgagggtatggtctttattatttatatgaaagtgagagatttacctatttggttaaacctgccagaattataaaatttactagtaattttttattgtaactatgaaaaagtatcttatctagttcatgaaacaggagagacaatttatgcatgcagtttacattgaaattggacaaagcctaatatgttcactagacgaaagatgaaaaaggaacacatgtttccaaaatttgtttccccatcctgccctaaccacaatcatttttagagaaattcagaacattacatgaagaccactcaggaaaaatatgtactctctttga

SEQ ID NO: 43915 - DNA, 1798 bp, Bovine  19866880209898
ccccttctcctcctgcccccaatccctcccagcatcagagtcttttccagtgagtcaactcttcgcatgaggtggccaaagtattggagtttcagctttagcattattccttccaaagaacacccaagactgatctccttcagaatggactggttggatctccttgcagtccaagggactctcaagagtcttctccaacaccacagttcaaaaatatcaattcttccgcgctcagctttcttcacagtccaactctcacatccatacatgaccactgcaaaaaccatagccttgactagatggacctttgttggcaaagtaatgtctctgcttttcaatatgctatctaggttggtcataacttttctttcaaggagtaagcattttttaatttcatggctgcagtcaccatctgcagtgattttagagcccagaaaaataaagtctgacactgtttccccatctatttcccatgaagtgatgggacctaacttagttctaatcaactcatctgattaccatctgattagtccaggtgactgtggcaaatcacttaaccaaccgtgttccactttcctcaatctaacttggagatactagtaaactccaccttaggaggctgttttgaataaacagaaagatggttggaaggacttagtcggcgcagaataaatgcatctaccatgctaattactttttattattattgtccaagatcacaaagagagcaggcagtagacctgcctagaacccatgacagtggctacaagtgcatgttttcactctatactaagctgccttttagatattttcgttaacttccaggaaagcagtagaccctgcatacgtcatgcaaaaggattgcagaagctgagggcaacaaagaggaagacagggtgctgggcccagggacaccagaagcaggagccaccaaccagaactgcccagtctataagctgcatccctctgagggaaggcaacacagccaggattgtaaccaactgtcaaccagggccagaggccagccaacactactcacaggtgacaatggccaatcactgtaactgtattctgagcctgtggtttcagtgtctgacaataagccaaatttaagttatactagaattttaatttttcttaggggaaagttatatatgagatactttctagatacaaaagtaagagaaaccaaaatgtgcaatgtagggaatcagacagaagcatttcatctgggatggactcctcccacaaaagcaaatacttcttatggacttctacagaaaataatctgaaaaggaaacaacatgttaaaaatcatgtaatatattccaaaggtaaacaaacatttctaaaatcacttactgccaattcatgtatatggattccaggaggttaagtaaatcatgaaggaaaaacctccaagactaacccacttatttagccttaatggaattgggtttccttcaatattgttttaagtaagtggatttttggttggggtctagaaattgtgtggttatagggatatttttgttgtaatggtgtttgttacagtcagatttgatttgtacatctcccaaaacaaatgttatgacaaccagaaaaaaatttgggaatctaggccaaacaaaactaggtctttaaaaatttcacttcttgtaagatgcaaagactgtacaattctctgtcatatttattctgaatatcagtgatgcatcctctacatttttgagagccaaaggcacataatttatagcagggtttctgaaactatgcccttttcactgggttgtggcat

SEQ ID NO: 43916 - DNA, 3403 bp, Bovine  19866880407582
tggaaggaatgctcatctctccacctccatattatatagtaaaatacttttctgtgatagcaaaatatagaaacaacagcttaaaaactgaaagagaaaccactataaatctgccattttcttaattatgcctttcaataaaaattaagggaaagaatgtaaataacatagttattaaataggatttgttttgtcatatgtcctgggttgagcaaattcttttataaaatgccacaataatcaagatctgctttctgggagctcacacttacagagtacctaagccagaaacaggccaacacaaaagaagtacagcagttaaacactatctataaacagaagagggaataggggttataagcaggaaagcagtatgagcaagtcattgattattgcatttttatttttaaaaaagcataaggttatctaccttttaagatttcagtaacgaaatatcagtaaggttattaaaggatacagaactaatgaatgaaaaatgggtttcaactcaaagaggagaccttcaaaatgaaactattagctggggtaggaagtgtattggcctcccaaagatgtccatgcccagaactcatgtatgttactttatgtttcaaaggggacattgcttaaataaagtttaataatcttgacatggggaaattatactgtgttatctccttgggtgcagtataatcacaagagtcgatataagaagaaaaaaaaaaggaagggggaggaggaaggaggagagtctgataaggagatgtgacaactgaaacagaggagggagtgacaaggccataagccaaggaatgtgggcagcctctggaaactggaaaagacaaggaaagagattccccccagaacctccaagaggagtgcagccttgccagcacattgtggacttctgacctccaaaattataataaatctgtgttgtttcaagccactaaatatgtggcaatttgctacgaaagtggtaggaaacagcacattgaatctggggttaggagggagttactttttagagaaaattcacaaagaatcagactcaattctccagataaatgctttctcagttcagaaacggttgttctagatgaatctgtaattttattatttttttctaatagctttgtgtgccaccttcatactaagagaaagagaagaagaactatcctttctcatacttcccctaggtaccagtcagaatgatattttttcttattgtttcaattaatccttataaaggctctaaaatggaagtacagagttctatttacaagtgaggtaactgattctcagagaaaataaactcaacacattttaagttggtgatagaaaaatgcactcatgagacagagatcagaatgttggtaactcatattctcttccagagaggaaatatagaagggacaggattagataaataaaaagatagataaataaaaaagttttggatcaagtcacacagaattttacaaacagaaattagtgtggccaaaagtttgcaaagttttgtctagaaagttattagggaaaggaaaaaaaaaaagccttttggacactttacctaacctcctggttttcttctctataaaggaaagataacaatagacgtctctctcataaagaatcccaaggaacagaactgaatactgtgacactgaagagccctttaaatgttgattcaatactctgtggtctacttatgatccccaaaccaatttgtgactcattcaacactaagaagttatctgttctgaaggagaaaaagagacattgtaaatcaggtggcaatcagtgattccaaacggaattgaacatattctttgtccaaatgaacagaagatgttggtatgaattgtgtactctccatgagaggtagatacagccaaagctggttaccagggggtgagcacaatgcaacagcagctcccaagtcatcttggatgagtgtctcgagttaggtcatcaagctgaatgaggtcacctacatagagtttagacaactgcaaagtagaaaaatatgacccaagactggcttaagacctcaacacagctacagagccaatggcagctggaaactcttaagggctaaatgcaatggcgagagtaattttgacatcaaaggcatcagtttgacaaatgaaaatcaaattggatgaactttaatgcaaacagctgggtgtgatgcaacttaaagaggcagatttcctggagtcagccaagcagatttattagaatcctccatacctcccaaggagaatgtaaatacagagtttttaattttcaagtttttccactccaaacaatggaagggagagcatggtaagataaatagtctgcaccactgcattccttggaatgatttagtggctatgcttgctctatctgtgccaagaccttttctctggtctgtccacattttcctcccttcctttctcccatctttccttctaatgtgtagtacattttaccttcaggtaatacattggaatgtggagtgattgattcagagagtatttttatgctaaaggatgcctgttattggaagctcctctgaacgaataggtcaggactccatgacacttggcatgagtgagcatgatagataaatttgcttcccaacatgtgtttgacaaccagccatactattaaatacatgaaagtgcaatgtggatatacatcagctgtggtttggaccaaagtgtaggtagctcaccagttgatggagaaattaaactcatgattaagtggaggaaagagaaaaagtttaccatcagccagtgaggtgtgctctaaggaatggcattaaggacctctgtctgttctgctctgaattagtgagcgacccttattctgttattagtggttacttatttgagtcagaatgcgaatatcagtacaaaggattcaagtttctggaaaaggaaatactattgcaagccttattgctctaatttctctgctataaaagaatagaagctcttgaagatggaaacacttgaccatgaagcatagaagcttcttgatattgctcattattgtgtccccagaaatttaacaaacgataggacgcctactaagtgcacaacacatatttaatatgttaatgagcaacataagttagaaatctgtaaacagggcttggcatgataacactttacaggagggatgagacatctatttcattaagtcatcattatccatttaacttatgtcacaggatgtgcagagcaaattcaaagccgtaaaattgaaactcaggattaatatgggggttcaaacaaacaaagagaaagcagaaaaaaaaatcctctaatgtgtggtaccatttaaagagcctgtttgcctcatttcataacctatgcaatatgtctaagcagcatgtaagagattt

SEQ ID NO: 43917 - DNA, 938 bp, Bovine  19866880429790
ttggtaaagaatccatctgccaatgaaaaagacacaagagacatgggttcagtccttaggttgggatgatcccttggagaagaaaatggcaacccactccaggactcttgcctgggaaatccaacggatagaggaacctagcaggctatagtccacaggtttgcagagtcggacacgactgagcatgcacacaggcactgtatgttgtagcacgtaccaataccttacttattttcatggcagaataacattttatggcatagatatgtcccactctgaatatccattcagcagttagtggacattgggctgtttccactgtttggctactatgaagaatgctactatgaatgtttgtgtacaagattttgtgtagacgtgttttcatttctctttggtctatacccagaagtgaaattgctggatcctgttgtaactctatgcttaagcttttgaaaattgcagttttctaaagtggcagaatcatttttcacccccaccagcagtgtaggagagttccaatttctccacttcctcacctacatttgttgttatctgactttctgatgatagccatcacagtaggtgtgaaatagtatctcattttggtttctatttgcatttccctgatggttaatcctaggctttcgttgaagtgcatcttaaaatatttattacagttattcaattcaatgttaaagcccttgctcttaaagcaattaaaatatcaatgagaaaaaaaagtggacattaatgcactaagctgatatgaacatgtgagcatatacgtatgtacatgtttgtatatcttgcatgcacacatttctttacatgtaaacatttatgtctccgaactatgaaaacatgggctctcaagttaaattgcttgaggtcaaatccaggcactgccacacagtacctggatgacccagagcgag

SEQ ID NO: 43918 - DNA, 1682 bp, Bovine  19866880457875
tcactggcctgcctgtgaaggtatgtatttatcatacgaaggcagggaatggttatgtcactggcctcagaataactaggctggcttcccaagggctgctaccagcaaatcctggtcaatgccatttacgtactacttcctaagtacatatgtgcggagaacttactacactctgattaagaaagcttttgagtttaggtattgatgctcatactaacaacaaagtacacaactgtaaatgcaaaattaagtaattcaaagtgtgcagttcctatttgtcaatgttgacatttctatgggtatgcagatacccttccaaattacaaagatttttgaagggtaaaatagatatattttattttctatcatttaatggcttcggggaaaaactctacttcctctttattattaaaaaaaaataaggaataaagaagcattcaaagtgatagcacaggtggtttcaagggaagattttagtttctgtatgcataacttcattaaaagctccaagagatgtaactgcatatgctctaaaacattcaactactgtaaaatacaacgaattgacagcatctgtacttgagaacttcctttgctttctaatctatacaaaatataaatggcatgtataacacaattatccacaatacagcagcatatttacattgtgcatgatccaaaagttatcaagcaatttcatactttactcatttcctgccacagttgcctgtttttcttgtttccttactatacaaatttcaggtatccttagcacacctcattatggtattacacaagcacatccaaatcattaggccctagaatacttttcctctttccctataacttctctataaagacacagaggaggcaggtaagacagatgtaaaacccaaggagaataacttgctatactggaaaccaagatgtcattaaactaagaaacaaaacaaacaaaaaacaattcattctggtgaagaaaaatgctcttaaacgttttaataaagagttttgtaggctggaactgtttcccaaaatgtgtatttccttataaatagattttttccccatcattacctatcttacagccaaagcttaactcaagaaaagcagttattctttttcacatggcaaagacataataaaaagagcaacacaagccagatcttataattcaatcttggtctataaatcttgattctgatagagaaataggaccaattttttcaaaaatctcaaatgcacaactgaaagaatctaaaaatgcagttcaccactatttggtgaagcccatcaaatcatcttggtaaacctcaaagaatccactactaggtttattcaaattgtttatagcctgatggcaagtcattccttcatctgtaactttgagtcctaccttgatggagtctctgtctataggcaaaacagcagcaacaagggcaggtcaagaggggagaagaaggcaaaaaagaaaagtaccagttagtttacataaaatcacacacttgtcaaatttgatctctactaaataataaataacacagatgtcaacttttctgtaaagttaattaattaaaattaattactactcgaccagatccacagagcaccaagctacctttgacataatttcagaaaccaaagctggatattcttggtatttatactccttattgactttt

SEQ ID NO: 43919 - DNA, 3657 bp, Bovine  19866880489846
tcctccccttggtgatgatctggtgataattttttccagaggcagtagtcctagaggctctgaaacacagaaactctgtcaccctcagtcaccacaataaccaaagacccctggtgattctcactggacatgtagccatgagagaaaaatacactttgttttattaagccaattggagatagtttgttagccagattaacttaatggaactcatcaggcagatagagttctcatagtttcttttcaggaaaaatttttttttccttttttttttttttttttttaggaaaaaaaaattttttttccatttacttttatttcatcatgaaaagttcatgcttataaattatatacagaccacatttgtctgattttttaaatacacccatgtaactacaaccccaattcagaaatagagcattactagaacttccagatttcattgactcactgattcacctccactgattgctcctccctttcccccaaaaatgataattatcttattttctgttaataaattcatttgcatttcataataattttatctcacatgtacactgcttagttttgcacatcacttcactttattcgaatgaaatagtattgtatgtattctcctagaacttgttttacctaattttatgcttttaagattcaatccatgatgacacagttatattttattctttctttttttctgctgcaattgtatgaatttcaggatgaattgtaacatgaatttatcccttctcctagtagctgaccacttgagtttcatgttgggaatttttgccattagaaactacagtaggacttccctggtggtccagtggtgaagattccacctgccaaggcagaggacatgggtttgatccctggtccaggaagattccacatacccccaggcaactaatcctgtgtgccgcaacactgaaacctgcctgcccgagagccctgctctgcaacaagagaagccatcacagtgagaaacccatgtaccacaactagacaggagctgtcactcgctgccactcaagaaagcccatgtgcagcaatgaagaccagcacagccaaaaccaaataaacaaaccacactaataagaatattcttgtgtatagcctagcatacatatgtaagcatctctgtaaggtgtacacctgggaacagaaacgctgagttatattcacatgctttactgcataggatcaaactgttttccaaagccgctgtaccagttcacacttaccaccagcttgtaggagagttctctttgcctcacatccttaccgacacttggtactgtcagcctttctcttcatttgccccttctggtgggtgtaaaatagtatcttattgtggttttagtttgcaatttctttagggtatactttcatcacatgtgaattcaagaaaccaaagtgagaaaccattgaaaatgatttgccacagttattcctaacaactggataaacttcacaaaccagactcctttgtacaggagaggtcaaataattgaaaaaggcacaattattcattttggggcttagaaaataccaaagggcttatgctactgttggtggtgtaggttaaacaactatttcacaaatggctccttttagaaggttaacggtattatctaaggccaggaggaaagcaaatacatttcaaggaaattataaacatttcttttatcttaccagataaagagattcagtataaatcctaatgcacccacttggctgtacacaatttataggagatgaagagtttgaaacactttcatgtaaacaatcacagattttattttttttttgaaggttgctaaaaggctctttgacactctttgtaagtggggagcatctcagagtaagaactggttctggataatatctgaattcatttcccactagcaaagcagctccattaagcactgctttcatttctgaaacctttacttttatgtaatgtttacatcattgacaccttctgttatagaatctctaatataaacaagggatgtaataagccctaatgtattttaatgaaattttaagagatatggctatgggatgaggataaccaaacaggagtagagattaaagcaaacgttttattaaacacctcaatttgtgtgacaatgacaactctaaaatcaagtccaggaaagaatcactcttcctgtgtttgttcatccattacaattcgatgaactccaaatgtgatctgactagccaaattctgtaacacagaaattcagcagaaaattagaaattcagccctattggaagagagatacaaaaataaatgtactttacttcataacatctacatgctcatgtcaactttgagttttatgaatcacaacagtaatactatatgaaaagcaagtctttgtaactcaccatcctaatgtagcaacctgagaaggtgatccacccatgaacaaactttacctgatatggttcagctaacatgggttatttgaaagtgtgcttagcattgatacctgtaagaccaagttaaatagaaggggtggttcctgattaactctgatatctatgtctttattctctacaaggctcactggtgttctgtggggaagatgcaagagttccaggcatcagcagtgataattctggcctgaggaatacgagtggactagagagctgtggcttacataagtgttactcaatgtgtggtccacaaactggtaccatcccatgaacaaactgctaacaatcgccaataaaaaaaaaaggtcaacagaacaagttgagaactaagtgtttaaaacctatatagcaaaggatatcgcgaaacagcccagggaatgattactgaatttgtcttgatgtctatgatgtgttacaaaagaattcagttcagttcagtctctcagtcgtgtccgactctttgtgaccccatagactgcagcataccaggccttcctgtccatcaccaactcctggagttcactcgaattcatatccattgaattggtgatgccatccagccatctcatcctctgccatccccttctcctcctgccttcaatctttcccagcatcagggtcttttcaaatgagtcagctcttcacgtcaggtggccaaagtattggggtttcagcttcaatatcagtccttccaatggatattcaggactgagttcctttaggatggactggttggatctccttgctgtttaagacacttccaagagccttctccaacaccacagttcaaaagcatcaattcttcagtgctcagctttctttatagtccaactctcacatcctcacaagactactggaaagaacatagccttgactagatggacctttgttggcaaagtaatgtctctgctttttaatatgctgtctaggttggtcataaattttcttccaaggagtaaacgtcttttaatttcatggctgcagtcaccatctgcagagatatcggagaccccaaaaaataaagtctgtcactgtttccactgtttccccatctatttcccatgaagtgatgagaccagatgccatgatcttagttttctgaatgttgttttaagttaatgttttcactctcctctttcacttttatcaggaggctctttagttcttcttcactttctgccataaaggttgtgtcatctg

SEQ ID NO: 43920 - DNA, 1216 bp, Bovine  19866880522102
tatatagggaaatgaataaaaatgtcctagtaaatctgggcattattgggtttattggactgccctgaaaaaataacctgtagagaaaattgaaatgatcacttctgtttataccacagctatctggacctgaaaggtctctgacttattccacatccttgtaccagccccagtccctgctgcagggattagaaccaaaccatattggactagtcagaatgagactcctgaatcggacgtttaggctggaatctgttttgataataaagtctgatagtaacctagtcagaccttatttagagaaattttaaattgagctggtgacagttctgtccttgggagaagagagccaactgtgactaaacagaggcacattgaggaagcagtactttggtactgctggagttgcagttactcccccgctcctgacaggagtgtcttcagttcttgcccgcactgcgcaccctccacagactgtgtgtgttcccttcctcctgtcagtggcagatgctcccttgtaaactgttttgctcaccttcatcattttcagttccttctctacctatttttctcctacccttttttcctcagtctccattctcccttaggggtcagccctctttcctggggatgaaggaagactattactataaaatgtctcatgctggctgtggtctgttatgtataacatgtgaagtgagaaattttgttcataaatgtcttagacaaaactctgcttcgtgctagtccatttgatttgcttgatggtcattaatattgaggggcatataagtaggaagaactccttgtcaatttgtatgttttcctttggctattaaaaaggaacaactgtacctctgtagctgagagattttcctgatttcctgttagacagctaaacaaagattattattttaatggtttctgatttcacaaccttttggtcttgacagatgaacttgaaaattgagcagtgccttctaaattatttaaagtaagctagtaggttgtcagtttggcagctagagggcaaataggcctgcattgggtcattgggatgcatagtaaaattaggtatagtcccgcccctcaagatgttttcctgctgaagtatgcaacttgggatatgctgccttctgagtagaaaaagatgcattaatgaatcgttcctcttcatttctttgagcttccagttagtcccagattcccttaaaat

SEQ ID NO: 43921 - DNA, 1730 bp, Bovine  19866880526428
agaaactaggacttgagcaagagagataaaatgtctcccttttaactagtgaggtttagggagtgcagatatatggtcttgctttcactcccctgagctgaacatacactccaaactgaaggtctcccttgtgggtggtagatcctgccccactcaacttacctcaaagaataaatagtgcagacaaatggaaatgtgtcttctctgtaagcaggcaaatcacaaagaggaagagaaaaggcaaggaactggcttaataactctcaactattccttagctaacattattctaactctccctggatcaagatttctcacacttgacatgattgatattttggatcagataattctgtgttgtaaggggctgtcctaggaggatcctgacctctatccactaggtgccagttgcatccttcctgcccctggttgtgactcatgtctccagatgttgccaaggcaaaatcatccctggttgaagaatcaccactccagagtaaaagggagagggcagaaatgtattattttgatagggcttccacttggagggaacattggggtgggaaagtttacagtagctctcatgaaatgagtaaaacaaaacaaaacatacaaaaaatcagcacacaaactcaatgtgtttctttgtgtaaaaatcgtctctcccccatacccaaccattagtactggtatggaagtgaagaagggtaagaaagcattcaacatttaaatatgctcatttatatgcctgacagtcttaacaagtctcagggttgtagtacttttaaaaaaagaagaaagagagaaaaagaggaagagagagagacagaaaaaaagaaacagaaaaataataggttcttggaattctaggaaaataaatcagtgcaatacctatttatcagtgacttaagtaaataagataggtcagaggtcattaactccatatggaaaccaggaaattggattcatgaaactgttcagaaaaatgtgccagccactgtcaagattactataatctaaattttgaagtttgaaagagaggttaatttgatatgaagttgtggtcaagaaatgtgtgactctcaacagaaaatgcctgtactaaaatttctgaattcacaaatttggggattccaaaggtctcggtctgtatccctcatgaatgtcaagtatctactctaattacatataattacatatattttcatcaatttatcagttaggtctgcaacactgctgttgtttccccttcacctttattcatgttgctttttaatcagatttcaaagcatttcactaagatcatgtctgattaaaacctaataaaactagtatcaggaaaacgtctgggataaaagagataccatataatcccagttgtcaacaacgcgttttttaaagtcagcaaattactccgaggtctgttcctcctagcaacttctgaagaatctggaaacctcagcctaagggaagacttttgttcttttaggggaaacactggtgttgtctgtaggtatgccactggaagaaaaatgaatgctgaaagcctccattactttttctctttagtttataaactcctgatgcttcattctccagactttctcactgtttgggatgggcaccatagagtcagtaaaaataataattataccttgtattttcaatgtagtattaacttttcaaagtgtgtttttgtatctatttgagcttccagacaccagggaaag

SEQ ID NO: 43922 - DNA, 1472 bp, Bovine  19866880535597
accattgaataaaagcaacctcccttgggtagcagtcacagctttcatcattcttcttcatcagttttgcactgtggactcaattttcaactccagccctatgtacaggacactgtttgtctgcacaccctgcagtgatttcatccatagccatctctgtctgtgtggaccccacaacctgacaatctgtgacgttagcccctatgtgcttctgccacctttcttttccacaggatttccatcatgtattttaatatctgtcttcttattttatgtatgtcttttcattggaggtgggtgagcacttaaagcaggaagtcacaatgacattttcaccaagtttgtaaacaggatttctagttgaaaattaaaatctattgccctctgagaagatagtaaactccaggagttggtgatggacagggaggcctggcatgctgcagtccatggggtcgcaaagagtcagacatgactgagcgactgaactgaagtgactgagaagatagatggatagacaggatgtaggggaaacatttatggtagtttgacttataagacgtactaaaaagttgagtttggaccagagagaacagctctgatctaactaaatgaagcttttactgaaaagggtgattaatattagtaaatacaatcaatatgtaaaagttgccagaattctgccaggaaaaaaacaatttgtaatgactaacttgagtgcacaagacattgtaaactgattgaaaggaccaagttaattatgtatttcaaaacaaatttttcttatttgttttgaaaattttactctatttaacatcatataagatgataattatcatcatctgtatagcatactcaaatgttgtcttgatgtaacagggagaatctacaatctgaaattatcttcatagattcaatttacacattacagtttctaactattaagctactgactcagaataatgctaccttagcaaatttaatggaaagtgcttattggacttgtaaatcttaagtctcaaaaatcttaattaagaattacctttgtcctaaaacaataagaatagttgattcgcattaattttggtgttactcacaaatgttgtctataacaaatataacttcttccaacaacaaagaaatgaattaaattctctaattttaaacacaaaggtgtgtttccaattttatccaaatccgatctcctctcctaagtagaaatcttcttttctctagcttggtgatattgtgtttgaaggacgtttttaaagagcacatcatattatcctttgaggatattagtctatcagatattcaacctgggattaaacagccctgaaccttcatcttaatttcttcctttacattcagatatgtcccacaccatttaagagacagctttaaatgctgctgctgttgctactggtggttttagctcagctgtttcagtttgatggcagcacactaaattaact

SEQ ID NO: 43923 - DNA, 2925 bp, Bovine  19866880577221
aagtaggtatgttagggaagaaacatatgtgttactcctactattatcctgtgaatcaatttcttatgaagacatggatggtgtgatctgcatgtgtacctgaatgatgccaagaaggctgttggtctgagagctccagaaacatcctctgactgctactgaaatatccaaatggttatggatggtgtattaacatgattgataaggatttttttttaataagtcttttcctatcatacatgggattaatggaggaaatttcatgtgtgggacatgataggattttagactttataacggtcaggatcatattcagaggtagctgagaaattactgaagacagtgatatagtgactgcagggtggagagtatttggaaatcatgggtctagctttgaaaatctggttttgttggtattgggtgatttggagccttgctttatacagaaagttcccaggaagccaactagtaaaatctgtgacattatatcatgtagcttttgctggataacagaccaccccaaaacttaaatgcttaagacaacaatatccaattatttgactcatgatttgtgggtcagaaatttggcctgggctccactggacaattcttctgctcttggggctaggatctgtcatatctatgattagctgtttccagtgatcttccaagaatgagcagataccaattagctgctgggttagctgagtctgtccacctgggaggtgagcagggtcattagctatgacagttaactcctctacatgatttctcatcctctagcagagtaacacaggtttgttcacaaggcatgtgggcaagtgtccaggagaagaacagaaatgtgaaaggcttcttaaggtctggcctcaggccatgtgtctttcaccagagaaaatcacaagatcagcccaaattcatggggtgtgaagctagacaccacctcaagccattgtaaggattttgacgttgagaggggaccattgcaccattgcaccttgacgttgagaggggaccattcactatcctgtgaatagtctaccaaaatctccttcaggtgattgaagcttagtcgggttgggtatacctgggctcttttccaggtctattaagaaggccaccacccttttgagctaacttttttccagtgatcttccaggaatgaagagataccaatggtccaacattgatctgttaccaaaaccaaatatgtgtgtcgaagccttgtcctggaaggtaatttggcttaaaggtaatatggcttagatatttggaacaatcaagagttttaagataggtcaggaaattgaaagggttaacaacagtagttaaactgtagctgaagctatctagtatatttggccagtggaggtgagttgggccagttggaatatatttagaaatgaattagactggatattgccctgcatgattctctcttgaatctgtatgaaatgcttcttgctcattttttttttaatatttaattttgcctgtaagataactaaaataaatagcagcgaagtgtaatatttcgaaataatcccatagttttcaagtgctcttgaagtagaaagccacagggctgtatgtgcttttctccactgatttaacacttattgtgtatgctgcctagaatggttccctttaattgatacttggcttgatatccttttaaattattaaagattggagacactcattaaatgagagattaaaagacatggtagacacagctaattattaaaggcccgagaagggacacaaaatgcattttatctaagactttaatggattataaaagtaaatgaatggtttagtgataaaccagtaggagttaatcaattgaacaaaactatagggaagctatttgagtctagatttgaagggtttataagtaatcatagttagagacttaccagctgttccctatttctttactttgagctgctaattggtcaggaaattgggtccaagctcatcatccaagttaaagatgactagaggaaggcagcttatatgtctttgtgggggaaggtttgcattgctaaacattagcaagtcagagtggagtgaattctttcatggcacattgtgatttaaactctgtcatgaatctccatagaggcaaagctctaaggaggcactgttttttacttcctcatttctgaacttttcaacctctcaactggtcctttaacttccagatcacgggcagtgtattatttttgcctgcttactaagagggaacgttgattgttgacatagccactgctcgccagtgagattagtaacacgatgcggagattttcagcacttaaaagtcattggttcaacatggctcagataggtaatgacttaaagttattctgacttgacagctgtttagaggctcatttgaagcgaactctttcttggttcgcctccagacaggggacatgttgctgctggggattgcaaaatgtcatctctgttggaatcttactgagcagtaaggctcagtgttgagtcatcatcatgaaggctaaaataacatgttccctagaatcaagaacatttggctggattttgtgtaaaggttttgagccctgtagaaaaataatatcgagttagtttttccccagagtcaaactcactctactcacaagtttaataccattaactagtttaagacaccagggcaacttttaacacattgctaacaatcagtgaaaacttcagacaagatgtgtttaatgtcctttcatggcccgtcaacaattagccacatctaccgtgctttctaatcacttatttaatgaacatctccgattagaaataagtgtctgccagccacttaagcagtgatttaggcactagagaaggtatggttcagagggttttaaatcacagaggactcagtcatttccagctttacaaaattca

SEQ ID NO: 43924 - DNA, 1703 bp, Bovine  19866880600108
gcaccctcattagaaggtgagaatggagatttgctcatctctccattggaaattgcactggagccatgctctgtgatgaaaagcaggtaggtggattagaacaaacccctgcacatggagtagaaagcacttggctgtagttttctcttcctcatgggagttaaatgacctcatgggagataaatataacatatttatctttctcttcccttccttactgctggccgtgatcttctattttaatgttatttttaagtagatctaatatctaattatttacccatttcttttttattgtaaggtaaaaagggaagaatactgtaaaggtattataagatgttgaaagataattttctctaaattattgcaaatccgttatgaaatggaacaggttgtgtatacgttaagccaagagcaatagcaacaacaaggcacaattcagtacttgtgcctttgtacaggtcacctaattctttgcactctagttttctgtgctgttaaggatgggtgataactgtgtatgaagtccacaggtcgttaagagggctaagtaagatgaagggaaaaatttaaaaagctgtcaaacacctttcaaacatattattattattataagtatttgttgagtcatattgcacagggatgatgagatgaatttaataagaacataaatcatgtgatattgctatggtgtagacacactggtaaatattaatgttggagaaacaatttgcatttaacatactggaataaaaatcatagccaataccaccaaagacactcggagtgggcagagatctttgaggttgtctgactgttttcaaactgcatcttgcagagcctggttttaggtgttaagttatggctggtaaaggggaaaaggtgaggcccactgctctgagtcctggcccctgccctattgccagaacattttccactagtgttaattaccagatagaagtcctggtaagatttcatttgaaataatgttcaaccactcttctttataccaggattcagagggtactgagattttcccgggaccatgaacttaaccactagaagatcagaccctgagtcagttctccagcccatgaaccactctttacatcatacatcaactttccaaaggctcagatctagagttcttggttgcagagcaaccattggccacacaagctaggtgctgaactgtttccctatgcactttggtaaaaacagaatactttaagaggaagaagattatctttctaagttaaacagaacatggtacaaatgatgagtattcagagcagttcctggtgggagcacatgggttcacaagtggaactccatcagtttcatacaagggattttcctgggactcagttctagatagctgccactcacaaccaaaagaaactagatttgccaaaattgattggatgtaacatgaattatttgattcattcacattatttgtttgggatcctggcttaacatggaagagagaagcttgtacagaagtaaaatgaccaagaagtggcccttgttcatgagaggactaaaaggccttcaagagttttgtccaggaagtactcttacttatcagtaaagataaactcactcaacttgccatgaatcagatctcttttctgatctgagttcataataatcttccagttaaggcaagtctgatactgggattaccaagcctaaaagtg

SEQ ID NO: 43925 - DNA, 1376 bp, Bovine  19866880605683
aaataaactaaacgcagccctgtaccagacacagcctccaaatctgcagacaaactgaggaattttctttctttcagctgtgaattcaaaaggctatttgaaaactgaatttttttttaacactatgttataaggaaataactggtgaggaaaaaggaagacacatcacataaaaatgcaattaactacacagccacaaaagacggggctacaggaagattatcctgacttgcaggcagtttcattttttgcatttgtgatttgtggtgtgactcaagacagacttttataaatgacagataactttttagttaggaagggaaaattattgcagtcatatatagcttggtaattcaaacaaagctaccaacaaaatcacatccaagccaaaaactaaatttaccataaaccacagatgacaaaaccatctctgtaaccccaatgtgtgtatcttcatcttcactgagatacgtttcactacatttccccatgtccttcccccatccttacaaaaagactcacaaaacaaacatccatcaccaagtcagtgagcccactctgttccaaagtacctttgtcaattaaacttgaatactgaaaatatacatatacttagtgatcaaagtcctatggaaaaatgaagaaaaataaaattttagaattaaaactaatcatctggaaacaggcaacgcaaagaaagaccgtgaaagtgaggaaagtgtcagtcacttggacgtatctaagtctttgcaaccccacaggctgtagcccaccaggctcctctgtccatgggattctccaggcaagaatactgcagtgggttgccatgtgctcctgggactcttccagaccgagggatcaaacccatgtctcttatgtctcctgcattggcaggtaggttctttaccactagctgcctcctgggaaaccccccccaaaaatgaacaactgcttacaaggctaagttctttggatttggaggaaggagtactgctggaggatgcaatcgaagctggactgattggggcatctttcttgagcaggcgtgtcttgtccaggccgttctctctcggggaatgtgctgggctccctcgaggtgatgatggatcctacaaagaaacatcaagggtatcaaatagagcacagcacattcacaatgcgagagtacttggtgtggacgtttcaagccagaagtcttcaatagcttaggagcaaaaaatgttctggaacagactgttaagactcttcaaattgctgtagaaaatattcagtatcgaggtcaataaaaatactacaaaatttatcatatttattttaaaacagcaacaaaaaaaaaactctacaaatttgcaagtaacttgtcaaggagacctgta

SEQ ID NO: 43926 - DNA, 1270 bp, Bovine  19866880639637
actctgcaatgagaagccattctaatgagaagcccgaccaccactacaaagaagcccccactcaccacaactggaggaaaaaacccacacagcaatgaagacccagcatgctgctgctgctaagtcgcttcagtcatgtccgactctgtgcgaccccatagacggaagcccaccaggctctcccatccctgggattctccaggcaagaacactggagtgggttgccatttccttctccaatgcatgaaaatgaaaagtgaaagggaagtctctcagttgtgtctgactcttagcgactccatggaatgcagcctaccaggctccgccatccatgggattttccaggcaagagtactggagtggggtgccattgccttctccgcccagcatagccatagataaataaaagtattgaaaaaaaaaaagtagcaatagtctagacccatcaaaatgcaacacgttccccaccatctgtcactggtgattaacaagcctggacactttaactttgtggtctcagaaggtaacaccttttggatatttatatttggcaccttctgtgcttttaggagaatgtgagttaccactgggcatcctcagagtgttatgctctttaagactttcccaggttatcaccttctactctcttgaggactggcactatggtgacattctcctgaatttttagagcttcctctttcactgtttgaaatctttgccaatgtgctaacagcctacacacactgggtctcataaccacagcaggcaatgccttctggaaatagacacggattataactgacattggtattgacccagatgttaagccatacttataaaagaggggaaagacttgatctctggtactgaaaatcaacagtgactactgccgaagctgttcaagtaactttttgacaactcacctgagtttctctgctgcactttctagaacaccagccaatccaagttctcttcaaaatgaacaaagccttgcacttaggaaattaactgcctctggatgcagtagtcaccttctctgcctctgtgaatatttaggaagagcaacccagcagttcctgggcctcttcaagacctccatcagcatcattgccacagagatgcagaggctttctgcaaggcaattccattgctaagtcaattatcacaggatgtggcaggcttttagagagattaaactgccctttctacgaaagaaaatgagaattctcaaatgggacccctctaataacccattgctcagctacagtat

SEQ ID NO: 43927 - DNA, 1446 bp, Bovine  19866880652290
cccaagaaataaagtgacattttcctacaagcccatgacatctaaaatgatgcaggaaggagctagcattcagaccttggtcttttgactttaaatatgatgtactttcccccaaaccaatgttgccctttgcactcttgctgaaacctcttacagtcacttctcatggagaacaaaattagtcaaccttgtttgttatcagcagatacagcagaaagcaccctgatctgatctcatggtctatttgtaatttgaatagagaaacaaggaagttgggagttttctgcctcctgctaaaagtggatgaggccctacttctgatgcagatgtacattttgaagattccagtgctctctttaaaatcatctgttccaatttgaagctccaaaaattgcaaactctgactctcaagtcatactgaacttgctttcgactaacattctgactctgaagctatttcacttcatttaaccacatttcctgggttgaaatgactagcttttgaaccacttttctcatgtaagaggtctgaaaaaatgtaagcaaccacgtttgttttgctgagaaccagtagaacaaccatggcagtgtttgttctctgatcctggacttagaaaaaggtgtctcagtctgtcactaattttgtgttttctataaaacttctcttggcaaaggattacatgctagtttgttttgttcctttttaagtccaacagactttctccctctgagccacattacttctcagctgactctagggcaacccatcccgttagaacacccagcccgcttctcagtgtgagagcagccatggcatgccagcgatgtcatgataataatttacagctgaggctgttgcatccccagctcttttcatgtgactgtgtgtacaagtaaaatatgcccagaaacaagggaaatatgttcaattattttattgcattattttacaatgtacatcatgtctccccaggcactgaaaaacaccccaagtaaaacgcaagtaaagataaatcctgggatcatcaaaacagggaccaaaccaaaaatgtgcctttggtttatggtgaaataggttcaagtggaagtttatcatcattttcatcttaggcctgtgtcttttatattatattcaaattaattacacatggaaatatttctataatgagatatgggtatgatttcctgagaacaaagcttggtggaaaaccagaaatttctttggggaggcatttgatgcaaaattatgccacctttaatttggttataaacctggaatctaacaacaacaatgaactactgcatgtggtaatcatcagcgtcaatcttgttttctctgagagagaaaggaaagaagaaagaaagggggagagggaggagaaaagaaataattaaggtaatgatataaaggtcaaattttaaaattgttagaagtcccaggaaatt

SEQ ID NO: 43928 - DNA, 1682 bp, Bovine  19866880681994
ttgcattattatgctttataaaactacaaacttagaaacattaaacacagatcttttttccttacagttggatcatgtaaatatactagcaaatttgttaagaacaaagagtcacactgtgaaagcagcggccaatttggagaggacaaactatcttaaatgtgaatggttagtaaaaacttctaaaaagtaaaactaataacctagaattaaaaaacagaaatttaattttaaaaagtaaacacatattggtatattgaaaaaaagaaggtaatgtctaataaaagctaaagaggacagaaacaaagtgaaaataaaaaaaataataaaatatatgaatcctattatatggaaatcctaactgctttggtaataaaagagaagctttaaagtcagttattcctaacattataaatcacagtacctcaaattgagaaaaaattctagatcctagtctgaaacccagcctggactttactaaggctattgatcaagtcagttgcaaaaccactactctaactgtagttctttcagtgcaggaattagtttgggtcagggacactcagggggaatctgtctatgatggtgggggtagggaggatagagaagacaggtttaaagccaggtaagaccctttactgatgtcataaccaaagccctctagcaattgaaaagggtggccccatctcttcatcatgactcttctgtcacctcaagatcaaagatgaccaagtatgagaaagagttctataaagtattcctccacccccaaagaggtggtggtgttataatcaactaattataataacaggtagcacagattttaccagcaaacaagagtgtctctctggagtcagactgcctgggttaaaaatcttctacttaatagccctgtagcctcggggatgttgttcagcctcagtctatagtcaacaacaccccacccactttctcaaccagggtgctctgaagaataagtgaaagaagccacataaagaataaggcacagtccctggcaaataactgagcctccacattatttactgcagagttagtgtggatcttctatttgaagcctcacataatgactattctaagcatttgggtacagcttccaagggagtgcagtggtgaaatatccacttgccaactgtaggagatgaaagagatgtgggtttcatccctgggtcgggaagatcccctggagtatggaaatgggaacctgctgcagcattcttgcctggaaaatcaaatgagcagaggagcctggtgggatacagtccgtggggtcacaaagagtcagacaaagtacccagacacacaacaaaaagcatttgggtagcactgtctcttagcatagatatgcagatggcccataatgatagggttccaataggctgctattaactaaaacacatctcctttcaacaatcacaataaggttttggtgtaatacttcaggcaagattgtaaataccacctccacactggactttctaatttgacttcaaatgcatttcaagctaacttcactttccagtggcacaggtgcagtgctcagatgtccctgccaacttacaaaatcccaactggcaagaatacgccaaaggtcgagcacacaaatagatcaagaactctaaaactcatgttatggtttgtttgctcatcagctgcaactttca

SEQ ID NO: 43929 - DNA, 1017 bp, Bovine  19866880703662
caaggtctaacgaggaagcagcagtcaagccaaggcgtggcaagctgcacccaaggaccaaatccagcctgctggcagttctcatacagtccacaagctgagaatggctttcacatttttaaatagtagggtggaaaataaaagaataacattttgtaacacgtgaaaagatgctgaaatccaaatttcagtgtccataaataaagttttattggaacccagccatgctcattcatttgtatactgtctacggctgcttctttgccaggttggcagagttgaatgcctccaaccgagactgaaaaatatttactatctggccttttaaaagttcacccaactctggacttgcttctagtagggtgacctattagacagtgtcctggtttgtctgggacacagggcttccaaacctaaaactggttcagtcccagacagactgggacagctggcaatttctggcatttcaatcatctattctgccccctttcccttagtcaaacgtgcgcccctaaagagcagaagcacatttgctctgtgtaggcccccaccctagacaggagaactgaataaagaaaataaaggaaacaaactacaaaattctaagtaggctgtgtccacaaaaacaggaaacacaggaacattctaaaataaatacacgcaaatacgaaaaggagtacgtcaaggctgtatattgtcaccctgcttatttaacttatatgcagagtacatcatgagaaacgctgggctggaagaagcacaagctggaatcaagattgccaggagaaatatcaataacttcagatacgcagatgacaccacccttagggcagaaagtgaagaggaactaaaaagcctcttgatgaaggtgaaagaggagagtgaaaaagttggcttaaagctcagcattcagaaaactaagatcatggcatctggtcccatcacttcatgggaagtagatggggaaacagtgaaaacagtggcagactttatttggaggactccaaaatcactgca

SEQ ID NO: 43930 - DNA, 530 bp, Bovine  19866880745239
tttgacatgtgctaattaaggaatttgatatgtgtgaatttgtttccaattatgagatctgagtccaataatgaattctttgaacctgtttccaaagtaacatatttggtcctgtaataaaatttcatcccagtgtctaagtaaaaataatttgccaccttcatgatagtgagagggaaaatgtcaaagaagttacacttaatgctttcaatggaaaaagtaatttaaaaaatttttaaatgataagaatctatgtaaaatgcatgatattacatgaaataagaataaaagaaagtgcattggtcctatgagtagacaataagaaaatgaaagcagtttagtgtatggggtgattaaagcttgagtgaatttttctttctcttaatactggattttcactattgatagacattatgttatttcaaatgggcttccctggtgatcagagagtaaagaatttatctgcaaggcaggagaccaaagtttgatccctggatcaggaagattccctgaagtagtaaattacaacc

SEQ ID NO: 43931 - DNA, 1913 bp, Bovine  19866880766666
ttgctgacactggcaaagctatgctaatattattccaaattaattttcttaaagattggcaatgtcattgatggcattacatgtattcggctatatctctatagttttatagacatcctgtatatgaacagtatgtatttcttgacagttttttgttttgtttttgcatcattgcagcatcctatcctggcatgactattgaaagtcttcaaatgggcgatggtcataaacagaaatatccatacttgcagtgccagaaaggaaatatttcacaaatatcctagattgtttttctaaaaggccaactcacaaactctgcagatttatccatctcaggctcactgactataatacagaaatacatttggcaaaaatccaaggactggatacatttaaaagtagcatattatcacaagccctttactttttccaaacaccacttattgtagagaattagaagacagaggagaggagataggaaaaaagtgttaaccttggccctggcagtctgttatccagcagacatgaccagggagtatggccaaagagagaggcgatgaaaccaattcctagacaggggttcagttatactgactttcacaaaacatgcctgccctgccatgccaatgaagttattaaaattgaaatttaaatgtattccaggttcttataaaacagctgcaggacaaagtcagtctccatcaccttctggggaaaacctttgctttcaaagaatgagacttcacaaactgcattgatcagagcctcttttatagactgaaagcatatgtgtttcagagctgtttctgccctgatgtttcttttctagatacagtagtccttccttatccatgggggacatgttccaagatccccagtggatgtctgaaaatgtgcatggtactgaaccctacatagactgcgtttttttccctacacatatataactatgataaagtttaatttgtaaatcaggcatgttagagattaaaaataactaataataaagtagacacaattacactgtaataaaagttatgtgaatatggtctccctctcaatcaaaatcttttattgtactgcattcacccttcttcttgtgatgaaaaaaaaaacctacctggtgagatgaagggaggtgaatgatataggcactgtgacatagcattaggctactactgtctttctgatgctaagtcagaagaaggatcatctgtgttgagtcattctggatcatagaaccatgacggacgtatgatgaggatggctggggatcctgggtggggaggagcaggatggagtcagacagcatgaggtttcatcatgctactctgaaaaacatgtaatttaagccttataaattgtttatttctggaattttccatttaatatttttggactgcagttgattgaaggtaactgaaactgcagaaaacaaaactatggataaggagggactactatacttctctttcaaatatttctataaatgctgttgctcactgagaggcttcatttgaagttacagtctttgtgcaacgtctccatttgacctggatcataagcagtacagactggagagtgggaaaatctttagcatgaaatggattcaaatgtttggtgctatcctaactgtgggagatttaaattttaaatagcattcccatcattgctgaagagaaagatatgtttctattaatatgaatcactttccatatattgttcagaagccaaaaacctgaccatgagagtagacgtattgtgtctataggttgattatctgaaatgtgaataagatgtaaactggacctgggttcctctgcattgtgaaagactgaaaacttttaaaagtgctttgaagtcacacacataaaaactcctctgtgaatttgcacggttttaaataaatattt

SEQ ID NO: 43932 - DNA, 2863 bp, Bovine  19866880804489
aaaaatatgctatttttattatcttaccacagtactttcactcaatatatgcagttttagattcaaattaattaatctcctctgtgatgacttaataccacgtggttaagaaggctgcaaatctattacgctattcctaaaaccacctaggaaagagcatcccaaatacataaggttaaaaaggtaatatttgacttgcttatgaaattttcacatactagcaagagagatgaggcttgtacgtgtgtatcctgccaacaatccagttctcctacaaataatcccacaaactacacaaagtactactgagttaataagaataaaagtttataaaattagtccaaatttattagtttcctaataaattttagcactctttttggggtagaggggacagaaatattgataacatgctaattagtattcaagcaaaatgctcaaattttacacaaaatttttaaaagccacagtgcaaaacataaaatttcagagaagacatgaaacttctattctaacatgtaaacaggagagagaaccacacagcaccaagcaccatgcggtgagcacactgggagtgaaggctacacatgcgaagcgttacctggaatatactggccccataaggtgttctccaggcattcagaaggttgtcctttcccgtgctgacaaaccatttgcctaaagaaatagggtttcaaaaaaggcagtgtctattactttgtcagagtcccaagatttgtgttacagagcttcaatgatacacagaaaacttacctcatctgaaacaagtaagagtttcttttcactggcaagataaagcccactctcacattatataaatgagttatttatacttaggacagggatgaagtagacagataccagaaaatgacatagtattagggaagtaggtatgtgtgagaaaggaacagaattctgagaagggatacatccatgaactgaagaccagacttgaaacaaagcagcaggaaggtagaagggcagatggtggacacgggggcttgcttaccacagtgggcaaacttgagcgacagcacgcagctctcgtgcaggtggagctggtacttgtcgggcttggtgacatgcaacacctccacgttgctgttttccatccccacagccagccactctccggtcgggcagtagcccagagaaaagatctagaatggaaacaggtgacgatggtggctacagaggatgtacttcctttaacagggaggcgaggcactgcttcctctggggatactacttaaatggtgaaagacatcaagacaatgttaactgtgcaggaagaaatcaaggcaagtgtgtaaccccaagtaatgagtcagatgtccacaatctaacttactaatcaattgtgagaaattcaaaggtctacagagtaatggttattgaaataaaagtttgcaaaaagcttgtaataaatgaaattttttaaaaaatctgtcaataaaatatataccattgtactttgacaataataaaatttttcttaactaattcagcgtcaaaagtgactgtcacatggtaaaggaattgctgttgaagtctctgatatatctcacaaagtcatatgtgtgtgctaagtcacttcagtcgtgtccgattctttgcaaccctgtggactgtggtccaccaggctcctctgtccattggattttccaggcaaaaatactggagtgggtttgccatgtcctccctccaggggatcttcccaaccagggatcgaacccgcatctcttatgtctcttgcatcagcaggtgggttctttaccactcgtgtcacatggtaaacgaatagctgctcaagtctctcatatatctcacacaacccagtctctaagatggcacgtgctcgagtacacacctgggaggtgaagtcgtgctgctgcagctgccgcccctcacgaaggtcccaggaccggaccgtgttgtccaagccacccgtccagagcttggtgccatcattagagatgtcaatacagctggccccgtccgtgtggccctggaattgcctgaagatgccaacatggagaaaagtccttgaactttttaagtttttaggtgaactcagtttaaaattccttagtcatcagtttcattgcaggcctgattggtatatttcctttcggtttattaggtgttctattattcaaaataataacaaagcatatatgtagagagattaaagtttaattgagatgctgaatctcttgcactttttatttatgaaaacttaggaagtactcttcaaattactcatatgctaaaacatgactgaaataactgataggaaaaagatatccatctgaaacaagagaacacagctacataaatatgaattaatcaaagatatgatctgagacctactctatccttgggataggaaggaaggagagaaggtgggaatatgtaggagatctttcccttctgaaagctttggggaggggcataggaaggggcaggacaaattctgcccttgagcaacaatgcaacataggaggctgccccaggagcatataaaatgtgtaagaaacgggtgctggggtggggattagaagcagttcctcataacagccttaccctaaaggggaaaaagtgataactactttgtttttagaatcattcagagttgcatcctgcaaaataagttacagatggacagcaggggtctcttttccttcaccctgtcactgggctccattacaatctccgcagaaacctttagcagttcacgcctcttgtctcctgttctctcaggtgttgacacctgaagatcacatgtgctttagggcttttcttatcaatgccaatcctttatcacctcatttctacacaa

SEQ ID NO: 43933 - DNA, 2098 bp, Bovine  19866880837923
tgtttaatatatatatattattgttgtttagttgttaagtcacatccaactctttttgtgacccgatggactcctctgcccatgggatttcccaggcaagaatactagagtaggttgccacttccttctccagggggtcttcctgacccagggatcgaacctgcatctcctgcattgacaggcggattctttatcattgagccacctgggaatccttatatatataattggttcctaaaaagttctgggtttgactaccaaagcctattttaataagataattgctttcttttttataattgtatttatttatttttggctgtgctaggtctctgttgctttgtgtgggcattctctagtcgtgttgagcagaatttactctttactgtggtgcacaggcttgtcattgcagtggcttctgttgttgtggagcacaggcttagaggcgtgcgggcttcagcagctgcagcacacaggctcagtacttgcagctcacgggctcagtacttgcagctcacgggctcagtacttgcagctcacaggcttagttggccagcagcttgtggaatcttcttggaccagggattgaacctgtgtcccctgcattggcaggcagattcttatccaatgcaccaccaaggaaatccaaagatctgtatattttaactgtagttgacaatgcctctaccccttcaacatattttatcagttcacttaaccattaaataaattacaaataaagtaatatctctttcatttatacctggaagagacacccaagatattacaggttagaagtagggatgtgactgtaggaacttctactttctggggaaaatgtaaagctatcctgtagcattttagaagtattttatcataactggaccttacataaggagagacacctaccagcagacaatattgaaataaatggttggcacagaggtttctcctaaaatttaaaagtcctcttcttaaaagttcatatggtataataggaattctgtgtattttatctcatttatgtttcacaataaccctacgaaatgagtactattataattcccactttacatagaaaaaaactgaagcttccttctgagcctaagtgagcaaatttcagtaaacaggtggagaccacacagttcatgaacagccgagtccacattgttctcagctttgcctgatggcaagcccagcctgtggtcactttatagtgctagtttctgattcttatggttgggagtcccttctcttgcacaaatacctattttattaatatattgtgttgaaaaaaaaaaacagccatagcctctgttttatttgcaaaatctctggatcttcaagcacaatgaaaatacttcagaatatacagtctgcacaggactgccattgtgttggttataattagtgtcatgtgtgtgtgtgtgcatgtttaaaagaatcattctatcattcaaaaatatattttccatacataagaatacatgctttgctaaaggcggcatatcagaacaacacttataatttcaggataagcataaattaaatttaaacttgttttaaaatacaaaaacattaaatatatagactagttgccaaaaatgaccatttaacacaaaattgttgaataattcattgtgtactatataagcaaattctgcattcagttgacattgctacaggtcatgtaagatgatgcatttactataactcatggccactatttattgtctaaatttcttacaaatacataatattgcctatagagggatcagataaaaatatggatgaatcagtcaagactccttattcccttacacatctgtacaagtcagcaatagatggcttttacaaataggcatatcctcgttagcacaggaagtgcattcccagatatgggaatgctaagtgaatcagtaccaaccattcttattatgacatagcctctgtgaggatgtggtcccccacatggcatttgttcaatcactaacagtgcctaaaatagtccttgttcaagagcagacatgcagtaaatatttgctgaataaatgaacggtttatccattcaattcagcatccctgaagtcatacatgc

SEQ ID NO: 43934 - DNA, 1153 bp, Bovine  19866880860667
ctttttgctatcagaggaatagtctgtggagtttctgtgcttctcagcacctcggaaactggctgatggggataccgaagagctctggaattagaaaggaaagcagaattgagagatgaccagtcatttaaccctgtcattttttaaaatcacatgagactttatctcctttttgctcttagtatacgctcaccaagctgttaagaggagacaggcctcccccgacccactccgcattgatgcctgcatgcgtgcgtactaagtcacttcagtcgtgtcagactctacacatcctcatggatgtagcctgctgggttcctcagtccatgggattttccaggcaagaatactggagtaggttgccacttcctcctccaagggatcttccctacacaaggattgaacctgcatctcttacatctcctgcattgacagatgggttttttaccaccagtgccatgtgggaagcccaccctgggtcagtatagctataaaaagatcactccctagtggtcagatgtgatgatggcaactcctccactagctccagagacagcggtgcagggtgggagtttagaggaggaagactgaggactagtaagtgggtttccattgataggggatgagtaactctaaacccttcctttctgtatcaatccatctcagggttttatatgattactctaaatgtaggaaccaagcatggtaactactgctactcaaacgttcactcttatgtttggtggcagaaaagacagtaggcattatccattaaaggctgaagacagaagcaaaacactacaagtcaaacaatttcatactgatagcttcttgactatcatctatgcccactgagttccaatcctcattcccaggctaagacttgcttcaatgcttctgctttgttttcctaccatggcccaatgcaattaggcttttacaaccattttgccattgaaatcatgcacacaaacaccatctgtgagttactacttaccaatttaatgccaacccctatatctagtttttcccctttccagtctatcttccacatttctgggattctcaaacaaatctccttccagagattctcacccttccttaaaaaatggcaaacggtgtcccactatccacaggggggaaaaaaccccaa

SEQ ID NO: 43935 - DNA, 3838 bp, Bovine  19866880876116
tggaaataattgcctgatggcctcctcggtctcttgagagaaatccatcttcactctcacaataccagggagttactgccaagccttggccttgaaattcaaaacattcttctggggaaaaaataaaaagaagatggcctctgccaattattagagaaaaattgatatgcagcaaatatctcttataccaccacacacttgactggagaagggggaccagttactagggtgggaatctgctgagtatctggattcaggacaggggagaggaaggcaccagcatgtaaacacctcaatggacctatcacagctttggagtctgtgctggtacagactctccgtagactgaggtcactacttttgaaagctgttgttgttgttcacttgctaagttgtgtctgactctttgtgaccccgtggactgcaacataccagactttcctgtcctttgctgtctccctgagtttgctcaaattcatgtccattgagtcaatgatgccatccgaacatctcaacctctgttgcctccttctcctcttgccctcagtttttcccagcatcaggatcttttcccatgaatcaactctttgcatcaggtggccgaagtattggagcttcaatttcagcatcagtccttccaatgaatattcagggtcaatttctttaggattgactggttggatctccttgctgtccaaaatactctcaagactcttcttcagcaccagagtttgaaagcattaattcctcagtgttcagccttgtttatggttcagctctcacatccatacataattactggaaaaatcatagctttgagtatactgacctttgtcagcaaagtgatgtctctgctttttaatatgctgtctaggtttatcattgcttttcttccaaggagcaagcatcttttaattttttcactgcagtcaccatacacagtgattttggagcccaagaaaatgaaatctgtcactgtttccacttttttcccatttatttgccatgaagtgatggtaccagatgccatgatcttagttttttgaatgttgagttttgaaccagctgtttcactctcctcttttaccttcatcaagaggatctttagttcctctttgctttctgccattaatggggtatcatctgtatatctgagattgcttatatttctcctgacaatattaattctatcttgagcttcattcagctgagcttcattcagccctttatttcacatgatttactctgcataaaagttaaataatcagggtgacaatatatagccttgaaatactcctttcctaattttgaaccagtctgttgtttcatgtctggttctaactgttgcttcttgacctgcatacaggtttcccaggaggtagataagatagtctggtattctcatctctttcagaattttccatttgttgtgatatacacagtcaaaggctttgacacagtcaataaagcagaagtagttctttttttttttttttttaattcccttgctttttcaatgatcccacggatgttggcaatttgatctctggttcctctgccttttctaaatccagcttgaacatctcgaacttcttggttcacatactgttaaagcctatcttgaaggattttgagcattaccttgctagaatgtgaaataaacacaattgtgcagtagtttgagcattctttggcattgcccttgtttgggattagaatgaaaactgaccttttccagtcctgtggccactgctgagttttccaaatttgctggcatattgggtgcagcactttaacagcatcatcttttaggatttgaaatagctcaactggaattccatcacctctactagctttgtttgtagtgattctccttaaggcccacttgacttcacactccaagatgtctggctctaggtgagtgaccacacccattgtggttatccagttcattaagacctttttttgtatagctcttctgcatatccttgccacatcttcttaatgtctgctgcttaagttagatccttgccatttctgtcctttattgtgcccatttttgcatgaaatattcccttgatatctctaattttcttgaagagattgctagtctttatccattctgttgttttcctctgtttctttgcattactcacttaagaagggtttcttatctctccttgctattctttggaactctgcattcagatgggtatatctttccctttctcttcggccttttgcttatcttcttctttttttgaaaaataggttgcctattaacaagacagaagatggtacagggtggtctctcatctataaagcttgtgggacaaaaaacacaggagggcttctctttgctcaattcttgctcaattctctgaaaaacatgagccctttaccactacttcagacagcctgacaggtcctcccagacatttgacatgctttaattggaattaagtgggaaaaggtcagggactctgacctgacttcagtgtgagcactgggacataagtcctctgagctggggatggagataggaaaagggatgcctaagaagcaatgttgataggatctgtggagtatttactttgcactaagttggtgatggacagggaggcctggcgtgctgcggttcatggggttgcaaagagtcagacacgactgaatgactgaacagaactaaactgaagctttgatctactgtctccacacatggcaactctttcaatattcaggataactctgagctggcatgaccatgcccattttccagatgagggaatgaagagacagatcctaagtactgtggtccttgctctatactggggaagtgtcagtatctgagtttaaactctactgactggctacagagcccatgcttttaagccactccagtgactctctcaaggtctcctacttcctctgattacttcccactaggttagaaatagagctaattccactttaaaggaaaaaaaaaaaatctacatcggaaatattgaactctaagactttccatttgggaaaacaaaaaaaacagtaggcagcctaatgaaaggaaaaaaaaatccaagactgaattccaactgtccttctcggatttgaggaatggagctataagctgaaagtgtaaagaaaaagtcattggaagaataaaatttggggcccaaagtgttcaacttcaaacatatctacagcaaaacttattttaacaagatatgatttcaaaagagaacatgacagatagctgataaaggctttcttctccagtcaggaacagagagatttcgcctcccatttgttatacacagatgactaggaagaggttcaggtagatgtggggacagcagccagttttctaagtaagtaaattagagaacatgaaaaggcatgttggaacatatcctttaataatacatgccagaaagtaatttctattaattatccagttgagctatttcaaatcctaaaagatgatgctatgaaagtgctgcactcaatatgccagcaaatttggaaaactcagcaatggccacaggactggaaaatgtcagtttttattccaatcccaaagaaaggcaatgccaaagaatgttcaaactaccgcacaattgcactcatctcacacactagcaaagtaatgctgaaaattctccaagccagtcttcaacagtatgtgaaccgtgaacttcctgatgttcaagctggttttagaaaaggcagaggacccagagatgaaattgccaacatccactggatcatggaaaaagcaagagagttccagaaaaacatctatttctgctttattgactatgccaaagcctttgactgt

SEQ ID NO: 43936 - DNA, 1773 bp, Bovine  19866880937748
attacagggctaaccagagacaggttttccaaaatacatatttagcaaactaactttggtgtccgtgaaaagcttagaggggatttagtggaggaatgggtaagctagttcttcagcagcagaatttcacatctcagctctaaactgttcattccaccccatctccccttgccttctctcctccctactctgcctgtaccaccctcaagcggaaccctgttcacagcctgacataattggcaacatgctttgttgttggtttgccttgctgatgcctcattactggaaggttgccaatgttagcataccagctacatgcaccaatggtctgatctggaatggaaaatcctactgtatatgcctatgcaggagtgagtcactaaacagctctgaagacgaactagacaaatgtttgaataaaagcaactgaagggtaactgctaattctgaagtcatggtcccagctgactttcctggcttccttccctcctagattttcctgtgctcctttgttatctgtggtttaatcctcaagtacagttctggtgcgatccatgaggcaatgtttctaaatgctaacatattggctcaattatcccaaaagaagggaactaaaaacgtttttcttcttgcagctaccaaatgtccaagtctggatggcttgcttaaaaacacacatacactgaaggtttgccccttgcttccatgctgaacactttcttctccccaagagatgacagagaccgtgatcaaaatatgagatgtgtagagaaaatctgtttcacttgtgtataccatttttgaaagctgaactaaaataacatccctaccttttctcaggttggatttcctaaaatatacttttgtttcccactctgaaacaaagatttgagccaatttattttgccccaatttgtgacattagcaaataaatgtctaaagcatcttaagtgaaatcacagaaactatttcatcaaaatttcaaaatgttgagtatatgtatttgtgtgtacatactcctgtttcttcgaggtaaggaatgaggctactcagaattaataagggataataagtgatggttttctttcatgaactgccactgaaggtttcaggaagactttaaaaaaaaaaaagctctggtaactagtttccattgtatttattaaaatcccacacgctacttttgtttgtcttccatccactttcttcatggaaaccaaagacacaaagaagaagcaaagccctgacttgcacttgataaatatggccctcatagcattctgcacaatttggagcctagaccattatttcagtgaagcctgtgattgttcattagcacaaagagtgtgtaataaatataatgaaagactgctggctttactctatctttgtcatctaaagcagttccatgaataactaccggggatttgtctccaaatgacttatctgcttcccttctaataaataacaagtaattagggtaatatattgtttcctagttatgttctccatgtagtgaagagaaacaaatgcacaagtttagatatgaaagaatagtagataatttttatattatcccttaaagtatttagactcattatgcataagttaaactgctgggaggtctaagtacaaagcaagagccgagcttctacatttaatgagtttctttattactcagggcatgaattactactctgatactataaaactgcaacgagtgctctgcatcttatatgagactctttgaggaatgcactcgtcagtgaactg

SEQ ID NO: 43937 - DNA, 853 bp, Bovine  19866880942047
ctttgttttaactttgcacatgcttggtacttataatagaaagagacaggaaccaagactgtttgctttttctagtgagagaaaataaaacaagaagacaatccaaaggaagccatagtgagatcaccagtagataaacatttcacaagagaaatgataaccactattatgagaagcaaatgcatcttttttttttcttggccatagaactttaaaaccgtctctgaaaacatcccgttatccctcagctagcagacacacatcttccaatatttgacaaataccatcttgaatctttcttagtgcaggtggttctaactgtgtcatgctgttactctcttctcagttaaagtcgcatttctttttcaaattccttctgcacagcagaagaaaaccttagcagatggattagggtaaaggaaatggtacataatgaatcacatttgaaaccccagcatgcagatcaatatataaatatatataatcctcctcctctctgttcattcagtgaatttgagtgtttcagagactcaggaggccagaatcctgctatgtgctgagaaagcttctcacgcagctatgcctctctccttcagactgatttctttatctcccctgccattgagcaagaaatgtcatagcatcttctagcccaagtcttctgaacacttggagatatcaaggccagaattctcatcttctgcaactccagggaaattttctggtgaacatttgctatagactgaatgtttgtatctctcccttcccctacaaattcatatgttgaactctaatccccaaagtgatggtgttaggaggtgagggtcttgggaacgattagagggggagtcct

SEQ ID NO: 43938 - DNA, 1153 bp, Bovine  19866880949663
atgagactctcccctacctgctttggaaacccaaagtgatgactcagtctctctttgttacctctctgaatgctgtgaaatttccttctagacttctccttctgttcactatagagtcccaagccttttgctgcattcctacgctccagtaccccggtgtaactcctccccatacaattctacttggcagtccagcattacctgaaaaactttaacaaaacctaccccctaagtaactttcgctgcctcaagttaccagtcaccactcatttgttttccttttgtgtttctatatccatcatcctggaatcctgtcaattctcagtcccaccatatcagttagaccctcagcaccccatactttgattagtacaaatctgcactagctcatttcgactgcagtgaacccacaatgcatcatcactgccaatacttttttcttaatccatggccgctcctgtctcttagaaccacctcttcattacttatcaaagttgtactcagctatcctgctcagctcatgtttcaccggttctgcaaaggcctctccaaacacaccttgcgtctactatctcataggactccctctatcattcactggcacaggctgcctcataaaggtactgttactcatctgcttatggagaagacgaccttgacttgtcaacaagattgtgaccttccagggagaagacagaagcctcaggactctgtaccctggcacctggctcaccactatttagtcatatggctgcatatttaaagttttgggtaaattaattttcaactaaatatagagttcctatatattctctacgcaacttctactaatgcaaaaacgtcttacatacctgtagactttatcaaaaccaaaaataaaaaaaaattacatacccagagaacttatcaaaactaaaaaattaacattgtacattactattaatctaacacagaattcactctgatttctctagctttccattaatgtcatttttctgttccagaacgccacactgccctgaggttttaatttttcacttgtttttataacaaaattataaagtcttttcaaagattttatgaatgacaacatccagattataatcgtaatgttgaatatattatgccttgaatttaggagagaaaaaaatga

SEQ ID NO: 43939 - DNA, 1781 bp, Bovine  19866880968366
cagtgattgttgaatggaattggaatttcctttcagtagacctgaatgttcattacatatctggcttgtgcttatagctgatctgggcacatggccagaattctttaattctcacaaagatcctaagaaagggattatgacccatcaaggaatgattaaacagaatcagatctgcacaaggtgatacagttattaggtagtggattctggatttgagatgaatttacctggaagggtgtttgttgggcgatgggtctgcctttgtttggagatcaggccccagcacatttctggaatggagaactcctggaaggctgggctagtccttgggtttgcccttgagccactgcactttgggcttataccagactcctggagtgtgggggcattctctgcatctctgcttggagtcggggccagaggcttggcctgagctctttctccatctagactgctttcagtgggtgagagggctaagggtcgctttcgcctggagtctcccacgcatgggggcgaagagagctgcttatttatcaagatgaatttgcttcctccctgggtaacctatttctcatttgtttaccaacttgcttttccatttaacttttatcttttccttgtggcctctaaaactatgcctgaagacaacgggctgtttgttaatcaccatcttgtgggtttttgaagggggaagctgggaggggaaaatgtgatgttttgtggcctctttgtagttcaaaaagaggttcttagatgcaggaaatcgctcacaactcaaaattttaaatgaaggcaaatgttttgcttatactgttaaaagactttctttgcagcattcaaatgaagggatatttcctttctcaatgtcccttagtccctactggatagtgcttgtttttgttgcatttgttttatttgctggacaaaattccttgtattctaaatgatactagtttgagccgggttggattagtggactgagggataagatgcatctttttaggtgctgttccagcgtcagtgaggccgggatagtgcaggtgctggcccttggttcttgctttcttcattttgtcttgcctagaattgttttttttttttttttaactttttgttttgcaccatagagtaggtaaaggcaattgtgaattaaatgtttcaaatgtgtggttagaagcaatttgtgtttgtttttagtgagaatgtttttatttgacttgactggatagactggtttatggcttcaggacaatagtaatcacttgatggctccagagccagtgaaagggatgtgaaatttagatgttttccctttttccctccccgcacctcctcttaaaaacctctagtactttagccgtggtggcagatccagtggtctcgtggctcatttaccatcagttctgtggggtgggctgttggagagaagtgggaggcagcgcgtgtaggtgcgaacgatgaatatttacactgatgatgacagttcgcgagactgaggacttgacttgttcagagtaagttcactgagaagagagttcatgactgtttactcctaagagggaagggcctgaggagttttagtcagaagcaaaaattagagtcattttgatgtggccttagtaacagctgtcagtggtggttgctttctgtctgtaaagagggatttggctggcaatcatcaatgcaaatctatatgccctctctgttttcactggacttgacctagtgtttatgccaggctttgacagtttctctaccaccgagcccagctttcctcagag

SEQ ID NO: 43940 - DNA, 2712 bp, Bovine  19866880970504
atggagtgaacgttaagcttaagcaaataagtactccatcaggataattaatttaattgtgaaaaagagccagtaattatttctgaaaatatatagcaatgaggtagtagatacagcctcaattctgttaacagtttttactgaagtttctgaaacaaagaattatctcctcacatattcaagtttggaatgagggcaaaataagaactactaacggatcaagttcagaggaaatgtctttctgccagcaaaaaaagaaattctttttaatcaaatgtccccaattccttgaccaatccctgagcaagagcagtgtgagtgtagaggttcagtctacacaaatccctggcaactctagacaactccaactggaaaccaagcagaggttttcttgtccagcacctctcactctataattctaccaacaggaaaatcctgcagagattaaaaaataaaaaacaacaactttcttagaagtaatgacaccctagtagcaatgaccacacttggtgccatatcttggcttctttaaataaacaaacaaacaaaaaaaggtgagcctgctccatccttgccagaaagtaagattaacaggtatgacaaacaggacaacgggtcaactcgaaggggtgctcactggcaaaactcgagacaattcaagcatcatgaagaataaaaactgtaatagattacaacataattttaaaaacagttgccaggattagactccatggtacccccaagaaaacaggcgtaccaatgggtcatgaggccaagaatcagagaagagttctcaggaccacaaccatgcttccaaccagttggccaagttgggtgcactgaacatgtgtgccccgacccaaccagaagacctgattctatgaggaaaataagaaagggaccagacacaggaactgggcaagagaaggcaacaaactctgaaataaagcggcaagcacagaaaacgcctgagactgggctggtatctatactccctgggttgtgaagatgccctttagtaggaaccctatctgtgggggctgagatgagtctgagaaaggaaatcctggatgatatgtaaggaggcaccataatgaagggacatcagagccactcagctagaatctttatcatctctgtgagcaagagcaggtcacttcatgacctcaagtttctttatgtaaaatgtgggaaaaggtataaaacctacctctccaaggctgctgggaaaattttataagattgagcatataaaacccttagcatgatgcccaataaatgattgcttctatcattggaaaaaagtatccaaaagtctatatttacacacctactcactcactcacactgggaaggagcaagggggaaggcaggaaagaatattattttaaaaggaaaagaatttagaatttaccacctcattactccaaatctattcacagcatcaagaaacactaaaaccactgggtgaaatgttgctggggaacaggttattcagtgtcaaaggatatccgcacagatgattagcttcaacaataatgtgatacaactgggaaatacacaacatcagtcagggagtgttttcactaaaaatacttaacctgaatctaggtggctcagatggtaaagaatctgcctgcagtgcaggagattctggttcgactcctgggtcggggaagatcccatggagaagaaagtggcaacccactccagtattcttgcctagatagtcccatggacaggagtctggcaggcagcagtccatgggatggcaaagagttggacacaacagagcaactaacactttcactttcaaacatgagaaaacaaccgcacaagtccagattgtagggcattccataagaccgtcattttgaagattccaggtcaaagtcataaagtgaaatgtttgggaactgtttctcagcagcgtgagagaagactgaagagacagcacaacaaaagcactcctgtacgtgcagaacagattgagggacaattgctgagaagaaagatgtggtatcaaggacattttctggacaaatgtgaatatgaactatacactccatagatggatgtcttaactctatcacgctcatgctggaaaactacaggagatgcacactgatgtattacggggtgaatattatcaagtcttcctctttcaaacaattcagcacacacaaaatataagtcttctgtctgcatgcatacacgtacaaagcaaaagtgacaaaatgttaattggtgaatctaggtcttgcctggagaatcccagggacgggggagcccggtgggctgccgtctgtggggtcgcagagtcggacacaactgaagcgacttagcagcagcagcaggtctaggtgatgagttgttgctgttgtttagttgctaagttatatctgactcttttgcaaccctataaactgtagcttctctgtccatgggatttcccaggcaagaatactagagtgggttgccactttcttctccagggaatcttcctgatctagggatcaaacccacatctcctgcactacaggcgaattctttatcactgagtcacctgggaagcccaggtgatgagtacactttgttttacggttctttccactcccctgtagttgtagaggtggggaaaacaggatgcacccttctagccagaaactgggagttcctgctctgaacaaatctctctagcaaaagctagaa

SEQ ID NO: 43941 - DNA, 1019 bp, Bovine  19866880983797
tagtaattcttctctaaggtgttgtccagtaccatcctggcatgtatgcaatacacacagcttcgacagtaagcagtatcattcttgattcacacgggtcgtttcccgattagtaaattcattaggcactccttagaatataattcctattaatagtcctcatagttgtgcagggggatgcaggagaaaccagatcaaaccagccacacaactatgttcctaccccgcagtgcagaactcttggccatggctgggcctggttttacttagatattgagtatcagaacgctactcagggcctagggaacaatatgccaaatgtctagttgacagctagaagtagcagataaacctgtaatatttcaaacaagaaaaactaaaagtcaccatgctctgtaaattatcccaccagcagctattcctaaaggaagccttatcttgataccaccccctagccctcctttctacattcccatttttcttttggtctttaggcttggtcaacaagtctgccattagcccttgattgactgccctctgcacttttcatcttctgtcctgtgttagtggtattgattttcagtattggatctctccctccatgtcccatatcaggcactattaagtctgtaatatattctttctgcaatacaacactttcagttagttgagtgtaaatagaagcacaaagtcacagaatctcagagataaaaggaatcttagaattcatacaggtcaactccatcattttacaaatgataaaactgaagcctagggaggttaagagctgagcataagatcaaggtcactcaagcactaaaagtgaaggatcaagaacttaaacctctgggttctgtttgcaagtccagcctgtacttcatgtcctagggcaatatttatcccttcctaatgcagtgaacctgtcactctacgggcttggctgtaacaaagggacatactagggaggtaatccataatagagtgctatatattagaggaaaagaaatcacttaagattt

SEQ ID NO: 43942 - DNA, 1652 bp, Bovine  19866880989206
aagtctccacatcataaaaatattctctcaaacccataatatgtaatagagtcagcatttagaaaccgaaaccaggaaagtcacatatcagagataaaaagccacagagcgttcaccgttattttctcaagcattttgagatttcactaatgtaccctgtggctgactgacagaactagatgtcctttcataattcagtgttccaaaggaagttggcctggtcacgccggactgacagaaccagaataactaacacaagaagaaaccccagggtttctggttcttgtgtttcgtgtgaccttcaagcttaacttcaagtttcagatttatgtgaactttaaaacagattcatgagtttcatttttaagtcactgtgattttcatgggtttcttaaaaagacattaacaacaaatcacccagggctcatttcaatcccacctcactcttttgatacctctggagcctaaagaagtaagggaatttgggggaatcgtgttttaatgtatttatgttctgcctgcagacacggcacgggttggagaaagtagtcaagtttgcaattatatgaccacgggtttaaagaaatctagctcttatttatagtcatgtgtgagatttatgagttgattaagtcttcattgatcaaaagcatacttcaatttagtatttagtgtgagaatttgcaaataaggtccagatgtgtttatgtgagccagacaccatggtaaccagactgtgaaataaacctacttagttgatgtctaggtgaggccaaaacaactggttgattcaaaaatttcaattaccagacaagaccttggaaaaaaagctatcaatttgttgctaaatttagctggccaattttgtcaaaaaaaaattttttttttcagacagcctttgaattatgaaatctctaataagaaaaaagtggtataataaaatattaaaattcttggatagccagagaattgcatacaatgcagacacaactttgaaacagaaaatgtaaaatgcataacaatttccaggaataacaccaacaatttcagccatttctagagaagcaaactacattagaagacttatgaaaattattcatgtaaaatctagaaactattttgtagcactccttgattaaaatagcgctccacagcagagggccaagaacagaatgcacttttctaactctagatatctctgtcagtcctaggtttggagatttaataaatgaaataaagatattcacttgcagcaaaaggaaactccatttaactggctctctcttcattcataaggagactctactcctcaggtaacatgtgatccatggtgggcttggtactagtagccagaaggtcccagtagcacatctacccacatgtgctatcatctgccgatctgcatgattaataagaaccagtgatgtttgtacccaaacctattttaacttgttttaaaaagatgaaacataggacaataaaagaattattattttctgagaattaagtcaaatccttagtaaaaattcaataaaatgagctactaaaaaatgttatcacatgacatgtgagaaagaaaatttgtaaggtttcctctattaaattgctctaagagtatctttaagtgctcataaatttttaaacaagtcaaa

SEQ ID NO: 43943 - DNA, 1920 bp, Bovine  19866881004876
tgacacatgaatttctgtttcgtatttctactttcctaaatttggtctttttaatttgatgaaaaacaaaacctttcactatgttatgaggtacagttgtatgtgtagtgctgttttttttttttttttttaaattttttttggcacctagcttaacatgatactgaattactctgaactgcattttgcatgtatagaataattggaaaatagaagttgaaaactgtgatcagtcactttcatattgtgccttagggaggaaatgaacaaaatgcagtggttacatggactggtggcagtgttctcgcctcataatggcaccaggttaacttgtcttattccttgttaactttgtaaggaatcaatggcttgtggataacatggtttgatgtaggagagcttggctgaaatcaccagggatcccctgataagtatgcagtgacacctgtaagaccatcttccgagatcattcattaagtgccagcagccttcaccggacatgtctgcttcgcattcatgccattttatcagtgttggtaatgtgttgtgacgtgctgtcatgtctaaggaatgtcctaaaatgactaacgcacctggatcggggctttagaggatttggaccagttttctactttttacattgggcagcctttcatttaaaacattatttcttacaacactgaatgaggcatcggagcataatcctgtcccatgttccatggttgactaattggcttgttctgcatggtcgtatattttgattgacagttggatacttggtgagatccttatggtagcatcataacctgcttccccttaggaaatgaaagatggttctcaagagggagaactttttttctgtaggcttttttgccttgcattgtgaatataaacaagaaaaagaaaaataattcaaatcattattttgaacacacttaatcaaatgtgggcctccttccaaaggcagcaatgccaattcttatcagtatgtgtccaagaaaattggtacatatttgagaacctgactcatttctttgactttctgttagatagcagttggattattactggacctaagctttaaggtaccttaggttagagctgcattgtagccgtagccataagtggctatctagatttaaattaaggttaaatatgagtggctttgtggctcaaatagtaaggagtctgtctacaatgtgagagacccaggtttgatccctgggtcgggaagttcccctggagaagagaatggcagtccgctccagtattcttgcctggagaatcccttggacagagaagcttggagggctatagtccatggggtcgccgagagtgcacatgacttgagtgactaatgctttcactttgacttttcaaagttaaatattgttaaaaactcagtttctcagtcacagtagtcacgtttcgggtgcttactatccacccatatttggctaggcactacagcacagattagaacatttccaacatcgcggagttttgtgttggaaggctctggacctgtagagcttattggacatatcaataaagaacgccttgcctgcatgtgagttcttgagaatgatgaagacaaggccacgtggtcagtacgagaaagacacaggcgacagtttccaaagtgtgtcctgagagccaaagttccacagccaagattatttggaaaggcctgcgtacgtatttgccctcttttgagatttgaaactgagcaaatgagcagtttgcctggtgttagttgaattaaatcttgtgagttttaaaattttgtgtaagtaatacctaatttcttaggggactaacatttcttggaataatatttaggaaagactgactagaaggattttggttaaatttaaagcttatttgtgctagtaaactgctgaagaaggctcagtgggt

SEQ ID NO: 43944 - DNA, 1364 bp, Bovine  19866881010494
ttagctgaggcccagagtaaagtggcttcctatctgttaaacaggggcaataacacttgattcctcacttccaggcatgttgtaaagtttaattagatgttagccataaagtaccatgaacttctcagagaaaggcagcatataaatacaagttacagagcttttattattcatctttcttctctgatttatctagaagccagcctcctgtaactcagaacttaagcattttatccccagatattcctgatctttcttagaggaagagttaggctcttgtccttttttcctccctctctaaatgtctgatgctctgaatttcactcagcctctccgtgctcactcatttacatcatccgatggattgccttcactcaccctatgtgctttgattggatgaccacagagacagctttgattggatgaccacagagacagctttgattggatgaccacagagacagcttgatctccctgagtactcccttgaactttcaactttaagtttcaataggcaccagtgggattctaatcaaggcgggggagactattgattgtttggctctatcatgaatgcacaattctctaaatcttttctattccattgtttgaaagtaattggtaaatcgttaggattgagaccacgcccttctaaactgaagatgaatttctaacttggtcaggtcacttgtggcttagcgccttaagactgtcatttctgcccatgtttatttttcatatattattaaacaaaacagatgttatcacctgctttttctatgagtggggtttccacaaacagaactaaaagcaatgtttccacaaacagaacctacaaataggttccaatttcttttctcttcaaatgaaatgcattgtttttgtacaaactgcaaaataggaactaatgttattaatacttaatagggaattattaattttaaggaaaatccacagttgaatttttcaaggttggactcaagtattaatctttctggtattttcaggatttatagcagatactgcatgtgtcacagactacaacaatattggataaatagacaaaattttgggagcgggggagtggagaggaatcagaccatttcattgtatcctagaaaggtagaaaaaaatcattaaatcaatatttagatgtgatttctaccagaaattagctgggacacaacaaatatggtctagttctagagagcaggatagatggagggtttaaggagaagagaggcttgcaagagtttgcaattgtatccataatatttaacttaaaaaaaaaaagatctaaagcaaataaggcaaaatgctaagattttctaagtggcaaatgcaggctattcttttactgtttt

SEQ ID NO: 43945 - DNA, 1185 bp, Bovine  19866881033065
ttcaattgtacagagtttcacctcaaaaggcctggggatatgtgcagagaccgtgaaatgcctgagatctttggagtgctggacatatgagacacaaaggatatttggttttccccatttgtccacagctgtggtcttaatgtaccaggaaatgggtgcttaacaagggatttttgtgctgcttcctgagcagttaaatgtattcacagcctggggaattaaggggaaaaatgagacaaggaaatgctttgggggtccactgaggcagggggaccaaaccacaggtacagggtatttcgacagccaaagagcaccaaaggaatccatagctacggcaagtttggtgggacaagcatgcagcaaacagggctctttacttcttctcagaattctgaggaagaaagttccaacggctgtggctcaggcgagaagctctggccttatgtaaggctcagggagaagcatatggcagtatgttgaagctcatgatggaaaattttcccaactgagtttaagtgaacatgttgtatactccagacagctggcaaagagtaactggcatcctggcaaatctaaagacaaaatgacttttttttcctcatactttctcttctctgtgttacttcctccaccaagtctcagctttgatccatcgctggctcaaaaaaagaggggaacattgcttctatttgtgaaatgctgtttctaggatcgtccataaatgctatttgtatggatctatggctctgatcaatcgtctcaggactcaaggtaagtttctaactctttgggggcatggggcacctgagagtcctgaggccgggtggatccatgtttaggaggacacagccactggggcagcgtcccaggaagatagcgctggccgaggcagctgagtgaggctctctaactctgagcagaacaagaaacagaagggggatgcattttagaattaagagtcttagtttataagggaaaggtgatttctatttggatttcacttttaactctgtttcctccaggactttaagaagtgatccattgttcatacctggggaatcaataccgtaatattcgtccattccataatctctggtgagctgttttggctaatgtgcttgtgtatagcttgagattaagaattcagcctaaaactcaacttggcctctaaaacaacttaacgtc

SEQ ID NO: 43946 - DNA, 1027 bp, Bovine  19866881062356
aaatctattgaaaggaaggagggaggaagggagggaggggaagccaaaaaaaaaagaaaactcaggcaagagaaatcttatccatagaacaacttaggcagatatcagggagttgggcttctcagacaaaggcaatagagaacatcagttttctgtggctgctttcttacctgaggcctgttttaagtaatggtcaaaacttgtgagttatctcacctgtgtggtacctagaaagcatttcctctttggcaagtggaagagagatcctgtactatttttttctcaatataaaaaatcatacctgaatttgtgagtacaggctcatgaagctatgacaaaaattaaagagaagcagtcttcacacatgttttgaaattttgaagaaaaagagagctaatagaagttgccaaatttgtctttctgacaagtgtctctttgtacaaaagtggtcccaggaagcagtctgcatctacatcagctcttaattgtgatgtgctgggaaaaggacaccatgccgatttcaccacaggaaaaaaatgtaaatgttgaagatttttatggagcaatgacctcatcgttattttggtaattttattttttaaaaaatatttttttaaaaataaaatgtggtaacctttccaaacctccctttctgtggcctccatatccacctcctgtaaaaagcatgaagaaaacttcagtggagcaacaaggctgtaacactgggagaaatgattgatttcacttgaacaccaccaccaacaaaaaatgtttaaaaacagtttcatggctcaactttctccttgcttttttttttctctcttatagttggaatgtattttatcgtctgtcagttttgccctatgatatgtcctcttaaattggatctgtaagcccttcataaagtttaataaatcttcagcatttcaccctaaggaaattatattaaaaaccttcaaatgtgaagttgggccggcagacacacagcgctgggaattttatcaccataatcagcgtgtaatgaaag

SEQ ID NO: 43947 - DNA, 1092 bp, Bovine  19866881066744
ttccttctccatgcgtgaaagtgaaaagtgaaaatgaagtcactcagtcatgtccgaccctcagtgaccccacggactgcagcccaccaggctcctctgtccatgggattttccaggcaagagtactggagtggggtgccactgccttctcctgtattaaaactataagagaaacagaccccaaaatggtaaaccggagggtctttgggtggaaaatttctccttgacaacacaaaaagtgacagttctgtaaaggaaacaatgaattccctattgagattctggtggccatgaaaatatgccctgtccaagcgtttgtttgctctcacacaggcccacacaaaaagcaattttcccaaccatgacgatagggtgctgactgtttggagaaacagcaagtatggatgacacatacctgttttaattgcttcatgaagcattgcaaggtttttgtctgtatctagaaatgacagaggtttccatttcagctctggatattatagctaggccagatggaatcctgtcgactacgtgattgagcgtatttttcatttgaaagtaggagccattgggtccatcagctgtagggtaatctgtgagaacatttttcttcattttagccagtagaccgtgcagaaacacctgtttcaaatctcggatcatttgcaactgctatctaagaaataagtgttgaaacaatatcattaagccactttttaaaattcacatacttgagcacaggagaaagtcagagtttgctttgccagtttcactagcatgactctcagagttttggataattaaacatgcctgtccccacttgtaggctactctgactcaaggtcccagaattcccaggactacagaccttcctgggatgaggggatttcagtgctaaaaccagaaaagaccaggagaaagcaagacaggttggtcaccttgttatagacacagtacctgaggtgttgagaggctggctggatgatctctcagccttgtcacttggtggtcaagttatctctgagtttccactcatttactgtatattcacttgagcaaggcatggcactgtctggtataatggctccattt

SEQ ID NO: 43948 - DNA, 668 bp, Bovine  19866881085560
tctctggcaacactctaacactttgtggagggccaggagcatccccatcttctcatgctgcatacagccaagaacaccccagaaacaagtgcactgtttggtgtttgggaacagtgcggtcagtgcagggagccctgagaggaaagtcaagaaacctactgtttccctttcggccagcagcaccttggacgcccgctgacccgcatgaaccctggactaccagcccgcgtgctgatcctcctgtactgtgacaccaggctagtcccttaagcccttaagccccggtgtcatctgttcaaggaggccagtggaatgacactgcttggcaaactgtcggggactccactgaaaactaaatacagggatccaagcttgctacttgctttacaggaacaccaggaagattaaggagaacatataaaacgccttaagctctctgtaaagaaaggtgttacagggaactagtgctcgtaatttctacaattattcttctttcagttatatttccttgcattttcagattctttatccaaaataacccagactttcagaagcagaatatgtatttcaaaaataaaaacacaatcccaattagaataacaattaagtgaagcttgctaggaaatcagaaagtcaatatccaccttccttggctccacctctcctgc

SEQ ID NO: 43949 - DNA, 871 bp, Bovine  19866881129498
aattacattgttaaatgattaaaatgaaggtaatatgctaaacagatgaggaaccacacctgaataaagagcattctctccagtacatggacttttaaaatacaggtggccacaaaaacgtgcagaatcaaactgcaaaacatacaacttcctttctaaagtgcacagttactgtcatttaaaacacttataaagaaataatagcttacctgcttgtgcatttctatattcaacccataggacatctcataatactgtcaaagaaggaaaagcaattaattttgagcctttcatcaaacaagcttcctagtttgttcaaaatgtccccaagcaaacataaaagcctcacctaaaccaaaatatccatccttccaatgatggtacatcaggaagaacactctacgagtatcttcagcttaataaactaaaagccaccttaagacacagaatctaagagaataactcacaaaagtaagaaaatcaagctcaaacatagcattcttaacacctccaaggatctttgtacatcacaagcggatgactcacaaaggtctgatgaaaatgtggtactctatggactctaattcctaggcacagcaggcaagttcataacaaaaacaacacgcctcatacaaatgctgaggctttgacatgaactatttgaaacggtgatgctatttcagagtttctcattttaaggacactacctcatgttcatacattcatacaaaggaaaaaggcttgataggaaatgaatgagttactctagagcctttatgaacaagagtaaaaatatacttggtaatacttctgaaaaagctgatctgattggtttaaacatgtagtataactggcattaaagaaattctgg

SEQ ID NO: 43950 - DNA, 1400 bp, Bovine  19866881168902
ctgacccaagtccacgaggaagtgagaagaactggcagggcttgttgcatcacagaagactggatccaaaggtcaattaagatttcagaggatgcaaaaaggggaacaagaacacaggctacgtaaaagccactgaagcaatttcatcattgttaatcctgcaatgaatgtgtctcttccccaataaaaataaaatgttgagccccaggacagtaaacatttctgtccttttcaccactatattcctggagcctgagcacagggactgtacctgactagccattgaataacatatctttacaaaacatttaacaggtaagttttgtggcttattatatgtagactgtcactatatttagtatcacatggcaattactaactatcctgatgatgaaacaaaactgacagataaacttaactcttgggagctatattagtttactagggctgccaagcaaactcccacaaaccaggtggctgaaaacagaagcttattctctctcacgtctggaggctgaagtgtgagatcaaggtgtcggcagggccatgctccctttgaaggctctgggaagaatccttccttgtctctccagcttctgggagtggctggtaatccttggtactgcttggtttgtggcagcatggctccaatctctgcttctatcttgatgtggcctttctctcagttcatgtatttccctgcccctacccaaataatggcgacagttatgtcgctgatgtgtctcaggtacttcttcttctagaggactttcccaccacatccatgtggcctcagtgttaaggaagaggtactggcttttttaaagctagatttccacacaaaagctctcctactcccttctcatttcttttagagtcctgcctcatctccacctttggaagtactaaggaattcaatctgtacccattagccaaaggaaaaatatttatactgtgaaataatgaacatgaccccccaaaacattctctctgactcaagactctgagtgaggcagggcaataggaaataggatgtgagacccacacacacacaccttgtgtgctgggtggccccttgagacacagggcttctgggttagggataaagcaagaatacatgtgttttctccttaaaaaaaaacaaagctttgaaaagattaatgatacgcttaaatgatgtgatacatacattttcttaattgttaggaagtatacacctgaaatcaatagtctccatcatgaagttacttctgacttgaaaacactttttggataagtaataagcaaacagaagacatttttaattcaagccaaagtagctaaaaaacagaaatcacaatcttacatcctaatattctgccaagtagttaagcatgataactgacattcagacatatgac

SEQ ID NO: 43951 - DNA, 856 bp, Bovine  19866881193017
tgttgaaaggacaagccgggactggttccactcacccttttctctcctgcctgtttttccgtaatgagggtggtacttaagatagttgatacggtgttttataggtgatgatttagaggagggaatgtgtatttgaaggatgtaagtcaagatctgggttgtacttagatttccttatttcttgaacagcctgaaactggaatgtgagaaactcgccagtgagaagacagagatgcagcggcattatgtgatggtaagaaaactgtgtcgcagattcagagtacctattagtttggggtaccaaaagctagaaatatgttcagattgctggaggctgcaggattagaggatagtcgctgtgccagtgcagttgaagttgtgggaatgcgaccattagcaacctgtaattcgaggatgttataacttgcctctgacaaccagctttgatttgaattttcaaaaagtttagttgcacagggtataattttctgtgctttgcttttacagattgaaaaaaaaacaaaaacctcatttacatttcgttgggattcataggcaaaatgtttttgtgttagtggttttctttgttgttttattgctcttgcttcaaacagcttttaaccagagaatttttcagtaaactgttaaagttttaaatgtgttttatttcttttaaacaatggtgaataagaaaagacactagacatcttttcagatttttcttccctgttcttcctttacattgtatattcctaatgtatgtgtatttgcgtgttttgtgtgttttcagtttccctactgttgcactgggattgttgtagtctcctgtaaaccgattcgttctcccagaatttct

SEQ ID NO: 43952 - DNA, 978 bp, Bovine  19866881305840
taaaatttaattcaaaagccatcactttccatgaaggcttcccttccaactaaatggaatctttccctttggctcttgcttttctgtaagagatagaaacttccctttcatatagggcagttcttaatcctggctgcatattagaaccacttggaaatctattaaaaaatattgatgcctgggcccctatcccagaaattctgatttagttggtctgaggtgaggctcaagcatcaatatatttaaaaagctccctaggtgattctaatgtgcagtcaagattcagaactgatggttgaatgagtatgttcttaaataatgtttgtcaatgaatcaagctaagatattaatggcttaaagttttaatagactaaactttaaaaacttgcattttttattaaaagcaatgcaatactaagtctgaagaatacaaaggtaaataatacatgttttaatgtttaacttaaaggaaggaatcataatttcactaagggggtacataagagctgcgagcatagaatatggtatatgagtagtagcctagaaatatatctaaagtatttttggagcatgaagcagggaaaccccctaatttaaaagtagcagaaaaagaggagtaaaagaagcctaagtgtgtaggtgacattgggctgaatgttgaaacatgaaaacaggtttgcaaagtcaggggtggaaaggctttccaggccatataaggaggtgtcaaaaaccatggctcattccgattcatacaccttcctaaaccaaaaattgaattgctagtagagaaaatggcaactctctgcctagttcttagttgtgagaggatgagaggatattttggggccagaggtctatgtctcaaattactcctgtagcagaccacctcagttgcaatggaccagctccaactttagttattttttccaaaaacagagaatgtttgcctttcaaaacaaactcataggaaggatgagt

SEQ ID NO: 43953 - DNA, 1178 bp, Bovine  19866881370553
tgttgacctcatgcccttcatcagtgtctacaagaaagattgcagccagcagcaggaggcccagacacagccaggccacccaaattccgtctgttgcttaccaggggtgagaacacacttaagaagtccttcaagatttacttcacacccagaagcataatgggaaatgtatgcaggtccagagtcatgctttgtgtgtggatatgtaaagtagcatgctcagcctttctgccccagaaatgacccttctgcagcatcccttgatttgcagaaagaaaatgcaaacagagaaagctggactatagacacatgtttatgaagcttggataattgctcacatctgcttgggaaagaaattcttaaatattccctagatgttctagataattccgggtttggttctactgctatctttgcaccacacccccctgcccccaccccctcgcaaacttggcatttgaaaataatcaccatcaacagttccagtatcttttttcttttttgtgagtgtcttagcaaaactgaaattcagttagttgagatgaaatgcaccaccaactgatgaaggaaagaaactggccaaatatctctatcttgtaatgctttatatattgataaaatcagagaatacaaagtaatatgctataataaaacagtataaagcaaatgtctgtgctatattcaaattactccttacacaaaacctttcattggctctccagtttgttaacttactataatattcttctctttgattgccatgcaactcttcttacttcgaggagtatgccttactgttaattttctcccccattcagctttagaattaacttgctcaattaatctcattttcatttattttacagtgtttcatgtttatatgctgattttatgaacatctgtttcaatcacagttgcaaacccattacttttatgagctatacatattttaaagagatttactgctgacctttgttggtgaattggatgtttttgttgtcagtaccatttctgtaattgatgccattgttcctgccacccagatagcgatttcaaatgagatatatttgggggactctttagacacttaaacacattaaaccagacagaatagtcacttaacattgtgtagctggataaaagaagtgtacttaatcttgcagcataagcataggtaa

SEQ ID NO: 43954 - DNA, 1570 bp, Bovine  19866881423090
aactaggtgatataagtcttaaaagaataaagctcttaaaattttaacagtctaaatagggagttttcactgatgcacaggaaaggataggatatttcagcccttaggtatttattttccccaactggcaagacatatgcgaatgacatttgtttgaatattctactagttattggtaagtgcttttcctcttaccttacaaaagatacagttcttattatacccatgttctggtatataagaaaaatatcattaccctaaatattttttctacatcaaagttacacctgaactcaaacaatgaaaccagtctatgatgtgggcctggacatgggttctttcttagttgaaactttagccagaagaagaggaagataagaacaagacggttggatattctaggaatatcatatcaacagtactccatgcattattacattttctgggatgttgaggcatccagcctacttctagagccagcagcctctacatgtgtccacaaatataaatcacttggagtgatgaatccttgtgtaacttctgctccatcccattaatcatcaggcaagtctgctgactgctccactgaggttcttaccctgacctaaaggcatgacctttgctgagaggccaggacaaatgaaccaccctcatccctagtatttccataatgtgagtcctttccctgaccaatgagttgtgctcctaatgccccagttgcgtaagacctctaaggtatcaaacaccaaagactgttcaactgcaaaagacaacaaaagtgaatgagattctaagagcttattagggagagagagcttgattttttcttacctttttggtttgtttcattaatgaaaagtcaaagcacatgactattttcttgtaaggaggaaattacatatcgaaatttgttctgaataggtttactcttgttcatacagcagtgggtctgtaagaatcatacataataaaactgttcaaaatgtgagttcctgggcctcatggcctgagaacccaatagtgcacacagggtgtaaggcccaggaatcaatatttttattaaacaccggtaggtaagtgtctgatgcaagagatccttggacctcactctgagaattggcaattagcttttgccagttgcctttgttgctgtgtagttgttgcagctgccactgctgttctcaacagctgttctcttcacatgtccccaggcacctgctttctcactgtttgctgctggtggtaaatccgcaagtctgaggcatggtgtctggaatagaacatcagtcaggaatcctgagcctaggttctgccactaaataactatgttatttattatttagcctctctaatattccattgaaataataattttcaaaggcctctgaagcttaaaacatttcagtcagttcagttcagtcactcagttgtattctgactctttgcaaccgcatgaatcgcagcacaccaggcctccctgtccatcaccaactcccggagttcactcagactcacgtccatcaagtcagtgatgccatccagccatctcatcctctgtcgtccccttctc

SEQ ID NO: 43955 - DNA, 921 bp, Bovine  19866881532128
ttttatactcctaccctttggttgtgtcacgttgcttttccggagggcagttcacttgcctgcctgccagtgggcatgtgctgaggttagcatgcagccagtgtttgaacatgcatgtgtgttagaggtatgtggatccctgtctgacttcttgtttggtcattattgggttagatctcaatagccatgacgacctttcagtgggaatatatcctttaggggctctcgtattcacaaactgtggacttaaattaacatcctgaattcaaatgctcttgtggatcacaaacaacaaaggatgtattgtctttctcatcctttagctgtaaccacaaaaacccaccaacccactgtatccccatttacctatttctactcaggatttgcttgttgaccagattacatggagtggtgaaagcactaaaggggtccatttgcatttctttaggaagcctggctgccccttgcctgatcagaccagcgtgtgtctctttaagcagctctgctttatggagatggccagtgggaagaaatgtgtatccgattgtgctacggacaggctgaggtggtgttccccaaggcagaaggagaaagtctgaatttttcttggggtggtgttagattttagacttcctcaggcatagactcctacgcataattaccagtacagcttattcccgtggcattttttgcgggatctgtggggttatgttcagatgtgggaggagatcttagggtgttggtggagctagctcatttgccagtaggtcgttttcccacgtgagttatgttgtttgtgtgagcaggcccggtaggaacagaatgtgtaatggtagtggtgctgagcaagactggactggaattaattggctcaggaagtcgtcccctgtagaggaaagccgtagggagatacggcaactc

SEQ ID NO: 43956 - DNA, 789 bp, Bovine  19866881641785
tgtccaaactaatcacatgtgtacatagaacctgtacttaatcagagaccatttcatccaatgtgaccagagagtagtattaatttttttagagatattctcctgacacacacttctggcaagagcagactaatggattcactataagtcattaaagacatatgaacaaattgtgagtcatatgatccaggtggttgaggcagggtatcttcaggttcagtctaccttatgtttcttgttctccattttgttgtcgcctgcataagaatctctgacaggcaaacagaattaacgtgtcattttctcactgagaaataggtggaaccaaaaggcagcattttctacccttgttcttctttcagggacaagactaacacacatatacaataaaactattgagctattttaatacctttcctgtcatgcattcaggaccctctaaagttgtcatccgctactgtttcatttaattctctggccttcagggtaatgtcagaaaattgaagagattaggaggtatttctttcctgttcaatgcatttgtgttgctgtaaattggcaccagctttcaatctcacggtcagggctctccagggtcctcccactggtatgacagccagtcagcatgataaatggcacacaccctctggcaggacagacagttgttcttcccttcctgactgccgcaccagccaagaggcaacatctcgccatcttactgcactgagtaaccacccccttaacactgatgttcttcaagttaattaaaggatctagtttccctgatta

SEQ ID NO: 43957 - DNA, 1024 bp, Bovine  19866881819642
caattatgttattagaacattgctgattgccccagtgcctattgttcagcttaacctttaaatgctagtggtaattaactactttatcattctaccaggaaactccaacatgtagaactctgttctacagtaaaattcacaaataaagtgctacccacagttcctgaaacagccagtttgaaaagaaaaagctatttgtacatgtgtgccaataaataaacattaccatttagtattaattaaaaaaaatattttgtcattgtttaaaaatcaaattttcctttttgacagagtagcagtaatgttcagtggagaatatcagaatcaaaagactcagtgaatcatacacagatgtactcacttttcttcttgttgtaaagcaccacattagtaggatgaaggggtgcagaagtatatgatggagtaaggcgaagaagcggcagagccgccacgttgccatacctaaggcatatcatgcctcagatcctactctactggatgacctcttatggatttgtttagccaagggaccctctggaaaggaatgtaccacatgaattttggattacagttgaggtgtgcagaggggtcgtgcagtcatttctgttcataaaaaaataattcttggcagctcagtgccactctttgtgctgggtgcccccaccgccggggatctgcagcctggagtgggtaggaccttgtaaacaaataggtatcaactgactgtgaatgctccactgtctgggtgaataaaacattaggacacaaagagtgatggattctgcctgacagtgtctgagggagtatcgaacagtgaagttagagctggttcttaagaatggtgaaagagggtttcaaagggaagatactgagagaaaggacattcttgaaagctgggtgggggtggggaaggcttccagtgcagtgacaagaggcacgggataaggtggagcagcaacatgctgagagctctgagaccaggcctgggctgaattggggcagagagtaagggcttgaaagacag

SEQ ID NO: 43958 - DNA, 1667 bp, Bovine  19866881845302
attaaaggtttaagttatatttgatggcctgtgagggatataattaatgattaagaatcaaatctccaatgttttctttgtgcctagagcactccattatggatcaaagaaaattcacaaaacacaaaccaataaccatatttactgggaagataaagaggcccataaacatagtaggaaaaggtgagcccgaagcactaggtttaattctgttgttgatctttgacaagtctggaacttagtcagctattctcttatgataaaagaatcatcagtgttaacaagaccactggtacatagcaatcgtcagcatgccaagcacggctatttcacaatcacttgcagaaggtgaagtgcaagatggtacctcaaattctcctggatccaaagaagggactggcaactaggcattatgtctttttgtcctggagccatttttctgagaattactgacacatggaaccggggcattgatgaactttcataatctcattagaaacagggcatccctctaaaatctcttccatctgcctgaggaggtgggttctaggcctctcagagtttgcccttggacttgcctcccagttgagatgcagtgtgaagtgatgtgactggtggcttgtgggatgcaaggttacattcagttccgcctcctgtctgctgctgttgtgtgactgcccaaccctcgttctaaaataaataggtttgtatttctgccgatggagccgccgagccaattgcccccctctctgagaccccgagcctccctccccacccatacttcaccccacaggctgcctggcagaggcagggggcaggatgcacagtgtaataaattccatccactgctgagctgagggataacagatggataggtttcctcatgcaatttccacttcacttggtttgggtataaaatagcagaagggtggcttttttcttgtgcaattttcaaacagatgaaaccagagggagggtttgcaagagtgggagaaaactgagggacttgactgtccttcagagaaagccaaatgaacaggatgcccccaaaaccttgtgaagaattcagacttgtttttgctgctagatgggagtcagattcttcatccaaaactgcctgctcatccctaccaggcatggcaaaggcaacgatcaggggaggccagacagtctgttgctcatgttgttatagtgttatggtgattgcagtacaaattctcagggtggaaaaaaaggtataatgacagattgtgtgattatacccatacttataattaagctgttacaatacagacaagcgcctgctcgctaatgtcaccaacagaaacctctttgcttggaaaggagagtgactcactctggcaattagaaggagttccctacaggacttcattttcaaaccttatgagccctgcaacaagaagatgtgttgcttgtttgaattacagggaaaagcacagagatccaggagcaaccactcaatttccaggtacaggctggggcattgttagagaaggagttattacgatcacaaataccctcgttgcaatgcacagagaacttggctcctgctacaaagcacttcatcattgtgtttctatccaactctgtggggcaagctggatactctggtttgctcttcaggactgagagaggaaaaagaagag

SEQ ID NO: 43959 - DNA, 1315 bp, Bovine  19866881979278
caattagttatttggattattttaatgccattatgcaaattaacttatttgcttagatagtaaaaactgtgagcttaaagttagctgcagggggtgacataattatggttgttaaaagtaaaacatttcatgctgatgtatggcagaaaccatcacaatattataattatcctccaattaaaagtaaaataaaattttgaaaaagagtaaaacatttctagtttaaagaatcacagacatttttgcagagaaagtgagcaggaaatgatattacatccttttgtcgtgttgttctgtccatgaaaggaagaccagaatacattaagcagagagaagctgggagcaaaggcagttgtttagaggagagaagggagaagagaaggagaaagaaggaatagaagcagcctgaggtcttccctgatggtagagtggttagaatccatgcttccactgcagggagcacaggttccatccctcactggggatctatgatcctgctagcctcatggtacgataagtatgaaagagacaatgctttacttgtatcaatcatcaagctgtagcatttgcaaccaagtaattaactatctgggagttggtgatggacagggagacctggcgtgctgcaattcatggggttgcaaagagtcggacatgactgagtgactgaactgaactgaactgaattaactatcttatttaagaaagcagctcaccgagtagacagataaaatggaacgacataccaaaaaattaaaagttaaaacccaaattagatgttgcatagtatttgaatagagttcaatttggggtgcttatttgcaggggttcataggtatcttatttatgttctgcattatatattttcttaagacttgttagacaatgtagtaactaacatatcacttaataaaatacatttactttaacagaaaggaaactttgctaggatcattggtgtaggagaaagcaaattaattagattttaggaagccagctcctggttctaattcttccaacagaattttttttttaccttgggtaattgactactgacaaggcccttatttctatatttgtaaaataaaagatttgggtaggtgaatacttttcaaacttcatttccagccttgcaacaatttgttcaagcagaactcttatctggaaacctagtgtgcaaattgagaggggctctgcttgaagctgaggtggagataagagccttccctgccagggccatactctattagacctgcatcacaaggcaaacttaacacctctccagaggctgctgtctgaatggtccaacatcata

SEQ ID NO: 43960 - DNA, 2603 bp, Bovine  19866880597472
tttcaatgtcattctcccaaatcttcccaccctctccctctcccacagagtccataagactgttctatatatcagagtctcttttgctgtctcgtacacagggttattgttgccatctttctggattccatatatatgcattagtatactgtatttatgtttttccttctggcttgcttcactctgtgtaataggctccagtttcatccacctcattagaactgattcaaatgtattctttttaatggctgagtaatactccattgtgtatatgtaccacagctttcttatccattcattttgatatttggcaaaactaatacaattatgtaaaatttaaaaataaaattaaattaaaaaaaaaagtctacaaatgataagtgttctcagtgacttatttgtattcctcataatgagtcatattctcttactagtctgaggcttccttgggcaactggttcacccttgctgcattttttgtaagagtagctttcttgccactttctacatattctctgttattcattctgattttcttaaaggataactgttctgcttcacatctgtgagtacaggtcactttgggttgctgctgctcccttactccctaccccgacttttataacttctcagctattcttgttcattgtcatatagaatattgtaaagacttccaggaagcagcatagtggaatgcagagaataaatgtcaaaatataagcacctagatccttagtgtggtgaccatagagattagaagttaaggtaatatcttaggtttttttagatttaaaattctttgtttgcctgcaattacatttcttaacactagcccgcaatttgtgaaagaacttgtgtctttgagggttgagtagaaaaagtatttggatattcagtagtataaatgctcttagttaattagattactccaagaaattgttgtgagccagtttggaaatccagtgacttttgaaaggaagaaatataatttttttaattgcagcatagttgatttacaattgtgttagtttctggtgtaaaatgattcagttttgtgtgtgtgtgtgtgtatcacattttctttttcatgttctttcccattatggtttattatgggcttccctggtagctcagatggtaaagaatctgcctgcagtgtgggagacctgggtttgatctctggattgggaggattcccctggaggagggcatggcaacccactccagtattcttgcctggagaatccaccaggacaaagaagcctggaagactacaattcatggggttgcaaagagttggacgtgcagtgtttacaattataatagtttattttattgtaaaagtttatgtaatttacaattacaatagttgatttacagttgtgttagtttctggtatagcagaatgattcagttttatgtgtgtgtgtgtgtatgtgtatacacacattctttttcatattcttttccgttatgatttactataggacaccaaatatagtttctgtgctatacagtaggaccttgtgtatctgttttatatatagtagtttgtatctgctaatcccaaactcttagtttatcctttccctactcccttttccctctggtaaccatgagtttgttttctgtatctgtaagtctgtttcataagtaagttatttatgtcatattttagagttcacatacaagtgatgtcatatggtatttgtctttatttttctgacttacttcacttagtatgatagtctctaggtctctccatgttgctacaaatggcattatttaattcttttttatggctgagcaatattccattgtatatatgtaccacatctctatgtgttcctctgttggtgggcatttaggttgcttccatgtcttggctattataaatagtgctgaatatagataaatagttatttatttatatttaaataaataaatgaataaatttattataatataaatctatttatttataatatatctaaattataaatagtatgaacattgggatgcatgtatcattttgaattatcattttctctatatgtatatgcccaggagtggacttgctggatcatatggcaactctaatcttagttttttaaggaatccctatgctgttttccatagcagctgcagcagtttacattcccaccaacagtgtagggagttcccttttctccacatcctctccagcatttgttatttgtagactttttaatgatggccattctgactggtgtgaggtggtacctgactgtagttttgatttgcatataagaagtataatttaaaaattactttgtctgaattttgtcagctagttcaagagagcctgtggttaactcttagtttaaaacaggagttttaaaactcttcctcaaaggccaaggtgtttttctgagggccactgagagggatggtgccactactaggaagaatattaggccctctctatctgatctacttttatcctggcagttctacttttatccagttgtaattatttaaaatataagtactgcaaccattgcttggctcttgattttttaccattttatggatgtataattgacatataataaattgtgcat

SEQ ID NO: 43961 - DNA, 2381 bp, Bovine  19866880688545
gggcagctatggaaaacagtatggagggtcctcaaaaaaaataaaaaaaatagtactaccatacttccaggcacttctacttctgtgtatttattaaaacaacggtaattcaaaatgatatatgcacacctgtattcactgtggcattacttacaatagccaagacatggaaacaacctgctactgctaagtcacttcagtcgtgtccgactctgtgcgacctcatagacggcagcccaccaggcttccctgtccctgggattctccaggcaagaacactggagtgggttgccatttccttctccaatgcatgaaagtgaaaagtgaaagtgaagtcgctcagtcatgtctgactcttcacgactccataaaaaaagaagtcttgccattttcaacatggatagaccttgagggcattctactaagttaaataagttagaaaaagataattacttatgatctcacttatatgtggaacgtaaaaataccaaaaaaccaaccaaacaaaaaaacccaagctcacagatatagagattggtggttgccagaggtggggattagggtgtgtgtgaaataggtgacaggggtcaataggtactaatttccagctattaagtgagtaattcatggggatataatgtatagcatggtgactatagttaataatactgtattacatatttgaaagtagcgaggagaatggatcttaaaagttctcatcacaagaaaaaaaattttttgtaactatatgtagtgatagatgttacttagactgatcattttataacatacaaatcacatcatcattagacacataaaactaataatgctatgtcatttatatctcaatttaaaaaattaagagatattataggattatattaaatcatgcatgtcaaacttctgaaaagtgtaaagcactattgaatttaaagaatcttcactcaatttaaaaaaatttaaagattttttttttttttaaatcctgaaggagtccagaggcctcttgtgagtatgtgacaaagcttgtatactaagattcctctgccttactccacaggcacaagtgggaaaaggacacttttttccatgcaatttcagcaaaactaattattcagcatcctagcccttagttggtcagaaaaaacaaaaagggattgaggtgggtactatgagcaggcagagttcagagagagaagggacagctgaacagagtgacaaccagagtagagtcagagaaagaaagaagcaaccccaaagcacagtagtccaaagaagttctcaagaggggtaaatggcctcttgacacttccaggttttgtaacaggtcagtgattatctatgataatgatgcagcaagtaattgctgtaacctaatactgctctagattctttatagtatctagaacagtagacagtctgtatcttctgttttaaaggtaggaaaatggatgaaacactagagattttcaatgaaaataattaaaatatataaatctcatttctgactttctgctccttacagatttgaattttttgtttccatggatgaagtacagaagaggtcactagatgtcgcagtgaaaaacagtagaccacttggttcacacagaaggaaggaactgggaaaggtaagtacaaaaggggatcttggtactctttccctcctggtggctacctggagttcataggtggaacacatccttgctgaaattttgatgcgatcatcagtttgttatcagaactgactttaaggaagatacagcctcactgggaggttttttgttttgtgccttttaaaaaatactcttaaaactaaagtatataaattaataaaccctattttaagaaactcaagaacatccaagttcatcactacaaaagtatttgaacctctaactatgatattaagtattgttttcacaagtacagcattgtgtgaagcttggatcttctcattatgtcaagacttttgtggtgaatgttattttaacttaaagttagaagtaaaggaaatataatcctcaggaaggagagacaaaaaagaatggtatttgtatactctgtagttgttgtattttaaacattatcttatgctcattctttaaagcccactctgtgaagtaggtgatgatattcccatttttattgttgagaaaactatagtgtcttgcttaaaattctggatcagtttgtaagtaaaggcaagctgttttctctaaaacattcgttaagtaaattcctgaggtacaactgcaaatagcagttcaccttttcctaggacactgaggttggtgtcagtactgtccttctggagaggttctatatattcaaagtcaaaggaaaaagaactattgctcaaaactcaaggaggccttttt

SEQ ID NO: 43962 - DNA, 1102 bp, Bovine  19866880771418
ccgaggaagagcacaaataagtgaagcaaggactggcatgggactgtggctaactgaggagcacacggccaggcatgacaggggcaaggctgaattctgcactggtaaccactatgcaggaatttgttgccagatcctttgactttttaagaaaaactagaaataaggacttaaataaaatctcttaattaaaaaatctagtaattaattcaaagttaaaaaagacctgtaagggcccaataaaatatgaatgcaggcccagctcagtcagtaaactaccaggcttaactgctcatttgctcaataatagatggtctatacatcaagcaaggttggatcactgtattataccacaaagaaaattaagtttcaggtggacaaaacatacaaattttaaaaaagtataacaaggaccttaagaagtagatttacttatataataatagtatcaacaacagcaaaaacaaaaagatagaaaaggaaacaagagaaatggcttaagcagggagagtaaagaaaaggattatggtatctattaaaatcttgtcaggtttttgctgctctactttgaacaaggccaaagtctcttttcaagggacaattctaagtcaaggtaccaacctctagcaattaggtatgtcatggcaagacaaaacacgctaagcacacgccaataaaggatacaagtattccttactaactgataatttatcatactgtgattcttaaccaaggttccctgtaaacaccagtctttttgtcagcaatacctggaagtatctctggtcaatcagagcctgctgctggttatctttgctgggctcatcttttccctctttgtcctcagcttttttttgactgataatattctgtaatctaagggggaaaaaaaaccaagagaatacatacgttttactaaacagcggattaagatgacaaaataagccaatgatccagctaccctcccgttaactctgtcattttacatatgtgtatgtgcatgcatacacatgcatataatcatatatacatttttaatttaagctatattgtcaccagaaaacgaaaagaccttctcaatagatacaatatagaaggaatc

SEQ ID NO: 43963 - DNA, 1145 bp, Bovine  19866881007169
tccctgagagaagctctactaaacatatatgttattattagaagaataaattatcacctatgaagtatgtcaccaaaaatacttgtatctgaatttagatttaacttccaggttagagggaacacaggagacagaagaataaattaaacgacataaggaagcaaatagacaaatctagcatgtacctctccaggaaaaccaatcattttcttcaacaagttaatgacattaaaacaaacaaaaagggcagagaagaggaagaggaagattccaccagtttaagagagaaaaccaatacccaagatgaaatctatttttgaaaaaatgaagagtctagctacatatccatttatgtagcaaacattactgtttatccaagacggtatgaggaactcttttgcagagataagaaaacactctattttgagtgataatgcgttcttcttcttcctgtgttaatctatagatatccttctgcaaggcagcaatagtctcttgttgctccattcgttttatcttataatgttcacattttgcctgtaagaaatttttcaaaaaataaattacaatatgtacatctaagacatgctgttctcacaatattgtacaaaaagctatcctcacaatttctatgaagctgtcttattcaagaacttcagtagggaggctgtttttaaatgggtacaaggtccagaaacaatgatacatcataaatgcaaaaactgtaacaagtaaaatcagcataaaatggggaaaatattgtttatactcgcatgcatttaaggatacataataagtaaaagaactcaatctttgtaaaactaagtttatatacaggtttagatgaaaatgataatcaggaaggggccaatattaaagatcctgcaaagaaccaagaattaaaattacaattcttaaatgatcaatgataattcaggatttcatatggtttaattaacttaggcattcatgtaatgtgggagactgcacactcagcataatcaggaatttgttaagaaataatatatacacccaagatttatgcaaggggaatgtaaatcctgaatactctcttttgtcttcagtgaaataccactggcctggttttcctaaaagactctgatgctaggaaagactgaaggcag

SEQ ID NO: 43964 - DNA, 1610 bp, Bovine  19866880368551
gaattgagcattccatatgatgctattatgaagacaaattgaaaaatggtgaactatatagaaatcttgaagagatggtgaaactatcctttctaatatggactggtgtaatttatattttaaagttcagctggtaaaagtactaagctttcagcaaagtaactttcaatgagtttgcttgtagggaatagactttcaggagtggacttgataaattttgagtcctgagaaaagtattgaatgtaattaatattaggaatcaaaactcagaagaattaaaattgggcttgctttaatttggggccaatatacataattgtaaagggattatatttctatatgaaatgctggggttgctttatctctgtttttattggctgctccaatgaaaatcctattggtcaggggattagccaaaatgtaggtggaggaaagagtaggaagagaatgtggggaaaaattttggtaggaagaagctaaaattggattggaattctctacaaaagtagaataatcaggcccttaacagagagttacagttgtcttctgtgttttgaatttaagcagtttaaatattcttggggacggaaatattttcttagcataaaacacaggtgcaggtactgtgcagccaaggaaaagcattggtaaacatttgaacgtccttccaatggcgtggttcagagccaaactttcaatctgcctcagtggcttaattttctcatcacactcaaatagagatagcctgttctcagtgtaatgaaaggaccatctcagagtaacatgaggaatctttgtgcaaaggcaatgggggctaaaataatcttcaagggagttagctatgtttgttcagcagcaagacacttttaaatggaaagtgttctctggatgtttgtactggacagtgatgtttttacattccagccatctcacttagtctcattggactggattctcccttttaagttaagaggtagttggcagaatgtctcccctggcatagaggagagaagaaactttttctgttttcagatttttcaaagcttttgtatatatgccaggttatgacaataaaagctagaaacaacaaattattctaggctttggtagataagagaagcccacttttgttaagagatccagatcttctgggcatttatcgccttgataatgcattttgtcgttttacaccgtcttacgtcctctccctggacagaactccatgttctcagaacgtgggcaaccttccttctttctctcagcctgtagtggctatgacagtctccatgtgtgcccttttgttttttttccaaaaaaagagaaacacttatttcctattctggctcattttacttttcctttctaattcctaattaactacctttctccattataatacatgtctccaaggactgtggggcaaatagaatcatcactaacattccttcctttgtgagaatacatcctggcatttagaatatctgtaaagggagttaaatcactgacttaaaattctggcatttttgttgttgataaaaattttgaagattctttttaaaattaccttgcctatttttcccctgggttctcactcatttgaacagtttctc

SEQ ID NO: 43965 - DNA, 3942 bp, Bovine  19866880385617
actgtcataaacagagaggcacctctgacaccacataaataaacataggatggcctcactgagagatgagagaccaaatgagacctccagatgtcctttgtaaagcaccacacacatgactgaagccatctgagaccatctggtccaagcccaagccagcccagaagagaagaactgctccacagaacggtgagaaaaaaatttttatggcatagtgtttttaagttactaaattttgaggtggtttgttacacagcaaaagctaactgataaacccagtaaaatttcttgtgcagaaaaattgtggtaagggtcaacacatcctagcacccgtcttctcagtggagaacagcttcaccacgtattccatccgggtgactttgtcatttctgctatcctcattttcttccattcattcataaagtatttgttgcttattttcttctgaaagagttctaaccatctttttgtttactctattttagatggagtaacactgctcaccctcaacaacatataaagttttataacgcatgcaaggcagtcaatgaagtgctttttataagagcataaaaattgggaactgcctaaatcctcaacattaggagtatagtcagataaaacatggtatctgatggaaaaatattcagccactgaaaatcttatttttgaaggatatttagtaacaagggaaatgtttctgataattagaaagtgaaaaaaagcacaatttaaaactaaagatatagttattcatatacccatatataaaagtgaagggcatgtattgggatttaacagtcattctctctaaataatgacataataaataatttttactagcttctataactttttctttatcaatcgttactcacacaatgagcatttattgctttcacaatcagagaaaacatgttaaaaacaaattcataaattttatttttgctttctctcacagttatccaaattaatcattaaaatgtcttttgtgacccatatccattaaacaaaataggaaaatgttcatttggcaactagagtttacattgactactacagtacttttgttttttaaaaaagtatccaggtatctacagctatctagctgaaaaaaatcaaaaaccaaataaaatataaaaggagaaatattaaacactgctatagcctcaaccactcaggtgcaccctgttcttagacataaaggattagtcacatgtgtcattccttctgaaaatgcaatctttctatttgatactgaataacgtattaaatttattgaagttatgataactaacttaaaagtatctgtggaaaacaggtgacttactaaattttgttagagcaaagacaacaatattgtactctaaggtaataaacttgttttcacagagaaatagattaataattgtgaaactatatatgttagaatttagtaaataattatattgtgggtataagagccagctatctcactgccatagaaaggacatacaggcaaggtaagggagaaggcaacaatggtccttgtagttttagatgtaaattgactatatcagtataaactctgctgttgttgatattgttactgtttttaacatggataggtttagacatatatatatctttcctagttctgtcccctaagagtatttcgaaggaagattaccaagtacaaacgatcatgcttaacatccagattttggtttctaaatatagcattctccaagaaaaataaatagagcttagctaggaaaaatatgttggggacattttatggtgtcagaaattacagagcatcttaaaagatgatgtactgaggacataaaatcatttctgtgccactttttgcaaaaatgcataatataaacttgaacacgaaacatcttacagacagatttattctacataatactggctagtacccttctaagatgtcaaggtcttaaataaaacattaagactgaagaaataccctaattagaagagactaagaagacatgagggtttcccaggtggcattagtggtaaagaacccacctcctaatgccagagacataagagagcaggttttatgtgggtgaggaaaattccctggaggagggcatggcaacccactccagtattcttgcctggagaatcccatggacagaggagcctggagaactgagtctagttcagtcatttgctcagtcatgtcagactctgcaaccccatggactacagtacgccaggcttccctgtccatcaccaactcccaaagcttactcaaactcatgtccatcgagtcagtgatgccgtccaaccatttcatcctctgtcatctacttctcctcctaacctcaatctttcccagcatcagggtctttttctttgcatgagtcagttcttcgcatcaggtgaccaaagtattagagtttcagcttcagcatcggtctttccaatgaatattcagaactgatttcctttaagatggactggttggatctccttgcagtccaagggactcccaagagtcttttccaacaccacagttcaaaagcgtcaattcttcagtgctgagctttctttatagtccaactctcaaatccatacatgactactgggaaaaccatagctttgactagatggacctttgtcggcaaagtaatatctctgctttttaatattctgtctaggttggtcataacttttcttccaaggagtaagcgtcttttaatttcattgctgcagtcaccatctgcagtgatttggagcccaaaaaggtaaagtctctcactgtttccattgtttccccatccatttgacatgaagttatgggactgactgccatgatcttagttttctgaatgctgttttaagccaactttttcattctcctctttcactttcatcaaaagactctttagttcctcttcactttctgccataaggggtggtgtcatctgcatatctgaggttattgatatttctcccagcagtcttgattccactttgtgcttcatccagctcagcattttgcatgatgtactctgcatataagttaaataagcagggtaacaatatagtcttgaagtactcctttcccgatttggaaccagtctattgttccttgtcctagttccttgttcctagtctattgttgcttcttgatatgcatgcagatttctcaggaggcaggtcaggtggtctggttttcccatctctttaagaattttccacactgaatccatggggtcataaagagtcagacacgactaaagcaacttaccgtgcatgcacggatacatgaagaataatgaaatcgaaggattcaggattaaatcttagttcagatttttaaaaaaaattagtaggaaaattgaagaaatctcaataagatctgtagattggtcagtagtaatatatcagcatgaattcctggctttgatcactgtgctatggttgtttatgtaagatggcaatatatggtggagatggctaaaggaatccttaatgccattttcactagttttgtaactctggaaatacttgaaaactaaagattttttaataaggggtttcctgcaggacaggacagttttttgttttttttttttgtttttttttttgacgtcagctagactcttcttcaaaagttgttcctaatttcacagttgtcatttttatctgttaaagacttttctcattaagccagaagaatcaaactaaatgttatgcaataagatctctttcttcttcccatagcttccttctctccgtttaaactttgcattatgttattctctcatcaaacctgcatgagaaattcttacttatgtaacacttaatgtaatatataacatcttataaacttccaatatcattgaaatactataataatgtaattctggacactgtggttaaataattgctactgtcttgatagctactcagaataat

SEQ ID NO: 43966 - DNA, 660 bp, Bovine  19866880466590
cacacagaagaattaggccatttacaaattgcagaagaccaaaatttctatgaatgaggatattttatacattccaaaagagaatatttgggtattagaaaatgagacattggaaaacctgatgaatcactaaaatatatttctaagtttcactctctttgtatcaggctgtgtcagagaaatatgaaggtgttctccctgtcttaaatagtttcactagaaaaatctacctccttccaaaaagaaactccttgtttattctagatttagtgtatattatccatgaatattgatttattaataattgagagataaaatttttaaaaactatgtgtttttgtcttttggtataaatttccaaaatattgttaatagtttgaagtgaattgacatctagcttttttttcccctaagaattattatcacatgcaaaacattttttgcatgtagtcaatcatgatctacatttccagttttagataggaatgaaattgcaaatggaattactagtatttctctttcaaaataagtaaagcactattatgccatagattaatgcatgtgatgagccaactcacatattttacaatatgacatgattctaatgtcgtagcagatataacaggctagcttacaaaagattcaaattaggccaagaac

SEQ ID NO: 43967 - DNA, 1516 bp, Bovine  19866880564062
atgagcagtgtaagctaattaacattatcagaaatgaagtaaataaagttcctaagatcactggacaaagaaaatgaaatttgaaggacaaattgttcagaacaatttgaacaagttcttagggccattctgggccaaattttcagcatatttaaggctgcattcactgaggtaaacctgtaaagaattaaccagaattcagtgttgggacagcagttggttcattcatttgtcattctgaggcagatgcagagatgtgccaggtcctaccaggtaagggggaatgtgagtctcacgctcatggtccatgcctcccccaaggttagtcttggttagtcttccctgtcttgaggacaccaaagtgaaagtgaaagtcactcagtcctgtccaactccttgcgaccccatggattttacagtccatggaattctccaggccagaatactggagtgggtagcccttcccttctccaggaatcttcccaacccagggattgcacccaggtctcccacactgcagacggattctttaccagctgagccaccagggaagcccaagaatactggagcgggtagcctgtcctttctccagcggatcttcccaacccaggaatcaaactggggtctcctgctttggaggtgggttctttagcagctgagctaccagggaagcccacattaactgagacatatgatattgtactctgaaattttttagcctcatcaactttgaaaaggaataattactgaatttacttttattatgcagtccagtttcttctggaatattgtaatttactattaaataatggatatgttttgcctcaattttttgaataaacttaaataattttttgagactcctaagaatgcaacattctgtgctgggaaattgagttgtaattatctaagtaactttttaacctggtcaaattttcttaaaataagtgggtatgaagttcagcaggatcaaaggtaattaatgttttccagcagtaagtgtgataaatacttgcttgttaagtcaattacatcaagacaaaacttgaatgtgaagtaagagtgtactataagtaaattgcaaatagcattcatgtgacagatctactaatttgctacttgttattccagaaagatttgaaaaaattagatagctgaagctgttataaggaagacaatttactgcagagacaccccaaaagaaaactttagacctcacttttgcctgttgatttttgccaagtagtcatctggggtctgttttgaaacaatctatgaccattcacaccaaagcatagttgtagagaaaaattagaaacaattgctcattctgcttcttggtaatataatgctatttgcttaagatctgcaaatacttgctgccgagtatcagtggtattggcctaaaataagagtataataggaaagtctgtggaagaagtgacagcattccctgttgaactgaaatttaatgaggacagtggagaggtgtaattgtgtgttctacctgactcaa

SEQ ID NO: 43968 - DNA, 1198 bp, Bovine  19866880582437
gatgttttgtgtcatcttcacattaaaagtaagatcattgtcatctctcctacttacttgcacttgaattgtcttcagtaatttagcaggctcatcttattttatagtcactgctacaagaaaaatgcagaggtcatgaggactgaaaaggatcgctatatattaaacatgtggaaggagcatataaccgagcattatcagatttatcactatacctgcatatacaggcaatgcttttctctaccacattcagaatacaaggctcacagaatgttagggctggaaaggccattgttgatcatcattttacaaacacaagaatcagagactcagaaaagttctacaaatttaccaagaactaatggctaaaaagtggtagaactgaaaaaaagaaatgctggtctctagacattcctttcaaacttgatcacacacatcagaatcacttggagggtctgttgcaacagattgaaggcccatacccagagtttctgattcaggtatcaggtggctggagcaggagggggaattctcatttctaataagtcaagttccaggtgatactgctcttgatgatctaggaaccacactttgagaactactggtctccaccagttttcataaacagctgttatcttattttcaataacttttctcatcataatgagcaaagcaaactcagggttaataccacattacttggctgtaatctctctaatagaggattaggataatacctacagtgtgaaaaacctggaaaaaaaataaagcaagattagggaatgtaagggcactaaatactaaaaagcttatgcccattgaggtgaatcattatcccaaccagcctatctaaaatctcaagttaatattaaaccacacccagtgtaaaagagccgagcaacgccctaaaatgttcctctctttccctccatcctcagaagtccctatgtcatttatatcctaagaatttcctactgcatatgtcaagtcatactaaaggtagctctgcttctgtgatatccaagctgtcctttttcgttgcctctttacctgtctgatcacatgtctattttgtgagtaccaaataatctctgagctgcagttttcttatatcataacagaatctcgtccgaagccaaacacagggaagacgaccttgttctctgctgccttcccccactagcagtatttagaccaa

SEQ ID NO: 43969 - DNA, 1712 bp, Bovine  19866880584765
ccttaaatctttcccagcatcagggtcttttctaatgagtcagtttcttcaagtcaggtggccaaagtattggagcttcagcttcagtatccaatccttctaatgaatattcaggattaatttcctttaggattgactggttcgatctttttgctgtccaagggactctcaagagccttcttcaacaccacagctcagaagcatcaattcttggagttcagccttctttatggtccaattcttgcatccatacatgactcctggaaaaaccatagctttgactagatggacctttgtttttttgtttgtttgtttgtttgttttttggcatttgcttcatagaacaataatcattggtcttctgctttgtatcagaatttgtaaaacgaatcagtgtaattttgtattcagttcagttcagtcgctcagtcgtgtctagtctttgtgaccccatgtatcgcagcacgccaggcctccctgtccatcaccaactcccagagttcactcaaactcacgtccattgaggcggtgatgccatccagtcatctcatcctctgtcatctccttttcctcctgcccctagtccctcccagcatcagagtcttttccaatgagtcaactcttcgcatgaggtggccaaagacctggagtttcagctttagcatcattcattccaaagaacacccagggctattagattcagttaaattcatcaacatttattcactggccctgtctaggcactgtgctagtactctgagggtgagaaagatgagtaggacattggactattctgaaagatctgaaaaacaatatattcttgggtacaaggtggcttaaataccacattttctaattttctatttttatgactgaaaacatggcttccaggtccttctctaccaattccatgcaaccacggcaaactggttcaagtttgtattgtatttgaattgctttataatctgttgttgagtcgccaagttgtgtctgactctgcgacccattggactgcagcccagcaggctttcctgttccttgccgtctcctggagtttgcccaagttcacatctatttcattggtgatgccatccaagcatctcatcctctgtgtctattgtatagcatcattcgtagttctcaaatgttttggactcggaacctttaatagtcttaaaagctattgaggatcaaaaagaccttctaaatatatataaataaaagtcactcagtcatgtccaactcttagcaaccccaacgactgtagcctgccaggctactctccatggtattctccaggcaagaatactggagtaggttgccatgccctcctccagcagatcttcccaacccagggattgaacctgggtatcctgcattgcaagcagattctttactgtctgagccaccagggaagcccatgaatactgtagtgggtagcctatcccttctccaagggatcttcccaatacaaggatggaactggggcctcctgcatttcaggttaattctttaccatctgagctaccaggaaagcccaaaaagacctttaatttttgtgaataatgtatatcagtatataccacattaaaaatgaatactgagaaagtttcaaactatgcattcagttcagttcaatcgctcaatcccgtccgactctttgtgatcccagggactgcagcatgccaggtttccctttccatcacaaactc

SEQ ID NO: 43970 - DNA, 1531 bp, Bovine  19866880585237
aagagagtattctccttttgatactcatgttattgcttcatatggaaggaggaaggacctgagaatacagttgctctggtggtgggagtagccagtctagctggggtccttttcagtgtccctagggcctctgacttctggttgtgtgggaagtccatgccagttttatacatcttcctccacctacaaaaatatccgatgaccgttagggagcattttcctcatgagtgtatcttttggaacatgatgccaggcactgtagaaaatctgaggtaaaccacgcctcttctcttttttggaggctcctattttttactttattaaaaaataaagtaatgccaaaaaggatcatagaaactgcgatgaatttaaagttgttggatgaaatgcttcttttcaaaactgttgccagtacgtctatgaaagtttaggtataatttcatttggagatatcaaaaatctaaattggagtcttattttgaatatgaagcttatgccaaatggttctcttggatccctcatccccattattcccatgatcggtcctagaagtaactgtaagccattctgtctgcctttaagacactcaaaatcaactgggtgagcagtgttaaaaatgctaatacaggtgggtatataataaagtgcttagttggcagcagacactggatgtattttttagagttcagagaatgaagcgggttagagcagtcaagagcttgtgcatgcaagacttgggataaaaggattttaggaacaaaaacaagatactgattcctcctataagtttacatttcaagtcaaattggctctattgggcctctgagctcttctgagttcctgtgtaatttaagccctgtgttgctgtccgtttgaagctggctaatatgtgaagccacagccaccaacgatgcagatttgagagtgaacaatggactctgctcactcttcctttgagtccaggagggagctaataactttccttcccgggcatgcaaaccctagtgggggatgcccagtgtggatggctgaattgccacagacgagccttctggaggggcttctaaagacctcctgcctttgaagtgggtcaggatacctcatgtggagctgtcctaggcatggtgggaccagatccacaaaacattctcgccgtagtggggctgcgagcatttcctccagcctcctgtttggacagcaggagcccagcaggaacccggggagcacgccccatggagtcaccaagtctggaagagcagttaccacccatcgaatcctgttccccgatgtggtgctggctggagcgggaagggggctgctcatcagactgaactttcttcccttctaagagatttttttttttcttccctctttaaaccaaaggcagaatttttgtttgaaaatgatttcttagactggttttagttagaaatttccatagggaacaatggaacgatagtacatttctaatttaaaactttgcatttgttgatgaagtcatgaaaataactagactaggcaacgcaaacat

SEQ ID NO: 43971 - DNA, 781 bp, Bovine  19866880678818
atattttgaatatgaatcacatatgtgacccaaagtaaattcccattctgtccttgttgcactatggtggtgtgtgcacattgttgcactgtggtaaagaatttgctgccaatgcaagaaacctaaatgctgcaagtttgatccttgggttggggctatcccctggagtaggaaatagcaacctgttctagtattattgcctgaaaaattccacagagagaggaccccagtgggctatggtccatggggttgtaaagctggacacacctgagcacatgcactttgttgcactaaaggatagacacagagcttgaaaacactttttctctgtttcccattacatctctagatggtaggaaactgaggatgatgcaagagaattcttgtccttggagaacatcactctgtattgcaaactttgtctataggcagtttttagtaaattgtgattgaccagtaaattgagatatcaattaatgaattgctaggtcgaatgggcaagaaggggcatagcagagtacttttctgccaaaggaaacctagcttattaggcttaagcatatgcaaaacacatttgaaatgcattcaaagagcattcattcccaggtgcaataaagttctatttattctattccatttcaaaaagaaaaattttttcacaaattcctcttactaacaataaaccccattataagcaagtgtaggggaaaaaatgtttatattttcttttttgcctctttgcttttggaatgtatgagtttattcacaagttaagccaatg

SEQ ID NO: 43972 - DNA, 1365 bp, Bovine  19866880700069
gtacataatttgttatgtcagcagtgagtggtgaaagctgagcatttgtgagatgtgaagatgaaaagttagcccttacaaaattaagagaagctatttgtattagtggttaagagcatagactcagcaacaggactatctggactcaaatccccctctactgtttctttattgaataatatggggtaagttatgtctctcaattcattttgatagagtagcaactctgcataatgagttatatatttctatttattagttgactggattcatttttgcataataagaggattgttgttgcttttttcccctgaaagcaatggagattatctactaaaggatttttagcagtggaatgacatgataaatttgtctttaaaaaacatctctagcagtatggaagtcaatgagaaaaatatatgcataaaactattttatttctctgggtttgtgtgtgtcaggattacactttctattgagtcatagtggagaaaaatgagaaaatgcaaaagaaataaaagttactttatatagtcttgtggcagaaacacctccctcactaatttttaccaataaaaataactcactttggaagttccaagggattttcacattcagggggtaaaagggaaatcaactaatgctgtagtctaaattaaatgaaaattcattatacaaattatccatgaatttgaaacaggtgttcctttcctacttcaggaggtaagaaatgagaaaactgccacaaatttgttatttatttaaagtgttcttaaagtgaaggaaaagttcatccacagtgccttatttctaagtttccttctgaggaagtcttcttgaacaaagagaatttacagaatgtcagaaagaaaaaaaataaccaagaaagagatgtgtcatttataatattttcatctgccaatatggttggctaagtaatcagggaattgtgatgctggtggctccaaaggaaaattgtgatttattagttggcgccactcaaataaaggtgactctactctctttgtgactttggaaatgcccaattccatccctaaaaggaatacagggattaaaaatccaggacagctgcaggaagccttctctgagggctctcattctactgcctaaaaaagagagcacggaaaaaaaaatattttacacgaatctgttggcaagactctgccttcataaaactcagctgtttttgcattaactgtaagaacgcccatgaggtttgaataaaagcagatatttctcttttatactgacctctcttagaagacatccaagggatcaacatgttcttaaaaatctcaaactgaccacttataataacacagtttgagatatgattctctaaaa

SEQ ID NO: 43973 - DNA, 1978 bp, Bovine  19866880717120
gagacccaggttcgatccctgggttgggaaaatcccctggagaagggaaagctatccactccagtattctggccttgagaaagccatggactatataatctatggggtcgcaaagattcagacaggactgagcactttcacttcagttaatgtggctaaaggtcctgacagggtagtataatacatcggtctttattttttaaaaaaatgataacgaaaaccatgtaatctttaatttgggggagcatctaaattttctatctcatcttaagacattgctaatgaagaaaacttaaaagttgtttcaggtgttagaagtgttctgaacacaaatcaagcaatgactagcacttaattacttcatgttaaaattatcaggatgtctaaaatctattctatgcataaatgcttggatattcaatggaaactaaaatcatttaacttatgcaaaattaattacatgcactcaatttaaacaaataaaaagaataggtaattttcctcgctttttcactcagtgaggatgcagggtaaactagggtgcgagaaatgggacacacggctacatgtcccctcagtcatcccagttcgtgtatgtctctcgtaatctgagcatcccatcatgctgtgtatgattcagaggttagcaatacgtgttttcctgttagtgagtcctgtaaacaaaaattagtcttctgttctcagccaaggaatgagcaatttttcccaatactgtcatgaaaatgtggatattttggactcagtgaaaccataaattatgtctgtctcccgtgtaacaacttcttaatggaatgttcgtgttacactgattctgcaatttttgccccacatgttcatttaagaaactgacctacctataaaagaagctactgtccttaaacttactgcagccacctattatcacatggatactcataatctctcagtagtggcaagaaacattttacctcagtacaaagtagattacatttgcatatttatatctcacaaatccacaatgcattgcatactcataatgcaacttgatgtgaatatgtaaataccaagatatgtaagtatttaaatatcagaaaagatttcacatagaagtagaggatatccataatgcaacttactatctgcctaatactacagcacaatccaaaaagttagtgctacctgtcagttggaaatgcccaagaaataagcctttccccaccacactgaagaagcctgagcaggtctagcctgagtagcctggtctctgtcaagagatttccacagcagaagacagaattcaatcagaattcttcctggaaaagcccagtttgcctctaggccatcttaattcggatgaaactgaactatgatttaaaaagaaaaacacaaatatttatagagttccctactgttatggagctgtcctgattgctacagggaatagaagatgtttttacaagcgctctatattttttaaaagaaattcatgttcacacaaaaatttacaagtaaattacaggaaagttagaaagccattgcaatagggaaaagtgatgaaggcccagcgtaggatagtaaaataggaatggtgactggggctttgaaagacacctaagaaccagattagtcttagtaaataaatgcatttagagtacaagagaggagttaggtgagtcaaagttgtctcatttttaatttggagtagatgagataacattaaccaagaaagaaaacacaggaatacaaaaaggttttggtcaggagataacacattttttttactttgctgctttgatttttaagatgggatttgagggactattttttcttttttttaacattttattaattttttttggcagggagagcttccctggtggctcagctggtaaagaatctgcctgcaatgtgggagacctaggtttgatccctgggttgggaagatccccggagaagggagcagatatccactccagta

SEQ ID NO: 43974 - DNA, 1317 bp, Bovine  19866880722066
acacacacacacacacacacacacactccaattttcctgaaacacacagcatacaaaattatgatgaggtggatacagaggtatagaaactaattagcacttaggatcatgaccttaataagttactttgcataccataaaactacctatggcaatactgattcagtaagttttaataaatatatgaatataactgtgcaacgatcacctaactagtttaaaactttttggagtgccaaaaagctacctgatgcctttggcagtcagtctccactattatctccagcccctagcacttggagatctgaatttttcttcacagatttcctttctctagaaacttcatgtcaatttaattatgcactgttctttcatttagtataaactctgttttttcatgcatcagcagtagtttttcactttttatttctgaattgtagtccactgcacgaatataccacattttctttattcatttaccaattgatagatatttggattgcttccaatttgggattgttttatgaataatgcctctataaacattggtcaaaagtctttaaatgaacacaagtttgggtagatatctaggagtgaaatcacttggtcaaatggcactctatcagtaactttctaagaagttgtcatattgtttgagtcatacgtttgtaagtccttggtcatagaccgcttatggaggataacaatgatgagacagcttgctggaatacctgatgacacctgtagccatactcatctctttccaacttcacactataatatcacaagggacccggctatgacaatcactgttgtttacaaataagaaagttcaggagagtgagaacaaaataggcaacttatgaacagttcatgaggacattatctgaacactaatttttaatgattctcacagttcatcacattacatggggactctcatagagaaaagttattggaactaaggtgtgtataggtgtgcccagcttggaaatgtactttgtgctaatcagaaatatgcatcgaccatgagaccaaaagtataagattctgtactcgactagtaagaatggtttctatggcgttatttctatctgctcatcatctatatctgaaaaaaataaattttcctacagtatcttcagaatttaaaagttacatgaaaagctaaatgggcttgttcatagagggtggcaaaactgatgaagacaatgtgcagtgactttctatatgaggcagaaacatgcacaacgcataaagagaaagaaactaaaaatatcctgatgttgttataaaggaaagcagagccaaaagcaa

SEQ ID NO: 43975 - DNA, 1398 bp, Bovine  19866880775984
cttacattggaaatgagcaaggtaattaaaaaagaaaaagaatatttctaatccccgagattttcagaagagtgagctaaaccagatttgtagatcatatggttgtggatcatatggtgcttacttgggaaaaaaatacatagcagaaaagctattctttgtttcagggataaaaatgttatgtttttcatagctgacatttctgtcacacttgagttactgaagcaaacacccatttcttcattaataatgaaaggagttagcttcagagctcaactatttaagcaatacaacagacatcacttacacaggtcaattacaatttctaataattaaaaacaaggaggaaaatattcagtctcacatgacgctgtctaatttggtaattttcacacatttcaaaaccgagacttgaggttgagtgcaaagagtacacagccctggctgacacatccagagttcctgtgaatacagctggagaagtcactaacctttatcctggcactgacaccctgcttctggagagcaaacttgccttctacctacatctcagaaaactcacctgtcattattagatctttgttgtttaatgcctggtcttatttcacattggagaatcaaagagtatttgatgaataattatttgcctgttatttttttaaattcctttttcaagtttctacttttacttcctaagctggatatttacttacacagtcctttgctaattatgtaggtcatcagctgctctaacaaggcaaactgacaggtctgctcctactttaggcaaactcttcaaaaatatccctcaagtacacagaagtactgcaactcaatttttccatcttaaagagtatggcactataggaaaatgtcatcaactaatatttttatttagagttgaccttcattatttatttttatttattcctgtgtgtgcatgtatgtattctgttgctcataaagaagtcaatttgttcagctatctctggtatccagcactatggaggtaggataaggtgtcattatgtctggatgtgcctaagttttacattttcagttggctggattaccaaaactgagttgagaaggcaccctggggtttttcttattcatttgcaggttttgttcttgttatgtattttatatcctccagcctgaccctgctattttgaaaaggtcagtttgactttttgtgcattagatttctttgataatgttgctgttttgtacctttggtcactagcgatctatgggtgctgttaattatctcagaactatgagttcaccaatggaaaacaattttgaaatgtgtgtgtgtcccatacttatgtgaaacctcccacaaattcatttaactttaacttttttttctataatgggaaagattgggatttc

SEQ ID NO: 43976 - DNA, 913 bp, Bovine  19866880828359
aagaataatttgaaagagactagatacacatatatgtataactgaattcgctttgctgtacacgtgaaactgacaccgctatctatgtttcaatataaaatatttttcttaaaaaaaatgggtagcagcatcttgatgaagaatataaatcaaatgcttgtatttattggtgagttataactatcccagggattgtggaataaaacagtcttcatctctccttccaccattcaaatgcttcctttgctttgttagccctttgggaaatcacagttctctctaggttgcattttcctcctcagccaagaaaacttactaagcgattacactgccacttaatccagtataattatactaatatgtactgtaagtctactcagcaacaatgcctctctgttcagggaggtgaaagctttgtggaatctagatactatatagccaaagaagaagatactttcatcactacggagggtgaaatcgcttccagcaatggctaaaactgaggaaaatatgggctccctttcctcaagagatgacaggttaagtaagtcattactggaaaatactgaggcagattgctggatatatgccaacaagatgaaacttgttgaaatcaaggggaattttaaaaaatcttgaaacagtaatgtcgcctctctctcagtggtcaaagcgtgttttcactctcttgctctcatctgcttttctcgggcaaagagagaggtgaatcacttttgttctgctgtgattatttttacccctcaaaacatagctttagggctccattttagggcataattgcacacagagcctacttcctcaaaaggttaaaaaacaaagcagaactcctctactcacagcaaatatcaagcaggagatgagtcaggtccaagtgaaagaagaaatactaaca

SEQ ID NO: 43977 - DNA, 996 bp, Bovine  19866880840979
cccagggtgataaactatagaggtaacactttctgaggatgctttattttcctcccacaagggactcagtatttgtttagatttcacagcaaaaccatataatctgagacgctcttgtggcatttgcgtaacattggtattcacattaagagagaaagtgatgctgtgaggcacccaactactattacaccaagtatggctaagacccagagtgcagtgctgggaagaagcaacagggagttaaaataaggacacagggataaattatttgacatgatcctgagcagacctgacttttgtaatgatactcaaacagcagataaccctgaaggcaatctgacaaagaagaataaggtggtcataccagcagatatgaaaggagatgagtaagctttcctgaaatgtctgaaccactactgaaaagcatgtccttcgactgtgaccaccatttcttttttcttcttatgcctactgccttccggctaatgtaaggattcacttttgcttatctgctttaacacagaagaaccctagtgaggataaagttataaggattggaagggatagggaaacaaagatgtgtacaaaaatagcaatggaagtttcagaataataacataagaaggtccatggttttctgattttatccaaataaatattaatttcaaaataatatctgacttgaacttgagagggagaagatgaaaatgttcctcacttagcctctgattcagtatgctgtttttggttgagtatagacagtaaagcataggagcagttcagttaagatatttaaagatgtcttaaaggactaataaagctcatgcttttaggacctactcagtaagtcggtgaggggagaatgttgggcacttcagcaagtgaccaccaccaacaaattttgcctaagtagtagatgttatgtggtagattccccaccaatctttcaaacagttcaattaggtgttattataaagtcaagctaacatgaagcat

SEQ ID NO: 43978 - DNA, 1777 bp, Bovine  19866880914172
tgattgcatggatattattactaatcccgttgcatatgacaagttaagggaagctagaagcatttgcttttgtgcatcaggagtaaagagaaagaatgccaggggtcagagattggcttatcctgtttggtcagggacaagtcagggataattaattagaattatagatactaggaggttggaaagacctactgtgtttcactccttctaaccaaggtttgttcttaccctcaggactgtgtgtgtgtgtgtttctgtatctgtcttttgggtttaaccaagacactgaggaaaaacctggaataagtttgttccctgtctgactcagcatttatgaagtgaggaaatgaaagggagagggaggattcatttgattcattaagactatccagtatcttaggtgatacattaaaaataagtgctgtcagatgtaatatgacatagaaatttctaatttagcctacttatgtactaaatttatatttcatatatctgttgtgctggtttcccactttatatttaccagcaaggtatgttgagcagagtgtgggctttgatatcagataattttgaggtcaagcactgggaagtccttcttagtattaagaagggcaagccacagataagccttggcctcactgagctttgatttttctcatttataagcaaaagtaatactgtccatttcataggactggtttagtggctagagattatatatgaaaagtatctgtcttaggaactagcgtttactggatgcccagtggatattgttgctgttgtcgtctctactattgttatacgagcaagaggatctttggagaaaggatagttgtctggggaaagactcacgggggatcttatgacagagtctctttcagatatcttgctcttgtaacaaattacatctgtgccttttctccaggtgaatcatgcacatccagcctggccagctgcttataacctcgctcctctttcactttcactaagtgttcagtaataaaaataagatgacagtttgccacttccaagtgtggtgactcagccctcagggttgcttgtgaagtcacttacctttccctcactttgtgccatacgacattgaaggaagggtgttaggtgacataaacaattcttttccttatcctgaaatttaaaaaaaagttatttttccaagtatcacaccttttctgtgaaataatattttttcttttatttttaccaaataattaaaaggcaattagacaggtatctatgaattattattaacatcaacattcaaatatatttctgtctaattaaatatgttaaatatctacaaattcaggactgttgtagatgtaggctttataacaggcacaataatagtcaaagttatttcagtaatgaagtagaaataggaggaatttgtgtgtaagaagatgatattttttaaagagtttagtagtaagggaaacaaaaggctaggaagctaaccaagaatgccaaatgattgttttcagttagatgaaaatataaaatatgtcctttaaaatgaagacatattttattctgttattttttttttgacatgtgtcatttttccagggcaagtgtttgaatattttagtttcttttagaatgtaacagctgctaataatttctgaagtttgaaactggtggccagtcatcaggtattgagttgagctgaaactttcatagttgtcagcattttttattcctcttatccctgtaagtgaacatttttgcagaaagtccagtatcacactatcactgg

SEQ ID NO: 43979 - DNA, 1545 bp, Bovine  19866880950117
ctaaaaagttatgctgtactaaaaataggagatatttaaaaatctccagtagtagctagcattcaaaatgttacattaatttgaaattaatttcagtcacataaaaaactaaagaactgttgcacagctaggttgtattatttccatcagactatattcaaggtgtaggaaagcaaacacatggctccatgcagttatttctctaaaatacctttcgcttgaaattattagcatatatggccaattctaatagctgcttagagaactcaaaatgtcatgacatccctcttgttgtagcatatattttgtttttgtttcacagaatacaattattaaaaatagaaatattcagagctaacatcctccatgagagatggccattacatatttgtttttaatagtcatagaattttagatttgcaaagaatttccaattttacttgtagttattcctctgcttttaaataagacaacattttgatcatttggaagaacttaatcttttcttaaaattctcctgagatccatactttgttttggcagtttccaaccaacacatcaagttgtgctggcaggttctgcacacggaatggcctgtgcccattgcagtgccctaaattgtaagcccaggtatgggatgggatctgggagcgtgcttgggagaagtgatttttttttttctgtacagtaccttcccttaccaaacctgataaaacttaatggaaatgagaaggtctccttttcttaaagaaagcaatattgggaggacccctgttttatgttaccactgggtgatttcactttctccaaacttaggtattatatctttatatatatcccttctaaattctttggactccaacttcccagaagaacagggaagagctgctctctatcgctgatagcacagctctctgtgtacttgaggacttcaggctcgtggctgatctgctgtgacactggtaatgagtgccttgttgggggctactcaagtaagtgagggataagatgactggctgtttatcaaagactcctcaagtctgatgctcatactcactggcttaagagcccaagaatgaacaaagaagatgggagagttggtaggaaaatgttggagatagcagagatgaggtgctaaggactgggtggagatatcatttgccagtcaggatggccttgggtgattatgtgtctgtataggggaaagtgatgtatctgtataggggatcgtagagaaagggaggagagatagaaaaagacaaatactaaatactttcataatgatggaaatttttaaaaagttagagtaaaggctagctaaatctattgatactcaaacgcagtaattagatttagtctctctatatatcgcgcgcgtgctctctctctctctatacacacacacacacacacacacactgtatatagatagatatatgtagttttagaacttcatttcatgtgtatgtatttcctttgaacctgctgcataccatgtattggattagtcactgggaatacaaagacaagtaagccatagtctta

SEQ ID NO: 43980 - DNA, 3317 bp, Bovine  19866880960552
gacccctgctttttacaagatgtgtgatttcctgccacctgacccctgacctcatttctctgctcatacctaggtacctgcctgctgtaacactaaacttgtctgacgtggtttatataatatataaaataactggcataatttctggcacattatcagaaccccctatgtggtagttataataattattattataataataatatattacccggctactcctgttacttcctagtccctagactaagctgctcagagatttaaaaaaaaaaaaaaaaacaaaaaaacctcttaaaagactcaaagtctactgaggaaaacttgaaagagcatcaaaacccaaaatatagtacggtaagtgctgttcgccttcaagaaagtggagcatagtaagaacccgatgagtgatggttggcaatagaactgccaatgtcattaccaacttaattgaaactatttacaaatcaggggattttgtccttgctattaatgattttttttagttttttgattattttttaatttacttcttttaagagttgtgtgtccctttgtaaagctaagcataggggagttgttctgactttggacttgagcatcaaaaacttagaggataccactgatctcagaaatgttgccttatcctgaaattagaaggaatctcttagcataagtaatgtgtgtggggacccaggcattcatgtgaatatttagagactgaatactaatcacctttgtagaaatgaatttcaaaagtttagagatcataaatattttcctatcattcctataatgaggcaattttcccaacttcagagctttaacatatagtattttaagattaaagaaaatgctataagacacagaggagcaattttcagaagactcaaaactcctgaggtataggagtgattgcaatctggaccacaataaaatttattaacctcaaagttaggttaataaattaggagttaggagtcaggattagcaactggagtttgaaaaaggatgcagcacttatatttactttctccatcactttgatgggtctggcaaagcttaaaatgtgtgtgtttctcaggatatcactttttcacactttctgagaattagaagttaagatagtttgagacttgggctgatttaaagagaaagggaatctggtattgttctttatcttcatcaaacacaagtttgagtaactgggaatggacaggaaatgaagtccttacaggtggacataaataacaaacaaacgaagaatttaagcatggataagaaatgggaatacttaggaatcaaaaactgagatagaagaaggtaagtgtgaatatatgaaataaagaaaacagacatcaatgtaatctttttaaagaaacaaagactaagctgaaatagtcttaatatagtccccttcgttgtttttctctcttagtttctagacaagaaaaagtccgctgttagctgcttacttgcttctttgttttatggctgggggactgggggatagaaagatgaaaacccacccaaggtgaggtatccatgaggggctgagcagggtctcagaccccagaatgacgggagtctgttacactgcctgccctctctgagttttaattatgtctttttcaaaatttggggaaatgtagcaaataaaatgtgcagaataaatgcttcctttctcaagtttttatacggtaacctcctttttaatctgacttgcagtaaataaatattcatctcactttactggttttctctgaggctggagttcatttaaggttcaattttaggaagttggatttttaataagattcctttaaatggtttccatatttagccaatcttgcagttctcaacagtacatggaagagcaagcagggagcttaagaaaaaaattagcttctttaactactagatgaaaccgaaatttgggctctctgactcctaagaggctgaagttgtgtttggcaatctaaatttatcaatagcctaacataccactcttcaaaaaggacttctttagctttcttatgatagtaatgtttcttaagttatcaggaatggtcttttccctctaagtgttttcagcttatagctcttttctgaaatgcattaatttcaatcctgtgccactgctgcatattaacttatacatacgaaaaacaacatcaaatatggaagaattcgttcatgaccctgttttaaaaagacaaatctgggtgtagtttttaaaactgcgcaaaacttggccatttttatagtacatgtgtgatgccatcccttgtttttctctactggatacttcaacaaaattaagaatgttatttttctttggattgttacttgaattctgcgaggcagtcaataccgagccctgtaactgctgatggtgtagataggaaggtgggcaggggaaggaaggtgggcaggaagcagaaggatagcaggaaacattttatgatttatacaactcttatgaaaaatgttctctttacttacggcatagtgttactattattatcacttggagggcctgaggcatgggccacacacatcatctggctaaaaataattctgcagcctgtctgggtgtcattatggtgtttgtttcataacaactgcctatgaatctttattaaaattcaagtgggttgcgacttgctgccaacagtgggggcccgtatataactaagagggcatggtctgtctctgggaaggctctggcaggatcagagcagggtgcgtccaaaactggctctctgcaaagatgcccagaccagagactctgaaagagacaggaagagaccattaacacgtgtttctcacaaataagatatgtgatattgagttcactcacagaatgaaaaggggtagacctgccaggctaacaacctagttgagagcgagttgccacttcttcccttgctgactgacctggggagtgagtgttaagggtcagggacttttctaaagatttctacaagcatgaaagcaacgatttagccttttgggtagatatattatgaaatggtgggatttcaatggtggtataataatctttataattgtttttgttctttcatgtattaagatacaaccagggtttatgacaaaatcttcataaaaatataggtaataatcaagagtgaggttcacagatttaacatctgaactgtatattatttttgcaagtttttttttttttttctggattaaaatactccgagaaaactactatgaaaacatgggcatagaactgcttgtgaggaaaaaatacataatcttagtattaaaattaaatatgttaaaaggaa

SEQ ID NO: 43981 - DNA, 961 bp, Bovine  19866880976506
aaactctggattgtaaacaaacagtaggattttccacagtggaacagagaataatgagatgaaggatgcagaagagaaggggtaggtaaggccgcacctagttcaccagagaaattaatgagctgaaaactctcagacgctctcctgataaactcccagatttctcaatttttaaagtccatgaactgcatgcagctcttccctccttttctttcctacacttttaaatttccatatcattgcttgtttttctttcctttcttttcttagtccctcttgatatttgaaatagtaggtcaaatttggacgtctagtaggtggatgctgttttagtagtaggggggaagtagttgctcaaattccctggtttgcagagccttcatatgatttcatggatttcacaaatctttctagattcagtttggttcagttcagtcactcagtcatgtctgactctacgaccccatgaactacagcatgccaggcctccctgtccatcaccagttcccggagtttactgaaactcatgtccattgagtcagtgatgccactcaaccatctcatcctctgttgtccccttctcctcctgccttcaatctttcccaacattagggtcttttccagggagtcagttcttcacatcaggtggtcaaagtattggagtttcagcttaagtatcagtccttccaatgaatattccagactgattttctttaggattgactggtttggtctttttcagtccaagagattctcgagtcttctcccaacaccatagttcaaaagcattaatccttcgctgctcagctttctttatagtctaactctcacatccatacatgactactagaaaaaccatagccttgactagacggacctttgttgacaaagtaatgtctctgctttttaatatgctgtctaggttggtcataactttccttccaaggagtaagctagatta

SEQ ID NO: 43982 - DNA, 795 bp, Bovine  19866881021087
aatatgaaaggtccgatacagtcccaggttctttcccttcctactatcacatctcaagttgctgttacagtgaagtcaaatgttgtgttaaactgtgatgaacttgctttgagatgctctttcaatgtagtgtctccttccagtttgaagctattatccctcaaagtcctcaaagggcaaaagataatgagtcatcttcagagccctagagactgacaggaaagctgtcctcctcataaatgatattagtaagaaacctctacgttgaaggaggaagggtaggtaggggaaaaggagaaacacaacccctcataccgtgtaatttccaaatgaattcatacatgaaccaaagtaatatacctaaaagcgaaacaaagtcactacaaatgctgtaaaaataactggcgttgaggaagataaggatgctgctgcctattgatctgaatcccttttgcctgttggttctcacttgacactacaccatggcatttccttttgtgacccctgggtcttgatctgaaaacctaaacagtcatttctcaccgagtggggagagagcagttgtgttaacatctgttttttaggtcttttatttttaagttcttgttgaaaactccttgatctgcctaccagggaattgaagcacattccatgtgcctgccgcctagctctcttttctctttatttggtctacagaatattgatttagattttggcctattcgcattgctttaaacttttaaacactggctcttatagctagaggaaacactttgctgaagctaaaatgatcac

SEQ ID NO: 43983 - DNA, 1819 bp, Bovine  19866881089348
agggctgtttgttttacctgaggtcctcactccaggcctcaggaccttcctttattctatttttgtgggcttttcccttctttgtcttttagccaccgccattttggactcttttatcatcttctaactacctaacagatctaaagtaccatcatatattttattttaatcagctcacaaatcttccccaaagtttttgtgatgacagcattatgagacattttaacaagcacacacacaacatgctaattgctatatatgcagagcatcataactgttggcctagcctgcctcctcaaactttatgactcctgtgaatatactcaatgaaagccaatttcagaacctatgtcttgccttgtgtattcttcaaatgcagcaagtttaaatatgaataactgacatgttttgttctttttgtaatatgtgctgagtatctactctaacctgttaactctactagaagcccagttaactctactagacaccagaaatacagtggtgaggaaaacaatcttttctcaaagatcttacattctgttgtaaagagttaaaagatgcaacaaaattaacaaaatgaggaaaactggcaaaagcactaagagaaaatatgggctgtaataagaataacaaaaggagtggggcagggtgggggctggagatgcattgggtctgactgaatcagaaaagatttcctgaagaggggacatttacgctaaaatctaaaaacgatgcaatgcttagattgacaggcatttggggaatatgatcctctgaagcagtaaagagcttgccttgttaaggagttgaaacaagaccaggatggctgaggcctagcagacaggccatgataaaacatgagggtttttcctagagcattgagaagcaattgaagatagttagagaaatgatttacatggcctagttacatctggtatatttttcttagttcctaaagcaaagtaattaaatattgctaacttaaattttatttgccctgaagttttccatgatgcatttgaaataaagttttcaccaaccttcattgtttgaacatgttaatgctacagcgaaacttgatttgcttgactgtcttccaaagatcagtccttactgatctctcataaaactcagaaccacttaagcatcctagctcaaagccctgttttccctctatcgtcttcatgaccatggagacctacagttcccagacgttcatatgacaaagggcattaatcatctgcttcaaagggctccatttgttgtgttggcagctttcattctttctgctccctaatgaggctcagtcccactcactgacatcctacaatagtcagacgaaccaccatctcaagttctgccaggaatcaaaaataacataaactgcattctatgctgggtatctatatttaatgataatgtattaatataatgtctctggtggtattttttcaaaatttgtttctccatttccccttcatctggaaaaatgcctcctaaccattgtctatatagcttgtctgaagaatcgaaatgcttattccccctgtaatacctatattataattagcacacagaaatcctttaaaagttcctgattttaattaccacctagaaagagagtggtcctcataattgttcagtagagttctctataccacccccaactgggaacagatgcagctaatgtgattctgcaaatgaactcacagaaatcctggtgcttcctcaagggagcaggattcttttcccaaggtacaggatacttcagaaaagggatagaagagacaccttcttcaacatgcatttataccttctg

SEQ ID NO: 43984 - DNA, 1214 bp, Bovine  19866881094001
ctagtattaaatttcttctttctgttcttggacaagtcttttctaaaccaaagtcaaagagcaatggaaaggctctgccacttctagttattagggcttttctcaaaacaccctggtttctcataaccaccagggctgctaactacattgtccatactgcctggcaaacacaccccattatctaaatatttctacctatctttgccttccattcatgggaatacgttcttcctttcttcttttcactcagggcccctaaggtaagatagctaatgtgataaactagtgaatcagcacaattacatgaatgtatggcctttcctcaaggatagtatggacattttaataaaacttttccagatttcatgacaagagggtggtaagaataacttgctaggagaagaaaaaagaggtctaccgactgcctaaatgtaaaaccagccccatgtatgaccatccagatctagacaggcacattgctcagctgttggttgagttagcaggatgctgggagccctgccccggagacacagatagaagaggctgagtcctaaattactgcatgaaacagaattccatgtagtgccctcccccagttcaccagtgtccacaccgctacctcactctggcctgtgaggtgagtgagaactgaagagaagttctcctgtaggcactgaagacgcagactgccaggttgtgaagagagccgcacgcagaggatggcaggcagcctgcgggtgctgccactgcctccagcttacagccagcaagagaagaggggcctgcttctatcgccatgaagaaataagttctgccaacaactggtgagcttggccaaaggctgtgtcagaggcatttgcagctctcaccaaaccctcagtttcagcctggtggacagagaatgcgtctacgccatgtgccgactctggccttcagaaccgtgagataagctgcttgtactgtctaagctgctaattttgtaggattctggcagcaatagaaaactagtagagtagctaagcaggcttcctaggtggttcagtggtaaagattccacctgccactgcaggagatgcgggttcgatccctgggtcaagaagaccttctggagaaggaaatggcaacccactccagtattcttccctggaaaatcccagggacagaggagcctggcgagttatagtccatggggtcgcaagtgtcagacattattt

SEQ ID NO: 43985 - DNA, 1016 bp, Bovine  19866881109144
ttgtgtctatgaagagaaaaaggctacatggtctggggctttggaatcccacaatatttgcatataaaataataaacacgttagatcacttttatttgggatgatgaatctttcattgcataagaactgtctcagaaaaacgcccccatgctatgttctgattttaatggctaaatatttttttatgaggactcgatatttccacgtctgtttatccgacatcatttgtaggtacaaagagagaataatcacaactagaaacaatgcagccttctccactgcacttattaactctctttggtattgatgagaatggagtgttcaatcatatattttggtagtgagttatggttaataatatcacaagtaccgtgatgacattatagaactaaatcttatttctaacaagtggtgaagcttagttaaatgccctgtcaataatgttgtcaattaactgtcaattactagagccaaggtaaaggcaagttgtttgtttctcagcaaacagttcacagagaagattgttgcaattatcaatctctcacgtcctactacattaagtgtcttactagaggttgaagagtcattaatatcttacatagtcgaggctttgccacaattgtttaatagctattttgcaattataagcagaacactagttaaactaaattagagttcataattatttttgtaatgaattggaaatataaaaatacatgtaactctctggaagtccaagcatacttagttctccttagcctcccatggagtgaagggttaatatattaagaaatgcagtataattgcattaattgctgtgtattggttctcaataagtgagacttgttttaattttgaatcccaaatgggcagtacctctgtgtgattctcttagaactctagaaggtacattttttatttctcatgtaccaacatactatggatttacatatctctaacaagtggacttttacagaattaagtatactaagaaacaataaagcatttggatttag

SEQ ID NO: 43986 - DNA, 1595 bp, Bovine  19866881121336
tctttcatttatcctatatgatttctttttaaatactaggaaccagcaattatccactttatatatatacttttaacgttttagttcaaaatgtcaagttatattctggcctttaacaaacacttctgtatttggtatctttatcaaacataattcatgagtatctcttgtatttttctaggtttctgatgaaaatggaaacctgaattctgaacttattgtgatggtcagtttttcaaagggagtgtagtcagagggattagaaagagtaaatttttccagttgtgaggagcttaatgatatttttaggccatgtcttatgataagtggcatagcttatcattgagagggacagaacttggaaaagcaatatggtcattttaagtcatcagctgtacagaacctttgtgtgcaagaaatttatttatgttttgaacacctagaattcatagatgctcttgactggtcagtattctgtgatcccacattagttaccttggacttcttagacagataaagaagagaggattatttttactgattaggtggatgcaaagccttggggacaaatggatggtgatctagtactttatatgtcaactttttttaaagtttagaaatgaaaacactgatgaatgaagaatcaagaaagaaagataaattgcaggcacctctttctcccagatagtaacgcggttaaacatggcccattagtttccatcctgaaggtagtattgatgatgtaatactcctgtgaaagtagacgtcaaatttaacacattttactcattcactatgatcaatttatcaatatgaatgagaatatcagagaacctatcacagaaatatgcatgctttggaacctagtcatatgccttgatgttgatgtagaaaatgagtttggtgggctagctcaagagattctgaatgaaggtgcaaaataaagattccaaaataagcaagagatactttcagttgaaagcattatagagtccaaaattccaagtaaagaaataattctatatttgcttcagagagacactatttatctctgttgcccaacatactttgaaacaactatttggttttaatggatatatatcttgccactctgccatcagtaatttgaacagcttgaaatactgtatgtcatcttacactgctttctctttgaagaaaacacaatcactggattgtttttcattgatttaaaaacattgacttgctgaagtatgagcctgtgtgcagtcataattcttgtcttttcttcctcggcaaagcctatgataattctttgagtttcaagcaggtgtcacgcatcagatccaagtgcttaataaatgcaccagaagtatatttttcttaaggccttgtgtttatcccatttccatttatcttgtgaaatgtcttcaaatgcttttataaaatcctgggaaagagcaggttagcatttccacttggcaagcagagctagtatgtgtaaggctctcctgtcgattttgaccttaaccaatgttggtaattcctagcctgtgtgccaatggactgtgaggagtgatggagttatgggatggggcccaccaatccatatatac

SEQ ID NO: 43987 - DNA, 1648 bp, Bovine  19866881128552
cataactcgcagcttcaatgtcaaggccttttcagtaaactcgggtgatttcactgtcttaggggaaacacaaagcaaacctttttccttcactcaagaaaaaaattaacttagtgcacaggttagaaatagggcttccaattatttttatgttatttatatacagaatcaacaatgtttagccaaaagttcatatgcaaagaaatgcatgctattttttgaaatctgagtacaaattttctagtattaacaaaaaaaatttacttgacctgatatgaaattcttactaaaatcacgtctacaaaagactgttggctactcactgctttgttccatcctattcaaaggctcccatcaatgctacatctatacctattgagagaacaatgaactgtcagctactgttctaatgcaccacattatctccattgaccagctcactgcagaatcttggcaaggattctttccattagaaagctaacttattgcatatatttatgttttatttatgtctattggacaaaagattattaaacagaatggatgttaagattacattaaaacatctgacagaaggtagaacttcagggtgaaaacttaacccctccctttaaactcaactcatcagagatccctatgatgatccccgaatagacagagcctactagctcagttgagtgcatttgttggacaggagcagagggtgaaggacttcgagaaaaaccttgggctccttttaaggagtatgataaacaacagtattttgttttgtttcaacacactgctagtgtttctgctgttctaaaatctgcctgtgccgtgagagtcctggaggtgacctgctgcctgtgaggcaccctgcctgattggcatcgactcccggtgacctccctgcaggcaaagccccgaggacagcctcctggaggcagaggtagagtttaaaacacaggtcgcgcctgtatgatatttttaaattgtcagagttaggagacagagaagcaaaatcattactaacatgattcatgtttttcccgaagcgcctcaagggtctccagaaatatttagcaacactcccaccgcttttgtattatttagatttattttactaagaataaagtcatttctttccagcccacaagtccaaagtttctcattatcctccaagcaatcacatgacagatgttaatggcttccctgtgctaaagaatgtcaactgtcatactctagggagattttacattgtggtcaaaatacgaaaagtattgtcatctaaacatggcaaaaggcttgactcggctatctcatctaaagatctggttcttaacaattgagagtgatgtagaaggatgtgatgtatctgagatattagggaaaacatgaattatttttcttctggtatttttgtgattcaaaaaagagcagtgtatatggagggagatattattttatagttgtgattattgttcttatatgtttgggtagttccttgggctttttcttcctcagctgtatgcaaacatatgcctaaaaatacaagacatttcagataagggttattctaacaaagcacacaaaggaacttttttttcccttcagaaatcatatctctgacaagagtctgacaaatgtctggagaacacagaggata

SEQ ID NO: 43988 - DNA, 2260 bp, Bovine  19866881185958
cttgaaggtttttcttttagatgttatacgtaaaatgttgaatggtggctcagagtataaagagtctgcctgcaatgtgggagactcaggttcgatccctgggttgggaagatcccctggagaaggaaatggcaaccccccccgagtattcttacctagagaatgtcaaggatggagcctggcaggctacacaactgagtgacttcactttgttttgttttgttttgtagccagtgttatcttaaaattttccaaagtagttttaatattagagagccaaactacaaaaaaaatcataaactattaaactacttgcaagtcataggctattacaacttgaaagagtttttgtactcattcagtcctgtccacacattgttagaactgggaatctgagggtccataaagttctttttctcaactcacataggtggtcagaatcagaaccaggatgaagatttaagtcttgtggcacccagtgtgctgattgtgtttatttctcaattacgaaagaagacaatttctaggacaaagtcactatctttttctttgagggggatatttttctgagcacattgcattccaatgatgttcattatgctcacacatggaaacttgggtaaaatgtgcacatgcacacacatacaggtctttaattgaagtcatttccaaatattttttgaggcaattaggtcacagttgtgggtatgcgagggaagatccgtgagtagcaaaaaatctaaatagcttggtgatagctgaaagattgtattggtgagcaatgatgtttttgttaattggagatactaggtcttctctgattccactagaaaataccaatgaaagagttttaataaggtattatgggaataggaaaatatatgaatttgacttattccatgtcctgtgggcagtttttaacattctcaaatgctcaacatctttatctactagactagatctactttcaacagttaaagccagataagattaagaaaaaagtttcctgagatgttcacaagtgtagaaaggagctatggatattttcaataaaagaagtcagtctctttgagttctgtaagagagaagagtaatgccaaatatcttcacaggattttccagtaaccttccatgccagagagttgtagaatactttaaattgctccatctacttctttttttcctcatggaatcaggctatataacatcaaaaactgaaactgaaagctgctcagtcgtgtctgactgagacaccagaaactatacagtccatggaattctccaggccacaatactggagtgggtagcctgtccctgctgcagtggatcttcctgacccaggaattgaactggggtctcctgcattgcaggtggattctttaccaactgaactagcagaaaagcttctaatctagactttaataagtttattttactccttatgaacttggataattcatattttattggttgttttgagggtttctgagaaacaatttcatgtttctgctagttacattttcattttcttcaggtaattgaatgctaccctgatcatggcaagttaccatatttccccaaagagtaggcatttctcagaggatgttttctcagaggatattcccctcttggaatacttttcttctagttcatagcttcagcgatgatcatccttgttgtgtcattgaacatttaccacacacatctggtcccataccaaattctcactaagtacttgtgaaattgatgagctttgctggactgtttttttctgtccaactgttcacttcgttttgactgcaaatcaacagttactgtgacggcaccagtaagttacagatcacctaccattcagttcatcctgtgcatattgccctaaggattaattaataggaagtgaccttcactgtaatgcttactttagtgttcttgactatcattatcatcagaggaggctcagaagcataatttagagatgtacactagagggtggtgttttacctggacactagactcatcaatgcatcggctttgaggaagaatgaaaaatgtctccaggaaatgttccccatgtttaatgttacataattctcagcacatatgccccattaacaaagttgataaactccagggaatggaagcagagactgagtcacttggcggccttgctatcccatttcttcaacacattcctgtaggtgtttggttttcctgagctccacatgcagagtgtcacttgaaaaccaacactgatcactgg

SEQ ID NO: 43989 - DNA, 722 bp, Bovine  19866881338196
aaacagactcctggccctgccaagtctaacataaagagagaacccagaactccacacaggtttctcatttatagcataatttcctccaaagacagctatttaaaaatgtagattaacccttaatgtctgaattctccagattgaaactttgaaacaatgcagtcccatctgccacattgaaaacccaggtggcaaaggagttgcccaggctttccccagtgagggccagagcccggcctactgactgtccacacaggagggagcaccacgctgcatgcttggtggtcctcccatggagaggcaaccgttgtgttcttaggctataaattataatcagctgataaaagaagaaaggaagtcatgatgtgtcttctcaaaaaaaagtactaaggcgtatgtgtatcattaacacctaagtgaaacaattcaaagtagtaactcctttaaagtgattgccaggcattcaccagactattcttaagggtttaaatatgaatatatgcaacaaatgacttcacattcaccccaaaatggaattatacatttctgtatctagtctgtataactttcgcttaagagaaaagtgatcattcaaaaggctgcaaaatgttaacctgagtgtgtgtgtgtacacatgtgtgtgaatgctttgtgtgtgcatgcacacttacctgtacaatgtcatttcaaattagtagtaggtagtggtcattcagtcatgt

SEQ ID NO: 43990 - DNA, 1023 bp, Bovine  19866881375597
aactaaagagcctcttgatgaaagatccaaccagtccattctaaaggagatcagtcctgaatattcattggaaggactgatgttgaagctgaaactccaatactttggccacctgatgcaaaaagctgactcatttgaaaagaccctgatgcagggaaagattgaaggcaggaggagaaggggacaacagaggatgagatggttgaatgacatcaccaactcaatgggtaagtgtttgagtaaactctgggagttggtgatggacagggagacctggtgtgctgcaatccatggggtcaccaagagttggacacaactgagcgactgaactgaactgaactgatgatttctctcacccttctcaaactcataccaaaatacacatgggtgcaagtgatatcattttataaaaaactatgaatcctcattaatttgaaaagcaatgtcatttccaactttacatctttgactattgttaacaacagaatacttcctagatgcctcaaaataataccagcattctagtggtagtggtttagttgctgaattgtgtctgacttttgtgatcccatggactgtagcccaccaggcttctctgaccatgggatttttcagggaagaatactggagtggtttgccatttccttctccaggagatcttcccgacccagggatcaaacccaggtctcctgctttgcaagcagaatctttaccaactgcctgtggttgggggtcagggaagccctgacctcatttggaagatttcatgggtcagtgagctccttgaggttccagcactggtccctacttagtcccagcacagggcctgaggaggacattgaatattgccagcattcaacagttgtgggtggaactcaactcagcatccactgggtggccctactattaaggaatggtttctcctcactagttgcaaacaagaactgccaaacacaatttgttcctccagactagctgtcagcacttttaatccatattaaaataagcatgcttacaaaggaa

SEQ ID NO: 43991 - DNA, 1519 bp, Bovine  19866881541999
cctgcctggagaatcccatggatagaggagcctggtaggctacagtccatagggttgcaaacagttagagatgatttagcgactaacacttatacatgtgagaaagaaatgccgtgaactgtatttccttgattctctatttgataaaaagctagtgttgcaataaaatgggtaaaacctcagtttaaaaacaagaaagaactgagcaaatctagaaacaccatcaaatatttttgaacttaaaaaagtcagttccggttgtggatgtatatcgtattcatttggcgttttaaactaactgcaaaggtaatttgtaacatttcaaaatagcttttgagttctgttgcctcacttggattatttcttttaagaaacagactggcagcatgttctttttgatgctgagctaaactggatcaaagtttcagtcccaatgtttaaaatgctacatgtgctctgaagagagactagagaccagacacgcattcaggtgaggcttcaatggcatccaaactctcaaactctcttaattgaaaatagcttttgttttttgcctttggtaaagtttcatatgctgcattaagcaatattttgcagtagtaagagttaaaatagtttaatacatatcaaatatgaaataaaactagtcagttagtagcaagatgagagcattaaaaacaggcaatgaagaacaaattatagatagttctctactagtcaagacaacctctgctcctcctccctttttctttccttcacaaacaccagagatcctatgagctataaggagaattcagttaagttgagaatatctaataataggaaattccaaggtatcctctattacatattctgtggcagtgaaagagcaacatgataatgagaaagcagatggttcagagccacagtatacacattgttcttgtaactttcatatgtccaatttcaaaatacttggttaatgacaagtaagatgtacagttctatagttaagtccaaaaatcaagaaatattgcccacttagaaaacttgatttatgcccagaataaatcaaattgcaaatacatataaatgaatagtggggaaggaaatggcaacccactccaatattcttgcctggagaatcccagggacagaaaagcctggtggactactgtccatgaggtcacaaagagttggacatgactcagtgactaaataaaatgataaatgaataaattaaaattttagccttaatgaattcacagatttgactagtttatgcatttatccattcattcaatcatccatgcaacagagttactgatccctctacaaaaaaaaaaaaaattagtcctgtttaggataatccgtttccctacaaaatgactatccattttttaaggtatagtaaatgaataatttttgaaagtttggaaaatctttaaactctgttgcacagtttagaaaaatatcatttatttttgctttcttaaatctgtaactccaacaaaactaagttagtaagcagatatttttc

SEQ ID NO: 43992 - DNA, 960 bp, Bovine  19866881624825
caaaattacagctcccatggtaagaaatgctgtcaacatggtaatgacttgtttaaacatttattaaatcacttcacagcaaatagtaacacatgaagtgttatcctcacatttcacagcgacatcactcctaagcagaaaaaacgctagccaaactgttttaaaatcttcatcaagatattatgtagttaattttgaggggctggattattcttgtttgttcacaaacaaccttttaataaatttggcaagcaaatgcaagcatggatgcattattattgctgaaaaaataaatgtctaaaaatcagaaaattcaatattggaatacccacaacacaatggttttcatcttctctatgcatttgtcagccttcttctatttcactttgactttctgtgatcatggattataataaagttactattaatgacagactcacaatatcacaatttgtaacctataacttgtgtgaatactcaatcttatgtttctctttttcatccttttaaaaatgtttactccaaagaaaataacaaagaaaaggaatgagtactttttaaaaacacactctcattggtcatttctaaaacactactcattctcttggtaaacagagatatattaatctaaaggtatatgtacatacatataaatactttttacatagaatattgctgaattggtttagttagcatttcagaataggtcaaaggaagttattgacaattaacattttttatgtccatttattacttgaaccatttatttttgtattaacaaaaagaccattaaaagttcactgatttaacaaagaaattaagatctgtaaaggtagttccaagctagtgtgacatctccatgaagttggagacccaaacccttccttaatgtttccttatcactcattagaacattgtccgtctacggttgaagagggctcaccactgcccactgttgtc

SEQ ID NO: 43993 - DNA, 737 bp, Bovine  19866880396544
accaggctcctctgtccatgggattctccaggcaagaatactggagtgggttgccatttccttctccaggggaacttcccgacccagggatcgaacccaggtctcccgcattgcaggcagacgctttaacctctgagccaccaagggaagaacatgtatgactatatgtgtatacaaatccacgaacatatccgtatgtgtatataaatccacttatgtatctataaagtatcaattttattgaagtctgaatgcattggggattctaacatgacatggttttatttttcactaatcactgttctaaactgttatgtcagaggcccctttgggcatatcccattagtttctgttaaaaatgtagctatttaaaaaggaattagttcagcccactttgaaagtctaaccccaaaactattacagatctcctctccttttctctgcagcacaggcttagtctatatttcaagagacttgcagaagtgaaatcaagtgggtttctcctttaattcattttcctcctttctctcctgggtcagactctgggacaccttctctccctcagccccatccaattctgggtctgtagatcctctggaaaaggaaagaggggagaaggtaggggtcctgactgcctgtctatagtcagaggcatctttgatctctggcttggtctggttttgtctgccactggtagcctgtgctcatgggatagtctcttcatggtttcaggaggt

SEQ ID NO: 43994 - DNA, 1131 bp, Bovine  19866880407750
ggtcttggccttataatgtttccctttacagttttaatctaacaagaaggaaactgatggggcaaaaaaaaaaaaacctaaaaatgaactgacacttgtaggctaggagcatctttataacaattgaaatcctgaccactgactgcttttacatttagctggtgaaaaaatgcataaccagtttagacatctcccaacttagtatgtagaagatctagacactctgtgatgggctgtggcctgttccctctttgccttgtcccctgagtcaacatgggtcagatcatacatgtttgtgagttgactgatgtgtgatgcatgttgtttgcaaggctctcccttcctcctgacatatgctgttggcacagcccccgcccgggtaacatttgatcttcatggcacttgtgaagtctcaactgtttaatcagtttaaatactcagccttccacttcagtcaagaagcattttaaagcagcgcttcaactgaacacttcattaatgtaatttagttaagaaaaacaagttccgtcagttttttcctaaaaggatgtcccagtgtatccttttcatttcctatctcgtatcttgtctatctgaatgtattatagggctggaatgtgattgcctattcagaacgacagaaaaactatccgatttctaaagcattttctgtttctgagaagaatattgtattaggttactatataagcgaagcgagggagcaagccctgaaggacatttctaaaagagtgcacacattcagcagagtaaataaagacgtatctcctattctcgctgaaagaaaattccattttcaatggaaaggaaaaaaaaaaggaggtgatatttttattgtctttcattgttgaaagacactgtatttttctaaagcagttttcccaaacacactgtcttttcctgttaaggtggtgtatttccagggaattgcatcagaactagggtcaactttgcatcatgacacagtggaaatgattggtgatggggtctgtcatgttgagcttcacacctcccaccctcagacgtcactctgcactgtcagtcctgcagggccgtggtccacattccttcttagcagttacttcctttcctgcaccctgtattttagctgta

SEQ ID NO: 43995 - DNA, 1352 bp, Bovine  19866880458123
gacagacagaattcaaactaagctttaaagtccataccttttccaacaactaaaaccacttcttacatcttattcaatgactaactcttgagacaacatataaatgagaagagtaagctaaacttaatatgtcagctatttaccatgttagactgctttgtgctggcttgttttaaaatatgttcctcagacttccctggtggtctggtggttaagattctgcctgccagtacaggggacatgggtttgatccctggtctaggaagatttcacattctgctgggcacctaagcccatgtaccgcaactactgagccccagagcctagagcctagagcccaagctctgcaacaagagaatccaccaaaataagaagcccgctcactgcagccagagaaagcttggttgtggagtacctaaatactctgcagtacctaagaccaggggcaaccaaaaaatatatatataaaacatgtacctcaagataaatcaatatccctcagcatttgaacaaatagagcataaagcaaaatggactaaaaagcatggcagttttaagtatggtcaagtgcttgaaagatgactatctttttgttacattgccagaaacttttattaccaaaagtaaaaaataacccaagaactgtaggacttaagtgtaggaagaagtagaagttacaacttaaaacagtgtcaaatgtgagtttaaatgcagtcatctatgcttagaaaagatatgcattagataattaaatgtgcttagaacttttaatgtgaaggtaatatatccatattttaagcaattcaagcagtaagaaatgtacatataaatatacaaatatgtgttttataaacaaaaatcactcatgccacttgcttttttcatttaatagatacattggctgcattttcatgttgctacatgtacattggccttgttctgtgacacagtggtccagcgttacatagttgggttgtaccatccctggtttaacttcccctattgatggacacttaggttcttttctacaattccaaagtcctagcattgagtatggcatcccactccagtactctttcctggaaaatcccatggatggaggagcctggtgggctgcagtccatggggtcgctaagagtcagacacaactgagcgacttcactttcacttttcactttcatgcattggagaaggaaatagcaacccactccagtgttcttgcctggagaatcccagggacgggggagcctggtgggctgccgtctgtggggtcgcacagagtcggacatgactgaagcgacttagcagcagtagcagcagcagcattgagtatttttgcacatctttataca

SEQ ID NO: 43996 - DNA, 892 bp, Bovine  19866880475858
ctagtgggataatatattttaagtgatttctgaaaatggcccgtgaaagccgtctgccacatggcccatgtttgcacatctctatatagttacgattgcggaatttgacagtataactctgaatctgattaattaagaatgtgtaaaaaacaaagttcttgcattacagctcgttccttatctttgtgtcttttactgtgatgttgtagaacttggatcatatggaaaactaaaatattatgacacaatgactgaagaaggtaagaatgattttagaattgtattcattggctttttttttttttaatttatggtgtctgtggcttgcccatttttttagtctttattttccccctctttgcatgacttcagtgacattgtgtgatttataattctttctgcattttcgtctagttgctgccattgtgttgatttggaattggagacatgcaataccatgggtgatcatgttattccattcaaacgatccaaaccatctcagtcgtgtaacacactcagtgaaatggtgtcagcaatgtaaacacaagcccacacccattggatcaccgttagttcctccacatgcttacaacatagaaaaatacatcagaccgacacttccttttaatatgcccctaatttgggggtggggggagatatgtatcttctggtgatattctgatttatgcaaaggaatgagcaatctaaaggaatccctagattcgaaatggagacctgtttctgatgcagaggactgtaggcccctgtccttttctcccacagcccatgctaactcatctgagagaggccagggtcattgttccagccagtggggctgtatatattggagttcacaccgtgtgagattggacgtatcgttttgagcatttcc

SEQ ID NO: 43997 - DNA, 1464 bp, Bovine  19866880497018
tgttaagacattagccacacttccttctcccactaatttggttatgagaatgttgcagtaggtcccctgtggacaactctcctgacccaaaatttgatgccagtaaccaagagtgtcctgtgagcaccagaattgcacactgtgcctctgaaaacgtcaaacagtgaagccttagcagtacatgcccagaataaatattcaccaggaaccttggcattttggatattatgtgaagtggaagtggaagagagctggtgagactttgcagatgccttgattgcgctctgtcattattccatttgacagtttattgcagacaggtttctctttctcatacagcttgaaatggtgtcaagggaaatgtgtcccactttcctcagaccagctctaaaaaatttcagcgagtcataagggaaataagttgataccacactttaaaattccagaagttgaagagagcaaaaatgggtcatcttttaatgagctaatagaaagccattccctcagtgggaactattgatccaagtaattgaacatgcatgatgtccagtccgaggcattcagtgactctgacacagtaaccctaaggctggcagtcagtaagggctatggtgccagtctaaggaacacagttatactggaccagtatgaactcattgaattgtcatcactgtcttcatctatcccagtcttattagatcttaatacacacatgtgtgtttttttttttttttttactaaattttcagtgaaattttcatgtaattgcgtcattgaaaaatgaatcgttcaaccattttatggaaactcctactcctgtataattactataaggaggcttcagatgattttagtcagagaaagagcagagaagctgtacagagcactctaaaaaaacaatttaagatccaggttaaaaaaaattcagaacctcaagcaatacattgagcctggattaggtgagaaggcattatgtaactttattgttcatcaatttaactttcaaatttagatgattttgtatagaattccatttttttctagagttctttaaaaatcaaatagacttctgggggaagcatttaaaattttatttatttattttaattggaggacaattacaatattgtgatggttttgtcatatatgtcagtatctttttattgataaactcatttaaccaattctttgaaaattagaagtccatgtatggtgcatatgacaattcttggttagtcagagcattaaattgacctaaccattttattctgtcaccactttcaaataaactggaatgtgctgggctgcttataaggcatctctctcccatagaaccttgatataggtctttttctgatcaaacattcccatttcttttctggaaacttgagactcagtgagtcagcacaatctgtccaagggttgcagagaaataaacagcaacactatagccctctggcctgt

SEQ ID NO: 43998 - DNA, 903 bp, Bovine  19866880543965
cgggaccttgcctcatcagactttgctcccactttctcagcagaacctacccctgtcctagtctctgtgtgagggcagagagaggcagaggtctgagcacatccatgaacagcaacaataacaagaaacacaagaaagcacagtagccaagatttcttctgttttctagaatgtgggctcttttgcaaataaactggtccagacacttcctgtttatagaaggagatcctgcagttcaaagcagagcaggctttaaaaggaggcttggcctgtgacgtgatttcatgcagatgattccacagaccacaacttggaaagcagtttatttatcccattatcaatggggagggcagactgggtgcccaacttctggtcacctcaagttttctttctgcttattctcaaactgaaccagaggcaggtaaactagacaaggaacccaaattagagaatttgaaggaagggaaaatgacattcatcaagaatatgtcttggaaaacaaaacttcttcacacttcagcttccttagggaaggcccaagtttttaaaggaagatgcctcatgtatttaaagaaaaatataactttggtgaaacaagaagttaacggcctaaaaagtaagatgagagagagctgggggctacaggaggcttccaattatacttaattcagtgcatataagaaagtggaaaggaagagaggctgaaagctggagggctccaataggtatttgcagaagtttgtaagtgtggcagtcagagggacaaaggtcaccctaaattttcttaaatttataagcagatagccagactgcatgtgcaggctattgagtgaaagaagcagtgatctaagtgggttgaatgtacaggtttagcattgtaatagaatagcacttaccggcagg

SEQ ID NO: 43999 - DNA, 917 bp, Bovine  19866880564213
caagggagactgcatgacttcctttgtaggtttttgaaagaaatggttgacaattctatttcttatagagaatagagttctatcagggcatagggggaaatacctaatcactctctggccagcccttaccaacagtaattgtaaatcatataactgtaataattcattcacctggaaaaggacacttgcctttatggccttcttccttaattacctttctgggtggaaatctgctcacaggctggttttgggtactgattttgccgttcatttaccaggctgatgaaagtgtacatatcccataaagtctttaaactgtaatgaacttctagaactcttcccctcaaatgaataaacagaacaaggaaaatagtaggttgtcgcaggataaaatgaagacaaactgttctgtgtttatgcctgaggtcagaccccaaaagctttcccgaggtatcttccatgcttcttctagggccagactgaacaccagacctacataaagcaatgaaagattggacctatagttatggtgtttttttttttttttttttaatgcctgcaaagtagcctgacaagattaaactgtactttctagatacctctagttttgtgatgtgtactgtttggttccatagaaaaatagctttgatatgtaatgctttgataatgatggaatattaataggatttttcctcctctggtcctctcctacccagatatgcccaaattctatgtttcctgacaatttcatgtctcctcccaaccactcattcctgagcatgttgtgcaaaatttctgtgttgtgctgacaagttgcattttaatcccttgtcgtgaagttcatttccatctcttatctttcagttcgcagcataaatgcccctttctcacagaagatttcccgatgttaagattag

SEQ ID NO: 44000 - DNA, 1212 bp, Bovine  19866880566645
atgtaaagcagaaggtggagaaatggaggtagccaatgaccatagtaatgtaaagcaagagtgaaacccagatttaactgagaatgagtgaaatctgggagcaacccaccacagcatgtggctagaccatcagatgggtggaaaggctatggtgagactcggaaccaagagtagatgttgaaaatcctaagtggcatgtgctgctgctgctaggtcgcttcagtcgtgtccgactctgtgcgaccccatagacagcccaccaggctccgccatccctgggattctccaggcaagaatagtggagtgggttgccttttccttctccaatgcatgaaagtgaaaagtgaaagtgaagttgctcagtcgtgtccgacccctcagcgaccccatggactgcagccttccaggctcctccgtccatgggaccttccaggcaagagtactggagtggggtgccattgccttctcctaagtggcgtataggtgagctcagattgttattctgatggcactgggaacttgtgagattttaatcaaggagtgaaaatggctaggtttttgtttcatatggataatttggaggcctgaatgaagaaggaattgataatctatcctgaagtgggaagagctattagaggaaggattttgtagtagtttgggcaatgtgtaagagcatgccagttatgggttagagggcttcttcaggaaatattttaaaagagaaaatggcagctcttgatgatgggtgtagggtggtagagtcaggggaggaagagtggcttcaggggtgtcttagggttccagttgagtgactgtgttagtggtgttatacctcttgagagattgcaagaaagatgatgaatttattcttttcagttttcctcaaagaaaaactaatttttcagatgtttccattttgctttgtagatagttccatgatgatttttttcccccggtacttctttgacactgtagctgttagacctctgggtcttttcatgatccttatcagaagtaaacttttgctttaaatctctatttatgcctaactctctgtgttcttattttttttttttttaacttttaggaggaacctaagaaagttcgctttgattatgacttattcctgcatcttgaaggccatccaccagtgaatcacctccgctggaaaaactgactttcaacaatcccacagaggagttcagaagaaag

SEQ ID NO: 44001 - DNA, 1606 bp, Bovine  19866880580413
ttgtccaggaaaggcttcatttatgctggaggtttttaaagctctttccatgtttttatttttaaacaatattaaggcctctgatttgtcagatatctaattgtgccattttctgttttgtccatatcatgatttatttttttcccctgaaatataccaagccatgattactctggttgttgtcttccccatgacaatcaaggatgaccagggaacaggtctatcaaatctttcaccaactaatctctgtaatacccaccgagactaacacactatcctcacttagacatgacatgaggcttttcaaggagattctgctgaggatgtgaaatgtaagggccattcattcaacaaagagatgtagagtgagatgcaggaccaggaagtctcatgcctagtgggtaaaaccactcattgctgctgctgctgctgctgctaagtcgcttcagtcgtgtccgactctgtgcgaccccatagacggcagcccaccaggcttccccgtccctgggattctccaggcaagaacactggagtggcttgccatttccttctccaatgcatgaaagtgaaaagtcaaagtgaagtcactcagtcgtgtccgactcttagcgaccccatggactgcagcctaccaggctcctccatccatgggattttccaggcaaaagtactggagtggggtgccattgccttctctgaaaccactcattaggaagcagataaaaatgttcaagtggagaagagtttgagaaaaggagtgaaggatgtatgaagggttataaattgttgcaactggacatcaaacagttgcaactggcacatcaaacatcaactggcacaccaaccaggcgcctacctcctgagggccttttggggggcaatgagagcatcctgatcttgggcaggttataaaacctggtctcaaggtctcctctgcaaaaggcaagttgtaaaaggaaatttccaaagtcttcctgcttttaaaaatgctaggattttctaaagggtgaaataaatgctgtattaaaaatagatgttcatggtttccaaatttggtcttatatctttaaaagagtacatagtaagctgtggagggttttctaaaaagagaagagagacaacaaagctattaatatgatgaagagcaaaagacaggcaccatggaacacatcaccaccttcctttaaccttagttttaggagagggatctgagactcactggtcttattgtacagtccaaggaggactgtgcatggctggtctttaaaaatggagaggagggacttctctgactgatggtccagtgactaacactcagcactcccagtgcagggggcccaggttcaatccctggtcggggaactagatgccatatgtcacaactaagaatttgcatgctgtgactaaaaaagatctcacatagcacaactaagacctggtacagccaaataaacaaatactgttttaagtatgaaaaaataaaaacacaaaagtggagaggtaacttgttgcatgtttctgaaagttagttgctagacagtgaatgcaagcttcgtaagcaagtgtaaggcatgactctcacataaagttatcagataacccagca

SEQ ID NO: 44002 - DNA, 2654 bp, Bovine  19866880630350
gagaaacccgtctgcatagcaaaagaccccaattatgcaaatctatgttgtatttgcaggcttcctctgttgaatgcaacatatatttggctcagtggctcagtggtaaaagaatcctcaggttccatcctggattgggaagatcccctggaggagggcacggcaaccccctccaatattcttgcctggagaatcccatggacagaggagcctggtgggctacagtccatggggtcgcaaataattggacatgacttagcgactaaacaacaatgttgcattcgcagagaaacaagagaatgaagtagaggtgctaaaaggttgggtgtggggtgcacagggccgcagagctgggggtaatctcagtgatttctgtccaggcagcaagcagccctgcgttttatttgctgcctgctgaagtcagcagcttttgaacttgagcaaaaaggggcagaaggcagatcagggcctggcaggatgactattagcctgtcagatgggccctccaaacctccaacacagtgctgcagatagcatccatcactcccttccctgcttgtttaaacatgaaagtgtagcagtcaggaccatgcgtcagatctaaaaatatcaataggaattttccactgatgcttccttttgagatcatataaataacacacacagctcctgctcccctgtgtcccccacctgggactcttgcttccagaatcctggagtatttcaagcagtagcactgaatcccaccagcacctctccctagggaggtggtaggtgggccagtctcaggccatgtggtctacaggaaaagcatgcgactagagacaggaatgagtgtgacgctcgacctgctactgtgttatgtttacttatttataatgtataccctaatactgccaaaaggatttttagtggcttacacaatcaccctcactttctctccaggagttgaaacaaataattaaaaaagctaatcttaagccatactgaaaaaggttctttccatatgagtgtatgtccttggcagcaagtgaaagaattttaaacaccaaatacgagggaattaagaggattaggtaataaggcagaattaggaagttggtgcatattatttgggttgtcttggatcttcattaaatatgcttcttatgttctccatctcattgttctgtaatacgttggaaaagaaggaggatctaaaatcagtcatctacgtttccaccttaggaaacaggaaaatgaagcacaaattagatccaaagtaagcaggagaaaagagataataaaaatcagagaagaaatcaatgacactgaaaacaggaagtcaacagagaaagtcaacaaaagcaaaagctgtttctttcgctatgtagggtccatccactgtttcctttacccatccctagggctcctgcccctgacagaagcttgggtgtgctgttcctggttcctcctctgagccacctccaccttctcccagcagatgcagcagatgtagcaaataccactccctatagggctcacccagcctcccaaggggtcagttgactacatgaataatctctatgtaatgagaccagtgaagactagaaaagaggtgcatgttaactgtttccttccagatatgatctttattgtttcactccaaatgaatgactttctgctccccacctgggagatgcctcaggaataggggaggatcatgcaagagttgagaccttacattacatgcaataagtaccctgtatcatgcaaggtggaatggttttattcagacagagaggagtctagcacttccttggaagacccatcaatctgatctggtcatcaagctccttccccttccagaatggacacttcccccccacccgccatggtcagatcccccactgccatctgcaatctagaaacttctctctagactctaagttaaccttttttttagagaaaaaagcaaaagcaactctttatgactcatatcattttaatgacaccaacagatggtgacatttcatcaataacccttctgcttataacctacggattagctcctttctccatctgccaaagtcaccaggcaggcagtgccaccagcaaatagtggaaaataattatctgtttagatacataagctctaaacacactaccgtccaacgcaaacaattagctatattgtacggcttccaaaagctgcatttaaggtggctgttgctagagcagaaatggacaaggagaagatgctgggtctcaggttacacaaacagtgctctctgtggggacatcatggcctcttgtggatgaagcttgccatagacagaagttcaggggcccagaatcctgcagaggatttgagaggtacccagggagcaaggctgtcagcatgtcttaggggaaattctctttgtctttttgccaagtgcaatctcactctggttcaatgggtgacagcttgcaagctagttagaaaagtggaaaaaaagtactgttccaagtctggggcttgttttgcctttgcccaagctggggctgctggcatgctcatttgtctcaaccccaggagaggctgggcaatgattttccagtttttcctggagtcgtggcatcctcactttgaccttgcaataacccatcctaaaacttctgtagcatatcca

SEQ ID NO: 44003 - DNA, 1685 bp, Bovine  19866880653869
caggaaacagacatttttattccttctagtacttattagcaatttaaggtaccgtctctcccatttgggctgacagaatggcctacgttttgcactcagccaccttagtcctatatgtacctatctactaccaatgccaaaaggaagttactaaacataattttgtgggtgctgcctcagccattgagaatcttactgctggcccagggaacatttccgaatgttcatcactgcgagtcagcacttttaaaattagaatctcacttcagtaaatgctcacgtaaagcatatccatgatgcaggataatgaatttcagacgcccctaattaggtcccaattccagttaacctgcggcacagagatctgcttaggaaatgccaacaggaagatgaagcgggtggatttgggcaggagaaatgatgataaatcagcccagtggaagccatccatcggtgcctgttttggtggcatgaaggaattgtttttgcaaacgagtgtttgtcactcccctgtcaaatattctgcaaacataatatactgtttcccagacacaggttgactgaataagtcactagagagtaaaagtaaaccatctccccagtcattaatctgtagctcctgagaatgtgtttgtgatgctcatgctaactgagaacaaagatcatggccaaacctgttgctgctctgttagcaggctgtgttactgcccactgctttagagtctgtggttgtgctacagagagagtgtcttgactcaaaaactgtttttaactgagcaagatgaactagagacaaagggaatggaaacaccaaaatgccagtgagaccccatttctccactggaccacagatggtttgcttcctgctcggtgccccagacctcaactgggccaagctgagagatactgcagtgaacaagagagccagtactcctgcccgcttgagattaccttctagaggaggaagccagaaaataatataatttagcaggtgaatttgcagcaacatggatggacctaaagatgatcatactaagtgaagtgagtcagaaagagaaagacaaataccatgtgatgttactttatgtggagtctaagatatgacgcaaatgagcctatctgtgaaacagagacagactcagacgtagagaacagacttcgggttgccgagcaggaggggtgtggaggagggagaattggaagtttggaattagcagatttgaactgtcatatgtaggatggataaacagggtcctactgtaccacccagggaatagaattcaatatctataataaaccagaatggaaaagaatatgaaaaagaaaagctatatatatatagcttcccaggtggtgcagtggtaaagaatctgcctgcagtgcaggagacccaggttccatccctgtgttgggaatatcctctggagaagggactggttacccactccagtattcctgccttgagaatcccgtggacagaggagcctgacaggctatagtccatggggtcacaaagagtcagacactactgagcgactaacgcgcgcgtgtgtgtgtgtgtgtgtgtgtttataactgaatcactatgctgtacctcagaaactaacacaacattgtaaatcaactataaactgaaatagagtgttagtcgctttgtcatatccgactctttgtgaccccatgga

SEQ ID NO: 44004 - DNA, 841 bp, Bovine  19866880690023
aattgaaattaagggtgctttacttgagcagaagggatggtggggttggagatgatggagaaggagggaagagttagaagacatcaatagttcttttaaatatgagaagtttgagatatgtatcagacatccaagcagaaataaatgttaagtaagcagttggacatatgattctggcgcttgtgagaaagatactggaacagccacagatctgagacttgtcagcatacagatgctattaaaagctatggaatagaagatgagaaggccaaaggacagagctttcaaatcttgcaatatttagaggtaagtagaggaaaaggagtcagtaacaagaaaaaacctaatcactatgctgtctcaaaaacctagagactcagtgttttaaggaagaagtaatcaattgtactaaatcctactgagaggtcaagtgagctgagggcagaaaattgccaattaacattgctgagatgtgggtcacaggcaactcagaggtagcaggcagtttctaagacaacctccagggatccttgcctcctagtattcatgccatcacacagtctctctccttaaccattgactcgcttctaatagaatacaaaagaagcgatgcaatgtcacttctgagattagatagtaaaagactgggagtccatcttgctatctttcttgggtgctgataaagagtaaacagataattaggtttaaattgcatagggatttttcaaggcaactataaatatgatggaggaagagaagggtataggacttaaagttcataacagagtagttatattgggtggtctctggactctaagcttcgtaaaaagagaagtgagat

SEQ ID NO: 44005 - DNA, 2945 bp, Bovine  19866880717716
catatgcacatttaagttaattgaattgaatgttataacttcaacaaaataacaataataatgagttttaaactagagtactataaaatattacttgtgtacctactttatcagagatagtaatatacagatgtgtatctatagaggatttattccatatatacttaatgagaaattaagagattttaaaggataaattggttctgcgtgcgtacatgctcagtcactttagttgcgtccaactctgaaaacctatggactatagcctgccaggttcctctgtccattggattctccagggaagaatactagagtggttgctagttcctcctccagaggatcttccccacccaggaatcaaaccctggtctcctgagtcttctgcattgcagggggattctttaccactgagccacccgggaagccacctaatttggttctatttatgcttaaattttttcttgtcttacgactaagttaatacctaaaccccagacacagagcagagggaaggtaaaaattcatggtcccactaccaggaaaacctcctgtgacacccacctttccctaggggtctcagtgccagcttggtacccctaaccctgcctgtttcacacacatgcctccctgggagtgcaactgtctctttacatgtctgtctcccccactagcgtgtgctcctcttgcatgcggagtccatgtattatttatccgtggatcaccagtgcctggggcatccttggcactcaataaatatagcttttgaatataatcagaattcagattattccaggtcaatgtttatgaacatctgttgttcaataagtgctccagtcaagcagggcacacaggaataagtggatccgatgctattgactgcaaggaacttgaaatgtcacagtttaaatagtaaagaatagtcttctgaggtgaggtttttttgttttttttttaaatctcacctcctgctctttaagtaaaattgtatataacataatgagatggtaaatgtttaaaatatctataaggcttattatatatgattatatttctgtagttctaaaatagtaataatagctaattcttgcctagaaccatggtaagtgctttatatacaacactgtgtatcatttacacacaatactttaatacatacattatacatacacaagatattatatttatataatactttacctatgctactatgtatcatttgttctctacccagttgctcccattttacccattttctagatgaagaaatagaagcatggggaagttaaataacctgcacaagtcactttacggagttggaatatgataccaaaatttaaatgtttgtttcccctaccccagtttagcacaaaattttcaaattttcaaatctgcagtttaaaccacttcctttgtacacaaaaagtttagtgttatcaagttaacttgcttctaaattcagaaatatccatttgttctgaatcatttaaatcacaatgccaaggattgtaacacagtctgatcccacatcagagctgaggtcacaagggagttgctgatagttgtccaatttacactgcagcttcctactgaaaaagagaagccctgtgatggtcagattcaaagctgggctcaagctctaagccaacctaggctgggagcttctttcatctaaacagaaaacggccaagtaaatagtgcatgccgtgtgaacacgccattattttgttctgagcaaattaagctacttgtttactgatatgaagaaagaaaaggaattactcaaaataaattgatgaggttttggatggtgtgcaagtgctgacatgggagtagcgagatgtgtgttacgtttgccttccttgtaagcacccagtttgcttaccaatgcagagaattctgtttattgctgatatgtttattatttttacctttcctgctctccacaaagtaattaagttagctaaagaacatatgtatgtaaggacagtttttaaaactctgaaagacaaagaaccagaaagaggaaggagagatttacatcagcaaccacggagaagataggttaatgcaattgagagttagatttagcactgagcttcttggcagccaaagctaaaagaggaacattataaattatgtagttcacattatctgataaaaagaatgcagtttgttctttgggatacacacaagatttttcctaacattaaattctaagaggaacttctcccagggatatataaggaatgaaccatatcaaattaacagatcaatagcagttttgtaaaagatgcagaaatttatactatttcttactttctgaatcatttccttttttttcacacattttcttgtatctgtgttgcatacaagtccaagtcccctagtccaaataatctaacaattgcctaatatcaaataatgaggaaagataattttcctccccctgaattatctcaaaatcatataagcagaagctaagctaggtctgcatttctcttacaacatttaacaaaagtggaattttctgaacaaagagaattttagatgttatcagctcttcaaggaaaaggactcactgattagtaaagtctctagtgagtaaacacatattaaaccacaatgccaaaggtattgtactaatcattactttgccaacaaaggtcgtctagtcaaggctatggtttttccaatagtcatgtatggatgtgagacttggactataaagaaagctgagcaccgaagaattgatgcttttgaactgtggtgttgggagaagactcttacgagtcccttggactgcaaggagaccaaccagtccatcctaaaggagatcagtcctgaatattcattggaaggactgatgttgaagctgaaactctaatcctttggccacctgatgcaaagaactgactcaaaagaacttgaaaagaccctgatgctgg

SEQ ID NO: 44006 - DNA, 1044 bp, Bovine  19866880734943
ttcatgtgtcctatccccctcatctttctttgctcttatactttagtgatcctaatatattagccatcttgaatttcctgatcatcccatgctatttaatgtcctcatgaaatacccttggtcctgttatgacctgattaatactcaccttttctctgaaacttttctaaataatctgccccactttaatgaatccctcccttctgtgtgctccctccattaacagtttatctatatttttattatagttgttactgtctcatcttaaagtgtttttctcctgatcagtaaggtgtttgaggggaagatacagatgcttaactatctgatttctcagcacttcagactgtgcctggtagttaactggtgctcaagaaattttgagttaaaaaagtgcaaagatttgtttatatatttgtaactgacttctcttaactgatttatgtattcatagttgcagtgtcttaactgcaaatacatccagatgatctggaaatgtgatacttggctcctccccttaatgggggtagagtggacaggccacacagaatgggagactccctggtagacctgtcttggctctcttagacgaccacagttcagggaataacccacccttgtacgaataagtttatacaacagaatcctgggatcagttggggaccaaggagtctttgcagcctttgcctctgtgttggaggacagaaactagccaaggagtatggagctcttgaaaacgcccatgaaaagacccgagatttttttgttgttgttaactgattctatcatgaggagtattaaaccacaaaactaacaaaggggaggcaaggaccacaaattaatcttttattgagacaacagagggatgtcagagtgtacaatcccaaaacatttgcttctgtattttgaaaaagcaaatggttttcagagaaatttcaataacaggatgttgaagtgaaagaaatttctgcctccctgtttcctatagggactgtgtggaggcatgataacatgaaagctatacgatcaccttgtttttgctgt

SEQ ID NO: 44007 - DNA, 1514 bp, Bovine  19866880738283
ctgactggtgtgaagtggtacctcatagtggttttgatttgcatttctctgataatgagtgatgttgagcatcttttcatgtgtttgttagccatctgtatgtcttctttggagaaatgtctatttagttctttggcccattttttgattgggtcatttatttttctggagttgagctgtaggagttgcttgtatatttttgagattagttgtttgtcagttgcttcatttgctattattttgtcccattctgaaggctgtcttttcaccttgctaatagtttcctttgatgtgcaaaagcttttaaggttaattaggtcccatttgtttatttttgcttttatttccaatattctgggaggtgggtcatagaggatcctgctgtgatgtatgtcagagagtgttttgcctatgttctcctctaggagttttatagtttctggtcttacgtttagatctttaatccattttgagtttatttttgtgtatggtgttagaaagtggtctagtttcattcttttacacgtgtgaaggaatttttaaataaacattattttcttttattaaaaaaaaaaaaagaaactgaattccatcaaaaaggacaaggaatctgaacagcatcagtcttctctacagcaacaatgaaacatcaaagacagaaaagaaataagtgccttaaaaattccaagagacaatcatttcttacccaagaatttacacaaagccaggctttgaacagagcataagaggaggataaagatatttcagacacacaagcattcaagatttctcccatgtccccttctgaagatgtggcagtcagaatgcgagttgggaaggaatttccaaacacaaagtattgcagaaaggggtgagtttattaagaacaaagagcacagataatgtaggcactgcaagtacagctgaccactagagaaagtcgacagttttcacgggttagtttttgcagcctcaaaacaaagaaaattcctgctgaaaggctggctttaggtgattggttaaggtgctatagggtgagcactgtggtgggcatttttgtctaaaatgggatcgagaagcctgctggtgataatcatgggggcttttggcaatggttacaaagaggctcagtcagttttggaggtgaacttggttctgggctccatgtctgtggccttgatgcaaggccttacactgtggccttggggcaggactccacagaagacacaggaggctgtgctccagttagcagggaaagtaaagaagaaaagaggattgaggaaacagggctctcaacacaaagagaattcccaggatgatacccgtggagcaggtctgggcagctgttggctcatgtggcaacaggagggcacagggctccaggactgatgtctcctaaaggggaaaacacgaaactggcaaataactgaaattccctccacctaaaaatactgaggggaaatgtacagttctatcagagagtttgaagtgaattagtatactctgcaactcaa

SEQ ID NO: 44008 - DNA, 3993 bp, Bovine  19866880743711
aatgggcgacacagcttattgaaaggttggggacagggttatgtagagatgagggctttgggggtcaggggtggtgaatattgtaatatgaatattgtaatatgaatttaacagctaacactcaaatcagaaaaatcttgtgataacaaaatgatcctactaactcaaaagattgtgataaataccagggggaaaagaaaataagacaacaaaacctttgaaaatgattcatcgctagggaccaggaagcaggagttacgagccatgtagaaatattgggttgaccaaaaagttcattcgggtttttggaccaggaagcaggagttacgagccatgtagaaatattgggttgaccaaaaagttcattcgggtttttccataggatgttacagaaaacccagatgaattttttggccagcctaatcttttgcgtatttaaggaattcattatatgtcacctgtcttccattttcattctgaacaaactgagaaataagcaaaaaggattgtcaggtggaatgatagagaaatgatcactatttttagcaataaaggctaatttagggagatggtgagcttgagtaccaagtagatttatggacagagtcctagtactagaccgggggaggcgtgctcccatgatattaggacccctccccaccacacacgtgcattcattatatggagggtttgggtgctgccgaactgaatagtttgagacccctgagctgggaaaaagactagtgactcattcatactacttgttagaagtgactaaaacaagtattttatttcagtattcaaaaccaaggatacagtagcatattcctactggctcaaggcacacttccattccaatatttgaactttatattggagttctgagtcagagataggtgaagagagaatgaactttaaggaggaaagcagcaggagcacaactttttgagcttttagaaagaagtgctccttgcttgccctctggatgggctgtcctgaatcgaggcctgttccccggtgtatctccttttaccagtattatttatccttatttccttgctcatgtggccctgcaggaatcaggaagacagccagagttttagactgcaggttgcttgatgcaactgatggatggcctgtggctcccaaccctccctctgaaccctgcctcaacattacacctaccttggtgcccaggagccctgagctgagatagtgttgcaaagagaaattcaatttttgtgtttcctgagcatttaagcctagaaaatatttctgtctctaatgtaaaaataataggtattcatcatttctcatttcctaaatagatggaagaaaaagaggagaggaggaagaagagaagaaagagcaacgatttgggtgtgttgctttaagtgctattgcagaaaccactgtcaaaagcaaagaagtttgtactgcctcccttaaccccacaggtatttttttttctgcttttatggttctcattgaactggaaggggagagccaccggccaaaaaacgagccaaatgcaaaggaaaacaaagtcgtctcagggttggagacctgagaagaacatttttagagcacactgggcttttattttgatatttatttttacttttaactatgcaaaatggatcctcttagaaaatagatagttatgctagattgtagaccagctggtggtaaaaaaaaataaataaaataaaaaatccgctggaatcacctaagcatgtaattcccataagaaaaaggcagtttactgttacttaggcagggaccaaaaacttcagtcatatacagtgaggattagcagaaagaatgtggaatttggagccaatattgggtacaaatgagagctgcttaatattggcaagctacttagcctcactgagcctcagttgattgatctataaaatgggaatagtaatagtgcaaaactcatgagattgagaagagataggtgaaaacttctagttcatgataggtgcataataaatgttagttctctctctctctttttttttttttgctccatcatggcagtcattagtgctgaccaccaaatcttaccattcttctgccaatcacatagtgcaactgtactttctagcttccttgaagatagatatggccatgctttttgctttagtcagtgaagtgagagtagccttaatgcatcacttccaaactgaagcaagtacaagatttgccatgtatcttttctttgtgacagcaactggcagtgttctagatagtcaccaacttggagacaggcatgagatgacacagcaaaattcacagagcacaggtagggtgaatgagagacagaaacctttgttgtttcaagtcactgtgattttctgagctccttgttactgccgcataacctgtacccttttgattggcccactctccttaaatgaactgcatttgctgcaactcattaactcatttcacagctatatgctgaatggatgtcaagcactgtgcttgatgctggaaaatacacgatactgattcttgccctcaaggagctcataataaggggaaaagaaggaggtcattgtcgggcgtcttttaaaactatcacccatcgattataaggtttaacaacagtcaaggttgggaactctgcttttgtgcacaattgaatccttcatttatgttctattgtctatagatattgataacagagaagccagaaattataatagaaagtaggaaaaacagtattgtgtcagaagagagggaaaaaagagatggttaaactgacaaagaaatataaatacttcatctttacttttgttgcctacaactccctggctcactcagttttctttcttccactttgcccttaagaaaatttagtagaattttgttttcctttagactaaatgtcaagtcaaaaacaatgtaaagttgtttattatcactataactctagagctatttcttcctgtaaaaaaattccaatgatgtggaacttccatggtggtccagtggctaagactctgtgctcccaatgcagggggcttgggttccatccctgggtcagaaagatctcctggaggagggcatgacaatccactccagtattcttgcctggagaatcccatggacagaggagcctggtgggttacagtccatagggttgcaaagagtcagacaggactgaagggacttagcacacatgcacaattggttaccctgaagtccaatttgtatggaaaaggcaaattaaatccatgattgttttcttttttctaaaacaatttgaaaataatgagttcattccttcttacccatcaacagtgacctatcaagttactatagaatcattatgaacttacagatataatcatacttgatacatttgaaacaattccaattattatcaatttttggtgctcagattgatccatccttgtctgggggagcctatttcaattgattccttagtcttcctgacataacctggaagtgattgatagcttccttgatttctgtaaatatctacaattaaaatgatacaatatctgggatttgctttaaaatgatggcatggagaaaatgcgtataaatgaaatgtgattgacagtgagttgattgttgttcaaggagggtgatggccccattggaggttcattatactgtcctatttgtaactgtctggaatcttccaaaataacaggcaaatattaaaaattcacacaatgacttccagaataagactttaaatccttagcaagataataatcttaaatgcctggctttggtgggagaaaaagagatttcaagtttctcaaggcttctcttgacttatcagggacgtgtagaggtctgagtataaagttttacccaaagtcaaaggtggtgcattttccagatacgacggacgtttcccctagtcccaggaaagcatgaagaaaccctaagtggaaaataggaagagggtggaggggtaaggagagggggaaaacgtctgat

SEQ ID NO: 44009 - DNA, 1236 bp, Bovine  19866880762957
ttacacaggctgtaagatacacttgtaaaaatcacggaaagtattcttaactttttccctcatataagacaggaaaaataagtaacagagtaatagaaacaaaaacgcctgggggaaataaagcttccagagaaaaacagaaagtcctggcctattttatctttttattttttaatggatctattaaagaagctgtgttctgatattgtgttggcaggtggggaggaattttctgtgcaaggtgatccatgtgagagaagggcagctaaaagaaaggccccacaagagtcatgaaggccataatctccccaagttcatcggtcaccacctgtgaagctcatactgtatttggagaaccaacccatagtgtctctcagagcaacagatggatcaaatgaattagtcggagcccttcccaggacgccaggcatacagcactttggagggaaggcagttcatcagtgcatcctgcgacaagagcctgacatctgcttaatcttctccctcagactccaaccccacactggatatttcaaatgggtaacaatgtgaaagctccatgtggacttccctttcattattatcatttcaaatgctaaatgttatctacttaaagatcttaccttggctccctgccttggcagaaggcaagatttttctgctaataagagcctggaggctttacaagaccatgggagttttcaaaatattcctacatattcataatagtcaaattaatagatctgatgccagatgtaaagtggcattttataggtagctttaaaaggtaccaatggagtaacttttaaaactactttagacatgcagccatgaatctaaactacaagcttgttgccttttgatcttggctgtgtgctcactgtcctatagctaactaatcagaaaaggtttggcatatttcttccctggaaagatatctgacattcaggaaagaaatttaggttaaacacctttcaactatcctctctgtaacaattaaaagcttttcctttgacttactgacacggttcacaaccacacacaatgaaggcaaaataaatctttcctgtgcggtacattatacgctcttagatggattaagacctgctatccaagtctgcatttttacaggttttaggtccgctaaaaagccatcatgattagtgacagctcgagcagcgggtaaacagggtgaaggaaaaccactggtaagatctacttttgggatcttctgac

SEQ ID NO: 44010 - DNA, 787 bp, Bovine  19866880827565
atgcataaatgggtggattcaggtacctgcctggttacatttacactcagcccagggcttgatccccagagggcacccagttaatccgctgcccagacaaacattccagtggcttagcaccactggctggcctggagaggcagaggttgtaggattaacattcaaacggtccaattagcttctagaaagctctctgattagtggtttggactgacagggcaaccacgagaccagcacttttgggaatgctagaaatactggctgttcatggtgtgagtatatccacccatgtgactccctcagggctggcagcctcatatagaggcttagcaatgttggggatgtgtcaggatataacccaaacctcataacctgagatctacttcttttccagagctgtgctggatcgtcctctgcagttactctgcctccaaaggccaactgcacttcatatgcagaaaccatggctctgaccatggaacagagggactgactgccagggtcactttttattgcaggcccagctggcctcccatctgcttgtcagcctggagaaaatgctgaaagctgaaaatgggaaaataatacagctcgaactattaagaaatcctgatttttctttcagttgtcatcctgtgagtaaaacctaggaattaacctataacctgtgtgtgtgtgtgtgtgtgtgtatgtttaatttcagatatgggcaaaagccacagggacacattccttagaccaccccaggcccaacggtattagaggaagaaaacaggactccaaagtc

SEQ ID NO: 44011 - DNA, 1006 bp, Bovine  19866880904864
ttattaacagcaaccaaggctggtaattctgtcccttttctctatcacctccctgtttacctcactttggagttccctttgtgtttccatgcaaatgcagaggggttaacattaaatatgctttaaaagcaggtatgggaaacccatcctttgtgaattgaatttattaactatattctgttgcactactttgatattatgtcaaatggatcatttcaaacctttgaccaagcattttatttccatgttcttgctcaaatctattgtgaaaacatatagtgagtgtgctttaacagtcccgtctgttgtagtttttataattgagtaagctgatttttcagacttctcagtatgtgaatgacagtagatccacagtgtcatttcatgttctcttatgttagtaagtgaaacatatagccctaattaaatttaatattttattctgatttttctggtgttgaccccagacctcctcccacttcacagtcatacccgtcccatatcatcttcttaaatcaaacaagttaattcaggtgaacatgcctagacagatgtctggtatataataggtacttcagtatatgattttacccctttcagatctgtaatattcatccttattagcaagtaaacacctgttcaagggaatatccaaggctggataatagcatcacaccaggtttgttagtttggctggtttttagtaacaaccaactcactttcctcacatcaagttcatggattaaggtccgttagagggagggacctgagggagttgagtttggagcacagttgagtccaaccgtggaggcgagtctgctgagaactaatgctgacgcagactgtcctctcccagctcctgacaggcagggtgggaagcgacgctagtgcagaggggaccgatggctcctcaactaataataatgttatgagagacaccagatggaaaagaagtaaatggctattgggagtagcccaacacgtgagggctacaatctgagctgga

SEQ ID NO: 44012 - DNA, 1246 bp, Bovine  19866880920662
ggagccctcttttatctcccctaataccaaattacccgcttctccctccctggacattctcactgtcctccccaaagatctgccactcacaggtgggagtggatcctcccataccttctcctaaacatttatgtgtgtgtatgttgttggaggttttttgttatattcactttcaacaaatcagtcactgaatttaaatacatcctctatgatttaaaaacacttagtactttgagaaaatatttatacagctttagttgaggagtaaaataaatcatacatagttcatagtttatttatcttgaattatgcataggattaggttaaatctaaaaaatcagtcacctcagatcctttttggtagtggatggatatgggtgaatgtagcaaaaattataagcaaaacatattcaggaaatcacttgggaatcaatgtagaactccactcacttaacctcatgaactgtttcataagtttctctattatacatctcacttatatcttgagaaaatagctttctaatccaagtcctagaattagatattgtatgtatcaatcaatagagtatctattacattttcatgtttttcctaaaaacaatatcctagtgaaaggattctgagttctttaataatacaatagaatcaagctaaaaataacattttgatcctgtagaaatctgatattgctaagaaaggggatggattatatagttaggataaacaaggatctacttgatatcattttttacattcctttcatagtttaaaaagcactggtttagattttgcattctgtggtgcagacctacattagtgaaattgtcatgtatactttttaaaatttgcttattacacttgtgaacattttcaggtgatcatagaaatgtctaaatagctaaagctatactagcacagtccagtattgatcccatcccactcagaaaaattcatttaaaatagaaaaaaaaaatctcatgtaatgggattgtaagctagaagccttaagtgctataataaaatacaatcttatgcaaatacagtcttagtgggacttttcctgctgccttggaaatggtgactggggcctgaaactgtaagtaacaagattcagggaccctacattccaacccctggggctggttctcatccaggtctactaagagattagctctgctatcaccatccactccccacttcttatatccattcacatctatatgagaagacaggaagacagggtcat

SEQ ID NO: 44013 - DNA, 1651 bp, Bovine  19866880950747
ttgatgatgctaggtgggttttcatctcccccaaatttctcgcaacacatgtgccttaacttttcctggaaagcgaattaccaataaaagagcagttcctccttatattaagtggctaagattatattttagctcataggagtaaagagggcaaagaaaaaggaaatggagatataaaatgacttactaaggtaattagaaaagattagtaaaaagagaggatgtagggagggtatgaggttgctaagaactcagtgattctcactaaggagaagttgtggaactcaagagaagtggattcgaatagctctgcatgccatctcccaagtggcaaggacattttgcttaagctcttgggcaagaatgaataaagcaccggtcccatgcagacaagtcaggtgcttaggatttgagcaatgtctaacacagtggttctcacctagggttgatctcacctctcaggaaatattaggcaatgcctggagacatctttgattgtcatgactctttagagaaagaaaggaagagcaagagctgagatgtattctcaggctctagtgggtagaaaccaaggatcccatttgacagtccatgatggacagcgcaaccctcacaacaaaatggtccagcccaaatgtcaacagtgtcaaggttagaaatcctgaccaaatgctagctcaaaacattatttttaggattatgatgacaatattatcactttaaaaggctaggtccgataatatcagaattggcagagtttagagaaaaaagtgataattctcctttgtttgataaagtaaaggttttggtcctttgggctcatcttcattccagaacatgataaactattttaaaatcgagtcttctcagaatagttctgaaaactagggacactggctatggatctaggcttcctggattgaattccagctcagccatactagcgttgaagcctggacaagttacttaacctccgagcttcaatttcttcatcttttaaatggagatcatgagaagaccaccttcaggaggttgtgggagatgaacaagctgaacgatgtaacatacttggccccaaacctagcagcggaagtgctccttaaatatttgttattatcctactcactgttctaattgttcatcctcaggctgccatgcccagtagggatgttcttttgttacttctaagtgttgaagtctacaggcgaaaagttcaagacaggaagcctgactctcaaggcagagctctttgcacatgaccctttgagtaaaaaattcagtacacacttcagaaacactgagcgtgaggcaatctgacacgtggtgctgttacttctcctgccttcttcccttctatgatctttcttcagctgaatcagtaaaagtaccagaaaagaaggctttccccccaaatataaaatcaggaattaagctaaaaccaccagcctcctcatttacatttaaaacatactggtttcacaaaagagaggcaagaatgggttgttagattacaggcttgatgttacagtggcacggataataggaagaaaaaagctacatcgaggcaggataatttctgctgctaaagaggcaggaaagataagccaagaaatgtgctagaataaagaatcaaaggatttttttcttaaag

SEQ ID NO: 44014 - DNA, 1132 bp, Bovine  19866880987243
acttatatattagtgagaaagagaaacagtgaaaagaataagaatgagaaggaggaggggaggaaaaggaagaggaggggaagaaggagaaagaggaggagaaaaaagaatagagaagggaccctatgagtgtgtgtgtattttttttaattgtgtaagctccatggagaaaaatggagaggacaaggaggaagccaggagtggagatgcaatttaaaattttaagtgctaagactagtctatggggaacaaagagaagcagaaagatagtggtggcttaggatagggtggtgacagtgagagtggtgagaagtggtcactttctgggtttatttttaaattagaaccaacaggattgttaacagactgaatttgagagaaagaaaagaaagttaacatgagagaaactaacttggggaagaaggtgaaggatttgttttggatgatgagggtagcagaggtgatagatatttaaagaaagaggagaagttatgaaatagtaatttaggaagaaacaatgtaggagaaaaaagatctgaagtcataagaaataatagttttctaaaatcgaaagaagacataagtcctcagactggaagtacaaagtcttaaactgaatatataaaaataaatccacatgtcaccactataatgaacctgcagaacatcaaagaaaataagaagacttttaaagctctcagatagcaggcttttccttagctgcaatcaatgccaaaaaataacaatactatcttcagggctcaccggaaataactgtcaatctgcgattttatgccctaacaacctttcagttgtaagacaaaaaagaagtcattttcaccattcagaaacttggagtatttaccacttactgatcctcacaacggggactattaaatgatttacctcaagaagaaaaatgaacccagaaggaagaaacaaaacagcacacacacaaacatgcacacataaaaatcactatttattttgaatttttaaaagtacaatagaagctgtgaactcaataaaaagatggggtggaggcatcgttccttggtagtaggaagcaggctaatagatcttgtaatgtttgacagggagacagaattattacatagctaaaggttgctgg

SEQ ID NO: 44015 - DNA, 2437 bp, Bovine  19866881018389
ttttttacatctagtctctataagtgttcattgctcagttgtgtacggctctttgcaaccccatggactgtaacccaccaggctcctctgtccatggggattctccaagcaagaatattggagtgggttgccatgctctcctccaggcgagcttcccaatccagggattcaacctgggtctcctgcagtgtaggcagattctttacagtctgagctagcagggaagcaagtctccataaacagacacattatattaataggttaaattaaatgtccacatccatgaacttcatctgcctcatcaggtgctcactcttgagcacttgggtctctctgctctggatatccaagctccctgcagctggtacctgctcttttgagactgtgcttgcctggcacaaggacttctgaaggaggtggcacaatgctgggacagaatgtccatgccagcctcaccaagtacgaagaataacctgtccccacatctgagtcttcatgaggatgcattactcactcaggactaaactcctccttgctgttccaaccaacagactggtttctgtgccccagggtctaggtcagagttccccaaactgtgaaatattctggaggctattaattggtgcactgaggaaataaccttccactaggtacataagttttcaaaatccttaaaatgttaatgtttttcttactttttattctcctttatcttagagaatttactctattcctgtgggataggaaatggacatgagtttgagcaaactcttggagacagggaagcctggcatactgcagttcatggggtcacaaagagtcacacatgacttagtgactgaacaacaatagggtttggtgggttttttaaatatagttatagatttttcaacataggtgtaaaaaaggaaccaagaactagcctacccttctattccctggataactcctgtggacattttaaaacattaaataatacctgcacagatttagaaagtaagtaacagaacaaatcaaaaggtgaaaggtgtgttcattaactcacttatttataaatacatagctattggtcatgacaaaaccaaaagtaaacatcagatgcttcagtctttggaaatcaggggcccctcctcagtaagtcttccctttgttctgggtagaaaagccttcttaaacaatcttcaaatgttcatttcctacactgtatcagaaaaatttctcttagagttgttaagtattattctgaaaattattcagagttctatcgtcacatactctttatgtaaatatcatccatttctttcatgaaatagaaagtgagttccaatttcgttactcacatgcttttaaaaaacagaatgcatgtatgtcctttaaacttatcagagatgaatagggaatgctgtaaccaatccaagaatgtctcggtaatctggtaatattgacactattgtagtggttttatttcaggcacctgccagaacaatctatactaaggaatggtgactatttctttgatgaacctaaaacaagatctggaaagaactcaaaaagatcactcagaataacttctcatctatagggagtccatggagagcagaacccaggtttatctacctgagttttccccatagtaccctgcacttagaattaactctatgaatgttctatgaattgactgaaagtcataactattcagagcggatggcttacaccttaaagattttttgggtggctcttcatactcttcatcacacacacaaaggatcctgaggctctgactaaacaaatgaagacacagagatgcaatattggaactggtatagagtatagcccttaaacagggcttccctggtagctcagacagtaaaagaatctgcctcccatgcaggagagacaggtttgatccctgggtcgggaaaatcccctggagaaggaatggcaacccactccagtattcttgcctggagaactccatggatagaggagcttgatgggttatagtccatggagtcacaaagagtcagacaagactgagtgaccaaggcgtcacttcattcaacccttaaacaagagaactcagagtatttggaaagtcacggaacaatagttttgtttaaagtagatttcacccagaagccatcaagtacagaaggaggtgggggaactgtctgcagtttgaagtagtagacttcctttaattgcaattagcatttaaaaggctttcacattcatttttattcaaatatgccacctttgtagtcatagtaacccttttatatttagatttggttgcagctacaagtctacttgagccattcatttttatcctccctcctgaatagaccaggttttttctttcaaatagaatccactgttgtacatttttattctattaataacacatggttctctctaaaggctgtagaaaaggaaa

SEQ ID NO: 44016 - DNA, 2220 bp, Bovine  19866881123837
cctcaggatcctaagagctctacagtgtttcctacaatttccaggttaagagtcacctagagaacttgttaaacccatagctttttagctgcagcccccagaggctggggtagacaagcattccagaaatctgtacccagaacaagtccgtgatgagcattggggatccctgggaaacagaatcctgatagctgaacaaccagaagattgttgctaggattgtaacctccaaacctggtggcctgttagaaactttaacaatcaggatctgtggcccctattctaggcttattaaatcacaatctctggcagtgggaaccaggactttaattttttacactcctatcctggctgcacattagaataatctagggagcatttgaaattactgagatccaaggcttcgggcaaatgaattaaagcagagcctctggaaaaggaatggcttgtaaaagctcccctgggtgatgctgataaaaccagaccacagctcagcatatgggaatcactggggtagatggtgtaggatgatgctgacgtcatcaggttctcatctttattaaacaaaacggagcagcgaggagcaactacacactgacttggtggcgctgcagggctggttcctttgttctgtcagcgccccagactgctccctgtgcgctgtttgaactatgtattccgatgctgggaaagagtgagggcatgaggagaaggggtaacagttgatgagatggttggatggcatcactgactcaatggacatgagtttgagcaaactcaggaagacagagaaggacagggaagcctggtgtgctgcagtccacagggtcacaaagagttagacaatacttagcaactgaacaacaacaaatttactttaggccattctttaaaaaggttgtgaaactcagatcagattaagaagtttgccatcagcaatgggagtgagaaggctgggagcccagagaggctgtttggtctgtctgccagttaaggatttccatattgcttcaaacaaatcctaaccacatgatgacattgtagctcaggaggaaagagtctctgtcccagcaaagtgggagggaaattctgtagccatcacggttacattttcacaagctcctcaggagactggttggcacatggtagatactcaataaatatatgttgaatgacagactgaatttccatcaccacagccagaaccttaaataacctttcaagatggttcactggtggatttttcaaaaattgctaccacagttgtcacaaagtatgatgccgtgaactattagaactggaggcaaatttactttcatttttaacgtggatggacaaattctacatagttacctaagttagaagtttatttccttaaacttccagaaggatggggatttcaatactggcatcttcccactgtggtggacacagtaattgcccccaaagatgaccatatcctaatagctaaaacctgtgaatatattaccttacgtggtaaaggggcaagtttgattatgattaggtaaagaatcttgagatggggaaattatcctggattctctggattgtccaaaggtaattacaagagttcgtaaaagatggaaggaggaggcagaaggtaaaagtcagggagatgatttataaagctacactgctgacgttgaagatggaggaggggaccgtgagccaagaaatgcaggcagtctctagaaactggagaaaggcaaggaaactgattctcccctggagtctctggaagactttgtgcagccctgccgacattctgggaaaaggcaatggcgccccactccagtactcttgcctggaaaatcccatggatgggggggagcctggtgggctgccgtctatggggtcgtacagagtcggacacgactgaagcgacttagcagcagcagcagccgacattctgagtttagcctgtgctcagtcgcttcagttgtgtctgactctttgcagcccgttggaccataggccaccagcctcctgtgtccatgggattctccaggcaagaatactggagtgggttgccatttcctcctctccagggggtcttcccaacccagggaacgaacccgcatctcctacgtctcctgcactgcacacagattctatgtttgcactgtttgaagcaactaagtttgtcataatttattatagcagcaatagaaaattaacacatcacataattaagagaaa

SEQ ID NO: 44017 - DNA, 1505 bp, Bovine  19866881184097
tgtgctgcgattcatggggtcgcaaagagtcggacatgactgagcgactgaactgaactgaactgaactgatgtctcttgaataagacactgcttcagatctcttcctctgtttcaagtcacatactttctcagctgttttcaaggcgcagggattaactaaagcttctccagttgtgcttggtaatgtgataagcaaccttattcaatacttcaaaacaaggttttatgtttcagaaatttcaagatttagtagaatcccaaggctttttcttaaaaaagttttttttttttttcttttctttcctcactgtctggttaaggaaagtttccctccagcattgctagggctagcaaatttggttcagttcagttgctcagtcgtgtccagcttgttgcgaccccatgaaccacagcacaccaggcctccctgtccatcaccaactcccggagtccacctaaacccatgtccgtcgagttggtgatgccatccaatcgtctcatcctctgtcgtccccttctcctcctgccctcaatatttcccagtatcagggtcttttctagtgagtcagttcttcgcatcaggtggccaaactattggagtttcagctttagcatcagtccttccaatgaatatttaggactgatttcctttaggatggactggtcagaccatagagactgtacagtatccagtgaactgtcccaggagcccctgggccagaagattggacaaaagtaagacgcagtgcctcagtgtcaaggctgaggcaggaagagctgaccagagaagaacataaaaccccgaaggctgaggcaggaagggctgaccagagaagaacatgaaaccccgaaggctgagccagtgctaaacagaggagggggcttgagcttgccagggcctggggcacagctttggcaccaggctgcccctgcacagggcctgaaagggtgagcaagggcctgacaggctcaggctggggggcggccagggccacagcaggagcggagaacaacagtgagtggcccagtcaaagcgaagacgcgactgaggatgacagggtgagaacacggctgcaaggaggtggggggatttgaatttatctgggaagacggtgcgaagcgctcagagaatcggagagtggccaagagcctgcttccaccaggtatcagcctgcgcatcagatacgcccagcaaatgtttgcttaatgaaactgaattgatttcatcataaagtagtttgcacgtctggcccctcggtgtggaggagaaagggtgcagggtgccgatgacggggagcggggacatcctggaacccaaagccatggccatgaatcaggaaatgcccttttccccagactctgttcccaggatcctgggacccagccagctagccggggcgccttatcagaaggaaagtcagacagcccatccctggggtgactgagagctgaactgagctctccccacccagacagacggcaggactgggagggagccacgca

SEQ ID NO: 44018 - DNA, 681 bp, Bovine  19866881217776
aggacagtaatgaaagagagaagcatgggatttttttcaaacctgaagtgctacagtcaattatgtttcagtgggcctgttggtttagtttctgaaatacacatgattctcacagataggcttgtttcattgcatacaaccacaaaataagagaagaaacaaacaagaactcaaaacaagcactgacactccaccactcctcttgactctgacctctcaaataagtgagcaaaactgaagacaagcttattgtaagcaggaaaagtactaggatggagatgggaccaaggacaggatgatatatactgaaaacgtggtggcaggccccttccaacaccaagtgcaggtcttttgctgctttctctcatcccctatgaaaacttgaaataatactttttttttataaaccattattataatgggatgttctttctacaagacagagttaagtaaactccagggataaatacaatgatatacactcaaaagaaatgaaatgaacattctggagaaatggcccagacctactaaattttcacccatgggtcatttcagtaggaagagaaataagaaatatatccagcttgggagatccagaataaaagacagcaaaatttttggtttctaagatagtctaagataaattaagagagatgacccagtaataattttcaagaatca

SEQ ID NO: 44019 - DNA, 899 bp, Bovine  19866881247142
tagtcagaattggccttctgcgtccgtattttgcctgctgtcagttccgttcatgaaaagcaccccagaagctttattcattatcattctgagtcatttctctaccatgggggcagctctaatgcaatttatatttagttcttcctatgcttctagttctttacatcaagccctcctgttagtggtaaggataagtgagccattggaaaaggttttgaacccttagtgaatttcatcctaaaatataccaaaatgctataatctgtatgcaattttcattaagaacttccaccacctgcttgctgaagccacagcaccgctccactcataatcaccacgcagggggcagcattagttaacgtcattagacaaatgttgaggttttcttttgcgtgttcattagcaccaggtggcaagaaactgctagacataggtgaggaatttggggagggggtgattgaggattatgcatcatttagtcactcaactttctgagcatccttgaaaaaccaaagagactaatagaggagtaattttctgtttttttttttttttttcagatacttcaggatcagttctggtttccaaatagagggtgatctttactagctgggtcataaggcaagtcacttaacctctctgtgtctcagattcctcatctataagaacagggatcataattttatctgtctcatagggttggtatgaaaattaaatgtgttaacacagataaagcattctgaatagagcctggttactgcagtcatcattaccatcatcatttgctaactctgcattaacatcgttcatgtatacacactggggagcccacagtgcctaaaatagaattgcagaaaatgatctgactgaagcacagcagcttctcttgtcctttcgtt

SEQ ID NO: 44020 - DNA, 1617 bp, Bovine  19866881397612
ccttgctgcttctggcttcctctcaactacccaccacactccctcattcttagacaagggtgcggaattaattcttgtctgattagcagctactgtccttgtacttcctgacctgccttattgtcttttcagggataggctggtgctgaatggtgtgggaggctatgcccagctcactgcccttgttatctttgccagagccaccctaactccccttatgtctgatatgtgtctcagggtgaggagcccataggaggggagtcaccaaggtaaatcatggcgaagacgtcagggagctagacctgtacagcacccccccactggtggaagtcgacacaacccatcaccatgagcccttgaagcattgtttggatcggaggcaataggaggagactagaggaggtgaagaaagcttctctactgaaaaggagtatttaacagcaccttacaatttttaggaaagacaaacttttgaaacctaaaacttttaagtaaccacaataaactctgacctgagtctcagggtagatgtctccaactcactgtttaaacttcagtttaagtcctaatgttaagtttggccataaatgaggcttgacatcatgataaaacaggctcctctggtgtctgagatgcacctaacctgtgtgaccatcctttatgttttctagggctccttaactatttgggattcaccatgaagaatttttggccttattgttctggcatctgtattgtaggttgtcttcacttttaaatattaggcagctcacagtactataaatggattaaaaaaatgaaagttggggcttctgattggaaggtttgtatattatttaaaattgcaaaggtaagaaaagtagaagaatggaataagataaaacatttggaagaggaggaggtttagagtaaatgagctaaatcctcccttttcatattaaggtgtctagagatattatctcaagttgataaatggagaaaaagaggttaagccttttatctagatttatggaggtaactgctaaaggtactaaaaacaaatagttaaaaagagggtgaatctggggagtgcgatggggggtggaggcagcgagcagacgggaaaggcattgctgcttttccccctaagttcttctctccttgttttgctaccaacacatgtatgactccactggaattttttttttcccctaaacaaggaacagaaagagaggaaaacatggtgggaacataaaattgaatcaagaattaggttgagaagcacaccacattgatgtgcacatttgctgcagctgggccgcacatttggctctgagctgtgcagcagcagttggaaaaggaacccctggtcagtggattcataacgcccaagatgaaagcaaactggttcttggagagaatctagcctgtttagtcacagtgaaatttctgaagtctttctgaagaaaacatggtgacgtgaggaacattctcaacaaccttactgtaacatcaccttttcccaccttagtgtgattctcaactgagatagttggggcgcacacccaagggtaatttgggtaaataattccatgggaagtcagctccctgactgatctagggatagactttagaata

SEQ ID NO: 44021 - DNA, 1016 bp, Bovine  19866881446061
ggaaggagcagaacagctcttcctggtcccatttttcttgtttgatcatccagagcatgtaaattacagtgaaatatggcctgagtcagcttctcacaggacagaaatcagtaaccattgatattgctaagcaacaccgcagaggagcaagactgcaaattaggtgacaaatttataagaagttggagtgtctggggactctcttgggtgtttcattatgaaccatctggatgatccacagtaatgaccacacattattgttcactgttcaaggatgataattcccatataattatatggcacctccatgtgtgatcctcacctacctttcagaatctttcactgtgtttttcacaatccagatatttccctgaaaaataattgggaacagttacacctaacggacaatgttcattcctctcctaaataagattttttttaattactcttttgactcatgtggtggcatagctagatggcaagaatgtgcaaaaaaaaaaaaaagagtgtgttagtcatggcatactagcatttccattggcctgacgtggacttagccttggtgtcccagagaagcctgaggtgatgagactcgtagtctgctcctaagtcaaagataagcacacggtggtacctacaccaagggagatagctaagcctcaagggaaatgaggaagggaaccaaagcctttggcttttccagaagggtagctgagcaaggacccctccctggtctcacttgttcattcattcactcattcattaatatttataagaaaattggactcaccatcctgattttaaaccaagcccagagtggtttgctttttttaaatttggaattggttaccaacatttaaggtacttccctgatggctcagatggtaaaaaaaaaaactgcagtgtgggagacctaggtttgataccagggtcagggaagatcccctggagaagggaatgacaacccattccagtatttttgcctggagaattccatggacagaggagcctggcag

SEQ ID NO: 44022 - DNA, 729 bp, Bovine  19866881534730
ttgggcagttttgatttgttcacagcagttggcaaatggtaggtgctcaacaaatatgtgttgaaaggttactctgacttgtattgatatataaaaaccagattttagctctggctaacatttattctgtagtagtcagtgtttcacataaacccatcctctcctgttacctggatctcatgtgtcagcaaatggtcagttaacttgtgttcttctattttttttttggaatcctcaactttacattgtaaattggtgcctgtcaatctcatttgaaatgtgggtttgtaacagaagtggcgggacctgctgtgggttcttaattaaatgggactgaaggtttagtggcccatgactaagacgggatgattcagttcatttaagatttaatcaaaagagaaatttaccatgcttaattgaacatgccaacttcctggtataacagatttccactttttttttttttttaagagaaggcttcatggaagtgggaaattatattattaatttataataacagtattcaagtttgactgatgaaggcgacttagcattttaagctctggggatgtcagaaatagacaaaaaaaaaaaaaaatccatgattcacttctgctgccacttaacattttctacgtatgtgatgtggcaaaatctgcctttacttgccaggtccaatctttctgcttttactgctgaggtttagatcagaaaataagatgcaataag

SEQ ID NO: 44023 - DNA, 3407 bp, Bovine  19866880359974
gtggccaaagtaatggagtttcagcttcagcatcagtccttccaacaaatattcaggactgatctcctttagaatggactggtttgatctccttgcagtccaagggactcacaagagtcttctccagcaccatagtgttggcttaaggagcgtgcagaagaatggaagaatcagagtgaggtgaagtcaatccagaaatattccaagcactactgagttcaaaatttggtcctgagaagaggtaacaaatgagtgagtaataggtcctttcttgccattcctagccatgtgtggttgcccttaaactgactgcccaaacacatcagtgatcagcttgagaagagtgatatcttgagacctcaatcaaaaatataatagagacagtgcacaggggcagcctgttggtatttctatctttctctctgccacatccgatggagagttgctgtagttcagtggctaagtcatgtccgactctttgcgaccctgtggactgcagcacaccaaactccctcgtccttcactatttccctgagcttgctcagactcatgtccatccagtcagcgatgccatccaaccatctcatcctctgtcgtccccttctcctcccaccttcaatctttcccagcatcggggtcttttccaatgagtcagctctttgcatcagatggtcaaagtgttggagctttagctacagcatcagtccttccagtgaatattcaggtgtgatttcctttaggatggactggttggatctccttgcagtccaagggactctcaagagtcttctctaacaccacagtttgaaggcatcagttctttggggcttagcctttttttagggtccacctctcacatctgtacatgactactggaaaaaccatagctttgactagatggatctttgtcagcaaagtgatgtctttgctttttaataggatttctatgttctggtagagagaatgaagaacaattttagattttcaagaccaatgaatgattcagtaaaataaatagatacttgatgtcctactgtctcctcttttcctctcccctctccaaaccatcaacatccacgtagcctaaaatgttccttattcatctggcttttttatggcttcatagatgaggcctttcccaccatctgcgctccagctggagagccctctccagagaacatctatcaacctgactgcctgaatccaatcccagctgtctttgctccttgaaattcagcccactgacaaactgctacttttaaactcaagcaaattcagagaggttgtacgtttgccaagcaacatcagctctgggtcattttaaggtctgtttttaagggacaactccacgtggcaatacacagttaattggatgcatgatttctagtggctccatgcttgtgtgagttctgtgtcccagaaaaacttctttagggaagtctgggggtgggctgtctcagcaggggataccacagcaatgtggcttcccagaagagcctccatccttgccagcgctccaaacaggatcagagtctctaaaagaatagacaatagatgctgtgtgcgtctgaagggccacatctgcctgacacatggagttaggcaactattttctaggttttaccatgctggtttataggtctattctaagactgcataatggatttcagagaataccttctccctttaccctggatccccccaaaataaacttctatgttatttttggggcttcctggtggctcagctgtaaagagcctgcctgccaatgaaggagatgcatgagactgcaggctcaatccctgggtccagaagagcccctagagaaggaaacgggaacctgctccaatgttcttacctggagatttccagggacagaggagcctggcaggcagtagttcatggggatgcaaagagttggacacagctgaggaggcacacatgcgtgcatgcatgttatttttaatgagctaaaacaattatgggcaaaggcagacaaggccagttttaagcaaaaacataaagtcctacatagtctcctttgtgccacctcttccctgtttaagtccctcccttcctgattctgggttccctgttcctcccatcatgcttgcctctgtggttctcgtccagcctttctgtgtttctcatgattggaggcacaggcttaaatttggttctgcccatgaacagctgttctgtgagcagccatgactgaggacgactgctgtggagaattcctctcgaaggtctttccttcagtctgcaaatctgttccagtttccccaccttgagaattctttcccttgacattgccagctgtggctcctgttccccattcctttctcttctcttgctgctaaaatggggtctcattcatttcctcacatggctttactcatagcccctctggaaccccactctagacaccccatctgggattgataggctcctgagattgtgctggaagaccaccactttcttcttgccccatccaaaggcctttcattcatacttttctttgacttccaggacaggttccccaagcatcgctgggtagtaagggctttgaggatcaggctaagaaacttgaatgtcatcaggctattaatgaacagcagtactgatgaatattcttggacaaggcatgacatgattggacctgtgtttatggaggcccttcttcaggttaaggagaaaagggtgaactagagacagtctgaagggaaaaagaaggcagttggaagactttggtaggccatgaacaatcaggttcaaatggcctgacaaaagggggctggtacggagatgccttaaaagaaggatttgattctattgatgatctgcttattctgcaagtatcagaaaaagagagagtcctttctgaaattttgccttgaaaaggagggagggagataggcagggattttttaaaaaatgccagtcttccagtatttcatccttatacccttcactctgcaatgaggagtaagaggctagaggggtttggggattttattcacatattttttttaatctagaaaagagtaactacatacaaactactgcattgccccagtattaagccttagagggtccccaagaatgtaggtcgtaggccaagagctgggaatgtcaggaaggcatgtgatttttttgtttcacagtgggaggttttgaccctgaagaaagagcagtgggtggggtctgggagtggagacaggaaaagggagcagatttttctcatctggatgcagcttgaagagctgccagcaaaaatggtgcagctgctatcttgcacaaaccctcgaatgaggccacagggccctgtgggtttgcacagtacccacttccttctgttttttttttttttttcgcgtgttctttttaccaaatacgcaaataga

SEQ ID NO: 44024 - DNA, 1110 bp, Bovine  19866880641083
acagcctgtctggcgctgatctcccccgttttctctcaggtcctgaagctgcttctcgtggcctgggaccgccgcctcatctttgccatcgggacatccagcaccacgggtgagtcagacaccgtcatctggaatgaagtccatcacaagacagagttcggctctaacctcaccggccacggctacccagacgccaactacctggacaacgtgctggccgagctggccgcccagggcatttccgaggacagcgctgcccaggagaaggactgagcgggggggtggggcctcgggggggcaggggtgtgggagccacagggcaggaagtagggagagtcagggtggaagttggtgccgtgccctcctgagccccttgtgcagtctccatctcccatccttccggccacagcagggagccagagtgaataagggggtgtcattcacaaacctcatccaacacacaggggctgtgggacagggtgagggccgccctccatctgttcctgtggagtttcggtgctgggtaggcagggactcctcccctcaccgccccctaccccccagcagggggcacggtcagcacacttagggtacgggcacctcttaccctggccttgtgaagccagaggcacccgccttggctggcttctcgctgcttccactctgcttggagagcggagtttctacttttctctcaccccctggaggtgaggagctctcactgtgcaagactgaggggcagaggggtgaaccgctaaaccactgcgacatcggcaaccgatgcctcgatgtacatcgaggaagtgcttctcaccaagagggtctgagcagtgagggcttccaggagcatctcagctcccatcgtggtcctggctgctcccgcctcccgctcacccctctcccctgtccaaagaggcatccgattctcttatgcagacggagggactctgggattcctctctggggcgctatgtctcccgcccctctctgatcagaccagagcctgcgtcccacttagcatctgaattagtcctcagggagaggagcccaactcttccaactcatcccagaccagctcaaagattccttggattcatccagtcactggag

SEQ ID NO: 44025 - DNA, 1039 bp, Bovine  19866880874954
tacctggcattcagaggcaacccctgtgaatgggactcggtcccaccagacgctctggggagtgagctcccttccctccctcgtttaaaacaacactccatgggtgatggcagcagagcgggaggcagccaagaggaggcacagggcgtgcgtggaggcctttaccgtatcccctgaactagcctacggcacaaagagagagaggagacccgtgtgaatgagttcagagagcagtcatctgcaccagaaccccagcccgtgtgacctctcctatcggtcactgagagatctggaccccagctggaatttcactgggcgggttctgctgtggccacagtgctttacacccagcagacactcgtgtatctcacagaagtctttaatctcttccactggattcatgacgtcttatgccccttccacccccagcctcctcaacgtaacttctaaagtgccgacttcagtgagatgtggaatcctcctgtttccaacttactgcagttttgtctccagcaagttcagtttctgtcggtcaacgtaacgagaaaagagggatactaggtttgtgggtatagagattggcttggccaggcccgtctggggaatccgcaaaagttctcgggttgccacaaacatcacctccgtcctaacagggaaaaccgataataatgtaagaaaaggaatgaaaaagaggacctgaaagaacttcaaagaagaaacatggcccagactgaccatgggttgctttgcgccaattctgaagcagcgtctgagctctgtaggtcttccccgcggctcaggacgacgaggagcagggacaggccaaactgcgagaggagaaaggagaggagacagagggcgtgagacaccgcgccggccgacggggggccaggcggtcgagggggcggcgctgaatgcaggcacccctcgccatgctgctccgagcccgtgcagagcccagaggggtccctccagactcagcagctcaggctctctcaagggcaacggctcccccatcccacccttcgataaaagcgga

SEQ ID NO: 44026 - DNA, 1586 bp, Bovine  19866880951750
ccccgggggcggccggccaggacgcggcgcggcccgcggcgcccgtgaccagcgggtagaccaggtccaggcggcggcgcacgcggcgctggcgctgcgtctgccggttgatctggcccatggtgccgaagtcaatgacgtagccgaagccgatggggctcaggtcgatccagggcctctgcttctcgaaggcgtgttggatggtgatgcccacgtccatgtcgtagggcgtccaggagccgtggtcgttctcccactcccacaccacgccctttccgggcgccgaggcggggtcgtagtagttgcgccggacgggccggagggtccctgccggagagggacggaggaggcggtcagcggcacccagggctggaacccacgggtgctaccttaagaggctcgcggtaagcgagtctacgtggccggcccttggctgccttggctttgaaggaggcgccttcctgccgttttaaggtctgccgtgaacggggagggttcaggggtgcaggctggggtggaaggcagggtgggaagctgatgagctgcaagggaaggatgcgggtgacgctgcagggtaccccaaagagcactgcctggtttggagttcggagactctactttagtttgcagccacatttgtttgcttaatataacagcccacaacctccttttctcccccaggagaaataagataatagctcctttgcaaagtttttgccataattaaatgttgctctctcactcaacatgtatgtatttgtgccaagtccgggatttctcaagcgccctgtcctttgcactaaggcatatcacctttgacacatagtaggtgctcttaaataatctctcttcttccgtgactctctgaaggcctaagcccccgagggctaagaggaaaagaacacaggtcagggaaccctagagaacgtaggaagactctgtccccacccaggatgcccgcccaggtggtgatggagctggctgtctggacttttatgggtgtggtaaaaaaataaaagatcagggtggaagaactctctcatatttcccagcattaaatcttatatcaacaacagtaatagcgatcctaagaataactttctatttatctaacatcttttattcaagaggctcaaccttcctaaagatagggttgtggctgtttagttgccgtttagtcaaaagttgtgtctgactctttgcaacctcatggactatagcccaccaggctcctttgtccatgggattttccaggcaagaatactggaatgggttgccatttccttctccaggagatcttcccaagccaaggactgaaactgagtctcttacatctcctgcattggcaggcggattctttacctgctgacgccccaggaaagccaaaggcagggtgaaagtgaaggtgctacttgctcagccctgtctgactctttgtagcccactaggctcctctgtccatggaattctcctggcaagaatactggagtgggttgctgttagcttctccaggggatctccccacccccggaattgaacccgggttcctgcattgcaggaggatttttaccatctagccaccaggg

SEQ ID NO: 44027 - DNA, 1593 bp, Bovine  19866880983811
gacgtcgcacgcccacagcaggaggtgaacaccggggcctccagggctgaagtcctgaaggaaaggaaggcagtctggggtgaggggcttggaatttctgcaaatactaacacccaggttggggagcaactccccgaacccccccttcctgcaacaggaagcgtgctacagtcctgaggctccttcacctgctcacagagggatcggtagccattctcctctaaccggtccagctcaaaggtctccccgaggagtgggttgaacggcttgctggtgcggaagacagtggtggagtaggaggacacggtgaaagctgcaacataacagagctgttctagagagttctcgcacgtggcggcccggtccaacagctcgtggtactccaggtcttcagtgaggcgctgaagcatggacaagggctcgttaaagttcacctgtcaggaaaagagcagatgtaaacgccttgcctgcacagccacaccacaccatttcttcttttctttctccgcaggtggagacacacactgagacgtcaagacgataaagcagatccctggggagagcagcctctgctccatggggacgctctacgccaaagaacgcccgttctccatgctgagctgctcgcgtctggggctgggcgatctccacctgcactgatttgctagctgaaagctgagacgggaaccatgcctcttttgttcagcactgcatatccaagagccccggacgcctggccccgggagactcataaaacaggcatcaaatgagtcaatgaaaggggaaggacgtgagcacagggacacccagacaggaggctgggcacgtaacccttctgaggaggagaggaaagctagcggagtccaggagcaggcagtcctgacggggagcacgctacaggggccagcttccgctccacacctggccatcactggactcaattcagtgccccgtcaggccaggtgctgccttctctcaggctgcacagctgcattctggaccgggagtgttcacaccaggggcagggaaagggctctgcgtgctcctgtcttcacgtttaagagccaacttgaggacaccagactacaggatgaagcgagcgtgtgtctgtgtgtgcctctctcgggagaaggtgtccacgcacgccacagattcatgggtgccaggccctacacaacccactgtgggcagagaagtgagcagaagagactttgttctccccaccccaaagagtcagcttctaggttgtactgtttggaacatatcatgactttctatttaaaaacttattatcaaaagaggttaggttcccaggttagcccataacgctgtttagtcagcagcacagctaaacaagcctgaaaaccagcagctcaagttctgagtccagagaagagaagaaggaaggaaaaaacgccctttgtactggatgaagctgaccgaaagcaccgttttggttactgaaacaagcaacaatgacacttttcttcctagactcccacctcttttcctgtctttttctgcacttttatccaaccttctgcccgccactctctgtgagtcacatactaccctaatatttactgtcctgcc

SEQ ID NO: 44028 - DNA, 1406 bp, Bovine  19866880988963
gggctggagaggggacgggagagtcccagagggccggacaacagctgcccgagcagggcatgtccgccggtcttggaaagcccccacgtcctgagcgctaattaggatggtcatgggaaaggggtgtctttccaccccctgtcttcatctgtagccatgactcccaacaagctcgctgccaaggactttgcagacactcgcctattgagggaagccttctgggaaaaggattccagaagtgttagcatctggggggcttcagccttggtgagagagggggaaaggtggatctgagagagactgggggaggaggggctaaagagggaagtggggagactggggcagaggacagtggggagactggggcagagggaagtggggagactggggcagaggacagtggggaggctgggacagaggagagtgtggagactggggcagaggggagaggggagactgggacagaggattgtgtggcctggggggatagggagaagttaactgtggatttggggtagcggttggaaaggtctatcccttttggtgggtccagagggaggatgatggtcaagacacctcccgacagggaactccagtcctgctcagaattcacggacgggtgttagctgttcagtcgtcattgttgagccgctaagtcgtgtctgactcttttgcaacccatggactgtagtccaccaggctcctctgtccgtgggattttccaggcaagaatactggagtgggttgccctgccctcctccaggggatcttcctgacccagggatcaaacttgtgtctcctggatgggccagctggttccttaccgctgagccaccagggaggcctatgagctgtcccatttcagattaaatctcagctgcaggtggagggacaccttagcaacataaaggtcccaggcctggtcccacatttggaaaggaggaaagcttactcagtgttcagggatgtctgcggtgggcctggtatggatcctttgtacagaagtgaagtctggaggagacccggtggaaggacagaccctcctccccaggtctgaccactatttgctgagaaccagctgaccactgcctgggagtgcacagggaccctggaggctggggcgccccacaggttagacctgagctggccctggagcctttttctaactgccttagggtacttgttccactgttctcttccttttagagactgttggtttcacccactcacgctaagggtcagttggccaacccatcctccgtgccagacccggtgcagaaggccctgggctggattcctgggagtgctgggtctgtcggggagcttgccaaagcagaatagcatcttggggtgtctgcaacccccctcttctgtctttctccgccaacagacacacaattcctctc

SEQ ID NO: 44029 - DNA, 861 bp, Bovine  19866881069008
gaagcagcgtggcagagttggaagaactccctaaagtttgagtccccgtctctgctgataaccagatatgtaccctggagcgagtgagcctttcgggtcttccaaggtaaaatgggaccaaaaacccgtgctttgtagacttgcaaggattaagtaaagcgataaggcctgcaaactagaagtggggggagcccacgaatgatgtctgctcttccttggcaggcatagtcctcaccgcaaccctaacaccatggctgggatttacagatgagcaagtcaggattctacgatattagggaaccggcttctatcacagggctgctgttgctgctgctgctaagtcgcttcagtcgtgtccgactctgtgcgaccccatagacggcagcccacccagctcccctgtccctgggattctccaggcaagaatgctggagtgggttgccgtttccttctccaaagcacgcaggcatgctaagtcgcttccatcgtatccgactctgtgcgaccccatagacagcagcccagcaggctcctccgtccacgggatcctctaggcaagaacacgactgggttgccgtttcctgctcttagtaagaggcaacgtctccttcagaattcagacctgcggggaccccaaagaccaaaaggctcccctccgcaccacaccactgcgggcctttcccctgcagccagggggtctggagaagccatggaggagcttaagccagagcagcccctgggtcctctctgactcaggcgatcctcaggtctgaggcccggggctccggacgcgctcaggggtgtcaccgcagaagcacttacccagaggcgatcagcacccgggactgggcgagggccagt

SEQ ID NO: 44030 - DNA, 1311 bp, Bovine  19866881838452
accctgcgctccacccggcaataaatgtctgatgtgtaatcacatgatggaggctgggagccgagcttactactttcttggagccttcctggtgcctaacccagtcctaggagagcagtcaccgaatgaatgcggtgacctggtcatttacaggtggtcatttgtggtacagcacgtcagcagctgggagtgtggctgctgccggagaggaagcccttcggtaacagacagagcaggagcagcactctgggtccaggtcccgcgccctaaaccctgcagagatggacacgagggcgcttctgggcttcagaagcacgcagaggccccttgctcacctggtcaatccacagtttgcccacgatgatgttgtgcaccgttgtggtcactttcttccaagtgtagtggtgcccagtcgcatggaaaatacagtggatgctccctagaagcagagcgcggcacacattaagcccaacgctagaaaagcagccccgtgctggctggaaataatgatgggttgattttattctatcaatatttcttacttttaaaaagaaaacagtacatcagaaaggacttataatctttacaaatgttgaaagtactgaatctttcactagatttttaaacttgttcaatatgaataaaatataattaacaatgatgaacactaacaactggtacaacttaactgacaaatagtattctgcaacaatagaaataaaaatgaagcaaaaccccagtcttcactaactgggcctgccatactagcagcaaaattaacaagaacaggtcaaatctatcccaacatgaaaaaaaaattgccttgtggcaaagagcacgttggtgatcagtactgaggacaagccccattgtgagtcactagctgtgtgactttaggcaagtcaccggtccgtatatgggcctttaaaaaaaataagcgtttagcatttttttttaaagtctttactgcatcttttacaacactgcttctgctttacatgctggtcttttggcctcgaggcatgtgggatcgtagctgccagaccaggactgaacccgtacccactgcactggaaagccgagtttcagccactggaccattagggggtccctacctttgagccttaatagataaaaaaataaaaacaaagaggagtagtggacagaccaagggctctagaatcagacagaactggttcactggtccaccactcgttagctgtgtaagcctgtgtcgtataataaagaatttgtctggtctttgtccaacattgaaacccttgccatttcccaagtgatagtgtctcgttg

SEQ ID NO: 44031 - DNA, 3372 bp, Bovine  19866881908619
cttttaatttcttgctgcaatcaccatctgcaatgattttggagcccagaaaaataaagtctgacactgtttccactgtttccccatctattgcttatatatgaaatcaaaagaaatggtacaaatcaatgtatttacaaaatagaagttaagtcacagatgtagaaagcaaatttgtggggagggaaaaattggaagactggacttgacatatgctatatatagaatagatatgtatatacagaatagatatattctatctagaggatagataactaatatgtatatagaatagataataaaaaccccactgaaaagcacaggagactattcaatatgctgtaaagacctgtataggaatagaatctacaaaagagtgtatacatgtatatgtgcaactggtcactttgctgtacagcagatactaacagagcattgtgaatcaactatatttcaataaaaatattagaaagaaacaaaatgcacagtggtaagggggatgagaagtacacacagggaaaaataaaagtatttgttgagttggtatggctttttcttttttcaaccagtcgaactagtttacttctgagaaagtgatgtaaacagcagggcaggtagctgcggatgctgccatggcttatcattacatatggggactttacaaaatcaaacagtgtaagacccaggtcacatgcaagtctgacaaagtcatgagaagtgaaaagcaatggaaatccttaaaaactgagacgctttacatataccgaatgattgtggtgggctctgctggtgtattttacagatgaactgactaaaaagaaggcccaaagtggctgacgaaagagaaacgacagagaagatttacagtgtttggtgctgttgttgcttagtcactaagtcatgtcctaccctttagggaccccagggactgtggctcgctaggttcctctgtccatgagatttcccaggcaataatagtggagcaggtggccactgccttctccaggggatcttcccggcccagggattaggaaacagttatagggtaactgttgttgagctgggcccagctgctgggtccctgctctgttgagacagggtccccgtggccttctccctgcctggaccttgcagtgctatccttcacccggaccccccacttccattacagttcacatttgtgcctggcttgctgtcagctgcactccagggatatgttctttcttctgtgtatctggattcctgctgatgttcctgttcgacactgatgtgctgggtcctttgtatctgtgcatcctggtatagtgaattgtctatgtatggttgagccccagtgtatgacagctaatatttaaaaaatacctcagttgtatacttgcatcttggcccattgcctataaggagattatcccttttcaaacagcatgaatcttctccttagtcttttcatggctgccttcatctcctggttcctcagggtgtagatcagggggttcaggacaggaatgatgacagtgaggttgatggagacagctctgtccatggggagggtggagaagggccgggcgtagacgtagatgcagggcacgaagtgcagggtgaccaccgtgatgtgggcggtgcaggtggagatggctttccccctgccctccccagcctgagaccttattagtaataatatgaccatgtaggatacaaggaggaagacgaaccacagggtggtgaccaggccattgttagaaatcatcaggagctcaaggacagcagtgtccgtgcaggcaagtgtgaggacctgggggacgtcgcagtagaaagtgtccaggacgttcggtccacagaaggggagggggagtaacagggagatctgcacgatggagtggacgaagccccccgcccaggaggccacgatgagggcagtgcaccgcccctgactcatgacggtcacgtagtgcaggggcttagtgatggccacgtagctgtcaaaggccatgaccgagagagagaagatgtctgcacccccgaggaggtggaagaaaaacatctgcgtgaggcagccatggaaggagatggtctttctctctgaaagaaggtccaccaggaccttgggggcggtgatggaggagaagcagatgtccaagacggagaggttgcggagcaggaagtacatgggggtctggaggcaagactcgcagctcacagtgaccatgatgaggaggttgcccagcagagtggtcatgtacacaaagcacaaaaagagaaataagaccaagctcaggtcttgggactgagtaagccccagaaacacaaattcatttactctgctaccatttcccaactccattgaatcatgtgtcctcttcctgtgttcctggggaaaaatgaaaagtgttatttcagagagtgtccgccctaccttaacagagtcaggtttagagagtcaggtattaggtctaaaaactagtgagatgttttgcccagtggatatctgttctggggttatggctaacatgagcaaagtgatacctcatgacacaagcatgcatttagttattatttcctatgtagattatacatgttttataaaatgaatacagtgatgctctgcatatataagttctaagtattcaagataaagtgaccattgtagcatgaggaatatgaagttggagtcggcttggtgagtggtagtgtctgataccgctgagtttcccatgagtgcctgtttgatatgacttagttctcaagagttccattttttccctcagatgatgccttatgtaaatggcttaaaaactgctatctttagaatggttctctttggactgatttctatagaagcactcctctctttttcaaaccacactttcccccccaccaattatttgattaattattttaaagaaaatcccacattgtacataaatttacccattactacttaacatgctaacgtataatgatctgtctgccatgccattagcacacctagcaaacaaaaatgcctcacgtttcctgatgcaaatgagacccaaatattgtgacttcttaaaaagtgtttgttaaggacttttctggtggcgccgtggataagactctgcctgccagaggacgcaggttccatccctgggccgggaagactgcacgtgctgaggagcagctgagcccgtgtgccaccgccgccaagccgagctctgcagcctgaggtccgcagcctagagccgtgcccacagcaagagaaaactcgggagcagcaatggagaccgagtgtagccaaaaataaagagatgaatacgacattttggcagtttcttaaattgctaaacatgcacttactgtttagtcttatggcttttgagttactacttttttggt

SEQ ID NO: 44032 - DNA, 991 bp, Bovine  19866880155636
agtcctgggtgttcattggaaggactgatgttaaagctgaaactccaatacttggccacctcatgccaagagttgactcactggaaaagactctaatgctgggagggattgggggcaggaggagaaggggacgacagaggatgagatggctggatggcatcaccgacttgatggacatgagtttgagtgaactctgggagttggtgatggacagggaggcctggcgtgctgcaattcacaggattgcaaagagtcggacacgactgagcgactgaactgaactgaactgaagtcacccagtctatggtatttggttatagcagtcttgatggattaagatagaagtttactttgtctatgcttcaagacttaaaatgttaaagctggtttaaagatatcagttcccatctacccatcatgcactgttccccatgactctcttaagccagaagcctggcttcattatcatttaaaattgtcctttgaggtggaagcctgacagggatgctatgaagtgaccataatgaagtccagtagttggcatgggggcactactgactgggctggcttgaggacagggaaggtccaggccacagctgagcctcgaggctgccaagaagagctgccccagtgccagagttccaggttgggactggggatgtctgccatcgctcctgcaggggtgggtgggggtgctttgacagtgatcagctgtggactaggattctgctaggtcagcagtgactgagagaggagtggcgctctgggaatcctgcaagatctatcaggtttgcaattctgatggggttaaaatcaaggctccaggaacagtcttttggaggtagtgtgtactgggttactggggtctgacagagtcatagccaggaatttcaatcgtctacaggcttcaagtcatttagtctcaaatcacatgcgtgtaaaaggtcagaggggagaaaatgtcccactcatcaggatactttaccaaaat

SEQ ID NO: 44033 - DNA, 1540 bp, Bovine  19866880357980
ccccagttctgaacttgaaccatgatatttcttcacaattgcaagcattcaaagtattggcatcccaaatttatttaacatggattggtactgggtatacattgataagatattttcattttagaatagagaatttcattattagaaacttgtgttgagtaattacttcctaaagagtttcttagactacttgtgttctctctgtgtttcattttataatgaaattcttacaataataacttcataagttgagctatgtgggaataatgtttaacactattttctaagcagttaataaatattaattaaattatagaacacttgttattttcataagtaaatagtctttgaaggtggaagtgttaagatatataatagatgagtctgtcctggtagaattttcaaatcatacgaaagggagttcccttgtcagcaggaggggaataacacaggaattttatgttcttggtcaacagtaaaatttttgatctcaattactattttctttgcagttctgaaataattccgagtaagaattttttaaaaattctcagaaaattaggttattaaaatgtatctgtgaccatcccatgtataatctgtgctctgtaaagatgtcatgagaagagcatggcaaaagggaacagctggagggagagagaaagacaaagagggccagatcaggggcagagagaaggcaaggaagcaggtgctttaggattataagtgctttatgctgtttttgctaagttttccaatgtgcatcaacccagttggtagcaaagtgaagcaactaaatgtagacccttgggtttaaatcccggtctgccacctaataactgtgtgaccttagggaagttacttaactcctctgagccccaagttttttttttctttaatccacaaaatggaaatagttgcagtatctacttcatggagttgttgtgaggaataaatgagtctgtgtatgcggagctctaagtggttctccctacataatgtgtgttagctgttattcagtcttttgactttaatctgtgctcaagtagttttattcattttaatgacttaaaattagttctacaaatgttaaaagttgtccatatagaaatgtatactagggttttctttcttttttttttttagcattcagtctttttttaatcaaagtatagttgatttacaacgctgttaatttctgctgtacagcaaagtgattcagttatatatatatgtttttatatgccttccatgatgatttacctcaggatattgaatacagttctctgtggtatacagtatgactttgaggcttacccgttatatatatatatacaatggtttgtatctgctaatctcagattccaaatccattcctccctcactgccccaccttccctcacttagcaaccatgggcgtgttctctgtgtctgggtttacattcattcttttttttttttttttaattttattttatttttaaactttacataattgtattagttttgccaaatatccaaagaatccgccacaggtata

SEQ ID NO: 44034 - DNA, 1365 bp, Bovine  19866880420942
actgcatggttaccaataatttaaatcttattgatttggtagttttatttatatttatagttagcaaatctgattttgtttaaaagatcctaatgaaactaaaatctttctgcattgaaaaggaatccaagtgacatatactaaaatgggtgcttttcgtaagggccatgacaccagttaatttccttcattacttacataataaatatggccataaaatgtgattaaaaaatcatctgtgtacggcttttgtttttaaaaaattctgacaaatcaaaataaggctctaccagtggttcccaaaatgtgtctctatgtagcttaagaacaaagttttgaggattttccttcattattagattatgagattatcttgtgaaactaaattttccctttattttcttaaaaggtggtagtagatggttattttttttcatgtaatgacttggaaaaatccaaaatttgccaatcttatgtcaattgcctagatttttaaatagcatatgaaattttaaaattgtatatgaaaccataatctctaggtaccacactggcctacttagtatgaaattttatatacacacacacaaacaaacagataggaattttcacctggtaccacagggaaaaatcattttgaacatgaacttgcgttcaagaagttcttgattctacccaaagatacttaacacttctctatttgtctctctctctctctctggtctggggctaagagcgctcaggtagttaagccacaactacttgaggacaggaagagatgacttatcttgcaagcacacagaagtagacattttgccgaacatcctaggataaaccacagcctaataaggttaataatgaagatgacaaatagtacataaagaacagaactatggaaaactaacggtagcaataaactttttgatattcctctcattgagaaatggattttaactgcctacccttggatcgacaggttgccttagggattggctggaccaaaagactgtggcagaagtgatattctgggactttggagccttagaactccagcctggaacactggaaccttctttctcacagtcctgagctgctacacaaacctgactactgttaagacactgtactgtgaggaagccaaaccttggcatgagagaggccatgtcaaaaagagaatgaaatgcctagccagcaccacaccgttcaagcctctagttcttgatcttcccagcagagactccacacctgggggagcagcgacaagccatcccgcataggccatgtccaaattcataagccacacaatgatgagatgacaataagttgttgctttaagcaacagataaccagaataaaacaaatccc

SEQ ID NO: 44035 - DNA, 4875 bp, Bovine  19866880521470
cgttttctctttaagttatttaaatgccacctttcccccttttattattatgcgatggccccttaacccagctcccctggaggctcagatggtaaagaatccacctgccaatgcaggagatggttcgatccctgggttgggaagattacctgagaagggaatggccacccactctagtgttcttgcctgggaaatccatggaaagaggagcctggtgggctacagaccttggggttgcaaagagccagacacaacttagcaactagacaaccttcaacacatttcttcaaaatctaaaaatttcagcttttcaaatttcttgtttttctgtgtctgccccatatgccgtctttttcgagcaacttccctgggctatctgtgtgtgtccaggacacattgcccgccaacctttaaaccaccaaagggaaggaaaaggacaggggtgtgtgtagtcactggtcaagttggggacaggcggatacactctgccagctacagtaatcaggccgagatgccccgattgaatcactgctcatctatagggaaaaaagactctcagatgggaaaaaaaggaaagagtgaattgagtactggagcagggagaggagggtggggaaggtggtgacaggagcagacggctcctgcttgcctctctgctgcctgccacagggccagaagcaggcggaaccccacagcactcacgcggatttccactctgctcctcagcgggggaaactacagtgacaggaccctcatcacagacaagaaccaaagggctctgatctcaacctttctaactgatgctctgaaccgcctgtcaagcctcagctggcagcaagcgctagtactgcatgacagaacacaggtgtgcaagtgtgtgtgcacacacgcctaggtgaattagattttttgccacccaaataagagataaaacccaaagacagacagatctatggcttcgagtatgcatgtgtgcatgctcagtagcttcagtcatatctcactttatgggaccctttgggccgtagcttgccatgggattctccaggcaagaacactggaatgggttgccatgccctcctccaggggatcttcccgaccctcgtctctcacgtctcctgcactggtagggaggttctttaccactagtgcctgggaagccctccagtctgtatgcacacatagaaaaatcactgaaaataaactgccaggcataaactgggaaattgggaccgacatatacacattactatattgtaaagcaggtaatgtgtaagaacctactgtatagaacacggaactatactcaatactctgtaatgacctaaatggggaaaagaatctaaaaaagagtggctatatatatgcataactgattcactttgctgggcatctgaaacttaacactgttcaaatcaactatactacaatgaaaatgtattagaaaataaattgtatatacagatgagttttaatgacattttgtagatcaaagttaaatattaatttccaacaaagggaaggagatggagaatacagaagggcagcattgaagcttcagacattttattttgtgagcaggtttaaactaacagtttcttaaacggtctacatgttttcaacattcacatgaaattaacgttcttgagcatttctttctggattctgaaatgttcagtataaatcataaaaactgaaaatgtcacaagtaaactcctgggtcgtacctgataggaaattacagtcattgagaataagccagtttctaccaaatactgggggcaggggggtgcgtgtgtgaaaggacaagactggaaaagaagtttcagtttgtctattcttgctatctagagcaaaaaacagctctgctgttactgatagcacaccttcccttacatcctctgatgtcagcctgtacaaactagatagtagagcaaagaaccaatgtttgattttcttaaagtaacaatactttgggcaggggtgtgtgagtaaacagtgtcagtttaatgcttagcataatatgatgaaagcaaaataatatgttaaccctcaacatagcttaaaaaaaaaaagcactcttcttgcatgaaattcatcaatgcaacttacaaggtaacaaagcaggtgttcaaaatacaatctcatgccattaaaaccagttaatcatccagaattcatgtaaacggtaatgtgtattttatcttttatcggtactggccatcttccaaacagggcctgtaaaactgtcagatttattacatgctgaacaaattcagttaaagaataaataaggataatactactgctgaaatccaaacataataagtgatcaaacatcagatctctattgccattttcaagaaagttataaaacattagcctgctatgaaattcctacttgcagatgaaatttataatgaaaggacacacagcgctgttgaaacaacttttcttatcaacacctaacatggggaggagctggccgataaatcacccagctcttgatacgagaccagaaaggcttctatgcctcccaaggccttctggctcttttctaaaatgctctctacaagatgctgctgctgctaagtcacttcagtcgtgtctgactctgtgcgactccatagacggcagcccaccaggctcccccgtccctgggattctccaggaaagaatactcgagtgggttgccatttccttctccaatgcatcaaagtgaaaagtgaaagtgaagtcgctcagtcgtgtccgactcttctcgacctcatggactgcagcccaccaggctcctccgcccatgggattttccaggcaagaatccgggagtggggtgcgactgccttctccgctataagatgcaggtgacactactgtgtcatctggggtctgattcttcataaacttagtaagacaaagaaacactcaagtaatactaaaagtgtacatacttctgtttgtttaaacacttttccatttctatcctattgaattcatcatgagacgataatctttgagggccctccacagctcagaagtccatgtcaaaagttcgatgtaggcattgtttctctatcacaagtaaaaaacatttgttcattctaaactgtaaacaattttttcctcagagtatactgtgttccaggagggtcttggttttacaaaagcgaattttctggatcagactctgaagaagtctaaagaaacacagcatctaatgctgaaatatacataatgtgccttaaggatgtagaggcttgagaaaggcagaaaatcaagtgggccaacccttagatgtcagttagatgatacagcagtgaagacaggggagggggaagaaatcactttctaaacagtgtcaactaaacaaaattacccaaagcaaacaatattttggcaagaccccaactcttggcaggagttaacaaattttccatgcagtacatacataggttgtatgaaaggatatattgttggttcattcaaacaagcagacaaagaagcaacacacatacaaatacaacagaagcaggactatgaacatttactgaaggcagggctgaaaggacagagaaaaagaccaaacttttccttcccactgggaaaacaagtaatgcattagcacagtgacagaagatgctattcaacatttcaaaactaaattttagttagtaaaatggtctatgatttcccccaaagtgttattttttactagatctcaagaacagttttaacttcatctttacccgacagtatgttgtttcttgcttttcatacaataaagttgtagtttaccccatacattacagtgtgtatttacagaatgagactcacacaagtgcacattaattcatggagtgacaacagtcaggttgctgcgttttaggaaactcccttcacataaatccagaagacagggcatctgataggaaacaaactctcagtttaacttcattacctttgagcaacttactctacacttgccttttttaaagttaactgcaataagccaaacacatactattactattatgagatgatttttcaaagataaaacactaacagtctccagttggacacaggagtcaaaaaaataccacaggctacaactacagctcttctccaagtaaaatggcttcactacctaccttgtcttatgctgtttcttactccacgggaacagtaatgactgtgtataaacaaacgttcaagcctaaaagttccttcgttctcagtgtgctgcactcttacatttacttttgtataatggccttagagtggtatattagacagtaactagaagacatattccattttctgactgaaagccaataatcctcatgaattttttagctgagagacacttcaagatgccattgggaagacggtgagaaacacattaggctgcaaatgtgaggcagcagctttttaacacagggctgcaataatcaagtaagtggctaaattcatgtttgctggttacacaaatattttgctgtaacatttccatcattaccatctctacaaaagaggggaaaaatatcctctctgaaaatcttctcttagcaaaattcagtgcagaatgtgtcaggatgagagagctttctaaggtgtgtgtgtgtggggggagggaggtagatcttgtctgacgatagtggcataggacagtttccactttctcagttctcacaggctaaggtccttaatcgctggtagcgcagacggtaaagaatttgcttgcaacgcaggagacccggattcagtccctgggctgggaagatcccctgaaatagcaacccactccagtattattgctgaagaattccatggacagtccatggggttgcaaagagccggacacaactgtgcgactaa

SEQ ID NO: 44036 - DNA, 1352 bp, Bovine  19866880566370
cagcatgtggatgttgggtttgggggctggggaaggtttcttgaggtgggaatttgaagtaaaatatattctgtttaaaagtgtactgattcccatgtatgtgcatttagaatcgccagccacttatgaatcaaatcagcaatgtttcaaatgtgaacttgactctgaggcctggagtacccacacaggtaaggggcagacaagctgtcagtatccacttaacctgtctcatcatttccctccttgatatcctatgtaaagcgacttagaaggccacacatagatctagatccagacgatggaggtcacgccatgtgccttattggtctagtctgttgtctttgtggttccctccccatcactgccatttttattgccacatacggtcagttaccattattcacactgtgtgttcagtcctgggtttccctgatggctcagtgagtaaagaacctgcctgcaatgcaggagaccacaggggatgcgggttcagtccctgggtcgggaagatcccctggaggaggaaatggcaagacactccagtattcttgcctggagaatcacatggacagaggagcctgggatacagtccacagggtcacaaagagtgggactgactaagcaaacaagcaaagttcctgccaacactgaattggcaaatagtgaaccattgcttctaggagaaataaagtgttcggtttctttgagcctcttgtcacatttccatcagtcagtccatgtgtgtttctgtttgaggacaccttttgtaatatatattgttgatccattaacgtcaaactcaaagccagcagcaccataactcacgcctgaatgaagctcgtctaactcacacagtttcccccacaaggcacatcagcctcctggacttgtttaggacactagatagcccttgagcactagtctcaggaaccattttaaacagcagagttactgatgaaaagcacagcagtgtgaaaaacgtggaactaagtagtccacaagaaggacacttgtctgcagtgtgagagctgaaataagaactgatgtcacctcgtttcagccgtgggtaggaatgtgcatgttgggcttctcacatattttgctgttccacatgtatccataaatgacgatggtgcagtgagtattggttctggggtgacaagtacatgttagcgggtaggccagctcgccagtccgtgaataatgaagtcagctgtgtacagccaagatccataaccagcctgtccccatcactgacagcaagcacggtaccccttccctcatccatccttccatccatcctccatcctggcctctgtcaccctcctctccttatgcaactccctttcttt

SEQ ID NO: 44037 - DNA, 980 bp, Bovine  19866880582908
tggaacacgcgtcccctgcattggcaccggggaagcaaaacaacccttaagagtcatgcgggtagggtttcggaggttagcctggcctccccagctctatcttctgatgaagcacacaccctccccttcagcactcgcactgcccgggatccacctagaagcgccccttccgcctcctgctcccacctctcttccagttgcccccgactcccgcattatggggcccgcctttaccggcgctatcggtggggatcaggaggcccgagatcgcgtgctgcaggcgggctgagtgctgcgggctggggatgaccccgtacagaaccaagtgcaggtcttcctgggtgaagtggtagcggcgagaagccttcccttttcggttcacgagtttggggccatcctcagagggctcgctgggggaccccgataacagctgcgagggcttcggcctctcaggtaacaacgaagcatccacggggggcggcggaacgaaaatctcaggtccccaacactggccaccgtcgctccggccggcggtgtgtgccaagtcctcgctggcggcgccggtaaactcacgactgctgttctggaagtgcggcacctccctggggaggtggggaacagggtaccaggtcggcagcttgctgtaccagggcaggtcgcatagcggctccctcgggagggccaggccctggcttagcaagggaggcgcggtccggaagccgaaggggggcagagccggggacgctgccagggcttccaggggccggaaaggctggaagccctcctctgccgcggtcagggtgttcccgtagtggccgtagggcgggaaaggcgtgtagtaggcggccaggtgttgggggctgccctggagccagtcgggagggtagcatcccttgtcctgggggccggcctcccccggcggccgcagggccatccccgggccacggcgctcggcgggtctgcggaaaagcaagggcggc

SEQ ID NO: 44038 - DNA, 1566 bp, Bovine  19866880614749
acctattagctcaagctataaatagggtaaaatcatctacttccttccagttcagtcaaatgaacatttcccttttacttttggtctatttctgtttgtgtatctttcatactcagcattaccttaatccactggcctgcctttccacgagacgagtgtggtgttttggttttataatatgttctatgatttgccgtgcagactttttggctcactctctcaaataacaagttgtatttttctttcccatttgtcttggggagtgtccctttattctaaacattttccattttaaaatcacaactcctgtactaaaatacatccattcttctgtcttactgagcaatttagtttatggaacaataaactccaggttattaaaaatattttgcctaaatacagagttgctgaacttccatttgaagtaatttgatggagatcataaaggaatcttttggggagcttgggacataagttttgagagagtttatcatcttggccattttttcatcaattacctggtacacatttctagttaggtttccctgcaatacctctgagcaaacattgggttcttatgcaaaaggcttcttacaagagattgatttgttgatttttaaaatgcctcttaaaataagaattcccattaaatttcatattggaaaaagaagcaatatgtatgattgacatctccaagaatgtcttgtgtgtgctactcacatacaattgttttgtagccattatattgaacatgtctcattttgagagtataaccttgagttgtcattgctttagaaaccatggactggttaggacatccattaatgtcctcgaacaagtgctatagcagaatccccaagggagacagggattttactggtctctggacacaggaatccatttgttggagcatatactgagtgtgatgagctgtaaaatgaagttaatttctgtgccagaccaaatgtggtgaaagcccgagcaactggataagatgagggctgcatatccttcggataaaaaaatcactgccttaatttcagatattgtcacatgaggtttttttggtttatttgactaggccacgtagagcaatcaagaggaacatgaacataatctaagcaagagctcaggcttcaggaagctctcattgtgaaatctttaatttcaggttacacttcatgcagagtagtcgaagaaaagaggacaatgccttttcgctaaaagcaccctgtaagtgaaactgttaataccattcttgtgagttcttgtagctgcaaattttaaaacagaagaactggaattttctatcttccacttgagggtacctgattatcaaagcaggaacagtaaaacattttcattttacatttgctactaggagttcatttggagtttgagagtatttttctggctgagattctctttaagctatttaatagtttttctgttattttccatgtcagttttttccttgctattgacagttgctctgctgtttttaaagacagtactcactacggaaaagcgaagcccacattttctacttcccagcccaccccaccc

SEQ ID NO: 44039 - DNA, 960 bp, Bovine  19866880621317
gagaggttgtatgcagagagtatagcatcatcataagaatgaagtagggccactcctaaaatgatagactaattgtaggtaacgatgatattgaaaaattgcccctcctcttctgttcccacagttaaaatgtccctttacttattagctccaattagtttccatggtaaccgaccagcccttgtaaacccgtactctgagcttcactcatctttgtctagactgagctcaccacccttcttcctccacatttggcagttcagctgagtctatatctatatccatatcttttgcacacatgtaaccggcacctaagtgcccacatccacattattgctagtacaatggtggccaagggagaatggaagtggcatttaatccctgagtaccacacgtgcatctgctgccacactaatttttccctctcttggttattgtttcttccagccttgttctattatcatctgtttgctgcttgtaatttcttttcagggaagccaatacagtataataaaaacctcattaaacagaaacacctatcagcctcggtgaaagccctaaatgactcctttttgtctaaagaatcattaaaaaagaaaaaccacttgtttgtcatgcttggaaaaaagagaaccaaatcagcaaaagggtttaccaagccagaggtctaatatgaagatttaatgtacttaagacaccatggttcttttcccccttgtgctgcccgttggctgagaatcccaacctgggctcagtaaacaaataatgagggagggtgagtaagtctgccactccagagccttggtggagatgggaggacctggatctgcagcagcctggttgtcataggccacactgtaccccggggccaccggcaggtgatgctgctggggtccccagatgttagtgtgagaagcatcccgtggaaagtgggggaggactttcagcaaaagttgaaat

SEQ ID NO: 44040 - DNA, 2017 bp, Bovine  19866880632602
cactttttattatgctacatgaatctagattattgatttcataaagacaaaaattgaagtaatattcagaacttttaagataagcatcactgcaatgggtgatcttaactgccatttcttttggggggggccaacttttttttaattggagtataatatgtaattgttttacagtgctgtattagtttctgctgtaccacagtgtgaatcagctgtgagtgtacatatatctcctccttcttgattaactgccatttctttattaactttaggagttttcatgaccagactactatctagaatttgttaagtcccactttcttattttattaacccagtacagtattaagcatcagattctttgctatacctattccaaaattaaaattcaggatgtaggctatggtaagatgaggggaaaaaaatgtcagtgaatatataacaagaagcagaggagccctgagacataaattatgtcagttctcaggataatttactctgctgatgatataatgagattgaaaattatcacatggccagaaggtctgcagcattgccattgtagaattgcttcactggcagcgccgcacatatagaagaaattaggatttttaaagcaaagataaccagttggcgcataagatgatttttatttttagaaagtctaattctgtgaaaatctactgtataatggggctagggagacacagaaaaaatgtaaagattgtctgacccagtctttatttttagagatgacaaaatttagcgcttgggactaccctgctgaccaaaagactttaaaaggaccctatgttgggccctgcttatttctctttcatcactggcttgaaaacacgtaatgacaatttttagagaaaaagtgaaaacagacttaacctgattttccagagttgacaaggcactggaaggccagagagtgctgcttcctacttggttcttagaagcagctgagaaaacccttaactaggtggactcttagaattcgatgaaagaactggaaacaaaattcatttggaaatgatggggaattttaaatattacagttaggaaaatccggtatacctgtgtttattacttacattggggatgacttaaagtagggtggaaactcttgggaagattttcaaggcttctaaaaagagatgctggcagtaaccacaaggctgtgactcaagctgtctgagagcaagctcattaattgcagaaatcagattgctagatgtcagcgggtcttatctcataagatcaaatccacattttcactgttgcaaaatagtcttctgagaattcagtgcattgagcaaaacacctgtgtagcaggacttcagtgctaaacatgtgagagataatgctttgaatctagagacttaaggtttgaatttgcatcttttccctgttaacatgtaataatttaaacagagaaaacttgctctcattgagccattctaggcatagatgcacactcatgcttacatcatagcatagtagttgctaggcaacaaaactaaatgtcaggttttttcatgacagcatatcatagtaagctttaagaaaacaaatagttttataaggtgaaagaatttcatctttccactatatctttaccattgtataaagcagtaggaagccacgtgcacttccaaaagtgacccgtagataatattatcatgacaatccctgttgaaggtgtatttaaagctgtgagtttaaaagaacacttagtacataactaatcaactgacttacttcctgacctccctccccacataccccatatacacatgtgcacacactcacacaaggggttccaacagttgatgccaacctatcatggaaagctatttacacagtcttgctttggcttgcacgttgtttacaccaatgggaacagcacaatgaacatttaagaagagcttaaaacaaaatggtgtctgttatgtgtgtgtgtgtacatatatgtgcacatatacatacatacacatatgtgtatatttta

SEQ ID NO: 44041 - DNA, 1464 bp, Bovine  19866880645706
aacctacatctgcattggcaggttggttctttaccactgagcccccgggaagcccaaagcaattataccacaacaaaaattttttaaaagcatcattgtcataatagactgaaactgtaggatcccgtaaacaaattgctgataaacgttcgtaaacagtgttttttcattctgcatttctatttttttaattgcacgcgcgcgcgcacacacacacacacacagtcctgcgctaaagtaagtgagcgttttgccccttgccagaaagaagctaagatgctacgacgtaatgagttttattaacgctcataatgtctgcaaagcagcccagcctaagtatcgtatccctttttagtctctccccgaagacctacttacaggagcactcgcatcggtgcctaattgatctgcaaaatgccggctgctgcaacctcttccaggcactcgcgcggttcctgtaccatctctaccgcctgctacgaacctacggagacaggctcagcgctgtactggaatcagccagaccagacccgttcccccagcgtacgcagagctcatctgtctccaattgggatatcccgctcccagccccaacacacacacacacacacacacacacacacacacacacacacacacggttagaatagctgtgaggacacacacacacacacggttagaatagctgtgaggttctctggctgggacacaaaaacgtcctaagtcattctgatgatgtgataggaaaaaaagaactggaagcaaaaatgcaatgaaacaaagcttcgaaaactaaaaaattggcttattttttcagtaatcccggtgcttaagaaaaaacggaattaagagacattccgggaatcaggtctggggtggggcggctgttggctttctagtaagtgatcctcagtacatttaattgagaagtctgggtctcttttttggtacagatgtggctccatccttagtttatcaatcgtgacggctaatcccttcacgtgtagtgaatacagtttccaagaagccactggaactagaatcagaggttgtcagggtgggagttctcagaccaggggcccaagtcgctggcagcttctgggatccgattaaaaatgcaaataatcaggctccacccaagattttctgaaacttgaactctggggagtggtcccagccacccatggtttaacaaaccctcccaccaagagtctgaggcaggctcaagtctgagaagccctggattccctgtctgtttcccaaactgtgtgtgccctgtgcttagtcattctgccctggtctgactctgcgacctcatggactgtggcctgtcaggctcctctgtctcaggatttttcaggcaagaaacttggagtgggttgccattccctcctccaggagatcttcccaacccaggggattgaacctgcatctcctgtgtctccttcattgcagggggaattc

SEQ ID NO: 44042 - DNA, 1239 bp, Bovine  19866880696453
tgaaatattgtaaaacctccacacttcaataaaaatattaaaaaaaaagaaaggctccctagaatgtgcacaatattcactctgggttgatatcaccctgaacaccatagtggaatctgacgttcattttttccaaattaaaaaaaccacaaagagctacattagccagtcaaggtaagatgaaagtcaggagtttccaccttggttagtagacaactatttcttagctggcactttccttgacatacatttagttatcccctgaaagtctgaccttaagttgatagtaactgaactgtgaacaagatttttcatacacttaggtattttctcatatttcaaatcccattagtaccttggttgttctttggataaattaaatccttctatgttcacaatgcatcacacttcaagaaagactttggcatggattattatttgttcttcacagtaacttctgtaggaagctacagaatgcattattattccttctctaatccactggcatcccctagaggaggttcagaaagctgaaactcacattccagttctgactctgaacctgggaacttttcctcccccaaaaatcagttcttttccatttccccccattattttgctaataatcaccaacttaatcatcctggacataaatgttagaaatatacagactagtgcgtgcatgtgcactaagttgccacagttgtctccagctctttgtgaccctatggaccacagcctgccaggctcctctgtccatggggttctccaggcaagaatactggagtgggttgctatcccctcctctatggaatcttcctgacccagggattgaacccacatcaatagttgataatcaatcaagtctaagaagcacagagagtcccataaaggataaagccaaggagaaacacattgaatatgtgctccatgcaaactgaaacacatattaattaaactaacaaaaaataaatgagaaaaaaatgaaaagcaacaagggaaaagcaataagtaacagaaaggaatctccataaggttaagagctgatctttcagcagaaactctgcaggtcagaagggagtggcaggatatatttaaagtaatgaaagggaaaaacctacaaccaggataattatacacagcaaggatctcattcaaaatcaatggagaaatgaaaagctttacagataagcaaaagttaagagaattcagtatcactaaactagttttacaacaaat

SEQ ID NO: 44043 - DNA, 999 bp, Bovine  19866880811834
gagtaatggagtaggagtaccaaaggttgcaattagttcactcggataaaagacgctgtctgtgagtcagagctaccaggtggataattattaacatataaaagcagatgcgctgtttaaggcaaaaggggcggggcgggggcaggtccgccgtagacaatgaaggagggtctctgccgaccgcccgctgcttattgtttgggctctagagactgctgtctacagcctaatcctcctccagggcttcgttcctcgctcgtccctcggtcccacttcggaccgtcagagtctcccagcgctgtccgccgggggcgccgggaagccagactcagccgcccttctctgaccgccctctcttctgctttgcaggttggcacctttgcgcccgagggtgtcgcgagccgaggcggcgaggaccgggcgcctctggcccagccagcccggcgggatgcggccccggcagcagcgctaaccgcccccacgctgggcaccgggcgttcgcgctccgggcggcaggcggagcggcagcggcggaggggatgcgccggggacacgccaggatcctgctgcgcgctcccagcccggggtggaccctaagttgggctcatcgcaggaccgcgcggacccctgccctctggggcacgcggctgcggagcctcgggaccacgactgcggtcaggatgcactgggcacctcccagctggtgaggatgccccacagcgcggctctgcatcgccagccccggtccttggtgggcacgacagcctgggcccggcttcagcccctcgtgccggtggatgcaaagctccggagtccttgagtgcgatcggcgaccgaatctgaattctgagagccatggaccgaggcgctgggttggagccccaggcgggagagccgcaggaagcgcgcaccagggtaggagctgtccaagagaagtgtgaaccctagtccttcaggtcccagagtttacccgccctgaacagcgcctcctgcccgcca

SEQ ID NO: 44044 - DNA, 774 bp, Bovine  19866880820416
ctactgtaaatagcgctgctacggatattggagtgcatgtatcttttcaaattatggttttattttttaagctaaaaaacacaaatggacatggttaaaagagtttgggatgatggctatcatccaggaaaggaatggtaaccaagaacatcagcagtatccacgttttattatgaaattttaaaaacatttctgaaaaaaataaaaatatatctcaagcaactatgagcaaatgttaagtttttaaaagctaaaagacacagtatttattctatttttccctcacttgaaatattttacaagtcaaaaagaagaaaatcaaaaatgcttgtgatactcccctaagtttctgagactatagtcaacgagattaagctctaagcctttcccaaaagcctttccctggcagttcagtggttaagactttggccttccaatgcagcggagcaggggatgtggtttcgatcctagtcaaggagctgagatagatttccacatgcctcatggccaaagaccaaaacataaaacagaagcaatgttgtaacaaattcaatgaagactttaaaaatggtccacatcagaaaaaaaaaaaaaaaaaaaaatcgaataaatctttcccaaatggtccctgggtaccactctgaaaagcaaaatagtgagctgattagaccattgatctggttcaatgtggcatttcttaaattcttaggaaattgggctggtgctaacatcttaggaaggctgacttatgatctacttatatcataagtaaaa

SEQ ID NO: 44045 - DNA, 1312 bp, Bovine  19866880837352
tctctaatttgtccctcccccttccctctcctctagaaaataatcttttttttttaatgaaagaaataccaataaatgcatcagcgagacacatttatggagtgactctttccaaagagagattctttacccactgggattgaggcttattaaccttggcctaattgtggtcttgagctgtcactcatttattatttatcttcataccctctaacctggttccctatccaatttaaacaaacaagacagccctaagggttctcttaaacagcctaaaatatagtcattcttctacttgggcattggccctaggtcctgtctgtgccctaagctaatctatgaaggagcagaattcttgagatagaaaagacttaattcttgcatatttaaaactaaaaagctactgaaagaaactgaggggtataattgtcagcagaggactagggtcctcctgggctgatttttttttttttttgactctgtcatgtggattgtgggatcttagttccctgttcagggatggagaagtcataaccattggaccaccagggaattcccagggttgggttttttttccccctcctgtgctcactggcatggttcccagcatccacgtggaaaacagtctaacgtagacacacagagcgaatgtacaagtgaatgtacaaggctgcttgcccccagtcctctcaattatggatcctgatttaagaaaatcctactgaggaagtggtcaattacacctactttccttgtctccttgcctggaagctatttcacttcctagccaaagtctaaccgatgtctgatttccatgtttcccaccccactccagtactcttgcttggaaaatcccatggacagaggagcctgttaggctgcaatccattgggtcgctaagagtcgaacacgactgagtgacttcactttcacttttcactttcatgcattggagaaggaaatggcaacccactccagtgttcttgcctggagaatcccagggacgggggagcctggtgggctgtggtctatggggtcgcacagagtcagacatgactgaagtgacttagcatagcatagcatagcatttaccgcttcacctggggccatttgcccaggtggacatgctctcctggtaagggtttcctcactgatcccatatatagtctctttagcttcctccatctccagttcaggttctaatcctcaccctttccactgcaatctcacttctgttctctgtccctatttcaaaatactgttccactcaagcaacacatgaaaaaccagtctggaaggtaatcttagagac

SEQ ID NO: 44046 - DNA, 2908 bp, Bovine  19866880855335
ccttgaatgagaaacactcaatacagatttatacaaatgatgataaaaatacagtatattaatttcctcaatgaatgcccttatatttgctcccaatcccagatgtgtgtaaaagaaagcttttacaatactgattgatagtctggatctagactcctacctttcttttttacctttactcttttcactcagataaaatgacacttaaaaccatcttgaatagaaaaataactatcatagtttcaaagagttctaatgacaggacttgtggtttttcattgtgatttactcttgggtttaatatatataatgagttgaaaataaggctaaaattaatctctttctccacacacacacacattaaaatacatttggatggtttcaaccaagtttttggttctttatttcaaataatctgctaatttttattcagctcaccattagaaaaatgcattatgaaaatttccctactagagttaatattgctttgcctatgtttatttcttctctatttttggagtacacatttaaattaatctgttttaaatttacttcaagaaattttcttcttcaaggagagtatctatatgcctttggctgcctagcaataaactttgacatctataggcattttcttctgcagcattgggaagttctagaagggggagatttgatcacgctaagtttctgatcaaacatttcttcccctcaagtttttgtaagctttaattctcatcaaaagttcttctagttcctttcttaggcatgatttcttcacaagacaaaaagattaatgccttcctttaaaacgctttgccaagatacttcaaagttttgcttaggcatctcttcgaacgctcaaattagccacatcaatttgaagagctggtttaaactatttcaggcagaaaatgagtcagaaagatttttgtaaaagttctacaaaatgaaaattggacttgatttctgtaatttttcattttcctggttttatgaatttttcatgtgtcaaatcaatttgttccctgaaggaaatagaaagaacatatgtattttaatgacgtgtattcaaataaactacaaaacaatgtttcaaaaaaatttttaaaaactagtaattttacgtttgcctaagagaaaattgctttaaaaaatggtaacacagttctaccatgtttggagggaaattttcaggccactaccagtttaaaacatggtttgctcttctaatggagccaaatagcaagaagaaattctctacagactatttctaaaccctcatcataagtggcccagaagcattaagaaagcctaagagtaccatttagttagtatcctttacacatgctcccttgtgtaaataagtatataacttaagtcagtgaacatattggaaatttctctgtcattgtttcctgttggttatgaaacactgtagaaacaaacgttgtttaaatactctacccagtgaagaatgctattttcagtataacagcgccattgaagtacttcctgcccttaataagttagtgataggttaaacacacactcgataatagttcttttctgagtcaaaataacaagaaagttaactgtgcagttcaggctcgctagcagtttatcttactaaataaaaatgtgttgtgttcccttgaaatgaaagaaaagtcttagataaaatgtgcctagaagtcaacgggagatagaatcaatctgtatttgggaaaagtgaaggagggaggggagtgaaagaatccctgtttcttttttttcccttaaagtcagtcattctaactttgatctaaatttaggtaatgcatacttcctgtggtaacctttcttttcaagctgcaacatttttgatgttaaaattgctctgaagcagtatttttggggtggagttttaaatgggaatggatagaaggtaaaaccaggaactgggtttcattaagaaaaaaatactgtgtgtacgtctgtgtgtatgcctgtatgtgtccattcaaaatgacagatttgtgcagataatactctgtgctttaaattcccaaagtgagacagttttgattttaaaaacgttcttataaataccaattagaaactgcaagtgactcaaggacttaaaaaaaccttctcctttgttagttttttgtatgaagctaatgtaatcacatagctaaatataaaaatgccaaacagcgcccccctttccataccctttaagtccctagggcctcagtctagggatagaaataaactgttccgggagggagggaccaaccacttagccactaagccaaggtggacctcgtgagtcaccatcttgccctctagcgtgtgtcaagaagcctgagtgacagtatctgtgcctgccactctgaactgccactagccctgtgtattctaatctagtaaacctcaaaagattaaaacgtctgcagctgtcagtgtggttttacacgacactgtattcaagatatggttattaagtttctgctgaggccccatgtaatgatctcacagcatcacagagtagccggtgttgagagctccgcaccaacagctaagtttaaggattcatcaccaaaggtgtttataccatgacgctgtttccctcctgaatggcacaaagccctcacagaatggtggtagtgggccagacatcagagtggaagatggacagaaagcttgtgctcaggacgcagaaggagcccggctgtcagaggatgtgtggccccagccccgtgccggggcccatcaggcctctccaccctagcgccgcccccaggctcagcctccacctaggaggtccccgggtggtcaggggtgctaacctctcctcttcccgtgcacacctgaaacagcgacacctaaagtgtccacttgcaaaacaagttccaaggccaagtca

SEQ ID NO: 44047 - DNA, 1674 bp, Bovine  19866880890061
ataatattggttattattagatataattattattaggtaaaatctagggcattgtgatgaacacgtgttcactgttttctgtgaggcattattactgttgttacaaattagcaagacataaaggtgcacttaatgcattttccctcaatttacatgcccttccttcttaaatcatttccagaaatgcttaggaaatgtgaaaggagtttatcagacaaatgtattgtcttttcctccagcagaatgtcatatcacttcttgaaagatcctctccaaatgcttcaactcaaactgattttaacaaacttgactatacacaccataattaggaagccaattcattcagttcatttgcatccgtctaaataatttttcctgacagatgacttccgttctaagtaccaagtactttttaatcctaggcaggttattgctgaggataaacgatttcacattctcataaagatgccagtcattaagaatattaacacgaattccttcccctcggatagaaaggagctgtcattttagcaatgttgctgcatcagcctttctattgtcaaacagaacaaatgatgagaaaatcaatttactctttagaattagtcaagtgaggaattctttgaagtggggggtcagggtttttgtctggattccataatctggaaaagcgggtactgtacagacgttggtaaaatgttgtgaaatttaatgagcactgtttgctgccatagaccttccagacagaatctatctctgaaaaagaattccccactcttaaaatagaggtttgatgagcaccagatgtggtttaaacgaagccttgtccagctgaactcagaatatattttgatctgtatgaggcacagtctagaaagaggggcagtgaatcgatcgaccagagcctgtgttgagggtggtggtggggcttgaatatatatttactccataaagcttctcacattaagcaaaatgcaaatgagcttttaacaaacactttctaatagttggaggatgtcatacttgctgcttatgagacgatttgcagttttatttcatgtctaagatgtgcagaggatagcatttcaatgggtagccacaacctttaggtgggtctgtattctggcaatgattgtacttcccacatctcagtttctccacccacaaagggaagattagctagttcttcaagaatgacaagcatttaatatttggaaaagactaaataatgaagtgcttggattctatagaaatgccgaggagaaaagatttatttcaagtcaaaatctagtacaaacatgaccttcctattgtaaatctcatgaatagggaaagaaattacatcgaagactgtttcttgggctgagaatttggaaatacattaatattgggatgcttcagatggtaaaaaaaaaaaaaaatattaaaaacatctgcttattataatctcttgtctttggagatgagaaaaattctttctgctacattgtcctgaaagaatgcagttagtaaagatttaaatgacaggaatgaaagggtcatcttttgatttctttgcctttgggcaggactacagttaagccagctcaggaaagagaacaatgctgtttcttgcaaaaatctccaggtgagaataataaaaattaaaaagagcacaagggaaagccccaggga

SEQ ID NO: 44048 - DNA, 2286 bp, Bovine  19866880901675
tgacaatgatagaattcctgagtatatgagtggcagggggaggtcacacaaggcttcactgaagtctgaactttcttagtgaactaaaaagggatcccaccattttgataggagtagagctggtaggacagatgtcatgctggtgcttgaatctagaactttttaacaccaatggccatgtttgggaagatgttgaattttgaacaaagaagagacatggttaagctagcatctaagaagattgctctggtaccctggagagttgaaggtgaatttaaaaggaactccagtactcttgcctggaaaatcccatggacagaggagcctggtgggctgcagtccatggggtcactaagagtcagacacgactgagcgacttcactttcacttttcactttcacgcattggagaaggaatggcaacccactccattgttcttgcctggagaatcccagggatgggggagcctggtgggctgctgtctatggggtcacacagagtcagacacgaccgaagtgacttagcagcagcagggcttcccaggtggctcgagtggtaacgaacctgcttgctaatgcaggagatgtaagagacacgggtttaatccctgggtcgggaagatcccctggaggaggacatggcaacccgttctagtattcttgcctggagaatcccatggacagaggaccctggcgggctatactccatagggtcccagagaggcagacatgacaggtgtcttagcacagcacagcatacagataggagacagaccattagaagctattagtaatctggggtgggagggggaagagaaggcataaactgtggtagtgaagaaagaaatagagaaaagagaacagcattgagaagcatttaaatgacaagatcagcaggagaagggattgatcagctctgatgagtggagaagatgccagaagagatggagaaaaaggatccaagtgggctctagttccatttatcactcagggaataatagtcatgccgccgagacagagacactataagacccaaagccataataacatggattattttctgtaaacagagaccaaagcactagactgcccaatagtcacaaggcatttcatgtttatctagtgctccatgaattttcagtcatttggaagacagggagagctgttgcagtttagaaatgagtaactactgtctcagaggaggtcagcctcctcaggatcacacaactagtaaatgagacagcagaacttccttccaaatctgtctgtccctctgctccggcagaactgcagctgtttcgaggagctgtttccgtgccaggacagaggcatgaactatctgtcttggggatggtgtttcctgcccaggtgtccttgccgagctgtatgtgttgctgaccatggttaagagtcttggtgggtgacacctgagaactctagtatagatgcatgcatgcgtgctcaatcacttcagccatgcccaactctctgcgaccccatggattacaacctgccaggctcttaactccatgagattctccaggcaagaatactggagtgagttgccatttcctcctccaggggatctcctgacccagggattgaacccacatctcctgcattatagacagattctttaccgctgagccaccagggaagccctctactaccagacagatatatattatgccttttttccctttgccagatagaatccaaaatgaaagactaataataagtttccaaggaaatatccctgatggataccctcccgtatcttcttcagtggcataggttctcttgggagtcactactctgaaaccctaggagtcccacataccctgaaaaacactggagagtgtttcacacatttcagacatgtaggtgggctgggggcagatggcatttcttcatgctacacatgcaatgtactcatttgatctgcttcctaaatctgaggcagaactgacttcattgaaaatattcatggatctcaaaggtgactgccttaaattagttttgtgttaagtgcaatgtgtagctccaatgtgaccaggatgggaggttctgtaatgtggaaggaaagtatgagatgtggggttccttctctgccttcagaaatagcagtttggggacagtcatttagcttctctgaatctagctccatccctacaaaaatagagcatgctgttgcaggttattggataattccaattagaaatggtctgtgaaatctttggacagtgtacatttgattacgtgaggtatcactgataactgaagtcct

SEQ ID NO: 44049 - DNA, 1900 bp, Bovine  19866880903700
ctttcccgatttggaaccagtctgttgttgcatgtccagttctaactgttgcttcttgactggcatacagatttctcaggaaatagatcaggtggtctgctattcccatctcttgaagaattttccacaacttgttgtgatccacacagtcaaaggctttggcgtagtcaataaagcataaatagatgttttgaatgaagagacggagccaaagcaaaacacaatactcagttgtggctgtgactggtgatgaaaggaaagtctgattctgtaaagagcaatattgcatgggaacctggaatgttagatccatgtttagctatgatcagttctaattactggtcacatcttttgtcacttaaaattagaagataaactactggctgggtcaaattctgcccaatttggtaatttcttaaaaaggaatgagcctgcaccagtgcccagaatcctgattcatttcctcccaaggtcactggaagttgtttgcaggcaagaatcaaatcctccccagcacctggaaggctgagtcagttctccggccaacgacaactgtatgccagagttccatttgttgtcttgaaactagttaattccccatggcttttatgtctgtccctaagcactgctgatgccagggttggaaagctgtctactgtttcctggcctcttatttcaatatgattgtgcttctgtcctacatacgaccgtttctctcctctcttctcgctctctccttttcctcttcttcctcttctctcttagatatgacattttattaaaaaaaaaaaaaatatatatatatatatatatatttatttgttttcctgagccatgagtggatttccattctctcctccaagggatcttcccaacccagggattgaacccaggtctcctgcattgcaggtggattctttaccagctgagctaccagggaaacccaagatatgactttttatttaaagaaatgttttgtttgactgtgccatgtcttagttgcagcgtgtgggatctagttccctagccaggaatctaacctaagccccctacgttgggagtatggagtcttagccatgggaccaccagggaagtcccagttaccaccttttatactccacaaatacagttaacaacagtgtggagagaatttactccgtgtctaaatctgtctaacagactatttctattggaagtggaggagcttagggatctcctcatacccaatctttttatttttaaatattttattcatttctttttttcaccacactgtgcaacttgtggaatcttagattcccaatcagtgattgaaccacagccctcagtcttgagaacacaaagtctaaatcattggagagccaaggaattccccacattcaatctttctttaaatatttttctttggcaggtgggaggtgaccagattcataattccaaataaatatacaataaatgtgttttttttaatttaaagcttaaagctctttttgatgtaacaaacatcatggacatctaaataatctgtagaaaatacaattttttttgttgctgttgctgctaagtcacttcagtcgtgtccgactctgtatgaccccatagacagcagcccaccaggctcccccgtccctgggattctccaggccagaacactggagtgggctgccatttccttctccaatgcatgaaagtgaaaagtgaaagggaagtcgctcagtcatgtccgacttttctcaaccccttggactgcagcctaccgggctcctccgtccgtgggattttccaggcaagagtactggagggggggtgccatcgccttctccggaaaatacaataagctcattttaatttcttatttttagaaagacagttacataatgagtctagtcacatcttagtt

SEQ ID NO: 44050 - DNA, 1496 bp, Bovine  19866880910046
ttgcttcttgtctcaacaggcatttcaaaaggagggtaattaaccaaaatcaagagttctttggttgagttagtaacaggcttctcctttgttctaaatcccttcataatccctttccccaccaatttttccagtatggcctggattttacaaaccacctctttcctggcctgctggacggagtcctggcccccagtttcaactgaatccagttccagaagttccttgattagcatctcttccagaagccagtaggctttgtctgtcttttttcctatgaactcttctacttgctcaagatactggaccttctccagcacatgtatgatttttttaatgcttgggggagtcccttcatctgaagataaacactcttcagcaagatgattaccctcgtcttgagtgcagggatgttcgtaggtggcattaccgtacagatgaggctcagcactatactggacctgggaatccaaaagctccgcactgtcattgttcactgatcccgaggactgccgtactgatggacactgcaaggaaagttgtgctggctcatgtcttgatctggttcgctgtaggtgtaggaggagtccttaggctgtgggggtggcggtcctgctgggggtacatccaacgggagactggggttgggctgttgccaggtgaacggtaagtgcttggaacctctgtggagtaattggtctgagcatacccaggtgtgtaataggccccagggtatgaggcagtatttgtcccggggccagtgggatacggtgggccatatcccctatttgtataagaattcaaactggctttgcatttccgatcttccagggaatgtacttgggtgaggagccggaggtcgggcagcagcattccaatagttagaattgtaactaggatatggtggctactcctggtggcctccgccagcatgaccaggctctgaccaggcgcctccagacgcttagtagccattgcctcctccgccttcccccggccaggtggtctccgccgggccgcccccgcgcccccgccaggaaatgggaggctggggaggctcggggcacggggagtagatgggcggaagcggaggcaccggcacatctccacccccaggccgtagtagcggccataagatgggccgtcactggggccgtagcccgagtgcctcaaggccaacatgctccatttttaaaaaaaaatgtttttactattacaattctcgctcactcttaaggttgagagacagagagagatacacacacacataacattattattagtggcattaatttttgcttaagtggcttttctaagtgtacatatattagtcaagaaagcacttaggctgatgaattaagacgtgtgctttgggactggcttccttttacctttggagactctttaatgcttattgttaaggatgcttcaaaaaatgctgaaaagtcaacaacaagaaatattttttgagttgcttttgggcttagctaccttca

SEQ ID NO: 44051 - DNA, 715 bp, Bovine  19866880945618
ggctcattaaaaaaaaacaaaaaaagcatctttctcttgaatgttcatgagggagcatctgtatgggaatttcaactgccctaaaattaattagatggcagctggttccagcacccattctctctccacacttctgaggtctgtattttgatcctcaacaatcaactgacatcagataaatacgaatcacgaatgaagtgtgaggaaccagaagaaaaaggactccgttgctcacttccatgtcttaaattctggagggtgacacggggcagtgaaagaagaaagaagggtatactgtttccccctgccatacagattattgtgttttacacaaacacacacgcccccattattttaaactttatgagctgttttgtaaacagttctaatgcttttgactctgcagcctgtaattattcctttggagggaaggagagagggagagagagaaagagagagaaagagaaagactcaataagaagtaggctttaaaacaaaagtccagtgtctgcagcaaggcagtcctgaccacattatctgcagagcaaccagctaaccacctccgattgatcctgtggcttgagaaagtcaatatgcacagtttggcgtgtggggttttttcttggtttctgtttggtaataaccttgggggttattttcagtgattgcggtgcctgctgaacactgaaagcacgcaattgttctgccctgactg

SEQ ID NO: 44052 - DNA, 1573 bp, Bovine  19866880953301
tattttgcctagagaatcccatggacagaggagcctggtgggctacggtccatggggtcaccaagagtcggacatgactgaagctacttaactattttgttgtattttgtttcacagtgagagccatcatggtagcgtttgcctcttgagaagaagtggaagcaatgcctcaacagaaggaaaacgtgaaatggccaatgtctcagaatatatcaaatacagaccgagaaacgatggtaatatattataattctagcgaggacttagattattcagtcccaggccctctgttaaattgcttaatcctcaccaccaccctaccaggaagatactattattattctcatttttattgatgtatttattttggctgcattgagttttagttgcagcacacaggatcttcattgccacataccaccttccctctagtagcagtacacaggcatagttgctccttggcatgtgggatcttagatccacgcccaggcatcaaacccacatcccctgcattggaaggagaattcttaaccactgacccaccagggaagtcccttattctcattttacagatgagaaaagctgaccaatttagcttcaagtcaactatagaaaaacaaacaaaacaaaagccatgactctaacatgtttcttgcacctactgactttcattggttcatttaatgctcgttccaattttttttttttcccctctctgtagcgtcttctcagcatgctttagaaagtggagactggagaaatcttcattcttttctgatgcaaagattaattccagtgacacatataatccactgtgtcctaccattttccataatgggatgacaatttttaacttttgtgagacaagttatgcaaataagcacagccaaagagaatgcacaaaataggatgtgagagcaaaggagaatggaacagtgatggtccttccttttctcttacagcagcaatctgctgaaaagaggcctcttgggcaggcagagggtcaggattttgcacagctgctccggatccggctccaagctctcactccccccaggaaagaggccaagagcttcctttaattgactccctcctgcccccattcattaacatgtggccctccaacactgcaatttgggaaagtgcctctccactcagaaggatggagagtcctgcctggatgtttaggaggtggcaatgagcagcaacatcgcgggctggcacctccattcagagcactactggcatatgcctacatgcaattagaaaaaagatattcccagattagctggctcattgacacctgaagcaagatgagaaggtgaggggggacaggagacacatattcagatggtgtgaaagacatatttatccatttatctaaataatattaggagaatctcatccaaaaaaagagaaaaacactgggccttgacaatcccacaaagaaggccacagcaaccgagcagagggcgcctgacgtgtcctatggtcctaacagtcacgagggggagaggccaaagtttgacgctgagctcaggctgaatctgacagtttaagaactgagtttcag

SEQ ID NO: 44053 - DNA, 1346 bp, Bovine  19866880961241
aaacatcagactaaagcaacaataaaaacttgtaaaatgctgaatattttaggtactacatggttctctaatacatacaaacacccaaaaggcaatttagatccaactttactccattaaaacactgaagttcccagagtatggagtgtaacctgatcgtaactgctatgaagggggagggctgactatacgctaaatcttgccatctgtaggtgcttggctttacacaattccagtttttggtgttttttttttttaaataggttcaaaagtttacagtatatttttctatttactaccagccacaaaattattttatgttatgtcatccttaaacaattctcagagcgatttgggtatatccaatcataaatttgcacaagagctctatctccaaatccattcacattcatattatgaacagtctttaatggtaaagcaaataatacttatttatatatttaggaaaaagactgttgttgtcgttcacttacgaagtcgtgtctgactctgcgaccccatggactgtagtacgccagtcttctctgtccttcactgtctctcagagtatgctcaaacttgtccactgagtcaaggacaccatccaaccatctcatcctgtcatccccttcctctgctctcagtctttcccagaatcagggtcttttccaaagaggattaaacctcccccaaaataattctcccaaagatactacttctagaatgtaacaattattctaactctaagactcctatatgaaaatactgatggcttgcaacccagcaattcacaaagatggtgaactgaaaagaattcatactcaggacctcaattttgttattactaagtgaactctacttatattcaagatgctcactaatttccactcatttcacctgtaatgttcacaagagaaacactgatgctctgtcttccacgactgggactcaggactgcagaactgtcacagtgagttagaccaaacagatctacagtacaattaaacacattaaaacatctgcatatacggagcccatacatggctaataaaaaggccctttcaccaaaccagtaggctgatctgtagttctgatgattttaaattagcaaccactccaaaattcaaaaaaaggccaaatataccactttctaaaattctctcactttgggtctatttctctccattacagttatcaaatttcacttgccaaactctatccttaattaatcacaggaaattcccagtaaattgaaatcatcactataaattcagtaggagtaacgcgaaaacatcaaagggtaaaatatagtctttaaaaagaaataagagagcaccaacatacag

SEQ ID NO: 44054 - DNA, 1872 bp, Bovine  19866880994288
ataaagctggcatttgcatttaagcaaaagaagaagtgattattaaaaaaaaagaagaagaaatgattatagcaagtcagtaagtgctgtgatagataggtgaatatagatataaaagagactggaataaacagagaaggtaagaaatagaacttcttttgatctccaagagtatattgatgtcctgccatgcgggaaataataaaaagctactatatttttttcttgagcagtgttaaaagcatgttgtataaatatatccatacatactgtgtcccatacctccctctgagaatggtggtcaggtcttcaactttgtctttgtttattatgagaggaaatgttgatctacagagaaactccaaaagcaacactctaaaagccaaaatgaagatttgtaatagatgctgctggatctttcagggcagttttatcatgaattattcacagaagaaattttgatgattgggtattaggtgtgattctgttaaatatcttaaatcttacggggactgcagtcaaaggctatgaggcatgtaaactgaggaactgttaacaacaaacagccattctaggttgtaagtgtctccactccaggttcctatatgtttaaacattgtgcgtttctaaccaggcttctttaattactgataaataacttacttctatattgtcatatctcaatatcaaaggatgcaaagaaaaggatgctaaggtgttgttgacccatgaaaagaatttctcaaaggcatgaaaactttctgaatactattgctgtgtattcagagaactcacatttttccaagaggcagatgaatgacataaaaattgtaggaaatattggggtttcgctggtggtccagtgattaagactctatgcttccactgcaggcggcacaggttcgatccctggtccgagaactaggatcccacatactgcacagagcaacaaaataaatacatttaaaaatttatatatagaaatatgttgtgaatttacattgtttactttcaaaggcaaaattaccagtgagctaatgaagcttaaggttcagagcctcttcctgcactcatccccgtgaggtgaggttctcgatggggaaactgcatttgcttaaggaagagctttttcctaagtacttcaaataatcacctaaagagatgtccaaagaagtctgaatcttctgcagagctctagcatctgctgtttctcttctcgttctctataacgaagaatgagaatcatacttaattttgtattctttgacttcattttggctgtgctgggtcttcgttgctgtgcaggttttcgggggctacccttggttgtggtacacgggcttctcaccccggtggcttctcttgttgagattctaggctctagggcatgcggacttcagtagtcgtggcgcacgggcttagttgctccaggccatgtggaatctgcccagaccagggatcaaacccatgtctcctgcattggcaggccagttcctatcctctgagccaccaaggaagtcccctaattttgtattcttaaagagagtcccttccctctaattgtatcagcttcaggccctacaaaacagatctttctctaggtactagcaaagtttataatctctactaggtcaaaagcaaaagggtcagtgtccatagtgaaaatgagagcttacacatgtcatgtggggtgctgactgtgctgggcagtcgtttactcacatcatcatcccagttcatccatgcagcaccctgtagagtaggtttatcattaactccattttatagaaggggaacctagagtttaagtgcaagtgttttgactcaaactgaaatccagatctctactgagcttcacacgcagtatcccca

SEQ ID NO: 44055 - DNA, 847 bp, Bovine  19866880994787
acttcagagaataaatgcacctcttaagggcgactctttggaatggtttacttgtggactaattgggaagaatcagattcagtagtcaaagcctctaaaatccttggatgaagcacagatgctgagctggaaatgcagtgtgctatttgtatattatttcattccatgaagtggcaacttggcagagtcgtatttagaagtgattgtactctctagtccttctcctcagctgtcttttgtgtgggtataatttcctgcagtcgtatcatagacatttatgcgctgctgtttgcataagccttttattggaaataacccagcaaaatagcactcgctgctagctagcttagcacagttgggccttatcgaagatgtaccaccctgcatatcagaacagtgaaatcttcagttaatgttggcgggctgacagccacaggcagcacattctcaggcctgcttgctatccctggcttccctcttgaggaagaaggcccagagagccaagtgacataattctgtgcacacaggtgcctcataaaaacagctggttcaagtgggtgttattacttttcacttcattgacttatactatgtatgcagctgatgccttattgcattaaaaatgtatttaacaaagagattaactattccatgacattttatcaggttttcaaaacctgatatttttggtttaatatagaattacaatgctaatgggctaacaaattaatatcataaatgacctaaactttatttcaccctgcagcttgttaactgtgacaccttcagggtttatctcatttttaatcattttgaattaataaaatatcttggtgcatcaggaaat

SEQ ID NO: 44056 - DNA, 2591 bp, Bovine  19866880996713
cctgttggacattaagattttatgaaactttgggaatattctgaaggggtaacaacaataaacatctaacttctacattaggggaaaattttaatgttccaaagcatctagcttcagagaaaatctaaaatcaagattctactgggttcatgcacaaaatctactattgtatataagtaaaactcataaaaccaacttaatttgtctaacagatgtttaattcaagtcaaaggaaatttccatttccattccattcaaatataatagaatcagtaaccaccatacagttttcaaactttatcttataacctagcaaatagtttattgtctggactgtaataaaactgccatataaaaggaagaattagaaatctagatcaaacagcctttttagtgacaaagaactcaaagaaactgcaaggtaaactgtttcctccaggcttgattttctctattctaacttaagccaccaattcaataattacaacacagctgtttcttcaaaggtattctttcatagtttaggtgaagaagtcaaagtcttggtattcatataagcacggggaaagtcttttacaagctcacccattcatctgtctgatgaaatttaccccagctcatcacacccatgctttttagtcctttgctcttctcaaggaggtataataaaactgggctccaatgccgtgatattgacagctaacagactacccaccctttaaggtgaagaccacaaaatttcaaatgtatgatttctgctcatgttagaattttatctaactggcaccaaaaccacagctaaaactgtggtttaaagaaagcaaaggcctcaaattaccaattctaaatcaattcagtatttttgaatacttccaaaagcagtaaaggcaaataagtctacagactatggcacaacaatctctcaaccttgcctggagacatatatttaagagatcctccgaaactggactacatacatctatagtatatggttaaaaagccattattaaatgctacatatttcttccttccccttggctctttttggatgggaaggcagaactgtagctgtgactagaacaaaaaaatatatttccactaactgaagaaacccatgattcactcatgaagtagcacacaaggctttgacaaaccaaatatgcaaaactgggttaaaatcacaagtttcaaaattcactgttaatttctcaggttatgtccaatttttctgagtctcaagctagcaatagaagtctcaacagaaatctctgtatcccaacagcaaagaaacatagaaaaaaagaaagggagggagggatgaagagaaggaaggcaagtgctacataatcattatggatatggataattttataaataaatgtttaatttatcccttacatttagatgctatgaacagtggaaaacaatatacatgatttgtgcttcaaaaataaactatgaggtgttaaatggaagcagcctgattttatttgctattttctctttaaggaaattctggcaaggtcagctgactcaaattcaacacctgtccagaaaataacatacatctgtcactttttccaaaatgaaagtgaacggcatagctaaaattccttgtgtgtgtatgtgttcagttgctaagttatgtctgactcttcgtgaccccatggactgtaggtccaccaggctcctctgtccacagaattttccaggcaagaatactgaagtgggttgccatttccttctccaagggatcttcctgacccagggaccgaacctgtctcttgtgtctcctgcattggcaggcagattctttaccctagtaactgacccacatcaaatgccacgcacttgttactatggtggcacaaatgtgcaattctgcttatcgcagactttctccctaaagctaacaactctattattcaggttaagtagaacatacaactttgaactgaaatctaaaggccagtaacaaaagaaggcaagagaatataagttttattaatataaacaatctgcaaccacttctccccactctcaggcatacatacacctacactacagatctctacttctttctcagaagattctagctccaatgctacttcttctaagacatgctaactcaaaagattaacacaaggtatagactggtaacactttcgctgctgctgctgtgttgcttcagtcgtgtccgactctgcaacccaatagacggcagcccaccaggctcctctgtccctgggattctccaggcaagaacactggagtgggttgccatttccttctccaatgcatgaaagtgaaagtgaagtcgctcagtcgtgtccgactctagcgaccccatggactgcagcctaccaggctcctccatccatgggattttccaggcaagagtactggagtggggtgccattgccttctccggcaatactttcgcattagccatctaatcccacaagctgagagtagcttttcagaggaacctgaagtgtcatgctatgcatgctaagtcgcttcagttgtatctgactctttgtgatcctaggactgtcgcccaccaggctcctctgtccattagatgctcc

SEQ ID NO: 44057 - DNA, 903 bp, Bovine  19866881094557
ctagcagtcttcatgagacttcatgtgggagtggaaggcttcttgatctgagaaggtcttcccacaggtgttacagggagagccgtcatcctcccctgtgcgagcgccggacatggctgtcgtgagcagcgtgcgatgcaaaagatttaccacagtacttgcatttgaagggcttctccccccgagtgctgcctgatatgcgtgcggagtatactggaggcagtgaatttctgcagaggacagaaagcacaggaaaaaataaaatgccatccaccaatgaaacaaaggagttaatttcattatgaccgatccttggtgttgttttcttgaaaaattgtgtctgactcttttgcaaccccatggactgtggcccaccaggctccactgtccctgggattctccaggcaagaatactagaatggttgtcatttcctcttccaggggatcttcatgacccagggattgaatccacatttcctacactggcaggtggatcctttaccccggagccacctcagaagccctcattgatcctgatatcacactttagttctccgcagtcaacaaatcctggattttaatgctatagggcactcttggtcaccaggaatagccttaataaaaaaggacatgatggacatgccactggttacaacagtggcccttcaatggctaagatcgtctgggtgtctagtcaaaaatgcaggttgacctgatgagtacgctcttttgggtaagaaggcagctgcatttaagcagatggtactgagatcacactccaggatgatctgcattatggaaggaattgctaacattggccactatctttgcatacatgggtaccttattggtttctttcttttttttttttagttaaacttttagagtaatagtgattcacat

SEQ ID NO: 44058 - DNA, 1070 bp, Bovine  19866881158363
ctctgggtcgtcccagtgcactagccccaagaaaacaaagagagcagataatgtcatccaccactgtctctttgcctagcacttcaacctgttaccaaggacatttaaaaaaaaaagtgtggagcaactaccgtgtgtcaggcactgacgtagtgtttccacacgtgtgtttcgaaagttgatcgtttatcagaaatcaaacaaattggccagattcagaatacctttggtgtttttttgtttgtttttttttatgttttaaagattgttttggccgtggtaatatttttcttcgtggaataacctagaagattacgtagggtgcatttccaataaggatacattttgatgttgaaaaagtgtgcttacatgtgttttgctaatacatgaaactagttaaatatcagtgtctgggcaggtatcatgtctcccccagtgttcttgaggccagatgtgtcaactttatattactgggtcaaaagttctagagaacaggagcagacaggtctcctctgtcccacttcatgcactgaagtgttcgtggccggcgtgctgcttcctgctgcaccgaagaccatgcatcagagtgtttgcagcaagcagttatttttagcagcagacctagaaatttttagttttttcatgttacagtagatattttaaatgtattatcatcccaagaagaataaataatttgagacacgtgtatgcgagtgcatgtgtgcattttgcacgtgtgtgtgagagagagacatccccttaataacaggagagggtagaggcttattcagtctattatcataaagctctgctaatgtagcttcggagtcatgtgaccacagaaaaggctattatctcaatgaaaaggaaactggtttttcaagcaagcaatagaatagaagcaggaagaattttcgagtgttccaccatgctggattgtcaaagggggatctgtctgatcagcagctaaaaaaggatttgtgaggctagtttgtcagctatcgttagaagcaagtgatggaggaggtaagcggcagggtgctcagcatgtgcttaggtttacatcaagg

SEQ ID NO: 44059 - DNA, 1903 bp, Bovine  19866881180118
tattacagcatcacaaaacgtgatgctgaagaatcatgaaaagtacttattgtctgattccctttgcttgaagttctagaaaaagctaaactaatctgtgatagcagaagagttacagttgttggtggggtgagggggtgggctgaggagagctctgctgggtgatgaccatgctgtgtatctagatgggagcgtcagttccataggtgctttcactggtgtgtgtgtgttactcgctcagtcatgtctgactctttgcgaccccacggactgtagctcaccaggctcctttgtccatggaattctccaggcaagaatactggagtgggttaccatttgcttctccaggggttcttctcaaaccaggctttcgttggtaagaatgcttaactttattcttaacatctgtttattgcaccaaatgtaaatttcaccttgttactctattgaattcttgtttgacttctcatcagacttttggtttaagaaattaatcacaattatataaataccaccatcaggaaaaaccttaaagttagaaacagctttacaaaccatccagcctaattccctaagccttcgtgaagaaaagggttaaaaccgataaactggagtctgctgcagccaccagcctgccctcaggagggggctagacagcttcacccacttgtgcttgccagcagaagatgtgagagagggacaggtttgctaactgtagtatgtcttgaagcgagagcacagaatctggactaagacattttacctggaagttttggcaagagacgttttcttcctgtaatggttttggtcagtgaattctcagcagattttgcgattgcccatgactagctaagaaataatttgtgaaaactccattgtagctgataaaggaccacatggtggtaaagagtgcttgtgacctcaccttagctcaagataatcaaagctttgatgatgttgtgagcagaaaaggacaaataggtggatggatttcacaaaactaccccctgtagtttttatgctgttcctttaaaaaaaagaagtgttctctcatatctgctattgttagtttcctataataacattaatttcctatgatgacctggctgattactgattttagattttaagtgcacaatgaaaatatttaggtggctgttaaaatcattataacttgtaaaagttctttgtgctttggcttttttgatgaggtatcaccaggtgtgtgtgagcgtttgagtgttttaaatttattttcttgatgtctcaatttctctgctggagtcctcatggaagctgtgctcactgaccccctgtgtagtcaccagaggcttggtgagatgttaggactgtgttccagcagagtaaccccgggtcccttccagtgactggaagagagttagtcaacaccccactccatcctgctcgagttatttatgtgtcgagtggttaattaaattaaaactaaaaagtttcataatcagaattatcaaaatttgggggttcttagaaattacagagtttttgtatagataacttttatgtggtaataattccttctgtctagttgtatctataacaacttttgttttttcctatattaaagagtataattttggcttggtttacttagggataatgcagtttgtgtaaaatgatttggtgaggcgaaaactgtcttgatctccaggtactgaaacaattcttctttaacttatctatacacacacacacacaccccaatactgtctgattccacttaaacaaggggtctaaagtagttaaatttcacagaaacagaaagtagattgtgtgtgccagagcctggagggaaggggaaatgggagttgttgtttaatgggtgcagtttcagttttgcaagataaaaaggtcgagagcacta

SEQ ID NO: 44060 - DNA, 1117 bp, Bovine  19866881263403
ctctccgcatctttttaaatcgggctgctccaggtcgtagatgcacctcatggcatcttttagatgtggcttgcaggaccttcttcaccgtggcatgcaagatctagctccccgaccagggactgaacccaggcgccctgctttgggatcttgaagtctaacccactggaccaccagggaagtccctctctgtatttttatataatctattccaccttcgagtctagaataaaccacgtgagccaagacatgaggaagtggactgactgactacccgggagagtcataggcccactccaggaaccacataagactcagtagtcaccagaacttgccagttggagacctgatcagagattcttaagtctagaataggacagaaaaagcacaaagacagcccaagagcatacttgctttgggctaccttcctgcgctccttagcaattaaacttgattatagccgacagctcccattacaattatctgaagacgatagcaagagcctcctgtcaggaagctattaataacccgaaagccttgtcttctttctccctgtagtcactctttactttctgggggagattacagaccctgcagatccaatgaagcacagagtccgggcatgcctatggagagttgggacagagggtgggtgactcaggagaggtgctgcccagacaagaaaccctgatataaaggaaccatgtatgtgcctctgcccacccactcagggccagcctaacacatgctgacccaagcaggggcagtcagttcagcaacctgtccagaataaccccaaggatgctgtgccctgccagccacaacgaaagctcacaccactctcttcccaagcagaattaattttatttttaataatgacagcccactttgagtgtttaactgcatgccaggccaggtcctgttttaagtgcgtcacaggttaactcacaaaagaggtgttagtcagtcagtcatgtcctactgtttgtgatctcatggactgtagccccccaggctctttggctcctctgtctgtggaattctccaggcaagaatactggagtggatagccattcccctctccaggggatcttccgacccagggatcaaacccaaa

SEQ ID NO: 44061 - DNA, 1527 bp, Bovine  19866881327398
tgtaggagtcgtttacactgaaatgtgacatctacgttttgaaatctaaactcctaccttctcttgatgagatcgtggctgcctccaacattcctgggaggaagggggtaggggcgcagctaagagcagaaacttctctcttcccacagacagctcttcaccgtttgccacgggctgaacttcagaaacactcaaggaaaatcattttcctttctactcgtgtaaattagcacgcaagcccatagataaaggtggcttttttgaatcactcgccgccttcacagacatctctttgtgaaaagcgctgggtaccagggggctgcactctgtcattgattatttttattgattatttttattggcttctagttaattgcacatataatgtccatatagctcaaacagctcattaacaattttgctttgaaatgttttcaatttggggccatttcagtacctccttcttctgttcttctgtgcatttcttttccagttctctgaactattttatagaactaattactttgatagcagtttaaagcagaaaatggctatagttgttacaatacttttaaagagctatctggagataaagtaatcgtttaaaatcttataccaacttaaaaaaattccatcagacttctaaggaattttgataatctgaaatacaaaataggaatttgaaatattagcaactccctgtctgcaggaagccaacattttaaatattgcactttttgaatttctttgaactgagagagggatcactgggggaaaaaaaagaccccaaaccaattaaacttgcttaaagtatgaaaatctagactacaaatacatatctaatacaaagagaattatttcaatatatagcaaaattgactaactttttttcagaactttttgtgtgatattatactaatgtacttaaaaatgacacctggtacagttttctgaagcacaagattagagaactattatttttagacaatgaatttttcctgtaattgggctgtagggaagaaggaagaaaaaaaacaaaaacaaaaaccagtattagaagttggagtcctgattcattggctcagtttcttcccagaagtgattatgaggtgtccatttcaccatatccaggagattcactaaaccactactcctaatcagttaaacccagatacataatcaacactgaaactttcaacaatggcaagtggccccaccggggcaaagcttccctctggcaccataaaatttttaatagtgccaattattgcaaggcaatttttttcattaaaaattttttttttctcttcgttaatccaaccagactcacgtctggaaatctggattacttcagctgcgtagattttgaagaccctggagacgttattaaggtagtttaccttctcttaaactgaattgagtcacaaaagtaaaacctaagaaactgtaaaggtgttgaatcacatgttatccaccttgggctggtaacacaccttctgtgagacatttccccaatgagcctgggct

SEQ ID NO: 44062 - DNA, 683 bp, Bovine  19866881364287
agcccttgcacttgtgaattcgaagcttgccagacgtgtcctcgacgcactgccacttctgcaagagccaacgtgagagccagttacacacccacatcaggtgtttctgattaaggactgctgcttttgtttttagaaccctggcaacaccgttaaaaagagcgcatgaaaaaaggccagctttcaagtgaccctggaataagttgactcctgctctcttagttctttccttcactgcgggcgaatacagatgaccacgaaatcacaggaaatcagaactacctcagtgacaccagagccaagaattgatacataaatcctccagcatccagactaaacagtcttgaatgaaacatggaaaagcccttccttaactcaccaagcctcagagcacagctgtcagggctgttttcaccagacccgtcttttttctggaaaaaacaaacttggctgctttgttctctgcccttgaatttctaattcgaggccagtaagagtggcatatgaggaagacagaaatgaatttaacctgagtccatcatggcgagccaaatttcatacacggcagacaagaacatttgcttctcttagctcaggcggtaaagaatccgcctgcaatggaggagacttgggttcgatccctgcgtcagagggatcccggagaagggaatggcaacccactc

SEQ ID NO: 44063 - DNA, 1442 bp, Bovine  19866881401895
cctctcttgttctgagagactggctgtttgcacagttgtggttcacacaaagagcagcttcagatgcaggaagcccccatcattttactttcccttcattttgttaaagcaaatgagctttggaaccaagtcctggttcgattccctgctacttttgttaacctgagaaagttagctttgctaagcctcagttttctcacctgtgaaatgggaatgataaacctatttcccagaagagctgagctaattaaatgagtagatgtgaacaaaacacttagcacagtccctgacccgtggtaaatactgaattttcactattaaacaatgtttataggcttccctggtggctcagacagtaaagaatctgtttgcaatgcaggagacccgggttcaatccctgaatcgggaagatcccctggaaaaggaaatggcaacccactccagtattcttgcctggagaattccatggacagaggagtctggtgggctacagtccatagggtctcaaagagtcagatatgactgagtgactgactttcataggcttatcagctaaggagaaagttcaaacacgttatagtctgatggagaggtcaaatgaaaaacaattctcagtgtgaaaagcatagatatattctagcatagatatgttctttgggagtgtgaagtggcagcgtcttatgatccagggagttggggaagacttcaaagagaaggtaatgtactttatgggtccccaaagggaagtatgggcactgcttagatctctatagattaaatataggctcaaaccacctgttttagaacaataggactcacttccctatagttagcaaaaattatgcctgtacctatattgatttgtctataatgaacagctttactgataaacatgtatattgtagtagacttgcttgtaattccagcaaatccaataaattgatgatatctatatgtgaggttaggaatgagaaaaattcagagactagatatgtaagtaatcaatataataccctagtaaattctagagataaaatgtgttgaaattatgattcttcatcactgcacgtaacacattagtgactatatttaatagcctaattagcagtaaaattttatgagttaacatcaccatgagaacattcccttctacattactgagttttatctgtaaatttgtaacatgaccacaatcatctcgaggtatttttacacattttattcaatgaacctaaatgaacttgcactaattagattttcactgccagtcttggttttataagtttgaacccatacaccttcagagaactcgtgtggtctgggggtggtgcacacttgaaatcgctttacaaacacagagatgtaccagagagaaaaattctttagctgtgtctgaagtctttcctaaatgggtatttcacaacgtttaacgtgaactattt

SEQ ID NO: 44064 - DNA, 1872 bp, Bovine  19866881406432
tgcctaaaggctggatatgactggatcaggctcagcggtagcctgtttttaatctttgataactaaatatgagggatgatagtcaaatttgctttaaaatggatttttcaaagtaaaaccttaaagtttgatggtagaggttgttttgtgtgtttttttttttttcaaataggcaaaaataagccagattaagaaaagttatataagaatcaactgtattactggactttttccctccaggattgcaggcaacttgaaaaatgtgtataaacatacatgtttgtcagccctattaaagcaactcttgccttctaaaaataatggaaaaaggatttgaggggaatcatggcgacgctattgtcatcttatgccatcacagttgtttctgactgaggtctgtgctgtgtttcagctatataatatgcttgtggaaacgggtgagctggagaacacttacatcatctataccgccgaccacggttaccatatcgggcaatttggactggtcaaggggaaatccatgccatatgactttgatatccgtgtgcctttctttattcgtgggccaagtgtagagccaggatccatgtacgtatttctctgtttccaacattcaactgtcatagctcgtgtatgtctgagataattcgattaccaatctcagggtctggtttcctttagtccaaacaaaaaagggtgagtgtaggttcataatttagaagacaaaacctcccgcctgccccacccctcccccagtcctgccacatgctaaattaatgtctactctttcaagagaaaggaaaaataactgtatcaatgattagctctctcaaaccgaccagaatccatgagactgtgaacacagacatagagtgtgattttaggtatgtcatccttaccttcttcgaatctttttttaaaatgataaccagtgccatcctcttggttgcttttttaaaaaaactattactgaagaatttttaaaggaaattaaatgttaagaactttaaagtttaaataattttagatacattttatttaattaaaattatttaaatgaactttaaatgaattttaagaaaagaagcctgaaggactgaaattccatttctgtcatcttaagtcactgcatccctttgcatgtcagtattcccatcataaatggattttgtatgccctgccagcacatcataatgtgtagtgtaaaatgagatcctttacatgaatcagttaccgaaagcgtgaaagaaaagagtgcaagtagaattcaaaacctgggatgacccttcaagtgcatccagtctggacccctgatttcacaatgaagaagctgcacagacagggtacgcacgcccctctcagagttcccccatcctggatgtgacagcagtggggcccagatgccagataatctgagtctcatctatgtggcttgtctgctgctgcattccagtgcatgctggggaggaagtgatggcaataagaagggccgctttggagaatgttattatgtctttccctggcttcccggatggctcagcaggtgaagaatccacctgcgatgcaggagacacaggaaacgggggtttgatccctggttcaggaagatcccctggaagaggaaatggcaacccactccagtattcttgcctgaaaaaaatcccatggacagaggagcctggtgagctacagtccacagggttacaaagagttggacacgactgggtgacacatgcaaaggagtcatgtgcacacatgcattgtctccagatcgctggaaactcctggggaagcactggatctagagtcggaaggctttatgtttgaaaggctaggcagcatgcatttaattcaagtataaaaaccttgtgt

SEQ ID NO: 44065 - DNA, 639 bp, Bovine  19866881957262
aggtagacattaaggactgacaaagtagaagtttgtatagtatggcacgttacagagaggcttttgtacaggcttcaaatttagctttcctttgaatattcactggtttatgaaacgtggtttgcaaaaccttgtcaagattcgtcttactacaaaaaagaacagactttctggggcctgaagggatttgtacttgaagatactccagtcagcagagggtcatgttgagcattctgcagacagaactgtttcaaatctgcagctgcctgggaaaccttcactcgattgagcccggcctccagccggagctgttgaaccacttttttcatagccgcgatgctggatgaaccagacatggcgcactggaaaggatggcagatctgcgggccgtcggcagctctgcggtgggtccgctgggccagtccgcggggctgggggtctagattctcatttttaaagatgctttaatgtaaacattgtatcccctaaatagagtttgtataagtctacctttattatatagaaatgcaagttaaaaaacaacaacaaggttttatatttgaaaagacatctaaaaatctccattgagtcatctctatttgtcatctctatttgtgtaatggaatcgatgaacgatga

SEQ ID NO: 44066 - DNA, 1514 bp, Bovine  19866882029624
ctgtctgtacctctttttagagttacttaacaggcctgcgttgtttatgaacacataatctggttcctttatgttagaaagaggcaaatctgactaaccctcaatcctggcattgactcataccaaaattaacacttttatgccttttgatcagggcttccctggtggcttggtggtaaagaatctgcctgccaatgcaggagattctagttctatccctggagtgggaaaatctcacggagaaggaaatgcaagcccactccagtatttctgcctgggaaatctcatggacaggggagcctggcaggttatagtccatggggactgcaaagagtcaggtatgacttagcaactaaacaacgacaacagcgtaccttttgaccaatatagcaaatcaaacaactgtcctttccaaaggggttggagctgttggtatcctgcataaggaggtactgagaaagggtggaggggaaagagagaaaggtaagatacttgctgtggacttcctgtgtgccaagacagtgctggcatttccactcccgtgccaactctttaatccccacaagagtggtatgaggcaataggcctgattcttatctcactttacagaagagaaaactaagaaggtaaaccacttgcccaaggatgctcagggagcaagaagcaggtttgggacttaagtccaggtcttcctgagcctggattcttactcactatattgtccagataccacttgtaattaacttctcaataaccaggcctagctcactcccatcctctccttagattgtccatgttgttttgtgagagctgttagatttgtatatgtatataaatgaagagtttccaaatatgtagttatctccttaataacagtattccttttaaatttcccttttccccaacattacagcgctctgcccacagggaactctggagacagcttttgttcttgtggcaagttttaacccaagccacaaccagcctcctgtatctccatcccaatccaccaagtgttctcttctactggtggagaaaaagtgatttctcattgtttaaaatcatgctgttttccccaaaaacttgtgtagattataacccctaaaaaatgtttcttagtcaatgcatttgtctgctttggagttacaattacagtaattaatgtagaagctgaaaagttgattttattgtggctgagagagttccctactgagaccctagatcttagaagtattttctattctggaatcattttttaaatgtagatactttataatactttttatttctatttctctttctttataattctcaagaagactttttttctttgtctcttcttgtgtggtggctccacagctcagggtcaccatagacaagagaagctaagctgattcaattcactaccatccgctgtggagggaacacttgggctgtcgagctcaggaattcacatccttaacggcaatgaagacctgagactcactcaccagctgataacctataggacagga

SEQ ID NO: 44067 - DNA, 735 bp, Bovine  19866882101841
ttaaaggtgaagttagccagtctccgtgggcttacattgcttctcccgctgcccatgcccccgttcccttctccaggggatcttccccaacctggggatcgaacccagatctccattacaggcacattctttatcgtctgagcccccagggaagcctgtatagttgatttagttggtgacataaagtcatttaagagtactttatagcagcagtataataacctaacagagtctcatgaaataatttggaggacttttctcagtctggctacgcagcccaattgatgtgaagcaggcatcctgttttcccgtagaaagatcacaggctcactgccgtcttcttcttttctcgtcatgaatcatctttgtcttagtgctaagaagtaccttccagagtttgatctgcttcctggacatgtgaggtgttgagagggtctgtgagaagggtggtgccgagtcatgggagactttctctgaagcattaaaactagtcttgttgtaatccccacattcagcagacagaagtgggagttaagacttgtcaattcatactgagaacagcagaatggaaagagatgacttgaggttgcatgacataacctgaataaatcaagagaggaaaatggagttgaaatatttcctgtgtggctggtttgttttgcctttagcgctggtgagaatttagcattcagcactgttatccctgtgtttcgtctaagtgacatttaaagatat

SEQ ID NO: 44068 - DNA, 1177 bp, Bovine  19866880134741
tcaaactgcttgccatagatagacgcacccacctcgacctgtcccctgttgggtcacctccctggatcataaagtctttgatgattctgtggaatttggtgccattgtagtaacctcgatgagccaattcagcaaagttcttacaggtctttggagcatccttccagtacagctccagcacgatgatccccatgctggtctccaggtacacgttgggcggctgccaagagtctggaggaatcgccgccatggcgaggctggcggaaaacctactttcttcaatttaagtctgaatttggcaataaggagttcatggtctgagccacagtcagctcctggtcttgtttttgttgactgtatagagcttctctatctttggctgcaaatcaatctgatttcggtgttgaccatctggtgatgtccatgtatagagtcttctcttgtgttgttggaagagggtgtttgtcatgaccagtgcattttcttggcaaaactctatcagtctttgccctgcttcattccatattccaaggccaaatttgcctgttactccaagtgtttcttgacttcctacttttgcattccagtcccctataatgaaaaggacatcttttttgggtgttagttctaaaaggtcttggaggtcttcatagaaccgttcaacttcagcttcttcagtgttactggttgggttgtaggcttggattaccgtgatattgaatggtttgccttggaaacgaaatgacattctgtcgtttttgagattgcatccaagtactgcattttgaactcttttggtgaccatgatggctactccatttcttctgagggattcctgcccacagtagtagatataatggtcatcgaagttaaattcacccattccagtccattttagttcgctgattcctagaatattgatgttcactcttgccttctatttgaccatttccaatttgccttatttcatggacttgacattccaggttcctatgcaatattgctctttacagcatcgtaacttgcttccatcaccagtaacatccacaagtgggtgttgtttttgctttggctccaacccttcattctttctggagttatttctccactgatctctggtagcatattgggcacctactgacctgaggagttcctctttcagtatcctatcattttg

SEQ ID NO: 44069 - DNA, 1536 bp, Bovine  19866880415588
tgagttgctcagggcccatgactgctcactgcccctgagagctgtggtcagggggactagtggttgccccttctacttatccaaacttcggggctcagggggcatgggtcagtgcagaccggcaatgccaggacagaggggcctggcactgagcctcagcctgccaagtgacagcaggcctgggtctttccccgtctagtacttcgtctttgacttccacgtctctcctgatgtcatgtttgacaagatcatcaagatctcggtgagtggggagcagtgcccagcaggtggggctcttagctcaaactgtactttagtgcagccttgaaaagggcaccctctctgggcaggccagccataggacggcacagccataaaaagatgcacagccagccaagcagggcacaggctggagttgggcccctctcactcccttagccacatcattctgtgcagtgtacaacatgctcacatgtacctggaagccagcaaaacactggcgaggcagaaggggctgatgctaagcctcagacagatacccctgccctgccagacaccctcctgcttgacctgaaactcacttccccataaagagttgggggggggtgccctctatcagtcagcccttccctgccccacggcctcagccccatcccacctgatcgacggctggtggttctgcccggaaggtgattcactccaagaacctgctgcgcagtggcaccctggtggggtccttcaaaatggacgtgggaaccgtgtactcccagccgggtgagtagctgcgtggctgggtcagtattggtgcacacagctccaggagcatgggtcatacatgcagcccctaacacatctcacagaagcaaatggggacagagccttgctgggaacaggtgtgaactgtagttgaaattgaaagaggagtggggggaagaggaaagttctgagtctgggatattccagggcccacacaaaatcagaggacaatgtgccctttgtataggctgtgctcgcagtcaacctgaaggggcagacccatcctagattagcctcctcctctgatatctggtctttcctccaccctgtcctgggtcctaggagctttggggggacactacttgtccctgtctctaggaggcttttggtctgcaattggagacagacagtaagtagatagtcgcaggaaataggagatgtacatatggaaaggggccaggatcagcttttctgaggaagtcaaggaaggctgcatggaagaggagacgcaccaacaaaaggattagaagtttgaatagggagccagagggttggggcgtggaacagaagggatgggtgcatccaagataaaagtacagcagccacagagccttgggggtgtgaaacagcaatctgaactattcagagaggggtcaacagctatgcctggcaggagcacagggggaagggtagggtgaacattgggggctagggagagctgcatcaggaggccccacagggggatgcttaaggtcggcagtctttcccccaggcgctggg

SEQ ID NO: 44070 - DNA, 777 bp, Bovine  19866880530645
acctgcctgagtatgcacatgtgcgtctgtgtctgtgtgtgtgtatgtgttacgagtgtgcacgtggggtgtgtgtgtgtgtacatgtgtgtacttatctccatcctcttctccatcccagtctctctagcccttctccctcccagtgccccccaccctcagtgcttggtgacctgggggcagggggaagtccctaaggcccagcctggccccagcccagcccctctgagctgtactccctcatctctctctcccctcttctcgaggtgacgcgccaaggtgatcaaaggccagcctcgtggcttctgattttgcctcatgttcatcctcaggaccccacgcccagtcccttgcacctcaccccactcccagcctcctgcaccccgataccttctggccggcaaagaagacttgcacataggggtcgaccagatccttgttctcgccagtgaaagccttcttcacattggccatgaggctcgtgttcatgcggggcagcccctctgctcggtagatcttcacgtagaaccgggcccactggcgttcagggggcaccccttcggggagcagcaagttcctgccggcatgaacagctagggctgcggtggccacacctggccgactcctgccccgacatccccatgcctctggggcccaggaccacgggtgaaggacggctgagaaggtccatagcagaactgaagacacccggagtgcagggcacccgctctcttggggggatcctgggcaaatctccccatctccctaagcctcagt

SEQ ID NO: 44071 - DNA, 951 bp, Bovine  19866880543463
attcttactgtaggctctggacctgtttgtttctcttagacctgcttttcattcctgtggactgtgggcagtagagcatgatgccattggctatcactgccctttgtaatcctctgattgatgacacatcataattcactatagaaaaagcttttgggcttccctggtggctcagtggtaaagagtccatctgccaatgcaggatacatgggttcgatccctggttccaggaagatcccacacgctgcagagcaactaagctggtgtgcctcaactattgagcctgtgctctagagcccaggagctgaaactaccgaaacccgcgtgccctagggcccgtgctctgcaacgagagaagcccctgcaatgagaagccatgcgccacaactacagagtagcccccaccggccatagccagagaaaagtcctcgcagcaatcaggacccagcacggccaaaaaagtaattaaaaaaaaaaaaaaagagctttgaaaaaagaaaaagctttttctgcttatcagttcccagaaaacagcatgcctgtttctcttggcaaagggtaaaggttatttttcaaataaatgttaacttaatcagggaattttaaagattacccactttgtattaaagatttggatttcaaaaaaggtaaattgttggttactgatctactgatgtttgtttgttctaaattctgcattttgtctagaaggttctccaattgctacagatgtagtatggtcagaaacagacaaatacaacaagccaataatcaacttggtgtacaaccactttgcaaccaagtggctccttattcgtagctgcatgaaaacaggaaaagcaggaggccagggaggtgggcttctcaggaccctctgagggtttgtggtcacagctgagctttcccatcactggattcatggcagtcgtaatgatacgcacccgcaattta

SEQ ID NO: 44072 - DNA, 1779 bp, Bovine  19866880587696
ccctgggttgggaagatcctttggagaaaggaaaggctacccactccagtattctggcctggagaattccatggactgtatagtctatggggtcacaaagagtcggacaagactgagcaactttcactttcactagactacaagtcccactgccttcccaggtagtcacctaagcctaataccacccctctgccctcaccaaagagcactttccaagttcccagccctttctcactgattgtcaccagtcctgtgagccagatgactccagcatagacacaggctggtgctgaaagggctccatggacgctagtcctcagcctgggtaccccgccccccaatacatacacacaaaccttctctttggagatgactgacatcccacatatggtgacctgaaccccaagagagatggcaccagataaaatggacacaacttctcagccggaaaggacattttgcatcactgttcaatctccatcttttgcagaggaaagaaacgggagacgccaagagcagaaatgctttgtttctaaggtcacagagcaggaaagaaacagagctctgactggaagatagttttcatccagactgggacacttttgagagtgaaggaagtgctaacagggacaataggcataaaccaggatggcaagtgtaaagcagggtcggaccatagggccaccctatccctgagagaggcctctgagccctgatgtagatgccacatcacaccattcctggttcacttcagctctagacctggtctccagctaagccctgctacccgccagagtgattcacaggcattccatttcaacaatcacacttgaatttggtcctcttttattttctatcctaactaaggccatcacctttcacctggttcccctcacctggaactcttcttaatccttataaccaactggtcaccaagtcctggctattctgcttctgccacttgtcgtctggcccttcctcctctctgactctgctgttgcagcctgtcttcagttcctcctctgatgtctttcctccctttgtatttcataccgaagtcactctggatttgggctgaatctgagactgcacaggtgtgagacatcaagcagagctacctaactggttgctacctggttgcccaccctctaaatgttgtagaatgttccagaacctttctagtgctttttaaccattggcagatctccagggacctcagtgtgcccaaacatatacatcccttcatttgtttagggctcaagagtcatgtgggaaggaactcagcttctctcagatctgtccctgggctgagatggctggaaggcagctggcagcccggaatgcagagaagcacctggagggaggaggatactcacagagaggccaaagtgggtgtggggtctggaagcgagagccaggggcctggatggtgtgtgaggctgcgcctgagtttcaccctccgggagagtctgtgtgggagacagagaggtctgaggggaggaggcaagagctggttgactggggtcccagctgctctgctatgggttccccctccgacaaggtggatggtgacaagtagaaaggacataccagaggtcaggtatttggaggaggaggctgggaaggggggttggccctggcagaggcccactgttggcccagaggccaggctgtggcagaggctggccaagctgcccgtaagtgggcagagtggtcagtggagtagaaagatggtgaaagtgggcagcagcagcttgggttatgtgtaaaacaactcta

SEQ ID NO: 44073 - DNA, 2026 bp, Bovine  19866880643069
ccagaaagccgaagtaaatcctttctgatgaaacaacatcggtcagagccaaaaacatatctctggacttccctggtggtccagtggttaagaatctgcctgccaatgcagggaacaggggtttgatccttggtccgggaagatgccacacgctgtagggtaactaaacctgggcaacacaactgctgaagcctgtgctccaagcctatgctcggcaacaagagaagccactgcagtgagaagcctgtgcagcacagtgagagagcagcccctacttgccacaactagagaaagcctgcatgcagcaacaaagacccagcacagtccgaaaaaagagtatctctataatagaaacagacccacaggtgatccagatagtggagttatctgatagacttttaaataactgtgatttaaatggtcaagaaaatcgattacaagagggagaatttcaccagagaactgcgatctatacaccagaatcaaatggaaattaaagtggcatggatagaattcagcaattaataccctcgaagaacagctaacattttttcattcagccagaaggaagggcacctcaggggcaggtaagtgccctgtgaaacctcacagttggcagcctgcaaacaggatggagggcggggtgtggggctggcagggccagcggcagcattctgtgcaaaaaattcagaggccagttggaaccacagtctgctagaatttgaatgctggatgaagaaatttgaatcttgttccgcaaagagtgaacagtagttcgttctgtttgtgtctctgggtttactttgcctccagggtcagtttagaaaaagtaaaaaaaaaaaaagaaatgatgtaggttgcatttttaagttactttttttaaacattaagaaatcagtatctgaaccaatacttaaaacattttaaattgtttctccatccacaaagagcctcatcttttgggctatttttgtaacactccataacaagcctatattacagtttcggactgtagcattgaacttctaaacaaattttggtattgagcaagacctttttcagctggtttattttgtccttcctttgctgaccttgtaaactacttaattgcgaaatgtggcttgtctcagagtgcctcttaaacattgtattctttaaaatagagattttccattgcacgggagaccaggagccatatcaacatactcgcacaacaaagccgggctcctcacttccacttacttagagacatatggtttttatcagccacttctctcttcttggcagaaaagctggcaagggtttaaattttatttagcaaatagcccatccctctaacaccaagcccccactcgctgttctgtctcttccgctgtcccacctgaccctgcctccttctccagtcccaaagtgtgcccccaatctccttccaggaagacccaatcaactgaatcacccacctgccggggctggtcagtggagatctgaagcaggaaaacagccagaaggcctctgggagttggagaacaagctgagtatgaacggtctcttagaagagggggttcctgaaattagatcagcgggcccagctgggagctgttcctcactgatgcagagaaggggcagctgatgaggacggctcagggcctggagaccactgccatttggggtgtcctacccccacagtgatccagtggggaagcccagtgccactcccttgccacggtctcccccaccctctgctcccgccagttcttacccttctgacatcactgtgagggagtctttgaaactggtagcaaagttcggtgagtcttcattctccctgagcatccttcccccgaggctggctgagcctcaatgacatgtatagggccagaaagaagtgcctgagtgctggtgaggacggccctagactagactagagggttcccgccggcttagcaccctcaccagtgccatatttgttgcaacaactgaccatttctgcctccaaacataccctgaatccatgcacgtttctcta

SEQ ID NO: 44074 - DNA, 1203 bp, Bovine  19866880686019
tctgatgagccctggccggtggcactctcccagcccctgactgtcccggctgcctcggcttcctcggccccagtgactctcactggcctcaacttcacaacaggtggggaagaacctctcctgacccccggcctttcaatggcttttaactgctcaggtgggagggggagctcagggtgcgagagctgcccagccctcccacagtgtcctgatctgagatactgtggggagctcctccctatttcttggagggtctgcgtgcccagcttcttccccacccctcatcggacagatcttcccttcctgctccatgtccccatcttctaaactttggcagaggctcaaggggcagatgatgctgagccggggcttctccactcccacctcggatgcctttgcccagcatgctctgctgctttgaaccctggctgggaaggcagtgactttgggattgttccagaaagctagccctagggcctcgcagacagcaggcattagcctttcctggacaccctgctcacttctcatttcccttccttctgtcacagagtgcaatgtcacccacgacgggcgcagctactgtgcttgcctctctgggtaccagtggaacgccagcatctgcagccatcgccagccctgtcaaaccaccatcaagcaccggccgtgtggctgtcttgttctgagccctactgaagccgggtactgcgagctgctgccacctggtgaggagggctgggaacttggaaaccaatagccccgagtgaacaaaaccctctctgtgtttttcctctctgagggctgtatctctgccagctggtccaagcccagcggctcctctgggtgagagaaaatgccaggtatcacagcagatcacaggccccgcgcttgggacaggaatagtgagactaaccaacaacagggctctggagacaggtggacaaggaaagtttcctttctggtggagggggaagtcttaggtcagaaagcttccctgtgtggttcctactgacatatagggtcttccaggctggactgcagcagccacactcctccagggacaaaacaggacaattagtgttgggtggggaaggagtgaggagagatgggcttcggaaaatgggggaggagggcgaggctccagggccacaagtttctgttctgggggtcctgtctcctgcctcctgcagtccccgcaaccctgaa

SEQ ID NO: 44075 - DNA, 2038 bp, Bovine  19866880717471
attgagacagcagttttctgaactgttgtgcagatggagctaatcatcgcagggctcaccaggcattccctaaccactagtgtagacgtttctcagattttactttttatggggaaattcaaggaaagtactgcctatctttgcttgaaagcggttctgtttaaatgttataaaatgtaaacgctatggaatcagaagggagcctggccttttaaagaagtttttggccaaagctagcatttaaaactgctggaaatcagtagggctgttaacatgtaatttttagcgactccaggcaaatggccttttctccacagtggagatgggttttagccaggagggtgcaggcagggcaagcttgtcaggggaggacgtctgtctcctcctgagtgagacgtgaccatgtgggcagggcatcggcaccttggagctctctttgccgctgagtggctccctcagctgtggaggtgcctggaggaaggggcgtccttcccgaccacccccttcagcccaggcacaatgtggacatttttcaccacaggaggttgtgccttctgggaaggggctccttttccattccaaggggaatcaaaaccaccttgcttcaggcctgagagtcaagtggaaataagttttcctttctctagcataaacagacctgtgggagacctttactgaaagcatagatcccattcttcttcactttctttctccaaagcagtggttccagcaggttcctgtaaaagggaaaaaatgcagattcccaagtcaattacctggagattacccaaggtctggtgagctggtcttggctggcagggctgactctgtactatctgatggaaggactcctgcgtaaggggtcttgggttagcactgaatgatcccagaagcaggggctgcagaagggcagcagaaggaccacagagaccccatctcagggctgttggctgagctgataagctggagcaataccccccgtgggggaaagagcagtagcggggcccagactgagggcagtgagctgctggtgggaaggacgttgcattttcaggcctggctctgctccttcccgctcgtgtgacctgggcaggtcgttcaacctccctgagtcttggctcatcagtaaaaaggggagagtaattcctggctcatgtggctccggcatctggtaggtgttcagcattggtggctgttatgttccctgtggtagagaaatttaacttggccccggggccctgggggacaggcttcagggtgtctgcctgtgctgtgggaacaggggagagggtgagcctgtgccccacataactctgcccatacataccctcccccctgccagggaccccgcggccagcctatccaggcatctccctgattcttactctcccagttcagagcgtgacttcctcctcggtccttctcaggtttcaggtttttgttgggtgatatgaggcagattgagatgcctttggggggttccttctaactctttaaatcctgcgcaacgatgagttctgtcctgtgcagactgaggcagggaaaggcgagccccatttgaggcttcacggccctgctgaggacgggatctgggctcacactgactccctggcagctcccggtgcgtccttggtgacatgggacattgtccacatatcagggtcagatttttccctgtgaatcaacaggaaggaagagagacgtgctctccacaagtgttaaatccagagaggcctttcagtccaatcctggctctgccactttccttgtatgactatggacgcattattttagcactgagtctcatttacaaaagagggacaggataaagtggtccctttggggcctttcagtaacggcagagacagcttggtcctaccctgagctatctctaaatttccttgtgaagatccatcctgtcctcatgttttctgggcctttcttgaggttggcttggaagctaaagctccctcctcttaagcgttttagctgtgggactttagatgagtccacaggctgagcctgaagcatgcaaccc

SEQ ID NO: 44076 - DNA, 3214 bp, Bovine  19866880720284
aggcttttgagttcctcttcactttctgccataagggtggtgtcatctgcatatctgaggttattgagatttctcccggcaatcttgattccagcttgtgtttcttccagtccagtgtttctcatgatgtactctgcatagaagttaaataaacagggtgacaatatacagccttgacgaactccttttcctatttggaaccagtctgttgttccatgtccagttctaactgttgcttcctgacctgcatacaaatttctcaagaggcagatcaggtggtctggtattcccatctctttcagaattttccacagtttattgtgatccacacagtcaaaggctttggcatagtttgttattttaaaatcaaagaagacacaccataaaaggagattattacaaagttcaaaagcaatccaggtattattctttctctacccatgacagataatatttctcacatatcttcattatgatatattggcattctgatactactgactaaagaaacaaagctaaagtaatctggattttgcacctgattttctaattagctttctttcattatataattattaaaaagaaaactgttctttattatcctagatctagccaacagcaatactgatgcagaattacaaacatatacatatttcacatgcatatttattcaccattcttctctgttattaaaagctggcattcttctaggatacgagtccttaagagtacaagccagctgtcaggtcacatgtatagaaacaaaacacctcaaaagtcaccttagtcctgtgtactcacattaaatacctgctgatttaagtaatggaaggaaattgaaagggtagagacactactcaaaattttggaggcactttacagaacgcggtagtctccaaatttatcttcataaattcttatttcaccacagcatcaaaagctcttcctcaactatcatgatccttacaaaactactacaatcatattctgatgatccattaggttatacactacacatcaggaagcaaatacaaaagtgtaaggctgacagtgaacctgccttaggaataaagaaatgaagcatggaccaaagtgatgaaggattcagacaaatgtgttatctgactgccacacattagctgtgttgcgttggcggaaactttaacctctctagacctgtttcccccatccacaacagttattaaaacttccattgccaatatgttatgaggattacacaagggttaaatgtgtaaaaagtctaggatggcacataaaaagccttcaattaagcttttctattggttttaaacatttcttgcaaagtcagacaggactgagcaactaagcacagctacccagtttcatccttctccgacactagtcagtcaaactatcctttttggtctgcccttatcttactctccttgatccagaccaaactgtacaggcagcagcaactcaagtcagcaattttgttctcaacttctccagagtttgctcacttatcttctactccttcgctgcattctaccttccttccccttttatggatattcacaacttttcatgcattaaaagtgtttacagggcttccctgatggtccagtgactgagattctgagctcccaatgcagggagcccagggttcgatccttggtcagggaactagatcccatatggtgcaacttcaagatcccacaagccacaataaagacccaatggagccaaacaaatatacaaaatttttaaagtgtttctatatcattaaaatgagttcatatactatctttaaaggccatcaaatctttagaatctaggacttgttgattaattgtttcaaacttattaatgcataatgcttattactctctacacaatatcatgacaacttgttatttggtcagaataatgctttgcaatggcacttgtttactctgtattaaagaaaacacagccactttaaactcctgcttgtttacttgacttccccaaatctttatgttctcctcccctctagctttcagatgaggtgttttttttttaatgttttctctttcttgttcttaaaattcaaaccaaaaaaacctttcaagcaacctcttctctggcgtttttatcagagagacaaaacatctgcttaaacaaattaaatcagtgctgatccactcaggataccaccagccaaagcacaaaaccatttcattccaacagagaagcaggaggaggtgggtgggaaggatcttcaaatggtattaggcaacaaatgacttaatggagaagatgaggactcttccctaccagaaaataaaggacatttctacttttggcacttaacaatttaggagacacggcttgttaagaatgatgtgtatggtggggggcgggggcggggggagatgtactagtaaaatttaagcatactgttctctaattccttagcaatatccttagcaatattatctcatcttggcattttttttcttctactctccaggaagtctgtactctcacactgctgcgcatgtagctgcttcaaaatttagaaccagacctgtctcttcaagacctccaagtcagtctcagtttccactcccaacaaatgtgggagaagaacctctgcctttcaccccaacttattattcttcccaggggtccttggcttttgctactaattttgttttatctaacatttatacctcaacatccatgctcttaactatgaatgccatcgcttccattttttactttaataaataaaatctgtcacttacagaatgctgtgcaagaaactgaggttccctgatagctcagttagtaaagaatccacctgcaatgcaggagaccccagtttgattcctgggtcgggaagatccactggagaagggataggctacccactccagtattcttgggcttcccttgtggtttagctgctaaagaatccgcctgcaatgtgggagacctgggttcaatccctgggttgggaagatcccctggagaagggaaatgctgcccactccagttatcttgcctggagaattccacggactgcatagtccatggggtcgcaaagagtgcaacatgactggaaattagtgcaagaaattagagcaatggtcctcccttcgctatagggccaatcatacactgttaccaaaggtgatagatgacaaagaaaaggggaaagactgagtcctcaggatccaatcaa

SEQ ID NO: 44077 - DNA, 1243 bp, Bovine  19866880750025
gggctgggcagggaactctcgcgagatcccttggggagttgaggcagagtgggttctggaacccagctccttcccaggtctcctccctcccaacaggcctctaaaagccgctttcccgaggtcatcgagctggtttaatgagatcctatctgtggaaatgtcttgtaaactgtgaagcattataaaaatgctatttgtcatgatttgtgacagacctgggattggaacccgaatctactggctcccgggccagtgcgttaagcccagcaataagaagaggcattagacagtaatttagcattctttatttttagagtcacgctctcagagacacttgctaactagaaaccccattccagcctccctctctctccctacaccgcgttctgcttggtggctggcagggtaggggtggcggggtgccggcggacttctatcttttattccctgattcaaaaaattatttacaaatcttctaagatatctcaggcactttgctggtgctgagcgtgtggtggtgatcaagacaaatatagccctggccttaaggagattggcatctgatggggaggagcgtaatcagtaatcgcttggttaactctgcagttgtttccgtgccggtgctgcgaacagagtgcaggacacagtgacaacgcctaaccaatcctaggggtcagggaggctcctttgagaaggggacatttagcagagacctgaaggatgcacagaagagaatcagacaggagacgagaagggtgtcttttggcaggggagccaccaggcagaaaggatctcaagaaggtgctggcagagttgagaagggcttaagggtggaatgtgtgtcaagggcaagagtcaggaaaagcaagactggaagaggggttggggtttgaacacacggggtgggtgactccatgagggtttatcttcaaagctttcctcagagcaatggacgtcattgaagggtgttatgccgaggaatgacataatcagatttttgtgttcaaggggtcattctgctcctagggtggctggcgaacatgctggacggaggccggcctggctctgtggaggaatgtgaggagactcctgagtaacgagggaggggggaacagtgctgggacagggcagcagtggcgagaaagagctggatgagtttgtgtgacattttcaggtggaatcagcagcactgggggggtccggatgtgggcgggggagttgggtgcggattgccagtggggac

SEQ ID NO: 44078 - DNA, 1316 bp, Bovine  19866880797473
attaccaaagaagcagtctgcgcaagtgggaggagtaggggccttggagtcagttttggctaccccactcccatcacctctttggtttcttctcactagaaaaagggggtggcaccagctgatctcaaggtcccttcctgctctgacagcctctgggctatgaatagatgaggctggggccccggaggagtctaatgactcaacagctagagaggttaagctttcccagaaaagtgtttccgtttgcgtttgatgaacttagggcccaacaaaggaagggtttcctgtctggaagactagggatgaaggagctggaggaacccttgcagttcctggaggctgtgactaaccaggtgaatgactaactcagaccctgctgaccttcaaccaatcagggctgctcatgaccaccctacgagctggcatcactaaacatgtcttggccatgccagtcccagctggctctgggtttcacggcatatggaggcagaggaagcagccaagaaactggcaggggaaggaacactgggctttgaatcagaagtcccagcttcttgctctaactccactgctcaccagctgcgtgactttgggggagtcctttccccttcctgagcctctatgccttcatctacactaagggatctaactacctgccctggaaacttccctgagctatgaaggctgagacttaagagatgagatgagagcacattgtgaacactaacacaatgaatgaatgaatgagaaattttgtcgtcattctattccagtaggattcctggtcccccaggagacctatttgggtccccaatgtgatcaagtggacacagactgctgcctttgggttttgagtcaagatcagtctgatgtagggccctttccaaccatctgatcacagcccacagagaattttattagacctgagcccatacggatagcttccagccaggtggcatagccagagtgagaggtgacaaaaagccaggaatcattgggtggggcagagtgggcagtgccagtctggggcccccacagaattagggtggtgctctgatgctctctcctcttgccaagaaccttataaataaataatcaccacaaccacactgtctgcctctgcccccagcttttagcatctttcttggtgaggactacaagcactttggagaatggcaggaacgggagaggaggaaggatgatgccctctcatgtctgcacaccttaaacccatcaagagcattctgtgagtgttcctgtgtattactgggtacctgtgctggcactaagagcaaaaagatgggaaccacagggcc

SEQ ID NO: 44079 - DNA, 2316 bp, Bovine  19866880943408
ttccctttacttttactttatgcattggagaaggaaatggcaacccactccagtgttcttgcctggagaatcccagggacaggggagcctggtgggccgccgtccatggggtcgcacagagtcggacacaactaaagcaacttagcagcccagttttatatacgctctttacttatctcctcagaagctctcactcccaatcaggtagtcataggagcaccatggcacagcaggagctttggagaaggcaacacaagcaaaactcttcctttggacacaaggaaaccgaacttaggtcagactgggggcctctacgatatcaccttaaaggtctacaaatgcccagcatggcccgaattgtgacacaaggctgcatcgtggtccagctgaggtgccttacttggccagcaggctcatgaggtaggttgatgtgttggtgtccagtctcaggggaggcaccgtgacgtaggcggctgcgtgggaccagtcctggtggtagtagtgtaagcccgtgagcgtggcgtgtgcagtggtggtctcagccagcacaaccttccctgcaagaagaggggagtccgaccatcaccaggaggccagtgaacctgggggagcattggtcggagcctctcactgggcaggagaaggagctgaagtcagaaaggaagggactagcctgagctcggctgggcattggagaccccagctgcggtcaaggccagagtgctcccgcatcccacgagacagaggcggaaggctgggtccacagcacaggtgagaccctggaggaggtctagctagaggagaggtaggaggcgagatgcggaaggcagtgtggcgggagggctggaaggccctaatttatatccccaggttcgtgactgtgatcttttatgcttgttatcaggcccccactggcaccccaagccaggctgggagtacaagcatggacaaagccttcaggcgtggccaggtgctcagacacacaggtgtcctagggctggtacactgggttcctgaaggggatgtccagctccgacactgtcatttctccaaggactacataggcatttccccctgaaatgtccgctgtaactcatccaggattttatgttggttaccaaggcaaccactagcaaaacccaagagaccaaaaaaaaaaaacaaaacaaaaccaattcatgagttgattaaaaaacttgaaaaatttttatcaatctgaggagaggtgacagacacttctgtaaagctgttatgcatacaaatgtgcagaggaaaacccttattctaaggggccaaccccaggcctgggcaggaagacagcaggaaagagaagggcagggcagtctcagggcctggcctcaggagccagaagggaaagtgcatgaagctgctgggcacccctcacacaagggctaactgcccagcccaccctactaactcaccttgcatcttagcagctgcaataacatcaccggctgagatgctggacacgttgaccagatagatgggacagtgagtctaaacacaggaaacatggtgggaaggagagagcatcaaccccataacaagcatcaagatgaccagacaggattagtcctggcgccagcacttccccctgcatcgctctgcaccctccttaggctgacagtcttctgcacagaatgcaggcctggcagctgcaggctaggggaaccccacaaaacaaggaggggacaggtggtgcctggcaccagagcccacagtgggaatatctgggtaagatgtcaagtgctgaacctcacattttctaccagccaacaccaagactatttacaacttaaaatgagggattttttcctgttcatgaatgtgaagacctaggtacagttgtgtattatgtcccatatctaaaattatgatgcctgccatgtgaaggctgctctatcagcagatagaatgtactctaccccagagaagaaatgttacacaagaggttcagggttcagtctacatcagacaggaccagtcttgcaaatggacactggattataactctgattaacttttcctctactgaactgtgcaaccatggtccatggtttcacttctttgggaatatgtttgagctaaaaaaaggaggaattgcccttttgttgttcagatctttccttactctggggtaagtttccatcaggaagtaattgctagcataattattgttataacaataaaatgatgtccttgtccagcttctagacttataaagggctaatggaaaacttcccaaatgttattctagtgccttcttatcaaattaggaggatagagaatttagga

SEQ ID NO: 44080 - DNA, 771 bp, Bovine  19866881019537
tctccccggccaccccgcccagtctggcttttctctcagtagccatgatggctgggtgacctcctctgaccctgggcccacgtctccccaacccctcagcttctccccacatcgactctcagccccagcctggcccaggccccatgcccatcccaagtccccaggacttgtcccagtcacctcatctccaaccccagcccggtaaccccccatccccacacctctaatcagcccctaacccacccaggtacgagctgagggtcatcgtgtggaacacggatgaggtggtcttggaagatgacgacttcttcactggggagaagtccagcgacattttcgtgcgggggtgggtgagaggtcccctggatgggaagggggccgagctgggtaagcccaccttcctggaaggcaggagaggagggagagaacggcgaggagggggggtgctgtgggtggagagaggcctctggggaggtggctgaagggccacaggtgatgacccacaggtggctgaagggccagcaggaggacaagcaggacacagacgtccactaccactccctcacgggcgagggcaacttcaactggcgctacctgttccccttcgactacctggctgccgaggagaagatagtcatctccaagaaggagtccatgttctcctgggacgagaccgaatacaagatccccgcacggctcaccctgcagatctgggacgccgaccacttctctgccgatgacttcctgggtgtggggctgggaccagagcag

SEQ ID NO: 44081 - DNA, 1966 bp, Bovine  19866881094140
ttcgggcaccggcgacagcccacgcgggggatgtcctcccagtgtctcagggccagcagtgccacgtgctcttctgtgggcttcctctggcctgtgggtgccagaggtcagctcatatgtgggctcagcagaacaagagacctgtgctgggccaggggctcaagggcatacagaggccccttctccggtctactgatggggaaactgaggctcagagggagatgcaacaacagcccaagctctcaggtgcctcatgggccccggatgggtctgtgtccttgggttttccctgcttggggggaaactgacccgagaatcccgctgggctgcgaggtcagggaagagaagaacctacatcctgtccagcaccttgaaggtgggtggcacaagcttccagcagagacatttgctggttctccatgaagggccacaagggcaaaagggtggggagggccagaacaacctgggtctacactgccctcactctgccttgtaaaagctgagtgaccttgggcaagtcactgaaaccctttgggtctcgttttcctcatctgtagaatggggaagaaccttcctaccccacagggaggctgaggggaagagaaaggggacaagtgggcaagtgcggtgtgggatggggaggaagggcagaggctgagcggacagaaggggggacgctgcggtgatgagcagaggggtggtcctaccacaaggatgtgtgggtccttccatggcctcttgacacccccccatagctgcatgcagcatcccttaccattctcgtcctcgatctcagagggccctgtgaagatgcggttggacaccttcactctcccggggggcccgaagtgggggccgtccactttgccctccttgcagaggcgggtcaggatctggctgggcttcatagggtcccgccagatattgtagccgtgtctgtgggaggagacgcatggcctgggtggggcttggggtgtggctggggcatccccaggtagtaagtggcccctgccagattccttaggttggctgttgccccatgtgagcaagtgagccctgcctcatgctccaggatcagctgagacacgagggctgctggaggctgatccctcctgccctgggctcgggccccacatgctccatgctcctcaaggacgagcatccagtctccccgagtgcagccgcaccatccccctgactatgtccactcctctggaacttcaaagactccctgaagaaactgacaaccagagaggttaaggggctggcccaggggtcacacagcctggaattggcaccagctggccagatctccagtggactcttcctagcacactcctgcctcctcccagcccgcttttctctccctctgtttcctctgtcctggaattctctggctctctccttgtcttggaacctgcagtcctggcccctgaaggctgagcccagagcttgtcggggtggaggcctggctgggacagaaaccatatgtccaccttcccaaatcccatggtttgcatcttgattttgaagtcaaggtgcagtaggcagcccccctgccccaccccgccccacgcacacggagtaggtctgggcgatgccgcaggtggcgcggtgcttgctgtagaagcggttttccaggtcgatcttggtttccccaatgaggtcatcagtgcctaccagatcccagtcgtacacggccaccgtcagcatggattccatggggaagcaggcttcgatgtcaaaggacctggtgcggcggggttgggagaagggttgagggtaggggtggggtagggtggggcaggagggcatctgggctgggaagtccgggcagggtggaggtggggcaccaggaggccttacttcccaaagacggggttgagctgcttggagatgtagttctccttgtcacggatatcagtcttgcctagccggaggcgatgtacgggtcagctttgccgtt

SEQ ID NO: 44082 - DNA, 1571 bp, Bovine  19866881135088
tttctgattctctgcattctggctccttttgcgcccctgtccaggtcctgaatgagtcagatctggacaacgacaatatgctgtctttctcagagtttgaacacgcaatggccaaatctccagatttcatgaagtaaggtgttctggagtcggggggtgcccagcctagtgggggagacaggaagctccccgcccccagtctccctgagccagcagagcacctcagtcttcccaatgaggtcatgagtttccagggcactttgcagattctttcagaatcagcaatactggaacttctgagaaatgaggtaacctggaaagagacagggcatggagtttcaaaaggcaaagcggagattgcagttcaggcattgcaagcaacgcgggtggtccagactttaggtgctgtccctctccagccagcgcaaagcccactgggctgcaggactgatctggggagtcccctttgccactgttagtcctgctcccctcccactacaacctccagtggccactaggagctggggactggcaccaaacccgggtgggcagacagtgaatatgccagtgatggagctcagaagaactcaggtggaaaggggccgtaagggtcatatctggtccagacacttctggacaattggccatctccatattggctgtgttcaacagttttatttgggtccctccagctgtgggaagtacaccaccactgaaggcagcccatatcaggaggaccagcccggttagggcagtcttctcgcactgaactacatgtttgcctgtgtctgctgttcctgcaccctgttctgcccttggtcatcagccaaggtgacagcaaggacaaatgccccttcaaaatggtttaaccaatcaaaaatgaacaaaaccagctaggcctcatggagcacccggctaggagcccggagtctctgcctctgtcctcagcagctctggtctttgctttacgtgcagccagaaatctctgctttgccaggcatgagaccaaatgtggcctctccacagtggtcaagtttatagctctttggctcccaatgaccctcagtgaatgtccctcggctctgactgaattcccagagaatctgattggccagtccaggcaggtgtctggccctcttccaatcacctggctggaggagatggcccttccttccaacatggctgcccaggggctcttttagagaaagacagtccacacttggagcaccctacttgattctcttcttctataacagcccagcacacaactgaggctggaatctgtctgccttgagtgttttctttgaatcactcccctttctttccactggctccagcaccacaaggttgtgactgccttagcattctggagctgctcaaaggagctttaaagaaggctttggggtggcttggattgctgcaagctgaccattgctcagacaaagggacacagagctgtgaacccaggaagtagaggggattttacaacttcaggcttgaggtggctaatggaattccttctttcagctcctttcggattcatttctggggatgttgacggaacacaaata

SEQ ID NO: 44083 - DNA, 1290 bp, Bovine  19866881212801
ggatgggcacctcaaggagcgctggagggctggtgcaaagcctcctcccctcccctggtgctgtctcctttctccaagggttgggtctgcctgaacaggctggactgggcaggttcccagcaggggaaatggaatctttttgtatctgagggactggggcaggcttacagccccagggattaggtgttaggacaggctgcccctcccagcctcttggggccagggaggagtttaggcctgcagtcactttgggaaggagtcaggcttcccaacttggccctgggaaaggtttggctcactgtgcagttacagaagccctcaggtagcacagaacaacggccaaaagccagccctggctcatctgggggtgacatcagtgactccccaatgggatagcacttgtctccttgaaaaacgcttccctaacgtgtatttataaatgcacagttcattgtgtactaactttgtaccagatctgtatttctccttgaactggctgaccacttcacgtgggcttttgtggttttaagtctcataacaaggacccttgttttagagacggggacttgggcgagagagagctgtttcagcctcatacagttaacgggtggatctaggcccaaacccacctgcttgaacttattttcagaaaaggtagcaggatatatggaaaggtcagacttcagacttttgaatgtcacaggttggatgagttatagatttctcacctataaaatggggataatgatgccaacactgatgaactcacaaaagtaataaataagacataaaagacctggtagatggcagggagtcaataaaagttcttttctgtctcttctccctttctcctctgctgttgtaatgccaaagaagatgaagcttaatagttctatgaagacctacaagaccttttagaactaacaccaaaaaaaaaaaaagatgtcttttttagcacaggggactggaatacaaaaggaggaggtcaggagatatctggagtaacaggcaagtttggccttggaatacaaaacgaagcaggacaaaaggctaagagttttgccaagaaaatgcactggtcatagcaaacaccctcttccaacaacacaagagacaactctacacgtagatatcactatatgattaatactgaaatcagattgattatattcgttgtagccaaagatggagaagctctataccgtcagcaaaaacaagacagggaactgacggtggctcagatcatgaactccttattgcaaaattttcctctgggctgggtgggtgtgg

SEQ ID NO: 44084 - DNA, 964 bp, Bovine  19866881356560
atgttcccccacctcggcttcccttttcacctccagaccctccctctgtccccgagtggtccagccgtgtcctcaccagctcccgcatgcaggacttgagacgctcccggtccagcctggtgcgggatgagtggccctggtccttgtccgcgagggagaggaagcggctggggtagggggtgggagcagagcttagcagagatgacaccttctctgccagcctcccattgccgccccacactggcagcccctccactcactagcaaccagagctcagctcctctaggacgccccgaagtcgacgctcagggtacgacttctcccgttttgatcatctcctgcacgtcattcaggccttcttcctgtgaaccagcagtgtgagccacagcccccctcagcctccccaaacatctccctctttcatcaagaggatgaggggctagtatcctaggacctcccatgagcactatccctggagtgctccgccatcataaggaaaagtgaaagtgaagtcgctcagtcgtgtccgactctttgcgaccccgtggaatgtagcctaccaggctcctctgtccatgggattttccaggcaagagtaggggagtgggttgccatttccttctccaggggatcttcccaacccaggggttgaactctggtctcccgcattgcaagcagacgttttaccttctgggccaccagggaagcccagaaacaccaatttccaggttctgttttcagaacctggaagctgtcatgctcgtgactctttggttcctgaggaagaagccatctctgggtcatgagtctgtggtcctggtggacccacaggggtcggacagagcccaggatcagatgcaagggggcagcaggtagagagagagggattggccagacgcctccagggaaacccaagactagatgggccacaattcccagactccactactgggaagccctcaga

SEQ ID NO: 44085 - DNA, 2077 bp, Bovine  19866881357676
tgcacaactggtgagctcttggggctgaggttctgctgctggcagagagaagggtggggttggcatggggcaatgtctgaggtaccagatgcactgggaggatttggaagaataccaggtgggtagatcaggcaggagattctgggcagtggtgggagcttcctgaggcaggtgggaggggtgggaaaactctcactgtggtccctgccttcgctaaacctacatccatgtgacccagactggctctcagagggcccctccccatttgtttcctgctccagatcccagggctttcgccttgtctccgatcctttctgtaggcctgtaccactgtgctccctcccaaggccatcagagacggggcactgtttcctcctctgccaccacctcgggcgtctgctgctgagggctgggagcctccattccctggttgttcaatgagagcatcagcttttcctcccaacccccgaagtttcccactccccagagggccagggcagggctggatggagtgggcaagtcacctgtctgtggtttgtttcaggccttgaccttcttgaccaggaatgaaatcctgtggtgagtagagggggtcccctttccctccccttggaactgaaatcttaccctggtacagcctcactctggtccctgaatgtggtccctgcccagagctacaaagtcctggagacgaggctgtcagcagacaggcagagacagaccccagtcctggagggtccaaggtcacgattcccagggccctactacattgaaatgtcagattgtaggttgctatgggatccatggcgaggtttcttcatagaaccgcagaggtggacagggccttcctgggatgatgaggacaaggaggagaggacttaggaaacaggtctgcagtacatacagcgaggtggtcctctatctgggtaaagctgatgccccactgaatctctcttagtcctcccttccctcccaagcttcgcttcactgcctcccagcatggtgggtgtaacagtgcgcagtccattccctgttcttaagctggtgatggccagagaggaaggctccgggccaagacagccaacacaaggatccctcatgggaccgcagagagggtagacagcatgagagatgtgagagcactcagcctgggccaggtgctcatcagaaactcgttagaggaggaaagggggtctctagggcattgttggtggggtgaagggaggttggagtgaggagactgccctgagacccacagaaccctctcgcctctttgtctctgctggacacaccctccccagacaacacccagcctggaagctgcacttcccactcagggtcccaggcagggcaatgattctgccccaagcatgagactctcccggcacgggggtggggggctgatggatgtccagggcacagtaagtgatggagaccagggacagtcaccagattacatcgctttccttttaaaacgagtgtttgctcattttagaaataaagaaaaatataacaaaactctacatcctactacttttacatctcattgatattttctaaaaaaggaacacttgcataaaaatgaaataaaaattgaaaagtaatatgtgagcatggccagaaaattcaaatagcataaatatcctaaaagaaaagtaagtgtccctctccttcccaggccttctccctgatgataaccctgttcacagttggtttctcatcaaggcttccataaaaattttcatagatagatctaaataaatatccttcaaaaattttatctcattcacactgcagcatttaccaatttatagtgtagcattatactgttctggaccttttttctttttaagttttcatgttgtctatctttacataaagcacatagagatatgtctcattctatgactatgggacattctttcctatagaggaaatatcattcattttacaacctccccccataacatacacttaagttctttatgacttttagttctatcaataacgttatagtaaacatttatgtaaaaatagcttatttaattgataagcttttgaattgtggtgctgcaga

SEQ ID NO: 44086 - DNA, 1539 bp, Bovine  19866881368647
ccatacactccacaaaaatggggctctaccatggaactgggcgatcatgctcatgggtcacaaatgtaagagaatgagcacatagacctggtcaaggtgtgccccctgagagctaaataaatatgactgtgtgcatatgcctgcacatgtgtgcgtacacacacacacacacacacacacacacacacacgcaagggcacacctcatacaccccatccagagcagcaggagctgaatcgaatccagattccaggcagaaccttaggaggttctgcagaggagagggcttctcttctattgggatgcaaatatcttggcattcagagaaggtgggagagcagggagcagaggaggagtgtggcagagagaagaatcacgaagacacgtcacctttctaaagctcctttctttgagatgcacacccgcctccgggggcgggatgctttgtgcctgtgtgcccttggcatatggaagcccgatgttccaggacacggttccccccagcttctggacttatgcctctcccagcgaacatttattgagcacttgtcatgggtcaggggcactgtaggtttttggggtaaaggagaactcacattagcagaggagatgacctaatgtggacctccagctggatgaagggtcataatccttttgtggggcagagatgctgggtaggcgggtggtcggggaagacaacagggagcctggctctgtgagtgagggtgagagccccctggttgggcggagatgcatccttccaggtagagaaacgtgtgtgaaagctcggagagcatgcaggtccccagggatgtaagtgacatgtccagggcatagggcacctctgggaaagtgagaggagggggtgcaccgtggggatctgatgatgaaggatcactctgtcatcagtgtggacgacaggctgcagggggtgagcctgggtctagggcaggggtctccatcctccgggatctaatgcttgatgatctgaggtggaggtgatacaataataatagaaataaagtgcacagtaaatgaaatgcgctggaatcagtccgaaccgccccaccccccgcaactgtctgtggaaaaattgtcttccatgaaactagtacctggtgctataaagtttggggaccgctggtcaaggggacttactatgagatccgaggctgcccagttaagcaaagaggagggcttgtagccctgggagggtggagggccatgggaaatccctaaggagggagcagaagcaggactggcagagaggcccgatgtggcaattagtagggtgaggcctggtttctgggggattctatagatggaggtggtgttaaccaggacaaggagagccaggaggaacagcaggctagttttggttgtgctgagtctgatgcccccggcaagccctcggtggacaccttggatgtgtggatctgtggccagaagaaagatcggagctggagacacggatctgggtgtcctttggtgttggacgtctaatgtgaatgagctctcccagaggcagtgggtccccga

SEQ ID NO: 44087 - DNA, 1599 bp, Bovine  19866881374862
ttggagcttgaaatccggtacctgggtgggaaaggctgtgtgggcgagtgttaatgtccacgcctgcagtaccaggcccttggacgtcaggtcctggtgttgattttgttgctactttaccgagagagaaagccacctctctggtgggcctcaattacatactcagaggtttactttctccacacaggtggtcagagaacatggaaagcctgggtgcagggctcctgcagtaccatgggtgtagtagaggctgtgggtgggatgaaatgcctgtcaatcttgcattgcatgggcaatggcagagcctcaggaggccagagttccgccttttgtccataatctacaggcccagcctaagaagaggctgtcatgaaatcatttttaaattccctatgacagggggctctgttgagaaaatacactcttccacccaggcctctgcagctcttgggtcgcagggactgttactcatggtgctagttccatttctctgaggctactcacccaggaagcccttggatatcatctgctgcagcatttccaggcttccacctgcaaaccgctccccaaactctttgccgagattttctgccacgtgttttgcgacatccacaccaacttcatctaccagtgtagcggcgcccacagggaagccgaagctggtggtcagggagtccagcttcttagggccgactccttcctggatgggcagcaaacccaggacctcaggggaaggctgtcccagactcccctaagggcaccccgtgctactctcagaatcagcctggtgtagcgcccacttctcttctgggcactgccaggtcagacccaggactgggactgatacacacagggaagcacaaagaggctggagagccccaggagaaagtgtgaacctttcctaacctatggcattcaaaggaggtctagacatgaacaaattattcatatctttcttgtttgcaatcctgaatctcaagaataccgagattgcatgccagatgtggtaaggttccctaccctgagagaggagacatcaccagggagcagggctgcagcagcccgtgatccctgagtctaatgggagcccggcgagtgtggccagccctttctgccactgaccaacctggatggctaccagaggggtctgtgtgtggcagaagcaggtacagcaccaatcagaccaaacgggtcctgttctggatgaagatgcagaaacagcacatagagcatgtcgggaggcctcggggtgactggagcagggaggacgcttggggagcagagctaaaattctgcattttcgcccatgacgtcccaacagtgggtggaatggaagggcagcaaaaggccttcctggagaagagccagcagtcagtgtattagaaggaagtctgctcttcatcttgacattaccagtctggaaaactagtttcaggagtggaagatgcctccaacattctgagagtgataccaacctggagaattctgatgacttcagacatcatgggtgtgaggcacctggtggtatagaagccaggtccatcctgcaaagggagagaacacgagctcatgggcccctggctgagggcactgcccgag

SEQ ID NO: 44088 - DNA, 1046 bp, Bovine  19866881418839
gcctgggcatccctttgtttctatgtctttgggttgcgcaatactgaaagaatcccggcaggagatattttctttgagggtctgtacaaaaagggttaatgaggcagattgtggtacacaccaaatgtctctagtcggggtttaaggtttgacttgtagtggtatgagggtgtggatttttttaatcattagtttcaaatctactttaaaatcggaatcaaaggtttgcaaccagaaacccggggcttcacagaccagtacgaaaaccactggaccctaactctaaccctgactttagtcaccaccacccccgccccgcccccactcatcagccatgccctcgctcatccctgcagctctaaagaaaagccagtcaccagcatccagtgcccaagacttcctgcacccatccccctgcctacagcccccactggctctgtgccatctgtccctgggcacacctgggtactgcagggggatgtcaatcttgggcccgatgacgtagtggccctcctccagggtgtgggctgtcaccgtggtccactggcggcaggaatgaatgagcaggatgtctcgctcactgacgccctcagcatactcccctgggagggggcaggcggacagaggagggaggagagaaaagagaacatcaggaggggcagagagacagggtgacctcctcaccgagacaccgcccgaggacagctctccacgatccctgtccgggccagcaatgctccagggatgggggctgccagctgtgagcttggggctgaatcaggccccgtctctcagggctcaggcttccgatggggcctcagaaaccaacgctgcctccatcctgcatttatccttcgactggactgcctgctgtcccagtccgtgtgctggagccaggggctcctccctccaggagccctgaggcccagggggcaggaggtggggagagatgtgaacagaggatgcgggcccagtttgaggcactgaatggaggcagtctgagctctcacagaaggggcagcaaactagttgggggggggggaggg

SEQ ID NO: 44089 - DNA, 1340 bp, Bovine  19866881433838
ggattctctaggcagaatactggagtgggttgccatgctctccaggaaatcttctcaacccaggggatcgaacccagatctcccgcattgcaggcagattctttaccatctgagccattgtccagacctttaatttgcctctaatgataaattttctaagaattcaggtagagacacttgttcctaaggttcctccgatatgacttcagaacaaatgactagggaccctcgggtgtaataaattgtaccaggaccaattagaattattttttttaaaactttagattcttgagcaacagcttcagcaaatgaaagcaacttatcagctaaaccaagagaagctggagtataacttccaggtgctgaagaagagagatgaagaaagcacagtgattaagtcccagcagaagaggaagatcaaccggtaagctcgcatgcagagtgtctttcttctgggcctttctctactgaaaagagggatgggtatgtactcttttgtaggagtagaaattgttagaagtgtaactaattcttagggcttcccaggtggtgctagtggtaaagaacctgcctgtcaaagcaggagataagagacacgggttcggatcctggggtctgaaagatcccctggaagagggcatggcaacctactccagtattcttgcgtggagtagccccgtggacagaggagcctggtaggctacagtccatggggtcacaagagtcaggtatgacagaagcgacttagcatgcacgcataactaattcttattaaaagaggtgttttttttttttttcttttgaaaacaggatacattcaaccagttctgtcctccggaccccacaggcagtttacagcaaaaagaaaagaatttacagcaaaaagtctgtctcccatatgtcttttgtctgggtcctctgtcccacctctggattcgtttcttttcctttttccaaaatttccttatgcacatacaagcaaacacaaagtctcatgcccgtctgcttttacacaaccaatagcatcctgtacacattgttctgtatcttcacgatgtttccatgccagttcatagagaatgttcacgttatttcttacggtgtcttgtataacactgcatagatatgctaggatttactcaaccaggcccacactgctgtgcattttgttgacttctaaacccttgctgttgcaaataatgccaacataagtattcagttcagttcagttcagttcagtcactcagtcgtgtccgactctttacaaccccatgaattgcagcacaccaggcctaccctgtccatcaccaactcccagagttcactcagactcatgtcca

SEQ ID NO: 44090 - DNA, 1134 bp, Bovine  19866881668211
caggtagcacctgggctgaactcactttcaggagtgaaatgaacatttactgacagcctgctctgtgcaatgttcttaatatttattctcttatttggtcctcaaaatgactctataattgaaagcaaggactcagatatctgtatacccatgttcgtagcagtatttttcataatagccaaaatgcggaagcgaccacgtgtcgatcgacagatgaatggataaacaaaatgtggtatgtacataaagtggaagtgaatgttatccagcctcaaaaaagaaggaaatcatgacacatgctacaacatggttcaatcttgaggacattatgctctctgaaataagccattcacaaatggacaaaaactgtatgatctcacttttataaagttggagtaatcaacttcatagagatagaaagtaaaatggtgttttccaggggctgggaggagtggggagaatggaaattagtatttacttaggacagagtttcagttgggaacaatggaaaagttctagagatggattattgtggtgacaacattgtgaatgtacttaatgtcactgaaatgtacacttaaaatggttaaaatgagaaatctcatgttatatgtatcttgtgtgtgcgcttagccaagaccgactctttgtggcctcatgaactgtgacctgccaggctcctctgtccatggaattctccaggcaggaatattctgacccagggatccaacaaagtcttctgcatctcctgcactgcaagcagattcttcatcactagtgccaccagggaagccccatatatatatatatcttatcacaataaaaatttaaaaaaatatatgattctgtagggtagagcttactcttctcattttatagataagaaaaatggggctcagaggaaatcacgcagccagacggaatgagtgtccatctgtctctggagtcccatgtctctttcacacgataccgccccttccagggctcaggatagccctggcataactgcggggctcccgggctccaagattcctctgtcaaaggatggaggaaagcccaagtgaaattggatctaactgcagtttagaaacagaggggtaggtggggcttgggcttgaattacaaggacgaaag

SEQ ID NO: 44091 - DNA, 673 bp, Bovine  19866881814919
ggagagcttgttgcatcttctacagaaaccccttcaaggtgaatatcagatattccctcgctcttccccaccccaacagcatccatatgtttccagcctcactccccctccgcccctctgccctcccaccctgagccagtctcccacagcatcatttctcctaggagcagctcaccccaaccctctgcccagaccacctcagggccaatctctgcctgcccagaagacattaagggccagtttgaaaattatctttttcctcagcacaatcaaattattagtcttaactccttcctccgctagtctctgcaggcaggtaaagattcaccatccctttgatatgaattatgccacccccttggaaggcagaagtgctggaataatttcgttggttgtttaaatcacagcttttgccttcctgctgctcaagtttaagtatagcccagagatgttttcattggctccacctgcctagtttgaaatatcttccccgctctggctccacccctccctcgtcaacacctcccgagccctatcctatgaccctgatacacgtgctttctcaaaacagctcaggcctgtttccttatttcccagtccttgctgtttccaagttggagaaccagccatgggcaccacaggaaggccctattctcactcctccttagaagtc

SEQ ID NO: 44092 - DNA, 1360 bp, Bovine  19866881984374
tagatagatagatatcctttctcttaaagcattccaagaacacctacacttagtgtttcactgaatgctgtttggaaaatgctaatatagaacagtcctcttattagagaccagcaaagttaaattagtgaagagatgaggtaggtctccagccctggctttcctactcagatcatttctgcctccttgtctatttctggctaggcctgaaggggccgatgaagggcaaggagaaggtaagggctgcaaaggaggagaagaagaaaagaacccagagcctaggccctggccaggggtcggaggcccccgagaagaggaaacccaagattgatgagctcaaggtgagggtctgggagcagaccccaccagggtgtggggacgtcatgcctaagtcaagacagaggcctgtaggcctgcctcacctccctgatggcctggcttggctcaggtgtaccccaaggagctggagtcagagttcgacaacttcgaggactggctgcacacgttcaacctgcttcgggggaagacgggggacgacgaggatggcgggaccgaggaggagcgcattgtgggccggttcaaggtcaggcggcaagtgtgagtggggcccagcccctaagacccaggccctgagtcctgagcccccccaccagctctcctccccaccccaagcctggggctgacagccaaggggaactgtcagctgccccagtgggaaaactatcagaatacttgcacactgagtgataagggggatctgccctgaatccactcccccacttcaacccccacataattgcccccactccggccacttcctcaaaaacccctgactctctgtgacccagcaactaaaagattaaggccccaaacccccgcagcagggtgcagaccctcagtgctctgggctattttaaatgccacccctgcctgtgcccacgggagcctgcaccctgatccacacttgctgcaccccagggctccctctgcgtgtacaaagtgccactcccagaggacgtgtcccgggaagccggctacgaccccacctatggcatgttccagggcatccccagcaatgaccccatcaacgtgctggtccgggtctacgtggtccgggtgagagccccctcgcagcctctctccccaggttcccagttctcctgcccaagaggggctgaagcaacctcaaactgatagcccccaactgggagacaccagggagggcagctggccttttgccatcctttatacaagcggaagccaaggcccagagttggtcagggactcacccggggtcacacagcaactctctggtccagtgctcctgcccttcattatcatgggaccatcatggggtggg

SEQ ID NO: 44093 - DNA, 1970 bp, Bovine  19866880488750
acaaagaatgtcgctgccagatcagaaaagacttcccaggtggctcggtggtaaagaacccacctgccaatgcaggagacacaagagacctgggttggattcctgggtcggaagatcccctggaggagggcatggcaacccactccagtattcttgcctgggaagtggacagaggagcctggcgggctacagtccatggggtcacaaagagtcggacacgactgagcatatgagctttatgagtaagcgaaggacgttgcagccatcaacccttggccccagcagctgccctgagtgtgccctggagaggagtcaggacggagaaaagcaggaccctggccccaggtagctgaggggcacatcagaaggagcaatttcagtgagcccagactcgtgcaccttcccgtacacaggaaagcactaaattcactgccttgagatgtctgggttttctttaattaacagggatcttttgatgttctgaccacctgggctttgctgcaaacccccgtctctcctggctccccacccccgacctctaccaagcggtccctccaagggcgctgggaggctgcctccaggcatgcatcctcagcacgtctgccgagtgaaacgtgattctcaaattgtaggttgtgcactgttttccagtcgacaacacccacactcggtgtgggagtcgcttctgtcagccctgacggagagtcgcccgaggctttctctgggatccatctctctgtggttctggagtgcgggcgagaagtgctaaccctgtgtcctgatcgtcctgtcctgctccgggaatttgcaaatgaacgtctccctgtctctccgggccgacggctggtgacaacacagacaaggagtgtgaacgcgtcggggacaactgtgctgctgctggtgtttggctgatgggataagttataatttcacactcgaaaatatcagcatccatccaaaatgagtgcattacaagcaattagtgtagattatggatttgaaatgaagaaggaaatatattaatctgtctaattactatgttaattaggcatcggtgccataatatttcatacctaaatgctaatgttgatgatgctttaattattatatttttttggagtgcaaaaatgaaccaaaccctgctcttctgctccatagcaaagaacagacactggcctggcccttgggggtccaggcgtcccactgcccaccgcttgcttgccagggcccgtgccatccagactgcgtctgtgcagatggacattgtcagttgaaacccaggggacaaggcagcggttgcagtcacatcagagcacgcgccgcctgtgaggggctgaagctgcagaaaggctggctgcgcacttcaggatttcagtgagtttgctgcgctgacacgccttgtaatgcctcgagcgtcaggtccaagccttgatgaccctgggacgtgtgtcgtgcactgggatgggccagcagggtccttggaggacggcccgggggctcgcgttgcccagggtggggtgatcaggtggagtgctccaggtggcccagaacattcctgattttaaaaccgacagtcctgtgtgccaggaacactttcaatcctgggaaaatggagatggttttcttgggactcttctggttttaagactgcaggcccctcagcctcgggcagacccatgcggcagcctgcaccccctggggctccagtgcgaccctgccgtggcctgtgggatggacgctcaagcgagggccgcttgatggacggggggacagagggcggctgtgtcacaacagcaaggacgcccagaggttaaaacagcgccttctgtggcgcttctgttccgagcacgtgcggctgctcagatcacctggtctgaatgcggcttcgggccttggacggcacctccagggcgagctgaactccagaccgcagacggcagggtgtgggcttcagctgaccgatgcgctgg

SEQ ID NO: 44094 - DNA, 1616 bp, Bovine  19866880594936
ctggaaaatcctcccgctatttcttgggggcttagaattaataaagccaggcggtataaaatatgtgctttgggtttttgaatgatcacttctgcaccaggtcatataatacggctttaactccatgtggcctgtctattaagcaagacaggatgagcctcacaaataataaaaaatatttatgcttttcttagtgatactaacaaggtaacatatcagaggagaaatggcaggagaagaataaggtaactgtgtcttatgaattcacggctcagtgggatcccggccagcccccataaacaccctaggattctctgctccgtactgctgttattccacaaattgtattttttttgctttttgtttgtgaaatctgaagtgtcataaatgcctccgtctcatctatatttgatagttaatattagtctcaaccaggaaagtgcactttacatgtgacaacatacgattacctgagagtgttattgcaaaggaaaaaatcaataccgatttataattcacgatcgcagtctatcagtttttatggctctctatccagtctcattaattttttattatgattgactgaaactgaaagatttttaacatgtttcgctgttatttattcaaccttaataattaaataaaccttaattggctgtatttcgaggcatcttggcgctgcggccaggaagggttggggtgaccatccatttttaatgcgggtgcacctcacgttttcttctgaggcgactcagggaagggggtctgctgtgtaccatcaccagagcgagagaaataggttttgtcatcacctaatcaaattctgtttaagaggagaccatttgttttaattcaaaatataaattatcgatagcgccgagagaaacgtaataaaatattcctggagcaacgtgagcccacgccgtgtacctgcacggaactttgatcagcggctaatatcttgattaatgaggccaagggccccgttgcaccgagagctgctggtagggacgccctcgcccggggtctcccgattggtggttaacaggtccctttgaaaggtgattgacagatggaaaattgcactttcaaatttcatccgtattcatttcagttgttcttctacatgtcaaccgcttcccgtctctggcaggccacggctgtatacattagctgttcccacagtgagaaaagagggaagacaatcccgtacttgagcattctgaaggaaaatcaatcatgtcataagtgagaagtatggataagtttgaactgtggcaactttcatcatttcatttctggccacgctggtgggtttctgagtgtccaggctgcgtgaggcaaccccagctgcaggggaagaataggcaggataatagagctgggctgaaagggaaatgttcttttccctggtatttgtcaaggaaggttcttgtggttttgcacagaagaaacatcaaaccctaagactatatacactggacgttttgacagaactgaaaaaaggcttctatggactatgacagggatagaccgacccttctcaatcaaacgactgggcttcagccttgcgtttttttttttccaatttttgtttgcactggactcttgactgt

SEQ ID NO: 44095 - DNA, 1212 bp, Bovine  19866880595977
ctcctgcttggcaggtgggttctttaccctagtgccacctgggacgccccatatatatctatctatacagggacactgtgcacatgggcaagaccacccgaggacaaggagaaggagtctgtctacgctccagggagagtggtctcagcaggaaccagctccaagcacctggacctcaggcctccagcctccagaccatgaggactagatccccgttgtttgagccaccccatcttggtcctctgacagcccgaacggactgacacaggggccagtgtaacctctgtcctttgtaaggtcactgggttcctaagtttatctgagccaacgccttgaaatccctgtctccaaccatcctctgcaggaaggaaaaaaccacagacttcgcctctcatctcaggatagtgaatcaggctctgtggaatgtcacgatccctcgtgtctggggagggtgaagcctccgacttgcagcctcctctgggactctgcacaagcgctgggccagcctgtccccagggcactgcccagtcttcctctctgctgcaaggtgccctccctgcagatgggatgccagaacccaggacagcaccatctgtcccagcagcccgatcgcgcatccctggctacagtccgggtcatccaatgagtcacaccatccctgacgagccagcagggccctcgtccagtaatcggtgctgctttaggcacgatggtttcctcataaattcagctgatggccttcccattattgcttttcagagagaagatttagagcagcagaaaatactatgaaaaaggatattaggcttagattgaccataacacaatgatcatgagatccaagctccccagtctacgctgtaccattaactacacatcttccccacatgccacccggcgggctgcaaagcaagtgttggctggagatttcaatcttagtgagcaatttaaactcagtgttttgcataaatagattacacaaaatctgtttattgtgatttccacatatatgggatggggaaatgtcatagaggatttctccttctctaggaggctcgaacaacagagaagtaaattccactcatctaagtcagtgcaggtgggacacatcgagaggaaggtgacaaaatggaatttcacatcgtgaaggctaggactctggagagtcccttggacagcaaagagatcaatccagtcaatcctaaaggaaat

SEQ ID NO: 44096 - DNA, 1653 bp, Bovine  19866880706907
agcttgtgggccccatcccacggtcgacgcgggtgcgctgagggccgttcagacttaggcttgcggcacattttccccaccatgaatggtgaccccctagtggtccagggggctcaggctcagtgcttccgatgaaggcgcccaggctcagtccccggtcagggagctggatctcacacgccactctcacgtgccccaacgaagaccctgcatagccaaatcaatcagtgtttttcaaatgaatgaactgactctgactctgccccttcaaggaggacaactcacagtatttgttaccaataataaaaatctggatttgaacaaaaattagaatttttggaaacttgcatctgccactgtgagctttacagttcctggatacttgggcttttctgacaagattagtgatgtaaacagatgttaacttttgcaacattttgtaaagaaacgtgtcagtatttggaagacacgtgtaactcggtgagccaacttccaaatgaccagtgcacagtgtcacaaacccgccgtgagcccgggcgccttgcacaggacgggatggacgggctgggttcagtgagaggctcgctgcgggactcaggcctgcctgcagctgagcgtgaagagttccctgctgtctggtttggatgtgtgttcagaggagagtatctgcagttttctgaaaaggctgttcaaatcttcctcccttagcaactgtgaggccagttcctcacccaagcagacaaagctcagtgtttgaagaaagcagggaagtcgggctgtcttcctgagcgcaggcatctccctgagcgcaggcatctccctgagtgcaggcatctccctgagcgcaggcgttgggagatcggcatgaatgcaaaacagtgccacccgtctgtctcttcttatttttgctttaggaaatgcagattttttaaattatgtatttgtgaacataggcttatatataatgggggtcttgctattttgagacaaactaataagtaattttaaatttctgttgcaattcctagtttgctaaccatcagcgaatgtaacccacgtatctgttgttgaagcctcagtaacttttccacctgtaaaggtgaagagagcacgcattctgcaaagggccccagggcagggatggggctatgggtcagccttgctaaagaatttcattcagagggtgtgtccaaagaaatgactgtgtgagggcagacgagggagcttatttctcagttagcatgcaacaccaggagctcatcctgttcccgcgtctgcattttgtgctgttgacttccccaagccacatccgagaggagggatgaagccaagctattactaagctgcgttatgttgataagtcagagatggatagtttacaagccagcttttatccttttgtgctaagactgaaacaccgccactaaaaaagaaagattgaggggggaaaaaacactcgaattgcagatggatggagcttgcagcatcctttccatcctgatgttccctgagttggtgaggggagctggcagctgtgagccagtgattcaggttttttttcttttcactttgtgttttataagtgatgtttaaccaggcccccttaaaatgtgttattgttagaaaacaaaccaagaaacagggaacagtaat

SEQ ID NO: 44097 - DNA, 1416 bp, Bovine  19866880748722
tgatttttttgatatttagttgaccattatcatctgcataattgagcatcagccttagaattaaactcacatgttctttctcccaactccctgcgtattagaattcttttggttggttttagaaacattctagaattttaaaacattttgcatctaatataacgctgaaaacatgaaatctacataatgtatgcagcgtaactaatattagaagcatgttcaaggagcagcctgtggggttaatagagtttaatttgcaagacaaatgaaggcttatttcctcctaggcactctgctcttcattctggtagggccacttttgaagaatagtccattaatagatgatgagaacccttgttggacaggagcagtatcagccagcagtggaatcagagcctttccactcagagggtgtttgccagaatacagagcccttgattaaaatgcagcgcttaaatagttctgtgcgggcttcctcacacagccacagatgggcaggggggaggacgcacaaatgctttatctctgtgataaaccaagattacagaaataaaaatagataatccagatgcccccacagacagtgggaagtttttaagtaaaccaagacttaatccacttaatgtggaaatattctgcattaaaaaaaaaaaatgttttcaagaatctttataacaaaggaagatccttataataaacatcctacctgaatttatccaaagaaaattaaaatgattaaaagactgaaaggaacatgttcagtcaacagtggttatctctggttgatgggattgcaagtaatttataactgcctgtgagctcagcagagtcagcggagctggcttgagagtttttcagcaggagacaccctggcatttgagacaccctagtctttgtgctgaccgttgcctcgctaaatgccagtggtgttccctagttgctgtgaagccagcggtgccttcacatttcctgaacatccatagatgagcactagccctgagatccctaggtcagcggctcccacattggcaggagagcatccgaaagcgtgttgccatgctgattatggcctacagttgcggtcagatctagcagaaggctgagagacgcctctagctccatctttattgatgacttatggacagaaaagaggatttgtagccagatagaaatgtgttcgaaaaccaggtggccctgtcttgttttctcccagcccttctgcacctgaggctgacttgggaccacccagggtcaggcgtcccctactccagggcaggcgtgtgccatggaggagccagccctggctggtcagagatctcctagaggacaggggatttgattcaaggaggaaaactggagtgagcagtttgggggaagtcagatgtttaaaacatgaaaagaagcagcactcttgag

SEQ ID NO: 44098 - DNA, 842 bp, Bovine  19866880756450
gaagcattataaggacacctttttccatttccctgtccagtgcgggccgcagccctgggggcgggggccggggctgggaggccgctgggtctgggggcctccttgcctttcctcccctccagacccctgcccctgtcctgtccctccacctccaggcctgcgggagtccctctaccctacgtcggggtgatcgtccccagctgggagccactgtctctcttgctcgttgatgaccagagcagttgaaaccgaaagggcaggcggttgcagccctgatggatcagaggcccagagggtggacgtgggcttggagccgggcgctaggtccctggttggagtcacgccaaggacacgggttgggagagctcggccccttggtgaggaggggagcccttggaaccatctgccctccacctcatcttttctcctttcaagggggtttcaagttggaaccatggctggtgtcttgaaggattcatctgggccttcctggggggtttaggaatgacagaccaggagagaatttcggaaccagacggttctcgtaaaacaaaataatggattccttccaagtatgcgatattgatttacatcacctaagaagtcatcctaacactctgcgaaggatatgttttcagttctaaaatcttctaatgcatatgtcaattttaacggatttttccctgttaggtctaaatctttcctttggatcatgccacgcagctgtcgtgagcactgataatgtgacaaatggggttaggatacgcatttccattttccaaatgagcctttcttgtgaggctgcggctggcctgcctccttccaggcaaatgagcccaaag

SEQ ID NO: 44099 - DNA, 1885 bp, Bovine  19866880803017
tgatgctttcatggccttgtagatcagttcagagggtagatggtgtctttcacttttttttttttttttttactgtcttttacctgtcaggagctcaaggtacctataattctttaaattctacacataaggagacgaagccacactatgtaaaggactctctgttgctttgcatggttccatttccacactgggctcaacggaacctcatggacagtgggccagatttccatctgccccgtccagccccacccatgaatttttattgcaaggagctgcactttgtcttcgtaacatggaagaacaatacatgttgtttcataaaggggccttcttgtttcccccctgcaaaggaaagcttccattggctgggggagagaaggggcagcctttggatgagggaaggcccaccacgggccagtccccagctctgagccctggggagaaagccctcggggcggggcatgggggggcgctgcaggcaccaagcagggcagcaatggggacagttcaagaggagcaacaaggggcgggaggcgaggaggagccaaagagaacgggaagggagagaggaacgagcagagggaggagaggagggctgcaccaggcggctggactgcaggacaggctgacagccccacccgcgcctgctcagcaccgccaacgaggcctaggcctgggcagcccacgtgcctccggcccgttctgaatgcagatggtgacagacaccgcaatgcagacaaagggtcaagccttccccttccgctggacgcactgtgcacagagcagaggggaaagttctcaactactgggcatttaaaccactgaaacagtccgtttccacaagcacaaggatgattcctcctcataacgatcaaaccgaggccctgtgagaaccagaaggggcctgtgaatcagagagcccatcatgttcagggtaattttcaggtcaagtatatttaattgtattgcagcgctccaaaaatcagcaacccatgaatggcagaactagtctcatcaagcagcacggcccaccgtctgaccttgccagcgagcaggagggcagagacctgaccacaatgagttccgtacagtcacacagcatccaattcttgtcattttttaagaatttaatttccacaataaagctatgattaaaaaaaaatagtttcttacaacagcgaagagttcttgtaaacacatgagatgaaattctcgagtatgtctgtggaggcaggggcggtgcatggaccccgagggcccagcactggccgggggagagagccaggacctccagggaaccacagagcctggcctctggaccccaaggggctctgcctccaaccccaggaccagggaaggcaatggcgagcagtgggagcccagcccaacgtcctgaccacgctagacaaaaaccaccttacaccaggcatccatccccgtgcccgggacccacacactagagtggacactccagtaccctgacctatcaagcacagtcttgaccgagtgtatttgtgttttcatgcctccccaaatagcgcaagactggcattaactgcagtctcaccacatgacccagaagaggctgcacagctccctcagggtcacacagcagaagagcagcagaggcagaactgccgtggcctgtctcctgagactccacattcgccggaccctagccggagtctctgccaccaggaaaggcccacctaacagacctattcccacccatgacaggaaaaccaagctcccactactgctgtcagaacagacacccaacagccctgctgcccgacccacgaagcaactgccttcaggatgggggattttacgtctgtcacaaaaacgcccgtcacatttaatgcagttacttctcaattcc

SEQ ID NO: 44100 - DNA, 1533 bp, Bovine  19866880843334
tgtgtgcacacgtgtgcggcctggcgtggggctgctcgaggtacctgcttctgtggccccagctgtgggggacagcaatgcttccccccaccagagtcctggcgggcctggcttagctgctggcctagcagtgaacacacctctacccagggcttccgaggctgggacgtctctgcagcctgtacctgctcccttcgtatccagaaaagcgagcatgtgatttcaatttgaaattaaaagtcatgtctgaataacagagcttcatcctcatttcctaataccctggtttttactactttgcattcaactgtgaaaagtcttttaaaactcggaacagcagtaaaacttgaatgaatttttgacccattattgcatagcgggtgtgccttccaagttggagagactgccaagttctccccacctaatatttccactttaattgtgccacttgagaaatttacgtgcctcaaaatatggcatgaatcttacgcttattgcagtatcattagcagcaacatttaagcaacatctgtgtgctatagaactaattgaagtagcagaagtggcagctgtaaatccacaggaagatggcagtttgtacccagcactgctgagttagctactaactgtcagcctgttcctgcaatctggtctcgagcaccacggtacaggcacacagtgtccaaaaaaatacagcgagtaggctaatgatcccattaaccactttgttgcaccaatttggctgtttttccagtttccttgttgaatttcattataaatttctccattcttgtaaaaagtccagtgtgagacgtgtctgactttaaactacttacctgagccgagaaacactcgtctggccagaccaaactgagaattgattttttgtgacttaataatttggttcccccctcactccttgcagttgcttaaaaaatttttttattccacatgtctctgtaaaaaatgactttaaaatccatagtaatgctgatatttaaagcaatggcattttcttcccgcgaatacaacattttcaataatcgatacacaagaaggcagccataattcactgcgggcgggggtggggcaggcgcagcgggtaaggggggtgccaaggtgtgagcgcgcctcggatgactcgccagctcctcatgtcacggctgaggagtgggcggccaggttctctgggttcagacccaaaggcatcgcttgctttccttccccggatatggagaaaaatgatgccgatccttccacacagggcgtgagttaagctgggagtgagggatgtactgagatgcctctttgtgaagaagtgagggcatccgagccactgcttttattcgaaacgctccttccactgagcacggctggaaaagctatttctcacgcctcctacaaaaaccagccccatcctgctcttaactccggtcctgcttgttttcgtcttggcagtgagtggatgttttctccctcggcacctggcccttagacaatgatgtaactggtatctttcgaagcactcaggag

SEQ ID NO: 44101 - DNA, 2020 bp, Bovine  19866880895078
gtgcctgtgtgacctgagctcccaggaacagccgctgaggcatccgtgtccctcggaggaggggacgtgcattcgctggcaggccctgagcggccacgggccacgtgggtgccaggttgggccaggcacttgggggtggaggcatctgtaggcggtgggaccaccccggggtctgccccagacggacagggaccctcccccccgagtcagcccctctggcctcctggccatgcccccacgggtctccagatacccagttcttgacccgtgggctctgggtgcagagacccgcaggctgtggtcggcatgctgactcagaagagacgtgacggcaggaaggcctggttcctcttaagtgctccgggggctaccggggacccgcggcccctgtggcaggagggctgccgagccgggcgtcatggttggagggagggcatgcaggcaccgtggcatgggcagatggtgtcctggggctgaggcccagccgctcgggtgccatggcggggtgggtgaagctggggcggctctccatagccagctgcccccagcggggcagaaaatcttccttggccagagggcccctgccctcagggaagcaggcatcccgagtccattccagggacacccgtgtcccagtgcccatcgtccacttctgcggcctatgctgcgtccacaccatggtgagggggcttctcagaccccacgttcggggtcctggtggtccaaagctctggggtttcctccacaaagggttctcccatgaatggatgcttcaatgaagccattcagccagccgggccccctcctgcggggggctcatctacgcctcccgagcatcatcaatgggaatatacatttcaaatgtgcgtcagggctagggggccccgagctctccgggagcggagggaaggtggggtcataacctgtctgacctggaagcttctgtctgatttgtgctgccctggaattgatggggacagaggcgcaatcacagggactcgctcctctctgcaggctgcgccagccctcctggaggccggacaccctgcgggcagccccatcccctgggcgtctggctcccgtcatcggcaggctcgcagggacgcatctctctgagccctcctgggtgaggtggccaggccgccagaggccaaggtctaaacgagctgtttacagcagctgagaaaccccaggttcttctgaaccagacccgatgcgtccccccagagtgggtgtgcggtggggcgggccgagcccacccagccaggcccctttgccggctgctttcagccttggtaaaggcagaattaccttgggaggcggtggcggtgcagtgggttagcacggtgaattaaaagaatgagtcacagtgacatgtccggctcctccgcaccagtcctttgtattcccagcgcgcctcacccctgttgcaagaaggtcaaaaattagagagagagaacaattttcaagcggctagcacttaggagcagaattaacaatcactctgtatgtaattgccagttaatagtaaattgccttccagactgtaaaatgcaatataaacgggtgggcacctaaaattaaattaatgagatatttgctgcatttaaaagtgaacagtgcaaattaataactgagtgcaatgcttgttttaatatttgtctaatagtgtatcgtttgctcgtttaataataattaaaacagtcccggaatatcttacctgaggaactccatgggcagagtgaacagtctcacatttataatttcaaccagtagaaagacatcgagttgttcagagcaataaaagaaattattttttaattagaatgtaagcattgcggtgttattcgattaagacaaattggaatttgtatgcttctaattgaaattatgttcgagggaaaactgcttttacagacagcgttttgcgagcgtggtgaggtgcttttgcacaatcacaaatgtcccttttcccagcgtgtctgtggccagagggctccatgtgacatcgaagggcagg

SEQ ID NO: 44102 - DNA, 892 bp, Bovine  19866880951943
ctgtgtaattgcctgcagcccgggtaattaattgttagttgtgggtgcatcgtcgtgagcaggagaggcccctgtgttgggaaggtccctgaattggattttcatccgctcagcaccatcactgttaattactagagccagagtgaggcctttttggaaatgaaaacacattaccctgactcccagcccttctggatccatgaagctctcttttggccgccttgcagatccatgcagataacggcctcgatgccttctttagacttatgtatagctacgatcgtgcccttagaggctgcttctatcctgacagacggggtgggctgcacgtggagatggctgtttcttgatggtgcttggttggagcccttgcaagagaaaagagtatcaagcctgggagcctggtcatcactacattattaagtacgaggctggaaggtattagcattggcagagtgccccgtcaccagggtctgtttgagattcagtttgtctctgctcagccctcgccggccttcttttgggaatccttgagcacctttttctcacggcacatactcacacctggtttctggctagtgtggatttgcctggaactgcacctgtgtgcacacaatcaaggctccccaagtatttccacactctgattcctgacgtccatggctacgcacctcacgtgctgaaagggactcttcagatgggactgaatcaaatatcttgatacaaggagtttcagaaacattgtcaagtaattaaaggtaaactttaggtcatgtatggatgtgaattcagttcagttcagtcgctcagttgtgtctgactctttgcgaccccatgaactgcagcatgccaggcctccctgtccatcaccaattccggagtccacccaaac

SEQ ID NO: 44103 - DNA, 973 bp, Bovine  19866880953702
cggcattgttcgcttagaatccacggcacagcgccgatgggagctgcgtgaagaccttcattccagaaacgtttttcttctggggaattttcattcgaagcagaggcttcaaaaaaaatgaatgcagacaagcaagtgtgatgaggcagctccagcgtgcccagccatacccacacgatggaggtgaagtcacgactcagaaagctatgtccaagagaggcggggatcacagatgcaaacactggtgtgtctcgtttgcgaggcgaccgtcccctaaacatatcagatgcactcccctattcccaggcagactgataaagtagtttgatacaaatcagttgtagattagattctgcaaagcacgttttcctaggaaatccaattgcacctgctttggtttctggggcggcatccgttatccggtgatggtacaggaattgcgctgcagctctttgagtgggaagggcgagatccttcatccgaccggggtgggatgagactgctcgagggggttccgcagggaaggggctccagtgggcacccttgggtcccaggctggctgggcaaccttgccaggcccctcggctggtgcctcccccaccaagacccacccaaggggcccagcctgcaggccatacatccgaaggcaggcgttcggtggagctccccgcaatttattttaattacgtgtgtcataaaaagaccacctacagatgagacaatgctgccgtaagagtctcaaggttactgcagggaatacttcataactgaagtgtgttttccccaaggacttatactaccatttgatttaatttttaatttttacattttaatcaaaaatagatcaaatggtggtggtctctccggggaaacatacttcagataggaagccggccatgctccttttaaatatgtaaagctgccatcctcctataagtcacggcgggcgcccggctgccagccgcccctgcca

SEQ ID NO: 44104 - DNA, 1246 bp, Bovine  19866880989471
actcgctcctcaaacttcacacctcgttactgtgttgataaattagaagacatagaaatgttggtcactcatttgtgtcccactctttgcaaccccatggactgtgggcttccaggctcctttgtccatgggattttccaggcaagaatcctggagtgggttgccattcccttctccagggcatattcctgacccagggattgatccctggtctcctgcattgtaggcaaattgtttgctgtctgagctaccagggaagccccactgataaatcgttttaaaatacagtgaaatctaagctaaccaaaatgatgttgaaaaagagtgttcagcatggcagttattcgtctctgtggaggcccagcacatgctctttcctcaggacgtctcgccaggaaggacagatggtcttcacagtggagagtgagcatgtgtgagccaccaagacttcgtctgtggttctgctgcaccctggagggggacatgctctgagaatcttagggttgccgtggaggggattcttgtttgtcagaacaccttcctgtcttagtaactaacctgtaacaaaaacaagactgaatctgctttggatgtgacgccacgcttagagcagtattgttccctcagatggccaaggctctgggtgatgtccagggacagccagcctgagacttagtgtcccaggctgtgaccgtgatcagctcttgccctccacagctctgtctcaccagtggaccgcacaggacaggggaaggactgcccagtgtgtgtgtggtggggggaggggtcgttataatgaggcccgagcaggcgctgcttcacagcttgcctggggccttcgtgcgccaaggatagtaaagtaaactccgggacacacgagtccctgctgtggacctaggagtccccctaagcctccacttgactttcctctcctgtagatggttagggtgaatgagcgcgaaggttccacacactgatggatacctttctttattttgcccttagttgagctgcggtggggagggggacgtccagtgctggatgtcaggaggttcacgtcccagggtatcctgctgcatccgagctctccagctacagaggaaccttctttacaaattgctgtattgtcataggtggcattctggttaaaagttcatctggatttcaacctcgcgtgaaattgcagagctgccactggaaagctcagccttagttgagaacctttagggagctctctgacattgca

SEQ ID NO: 44105 - DNA, 1221 bp, Bovine  19866880996664
aaaagcaaatgtcattcggaagcctcagaaatgaaaatttgtatgaacttattagcatgaagtcaacagcgctagttaagggcaggctccccgtgtgtgctctgtgcgtctgctgctgagggagcctcgcggggatgagcaaatagagcccccgctagtccaacattagagcaaacaaagggaggtggtgtcggcccggctcaacaacaatacctgccgtgattaactcccgtgtctgccgctgcctctgacccggcagggagccacgctgggcttccgggaagtcctgcttatgaagacgtgcggccagggctgacccagagtctaaaacgacggtttatcaggagctgagctactcggggtggcggtgggtgggggcgtgctcacgtgggatggacagcctaaagaggcccgggcgtccttgggaggctcgtccccgcaggcggcgggtgggggccgcacggtcaatccgccgcatgtgtacgaagctttagttactgtcttttggacgaatctccaccgaggtggttgcaagtggtggaagatcaccgaacggggagggccctcaggccaggggtcgagctcctccacgtcctgctcccctcagcacccgccccaccggatggaggaggatgcgggtgacacgggggcgcccagggcccactgggggctcctcctctccacggaggaccaaggcccgcgctgcctcttgtctgggctgtaattgtgtccagaccgcatcagccgggagatgcggcagagcctaggggccacacggccgcccatcacgcaggcctcttctttgtaccaaagatacaggcacagagaggcccagagtcccacccgtggcgcccagcccggcagaggcggcctgccggtcagagggccgcagcccccgtctccccagcagtcagctccctccgcgctgggtctctgcccacgacaggccctctcgggtggcggagacggtctgcagccccgtgcaggaaaagagccgatcagaggccggaacaaagctgcctcctcgaggctgtggccttcagcctcgcctctgcaggctcgcggcagggctgctgggagcatgggcctcctggtctttcctctgtgcccgcccttgcggtctgtctacaccctccccccccagcaggccccgagcagcagcattgtaataactcatgcaaatgtgagcgctccggagacaaagggaggtcaggccagcgg

SEQ ID NO: 44106 - DNA, 3852 bp, Bovine  19866881005118
ttgcatgaaatacagcccccagttacgtgcccctgaactgcttgccatcatggacaccctgcagggatagacaagggcccagcagtcttccagatgtgtggttccaggaaccagaacatcccagggcctatgtggacttgacatcatgcattcctgatggactcagctggaaaactctaactcaggtccaggataatcaggaccatctgctgtgatgtgttgtaacaggtgtcctgtttctgaactcagcatggcgacccacttagatgctaagttgggacgccctgttatggaattccagcacaagccccctcagctcctttccatccacagtcctcaactgattgaagtttgaaagctcttggcttgaagaggtgcgggctcaccaacgtgtgcaggctggggtgggtctaaagaaaagaaacaggcagcaaccccaggcttcttggcttcttttcattaagcaaagcaaattgcacttcagaatttgtttccgcgagtgattctgtaaagctacactgcctgtctcaaaatttgtaagttcagaagatgccatgaaatgtctctccattaaatactgtcgccaagagaagcatgaacaagataaattcatttctgctccaaaccgagctttgtgaggcataaatagagtatcagtgcatgccttctgtggagacagtccacgtggtcctgggaaggccaccctgggtactgctgaccccagttctaagggggagttaagttcacaccaggggttcatgaataggcgagatgcaaactgcacaaaacacaggttcgctctgcctgacgaggcttcgggagtgatagtaacaaatgagccacctcatgggaccttcactttcagacaagcacgttcccaggcacgctttcacctccagaggtgccgacccaacactcaggtgaggacatctgaccctggagaagggaggactcccaggccccccagctgggggacagcagtacccgccctatgtcctggtttccaagcccagctcttaccccatggctgacacagacaccagatcatggtcaccaggacgaagcaggaagcaatggccatttgaacccacgtgtatgtgcacaggggccccacactgccttggggggattacacagcccccacaagacttgttccagttaccccccacacttggtgaagttagaactcgagcatggtccccctgggatctcaccaagaggttaatccctacccaccccctccagaaggcttctcttgacgctcatccctggcggaggcaacgtgcctccaaaaatgccagggagactgcagaagctcacacggatgaggacagctcagagggtcagggggtgggggtctcctgcccctgccagttaccctcagtttatctggtctcagggcagtgggtcccccttaacgggtcccaaactcacaggctgtgtcacttacttgaagctcttgcacaggactggcccagaagagccagaaccagacttggcctgcgggtagcatctgccccaccagccaccccgaccttttctaccctcaaagcaagtttctcctcgaaaggtcctctctgcccactggccacatgtccattacactctgagatgctctaatgacactgagcctaaaagggggaaagagatgggctctgcactgccttcattccctttctctgggggtcttttgggctcagaggcaaactgctgacccccaggccctacatcctcaacaacctctgaggtctgggatggaacagggggtgggatgaatcaggggccaagccttgcagccacgactgcccatcattgcctgtgtgactgagtagccaccctgccgggttctgcaataaagtgactgcaaaagtatggggcaaggtcggccagaggaggtcaactccagcagctggttttctgatgcgtcagacgaagaggttgtttctagaagtgaaaacatcactgtgcacctacagataaccgcagtcaaccacttaccctctgcaaggggtgatcccattaagcctaattgccttgcacagatacgagagttccaagccgggaacaaatgaactgcaatttagctctggggtgttttcttaacttgtcttatctggagtgtttaaggaggtgaccccgcaggctccctggggagcaggcagaggtgccttgagaaagcctgggggagtatctagcgaacaacagcaggtgcacatatgaggtcaggagtgggggaggagagggggagatgcccatcttccatctagggaatggtagtacacaattttatcctaaatcctctccttttggtgtaccagtttccaagcaggaatggtgatggatttagctctcagggtccctgcagatatgatggtgggcagtgcagagacagctgtccctgggaggcaggaacagacagagcagagccccagagatttaaagggatgcatttagaagaaaaccaaaacaaacgttagtttgaaagagtaaagaaacagagaaagagtgaagaacgtccagcctatcacaatctaagacatgcaggacacagcagctaacactctagggtctgcccagcaccactgactgcatcaggctggctggaaattccacatgaagcaacttctggggcctttttctctctaccattcccttgttgttagggttccaggaacctcatcaggacctggcatggcagggtcattagtttcctgggctgctgttacaaagtaccgaaaactgtgtgacttacaacagaaatttattctctctacaggtctagaggccaggagtcctacgtcaaggtgtcagcagggctgagctccctccgaggctacaggggaagggtccttcctgcctcttccaactcccagtggctccttggcttgtgtgaagcatcacttcagtctctgcctcccacgtcctgaccccctgcctcccagctgcacccgggcatgaggcagaagcctctgcacacacagcaggtggcaccaccgatactgctctgaccccccgggggcccatccaacccgactgacgccacagctccaccactcccacgagctcaggggagagcaactgcaggcccttggaggtggcacgcatgtgtgtagaaagctcttcaaagtccccccccccccctttgaagtaggcgcctccaggcagggatggctcagaaggcagttatgttgccacgtgggctgcaactttatgtgactgaagccactgtgagtgaggagggaccagcctccagacatcggtcctgtcagcgacataagggagattcgatttgctctaataatgtggctaattactagcatttcaaatttaattaagaaagatgctcctggccttatttgtgttgagcttcatatctctgtgcatataacatctctggattaacaagaaaaggaactatttacatagaatctttaggacatccaaggagaatgtgctggatctctccagacactgtttagacaccaaaccagtccatctctgactacaaacactgctgcagtggagactgcttgggtgctcccaggggccacaggttcaaaggtgaacatggcccttccccgccttgggcaggagagggttactaggctccaagtgtgaaggataagcccccagtgaaggggaactaggcagggcttctggatgaggtggtatgaggctgggcttcagagtagggcagggggaccagatgggagagagcagggaagaagaaggattccgggtagagggaaaattctctgtaggagcttagaaactattggaagctattcatctggccccttaggttaccaaataaagagatggaggttgttggcaggaaaaatgtaaggagtt

SEQ ID NO: 44107 - DNA, 2190 bp, Bovine  19866881015846
tactaaaaacgccctgcagtaccctcccatacccttcccccagtgtaggtgaggccagcaagcacacgggtgtctcctcaacgtgtccgtgacccaaggatgttagctctcaggctacaataacgcttcttctgtggccgagcccacaggggacaggacaatggcacagaacttactcaggaaagcgtacaggagggtgaggcttgtcatcacgcctgacgggagcggtgcagggactcagccagactggaaggcagcttttgacctggaccagttagctagttattacataaacctgagtcaggccgctgactcagggcgaatctgggctgggtctcctcgagccatccactgtctaacaccagccaggctgcggactaaaaccatcagcaccgctctctcaccccaccacgaccaccagcattaccactactgagcccgcgtttgtgaccccaccacatctgaaccctgcagggcaagcacagtgccacctgccagagttggtgagtggcaagagctggagtcgagcccagcagcctgactctgatgctccgatctcactctgggtggatgagctagcggacacacccaggcccgtctcacgcgtaacagtacaatacagagctcccagtgagacgacctgtgaaacacggagcatagtttctatgcaagtaacggtggaacacgctgaaaacctagattccaggaatctagtctgaccaacagaatatgaagagtgctgggtggggctgctgcagctctggaagggagaaggcagtcctttgaaagagggcacagcaaggcacagctggtggcttcaggtaggaggtgggcggaagagctggcagaagcggcgggagagccagccagcccctcgtctcctccagacctgccgaaagcaaccaatggaaccacctcccaggaagctacggttacagaggacttttaaaaaaagacttggcttttttttttgacagcctgtaagaattgtcaccaatggcaaatttctcgaatttctcccaagcatctcaagttttatagctttttaaaaaactattatataatcaagttttggaccaagaccattttttttttaacttagaggagcacagtagatgttctttggtgtactcctcggaaatgtctgcttcttccctgcctctcaaatcccaggatgtgtgtcctgtgcagaggtcccggagtgagacctcctaacaagaataccaagagaaaggagccccaaagccccaggacatcgctattgtcctgatttgtaaaccctacttcatgccaggacagcaccaaaatagtacttcaaatagtagaaataacattataatcatagttcaaaaaagacacacgaagtgaaagcaagaaacccagaggacacacagtgcccagtctcacctcttgggctcaaaatctaaaattaaagcacgcttaaggtgatgtctatgtgtaacaacagccagggcttctcagcccattccggacttctatacttttaaatatagttggtttgcatttaaagcaggagtctgtgtctctaaattgtttattttgcttcagtatgccttaaagtgccacactgcttaatatcttggaaaagctactgtgtggaacagtagcattcttaagttaggagtgacaaatccgagaaaacctctacaatttggcttccatatctctgaattggtatttcaatgacagatgtttgttgcggcaaaaacctctgtcagaacaaaattaggtgatctatcattttaagatatggtcttcatatactgtttactcgaagatatcacttgcctcaagccaattttgaccaagaacattttgtgatatggaagtgatttgtatatcatcatttttgtgataaatgtagctcttgaacacaaaataacctaccattccacagtattacagttaaaactcctcctccagtaaatctgcactagtccttttattactaccaagacactgcatgtaggctccagcagatttttccccttgaataagatttctacttgtctgcctttgcactgggtgtagggatttctaacccactgtcaaggcaccctaaaccctaccctctccccagctcctgaagcttcttagggtcatggtgccttcctggaggactcctgcagttttacggcccttggtggcacttgccaagctgccgctgct

SEQ ID NO: 44108 - DNA, 2462 bp, Bovine  19866881028739
ggagagggcagggtctgagggccctgtcggtggcggcggtcactgaggcagccatttgaccaagctgtgcccgaggctccaggccaggcccctgcacagggcccacaaggagggtctcaccgctgccccagcaccggtttttctgggtctggagtcagactcctctccagtgctgggctcaccactccaggcttaggtccaatgcccaatccttcagggtcagttctcttaattaacacgtgcacacacacaagcacacacacacactcatgcaattttcctatagcaatccaaggcgccaggctgctgggtcagaagttcccccatcagccacacacacgcacggtgtctggacacgtggcatagctctcctcttaagcaggggtcacttgctcaatgcccagtgctgaggtcatttgccaaagttcattgctgcaaatcaatgccaccacgctaccgatagtcggagaaggagaagggtggacaggagctgagcagtacactacacctggactcacaagctctccccacacagacaccctccagggcttctgcgagacctcccacggcaccctcatcctgccccagggagactggaaagagctgtggtatctccaaggccccagataggcaatcacaaatctgaaacaggcagtgctggtggtaaagaacccgccaattcaggagacacaagagacgcgggtttgatccctgggtcaggaaaagcccctgcaagatgacatggccacccactccagtattcttgcctagagaatcccatggacagaggagtctggcggcttacagtccatggggtcacacggagttggacatgacagcagcagctgagcatggcacagccatcagcccacagcccagaagccaggctggccagccccagggtcacaccttgtttgccagcgccgtgcgctcagatctctgagccactaaaagctcagaaccaatcagggctaattgcaggtttctgtgccaccctcctggctcagctgttcagcaaaaattacatttcattacttttttcactaatcagcttcaagagcagagtgcaaaattaacttgaaataatttcatgctttcaagtaacctttattttctaaattgtggtgctttgccgtaactatttcatcctactgtataataacagtgttctttgcgtgagggtagagcacttatatagcagctgctatcttaatcaaatatcaatagctcatctttatttcagcattaagtcaatagcacatgccatttgttacttcataaacctcaataccgtaagtattatcagttaaataagtgttctctaaagtgtggtttaatgaattagaaccaatttaaaagagtctggattgaaatctgccaaatttaagacttctataaaacactgaactcttcaggtaaccaaatgttcagctatattttgaacacacaccctctcctaacaagtgctcacatactgtggtttcacttaaaatataagttagcgtatttatgctgaagactcaaccaatcgcaaaccgagctcctgtgtttctatttttcctctgtcctaataaattgttaacacacacttgcccaaccttgtcccccaaaagccaatactgaagcaaagaaatatgcttgttgtcgcttaaccatcatgaatgtaaataagacctgggggctccagtcaactgtagactcctgtcagaagacagaacagacatcagaaaggggccagagcaatcctgaacattagcagggtcctggtgcccaggaagcagagggcgacagccacaccctgtacccggaactcgcctggaaggacgtattcacatctgagcccctcgctggaaagaaaagaggcgacagaacgacctagatggaatcaggccccgagacacacggaggaaggttggccagaggatttgcacacgtgtcccaggggcagggccaggatgacccagtagaagcaatgggctaggagggctgtctacacccacagctgctcggacgtggaacgagccacttacaggacaactagctgagttctctcattcccaaggtgacggaaaactgcaaagagaggacctaacaggtgggctctttgtatttgccttaaaagtcagtatttcccagaaatctcttctgggcagaggtcaggggtctccttgagtggaggaggcagagcggggactccacgagagcccaagaggctgcaggtcacagtgtgcaggggaggagagggcggctcctgagagctccagagaccctcagtcagtggatgcctgcagaaaagcttcccacgtccaggaagagggccgccaggaaggccacaggggacactcacctgagctcacacggggcagagaatggggcctgtccccaccagcccgagcagaaaaccttaaacatccaggaagaggaccgccaggaaggtcgcaggggacactcaccagagctca

SEQ ID NO: 44109 - DNA, 1504 bp, Bovine  19866881061697
tcgagcagccccacgccagaccgcacacgtgtgcacacactgtgacacgggcatgcacgtgtgcgcgctaggcctgtgcctctgactcggggggcaaggaaggacaggggccccagcctcccaccaccaacgagggcccgcagagtttctctcccacttatggtcctttgtcttcccagcacaggctcctgccaaaccaccaaatctcctttcccaagaaaaacctctcctgtggagaagagctccctgacgggctgtcacgtccgcttctgactctctctcaccccacttaagggaggcggtgcttgttggggggcagggacgctgctctcagccggccatccacctcctgagcctccgatggggctcagtgaccccagtccatctcacttggtgatccgtacctattagcaccgttaggacttgaggccacgcgccggatggcggggacaaggctcctccgtgtctctgctggtctcctttccctgcacgtcctgttctggtggtggggaccgtctccagtggggcatccacacaatgttgtcttgtagacgtttgccaagtacttaccctccccttagatgatgcagctcatttggtgaaacctttgccaggcaggtccaggactgaatggtccagccctcaagagactgctccacgtcttctgtccgtctgtctctccccgctcctggtctcaccccccagccctgccaccaccacaggcccatctctctgagcctgtggcacctggattgcgaacagcaaatcttacagatgtcaggatggccttgttgtgaagcaaaaaggacaatgagttcctgctgacctcggcacagcggctcttgctggagcacagtatgtattttctcctggcggtgaagagcccgcaagtaattgacggagaacagaaatgtcacgggagcacttgtgttgacactgctctatgcgtggagggaagcccagcccagcagtgggggctgagcacgagcccgggaacttgtaatttagcgaggacaggatggagggatcagtctggtcggactccccaagtcctggtgagctgccccaggaccgcgggggccatggggagagccccgtgtgcacagacacacctggaagcggagcccggctgctgccccagtcggtttccagccctttactgcctccatgatgcttaatgtactgtttgtgtatgttgtccttgccgtatatttgatgtgctctcatatattttactcatctctggcttccacaaaggcatgctcccagcaaaaatgaggctcgttatttgccgccatcaatcaagtgtctgtgtggtcggcacctcgtgggatgggcttgattttaagtataaacgtaactcctgctcttcggcgccatttcattctctgtcctgggtctgttgaggggttgtctggatgcggtggccttcctggaggggcagacggccacgccagagctgcctttgggtctgcacattctcagggcccctagaggggagccg

SEQ ID NO: 44110 - DNA, 729 bp, Bovine  19866881093104
taactgactgagaaaaagctttatttttgctttaggcaattacatgcagactagagagattgactggtagtgtttcatttttaagggttaaagtgacagactggaaatgttatgcttaaggataaaatagaaggttttaataacaaaatatttacacacatttttttaagaaaaatgcatgaatgcagtaaaactatttagaaatagaaaaaccatgtttaacggttatagaaccaccatttttctccacaatcatttccactcatgacagatgacatgaataaggagcctaactgccacatttcatcactatctaccaacaataaaaccctaaagaatgctttggaatctgtaatgtttccatgtctgatttaaaaagtaaaacccaattagatgactcactgcaggaaaatatctgcactgtggttcaaataccttttgcttcactaaaagcgctgtcagagcaaacagacatgagagctcccagataacttaattaacctgcaagatcaaggatgtatcattctgttttaaaagatgtgcatctcagtgctcctcaaaaatcatcctacagcacgacagccttctttcctgtcctcctgggcagcacagaaaaaggacagtctaatcctctgacgactgagaccctatcagcatgccaggctcctgagacactaagcatactacaggtagagcccaaaagttagggtgagaagacagatgtgcagt

SEQ ID NO: 44111 - DNA, 1163 bp, Bovine  19866881126261
gatgtctttgtattgagcaatttaattttactttatttaatttttacacattacaacctgtgttcattcaggcactgaagggctgcagtctgtcggggcagggtctgggtctccctgttagtaaaatatactatatcttatttaacaatccccatcgccttaattgaagtgcgttcttgtccctcggaaaaggaactgcagatgttcttattatgtagttatgttgctaatgtgaaaaactgcctcattatgaggatctgtttgtagctagaaaattactgcattatgacaaatgcatgattgggaagttacaggaagatgatcattattgaaatgaaactggaactcatttaatagctgcaaccagcagctggaatgaagcaaatgaatgtcttcctgtttttattgttgtaggcaggtttttcaggcagaagggaaatttgtgctaaacctggaacttcttgtatcgctctttgctcgctgggcttgggtttaaacggaggcaacgctgaaggcagcgggtctcctacctgggtgtcccccttgtgcactaatgatgctgttttaaacacaatggtgtcagtagggacagtcagtctgggcgtgcttagtgcctgtagccctgttcgctggctgggctggtctccaggtgcccctggcagggggggtcaggaggttgccatcacaattaagccctgtcactgcgacccctccttcccgccccagaccgtccctgtttgcagccggggtgcctccaggcctgggggtggttgggggatcccagcgccccgggcaggtggcccatcaagagcggcagcagcagcacgaataaggggtcaggtctgctcggggctgctgttcctgttgcctttgggggcaggtttcccccgggggcgccccaggcacatagtagctgcttaataaatggtgagcggatgaaatggatttagagacagttggtttggctgttttccttctaagacagatgctcttgtagaaaacaggcttcccaggtggctcaaacggttcagagtctactgcaatgcaggagacccaggttcgatccctgggtcgggcacttcctctggagaagggaatggcaccccactccagtatccttgcctgggaaaccccatggacagaggagcctggtgggctgcagt

SEQ ID NO: 44112 - DNA, 922 bp, Bovine  19866881199108
ctaccgttttgattgatctgttcacatattgattagatagtttatctaattaaaatgggttcactggagactgtccttccttgagtagttgtgaggattcagaattgcccccgctcccctcccaaaaaaaaaaggcttcataaatcagaagctgtttctactgcccacattgtatcatcgagtgagcccaggtcaatgtcacagttacagccaggatctggtaatgaacgttttttgcatctgaaaagaccgagctgaataggaataaagtggtttctgagcagggaaagtatcctttctcaagttcacggtgaggaaggcaaggaccactctgtctggggaacgagttatccgctggagggatgactcggccctgatccaggttcaggccctcccgtctcagtacttcacaggggtaaagaaggaagtcacgccagcagggacagctttgctcccagggacaccttccccggggagcttgtgacaagcaccccagaatcggtacccctgcctaactaacaactcaggaaacaggaaatgacatcggccctgagatccgccttgaacagaggggctctgcataatgcattatctccgggagacctggggtagctgagacttgagcccagacgtgagccagagcctggatctggggtgcagggagccccagttcttgttcggacagcagggagggccagctccccctgaagaaccacagcctcatggaaaacagctgggcaggtaagggggcaccaggaggtgggcacacgtaaaagcctgccacacgaggtggcttaaaagccttagctgtggcgggcctccgtgaacaaggagccatacacgcaagatgcaggggagagttggggcgcggagatgggacggggcagggcagccaggggctcgtggggattcttcacgcttt

SEQ ID NO: 44113 - DNA, 2341 bp, Bovine  19866881211334
ttcggaagcctgacaccgccccgtcaccctgccctgccgcgcccccctgccctgccgcgcctcccgcgcgtggatccaccccctgcttagctaagttcctggcttccctgacccagagggaccctgggccccagccaggcatcccacaaccacaccaggcccgtgtccagccacgctcaccaagatctccagttcccttcacttccgcctaggagcctccctcgacctgaccgagagctcagacaggtcacgactggcttcagtcatgatgagagaggggacagtcactacaggctggcacttggcgtctgcttctaccaggatcaaatctcgagccactgcagctgctggccatcaacaccccctgaaaggagctcagggtggagtacagaagccccccatgctctggagaaactggtgggcagttctttagatagtgagctattttcaggagaagattttatgagtccagtttttgcatctcctcaaatctagaaaaacactgaactccttcgtgatgacatctgctcctcgtgacgagcagcgaccctcacaagactagcaaagccttctgcaggaacaagtgcttgattgcatgaactgccctgccaccaaaatcacacatagaccaacctccccactgctctttggagcagtctctcggagccagccaaggtgctatctccggggccatagccttcatcttgccccaaataaagcttaactcacagctctcacatggtgcgttttacttccagtcaacagaaccaattctggacagaaaacgtaagagctggcgcaggacttgccatgttctcctgcgtcaggatgacccctgaggtctgtgttgagactacagtgtccgaggccaggggagcccgctcaccctggatccccgagtgtctacccagcaaagagccctgggctgtgtaagataaacacggacgataataagggcacatgtgttgcttggacaccgagaatcaaggccgtttgtttctgcagcatcacctcacctatcctgactgctgcaaccagggtaaaccagctgcacacgccctggccgcacagacacgctcacactgccctctcagagagagctggtccctcgtggtggaaagagccctcggtgattctggggaggcttgcttgacaggggccacaaactaccctccaaccacgtcagtccctggcagagaccaccctccccagactggtggctctgggcactccacggtcccctcttccagttctccatcttgcctctgaatctgaatttctacctggtgtgatcgggagcctggcttcctccctgcaaagacgggtctctgataatcacactgtctgtctggaattgctgctccagaatcaatagagaatgtattgataaaagttaaattgcccctgactaaagcactttcctgccaaagagaggcagcataattaaactgcagacaatttagcaaaaatttaaactttagcttttacaatctcgagaggtgtcagcgcaaagccttcccttaagcgctcactttcctgtgggataaaattgctctgagtgcttttgctagtggacatttgggtttgttttttgtttgttttccggaatggatgtgagaaatggcagatttggatcagcaattcgcacaaagagaagtccttttggccactgagtttataagtgggcctttcctttatttcttcattctgtgactacgtatcaagtgcctactaagtgccaagcaccgagaagacataaccttaagctgggagcaagtgtcaagtgatgacggcgagaagcagccggtagatgtggggctgcatgtgtgtcggggggtccctgagcctgagcctctgctggctcctctgcacccaaggagcttgctggtccgctgacacgctccccgcttcattcattcaccctccactcatccaccccctcagctcagggctgcagagctcagactgtgaggctctggtcccagctctgggggctcagcaccccgaccagcaacagaatcggccacctcgggagcccacgtgtaacaagcataagaggaaggagggacacgtggcatattgagcaagtgtgtgtcgggcaacatgaggcagaagagcaggcatgaaaggactgggcggggagggcgctgggtgtctggacagaccaggcaggtccctgaggaccccttgctggggtcatttccacagaggctgacctccagcagccagaagaggactggacaccctaagatggcccagctcacaatgtgggcactgggtgctggctgatggggccccaagaggccagctcccctccactccacacggtctctgactgccc

SEQ ID NO: 44114 - DNA, 791 bp, Bovine  19866881275994
gattagaaatgttgacagttgaggtgtgtaaagaatgtcatattcacgcacattttccaacttcaatattaggatccttcattttttatgacttctgtaaagcccctttgaactgcagacaggggaaccaggagaaaactttccatagagtgtactgcacgcactaacagcatgacctgatttccaggtgacttgttacccttgagtgtgcagaaatcacttcacaggcaaagaaattataacaaaagcaacatcctaattacacgagccacacatacccaaggacgggcggtaaacaggagcaccttcctgtgtgacaggagcagacacctcggcccccaggtaaccgtattcacctccactttctgttcttcagacacctccaggccctcaggctcttacagaattttaaattaatgtctatagcattacaggagacgcagagtcctcatacatttaaatttacacctcatgaaaattcttattaactaaatttttccctcaatactcgcaggtcaagaatcgatgaatagtcaatttttttcagtcaaaattaaacaaatcataaaaaatggcataattttcagcattgcagattagatttagtgggcaatatctgccagatatgaaaaacagagctcattatgttgcactaaagtaagtttcactgcagtgtttttatttcacttcgtcagcctcaccacttttggtaagttcactacgatctttcacaaaataaccctggtttgaaaacagacttcgcaggtccctgtcccgatgccccggacatg

SEQ ID NO: 44115 - DNA, 963 bp, Bovine  19866881282212
acacacgcccccgacccccggggaggctggtggtggagccaagggcggccccccatttacagatcagaacctgagcgccagagagcacacttgtgctgttcagtccctaagtcacatctgactgttttgcggccctgtgagctgcagcctgccaggctcctcggtccatgggatttcccaggcaaggatgctgggagggggttgccatttctttctctagggtctccctccgtgtcctgctcttccctctctgagttacaccttctgtgacgttttgctcgtctgcataatttggaaaatgacaagggagtggctgggacgtggggtgagaagaagggcgggggtttcgctgctcacgggttaaaccaaacaggactcagcgccgcgttcgctgctgcagcctgagcaccctctcgttccgggcgggggcggctcctgctgtcctggctttactcgtcttagaaaatgctttgccacgtgagccgcccagcccgactccgccgccatcagctgtgacccagtggtagttgaccttccagcaggagccgccagcaccacaaacaattcctcggtcaaattaaatattcagtacaccctgggtgccctgaatcataatgctgctctctgcgacggggctttacctggctccgaaatggttctttaaccacaaattcattccgagtgacgcgtccaatgaaatgaaccttctcccagtggctggagatcacccctcattcgccactgtgtccctccacttaatggcacgctttaaaaaatgacgtcactagttaaatctgtgtggtcatttcatccccaactcatctctacagctttcaatgaatgcttaaaattccttccgccaagcctcgggcaaaacgtgaattttttaggaaagtaaacaaaaatcacggtttccatctgggaattagtgaggaatgaacaattcacagctggttttaaagt

SEQ ID NO: 44116 - DNA, 1058 bp, Bovine  19866881323359
ccgggtgcgtggccctgcccgcagtccacgtggcgccagggcccaccgagcggtggcatcgcgtaagccgtgtgtacacacacgggccttccaaaccatgaagttgtaacggtgagtcggagataaattaatattgttgaaattaatgaactgagaaattgaagctcccatcactacatgaaccaaatgtattaatatgtgatacataaattaatgagaataatcactcttgacaaaaattaaacaacactaaagttaaaaggttttaaatcaccttggcaccaggagttcactgggaagcgtccttgcacttggcatctcggcacaagttctctctctgttccaagaagagaagggacacgctccctacatgtgggagccgtgacttctgtcttgtcacggcccttgggcccacgattgcaaaccaggtgggctgtggtggcttttgatcttggccagcccgcgactcaccattacgatacggagcggtcagcagcaggtccagggcaggggctgagagcagaggggagcccgaggcatgcccagtccacgtagggagtgagagcggggcccgggtgccccccggtccgagatccggccacagctggcatcacaggagtggcccggttggcgcgcctctgttgacagaggtggcctcggggggcctgggcctctgtgtgccgctgaggtgtgtgggcggcggccccttcgcacgcagaaggccagaagcctttccctttgccacgtgaggtctttgaggagaggagcctgggggggagtctgtccccatgtgcacccccaccccgtgaagtaggtgcccttaaccgagcccacggctggttagtggagggccgtgcaaagccactgtcccattgaccaaagcccagggaggccccccgcgtctggtgaggggtgcccctgacctgccccccctctcttgcagctatgtctgggctggtagtcccacccatgtgaggggcgctgttacctgccgccacgcagcgtccaaggacggacttcaggggacacgtcaggacacacgaggtgctgacgggacg

SEQ ID NO: 44117 - DNA, 2606 bp, Bovine  19866881513184
tggtgaagttgatacagttttttagaataggaactcattgtttttccagttacagtgagaaaaagcctttgtagattctgtctgcaacatgttttcaggagtgaattactagatttggaaagtgagggatgcctgagcttttgttctcaacttctttctggaagaactggacttcaactgtgcatgctcatcgtatttcagaacattagtctgagataacagaattgcatttggagataaggttggtgtagtcacagtcattcgatatgaaatgaagggtgcaccttgtaggtatgtttcccttcaccctgtcagctgtacctgcttcccttgtgcagactccagaagggaccccacttcctccatgtcggcagcgaggccacctgggccttcaagagcccaccaggatcaggccgcacccagcagcagctgtgtcctcaggacccatcttcggtgtcagtagagtcgaagtctcatccattgttgataagcggccagatagaaatgtgtaacaccttggctaacaggctgtgatgaaattgaaggtggtcttttcaaagactccttattgaaatacagcccattttgggtaaatgtaatagtacaatgagccctcagctgagtggaaacattatagaatgcaaatggaaagatttgtggtatttttccttcatgaatttgtagttatctttgcaggagtgaagaacatccaatatttcatggcctttccccaggattgtgtgtcttagcaggtgcgaggcgtgtggccctgatcctcgctggctctctctgacttcccggtggctttggtccctctgcctggtgggggcagggccctttccatctgagttcgctaatttcccgttttccctccctaaatggaagctgtggcgttctctctccttggccctcctttctgagatgggaaattgtgttacagctctgttgtattatcgtggacctgctgtggaaatcccctgtgtctttcctgtgattgccaccctgcgctgcacctgaggagaggcccccgcttttacagtctttgtttctgctcttttgtgaaagtgcagctgacttggagtctttcgtcaagtgtgtcagatcatttttgccatttcccttttcccttcagccttctcttactttccatttcggtcttggttacccatcttaggcacactcatgcttgctgctggtcggtctgttatgctctcagggtagccttgatctcattccattcccttaacaagtggcattagcagttggcatatttgggatttgaacgagcagtgtttggtcttctagcgttttgcacacagcagtggggcgatgccctggttctagaatactcacctttaccagggcgcagtttctgcgtcggaacaaggctccaggcctgcacacagacgtctattgtttactcttaggtgttggtgtttgcacctagaccttacccacttacgtgaatggcctcgtgatgacgaggacaattaaagtattgtaatatagtatattaagtagacttagactacacatttacctgtatatactatattttcaatatttattcagaatgacttttctcaaatatttaataagaattaataattgaatgtactcttgccttcttactttgccctgggatcccataagatctttgaagctaaaactagtttgggcccttaaggggtttatagaaattaggtatgtctgagtatgaaaatggctggtatggtgaaaaaattgagtccttaagtaatttactattcccagtgataattagaagaaacccctgctccagctccatttcccaatctttttactgttttcagggggagttcttgaggtattagcagctattttttttcatgtgatctcagtgtaaggtaagtggctttggcatagcatgttgccttgatgggttattaaattgtcacttctaagagatgaatgtgggttacagagtatgttgtgccatatatcattttagtcatcaggaatgtttcagaaaactgagtaagagtaaattcttttaaatttatgattgaaattagcaattttattaggtcttttttaaaaaaccctacaaacttttaaagtctttctcaaaatatacatctttgttctcaaaagaggcctgcagactgcccttaatttgtctttaaaggacacagaattttagcagaatccttgggctgcggagtagacagacgcagcggctgttccttgggcggtctgcacagagggctgatgtgccctgagatttactgtgcatcaccatggccatcattcccctaagtattaattttaactccactaataagaaactgaacaaaagtggaattatgagttcagtagtattctatgaaaggtcagttgttaaaaaggcagagtctgacattctgtgaacaaggtgccttcattaatcatcctgataggaggacacgggcgctcttgaccagcaccagtgagccttgcagcgggcgctcggagggcctgatgtgcacgtctctatgtaaagacacaggttgcttccatgtatgttgagttaatataagaaatttatcttggaatttggggatgtgtgtgtaatacagaaactcttc

SEQ ID NO: 44118 - DNA, 986 bp, Bovine  19866881658271
atgaatgatgccctgtggcctttcctgcaaactacagccgggatcatttgcagactttttcctgaaagcgcaactgtaggtcctaagtctgggtgacagctcggagggagcattccaagacgatggtccaattttgctcgtttttggtaattatgtccaactggcgagtgtccgcctctcgcgcccagcgctgctgagggcctctgcactgtggttcttgtagctgatcacgccccacgccatccgtgtccagaccccaccgaggcacattcctggagtcgtcgaagtcaccttgtcctacaagtccaagcagttctgtaaaggtgctccagggcggtttgtctacaccggtgagtccacctttccagctttccctgatccaggagggcctctccatggcccccgggggccccgcacggttctgcagggagggctggcgggtgagccagagggtggtgtcatcagggaagtctctgcatccttgaccagttggtgtgacgccgtgaacaggtgcagatccctggggccgcgggatccgtcccctcaccccctctgtggtcctgcctgtaaaaggatgcggtgggctgtcggtaaccacgttcccagcgtccgaggggtggctgccccgtgaggtcccagaggtcaggctgtgtccccaaggtcacccatacctggggataacagaagcaggtctctgcccggcctggggcctcacaccacacactgccctgctgctgatggagggtctgaattctgtgcggggctgggcacgcggacatcaccaggaagggtcccctctgaggtcctggaccgccatccagaagccatgttctgcagtgctttgcacacaggtggcttggaggacacgatccgtccgaggctgctgttgggaaagaccacggtgaccacagggctcgtccgcattgaggcctctggtcctgccacccacagagcttgggatgtctgagagggctccacgtgctgag

SEQ ID NO: 44119 - DNA, 1039 bp, Bovine  19866881678546
cccttgccccaacgccctgggaaacagaatacctgtgccaaccaccctgaacttgccccggggtgaaaagagtgggggtaccaagcgcccacggccaggctggcacagcggccgtgttcaaaggatgcttgccaaatctggagcctgggcgtttgtatgcagactgtgttcctggagaaattttacaacaaacctaagtctctgatgtcctgttaattttaaaagctcttctgtttgtattacagagacacgccagctggggagaggtgcctgctccaacacaagaaatgtattgcaaaggacaaggaaaacacagtttcgagccactagaaaaacaagctgcacagtcaccaaacaagaggagacgacactgacgttctgaacgcagagcacagcctcgaaaaaagcctaagtatccctactgagccacagctcaagggttagagcagtggtcttgtaagccacttggctcagacggtaaagaatctgtctgcagggcaggagacccgagttcaatccctgaattggaagatccctggagaagcgaatagcaacccacgccagtattcttacctgtagaatcccatggacggaggagcctggtggactactgtccacaggttcgcaaggagtcagagacgactgagcgactaacgcttgtaaaccaggggttttgagttcacatcttcctggggccggtgcttatttttttccctcaatcactaaataactggaccaaacagtgttaacttataaaaacagatggtcagcgggacgcaccagaatacgggacataaaaaaatcaggaaggccttggctctctctgcagtgagtggaggggagctgccctgaccccagccctcaaatcagcccagaccctgtgtttctgagaaccagacacagacacgagggtcagctcacgcaagctcctggtttctggattaagctgaaaaatgtatttaatttgaaaaccagaatgaatgaccccaggggaaaaaaaaattccgattacctcttccttcagattaagaatcaaaag

SEQ ID NO: 44120 - DNA, 1279 bp, Bovine  19866881696336
cacactcaacctggtaagctcacacgtgggggcacgagtgggcagcggcccacgtgcgaccctgctcatgcccctgcccccgaccccacaatgggaagcaggaaagggcccgacagccctggccggcacctcctgcagaggcagcggggtgaggtgctggtgggggagggtagcaaacgtgggtgcctgggtggtctctggggcttgaggggtcttcctgaccatcacaccctgcaaacggggatccctgaagcgggggcacaccatccaggagacaggtagcttaagttgagagacaggggctctgcacccaccttggggagtcacgactcttactcagatgccctggttcgctcaggggcatctgacaaaggctacggagctgtgggcatcctggggcactgcccaggttgggggccgcttcccctgcgttgctaagggaattgaaatgtgagctgagtttcctagcatttcccactcttaaaaggatatttgaagaatttttatagtagtaaaattcatcttaaattgattttttatgcttgtgctaaagatctcaacctctgatttactctgtagttctcctttttaactctttctctattggcattagataactattcatgggtgaaatgtaattaaacagctttgattctgaagcaaggatttatgatactacatttaaaatgaatggcattaaacacacacataaaatcagatttttaaagccatgacacaaatttccatttctacaataaaatgaaatttattctctgccctgccctctcctccaacctcgctccgctcgtccctgaaagagctgtggtgtgacaggatcacagcatctctaacggctgctcttattatggaggagtttctccaggcttcctaccgacgaacctgaaaccccaatcattatgggctccgtggcccacactcatttaaatctcacatccacatctccctgggagccgggagcctagcagctcacctaccaccaaacgcacagacttgtggccaccgcctctgggaagcaccgctgtgcgggagcccagcccccagaaggccgctggaaggctagcgctgaggatggaagcgagataaggccgccccaccgcccgggggccaggctgaggctgacctcagagccaatcctcgaaaagccgcccaggacgccatcggtaagagcagtactgaggccagtatcaggacactggggcccttatacttgttttcagttggcacaagaaggctggtagtggctggaaaatgaatttgg

SEQ ID NO: 44121 - DNA, 993 bp, Bovine  19866881745385
aaaagggggggacgtgccatttatgttggttcttgcatattttattctacaaagaggaagagatgcggacgcactgagaaaagcatacgtcctggccgagtggcgagccctgggtctccctccctccctggctcggaggactggctcaaagggcgggccgctgctggacctcgtggccctgcccagggcggctgtgtttttagaaagagcagacagtgtcccctgcccctaaatccagggcggtcctttacacaatgtgcctgcgccacggtaaacacggagcaggaagagagagggaggaggagctgctgtcgccacagagagtctgcacagggtgacgctggctgagggcagggctcagcagggctgctgcttctcggcgcttcttagaaggcaggaaatatctgaatatagcttgggacatgcagacgagctaaacacacttcttccgctagttcattcttcagtttcggaagcactttgttacatggccttaaaacttcacacaatgccctggcaactgagcctcagaaggtctgtcctgcctggagagtcccacccctcaaggtcgtgaaagccacatctcagagagagatggttcttttccaggagataccttacttttacattcggacactggaaacatgaccttcaaaatgggacctgtacgctcataaatcctatactctgagtcatctcggttggttggacaacatcagtgcctcaacggacatgaatctgagcaatctccgggagctggtgatggacaggggaggcctggcctgctgcaatccatggggtcgcaaggagtgggacacgaattcagtgactgaaatgacctgagtcatcttgaacataagggttgcaagtaaacctgagggagagcgcgtttaaattaagtaaccgtttttacacttttggatcctgcaaacagctagacggcattaccgccattgggttttgtatcgattcttcgtacgtctgacgttggta

SEQ ID NO: 44122 - DNA, 1029 bp, Bovine  19866880431560
atattgactgagattcatggttcatcatgcattttattagtgaagaacacacttaggtatgtggatgtcaatcaagtccataaggcagacagcaaatctttaaaacaaatatggtaaggattttgaatgaccctgagttcatatcacttaatatgtaaaatcttttcatctttcattttttcatttttacttttcctatactttctcagtcaattgtaaagactgtgatttaagatatccacattgcaattgatagagatctcaagaattttttgctaaaatgatttattgcacttggaatactgtacttaatctccagtgccccacccatcctcttaaaacatttattttaaaaataagtaatgatctatgtaaagattcttcacacatctaaaactgactctggatatttttagtatgacccttagactgcctcttctctgatatctccttcctgacatttacttctagattatacaaatacttctattacatttacccagtgagagcgttatacctatttcacaagctgagactttataatcaaattttaaaacacagtaaagtgactgatataaataaatcaaaaggattaaaattaagtatttactgggtaagttgatcttataggaaaagtttacacttgcattttcaatttaggagaaactcgttttacaaaagtgaacgtatttttatatactgtttttctcattgattattgtttcttattaagttactcagtggaactcttcccatttatcaggtttatctgggcattaatgtggaatatttgacatgtgccaaatgtgttaatgaaaattatcactgacacagcatttctccaagctgtaaaagacaggacacataaaaactgattagttgccatgacagaatgaacgcttgagaattacttttccttgcatatcatttaaaaaatcaattagatgaatgttagagatcaatattatttagtgcaggaaaacaaagaaaaagcacaattatgacaggtattgcctcctaaattttttt

SEQ ID NO: 44123 - DNA, 1658 bp, Bovine  19866880613948
ttatagatatgacatcacttgttatctgaatatggaccattataaaagtttaatcccattaaattgatagtagctaatacttgctgaactctgttcaaagggattgcgtgttttggtcacttatttctcacaataatagaatgagattagtactactgtaatttctcatgttgcaagggaggaccctgaaatctagagatattagataacacctccaataaggaagctagtgatggaagagggctgtgttttgtcagtttgtgtcaagatcatatatacttaagaaaaaaaaaaagatgatacgtgcttaatcatttacccgttggaaaaagagtagatgtgttacactgacagaccgaatgttcttgttaaaagcatgctaaaggcatgatttaataaagccaactatttgacaaatccaattccatttgattaacctaaaacatgacaaaccctgccttttttatgaaggagatacttcagaaataacttgatcagatatttgacaaagcattctcaaattgcataataaaggttaaatcacaatattttctaattagaaaatcttctttagctttaaaaaaattagtgagttctaaaatccacctaaacattctctgtatgtgcatcagtcttacaatttattcaactcataattcaacacctactggtaatttgtacattgaaaaaatgattagaaagtatcaggcattatcctcatctctatggaactaaaaaccaaaaaaaaaacataacttcctttagaaaggtgtgaaacaaaaggctctagggaaatcttgcaggagctaattaattcagtctgccacaaaaatgttgcaacatttacattataaggcttctttctgcaaaattagatgttagttttgaagtgttaatatattaaaatatatgcaaattatctcaaatagtcactaactactatggattttcattctgttaaaagttataggttttagctaatcaaatatgcaaacactgggtgatctaaggaaaaaattcttaggcatgattaattgccaaattcttttatctggaagaatctagatgaaaataattttattaagattatttgtgttcatttaaattggtgaattgatataatgaaatttaagtgggctaaagcatagcaaagtattagtgagaccaaagtgtttactatagttattcaggataaaacaatcccctgtaatgaatcctactaattaaagaatctaggagccttcagaggattcattatagtgtgctgctaaatttataacaatttgtccaaaaatgacaattgctaaagcaatggaaatatgagatattttaaatatactattattttaatatttggtgataatatgacatgggggagaaaattctggttttagagttagacaaaactgacttcaaatcttgattcttcctcagtgtgtaacaggaaagggaaaagtattaaataacagtcactgccactatcttattgatcacttactatattctagatgtcctaagggctttgtatatataaaagaatttccaataagcttcatgcaaaattgggaaaataaactccgctttaaggtgaaaaaactgtagtagaaactcaaagagagtaatcacatattgttttcacttgttgctttaatatagtt

SEQ ID NO: 44124 - DNA, 1831 bp, Bovine  19866880704192
aaatacatgaatgatacccagaagcattaaagaacttctttatggtcctacctaccaagggatgcaagtctagcctgtctcactgtaaaacccatatctttatcattacataaaacggcttttgcctaggtattttataatcaggattcttgggtttcaaatatgagaatcatcttaaactgttcctttcagtattaatttttccacacagattctaaatatttctatttttctggaagttttctgtgccattttgtgatgtgaaactttacttataccacatcagctactcacatgttaacatttagcaagattctctccactgaggttgttgagtttaaaatgagaaacattctctgagaatcatagagtagttgaagttgtcttcactgggagtaaagtgagaatgcattaatttataaatcctctgtttctctcttttctttgtgtatctccatttttactgccaagtcattactctaagagagtgcagaggtaacatatgtttggccttggctgccatcttctctagggtgtttactgttcaaatctgttccctgtcagatttgaatggtgacatggtgccctggcaatggatgactctggtacttggaaataagaggaaattatacaaatattttgtaactaattaaaaatctgtagtgttgacatctgcttaatatacatagtaattccagaagctggtaacatgccacctctaaagcaagggtctgatgcagcctctttaaataaagtaattatgaagtgtactggcatggatctaaactggaagatcatccaaataaagtcataaaatgtactgattggtactgaggatcagaatgcagtaaaaagaaaaaaaaaaaaaaacagatttataatactgactattttacagtagaagaacttttctactccagagcctaaaaatgtacttgagtattaaaaaagaagttattggctttcaattcttcttgcaattttaaagtaccatgtattgtatttagatttagacaagttacatcagtgattcttaatttatgtattcagttaacataaaagaatagtatccttttcaaactaataatttaagatttctacaaaaatgtagaataaagactattttatatataaggaagactattaaaacacttaagagactacatcaaaaccctgctattttagtcaaaatactgtcaaatgaaattggctttatgtgtacacatacatattttcatttgtctttgaccacatgtggctaaaaggttttgcaagggcttggtatatacctaggagtggaactgctgagtcatacatatagtaaccctggtttaacatttggaggaagtgccaaactgtcttgcaaagtagccacgttgccttctctctcccagcccacacgcatggcctcatgagtatgggcaaagaagagaagactcagtcctggtctgtacatggatggctctgtacgatgtgcaggcacctgaaagtaggcagctgcagcactgtggcccctcaatgggccatctctgaaggaatggtgaagggaaaatcctcccagtgggcaaaacttagaggagtgcacctggatgttcactctccttggaatgagaaatgacgaaacacgcaatcataccataattcatgagctgaggccaaagagaaactgtgagatagtaaaggtgtgctaatttaagcctcttagcttaagataatttgttagaccatatagataattaatactttagggacagagggtaaggagtattctgttaaattactgaatcatctttgcctgttttcagtaaatttattttctttttaattaaga

SEQ ID NO: 44125 - DNA, 1737 bp, Bovine  19866880878996
aattgatgcttttgaattgtggtgttggagaacactttagagtcccttggactgcaaggagatccagccagtccattctgaaggagatcagacctggggtttctttggagggaatgatgctgaagctgaaactccagtactttggccgcctcatgcgaacagttgactcattggaaaagactctgatgctgggagggattgggggcaggaggagaagggcaccacagaggatgagatggctggatggcatcactgacttgatggacgtgagtctgagtgaactccgggagttggtgatggatagtgaggcctggcgtgctgcgattcatggggtcgcaaagagtcagacatgactgagccactgaactgaactgaactgagagccctatgcgtgctcagtagatattgaaggaataatttccattttatatataagaaacataggtttaataggatcagttaattttggaaagcatacaatcaacttaagtggagtttgtgtgattatagggaatgtgatgctggggaaattcttttagtaaaaacattcttcacaaataatctcactttatcctaaaatatttctgaaaatgggaattattatcttcattttataggtgaagacaccagctcaaaaaggcttctaactatatagaatcaagatttgtatgcagaacaaccttaaccccaaatccaagttatattgacattgatgttttacatctcacaatacaaataggtaaaatatccaatgattcttaaaccaatcactaaaaatctaccatcttatctctaggtattaattctgcctcagcatcctaagcagaagtttgaaaaatcagagcacttttgagataatataatacactgactgcaaaataaaccatcaatctgttgctttgtgtggcttagtgattgaatcaaatcaactgaagagctgatcacattgataatgataaaaggagttactatgcagaagaatatattaaatagcaaaaatcaacttggcagcaactcagagatataatctggatcttttccaataatattttgagtacatttttcttgcattatgtatgttttatgacaattatctttcttattgtatcattggaatgaaagacatttctttctgttgccatgatgcaaatttccttagtgagagattagtttgatttgctggttatatccttttgctaagtgatggcaaatggtaaattaggctcagtaaggaaacggcagtaaaatgcattgcatcttattctatagctgagataatcaagaacatattgttgagaaaacaactaaatcataatgtttagaggagaaatatctatcagtagtcatatgctttttcaactagtttttcatttgtaaaattaaagtctctgaataataacagatggaatcaacaaaatatgttccatcctcaatgatataatttctgaaaactgccgatggaaaagttcatagacctaaataactccattttttagaaaccacttctcccatgttatcagatacatattcaaaaactgtgtatcagccaacattctgtcagctagaaatctcagttaattggcaagaacatattgctgtgatgcatcataaaatagtctaaaatgaagaactcattgcactcgaagaagttgtaatgcattctgttaaaattgatattaaaaatcaaatttttgttttgtaaagtgaacagttaaatattttccctgtgctcatatt

SEQ ID NO: 44126 - DNA, 2152 bp, Bovine  19866880954649
gtaaagaatctgcctgtcaatgcagaaaacaaaaggttcaatccctgagtcagtaagatcgcctggaaaaggaaatggcaacccattacagtatttttgcatgggaaatccaaaggacagaaaagcctgtctagctacagttcatggagttgcaaagagtcagccacaactcagcagctaacaacatttttaattacaatagtaaattgaaaataaaatttaaaaaacaagtgaatcaactagttagggaaaaaaacaaaataaaacttagtaatacctccaaaccaggagcccatactgttacctaaaccaagaactgtgactgttgtatactgatatatcaggatttctttttttgtattattcagctgtcgggaaagagatcaatttatcagatttctctctttcctttaaactgcatcagctaaaatctgcactcaacatttctatcacactgtactaataagacctagtagcagagtatcaagagcttacctttcaaagcttttatctatttaattctgtttcccaaatcagccagtgacatgatccagatgaccattacagaataccagtctccttagcagtatacttttgtcatcaaagagtatccatatatgtatacagtatgctttaaatagtatacaaatgttttaaaatatacaaatatgttaataaactgctttggagtaaagttttacaaattaaatttgtactcctgcaacataagacagagtgcccatatagccatactaggaatactcatcaatattgtatatggtcatttttttaaattattacttgatatttaaaagaagattttgtcatagaacatgtattgcaaatacctcttttcattatgtggcttttctcacctttagtgatacctttctatgaacaaaggtcatttttattttaaatatttcagagctttatagaggcatatttgggacacattaaacagaacacatctgaagtgcatactttggtacacagggaaaagctgatttcctttcctgtcactctaaattagtttgtaattcctagaattttagataaatggcatcataaattaggcacttttttgttcttatttcagtcagcataattatattaaagtctatatattgcatacatcaataattcatttctattactgctggatagtattccctgagtgaacactgcagaaaccaactatctattcatttgttgatcgatatttgagtttgtttccagttttgactattgaaaataaacctgttagggatatttgtgtatatgtcatttatggatgtatatcttcatttctcttgtggaaatctctaggtgtagaaaaacttgcataatgtagtatgtaaatgattcagtgttaagaatgtgccatcctgttttccattggagttgtactattttgtcctctcttcagcaatgaagcagagctgctcatccttagcaacacttaggttcatttaggttagctgttgagcactctaagaggtacgaagtgctttgagcttacatttccctaatgattaatgatgtcaataacctcaccatgtgtttatttgacatcatttgaaatgtctgaatattttgctctttctttcattgggttggctgtttccttattattgactatgttaggctgaataatagtttccaaagtatgtccacatagtaatctccagaacctgaatatgtttcagttcagttcagttcactcgctcagttgtatccgactcttagcgaccccatgaatcacagcacaccaggcctccctgtccatcaccaactcccagagtccacccaaacccatgtgcatcgagtcggtgatgctatccagccatctcatcctctgtcatccccttctcctcctgcccccaatacttcccagcatcagggtcttttccactgagtcaactcttcacatgaggcggccaaagtactggagtttcagcttcaacatcaatccttccaatgaacacccaggactggtctcctttaggatggactgattggatctccttgcagtccaagggactctcaagagtcttctcaaacacaacagttcaaaagcatcaattctttagcacttagctttcttcacagttcaactctcccatgcatacatgaccacaggaaaaaccat

SEQ ID NO: 44127 - DNA, 779 bp, Bovine  19866881236477
catatgtataaaatttaatagctcagcttttagtgtgccttattttcaacaacactctactcaggaacatttgctaaatttctcatttaaataaggtgataaagcatccttaagccctgcagggccaaatgtgttgacttccaaagattgttccaacatttgtaaaaacgtcttatcactttcactatgaactcttcccaataagcagataaataataattcagcaagtaatctagacccattatctcttctcccttctgtttaatccaacctgttttgcttcttgggtacttaatcagaagcttgtaagatatctattacagattatgacgctataaatcatgtccttaaagtgcgaaacatccttgtcagaacattcaaagtagcttttgagggcaagcagagtctatcactttagaagtattgattgcgagaaacagagagcaatacaagctaacctaaaaagaggacttattggaaagattttgtatctcacaagggccagatcttgtcatagcagaacaaggtgtgttccagaggatcacagagcaggaagaaacagagcatttccctattgagaaggaaaggctcatcaatgtgacattgttgccaacgagactagcagcatggaaactatgcctcctctagatctgctgtttaggcagacctgaccaaagctggcaaattactgctatgtgagactggctgctgcttgacaggccagtttgggcagagtccacaggatgccagtactaagtacagttagccaaattctaggg

SEQ ID NO: 44128 - DNA, 1722 bp, Bovine  19866881811970
aacccagaaggggatatgataagagatagatccagaggagatttcatagtttactgtcttccattttaactattatactactctactgaaattgcactatggtaagcatgatagctcttataatctgtggtatttaacaaaggtgattttgtgtttttttcctgcctgtgtgcgtacttaattcctgcattaccatgaatttttcttttaaaaactcagaagaactaccttctttttttgcttcatttggcattatttatttgtccttttaattatttcacagtcctatagagtaatgcaattataagaaaaatgtataactcagcatcatagtttgtcattgtaaaaatagcatgagatacatgacaagtgaattctcagtaggaccttagataaactgagggaggcttctgcttagctgttgtctgtttcgtaatttaaattcctcccacagttctctaaaggacagtaatttagatgtatcatttaaactactagtgtcatactgtcttcccacaattattcaagttgaagtgaaaaattactccccagctattcttaacctgatattttatcaaataaaggaatttatggattgttctagtgagcatttaaataataaatgaaaagaattccagatgaatacattgtcctttaaagttagaagggtttcctttctcagaggagcaactaagatgccaaggcctctctatgttgacttattagtgtcaccaaaaggaagtaaattgttggaaatacaaagaaaatagacttatagccctcatgtgaattattcatgctcagtagatatataacagtttctcttgaaatgtaaaaatctgtatatagagagatactcacatactgtcacactcaacactttaatattatttgcccataaaatatttcatactggtacaattatgaataattaagaaaatagaaactaggaatcttaagaaggaccaggctgtttctcactggtaagtaaaagaacttaaaagtaatctgtgcacttatctaatccatcactcacatcctcaactgatatttctacaaggttttctcttatgcttatttttctttctcatcctttaatatagaacagtcagtaaattaatagtaagaactgaaataaacattttcaatcaattaaaaaaatctttgttattaactaatttattattgatcatcttattccctcagttagaagacatttcaaagaaactttggaaaagacaatagcagtttttcatcaaactaacacaattcataagacctgatgattaaatcctgcctggtctttttcaaatccaggaactagattgtatgttaccttgtatcacttatcagtttctttggagaagtatcaggtatccttgcagacaaattgggctttgagatcaaatgtacctggattggaatctcagttctctcaatgaatgctcatgtgaacataggcaataatttctgatctttaagttctccatctagattttagaggaaaaaaatctttttaatgtttataacctcattttttattgaggaataattgacatataacattagtttcaggcatgcaaaataatggttcaatatttgtgtacattgtgaaacagtcagcacagtaagtctagtttacattgtcaccttagttaccaaaattttttttcttgtgataatactactttcttagcatctttgaataggtaattcagtatt

SEQ ID NO: 44129 - DNA, 804 bp, Bovine  19866880360748
ataggtctcatcacactttggtatccttgcttctttatttgtctgcctctccagtagactctaagctcctggtgggcaggaaccacaagcttttatcctcatacctctatactacctggcatgaaggttgaataaatgaattagtggatgctcacctggacagaggcagctttttaataagatgacaagatgcttgagaagtgcttccttaaaggagtaggcctctccccagctcctggttctaggtgagtgttcaaaaagaggttcactgcaatccctggctataccccactcttccccctccccaattcagcccatgttatgagacagttggagttggaggcactgtgccaaacttgcccaccctttcctcctgggcttactttggcaggtgggcatagagttgtcaaggctccatttgccattggcctggcagtggatgaccctttggccggtgtagtagtagccagggtcgcagatgagcatcagctgggcctggaactggtactgtgtctcgaagatgagcctccatcgaccatgttccacactgacgctgctgatgtcaggacaggtcacagctggggaggtacaaagcagaaaggaggattcattcattaattacggacgacactggcgagagcccagcgttggggagtgggggaccataatgcagtcctgatgaccctcagaacattcagtccccaggcagatgtggtctatgagtgaagtgagctgggtggggaatgtggcacacgactggggtggcagatctgccaaattaaaaaaaaaataggggggaggtgg

SEQ ID NO: 44130 - DNA, 1896 bp, Bovine  19866880378450
gtatttgtgggggacacaagcattcgtcctaacaggggataacttaaaacttaaaacttaaaaaaagtgtttctcaatttttaatgaattgtatatgaatcccccgggaatcttgctacaaggcagattctgattgaggatgcagcctaagagtcttcattttaaacctgctcctacgtgatgtcatcttgctgatctgaggctcaggtcttgagtagcaagaacctagttggcctggctaatggcccatgacctattctagggattagacacctgggagtttggagtaacattttgatttgaagctgagatctccctctgtggaatcctggtgcctcgtttcctaagatccttctctgctgaacagtgctgacaccccctgagctctactgcatgctgggctctgtgctgaacagtgctctgaatacattctcttaatcctcacagctcggcaataaagtcagcattgtgactgtccccattttactgatgaggacactaacccttagagatgttaaagtgctcaagatgacatggctggtaaggggcagagcaagcattccaacccagattatgattccagagcccttatcttactgctgaactaagttgcagaatggcattcttggttccagccttggaagtaaacaccacggcatcacatgtgtgcagaagcggacaccgttgtccatcagtgcagagtgtctcctccaagggaacacagctccacttgcagatccagcctctgcctcagattctcttggtaactccaaggaggtctgatggcagctatgtcagccaatggggtgggaaggctgctctcgccccaaggaaaggattccttggctgtgaacagcacttagatcatgtcatggtaagaccatggaccttaacaggccacatgcattttcatttaccttctgaaagaagattaaggagaaaattcaattttgcctaatgcttcccccaaatggctaatttatatgctaattagcaagataagaatcgatgaaactggtaatcaatatgatagccaaggcaccagtaataaaattcatctggagatgaactgccagtggaaaggaagcaattacacagaataaatggggcagctcagggaatagtggtccatattgctcttgacagcattattccccccattaatcctcccctcacgctctccccaccccattgaaatcaactgtccactcagatctttcggggtgccacacaccagcttctccctctctagtacctaaccttgcatgatccctgtggatttgtggtccaaccaggagaaaatgaaggagggaaaattatagtctgagaagatgtacaagccctggaggagaattaggggctgaataggggcttttaagtcaaatgctgagtcatgaatagcactttactctcatacttgctgagtgtagtttaaagctttccaattctagagcttaaatatagccactctattgcctagattttccagagctgtcctgattccagacattttgtctcatcacaccatatgtcaaatgatgtgtcctatttaagtccagtgtgaagtaggccatagggtttccataagatttagtctgactcttggaagtcttatttcaaattgcccatttgttccagggctctaggtatttttcttttctgtgtgtgtgtgttaagggtgtgattacagtcatctcagaaggttagtcacacagcattattcattttggacttttcaataagacatttaaaatttgtcttttatccccattgtctgctcactggtatcatctgaggatcttttttccccaaaatgtatttatttatgaaaaaattttaaatatgaaaaagttggaagaattgggaaaaccaagattatggcatccgttcccatca

SEQ ID NO: 44131 - DNA, 1896 bp, Bovine  19866880393190
gaagcccagggaggaagccttcatccctctagctttctcaccaggtaggcaagctcatttcccatgttccctgatgaccagtcatcattggatcatctagtcaggctggaactggcttcctatctcttactgtccctagtcctgccccacagaatgatgccatttcctagcctggtacataaggaaggacccttggctcctgcttcctgctgccatcccatcatactgcctatgtagcattctctcataccagcccattcatgatcctggtttgcacagtcccctccctcgtccccggctcccctagcaacatttccacatccttgagctctcatccaagggctccctgattgcccgtcctctcttctccgtgtcaggacttacctgttgtgctgtgactgagctctttacctggtctcccactacttcatgaacttcctggagggcaggggcctggtctcatggcctttgacctgccagaacctgtcagcgtgccaggcacatgacgcgctcagaccctgctgaatgggagaatactttccaaacctttcctgagcctcaagcatggacggatctccaggctcttggatctctcacaggagataccatctagaacaaaggtcggcagactgttcctgtcaagggccaggtaataagtattttcacctgagcattttatatgatatctgttgcaaagacccctctttgctgctgtagcatgaacacagccatggctgcatatgttcaggcagcatgcacagccatgatccacgtacattgatatgcatgccaatgagtgtggctgtgtcccaataaaatttagtttacgaacataagcaatacactagatttggctcaaaggtggtagtttgccgacccctggtctaggagattctttgagatacttaatcagtttttgactatcttctcttgagagacttcatcaccacaagagcgacacctataatgtgtttggctgttctgagtattttacaaacattaactcactaaagactcatgacagccacggccactgtgaagccctccattttacaaatgggaaaggccaagcctaaagacgttaggcagctcccctaagatcacacagctaagcagtagacctgggactcatcaggcagaggccaggcccctaccaccctgctctactgtctcacagcatcccagggaggtctcaggtccatacgatgggggccgtgacttaccctctcaaccttccctaagctctttctctggatcccagctgctcagccaacacttgctcataaaatactctaaggccagctgtgccttctgcagacccaggggcccggcctccgcagggagaagtcagggtcctgcctgtacattcttgccaccctcaccccttccgggaagccccaggtcaccaagccagtgccaaaaaagggagtatgtgattactatgtccatgatgggaaaagttcgctttgcaggccagaacccagagccataaaatgtttcacatcaccgagtagagtaccattgatgtgagctgcattttagagcatctgaccccaatgtgggagctgattacaccaagcagtcagcacaaaacactcagtgttgaagccttgggacgggcccctggtactcagtgtgctggggctttcatttgttcccctcttctctctggcctttgtttaaagacacgatcctgtaatgattcattaactaacatgcagatgagtgaagctggcaaagtgtctttctaaggcaggagagtgacagcacatgaaacaggcgtgattaaagaggcacgtgtgtgcacagtcagacacccaatttgcacccattagataaatgaataaaagaacccttcgctaggatgtaattactgagcacccgccatgtgccgag

SEQ ID NO: 44132 - DNA, 1085 bp, Bovine  19866880397271
atttggcttcttgaagaacaatgggggtttgtcactgacaagaacagtggacatctcacacgattctagagcaagctccctgctggcaagctcttatagttatttccagcataacccttatctcactgcacagtgcgctgccttggggtatgtgtgtctccccagccagacagtaggtccctgagcgtagaaactgcacctcgtttcccttgcagtgttcaccagagtgcctgacacatactaggcatcacaaaaatatttttgtcccagagtgggaaggtctgaaagtaccgatcccataattacctttctccttatctgagtgcaaatgggcaaagatcatattcttgtctcttatcactggtttcaagtgtgggcccagagatgctgaaaatacatactctataaattgtctgctgaattgaaccaaattgaagaagttgctcagttggtaggcattaaggggatcttctgcaacatttggagttcatttgagtataaaaatcccaccaaaatgagctttgattctgttttagacaacatgccacagtttcagaatgatgcctttgaagtaaatcctgtttgagtaatgtttctcttggactcataaaatctttatggcaatcttttctcatctgatagactgtgaaaaggaagaagaagccagaaccactgagcaagaagtggggaatgcagtattttctcatatgtgggtcacacacttattgtaaatactttttaaatgcaaatacaatcctgactgcacattagctaaaaaatcctagctctgtccaaagtgctgaatctgtgagtactctctgattaaagagtaggtggtatggaaattatgtgtccattcagatagaaggtttaaatgtattaaaacataaatgaatagctttctgtcccccattgcaagaataaaaaagacagaaacagaaaaaataagttgataaagatgagttctcaatccagttgtgcaaaggagcactgacttgggagccatgcattaagttaacacattttttaagtgcctactgtatactaggcaggcttccttggtggtttagttggtaaagaatctg

SEQ ID NO: 44133 - DNA, 769 bp, Bovine  19866880445636
cttaaaaaagagatacagacagagtcttgaggaaaactaagcactgcttggctatttggtgatatgaaggaatcgtttaaaattttaggtgtgataacaaaacagacatggtctttaatttttagaaatcttaaaaaaatccctccaggtctctgccccccttctgagggtaagatgatcagacacgggagcatcccaagagggatgctttcaatcacaggctcctgatgtaacctgtggcctccactctgggcaggacttagactaaccccgggggatgcctgcccttgttctgatgaataatgtgttctttcggcttcctagtgatctcttgcgggaatcctgggactccaagcaatgccagagtcctgttcagtgacggcctggttttctccagctccatcgtctacgagtgtcgggaaggctactatgccacaggcctacttagccggcactgctcgggtcaatggcacctggacgggcagtgatccggagtgcacaggtgagagcctctgggctccatggcagtggggctcctccacgccagaggagaaggctgtctgctagagattgggaagactggctggcgttgagggacttgaccctgaatgaggatcatacaagtcgcctccatttactgagcacgttctgtgggactgccactgagcaaagtgctttgttttcggatcttttgatgctcaccacaatcccctccctgtgaaagtaggaaagtgaaagtcactccgtcgtgtccaactctttgcgaccc

SEQ ID NO: 44134 - DNA, 1037 bp, Bovine  19866880448816
caccagggagtgtccaggaggtagagggacatggtgctggctcctgggagagcttccaaagcattaggggaggtgagcagatgcattgaaaagtcaaacacaagcataaatgaaaacaaataaacattccagagaaacacacagtcatctgtgctggcaggtactgcggctgattcaggcatctttgacttctgccaccccatcagaagaggtctcattaagggcaggggctgtgtcatgtccctcagtctggggcaccccccgaggtggagagttagggctgctccatcacatggggctcccaaggacagggtcattctgcagaatggggtcctctggggtcagggctgtcctttccacatccagtttaggggaccctgaggtcaggggctgctgtgttgcctgccatatcataaattagagcccagagctgtttatctccttctcagcagggcatgttcctggtaagtcatccaatttacaccttcagtgcatatggcaaccgggagcatctcccaagtgggcattcccatgatacctccaagcctgaggctctgttgcggggctggcggtaattagaggtgattataattgctatgcggtattaatacatacaaaacagaagacaaatggaataatgaaaatattgtgaggtgccatgaacaaacagtaattggaataataagttacagaatgaatttatggagcgagatcgatgaggtgagagcttagggcatgagcacatctgcggtcctggataatcccattcaggaaaaactcccctcagaaccactgagctgaagacattttttccagagaagaaaagagctgctagcagccaggttgaaaccgaatctacgcagtgggagctacatgtgtgcctgcttgtatgcacaggtcagggtggccgcatgctctacggcaggggtccccagcctccagggtctaaggcctgatgggccgaggtggggctgatgtgataataaccaagtgaacaacaaatgtcatgcatttaaatcgtcccgaaaccatccccg

SEQ ID NO: 44135 - DNA, 2349 bp, Bovine  19866880454906
accccaccccagagcctccctctccccgttagagccctgagtctttcttgacaacttgttcatgctctacctcgctcccaggagaagacccaaagttccgttcaatggctacgctggccacgagaacacgaatgttcgggccacgtttgagaaccctatgtacgaccgcaacatccagcccacagacatcatggccaccgaggcggagttcacagtcagcacggtgtgcacagcggtatagcctccaggcctggctgccatcgccgccgccaccgagagccccgccccagcagccggtgagccccgcacccctgtagacgtgtccagcgtgagggggatggagtgcccgctcctgccctgtgccagccactgaggctggcacctccctacgcctgggacagggacccttgtcaccccctttacagatgggaaaactgaggcacagagaaaggaattaacttggccaagatcacaaagctagcaagaagtaggatggcaggatcagaatccaatcccaggcagggggctccaagactgtgctctgagccactgggctcagcaaaatatccaagcaggtgtattagtcagaaccctccagagagaaagagacatatatatacacaatatatgcatatgtatgtccatatatatatataaactctcaagatatgtgtgtgtatatatatatattggggtttgtattatatacatagatacagagaaagaaggagaaatttattttcaggaattgacttacaggattgtggggccagcaagtctcaagtccacatggcaggtcagcaggctggaaattgcatcaggggctgaagttgtgatcttgagaaaggcagtctggaggcagaattccttcttctcaaaggagaccacagtcctttctcttaaggccttcaactaattggtgaggcccacctagattatggagggtaatctgttttattccaagtctactgatttaaatgttaatcatatctaaaaaaaattccttcagtgcaacagctagactggtgtttgaccaggcagctggacccgagcctaggcaggttggcatatacagttacatcacctagaacatcatagacagatcgacaccatatttggcattaagcaagacagatgggcctccgttacatagacagaggggaggacacacacatggaggctcctaagggtccactggacgctgtttctcacacacacatacacatacagacgtgtgaccaggaggagctgatgaatctggaaggtgtcttctttccccgctgtgtcccttctcactgatatcccttcctctgggggctgagaacctgcaggaagggcccccacgaggtgtgccatgttgtcttccgcagacattgctttctggcggaggccgggccctctctcaggtgcctccccaaccttagcacacccagctctggagagaagcgtcccagggctccagagaggtggggttccaacaggggcacaggggtcatcaagcagagcctaggccagggacagctctgccttacaggcccccgtctgcgtcagcatttgcgatgggccgtccctggagggggcaggcgccgtgggcaagggtgtaggctgacaggactggcagggctgggaaatgccagggcagctagactagtgagagggattgtgaagtctccaccccgccctgactgcctcctcacaccagctccctgaggattttcagcacttcagccagaggcccagaccacacacgcagtcagggctgccaccctcaaacctccctgccttaagctctctgccagctgccctcgaccctccccatccctctctgggtccacttttttcctctagatcatttctgttgcttaagcctaagcttaaaagtgtaggtattaaaaaaaaaaaaaaaaagtgtaggtattaagataacttatacataaagaaataaaaattattttcagaatatataagtgaagtgaaagttgttcagtcatatccaactctttgaaaactcatggactatacagtccatggaattctccaggccagaatactggagtgggtagctgttcccttctccaggggatcttcccaacccagggattgaacccaggtcttccacattgcaggcagacactttactatctgaaacaccagggaagcccataaatttattattacgtggccattattattatatttacttctttccttctgattttgaaagaagttaaaaccatcttcctgggcccctgaaagagtagtagccccataggctcgggggatcctgtggctgacaggtaagtcggccctgcctggggaaaatgtgacattaggaagatacatagtctt

SEQ ID NO: 44136 - DNA, 642 bp, Bovine  19866880454907
tagtagccccataggctcgggggatcctgtggctgacaggtaagtcggccctgcctggggaaaatgtgacattaggaagatacatagtcttctgtgtacatttcctacctgtatccccaccctcagttcaggaagattaaaaatcaaaggtaaggatcaaggcaactaattgttttccttctctcccctttgttccttctctgctttgcctccctcctcccgccttttttctgctgccatcccccacccgctgcccctcttgttttgcaaactctggtgccacgtgtttgcacgcagttctccaggggacaggaagtaagctcccctggcacagtgcccagtgcccatcttcgtctgtctctctgcccgtgtctgctaccactgggacttgggccctcgccctgccgccatctgcccctgccaccctggagaggacgcccactctgccctgactgggggccctaaaggaagaagggccaccgcgggaggaaggaagttgtggattgaaaagagcaaaggatgttgtgggtgtgtacgtgtgtgtagggcctgaacgcacacagacccctctcctttatgtgagtcctacggaagagaccacagaagcttcaaaaagtgaattgtgtgtgaaagatgcccctg

SEQ ID NO: 44137 - DNA, 790 bp, Bovine  19866880486676
accagcccagggacctaccctctccctgcaggtgaaaaatagctcttcaggatcacagaaaggcatccccaggggagaaaggcacagaaggaatggattttacgtattttttttttttttaaaggtttaaaaagtccttcatttccaaccctgcctgggggtatgagtggggaatagaacgaactgagaagggcacccaccctcccctggggagagtccaactcttccccgggagcaagcagtgtgcagggcagatcagaggccggcccttgcccttcttgccctgcctcctccatcggcagctcacactgctgccagcaagttccagaagcaaagaagtgtgggagccgaggccgaaggctgccttcttcacctcggcggtcactccagctcttccgcccttggacgttctctgggccccaccactgggctctcagggtgagtggacaggcaagaccaggaggcgcagcttggcccagcccactggcagcttccttaatgccgtctgtgacacagcagggcagtcggggcagggggcgtcacagtgcaggaaagggctgcagagacaccacgacaatctggaaaggaaaatctcctgctaacctgcatcgctttctgatcctgcctctgcaccggggcagccctttttcctattccccatcccgaggctgagtggagtccaggacaaagcactaagtggcttgtttgttacaaaacacctggagatgccaggggggctctcggcctgtcagtcagtccaggctcccacacagtcacacacatagcgtta

SEQ ID NO: 44138 - DNA, 877 bp, Bovine  19866880524982
ctccactggaagttgggctcacattccagaggctccccgtcgctcagtgtgtagcctgagtcgcagctgaaggtcaccagggcacccacgtagaagtcattcccatgacgttgcccgttgacggggatccctggatccagacagtggtccgactgcaatgtgatagctggaaaagagagcccacggctggaacagacatgttccctgcaaccacagggggaccccagctgactcacaaagggagggagagagagtcctggctgagagaaggctggactgtcatctgcctgctcctgaaatgtggctgtcggtactgggtgagggtatctgaagacccatctgtcagggacaaccggttggctgcaatcattcgttcgttcatcatccattcagtaaacatcagcggattgacacacacggcttggattacagataggatcacgggtaagaaaacaaccctctgctcctagtgctctccgccataactttctgcagtggtctgcaaagaactcagtcaacagtctctttcagaatggatgtgtgtatacgcatgactgagtccctttgctgttcacccgagactatcgcaacattgttaatcggttacatccccatgcaaaagaaaaaagtttaaaaatataagataaaattgactttgtccgatattaatgcggatatatcagctttatcttgaccaaaaaaaaaaaaaatctctttcaattgaggcaccagcaatgaatgcaggcaatgggagagggtgaggggagtgtgaaaatgacatctcacttcaacatcaccatccatcaagcactctgttccccggggtgcccagcaggctggcgcccagtcatctgcacgcagaaggggacctttcatt

SEQ ID NO: 44139 - DNA, 7762 bp, Bovine  19866880664293
ggggaacaggaagaaagaagggaacccagacttaaagaggactcaccacctgtcatgcgctgcacccagcattctccacttgcaaattcaaaccaactttcatgttattgctatctcagaatgacccgacctgtgaactatgatctctattttataggtcaggaaacagaggctcagaaagatgacatcagttgcccagaaccatgtaactaataagaggcagaacttgattaaacccacaagtgttctgactctttcctctccacccgccaactgtatgatcaaccacgtgggtggagtgagaggcggcctgaggcaagaaagtgaagggaatggcttcagacagggttgatcccagggcacgtgaggtacccgatgtctattactgtcacaggatttagagtccagctcccctgcaacataagtgatcccctgtctgaatttaggggcccatagaatggatttgacattgaggacacagatctactcctttaccatgttgagcctcagtttcttcatctgtaaagtggggtgataatacccatttcacagaatcgatatttgatattgatgagctgacaggacaaacagcccgctgcctgacctataaatgtgctttagaatgaggttggactagatgctcagggaagaaggacatcgagttcaacaagacctgctttacgctcagtgtggcttagggcagacagctctccccacagcatgccggtcccttgggaaagcgggggaagtctaggattggccttcatactgaagcttcttttggttgggagtccatctgcacaccagctctgtctaatcacgtccttgactttcctccgcacagccttccgacacaatgagtgccccgatcctggcgtcccagtgaatggcaagcggttcggtgacagcctccagctgggcagctccatctctttcctctgtgacgaaggcttcctcgggactcagggctcggagaccatcacctgtgtcctgaaggagggcagtgtggtctggaacagcgcggtgctacggtgcgaaggtgcgtgcctgcgggcgggcggggggcggagctggcagccggagacgctgaggagggggaccgagcagcccgaaacccggtggtcctcctctcccgggactggcgaccaccctctcaccctcatcctggaatggtcgagtctttatagaacaacattgcacagaaaattgagttataaccagagattaaactggagaaacgctggatctagactgtcaggcatcaaaaaacacctcttctttcaactgggaatgctctcaataccacagcagttaggagccctgctctcagctccttcagggagtgccatcagcctgaagcagcctggcagtgctgtgagtctgcgtgtctttcaaaatgccttccactctttctgtctccacacgctgctgctgctgctgctaagtcacttcagtcgtgtccgactccacacgctaatttccctcaattccctaggacatctcccaggcttggccttggtgcctctgttaaacactgccttgatatccttgcagtcaatctccaggagactaggggcagaccagccagaaaaaaaaaaaaacacacagcttgaagcaggcacaagattgttgtgatgtctcctcagtcctgccttgccatgcagacaggttttaacgcaatttcagggaccagccatctggtctacccagcttcagttatggaacacacaaataaagtttcttgagggcaggaattatgtcagacgtgtgcaccaagcacaatgcctggcacagaacaggcccttgataaatacttgtgaacaacggactccttgaaggcagtgatggtgtctaaggaggaggcaggggctgtggctccttccttctgggagccagaaagcttcctcctctcatctcacatgatggacagagtgtgagacctaagggaactctccatacccagtccccagacccagctctgagcagcccagccagcaagagggaaggtcaggagcccaaagaatggggcgtgccttaaagggggcacagccccaagagctgacaggcgggggtggggaagggagactcccaagagtacagagcctgtggcagagggtctggcatcaaggtggggccttcaggtcagaaggacctgggctggaaccatggcaagctgccttttccctctaaatctctgttgtttattttcagctgaaaaaaaagtggggagataataagatgcacatgtaaagggcagttcccagcataggcggagcacctcgtataagtattggccatgctcttgctggttggtaagctccgtgaggttagggaaccttcctcggccttgtatccccacagctggcttatggtctgacacccgctaggtgctcagtcaacactggctgatgaaccactgaatgaatgaatgaatgaccttttaactaggctagagcctccctaatggcctccagagccctgactctcatcagactgccttgtgtcttctccctgaaacttaccccactgagtcgccccggggggtaagtgacttgacttctctgtgcctcaattgctccatctgtaaagtacaattaagaaggggagccctctcccagggtggtcgtgagcagagaggcagtgccccatcagtgttggcagcgagcgtgatgttcacctaatattaaccattccttcaccaggcccagcagagtagcggtccactttggggagcgtgtggtgggttcatccttccagatgcctgtcccgctcatgacagacaggtgccgtcctgccctcacagcccccagccccctctgccattttacccagcgagtgagctcttctggaaacagcataagcttcagtgtcagagaagcatgaaactcctgtcttcgcccccgcccagctgtggacctgatgggctgggtaactccctccctgtcagcaggggggtaaacacgagtgtctgatggtggtctttggggatgagacagagtccagggtctgggggcttgttggtctggggtctcgccttccctttaggctaggcccctcattctccatcgtgctcctcaacctcctctcttgaattttcctccggtccgtctggcccaggacatcttccctgctgtctcctgctcacctggtctctcttttctcctggctcccttgttcctcttaaaccagcagcagagaactcgatcagacactgggcctcaccatgagtacattttctttaccagttccctggagcttggtcctctttccccaccaagactgtgggaattctggggcagaagcccagaccccagcacccctgagcctgtgggggctcagtcccagtggggctgacccccctgagaggcagccttctctccaccacccaccctcctgaatcagctgctcctagaccacagttctgccggagcagtgagctactccagaccacgagtgaatgcccaagagaactcggccttcgttcgtggaccttaaagaggattactgtttgataggcagagtcttaattttgaaattacagttgtcttgttcattctgtccctggggagggaagcgcttagggttggggacagtgggcaaccagaaataaggggcactctggtggaaagaggctgacttggcaccagggaaagtctgctcggtcttcctagaattatgggcatttgatgccaccatggttttcggggacctggggagcagcagatcagagggccagggtgagagctggacaccacctaggttgcccaagtctggacttgaaaccgtggagtacactggttaagaagcccctggaatctggccctccttggcccttttccctcctgtgccaagtcttggaagaatcctgctttgtaaccagcatctttgtctttccattttttctagttttgtttttgattaagtatccccaccttgtggacaattaaacgtggaagctaatggtcttttaaaaagtcttttaatatattctgagagcctcttagcttttgagaggctgtaataggacaagggagaaaatggcttcttctcctaaatttagaaagaaggatgatcatctggctgatataaagcagaagtcagtcagcaaactttttcttaaagggccagctaggaagcgttttcagctttgagggccctacggtctcagctcaactctgccatcattatgggaaagcagctttgacaaaacagaaatgaaggggtcggctttggtccctgggctgtaatttgctgacccctgatctacagaacagaggacataagggatccgtgtatttaaaatcagaaatttcctaggaaagacttccaagtagtgaagcagctacaaaggaacatgtggttctcacccccacgctcgtctcttcctctgtcttttaagcagggaccgattcatacagcactatgatgggtgtttaaaggtgtcacctcatatcggccatgtaccagtctaggaagtaggtgttgtaattgtcccatttaaagcacaaagaagccaagtcacttgcccagggtccttccggcttgtaagtgacagaaccagaatccacatccaggttcttggctaccccgttactgtaatttccttgaattctatcactagagagaatatgatttcaaacttgtttgtcaaagacttaaaagcgtctacaaataggatgaagagcaggttttccactttccatatcccagtagaaaattaaaacaaaaggaaacatattgccaatcgcaaaagacaaagaaaacaagacccacagaagcatcataaattgacagcataaaagaagatgacagcagcaggacaaacacatcagttacgataataaaggtaattaaactccctattaggagacaaagactctcaaactgggttttcaaaactatgctgtttaaaagaaatacacaggggaaaaggagataaattatctgcagtaagtatgtattttcgtgtttaaactcatacttgatggttgtaaaaaatttaaatgctacacgagtgcaataaagttaaagtggaaatattcatttcctaggcccacatcccagagcaaaatggcctatgcattttgtgtagacacatctacatttttttttcctatctgtatgtaaaattaatgtgttaattttatgcttaaaaaaaattcttataaaaaaagaaaaatccgttctccccactcccacaacagggaactaagtgatggtgggatgtcatttgggcttctaaggaaggagggtagttattgagtttctaacagtgtttcattaaatcttctggccccttttgttgagaaaggtgtcactctctatgcatgagaaatctgcacagcagcaaggtgaactgacttgcctgagatcgcccagctagtaataatcgagcagttattatgtgctaaatattaggccatgtgctctacaaacactgttctattacgtcctcctgacgaccatgggggaggtactgttaggatccttcacagctgagcaaactgaagcacagagtgggcgcggaacttgcccaaggccacacagctcagtgagcgggaggatgagcatccaagtccaggtattttgataccggagcgatcgctttgaaccaccaaatgcagtctgtttgactccagagttcgagctccttttgtttgaccacagaatggtggaggatgagctgtgagggattcaggggctgtggggaggcgtggttggagggaatcgaggaaaaggcttccacggcttctagacagtcacacggagagccccgtgagggcagtgctcagggtgggcattctcgtgtccacccgcagtggttagaaatgcaggctctggagccagactcagttgagttcagttcagttcagtcgctcagtcgtgtccgactctttgcgaccccatgaatcgcagcacgccaggcctccctgtccatcaccaactcccagagttcacccaaactcatgtccatcaagtcggtgatgccatccagccatctcatcctctgtcgtccccttctcctcctgcccccaatcccacccagcatcagggtcttttccaatgagtcaactcttcgcatgaagtggccaaagtattggagtttcagcctcagcatcagtccttccaatgaatacacaggactggtctcctttaggatggactggttggatctccttgcagtccaagggactcacaaggagacccaaccagacttcccaggtttaaatcctggctctgccacttctctgctgtgtgtttctagactagttacctaagccctctgttcccatttcctcaacttggaaatgaggctgagaccagcacctaccctgaattctgctgtgagggtgaacacccaggaagagcagagcacacgtcaattggtggctggcgccctgtgagagctcagtgagcctgtgtttctggggtcactctactccatccccatcccatatgcccttcaccctggagcatctgaggtcaggagaggtggggcctccctcccgggggaccccagcccctcgtcagaagcccagcatgttagccatctcgtgctgccataacaacataccacaagccaggtgatgtaaacaacagaaatgtgttttctcatgtttctggctgctggaagtccaagatcaaggtgccagcagggctggccgctctctcccaattcctctctccttagctagcagatggccgccgtcttgctgtgtcctcacgcggcctttttctctgtgaacgtgcactcctggtgtctcttcttcttgtaaggacagcagtccttttggactagggcccaaccttgtgacctcatttcaccgtcattgtgtccttcaagtcccctctccaaaaccagtcacgtgggagttaagatttcagcctatgactttgcagggtcctaatgcagtattttattccttccatcaagcatttattgagcacctactctactgggcactgggataaggcaccgggtccctcttattgctgaatccttctccccgttcaaggcagaaccctctcctctttttttttttttttgtcttttccctgtatgcatgtgtgtgtgcctgtgtgcatacccttcttttcagcctaacattttgttaaaaggaagaagggatatcttctttctaagttttattttatttacttatttggctgcgctgaatcttcgatacagcacgcaggatcttggttgcataatacaggatcttttccgtgaggcacacagactctctagtcgtggtcctcaggcttggtagccgcagtgcctgggtttcactgctatgtaccatgtgggatcttagttccccggccagggatcaaacccgtgtcccctcattgcccaggggattccttaccattgggaaatcagggaagtcatcagcctaacatgtttaatggaagttttcaaacacagagagtagtatagtgaaccccatgtgcccataacccagctgcagcaattataaacccatggcctatttcatttcattcataccccagcattaccagtatctcccaccattaccctcctctgggattattgtgaagcaaatttcaggcataatatgtaatcaacattttagtgtgtatctctaatagaggaaaagaacacgctaaaatagaacttcaatactactgtctttaacattatggagatagttatttaacacaatcaagtttccttgattctctatctaatcctttctttcatagcattttaagtcagacccctggtgaggctgacgca

SEQ ID NO: 44140 - DNA, 1280 bp, Bovine  19866880738421
ctcttggagcccagattgctgttcccttagtgcctatccccaccaggagatgaaggtcagctgggtctgtacctgctcaggtcaccagtggagtgtgtctggccctagccccgtgcatacagtcactcatcaccatgacagccaaatagggtagcttgggaagctactgtcttcagtccagagatttcaaaaagtaaagcaaggcgtcagaaagtttatgaggacttgcaaaggtctacacaggccaggtgtgaatcaggggtggaactgatgttgtgcctggtgctgtgagccagcactttaagtgactggctccagataatcctcaaaacagccaaggagacccactggaccaaggaggaggctggggctcagagaagttgaataacatgtctaaggagaggaacctagtacaaggcagagccaggattcgaacccagggtttgctgactccaagcagaccccaggtgtctgactcattggctcccccacggcagtcagttaccttcataagaagccttgaagcccaaggagctgccactgccatctgtctggaagaggagccacatttgatggttggtgctgacgatgagatctgggaccgacgtacctgtcaggctgtcaggagagagagatttagaggtgtgaacccaccgtggaccccaacagaaagactgtgtgactacggcatctaaaggaacatcgaaggagccagggtcactcgggcaaatcctgggtcccagtgttgctggctcacgtgctgggagactcaggaccgctccccctctgcacaggccgagctgcttctgcaccgcggactccccctccccagaccccctgggctcaggggagagatctgtgtcctcacttgcatagggagggatggctggagccaggtccaatcaagtgggtgtctacactcccgcaacctcccatctttcatgtgaacaggactgtagggaagacacggacagaaacccatttccccaattggaacccagccactctttttaatgaggcatctccactctagcatgagaaagcgaggctttaagtgcagccccgacctagggcaacactcctttcaaaaaaacaagtttagacatggagaggattctgattcaactcgcattcaccaggcacctacccaagacagatcatttcccttccattatctcatttagtgtccccacagcccagcgaggtaggggacgtgttacccccattgtacagatgagaagacggaggtacagaatgggcagggctttcccaaggtccgc

SEQ ID NO: 44141 - DNA, 1905 bp, Bovine  19866880761161
cctaatctgatttgtgggttcacagatccagcagctacaacatgtctgtccaacctgtgaaggtgaaaaagtgtaggtttcaacaaaatccctgacaaggaaatactcaagatacattaaggaaattaaaagatctgaaaatccctggatgtggaagaatgcaaggggaatcagagggcacctgggtaaagaggatgttggcacgttcacttccatcaggcagaaggaaagaggtgcaggttgagcccagagcacaagagccatccccaccctctgggttccagagatcatgaccatcagagaaagtgtatggaggtatcaaatgtttgtttttgatgagcaggtagaggctcgaacactatctttaaggtcaggcttcaagctcaggcccttttccctcacttcttgccagggccccagaaccctctcttcttccctatgaggtctctagacccttccaccttcagaacctctcccgactcctcacctacagagctttctaagaatctcctcactgccagggccttctacctccctccttatccccgacccctctatgaccctttccatctccggacgcttcatcctctgaccggccctcatcccccaccccccataaaagcctctttctcccgtctcacctttccccgaccccctgtgataaccaccacgtcctaagtctcctccagcccagagccttgagtctcagctgcccccgcccagccacccggactcacccaccaagacacccacttcacaacagggcggaagtgctccaggactcgcgcagggaatgctgggacgcggagtccgaacagcgccaccccgtgaatggcgcttctgtgactacaactcccagaaggaaccgcgcgagcgccagagtgtggccccgccccctcctcgcttgcggtcttgcaggtgtagtcagccaatagatgcaccatctcctccggcaccggaacaaatcggaagagattattacgcatgggggcggggtctgttgtgatcccggtcctttccacaggctctggaataacggcaccgcccagggggcgggcattcaagctcaaggagcggagtctattgaagctcagagcaagagcgggtggctggggggtatattaaagcagaaacaataagaaataaggagagagggtgactagaggtgacccacctggagggcgggagagagttggacaatggtaggttcaatttccagttcacagttaagctgcgtgtctttggctcaattgtgaatctcgctgtcttcacctgtgaagtgaagataataaaagcatctgtgtcgctgagtttttgtgagacttactgggataatacacgtaaaacgattaactcagaacaggggtcttaataatacacagggaatattagctattatcatgtaaatagtggggagcttggcacttcgtgcgtgctggaagagagttaattgttatcagagtaataatcaccagaataattttaatataaatgcagttgctttgctcccttatgaatactttggagtaagagcaatctaacatgggtttgagaatgtgggttttgtagtcagacatggatccaaatcccagcccagtgacttcacagctatgtggccttgaacgaatgactgcgtctcttttggcttcaggtttttagtaggtaaaatgcaggcgatagaacctacattgcagggtattgtgaagatagatgaaataatgcagggaaagcaaggtctctgaagtcaaactgcttgtgtctgacatttcttactttcatatgcaggatgtagttggtttcactagttgtgaaacctggggcaaattacttaacctctttatgcctcagttttcttacctataaaattggaattacaatagtgtcatctacctgctaggaataaat

SEQ ID NO: 44142 - DNA, 1642 bp, Bovine  19866880780823
tagcatgcacaaaagataagatacattttcttccttgtggattagccatttttaaccaattaactctgtaaatattccacccattatcaactttgctgctactgctagctgctgctaagttgttcagtcgtgtccgactctgtgcgaccccatagacagcagcccaccaggctcccccaatccctgggattctccaggcaagaacactggagtgggatgccatttccttctccaatgagtgaaagtgaaaagtgaaagtgaagtcgctcagtcatgtccggctcttcatgaccccatggactgcagcccaccagcctcttccatccatgggattttccaggcaagagtactggagtggggtgccatcaccttctccgattatcaactttaaagccacctttattacatatatagttcaaccatttttggggtcaactttctatgctaccacagttatttttttgtctattcctgcacatgagctggacttctgaggtggtgctagtggtaaagaacctacttgctaatgcaggagacatagagatacacgttcaatccctgggtcaggaaaatcccctgcatgagggtctggcaagccattctagtattcttgcctggagaatcccatggacagaggagcctgtcaggctacagcccagtcagacaggactcaagtgacttaacacgcttgtacatgagctatactgttttaattatggtagctttgtaatatatttaatatttagtagggcaagttccctctcatttgtcttcttttaacttaagaaattcttctctcatatttattcttttagataaactcaagaattttctcaaattaagaaaaacaacaactctccgtactcccctcaaagacccaaaataatttctataattctcactgattaacattaaatatatggattgacaacagagaaaacatatatctacatgatattaagtcttcctatgtgtatatatgacatctgattccatttaataaagttgtcttttatatctcccagtaaaagtctgtacttattcctgggcattttaatattttttattgattttggcatttgggtctttgtatgcatttatttcctaacagaatattgcttgtccataagaaaatggctgtgatggtccagttcatcattatatataggtgatggatttatccctgacaaatctgagagaatctgcacacagccagtacatctaaccttcttttttctctattagatgcttccagttttttcagctttattgaggtgtaattgacaaataaacttgatttttaatgtgcatgaagccactacatctaataagacaggtcagcaagatggctgccttcaaaatgaatatgttaagtggatcgtgtttaacacacagttacaatgttacattcctatgaacactgcccctgcgtatctgtttacacagtattcaagtttctactagggcatacatgtagaactaaaatggagaagcaggtcacacagggaaggtacatcttcaactttgtcagacattgtcagtttgctcttcgaagagtaaaccaatttaatctctctaccagcaccacagactggttccaaataggaaaaggagtacgtcaaggctgtatattgtcacccgg

SEQ ID NO: 44143 - DNA, 954 bp, Bovine  19866880824453
ttgttttataatctgtatcttatctatgactatgtttctttttcattattaaaattatatatttgtggcttctttattccttgaccagtcctgcatattctgtctagaattctgtctattctattctgttatttatttttttccttttttcagtcatttttccttttatctttaaacgtatctttctcctacttcctttggattcattctattattcaagctacctaaatccttatttatttttaatctagatgatatgccagagagtaacagaggtatattaaatcttctacaatgactgtgactttattaaaattttttacatttctagcaatttttaatttattcatgctatgttatttggcacataaagttttactgtggattgattgtacattttattagtataaaagagctctctttttcatttcattatgagatgaaagaagaattttcaaatttatcttataataaagtgatttcatttttctgtggtttaccatcttctgctcattgcctccattccatttttaattgggtgatcatgtttttcatctctgttcaatctttcctcatctcagattgctctgttttcattattgcttatttttgtgtcataaatataatatcctctcaaatcctgctaagaatacaaattagaagcttttaaagtatttttttttttcctttgttgcttacagagggggcaattaagtctgactcctcagacaggtcctgtcttctgatctactaaatatttgtacatatccagttcattttcctgttagcaaatcacgacagatagagaagaatggacagtggaaagactcagtcatctctaaggtggggaagaagaattaagccagaagaggccacaacatagtaggagcctctcctggtgctaaagtgagtgtgtgtgaaggagtgtgcatgcctgtgtgtgtgtgtgtgtgt

SEQ ID NO: 44144 - DNA, 1403 bp, Bovine  19866880827585
aggctgcgggtgcactccaaggcatggggaagctataccccaaaacaaaaactaaacacgcgtgcacacagactcacagacccgctgggttcacttctaaattaggtcttgcatgtccactgccacagtaatgctgtaaagcagcgctctataatcactgccttttatttatttttctaattttatctttaattggaggataattgctttacaacattggtttggtttctgccacacatcaacatgagttagccataggtgtacatatgcccccttcctcttgaacctccctcccacctcccaccctttcccaccctttccagattgttacagagccctggattgagttccccgagtcatatagcaaatttccattggctatctattttacatatgttagtgtatatgcttccattagtcactgccttttagccaaagaaaagagattcagagaggtgaagagatgggcccaaggacacccagttaaacaatggtgatgactggatttgcacccaattctgtagggctttgttttccgggatttccccgcacttcccagggatagaggatgggatgggaatggatgtgaaaaagctcggcctgatgcttagtcaataatgtggcagggaatgcagaatccagtgggtcaaaatcactggaggggcttgactgggacacacaacacatctggagaaaaagatgagcatgttactcgactgtgaactttcttctgaaacaccagccctcccccaccctgggcttctgggtgtaaacacccagcattgctaagagaacaacctgcctccagtgaaaaggtcctggggagagatcagataccaccaccgcctgaaggcattgctgttctggctcctcaaaaggaatttggaaatgaccgactggcaaagcgtcccttgatcctcagacttgatgattctgtgcctgtctactcagcgggtgtctcggttccctggaaatggagtgttgtgctattcaaatttattcaagcatccattcaacacatgctgctgagcacctactgtgtgcccagtcctatcccaggcagtgaacaaaacagatgtccttgccctacagaggcattgctcgagcacaaggatatctattttcttgtccagtacttcccaattcataaagtgtttccatacccacagctccatttgatcttcaccttagtacaagatgggtcaggtaggagccatgagctacatttacaagtgaaaaaaaataagcccagggaaaataggggctttgctgaactgcctgtggccagctggtggcaaagctgagagcaataaccaagaactcttctttggtttgagtttttagaaaaaaaattagctaggtggaatttttgaaataactaaaaccagtcagggtgcaaggca

SEQ ID NO: 44145 - DNA, 892 bp, Bovine  19866880866233
ctataggggacatgtcctgaaaagtaatgtatacattcatggcagggaagagacatgcacagtaatattctacttcctacagttcttcacgttagaaaatgcttccaaacccacccccacatttgtgcgtcacaacattccactatagttgtggggggggctgttcatcccaagtctgctccagaggggctgagatgtagagagtttcgtgcagccagtggacgccagagctcacagccagggtcttctgattctgagtcaggtactcggtccattgtagcagactgagttataccccacaagagcgttgacctggcccagggagttgggggaagccttgtggaagaggcataatgtaagctgcctcaagggataagtaagatgtaatcaggcagagaagcagaagggtgggtagcagtagggtggtggggaagtaagcagtcgagggatgggtgtgaagcatcactggatagaaggtgatcctgggaccctccatcccgccacaggttggaagcaccgtgctcttccgttgtcagaaaggttacctgctccagggctccacctccaggacgtgcctccccaacctgacctggagcggaaccccgcccgactgtgtccgtgagtgctcccagataactcctctcagcagctcatagcctccccgacctgggcctccaggatgtgcttgaatgctctgagtgacagggagctcacagcttctcattgggaccgtagtggtctctttgcagtcctgatcccttgggtccccccacccccagaaggtatttcttcacaaatgcctttctggtatttgaaggcaattcctatgccttagcaaagaaaaagaaagaactttcccatggctgtagataccaacagtgacaaggcccac

SEQ ID NO: 44146 - DNA, 1434 bp, Bovine  19866880915763
ttcagggctgatgtaatgcttggggtcaacgggatcctttagccgattctaagaataccgccaaggattcatctgttagacttgtgagcaatactgttctcatactgggaggcggtgttgctgggtggctaagggcttggcccctggagtcaggtggatttgaactagcaaggatttgcatggattggaacttgctgctaccgtctactcactgtgtgagcctggcaagttacctaatctctgtgagctgcagtgtcttttatcttaaatggggttatggccttctctccccttggctcaaactttccatacctataaaatacagagattacagggatgagactgaatgtgtcctagggactagtttcactttgctaaatttgatgggagggctttgagtagcaggttggaaaagtaacacccagtgcagaaaagggaaaggtgggtagactcaggaaaaggaaggagaaactcaacagaaagaatcaccagttcctttgttttgtgttgttttatttttttgcaaacatggttttaatattatttttcactttcacttcattataattaataagtcaatatcatactttaatttcagtattattaatatccaacatcactataaatgttataaaggcatttaaatttttgtccatattagtttttatcttctttacactttatatattaaaaaaatgtttcaatgaccctatatcatttttgcaatcagaaaaatcaaatattgctttcacattgaaaaatatcacccccaaacctttcaccctaatacagtttttattcgggggctcatgtccagtctttacccatatatatatgtaaatatttattagctataatccaaagtgtacatataattttatgatgtactgtttgactttaaaatgtttaacattgttccttctacaggatcatatttatcactttaatgattgcattcaaaccacaccacattaaaggctataatttacctcacattattgggctgacatgtaggttgttcacattttttcctctataataaaattatgtcactgtaaacatatttgtccatgtggctcctttcttttgaattaattcctggagattacagagtcagaatatttgaatagttttgtggctgttgataagagctcattcactcccttccagaactatatcagctttactgtgcaactgacaagaaatacatatgagtttccatgaagcctcagcaatatgagttgttcgtttttccccctaggcaaatggactgccttttcacattaattctattttctctcatatgaatcctctgagcatattctttgctcatcttgggtgatgttcttgcataaattacaaaactctacttcagtattggagagttgctctttggcacatttgttgcaatatttttttcatgctatcattttc

SEQ ID NO: 44147 - DNA, 1135 bp, Bovine  19866880929139
ggtttgatccctgggttaggaagatcccctggtagaaggaaatggcaacccactccagtattcttgcctggagaattccatagacagaggaacctggcgggctacagtccatggggtcgcaaagagtcagacacgactgagtgactaacactttcacttttcagaggatacaattggatttacactttttctacaaaaacataattttacttttttaaaaaagcattaaatatgtaagtccacatcacccacccctcaaaagattaatttagacaaaatttaaggaacatccactatgtgcagtagaatatcatcaaattactatctcttataagcatatttcctgatgaataaatatgtgaataaatgaaaactctttcacacatggattcagagaagctctgcatttccagatgtttcttcagaaggaatgggtgccttataatagtcatctttcccctagagaaaatattcattcccacttcaagagggacaactcaactcctcaagtctttagaaaagcctagagccacctttctctgtatccacggtttctacattggtttcctcccccatcagaaagagaacacaggaagatcaggttacattggtgtcttgggcctgtataaattcctgggaggttctctcttctgttacgaaaagtttccctggcaaccatatttacacactcaattccctcccctcctctgattcgctggttggtataaaaattaatttgcattgaatcgctgaagcttacaagttaatcagtttaacagactcacaaaatgttagaatttggtttctagccaaagctcacttcttgcggggactgtcccctttcttttgaaatctaaattgtaattctgttcagttcaaatattttaaaacacatcaaatatgtgtgctggatatttctggctatagataaagaaaagaaaattctcctaatggcatctggtcaatattattagttaaggaagatcaagagaggaggatgtactttacttctaagttaagcgagatcagctatgataaagagctagaagagacgagtcaaggaccaagacaaagatgtctaagccctggaaatgagaattcaggcctaagactctggggatcagagctcaggacc

SEQ ID NO: 44148 - DNA, 802 bp, Bovine  19866880934736
aatttctcgttgtaatcctcaccatatgccgaaggacagagacacacgaggaaccagagaggttaagtaacttgcccaaggctgtgcatcaatacaagtggtgcagatgatccttcagccccgggtgtctgacttctgagccatatcagaaaacggcatcagaggacacagctcagatctatttccaatggtctgtgcggaaaaatttaccctgcctgaacacagaccccttaagatatactatcctcaaaaacctaagtgcttagcctggcttacagaggaggccgtgttatctaccacaagatgattcggcaacaatgaacttaaatcccagccactgctggagaatatctgcttctgaattcaatttggttcaattcgatccaatttaattcagtgcagttatcgagtgctcactattcacccagtaagggctggctacggaaggcccagagagaaaggcagagattccttttatttagttatgggaaatcataactacttgaggcatggggcattacacgaggacaggggagctgggggtgttggaagcagggttgaatgtagagaagattctaccagtttagtctaataggaagtctcaggcataatacatatgaaagaaattgggattaatgagtgcttgagggcaagactccagtgacggagaacctggctctattacttcctagtggagtcacctagggcagcttatttagctttctgagcctcagtttcctcgtctgtaagagggtaatgaaaataatacctgtactcatagaaggaaagggttaagagagat

SEQ ID NO: 44149 - DNA, 1758 bp, Bovine  19866880954754
ctagaccctggggacgggtgggacaaggaagcaagacctctgtgccaagtggggctgggtagagataagttctattaggaagtgccaaagggaccagctctgggtgtcctgtgtgcctggggcagggcttgcttggggacttgcatttcataagcaacctctgggaaaggatctggttaattgcccagggggacccagcttcagctccttctgacaattttccatcggccaagttcatcgggtctgtagctgattctaccctgctcagtgcctcttgctacctttggcagcttgctgtttccagcgtccaaacttctgccttcacccctaaccctctctacaaccccctgagacacagaaatgacaagaatcactgcttcagtttgcttctagagaaggggcccagggttaaaaccagaggtgacaactttgggactggggccgggaggaaatgaccccaaagcaggctcaaatgagtctcagagtcaaacagaaacactgttccagacccttgtttctgatttgactgtagggataggaattggcaaaacaaagcgtgagcggcctcatgggggatacatgaagtcagcagtgagaaggcatccaagggcttggaagagcacagcagagaggcgtcagtaaccagaggaggacggcagggcccttcctgattctagctgggccttctaggagggggagggggggggagggataaatggggccccaggctcctttcacattacatgacgcatctattagaaataaaggctcaaaaatgagtgaagccacaaaaaagagtgccttctgtttttcctgtcatgctggagccccatgcctggctctgcagtccttgaaactggtccacccacaccaccactggcctgtgccctgcactggacatcctcagagggacagtcagtgggggccacagggcagactcactggtaaaggtgatgttgaagcctctcttccccgtggagtggtcagtctggaactcgagacgggccacgtggccactgctggtgatggaagaggggagctggtttcctgagaaggtgcccaggacgggggcctcagccgtggccccatccttgatgaccaggaagtcaaactgaggctccacgtcgatgtcattgaaggccaagtggatgcggctctcgggccgggcgaggatgagccagacacagtggaggtggttgccgtagtcctctgggtagttgggcgacaggacgatcccagaagggctggtgaagttgaagaagcaggaaactgcaagagaagagccatggaggtcagtgagcgtccctggcgctgtgcccaggccactgagggcaggcaggggggcatgtccttagtctaaaagcaatagagagaaaaggtgactggggtttggctggactggctgggctctgagctctaggcagcagacgtgctgggttcatgctgcgtgtggtgctgggaagggtccctctggcacactgcgggcaaggcggagctgctctcctggccttcctgcccttgcggtgagccgatcccaggagtgtctgctgctctcaggccctcctgttggggaaaaaccaccatttaagctgaagtggagtcccagtgcctggttcctcttagctggtggtgatcccccagagtggtaaccagggtagagatagtgccactccatttctgtcctttaaaccttctcggtggggaaatgattgtgccttggggattctggcaactggaagctacaaaactatgctaaag

SEQ ID NO: 44150 - DNA, 1954 bp, Bovine  19866881036896
ctcattcaatttgcaatgctttatctcttcagagtctggtaatgactccacttatatccctttagtaaaaaccccagcccccagatgggtatttggggagtgggacgtttggttaggaggctgcaagagaagcagtgtttttcagcagcctgatttatgggctggcaggaaatgccagctctgccatattctgtccctgtgaccttgggccagatgcttaacctctctgatcttcaatctcctcctctctaaatctacctcccagggccagggagagaattaggagtcaattggtgcaatataataaagtgactaagaaccggcttttgactgcaatggcctgacatcaacatagaccagccggagtcctttgaccagttcacctctctgagccttggttttctcatctgcaaaacaggagagaattccctcctccatggcactgggaaatgagaagaggtgaaagcacttgctcatggagggcacttaatatgtgtttgtcaaactggaatcaacccactttgtatttctctcgaagaagccccacaaggatccctggagagagctgttcctgctcccaaccccccaccccaagaaaaggaagttcgttttgtcctgagtggggcatggatgttaagttccctgagtgcttctaaagtacaccggggctgaaactctgtggctctcaaaggaagcagtccagagaggggaggagtcacctctcgacctcagaggtcatcctgctccccaccccccgagcttgggcccccatgcccaaagtccacccaaccatatagacacgcttggtgtaagtcccaaagatattttatttgcattgttcaggatagcagccacagcctgtggattctagggaagagcaggccaggaggagcaccagaatctgaggcttccagaaagctcggaagaagcgtgctgttgcttcctgcttcattccatgggtaatgaccccgaaccccagcatcactcagcaggcacgtgccagagccagggtggaggcaggctctccaagcagccctgtttcatcaccgtggtatttccaggccgcctacccctggaccagcgtgtgccagccttcatgtgagacagtcacagcagcatcatcttttgtaagacgtgtgtccacacaaaccccgcttcacagcatgctcctctcccgactgtgtgtcccgactccccctttgcttgtgtggcactcagtgcctcaatttaccccatagaggaggccctttatctgctgggtcctcgtctcacctttccttaatattcttttgctctcagcactccattttatttttttaacttttaattttgtattggagtatagccgattaacaatgttgtgatagtttcagatagatagtaaaggagaccagccatacatattcatacatgtatccatttccctcccaaaaccccctcccgtccaggcttccacataatatcgagcagagttccctgtgctatacagtaggaccttgtaggtgatccattttaaatacagcagtgggtacatgtcgatcccaaactccctagcggtccctgcctcccacccttcccccactggtaaccagaagttcattctctaagtccgtccataccccactttaatgtccctgcaccctctgccctactcccttccccatgacccctctgaccttacctccctcatctagtcctgcagccgcactggcttccttgctgttgcgtggacaccaggtgggctcctcccacctcaggacctttgcacatactgccctttccacctgaacgctcttcctcccagatgtcaccccactcctccatgtccctcaggtgtcacctctaaggtcacattctcggtgaggacttcctgaccccctattgaaaaatatgagtgcttctttctcctctttaaaacgtctgtatttttctcagctgggattcccacacctaa

SEQ ID NO: 44151 - DNA, 1743 bp, Bovine  19866881099337
aacaacaaccatctccttctctgctccgaaaacaccgaggctttgttttacacatgtgtatatctctagggcttcagacattatggatcctcagtacatgtttgctgaaagaatgaattaatcatccatgagtaatcccacatttggaagtgattggtcctgggacaagcccaagttgtgggtaggacccaagcacccagtctcctctctcccaccagcttcttaccttgacagagaggaatggcctcactccacaggtggtagccctgggggtgccgggtacaaatggccatgctgtgtcccaccaagcggtagccggcattgcagccaaagtggatggagcctccgggctgggtgctggtctggcccagaaggaagccatggaggggagccctgggcaggctgcagtagggagctgcatggcaagatgagggtcagggaccgtgtgcagcgggaagacagaggtggcccttcttcatggcagcccccccaccctccaccccccgccttgcttctccccctccttcccatctttaccactgccaggtcaactgctagttaggacgtcgatactgaaaagcagtcaatcaatctaggacagccaaagaaacgaaaagaaatgaaaggaaaagagaagggaagagaaggaaaagaaagggggagaaggaaaggaacaacaagagaagaaagaaaaaaaggaacagttctatgaagccctgggtcacctttgggtctggaggcagcacaggttgtgcagctaagttcaggctctcaaatcctgctagctcccaaaaagacacagaaaacaatctgatgtgcttggtttcagaaagatgtgactgcagggctgaggcctctggagtcagggctgcgcttgagttccactgcccaactttccacaggtctgtgacgtgagacaaatctctcaggctcttttagctccactttcctcacctgaacgttgggattggcaatgtcttcctcataggttttgggataatttaaatgggatctcgtctgtaaagcccctagcctggtgcagggcactctgtgctccgtaaatggtccgagtcctgctttctgttgtgtagggggctggagggggagagggagttgtggcaatccaggacgtgaaacccacagtcctcgtttccccttgacatacaatttcaatttatttcattcatttatccaacagacagacatcaagtgtctcttacatgtcaggtgctgttctaagtgctgggaatacgacagtgaagagaatagacgaagaccccagcctcagagaccttgcaacacaaacctctgccagggagcctcagggggaagttctgtgaggccaggaaagagggctgaccaaaggagcacaaagaaaaagcccgttcatctgctttcagcatccctggtgcgggataagtcaggacgtagatgccaggacccttcctgtgtctgctggcctcttacgtgattacatccctcagctggtgaaactgaagttctcaaacctccccttccgaggcagatgccctcctttgcttctgctttgccgactgcatcctgtttatgtgggatccacaggtctacctcagtccccagcaagaatctcagttataaaatatacttagtcacggtgatagaggcgtgggcaaattacaagattctcctgtgtttccattaaggactcactgtttcaccatgtaattaatttactttctgcagtggcatatgtattataagtga

SEQ ID NO: 44152 - DNA, 942 bp, Bovine  19866881118476
gattttcccaacccagggattgaacccaggtctcctgcactgcagacagattctttaccacctgagccacaggggaaaccctagaatactggagtgagtagcctgtcccttctccagcagattttcccaacccaggaattgaaccagggtctcctgctttgcaggtggattctttaccaactgagctctgaaggctggtggagaaaccccttactcagcatccagaacagaagtgggggcaccacggtcctggagaagccacagttcagcccacctggctgcctggtcagcccttgtcctgtttgctccctggccttccaggggccctcctgactttctctcccttccagagtgtggggtacaaatttggaggaaccttgagcagttgtctggggtatctgatgacagaattccttccccagacttttagatatctttttctggatgcaaagctctcactgccttcccaaagcagcccgttccattattagaaacttttccttagattgccttaaactctacctctctgtgcccttagattgcaggatctgattgctgctcttagccagaattttgcctcactactggaaggtgaataccagcttggagagcctgctgtccataatggggagatgaaaaagtcagtgccctgagatttcttctccacctactactcagggctccttctccatacctgggggcccctcatatcctcgattggcctcctgtcctgatcctgtcccctccccattcagtcagctgcccccatggcctctctctagacttggtcatcatcagtctgggccccccgccaaagttgcagccttcacatgtcccactctgggagcccccatccttccagcccatgtcctgtgattccacccccaacagcccttcctcagagtcctctggtctgctgacgctgccattctcagcatctcc

SEQ ID NO: 44153 - DNA, 691 bp, Bovine  19866881130424
ccaccctaaactctctgcgacattatctcttataattttcacaaaacccataaagcacgggcatcattattaatccatgttgcagatgtggactgtggggaccagagaggtttctcatgcaatgtcatctagagttagtaagtagaagagcctgggtcaaatcccctgtgtctgattcccaaacctaggcccttaatcatcgcactccattgcctcccctgtatggtcagaacagtgagctatttttcttccagagaatcatttacatgtatatgctgtaaagctggagttgaaagctaagtctgtttttaattgggaagggataagattgcttcttgtttggctttataaataaattcagtaagtgtctgatggtgacggtttgttcatttatttattcacccaagaaatatttactgaacaccactgtgtgccgggaccactctaggccctggagatacagctggaagcagaacagccaaggtctctgttcccatcataatgcacaagcgagctacaataaagaggaaaacacgtgaactagcaagatgattacaggttgtgctatgaagggaacacaacacggaaacgtgacaaatttgatgaaaggggtgaaagggtaagcccagaagaaggtgatcaaagaagcctgtctgaggagaaggatgttggagctgaaaaccgagtgaca

SEQ ID NO: 44154 - DNA, 1072 bp, Bovine  19866881162899
ctacaatgttggacagtcagtgaccttcgaatgcctcccagggtatcaactgatgggccaccctgtcctcacatgtcaacatggcaccaaccggaactgggaccacccccctgcccaggtgtgaaggtatgttcctcagttagtcctggtgattctttttcaggacagggttcacgcatgtgcctgctccgtgggatcacccatgctaggagatcctagcaaacattgtccatcatgttttcatatggactggactgagcctatccagactgggcgcagagctctgggccaacactagggaggacctggaggagacacaggtcaaagccaaaggaatacattcttagcccttgggaacagccaacctcatgggccagatgtcccagtcagaagcaaagacactgatatgctgagaggtagagagtcaatcatggtgctttcctaaagggagaagagaagaaagcatctttctagaaaagttttgttcctctcttcataccccccaacttattccccttctcctacatgaacctagagagatctgagttgaggatatcagagagctacaggggatacttccctgggccttcattaaccagaatcagggtggaggaggaccaggagctcatgctgtccctatccatgtctgcacatctccgttcaattttcccttcctttttcttgaggagaagctggaatttgtcttgaaagggcaaggtttagcaggaggacagtatgattcaggagaaagtgccccagctctggaatcagatcaccctaggctttatctctgaactgcttcacctctctgacctccagtttcttccttggtatgatggggcttctcttcgtaagaactgagaggattccaagatggcatgtgtaaagtgcccagcacggtaactggttcaaaatccacaagttggaaaagtattaactctccatagataaagacaccttgcttgcacaactgatctattctggtgttagactataaggtcgtaatctctaaaactattaaattcccagttagattttcaaattttcaaaatcatacccatgcataatcagt

SEQ ID NO: 44155 - DNA, 907 bp, Bovine  19866881198887
acttctgcagcaaagggaaaacacttcgtagagcattgaagactttcctgtgctcagaggtcagccgactggtacagaactgcctctaccacccggcgcttttatggaaatgttgatggggctcccagctgtattccaagagcattttcatggagaatcgtgggttccctgggcaaattcttacaacactcaactgccttttgagctgtcaccaaagtattcattcccactcaatgagcaatttttgccctggctgaaacacttgctgaaatgatttcataaatcatcttttccttgttttcaaacactcacgaatcaaagccaccatcaaattcaacatccattccttaattcacccacggcttctattttctagctaaaacccattacttccttagactcctcacttactttttacttccattaccaccctgggcagttggctctattttgggaaatgctttttcacaataaaataaagattttcatcacttcaaaggaattgctgcataaacccaagaagagaaccccagagagccagagatgtccagtggtcatctagatttgctcactagctgagtgtctcccttccgtgcaattcaaatctaagcctcggcatcattaagaaagatggcccaaatcaaagttcactttatggagactgagtcttcgaggatttgcagccataaggacagtcagctcccatgactgtggttgagatgtgcaggtgggaccaaggttggcctggagttgagatctagaaggtttcatggctagcagactggctggagtctggggtcaagatgagagatccaaagtgtaacttaatgaaccagggaatccctgggagttcaggaacccttgtaggcttcctatcctataaaatccagatctgaataattttttc

SEQ ID NO: 44156 - DNA, 705 bp, Bovine  19866881206410
cagccaggaagactccagccgttgttcagataactcaagttatgaggaacccttgtcccccatctcagccagctcgtccacctcccgccagcaacaaggcctgcgggacctggagctccctgacatgcacatgcgggacctggcaggcatgggacaccacttcctgtcaagtgagcccaccaagtggaacgtggacgatgtctacgaattcatccgctctctgccaggctgccaggaaatcacaggggagttccatggccaggagatcgatgggcaagctctgctgctgctcaatgaggaccacctgatgagtgccataaacatcaagctggggcccaccctcaagatctacatgtgcatcagcatgctcaaggagcagggccggtggagggaagggccccccccgctgtggggcgtggctggggaaaggaggtctcgggacctccttggtggctctcaggggcctttctttctgtgggaggggcagagaggtaggtggcacagaagatggggctttatgcttgtaaatatttgatagcactggcttcctccaaagtcccacgactctagccccgcttttcttcctctctttctgtcccccattttccagggggtatgtggtcagggcttccaagctgagttgggtcacttcccagggcagcccgtcgggcctggagagaggcttcggaagccctcgcctgcctt

SEQ ID NO: 44157 - DNA, 1047 bp, Bovine  19866881231309
cgggcaacttgggtcaccaggtaactgcttctgtgtgtgatgggcaatttggcaggatgatttatggggactcaaatggttacagtattgccctttgacccagggaattgtacctctggaaagttctcctcaagaaacaagcatggccaggtacaacattctgcttataaggatgtgtcagaacactgtacttaagaggggaatgaagaggcctgaggcttgggacccttcagtagaagaatgtgaccatttgtctggtggccctcagctctggcaagttcctgtgcagtgagaagggctttgcaaccagggcactatgaaggatgggccttcaaagctatctttgtcttccagaggattcacgtcttcctgtggccctacagtaagtcaagaagtgacttacagagactgtgctggacaggggtattccatgaagtctcgctccctatcaaatttctcttctttatctgtcccttacagaaatcactaactaaatgcctactggtattggtcgcttacatggaactgcttcttttgacaggcaaggctgaaatgaagtgtctttaacctttttttcctggctctacaagcgggagaagccctactggaattgcaggcagagggtttcaggaaaaaaaaccctctgtaaggatacaacctaatctcaacactttaagaaagatcttttatataaattattgcttgtgatctttacttgaagagtagtcacaggagctattatcccacttttggtgaagaaattgaggcttggagagaggggaagagacctgtccaagaccacagggctagggtgccaagagtcaaaactagacatcagatttgctcaagctgtttcctctggggaatgtgttttgcaaaccccagcccttggtggaacaattatccacatgcatataactcaatacctgtatataaaagtcttgcctctcactcccagcctggggggtcggtttgggtctgagtctggccaggtgggaatcagagtgccctcctctttggggtggctgggcagctctaaaagccctc

SEQ ID NO: 44158 - DNA, 1983 bp, Bovine  19866881276828
ggtcgcaggatgggtactgaggagaatgattgacagagatactgatgaggaattgcagaaggagcttattcctgcctctacagccccaccctcacggtgggcctctgggacaaaggacgacctgctgccaagtgatcatccactttgttcccctgcagcttccttgacccctccccctcctcagaaaggtctcaacccaccgcaggaggctgctccagcccagctccagaaaacccctgactcctgccatcacttcctctttaaaacaggaaatgactggcctttgctgactcctctgcactccttgaagttgctggagaaggggcaggcaaggagcgggagaaggcaagttattttctggagcgtcacaacacctgcacggagggtgactggcatccccacttgacatatgagaaaacagactcaacaaaggttaaggatctagtccacagccatgcacagagtcagaaagggagctgattcctaaccagatcttacctatccgaactcaggtctctgctggccaaggagtcggtctgtgtggcttttagtgaatgctgcagggtaaggtggacattctcccaccagaggaagggatgtcagcttagagtcatcaagtaataacctgttctcgggcacacctggcctgttcttagctctaaccaagagtccaaaaggcctcctgggttctgctaatctagtttaggcaggagacactgggacctaggaactgctttggagaggggagatcatcatcaactgtgttgataaaatgtttgtaaaaatggtttgaaaaaatggttactgtgtaagccatcagagttggcttacagaactgttgtcccacctgaaaacagtggaggctgttaaaaattgaaggtctatgagaacattacagaaatggttcaggagacccggagggaaatcccaccctctccgggcctctagttttcagctgttaagacaatatctcagggacttccagcagataacttccccaactctgcacctatttcccggagggaaccacctttcctggaaggcctgatgacttcatgctcccattcggaacatgcatctttctctattgaggatgaagagtctggacagcagccacggataaggaaatttatctcccagacactatggctaaacagccgtgggtcccatggcgagtaaatttttttttttttttttttaatgaatctggattctccaggagaaagggccacaaggacactgtggagtaatgtattttattatcgcattgcttaaatatgtacaaaccctgccgagagcgggggaggtgaaccggatgccactgtgtttctccatctggggctcctgcccagcggcagctctatttggcctgtgggcccgtcctgactttccagctgctgacctcactgactgactcacagatgctctgggtccttagacagttacgttccctttttgggcctcagtcccccccctttttttaagtggggggtatgaggaaggggctaaaacatctcttcgggggtggggcctctgctgaactcagtaaggtcagaagtgaaaggtttccagggagctggtggtgcctgggtcgctgtacaaagttggggaagggatggaccgcccgcctcggagaggcactccccccaaggccgggcctcctccagccccctgtcccccatccccgcagccaggcaggttttcatgcagtctttccgtcccctccagcgccactccgcttgcagaaggggccccgccagcgtctgggacctccggggctcagtgcaccgctagcgacgtagcaaggcatactccttgggcgcccagagcaggcgcgggcggcggatctcggcccggcggcctatgtcggggctccagcagaactcgggcgacagcagcttggcgggcttgtgcagccagaagaacttgttgaggtggctctcgtcgtgccagcgcgcctccaggccgcgcgcgcggtcccgc

SEQ ID NO: 44159 - DNA, 1622 bp, Bovine  19866881287972
atgtgggagaaatatctgtgttttgatagcttctgtggagctttctgctactcacagccaatcacaacctaatgactgtgggttctgaagaaaggctttcattaccatagaaaaattcatcagctcttgaccctcaggataaagttcagtttcttggcatggaaaccctagacttttcatgacctgcttttggcccttcccacctagtcagagcccctctgcaatcctctgctccaggactgcttccctattcctcctcagagcactggctcctgaggggtgaccttggcttcctcaaccctccgccttgggttcctaatgccctggggcagcctgactcttagctccaagaaaggaggggaattccctttcccctggcatggactgcatggtgactcctgcaggggtcttgctgagggcccagggcggggctggagaactggttcttggcgggggagaaggggaggccggtggaagggctggcttgaaccctcaagaattcaagcagagagatcttcagcatctttgcgaaatgctttcgaggagtttgggtaagaaagcccaagggcaaagactgagaaggttcagaggttgtggaactttggccagtacctcaagttgaattttggtggctctgagagtagtaagccctttcatgcattcattcactcgttggttgatggatttattcaactgttaatatgcccttgccaagtactgggctttgaagaagcaacagagccaagacaaatgtgaataccaccccaagacctcactgcctagaggaggagacacatgggtccatggggaacacagcgcagggtggtgagtgctgacgtcagggcagctggggatgcagcaggtgcgaagggcacaaagtcccatccagaggagggagcacgctttgtcttcacagaggaaggcatgtggggacccatagctagctctaggggaagggggatgccaagatatgctgggaagtgaggacaactgtggaaaggaaagggatctgggtgaggacctgcaggaggccctgaaagggtccctctagagccgcccactcacgaggaatgagttgcaggggcgattagggaaaacctctctgatcaccagccggcatcttgcacggggcccagcatagaacacacaggagtaaatgtttgctgaatgaataagtgagtgaacaaatgggccagcacagaggttcctgacatttgcacgagagagtgacggctgcctggagagttctttctcagttctccgggtctacacagggaagagtgacagggctaatccccaaggagtgagtaatcgaaacactgttctcttcggcttttgaagttcatgaaacgcgctctccctctccctcccaccttgctcgttctctcctgcctgccttttacttcttttctagcacaggtggattaatttcctgatcaaatgcggtgaggatcgtaggcaaattgcctcacatggcctgatttcataccgagaagctgtgaaaggaaggcaggtgtatgcaggtagggggcaccgactcaggcctgggtttcagttccaaccatgaaaatttcatcagccacatccttttggaggctaagctggaaggtcctaacaggagg

SEQ ID NO: 44160 - DNA, 2028 bp, Bovine  19866881342740
tttcttatttttatcctgcgctaagaatagttcgactaggttaaacagacaaggattctgccttttggaggagtgaagaccttggtcaatattgatctggacaaacaagttaacattcagctcaagggagaaaagtgtattcaaggtaccatctaaaaccaggatgaaaaaagctgaactaggtagagggcttggggcttgatgggtttgggggaagacagattgaaggaaccttccatgaagttcctcgggcaagggtccaattttaagcatgctgtgaaatgtcaaagtactgaaccccaagtaaacattttaatatagatctgcctatgcaaagactggctgcttgggatcactgcattaagatatgtgtgtgttctatttctccaccaaggaagccaccaggcagagatgaggttatctatgctgtttctgcaggtcctgtgcttccaatcaagcctcttatccagttctcagcttcacactcaatctgatccttggctgaccacagtctccttcctccatggacagcgctgcctaagttctccccataggcctgccagccttgctctgaaaggcctgacagagagctccaaagagtgtgaggggagcctccgcggaaccgcatgagggacctcctcgtctccacttcaaacagtacctctcatgagctgcttcactgtgagaaacaacttttatctcctcacttttgtaactctcttcccaccccttcccagggccattgtctaccaccaccaactgtgtgagctgaggctgcttttaaactggaacttcctaaaaaagaaaaaaagagaaagaaagaaaaagccatttctttattgcaacaagcctactgccagtaagcataactcagtgtgtatatgtgtacacactttggaaaacgatttcagtataattattaaagcaatttttgcacaaaatttataggaagatgctcttatttcatgttaaagatccaaaatccaccacagaggaggaatttacaaggcctaattatataggatggaggaatcaaagtaaactcattttaggaaaggtttataactggctttcttactagtagtcctagcgtacaataaaccaggataaatcttttttgttaaaaaaaagttaaccatgacatacatcttcagtactcagacttctataattcagctgtaatgaacttcagagctgagcaggagttacctgagagatgtgattaatgagattttaaaataattctttggagagatagtcataccaccaagttaagaaaaattcatttcaatgtttatagtctcctttgaaaaaaaatttttggacagttttgacttttctatagggacggaaattttctactttggattcagtgtttctaaattgtaaaggtgtttaggaagtgaaaagaaaatctttccttaacaatccatgaataactaggaggactgagttaactatgcaatcaattaagtttctttgcttttaaattttaaatacgtgaaaaaacaaatacgtatttttaaaaatgagtaaatgttaagatagaaagcttagtatttaaattaaaatcctgtttttacatggcagctatttccttccaattagagcctagatgaatattccctaggttcaagcccttaccagtgcttgacctttctcggtaacagccccacttagtgattttctggcatttgcttgaacacctctaatgacaaaggaactcactacctctgaagtagtttgtccccaacttggacagttcaagaagttcttccttacaatgagccaaaaatccatctgttaatttctatctacttatcctggttctattccttaagaccacacagaacaaggccaatcatacttgcacaatgggtaaaaacacagccttagacttggcttagagactggtctctatcactcaaggattagcagcatgtccttatctgtctctgagcctcggtttctccagctagaaaatatagatgataagacgacaactctatagccctgctatgagggcta

SEQ ID NO: 44161 - DNA, 1690 bp, Bovine  19866881358845
ctggataactgtcacctgactgccctgaatggatttctcactgagtttccagacaatggctgagatcagatggaagggactagataaaattccagggaagaaatccttgggcccaggaaggcaacatgggtgtgtctctttgctcactgaaggccactgatgcaccagttagaacaggcaggcatggtgacgcatgacatgcaggatcttctttcctcttgcagggatgggccacagaagacagccccacagcttggagccttcagccggagctttgccaagaagacaatgtacagctcatccaaccaggtgctgctccagttccaccacgagtcagccatgggcgggatcttcgccatagctttctctggtcagtatgaaagcctggtccaggaaggacgagagggccagacttttcagtccaggctgggcttgcctcctggctcctgcatttgccaatttggggtttggggacgagtgacatagcttctccatctcagtgtcctcagaagaaacaaagtgttagtcgctcagttgtttctgactctttgctacttcatagactgtagcctgccaggctcttctgtccatggtattctccaggcaagaacactggagtgggtggccacttccttctccagcggatcttcctgaccctgcgatcaaacctgggtctcctgcattgcaggcagattctttactgtctgagccacaagggaagcccctatgtttatttcctagatttttcactgtaaaaatgagatagacagcattatcttgcaatcctgcttgaatagccctgaaccacgaggctgactctcttctgtaagtcactaggttaaaccactggaaactggcatttccatgtattaaaaggagtcaaatgtcagaagcttcccaagggtcagccttatagcctagcccctggattcttttctggatgattctagacataaagatgagaacagtgggggacagcagagctgtctgcttttgtccatgctgctcacacctcttcccgcgttgggtaacctgcagagaagtgaggcactggcttctagaaattacagccctctggcgggggaaaccctatttcagatttttcaaatcagcattatatttccttttaaaattctttcggtgtagaaggcagtaaggttctagtgcttcccaggtggaactagtggtaaagaacctgcttaccaatgcaggagacatgagatgagggttcagtccccgggtttgcaagatcccctggaggaaggcatggtaacccactccagtattcttgcctgaagaatcccatggacagaggaacctggtggactatagtccatggggtcacaaagagttggacacgactgaagcgatttagcatgcacacacacagagagggggtaaaagaagcactggcggggatcgggaactcgaggatagaaaggaaacgtctcacacttatggtggatgagaaaaatcacaattgggaaaccgtaccttggctatcatatgtgtaaaatagccctgaagtgtggataagggtattttgtatttgtagctggatcactcaggttatacttttccatgcttatcacctgggagaggcaggtaaccaagctccattcacaggtatgaactcggaagtcatgctcttctcttctgcctcccaaagacagactgagggctacccata

SEQ ID NO: 44162 - DNA, 810 bp, Bovine  19866881458574
ctgcggaaggcgaggaagagactattgctgctgctttcgatgcggccgggaagctgggagccgtagaagcttcctatgagggggctgagagagtcccgtccgtcgtagatatggaggaagtcgtagccaggctccaagttaaagctggggaacaaacacatcccaaccccaccccgctgaggtcacataaaggctggtacccagcctcgggctcaaccaaaggacagggcccccaacacagcaagtcctccagcccccaggcacccaatccctgagacctcctggccccgcccgacctcccagtgagagagaagatggacaaggcaggcttggacagagcgccagattctagcatcagggtccagaaagctggagccaaaagcctaacaccctcttttttttttttaaaaaaaagaaggtgttttaaaaaattgaactatatttgacatggcatataaatttgaggggtacaacatgctgattgactacatttatatattgttatatgatttcctttgtagtgataattagcacctctgtcacatcatataattatcgtttctttttagcggttggaataattaagatctagcctattaccaagtttgatgattataacaacactgttgtctatattcactacactgtgcacagaagggaaaatcagttatcagctctacacatcaagtggtcagaacccacagagcaggcccagaagccaggcctcttacctgcctctactattctttacactgtcctaagctgcacccgcttctctgaggggtgagagccacccagggacgccattca

SEQ ID NO: 44163 - DNA, 1480 bp, Bovine  19866880430142
tatttaataaaagatatttggttgactctacagaattaatgttctctaacagtgcctttgttttgagcaagatttattctctttcatattaaaaaaattggaattaatacgctctttctgaacagttcaatttaattactactttaaaattcaaagagaaacatcattaaatattaataggtcaatctgcagaaacaaatttcactgcaagtttgacttaggtaaatgggaatttgagaaagtatgacagagattaagaagtaatagaactaagaagcagtttgcattttctagatctccatttacttatttacaaaaatctgagtcttaggattatgattcctaacaattctataggtctgtgttcgtggtcagtaagaaaaagagctataaaagccatgcaggtgatattagtgagagaggtggtctggtatgatcttcagaagggagtgatggagacgaaggcaaactgcacagacagacctgctttgtgtaagtgggcagacattatgggagttgagttgaacatgtgacgcaggatgtctagaatgtctttttaaaggaaattagaaatttatatttttgtgatctcttctattaaaaatactgttttgattttaagcataatacatgccaagctaaggtctacatgctaaataaagcctcaggcttcaagtttgcaatttttcatctctaccaagtatccatgagcagtcaatcatcaattgcaattgaccgacagaatcaaccaccacccagtgcttcccagtccccaaagcattaggctcatttggagcacattttacatcagcaggacctacagtccacctgcagagactctgattcagtcagtcctgggttggcatctggcattagtaggctttaaaactccaggggtgattctaatgtgcaactagtttgagaactgctatctcaaggaaacatttccacccccccccatggatgccagaacctcttctggctcccatgactcctggggtccccaggggcttgtgtgagaccttcttcttataaactttgcctttgccatcgttctggagcttttattggtgatgagatgctgaagtcacaaatctctccttttttcaagaatgtcactgattttgctcaagagtggttcacagcaatgctgtccccaacctcatccacactccattgtttcagggtttcattttcctaccagctgcagagagggaaggagagaatcaaggaagatatcctcccactatttttcaattttatgctgcctaaacaatattcataacaaacccagtgggaaatctctcatttactgtcacagtttttctactgtttgggtgtactttttatatttttgctccctcaaagaattgaaaacaaattaaattcagcaaaatagaagatccagggaatacaggaaataattactcctgccaagcatgagtatttagcacctgcatgtttgggaaacattcaaatt

SEQ ID NO: 44164 - DNA, 1508 bp, Bovine  19866881106014
agcaccagtcggctttcaatgggtttacacagggtttcaatgggttttcaatttttccttaaactcccatcaataagaataaacatggatgccagtactcagaaaccatcatgtttcatctaaaaagctcttctctgtcactgtacccacagtcagtgacttatttcctgggcaaaaaaacaaatgttttggttcaggcagaaattgctgaggtaagtcctcttcatcagcttgataaagaagtgaaacgttagcttgtagctctcaggcggccacgctcatagacctgtgcttaattttatatatgtgtcttgtgtccttgctcagagatatcttcatctaagtccttttgataaacagtggtgtgggagaaaggcagaggatgtctgcgtgacagggtggcccaggtcagcaaattaatgttcctccttggggccagagctggctgggagaaggattggctctgaccttgagggttttacaccagaggtggtccagcagacaggaaacagaggaaacagtagcgattttgattgagttattggatgcattcactttcctgtgcaacccatccatgtgattggctgaatgtctttaatttgcaaacacttatggagatatcacatctttgtcacatctctataaacctgtggtgtgactgccctgtcacatactcaaggggtctggcatgtgcacaagatcagttgtgtccaactctttgatactccatggactgtagcgccccgccctccccaggctcttctctccatgagatttcccaggcaaacccatgtaaatgcatcctgatgtgcaagaatctttggttaagatttcattcacagctacttccctggtggtccactagctaagactcagctcccaatggaggggacctgggtttaatccttggtcagggaactagatcgcacattccacaactaaaagttcacaggccacatctaaagtccccacatgccacaactaagatccagtgcagccaaaaaagcaactatattaaaaaaagatttcattcacaatttcttatacctatgcagttctttcaactttccaaaccccatatgcaacactgcagtcaccctctggctccagctagtttcttttcccatttcctttcaggcaaaaattaatgacagattaggcaaagttaaattgccttggaaaatcatctctcttcaattctgcaaatggaagggagtctgtggttgggtgaaggcagtgaagtacagtaaacagtaaaagatcagagcagcaccggccatctaaatggcgaggccctggggaaaaggaaaatgcaagctttttgtcaaaaaattattagaaagtatgaaatggtgaccacagcctcttaaaccaaacatgccttttgtgactgccccatcacatgcccaagggttctggtgtgtgtgcagctcagttgtgtccaactcattgccaccccatggactgtagcccaccaggctcctctgtccatgggggttttcaaggca

SEQ ID NO: 44165 - DNA, 831 bp, Bovine  19866881336214
cataattaaaggatacgtttatattgtactttttatactcaaagtattggttaatccatatgttattcctacaagataaaagcatactgcactttgccccagagagaggtgttcttaaaaactctcttaatcaagatatggagatttgcatctacttgattatctacagcactgcagaaattatgaaactcagatacatttgtgtaaatgcatacatattcatttattaaaagtgccaatcaaaatatgagaagcaaaaacataagctatagtgaacatatggtgagttatttggtttttgtttgtttgttttgtgtatcatcagcattcattaatttcctgtgaagaaaaaaaaaaaatcctggatttcctttgaataagatgggcttcccttgtgactgagctggtaaagaatccttctgcaatgcaggagacctgggtttgattcctgggttggatagatcccctggaggagaaaaaggctacccactccagtaatctggcaaggagaactccatgaaccgtattgtccatggaatcgtaaagaatcagacacgacagcaactttcacttcacttcactttactcctcaatccaagctatgcttgcagctccagagcatcaccaattacatcaccaattacacggctgcagttatcaattccagagattaaattgccaacatctgctggatcatcgaaaaagcaagagagttccagaaaaacatctatttctgctttattgaccatgccaaagcctttgactgtgtggatcacaataaactggaaaattctgaaagagatgggaataccaggaccccctgacctgcct

SEQ ID NO: 44166 - DNA, 4305 bp, Bovine  19866880546157
aatgtacatctatatttttgtgcctgtgctttttgagaagatcaatccctagaactgcagcagtgattagttcattacactttatgttttacatacaataccgtgttcgtgtgctggtcgtccagtcatgtctgcttcctggtgaccccacagactgtagcccaccaggctcctctgtccacgggattctccaggcaagaataccagagtgggcggccattcccatactgccttctaaaatggctttctacctatttaccctcccaacgtatgaaaatacgtcacatctgtagcagtactggggatactatccataatgggtgtgctggtttgtgctggtggtaagaacttttaaaatttccatttatctgatcattagtgcaattaagattttccttgactgttttcttcatttagagttgctgtcatactgtgtattttatctgactttgtcagactgtgtctcttacttgctgctttacaacagcatttcttttttaacttcttgttttgcattggggtatagccaatgaacaatctgatagtttcaggtggacagcaaagggactcagccatacatatacatgtatccattctcccctgaactcccctcccatccaggctgccacataaagcaacagcactttttataaggactatatcctttgtaatgtatgtataaaatacctgtcatgtgtcttttcactttgcatacagtgtcttataccatggaaaagtttaaattttttacatggtcctacctaacactgtccctcttcataacttctggactctgtgtcctgcttactaaagcctacctcaaggtagatagaactcaaggggatagaaatattctacattctcttctaagaaatttaatattgtgtttcctatcatatctttaatctatatggaatgaacttctctgtaaggggtgaaatgtggatctgactttatttccagctggataattgtcaagcaccatttaagtaatctatctcccccactgacacatgaaaaataattacttttgcaagtaactaaattcatggggatacatttttcaaaaatttccttgtgatgctttcctatttaccattctacattgattttcaaaacaaaattgtcagtggaaaattatcctaaaagaattgtgactggaattgactgaatgtacagacatgtttatagtactaaaagttccttctagaaacatggatctccatttattcataacttctgttctccttaacagaggttagaagtactccaaaataatccatttcaattatttttttctgtactctagaacagcttaattatgactccttgaaggttcagcattaatctgtgaaaccaggtgtcttaaaaaagggctagactattcaagttcttccattttaaatattaggaatttttgctttttgcctttactaaatacagacttgcattattcccagttattttctaattcttttgttccagtcttatccagagttctagatacttcctaaaacatactctatgtattaggtcatgttgacttttctcaccaacaaaggaatacagtcatatatgtggtggtataaagctttaaacgtgttaatgtttaagctttaacacatgctaatcctcatcattcacattaagtttcagttttaaaaaccgttatgatctccaagtacatatactgtcttccagagttcactgcttaaaaacagctttcaagcagactctgaaggacactgaactatcattatagagcatttagtctgggtcaggcactgtgctaagcacttggtatgcatcaagtagtttaaattttcacaccaagggttttaagagagtcatataattacatttacatttgaacagaccactgggagtagtgtaaagaatgaacttggaggagacaaaagaggatgcagagagaccagtggttagacaattggaatagtccagatgagatgactacgttttggattagggcaatgaggatggaaagatgtggatgaattccagaaatactcagcagacatatccctaggacttggtgatgcagggggtggggaagagctgagggcttgagatgactctgtagcatgaattttatgatgatgagcaaggtgtgcgctttgtctgaagacttctccgcattctttacattcgtaagatctctctccagtgtggattcttctatgtagattaaggtgtccaatctggctgaaggttttcctacattccttacactgatatggtttttctccagaatgaattctctgatgaacagtaagcgactgtcgatggctaaaggctttaccgcatgcactacattcgtaaggtttctcccctgtatgacatctttgatggcaagtaagtgatgattttgttctgaatgccttctcacattcaacacatgcatagggcttctggcctgtgtgaagtctcagatgctgagcacgggatgagctgtcactaaaagccttcccacattcagtgcattcatagggcttctctcctgtgtgaactctctgatgttggataaggcgggtagcctggctgaaggctttaccacattcagtacaatcgtaaggtttctctccagtatgaattttatggtgctgtgcgagatgtgccctctggttgaaggctttcccgcattccttacattcataaggtttctctccagtatgaattctctgatgagtagccagctgtgaactgatgctaaaagcttttccacattccttacattcatagggtttttctccagtatggatcctcagatggctagcaaggtgtatgctctgcctgaaagcttttccacattccctgcattggtaaggcttctctccagaatgcactctttggtgctgggtgagtgaggcatgatggctgaaggctttcccacagatgtcacattcatatggtttctctcctgtgtgaattctctgatggacggtcagggatgagccgtagctgaaggttttcccacacacattacatttgtagggtttctctccagtatgaatcctcctgtgctgaataagtcctatgtgatcgctgaaggccttgccacagtcgatgcagtcaaagggtttctccccagtgtgataatatctccagtgacggataagcgatgtgttctgcctgaaagctttcccacattcaatacattcgtacggtcttttgccagtgtgacacctctgatgtcgggcaaaggacgagccatcactgaaggccttgccacattccttacatttataaggcttctccccagtatgaattctctgatgctgagcaaggtgtgcaggctggctgaaggcttttctacactccttacatttatatggtttttctccagtatgaattctttgatgttgaataagatgtacattttggctgaaggctttcctacattccttacattcaaatagtttttctccggtgtgtattctgtggtgctggacaaggtgttgactctggttgaaggccttcccacagtccttacactcatatggtttctctccagtatgaattctctgatgaacagtaagagatgagctctgggtgaaggttttctcacattcattacatttaaaaagtttctttcctgcatatactttcttgtgttttaataccatggaatttctggaaaagtttttttcatctgacttgtgattatcataaatattctcttccaaactgtgtagaggaacaaatttctcaggtttgttatatctgtggtctatttccacagtgaggttttctttaagagcgcttctttcttgcctgataaatgtctcttggcttaacaactgcctctcaaagagatcttcacatttccaattttctccaaaaataggacactcccgttcatagcttgcaattctctccattaacgtatcatcacatacacactgcttcagagctaattcttgtgtctcatgtatagattcccaatctgaaagattcaaaaaaccaaatgtttcctttatcatgggctataacaaaggaaacatttaacacagaagaggtgatttgaaaataatacactccacaaaatatattatgcacaggcatttcaactgaaaaaaatatgtaagcagaccccagagaatgagagctcacagaagaacatagaaatggcaatttagaaagttaaatgtcggataacagcgtcctgaaggtgtgggtggcagtggcagtaatattttacgcctgtattaacctaacaggctatacatgaaaccctgttcctctgtcctctccctcttcatgcctgtattaacctaacaggttata

SEQ ID NO: 44167 - DNA, 1114 bp, Bovine  19866880957131
gtgtgcacaactgggtgtgtttctctagtgagagctgtaggtgttttgtgatgcactgcattatcacatttgaaatgctccctctttaacttaatagtggttaaaattactattactttgtcttttagggggtatggtaagttaacaactgtctttaatacttagtgatgttatcaagagctgttatgtaatcttttgttgttcctgattgttctctgtaatggcatacatttaagttgtacttttgcaaaatcaccataaaacttctttactgcttttattacatttctgtgtaattttagagtaccaatacagtgagcatcaaatatatttttatatatacctaattgatacagctggaacactgagcattcagttgcataatttgggaaaaagcacataaaaattgagcctaacccatgtttctgcctcctcctcgaggccttttttcactgctccagtctgtcctgattttccacactgagaaatgctctagcatgtagtttgagtactgaattatttcacatttgattgtttacagtgttctcttcttgccaattttcactttatcttttctccatcagttcagtctctgaaattgtgtactttccatgacagagtatcaagactaagcacagagaagtcatgttgcacagaccccaagatcctgacaggaaatttcactatatgcagtatttctaagaacacaggccatttaactttttaaactatactcatgtgagggtaagaacaccagtcgagcaggaacgtgtctgtgtcatttcaggatctggtgacatttagggacgtggctgtcaatttctcgcaagaggagtgggaatggctgaaccctgctcagaggagtctgtacaggacggtgatgctggacaactacaggagcctggtatcgctgggtgaggaagtctccctgtaaggcggaatccgcacggaggctgctttccagtgccacgtttggggagcctctgctgcacctcactactgctcccccagatgagtgtagctctgtggagttggcagcttggttggatgttcatgcagctccgtctccccacccccagaactcgtcaccttgccctcagctccctccccttcc

SEQ ID NO: 44168 - DNA, 1062 bp, Bovine  19866881237098
tcttctctggtttccttctattctcctgtcggtgactctggcatcttcgtcagtgttcagtcctcctaggtggtctcttctgcctcaccctcacctgtccttacttactctcttctccatccttctcccgctctctccttaggttcccagaaaactcaaacctctgtactcttctgtagtttttggtctttttcttctgtttctactataatgatgtttctctctgagtaaaaatagtagagggccttttacatttcttttagattgggaggagcaatcagaaaccaaagatctaactccagagcaaagcctgcctgtagaaaaatcatcttcaggggcaggaatagaggatttggaggcaggtgattcctggtatacccacacaggagagtcttctgatgatcccctggagtcgcaacaggtcaagccagcggaagttttgagtcccacagaaatgagtgacccgaagacccttaatcaggaaggaagccacgagggtgatcaactagagaaaagcttggaacttaacaaaccatcggagagtcttcctggaaaggatccccaggagcacaccactcctgaagtctgcaccaggtcccagctggcccacaacttatttttcctccaagagaacaaacactacagatgtgaatttttcgacagaaattttagtacccgaccaggccgggagaaacaccagcagatccatacggggaagaagccgtttgtatgtaaacagtgtggggaagccttctacctcatgctacacctcaccagacatcagaagactcactcagatgggaagtccttgacccagcgtgcagatgtctacggccgcgtgagaattcagagtcaggactaccacgagtgtttccagtgcggcaaggcttttatccaggctgtgcatcttttccagcatctcaaagcccacgaagtagcgatggccctgccgcttgagttgccccgaaacaagatgtatttgattcgatataagcgacagcacgactacatggagaaagagcctatcagtgttgcgactgcggcagaaggttccgtcagagt

SEQ ID NO: 44169 - DNA, 1499 bp, Bovine  19866880489909
ctgctgctgctgctaatcgcttcagtcgtgtccgactctgtacgaccccatagacggcagcccaccaggccccaccgtccctgggattctccaggcaagaacactggagtgggttgccatttccttctccaatgcaggaaagtgaaaagtgaaagtgaagtcgctcagtcgtgtccaactcttagcaaccccatggactgcagcccaccaggctcctctgtccatgggattttccaggcaagagtactggagtggggtgccattgctaggcacctcttaccagctcgtccactccatgtggactgagccaccatacagtgattcatcagaatcatttctgccagaatcacagtgatcatcttctacctgatcccctggcttctagaccctccctcccaataaaaatgtctattcttaatgcagcaactagaggaatcctgttaaaatgtgagtcaggtcagatcttcatgagctcaaacctccagtggctctcacttcagtaaaatacaactctttgtaatgtcccatttacttctcagggctcagctcttgttgctttccctctagtccaggtgtcagcaaacattttccttaaagggccaggtgtaaatatgttagacttcatgggctatcctgaagatataggtccatttaatgcatattttgaatctaattttctaaagtgagctatatacttcactccactttggaccacacctcacctccagcactctattgtttttaatagactggaagtaattatttaaaaataattgacttttgactcaaaatctataaagcagaaatattttcacttaatgtcagctgcagtcttagaaagtagtttaggaatcaataacgtggttgtgatgtttcaatgcctcaagagggaagcaatgccttgcatatggaagttcttttccagtagtctctgtcaattctggtctggccagaatgctcagaagacacactaaagtctaagaagcatgaaggtgaacatcttccatctggagtgtgagctgttcaattattaacatagtttgccatctgtgcaaggtgtaagcaaagtgagtgttgagactgtctacacagcacagactggaggggacaggtgatcagagggtgagtccactgccaaaccaaaggcaataacaatagaaacaacccatcgtatcacacactcacttgctttctaatgtgaatgactgtgactgccagattcttccgactattgtcatggtttgatctctatatgtaacatgcacacttggtgtcaaaaagtggttactgtgtgagattatctgttatttacctggcacttccactcctgtagaagtgcctgcctacagctggaaaaaactgcatttcccagaattccctccttgattggttccaggtaagggtttgccagtgagaggaatttgggagatgtggaaagtagaagggaaggagatgccattattttggggagtgtttgggggtcagatgaggctgacttg

SEQ ID NO: 44170 - DNA, 1392 bp, Bovine  19866880632231
tccccttctagtctggggaataaagacctattggaacactagcagcacgctcattcatttacacattgcttcgggctgtcttcgtgctacagcagggttgttgagtagctgcagcggaaaccgtatggcttgtacagtctgagatattcaccagctggcatttttgtaggaagtttgctgatccctggcctttgcagtctcagtccacaaactaacatattagacaatggcactaaacacaccatttgctcaaatgagtgccattaaaaaaatgtggacgccaagcttagtggattgagcatagaaatcgtgattcccaacgcttcttaaagatgagtgccacttggccaattcttttctaacttgggtgcgataaaaactgtgaaacagctccaatattcctgtccatttgaacatcccaaaaatgtaataaaaataaatagttgcaaagtatttcatactccttgcaaaaaagatactacaaagaagcacagagaaataggtcaacaggccatgggtcatgtgcttcaaagtaaagtgtcaaatgccattgatgttattctctcataattctctttatttctgaacatcaaaagacagtggagatttaccagcttaatgggatggtgtagatgcctggaaactatcatgtcagagagacaggggagatgttactttgatggttagcatcctcctcttcacatttacacagaaattttcataaataaatgactacaatcctcaatgttatctactaaaaagataagctaaataaaacaacgtactctctgaaagcattctaaaattcgagcgaaaccatcagtctttctcagatcagcaattaggtgctccactttgaatttgaggaaatagaaacatatttttatgtctgtaccattatgaaaggaatggtcatttcctatcctgatcaggtcagatcttcctgatttgcatgacctataggaaaggtcctacttgccacttagatttgaaaatgctacatgttctcccccaaatttctcattcatatattaatttctcagtaatcctggagtaatcagggtttgattcccagtgagggagctagatcccatatgccacaacaaagacctggcccagccaaataaataaatacacatgtatttttaaaatccagctcttactcctggatttcctctcactgaatggcatctccagagtcatgctaaatttcttcttactcactcctcactctttgaggctctgaggctgaagttccatcatctggtatctctcttgctgtctcatatgcatctctccctctctactaccacagcctcatctgaggctcattatcttctctgtctcagacccactgaccatctcacaaatggtctccatacccctggtgcg

SEQ ID NO: 44171 - DNA, 667 bp, Bovine  19866880688734
atccacctacacacaagctgtgttctcatcaacctctacatacctctataccctccttccacgccccccctctattttcctgtaactgaagtttccttgtctccttacaaccacctctgcacatccaaattctaccattctgtaagactcgtttcaaatgcttcctcttccataaaattttccctaggcccacaagtaattccttctctgtgaatagctagtggacctgaactatgcctttcttaaggcacttagtccatttccccttgacagagttactggcatttatgccatatcttcctgtacagagatcttaacagcacagtctatacatcctaagaagcccccagagcggattacagcagagccaatgaaaagacttttaggaaatatttgtggactgaatcttttccttccttatttttattttctcaggcaatgataccctcccaggggcccaaggaagatatttcagaaaactgccttcatctccaaatgttttggcccctagttaattgcaaaattgtatagattctatctcctctccatttgttctgacttatttcaggccctcatggataatagatgaaagggcaggggaatataaagtgcattcatggaattatcttctttgagacccaatttccatatctttaaattgcattag

SEQ ID NO: 44172 - DNA, 1204 bp, Bovine  19866880740245
gggacgccagaggatgagatggctggatggcatcaccaactcaatggacatgagtttgagtgaactccgggagttggtgatggacagggaggcctggcatgctgcagttcatggggtcgcaaagagtcggacatgactgagcgactaagctgaactgaactcaatagattcaaaatattattatttaaacatacagtgaatataacagcatcactgaggctttttaaccttagtttttttcattctatgttttacaaatgagaagtatcttttacaattatagaacgtttcaattcagatggtaaaaatgttattggaaatacctgatctatatttagaactcataaatgtaaagctgtaaaaagacattcacatacccaagttgttccaaacacacttaaaagttttccaatcaccgaatgaagaaatcattgttaaggacttccctggtggtctgtggttcaacgcagggcacacaggtttgatctctggtcagggaaccaacaacaaagaacgatggggaactaagatcctacctgccgtggtgcgactaagcccacaggcaaaaccactgagcccgcaagcagtggagcccacgtgccacaactagagggcccttgtgacacaacttccgagcccatacagcacagccagagaagtctgcacagagcagaggaagaccctgcctgatgccacgaagcctgcacgtgccacagctaaggcccaatgcaaccaaatcaacaagttattttaaaatttagagtaattcaaatgaaataagaaggaaaagtcagaccctctgtctcatcagccacattttcaaaggtctgtggcttccctttaagggcactgggggtcgagataatactgtttagcataaatcagcctgtactgttaacggatctcctcactctccagtgactggtttcccatcgcactcacggggaaaagtccaagtcctgacaaaggtccacaaggcctacctagctgtctgtcctgcctaccattccatgctcagctcttgctctctcctcctcagctcttgctctctcctcctcgctgactccactctggccacctcagactctccagatctactcccacttcaagttctttgcccctacttgtgcctctgcctgggatgctctcaccctgccccagcatcatcaagtgccgctccctcacttcctcaggtctttattca

SEQ ID NO: 44173 - DNA, 919 bp, Bovine  19866880780058
ttcatagagttgcaaaagtcagaccccaattgagtgactaaacaccagcaaaattttactatacatcttaataagcagtagggtgactctccacttgcttttctttttcagaatcttcaaggcttttctggttctggcttgcagatttttccacaaaaactttagaatcaggatgacttgtttcaaagagaacctattggtatttttattggaactgggttatatccattaatgaacatagaactgacaacttaatgacactgagtttctatttaaaaaagatgtgtcactactgatttttctggaggggagggtccttagcagtatttgtttccttcattctggtcttgcacctttctttctaggggtacttttttgttcttactataattatgctatatttgctttcttatatagtctcattttgtggataatggattggaattaatttttcaatacttgaaaatgagattgctcttcagtattagaagcaccaaaggatgtttcagaaacaagaagactgcctacactgagttcagcctattcaataaaacactgttttcataaaatgaaataatttcactgaaggagttcaagctattcttttccatgatttctatcgttgttgttcagtcactcagtcgtgtccaactttttgcgaccccatagactgcagcacgccaggcttcccagtccttcaccatctcttggagtttgctcagattcatgtccattctatcgttaactcaaaaacctgggcgcactccttggctactcccgtctccttctgctgaccatctatgcataggtttttaaccaatggtgaacatcggactcatacttgtagcttttaaaagtacatacagccaggttgaaccttctgattcaggtctagggtaagtctaggcatgtgtatatg

SEQ ID NO: 44174 - DNA, 1344 bp, Bovine  19866880957280
ctctgtttaatcatgatcgcataagattggtatagtttcacagggtatgcaaaacagacatgccttaaatggttaaaattttgcttgtttgggctatttttaaaataattgaatgtgttaaatttgaatttggtgtctgtggacttctgagctagtgagtctaagcctgctgtaaagacataaacgactgggaaccaataggcagaggccgtctttggctcatttatatagcagcactgctttcatgttagctccttcctatgtctccgtccagcttatagaatggctatcctttgatctggtaccccagtcctgctccagtcagctgggatcaaagtaggagggtcaatctcctggatgcagtatctaggctcaagctgccactcagagggcagttacaagcttgaaagaccccagatagactttccctcaaaacctttgcctatcccatttatccatgaacaaagtcaaatgccatcccttacaggtaggcttctcccataacacctgcccatccattgcccccaccctcacgtctccactgtatcctatgcaggtcactgtcagatgtcttaccttgtcatttagagatttgttacatcactttatttcacctatgaaacacaaagtgtgaaatatatgatcactctcatgtccccaggacatcttagagttcctagtacaaatctgttcaacaaataattgctaaatagattgtttttataaaatataaaaactccacagaggaaatgatgcctaaggagttatttgggaggatcataaggagtgatcctcctatgaaagaggaaataacttctccaacggagaaggcagtggcaccccactccagtactcttgcctgcaaactcccatggatgggaggagcctggtaggctgcaggccatgaggtcgtgaagagttggacacaactgaacgacttcattttcacttttcactttcatgcattggagaaggaaatggcaaccctctccagtgttcttgcttggagaataccagggacggaggagcctggtgggctgctgtctgtggggtcgtacagagtcggacacgactgaagcgacttggcggcagcagcagcagcaggagtgataagggatgaaagggtaaattctaaagagagagagagaaaaaatcctggatataagcccagagacatgaaagcatgacatagtagagaaaacataagtaccaagtagcttggcaaatgggatgtgaatggatggtcacagaggccccccaagtataacataatctgggagaattcagcccaggccttcatgttttttttttaatgtattccaagcttctttctaatttagaaag

SEQ ID NO: 44175 - DNA, 1076 bp, Bovine  19866881154196
gattccagacttgagaagccagaaaccagaataatcaattgaaccaatggacacgggaaagatggtttcaagcagggtcatgtgatatgtttaagcccagctttgaagaccttgttttcttaaggacatcagactggtaatttatttagactcggctctggatgttctgtgaaagaaaagaaatgaatttttattgaggaagaagtacaatttggtaattttgttctgaatatgttttctaccctgagattccttacccatcagggaaatagattcttgtactttgaacagctggctgagagtctgatggaaaatttatataaagctggggctccgaggagacctcagggagaaagttatatccccaaggctgtagttttatccatttttatctcttgtctggtggttatggatgcaactagccatgaatacaaaaaggcttctgtttggaggtgcttctggcactttctcatagaacaattttcttttttaaaaaatggctgaccactgaccactcattaagttagaatctatgtggtcatggtcctagtcactcgagtcaaaggggtatgcttctaaagatctctctgtatcacttatgcaaggatgctcctggtttggcacacaactgttttgaccaagtgaagagaattgtttttaaggacaccaataccactgtctgtttccatagacatgcaagacatgtctctggtcttggtgtctccagaacgcagttagatttttaaatcacctaggaacttccctacaggtgggctagcagtcaagaaataatgttgtttctggtttatagattgggaacattatgattagagttttgtttgtttgttttaatcagggggttgtagcaagttatttgtaagggaactgagtagcctatttttcttgaagagaaatagcaatgttttcagataaaactgctattatggtctatttggataaaaattccatttttccttctctctgaccaagatatcctgtctacagttctagaagtaatattagtttttaagccccaccaccaccaaaaatatagccaaggactctaaacatctcag

SEQ ID NO: 44176 - DNA, 2383 bp, Bovine  19866881457531
gtttcctatcacttaataaggcttatacaactctgaaggatccagttcttgcttggctctccatcatcatctttcatccttctccctccatctgtcctagacttcttctagtttattgaattggccttgttctcttataccttcagattatttgtattagtaagtgaatgctgcataacaaataattccaaaactcagtgtcttataacagcaatcatttattacttcccatggacctatgggttagacgagtaattcttcgggccagattcatctgatctccagtggactagttcatttgtctttattcatttagcaggccaagtggggacttgctggtctagaatgatctggcttggccttatctggctctcctccacagaatgtctcacccccagtaggcaaaccctggttcattctcatggtggtgggagagttaaaaagaaagggaaaaaagagtgagagagagaaagcagatacagacaagacctcctgatacctagccatgaaactaacatatgatgatttctgttgcattctattagccaaaggaagtcacaaggttatcctagaatcaatgagttgaaaatagattccactacttgacgggaggagctgcaaagccacattgcaaaaaggtggacatgtaaacaaatggaaaatctgggccatttttgcaatcagtctaccacatcacctttcatgcttcttttgcagaggatacttgtaccccagcccttctctttaataactagcaatttcccctctggtctcagtttaggggtcacatccgggaagctttcctagatttctccagatgtctctcctctggacctcatattaaatatctgactacttatctgactctccgtaagtctttgaggacagagactgtgtcttatttggtcacttcctagtacaatgcctggcaacagcagggactgtgataggtaagtttaaatttagaatgtactataaaaatctatcaagcaaggtctcaataagtaaatttaaatggaaaatgcacaataaaaccagtcaatattagcatgtgcttccttgtcacttaaatctctgattacagatgaaatagcatcaaatatttccaccaactcacctttacccctttcctttcctttcttcttcagtagaagcaagggagaaggatttgaattttactgtgtgattctgcttatgcatggtggtcacaaaagtacaatataaacacaagagttatgggcatgaatctaccttactttcttagtgaggcaggagtatttatttcaacaccacccccacccctccgccttttcactgcactgttctcgtcactcatctgataagaagtaatgcactgttttatctataaattactttttctcagggctcagtaattttcattactagtctcatgtcttctacaaatccttgacgtctcacaacagagctaaatctggtattcagggtgcaatctctagagcagtgaggcacaagacgactccagcttccttcagtcggctggcttcctttttgccatcttatcacattaatttccaagttgttattgacttttcttaatcgcccctctcactttgtaattactttcctcttgctatagctgcttcctcaaccacatacctcacctcactccatacatagattctcatgtgttgcagaatcttcctcttaggacatgcaagctgacaatttttctagtcacctttccatctatctatttgctttcccatccacttatttttttgcttcacaagttattattttaagtgtcttatctaacaggaaatgctaatcccatccctatataactcatttgaatagcaagttgtaatgaaataggcagttgtcgctctcatatctttaagcccacagaggttaatattgtcctctcgtcacatggatccactctcatgattctcactattgctaacacatcttcttaatcttttaccaactgcccctgaggtcaactactgtttatcacatggatgagtagtacgaacaaccgatgcaaaaagtatttctcagaaattccccacaaagaacattagagttagtcaactaggactctgattcagcaagataactcttagattctcaaagtgacaggatgaacgctagatgagccactatttccagccagtaaaagattcagtatttatacagcatgctaaagtagctccgtttacctccttgacaaatttacaagaccaagacctgagtgaaatacttgacaaagcctccttggtagtcatgagaaccatgtgggagaatatattgggttggtcaaaaactttagttttctgtaacagcttatggaaaaacccaaatgaactttttgaccaacccaacagctaggatgatc

SEQ ID NO: 44177 - DNA, 1062 bp, Bovine  19866881562681
tgagtatggaattatgtgttggtttttagcagttcttctccaagggagtggttgtccccccagaattcacttggcaatgtctggggacatgttggttgtcacacctggggtcggggtgctaatggcatctagtggggaaaggccaagctgctgaacatcttacagtgaacagcccccccacaacacccaaaatatcgggcactacagatcaataatgctgaggttgagaaatcctgccctatgatcacttaggtgaaagccactctctcagatgcaaagcccaaaaggaagtcactgccaaagtggctgaactgggttaactgagtacttgccaccctgccatgatttagctccaaaccttgctcccaaatgggttcataatggcgcttttggatcatactgcaatggaatagcaccagagcacttagagaagataaacagctgccaacctggctagagatcagccatcttcctttctaaatttatagcagtttattagtttgcctcatggaacacaggatgagtcagccatgtagtcccttccccaggttaaatgtcagtgacatccaggacagctttagcagcaatgagaagagctaaaatttatggggcgttcactgtgcaccaggcactctactcaacacttgccatgcattatctcaatttgcttttcttcaggggttccacttcttgcttattcttttacattcacccgtcctatcagttcagatcaaagtgttaacgctttaaatggtacaacaggaacattcacagggtgcaggcattcattacccaaaatggtaagtgttatgcagatactatgctttgcctgttctcttctttaattatctaaagagagaaataaatcattgactttcagacaattaatttgatgaaagtattgtccacatagaactgagtgaaaaacaacatctcagagttttcaatttagaaaattattttgcacttgtcttttggcttctgtattacaataaccgaaaagaaaatcacatcacaaatcttggtgaggaaagatcagaggcaccatgatattgtgtaaga

SEQ ID NO: 44178 - DNA, 984 bp, Bovine  19866880957923
cccagtgactatatcgctgccatcttggagctcagtgcccttgtggcaaaacgatatcaacagatcttcctgcacatggacttcctgtactacctcacccctgatgggtggcgcttccgcagggcctgccgcctagtgcacgacttcacaggtgctgtcatccaggagcggcgccgcaccctccccaaggaagatattgatgacttcctcaaggccaaggagaagaccaagactttggactttattgatgtactcctgctgaccaaggtgggctcctctgggatctgaattcaagaagcagtataggccttgggaacttgatttaatcaaacttaaactggattgaactggatgcagagggtgctggggagccatgtgagattcttgttgaaggaagggctgggttaggggtaagttttaaagatgaccatgtggaatgcacagggcttccctggtggctcacacagtcaagaatccacctccagtgcaggaagcccaagttcgatccctaggtcaggaagatcccctgaagtaggaaatggctcctactccagtattcttgcctagagaattccatggacagaagagcctggtgggtttcagtccatggggctgcaaagagtcagacagaactgagtgactaacacacacacacgtggggtgcagcctgcaggggactactaagtctgaaattgtgaaggcctgagattttactctccttcccaattagtaagttagtctactgcagaaatagactgtatatatccatgtatacatacagaatactggatcttaagaatccatttattacttatagcagtaacagtaaccagagtagaatggtatctctgctcccccattcccaaattcctctgagatctccatgatttctttatcttcccatgtagccatacttgacattacagaaaaaaataccttcagttttcttttattttttttatttttaattaattaatttatttt

SEQ ID NO: 44179 - DNA, 706 bp, Bovine  19866881182512
gatgtctgggacaagaacacctgcggggatgcccgcaagtggactcgatgcgcccataagggactcatcaacacgggacaggacatttcatcaccaaggctggccatcacgtgtacagagttaatactcatgtctctcattcttctgttttaatcctgacactctctacttaactgggtcgattgaacagtgccgcctgcggagtagacagtgtccacaccgagcatcaccacagagcccgagctccagtctcacaaagaaagaagacggggcgcccttcacaggggctggaggggccttctggtggtcaagaacgcaggacactcggcctggccatgcacacataagacggtctagatgactacatgagggactgtaaattccaaatcgaggaagacacccagagtgcacaagacgcattctcatcactcacagaattgatgaggcgatcggtttcccgagaattgattgctttagaaatccaattctgaaagtcttccaaactgtcaacagataaaaggcctggttaatttattttcttgggcagaattttcagaatattatgctgaaagaaaatgaaagctcatattctataaagtcaaagaatcaaacattttccgttttcaacgaaacagaagtagaacccaaagtttacagcagcggttctttcaagtgcagggcagcgggtgcctcggggaggaagcag

SEQ ID NO: 44180 - DNA, 1049 bp, Bovine  19866881562001
gcttctagctcttccttctttcagaacatctttctgtgtcttccctggtctccatccagagacgccgctcactctgtctagacagcatcaccagtatccaactccttatttcctaacctaatggtgtttcttcattttacctaatctctgtaggctggagtacaaatttggagaatttggaaactattctctcttggtaaagcacatccgtgatggagtcagtgagattgtgtgtgacctggttgtcaacaaggagccagtcgacagtaaccttcgtacgtacatgctcttgcttgagtttgagagtttgcattttcaaccgtttcagtttttgaatattgtttgcaacatgttgtgtaattcaaaccctggattacaggttgtctgtctcattatggcatgtttatagtgtgtgtattgtgccattggtatatactaagaaaattacgtgatacataaaaatatttgatatatccacatattctcatagttggtttaattttgaagcataaataagccaaaaaaagttaatgcagtggaaagaaactagaaattggctagcaatctggcagttgactgtcaagtatctttccttgttttaggatttagaatacagtgttttctgtatgtgtctttgacagttcagacatcctcttgggttctgagggagttgttcagtctctaataactcctctggaggaaatgagtcattccgggtccccagtagatagtatcagaagtccctggggctgttccagacagtaagtactgttcgcagtgatgctgttgaagactggttggttgtgtcagaagaacattagtaagaggcaacgtgaaagggccaatgtgggaagattcagtcattaaaagaataatgaagtaactgatggaaacaccctgaacataacaaaaaccaatgagttcactatgaagctaaaaagcacaaagcccccatccccaaacagaaacaatattttggttgcctttgggagtgacaggggacacgtggtgttaactgctgcaattaaaatagtggaaaagcaggaaca

SEQ ID NO: 44181 - DNA, 784 bp, Bovine  19866881701514
ctgggcagttccttcctgggtcttagcagtgccatcctgagaatgagctgataaaggcataaacaaagctgttttcccttttgctgtggttattttcaggttttttgttcccctgtgctgctgaagcttcttgaattggtccctggactcttgcagagctgtttttatttgtggatagctgccaaattgttgatattcctcaagagttggaggctggggacctcctcatctgccttttgggtgataccacctactttttcttttaaaacagaattcacatatgtgaaaatctagatcatttgaaatttggaaataactaggaattaatacagagaaaatgcatgttaaaatgttgcagattgaaagggaacaaaaacattagcttttcttttaggtgtgtctgaaaaatttcagtgtttcagaaatactacaagtttgtagaaatactaaagcaactcaaaaagaagtaacacaagtgaaaatatcagttaaacacagtgcaaagaagcaaggaaaaatttcaaggttttgaaacagtatataaaaacccaaagttttcatctaaatacagaagctatgtgtaaatgtgccaacaagttgagggattcttcatattttacacatgctttttttccctctgttccttgcatttgcagaaaccttacatggaagtttcatcccttagggagaatgccatgtcaccatggatgaataggcgggaagagaggtgggattttgagaccccaacaaagagactcctataacaggaggaaggaagaaataa

SEQ ID NO: 44182 - DNA, 1955 bp, Bovine  19866880441931
taggttgtcacagagcactagatttgagctgcctgcatcacacagcaaatttccactggctttctaatttttcacatggtaatatatacgtttcaatgctactctctccatttgttccacactttcctctcatcccaccctctccttttcctgctgtgtccacaaatctgttctctatgtctgcatttccactgctgccctgaggacaagcttggatttattcttttattgaacttcaacatcttcaggtaatacattgattaaggctatatattcgcacgctctttttaagtcattgagccttgcataaaggataatattttcaacaaatatttattttacaaatatgcattggtcttctggaaaaacaaaacacatttcatgaaatccttatggtacgatatcacattacacagactgacatctgaaaatagttttaaaaagtacaaggcaatgagacataccacaagcaaatattttagagcctactgtacatgagagaaagaattgaaaataaataagccatatttcacagaaaagtgtttgtgatgggtaaacaaagctgagtagactacattaaataattatcatttctaaatatagtcattacacatttatatcatattttagcttgttacgtgtggatatatctaagttgttttgtctcaatcaaaagttgtctgacttttggccaatatttggaaattggcaaaacttaaagtgaattttttcattatttattaagcccatgtgaatttcaaagattgtttacaagcacagtctgattcatttagaagttttctagtgatggatttgtttacaaaagtgtattaatgcctagaaaatgtactccattgagcagatttttcatatgaaattttccatcaaaaggaacacaagttctgaacttatcctaaggacttggattctaatatctgtttggccagctttccttaaagattagccatttcctgagcactgtctgcatgctagggattttaatgtgtgccaaggatgaattcaatcctgaagaaatgtcttcttcttcaattgagagaagaccaattagcaactggacagggcttcatgtagccccatgtaaactagacatctgatgtcccacagatggtcttacttcagactaaatagcgtagattttaggaaaagaatctgacattcaactactgtgggtactgggcactgcattgttgacaccacgggtccaaactggagttttacccctaaaagttgattatgaaaatctagcattttctatagatcttgaaaccatgccttttatcctgagtgccaaatagtttaaaattgtgagcatacttcattaaaaattacctaaagacatggatctatgaataactgctaattcctgcaagcttctgaacatgaacacagaggatgcttagagccacatttaattattgtgtagaaaaagaaggtagtgcataattttaagaataaatacaaacaaatgttgagacgctttaaaaaacattttccatgaaaatgctatgttaaatttatgattcaactttcaatagaagccatctttaacattttttgttctaatttgaagggagttaattcaatcaaataccatgatctggaatatcttttgaccacttccctctccccacccaaactttttaaatacattagtggtattttattcaattctgaaacacatgtcagctgcaatgctctgactgttacactacactctgtatcagactcagagcaaatgacttccctgttggtccagtggctaagactccacgcttccagtgcagggagcccaggtttgatccctggccagggagctagatcccacatgccccaactaagagtttgcacgccagaagtgaaagatcccacatgctgcaactaagacatggaaccgccaaaaaacaatcaaataaatgtatccaaataatatgctg

SEQ ID NO: 44183 - DNA, 1024 bp, Bovine  19866880481547
agagcttccacacacaagatggcattaccagctgctgtaatggttactgacctgagtgccccaggcaactagagtgacatcactcccttcttggatgacttcagcttgggaaagggggatgttgtatggctctacaggaacctgctccactgaacataaaacgagggggaaaaaatgtaaggttagttattcctatgtgacatttatgcaaaaagaatataagaacttcattgtggcaaagctttattttatttattcttcctccaaattccagaagttatttataactcaaatagaattactatatgacagcactacacagatgaaaaagtacaatcaaatcagctatagggaaaaactaagaaaattttaataaagtctgttatttagtcaataataatgtcaataatatcaccaatattggttcattaattataccaagtatatcatacataagatgcaaataaaggggtatatgggaactctgtagtgtcttcatactttttctgtaaacataaaacaatacaaaaataaagtttaaaaagatttgaatatgcctgctaaaactttattggactgaattaatttctcagataacttttctatcaaagagtaaagaaatttatgagtgcttgaaaaacagaaaaaaaaaaaacacataatatggcctactttctaagtatattttatttttgcatctttcaactatggacactttcaccaaccacagcagaagacaacacctcagttttcaaatctgaattctgtagacctcaaagagacaaactgaatcagctccaccaagccaaaggaagaatacatcactggtaccccagagaaaaccacttcatgatatctctgcccaacaaagtacaagtaacccgagagttgatcaaactcaagaggaaatggtttgatgaatttttaaatgaaactgagtaaaccaaattacccccatgatgatggggaaagtcttcttgaattaccacatgaagcaggataacaatggaagagataagaaaaa

SEQ ID NO: 44184 - DNA, 849 bp, Bovine  19866880554010
aaatttataatagagaatattaatttaatggaaaaatttttaatgtttattatccattcatttataatgagtatgaatgactttgtttccctaatagaaagtacatggtttaacattttctggtgaaagaaaggtatacaagttctagtttttactgatggcatattcacatctagaaaaataaatcactcaattgtgcattgattagactgtttctatgaattttagaatgaatcccaatgaataaaaatattgatacttttcattttgaattcaaaatgactacatattttaaatttctacttgttcattttctatttctcctctttatactaacactattttatatgtctattataatatttctctaatgtgttcaaaactcatttctgtctgtagattgtgaccttctgaaaaaactatagtacattataatggctcaaagaatattctatggtaaaaatgtttatttctctctttattataaaccctttgtgtaattgcttttgtcatgtttccatccttcaaagggcccaacattatgtcttgctaaaaagaatgtgatcttagtgattgttgaatcaaattgagtttaatatagagaacatttttaactctagcaaatactgctgagaagcagaaactagaaaatgagacatcggaagggtgaagaaaaatgacacacacatcaagctctaaatctcaattactctgttcacaggcagctctttgttcttaataaacatgtgcattcattcctttttatttggccacatagttagcaaaattaactgtctttttctagctcacagaagaattgaagcaacatattatgaaggtgctaatgga

SEQ ID NO: 44185 - DNA, 1567 bp, Bovine  19866880929504
tggctttaaaacaccggataataaacagcacagaactatgatccctaagagaagggaaacacatgaggaaaactgtacaagtgctccaactagctgcctagaagtttccaggctgaagtacagagcggggaaatccaaatagagcctggcagtcttcctaagtttgagattagcattcaagaaagtcaaaatagatagaaattgtagaaaagagtactggagaggagaaaaagctccaaagaactacagaaaaatacaattgagtctatgactgagcacagttctgggaatgcaaaagacaaaactacccaaagctggggggaaaatcactgaaaagcagaaggtaaacaagttgtagagttcaaataggtctggaaatagttcatattcctgccagccagagtagaaaaattttataatatacaggaaaatgagtagagtccccttagggctaagttagcttgagacaagaggctttggacctcagaaagcctcaaaagaattaagctgttttcaaataactacacattagaacaaaaccaacactctttaaagacatttttaaaaaatctaacaatgaaaagaatagcaatattcaaatgggcaaaaaattaccagcctgcaaggatcaggagaaggaagtggcaaggcactccagtactcttacctagaaaactccatggacagaggagcctggtgggctgtagtccatggggacacaaagagtcaggcacagctgagcacacatgcagggatcgggaaaatatctgtcccataatcaagggaaaaatcaatcaacagaaacagacccatatacagaagaagtgataaaactgccaagactttaggacggctgttatgaatgttataaatgtttcatgtattcacaaagtagagaaacacattaaaatgatgaagagaaaaatggaagacataaaaaaatcacccaatagaatctcattaaagaaaagaaaaaaatagaagttcatgagatgaaaaaagcaattttgaaattgaaaaaaatatattggatgcaattaacaatagattataaaaaagatcagtgaatccaaaacatgggaatataaactattcaaaaggaagctagagaggtaaaaagactaaaaaggatacttgcccctacctggaaatagagcattagtaacctgtgaaacaatatgaagtggtctagtgtatgtgtaattgaaaccatagatatgggaatgtagggggaagagaaaatatttaaagaaataatggttgaaatttttctgaatttgataaaaccaattaacccaaatatccaagaagtttaatgaatccaaagcaaagaaagagaatctcacacaacagcacatcatacaacattactgaaaatcagtgataaagaaaagaaaaaagaacttaaaattaaccatgatggagaaaacatgtttttccaaacaaagatatgaattataacagaatttttgtcaagaagtatacgagccagaacacaatggtataagatctttgaagcacttaagaattctgtagtgagcaaaaatatctggcaaaaataaggcat

SEQ ID NO: 44186 - DNA, 1191 bp, Bovine  19866880958516
ttgcaatgtgcagaaacaaatctttggcttgggtgtacagtcctgttgaaatctctcaaagccggcattcccactgagacttactctgagtgtttacatgttaagaccagatgaaactgtttcccttttccaagtcagtactgctgtgctaagaggtcagtaaacagtgtttatcatcagcagtggacactgcaaccctcaaaaaactgggtaccggtgctgaacagatggagactcatttatcagcctctaggaggctgagtatccatacaagtagaccttgatgagggagtagtgttttcattgagtttgatcccagattacagcagcgcagtctcctccacagtgagctcctgagtggccagtgaggaccagcatgagatggacaggcacgccagttgggtttgactcagggtagggtgtggctttccatacacatccacaaagccggtgcagccagaaggagtagacatgggcttttgttgtatttaagccaatggttttttctcctctgaaaagcaaaaggagaaattctctgagtccttagactgaaggaagacagaaatcataatcattctttgagatctcctgaatagagaacctaaaggtctaaaatagtttatggtgggggaaaaaaaacatatttagctccactgttgacctagtattgaaacattgttcatctactctttatgtcaggctagaattaaaagacagaatctgcagacaacatccaagaacatcctaggttccccccgcaccccaccctggcaccattgtgctctctatgtcgttaaaaattttctcattgcataaaaagatctaagatcctccagaggatatgttttgctttttttttctcttttatttccctacctttaaagggagaaattcttaaccaatgttgacagttgaggctccttggaaatcttttgggttcatcctcttctgaaatgattagaagatctagattctcaagttccataaaactcagggtgtcctatatgctttgtttcctgatacctttggcatagagctctgctgctcacatgacgtgggtgtaagttcagatcttggttctaccattcctaattgtgtgaacctgggcaacctattgttgggagacagttctccgtggttctctgtgtcttcacatccttcaggcagaaggagtgactgtttttggtttag

SEQ ID NO: 44187 - DNA, 1100 bp, Bovine  19866881043311
aaactctgatgataagttcataataacttgtatgtggcttgaaatggaagatctattgaaagaagcatttttgctgcaatgaaaaataaatcttacaagtttctagattaaaatgaattaaggttttatgtaataacacaccgtaatgttgagctatattgttcattatttttagttttaggaaagttttgagcccatatgttctagatgctagattctagaaatgcactgaaccaaatacagtactggagacaaaaagaaaaccattttccgatgcctggggccaattcattgttggcttgagtcagagtgaaatgggaaagagtctagatatttttgtaaagaaacaaataataaattgtcaatgtcaaaatgaggtcagtgaccttcaacgtttatcatattaaaagaaggaccatcacttcatctgtagcctaacaccacattaattttcttcagagagcaaaagaatgagttggtaattccagaagggtttttattttcctgctaattccaggaattttgcttgtctgtgatgactgtgtctctgtgtgttacagtaacacttctgagaggctatccagactaaataaaattaggaaaaggttacagcttaggtgtgttatattggatttgagagaaaaatagaaacctgatcatatataacaaaaaaaattggggtaagtaagaatacatcgaagttgtgaatttactttggtaaatttttaggaaaggaaatatcatgttggaggtcaaaactcaaatgagagtcttgtttttgtttttgttttctttttaattatgtgttatttcagttcagttcagttcagtcgctcagtcgtttccaactctttgtgaccccatggattgcaacatgccaggcttccctgtccatcaccagctcccagagcctactcacattcatgtccatcatgttgctgatgccatccagccatctcattctgtgtcatccccttctcctcctgccttcaatctttcccagcgtcagggtcttttcaaatgagtcagttcttctcatcaggtggccacagtattagagcttcagcttcagcatcagtccttccagtgaatattcagga

SEQ ID NO: 44188 - DNA, 1282 bp, Bovine  19866881072827
ttcttcctatatatttgctgtgtttatggatgattgttgctgttaagtcactcaattgtgtccaactgttttgcgattccatggactgtagcccgctaggatcctctctccatgggatttctcaggcaagaatactggagcaggttgccatttccttctccaggggatcttcccgacccagggatggaactcccatctcctgcattggcaggtggattctttacagctgagtctcagggaagcccgtgcataatggtaatgccatttaaaaaaatgttgttcatgcctatcaagggcagtgcccagaacttcagtttgctctggaagcttgtctatgtgagttttcgaggatactgtttcctcaagatctggccactttgtctttctctttttgatctattgtctggggtctggatattatcactcagtttttctctagcctcaagtcatgagagtggggacggtagaaagttcagactctgctttttcttcttggatttgggtcaatttcctatttcacaatccattccatttaatgggatatgttctcttcctgagcctgtcaatgtgtgatgtttccagtagagagaattcctttagattttccttgtttcttgtacatgtttctcccaataatcttctgtgtattcactcctcttccccagtcagaataggaaaaaataatatttcctgtgggatttagcctcatcttatggtaactggggacccagaggggtttcaccttctgcttaatctcttaaacatttggcgcttgcagacagtttttattttttcttatttatctgcttctttgtattcaattctgcagctattgctgcagctctttcatgccctctttttcttctttgtctggaagaaggcatatggcctttcctggcaggtttttcctttatgagttccttcggtggagatgtttgcaaagatgtttgcttgactctcccatgaatagcctgttttcccagcttctatctatttttaggaatattagtaacacttttgaggacttggctgaatcatctgctttccctaccatttcttctgagagatgcagataagatgaaaggacttcttgaaccaaataagcatcttttgtttatttgcttggccgtgtcttttcaaaatctatgtcatgtatttttgttcctttcattaaatgttggacaggcagattccttcattgtcttttttaactggaagtctgaacttccggttcagacttttttgccattttttctttctttttcttctccctttaaaaaaa

SEQ ID NO: 44189 - DNA, 1237 bp, Bovine  19866881097079
ttggtaaagaatccggctgcaatgaaggtgactcgggttcgattaatgagtcaggaagatcccctggagaaggaaatggcaaccaactccagtattcttgcctggagaatcccatggatagaggagtctggcaggctacggtccatggggttgcaagagtcggacacaacttagtgactaaagagagagagactgaatttaataaaaacatagcaaaaaatatgtagaaaacatatgacatgtttacttttttaatcaggtgttagaaatttcctcaagcctcagaggattacactgaatatgcaaaatatgaaacaccttttctaagaatatagccattgctaataaaatagatgttatgggaattacagggctcaccattttgcaactcaggaaaatgaagaataaaccttataaaccttatagctggtggcaagaaatgtcctttaacagagaagtgatgcagaattcattttaaatatttggttatcaaaaataaccacagaagcataatttagtagaatgtttttagacataaaagctgttgaaagcatgaaacacaagatatatctcaatgaagatcaaggggaaatgttcttgttagaaacctgctgacctcattaagtgagtttaatatttaaatatgatggactctggggagaatgaataacaaacaccgtgtaactgctaaaagtaacagatggtgagaaaaaacctcatgcataaaacttgcctctgattgtggctgtatagattgtgaatgaaaggcgaattatatttaactgcaacacgaagaagggatctaatatattgaacacctggaatcatcctaattctgggtccagggttacagacatacattaacatttggttgttctatcctcggaggtgtcattgaccttgatgagatggggcatatccagtgtaggaagttactccttattcaaaagagatgttagaataacagtgaatgtcacaaatgcaggcgtctttacaacaggccatacgaatgaggtgaaatgagactagaaagcacctaagagacacaggggtagggcaggggccggggtgtgaaaaataattgtgtgttcctgaactgtatacctactgtccagaactaggatatcaatcatattttcctgatacagactgaaaaggaaaatggaaaactctctattagcagatgacattatcctgtatgttgaaaatcctaaggaatccactaaactatcagaat

SEQ ID NO: 44190 - DNA, 1464 bp, Bovine  19866881131491
cgtgcgtgcatggaggtgagagaaggaacagcagaggacttgctgaatccatttacgggcctaaccatctgccttttcatgggatttgatgtttttccatgactattcatttctgtccacctcgactgtggcttgtagcaggatgggaaaaggaatataatcactcacttgttttcttatgtaaactgcagagaaattgtataaccagatgctttaagacactgaattcgggaaggaaaactaggacaggcatggggagaaggcgagttttcttctgtcatctgccagtgtttggaaattgactttgagctgcagcatacttgtcagtaaagtgaaaggagagcatgtgtttaggtattcttttatcttttttagaaagaggaacacatttgctttaggctttaatttcttttacattaagaggttttatgagtataataattatgccgtcttagaactgtggtctgctttgggcacttaattctctctttttaatattgttggggtattgttgatctacaatgttgtatcagtttcaggtgtacagcaaagtgattcagttatacatacacatatattcattatttttcagattctgtccccatgttagtattacagaatattggataaagcttcctgtgctatacaataccttgttgattatctgctttaatagagagtagttatgtatttcttaattttctcttaaagagtcccctttccagtatacgttttaaatgtggaggctgaaggcagagtcttttgacatgtctcatacttgtacctgaaataggaaattagcatctgcagcaggaaaaagtgagcttacattatatgttgctcctgcaaagagagggttactcgaatgatgaccattctcttggatcccgtgtcaaattccactgaagaaacggagtctgtgagatggggttcggcctctggccagttaaaactaattttgctgggaaaaaacaatttggtgaaccagtgacagttctctgggaatatggactacctgacttatctctgcgcttgaagtatatacatttaagacttcaggacagactgaataccagatttagactgtaaggtatcttaactgttccatgaatttggagcaaaaacaagaattcataagatggtgtaaactttttttttctaatatgcttaaaaaactgttttaaaaggattgctagtagttgtgcttttcttccttcctagaagtcaggcacttcacattgctcctgctattataaggccccttgtttactaaaagcacacatgtagacacattagttaaagaacatgtcaaaatgcctttctttttatccagttgaaggagttatcctcaaaaatgggatgaatgtattattagcatatactttacttgtattagtttcctttacatatttctttaatgtctttttgtaaatttttattaaagaaaaatatattagaatggta

SEQ ID NO: 44191 - DNA, 861 bp, Bovine  19866881138528
tgtctgactctgtgcgaccccatagacggcagcccaccaggctcccctgtccctgggattctccaggcaagaacactggagtgggttgccatttccttctccaccttggggcacagagactgacaaaattaaaacagtaaagaaatctttctgtttccttagtggaaatttcctttttgattagctctcccttttcttatgtcctctgttccctttcaacaatcactttgatgaaaacgggtagaaaggagctaaattccttgatggaggaaagagcttgcataaagatttctaatgcagatggagatgaaggccagaggtattaaggaagcagtcaatgtttcagataataatagaaagccacatgtaaagcacagccaggaaatgacttgatgtattcgagtgttcaaacactcattttcttattaagaaacatggtctttactagccacaggaaaagctccatgctacttttgcctgctggaatgtaggatacacatttcattggtctctgttcctgaaatctgtggcttgaaacttggagagcagaaaggtcattagatttagctggcctaaaataatacttcatgaaccaattccgattgtcaagtaaaagcattggcttgggatctaaaaacctgtaagtctttggaatgaattaattgacatctttttaaaatgttaaatttatttgcaacatttaggaaaatgtgtagtctccatgaacacaggactgccttttaagtgaaagattttattttaagcctgatattgaacgttaaaagacattttgccttttgcgtaattgataaattgacagattatcagaagttatcccccatccgtatttcgtcaaggcat

SEQ ID NO: 44192 - DNA, 1505 bp, Bovine  19866881151021
ggtgttaaaggaagtagagacagaaataagagactcttttttatgaatggttttacaagtgcacttagctctggagagaccccctaggattagccaatatgatggaattattttaaagggtctgggaatataccaagtggcttgcataccagttgacatcactcataaaaatgtgttaaaaggtgttttgagggtcaaaatgaagaaacacttggaaacttatttgatgaaagaatgccaactgacttttttagatgggaaagagatgcttcattaacttgtcaaaatgtcagaaaggtattatttctgaggaaggaaaaaggtgttataacacatcctttgcattttgatagtggccaatttattgacatgctttactggggttaaaatgatcctttctcttaaaaatggcataatgggaaaatggatagattcaactgaaacttgcttaatgggaagaaacagatgtcatttgtcaactgaagcatcgctagttcagaaaatcactgtctatttctagaggactttgtttaggcagccatgggaacagtctctcctttctaaacatcagtgtagaatagatgtaagctccgtgtgtataggcagactcatatatactcaatgtgtgactgtaaggttcaaaaacttattttttaataaaatttcaaaactaagggaaagacagtcccatccgagacatcagtttggcagcctctatattcatttcagggatcctgcctttggataagtcattcttgtaatttctcttgtggaattgtcccacaagaccatggcaagcttcaaaaattatatttaacagagaaaaatgttcatactttgagtgcaaatattacatttgggagagatccaaagaaaacagagtctcagctggtaaagaaagtgagagattaaactgttactaattttttaaaaaatggggtgtgactattaagtcaagaaagggacattcttttgtggcttgtaatctggttttcaaagtcattcccaaagcatttgaaacatactttgatcagtgaggtatggttgtaacaggacaaaggattttcaaggtgatggctttgaaagataaatttagtataagttccagtatgttggctagaaagccagtttcatggtgtttatggttttaacttataaagagagagaagtagaggggtttgatgtctagtgaaaatttcttgatgattttaagacatgggagcaatacacagttaaatttttatagaacaataaagagtcaagtttttgatgtagtatatttggaggaaagagtatgatacctattggaaggccagagctggggctatgtgaaactcagatcagtcactttgacaaagaaggttggggtgggataatttagaagtttgggattaacatatacacaccagaatatataaaacagataatcaaaaaggacttactgtaaagcacagggaactctactcaatattctgtaatgaacttatataggaaaagaatctgaa

SEQ ID NO: 44193 - DNA, 1604 bp, Bovine  19866881152981
ctcttcttgattcatgctatttttgcaattttaaagtcctccctttgtggctatattttccagtaactctggttttcatttccacacaaatacaagtcactaggccaaagtcttctctagctaaagatggctaggcagatacccaaatcctaatggatccacttttgttcagaacacacacaccacaggctggcttccatggacctgaggacgatagctttatagcaaacaaaagagaaatgatggcagtattctacataaggactcgcctcgtaggctctaatcaatgtatttatacctgctttaatgttcctgttttacatagtgatgacccaaacacctctgcttgcaaataaatgctccccaaggcaggtaccattttctatccatcactgactccctagtgcccaccacacatggtccacttcatggaaatatctgctgagcttatttaaaattcaatgttcaccaaaattctatatgatattttatatatatatatatacacacacacatatatggtgagaagatacaagtgatttcatgactgctcttctcctactggaaaccccagatataattaattttataaaatgttattggtagtacagagaatcaggagaggaacactttatgttttaattactactgcatattttacatctcccagggatatgagatattagtttcctatttcttgagatacgttaaggatgatactccatcagaataaagaactatttattctttgtttaagtgtgaccccttctttaaaatttaggcaagctgggttctctgaaagtttccgaggattcagtcagttatggacatgttaatgaaaaatataaacatttttaggtttgaaaagaacatattaggaatctaacatcattctcacaaccacaaggatggcgacttgtctgcttcccagtagattaaattgccatgactgctcatttcccagggatcctattcagggcatcttccttgaggaaggctgtgcctacagaagtagggttttaaaggaaagagcgtccagcagaattggggaaaggtcccaagttacaaatcagaagatgaagatgagagggctactgttctctgcttcccttctcatttaaggatggaaaacacgtgccactccccacccagggctaacagtccacacccacggtggatgtcactaacagatccccccacccttcttctctgagcccgggaaccttctcagcccgtactccaggtgactcctaccacaagggctgcacatggtgcgggaaaggctgtctgccctagcttagccacagttgacccttgaataacagggggttgaactgtttgggtctacttatacacatttttaaataataaatattatggaactactacacataccctgatgcggagccacagagagagaggagacccacagacacagagggccagctctaagttatatgcagagaggcagcgcacttaacccctgcattgttcagggatcaactgtgtattgtctcattttttatctgttaaaagtgtcgccactttcacaatgtaaacttacgtaggtcacaatagactctatcctggggctactgtgtgcc

SEQ ID NO: 44194 - DNA, 1069 bp, Bovine  19866881243668
tattcttgcctggagaattcctgacctgaggagcctggtgggctacagcccaggggatcacaaagagtcggacaacaactgagagactaacacagcacacatacacacacacacaatactatcagtgaagaacctatggagttggttatttatggtcaaaaataaatgattatttgggatataatggatccctcagttctctgaaaggctcttacacagcctgatttcattagggaacaccctggaaaggagactcaacagtagatttgttttcctaagcacattacctgttaggatctgtcaaacatgcttgttctccatacaagcccatttggaatgttcacttccaaaataactagactgaaattaggaaaaaatgttcccatcccatttcatccttttttcctgatccgactctccccgcaaagtgactaggcgctatgcctaagaaaatagttacacactcacaagctgtgaagggtaaagaaaattaccactcaaaatgtaactcacttgccaaccacaattcactacttgaacaaccagctactgattcatctaattttattctcacattcaggagaacatttttcaaaagtctgaagtttcttgagcagatccttcttaaacttgtacttgccattggcagatgaaccacagctgttagcctacagggctttgtacatactggtctttttttctgaaatattccctttaattcacatggctgatttctattgggccttaaactttcatcttaggtgcctcttcctcagacaactttctcactaactcttgactcgagtcattcctggcaggtgccacctagttgttctcaggtggttgttacactaatatttaatgttatacttgcattttagtcgttaattcatcagtctcccattgtgagctccttgaggataaatgctaggttttgcccatgagatcaacccttaatacagtgttaacccttagcacattttaaggtcaatacatttttgctgcatgagtaacttaacacaagaattattaacacactagtcaattaaggcagaaattatttattcca

SEQ ID NO: 44195 - DNA, 1980 bp, Bovine  19866881296599
cagaaattaatatatcatttgttcaggttccaaatagagcactatgataaattatttgaaaagaatgtctttatggaaaagctattcagctaagaatcttttatggaggagttaccatgtatgaggcactatgaaaaaaagagaaaagtagtgtttacattttttatctagaaaagttaaatttggtggaatttactgacaggtgctgactttttgaaaagctttttattgaagtatagttgatttacagtgttatgttaatttctgctagacgtgataaatgttactttcagaaaaatataaaggcagttagccatttttggtagtggttttcaagactaatggcaaaatgcatcaagtacttgctcagaaagcattttgatgaaggttttaagcattcaaacagtggccaattttttggcaagaattatttgttgagtccctttcttacagatgacgtcagaaaaacaacttttgtaataaattacgtttaagggattagatgggaactctcagtgccaggggaagggagcagaaaggggaaatttcaaaagcaagagagtaaatcaccgaagttctcagaggctaggagtctcagagggacagccccttaaactcccaccagataaaaagatgtttgggaacatgagaggttggaggactttatttgcctctttcttggagcctgggaaaatgaccgtgagccctgcctgatgaccttgtcgtataatcaagataccagaatatttggccctcaaaatgaggcaagatttacttagaaaccagtggttcctgaagagttctctcagtggggatgaagggatgccagggaggaagtagggcaggagaggtggctgcagacacctcagaggatgctgaagtggaagggcgatcaagcaagaggccgaatgccaacctcactccacccccttcgcattactagacaccccatgtggtgtaaattgactaagtttgtgtctcacttgagtaagaaaactctaaagtgtctgaggaaaaaaaaaaacttggaatgggtttagctaagtttcagtcatccagcaactaagctccattagagagagatacgttatgttacacatctgaattttgttaattaaaaatattgtacttccaaagattaccatgacttcagggaatgtgctttatttcctgtgtatatgcagaaaatgattttggagcacttgcttgacactagagtcagcttcataattaggaatgtaaactattttacaaaagtccccttaatggattcagtggagagaagttaattaccagatgttgatatactcagaaatgttcatataatctatcagttgattgagaatatttaaagtggttaatgttttgagtaagaaatcaccaagatcaaccatctctttctctctctgcacgtgctcagtcgtgtctgactctttgtgaccctctggactgtagccttccaggctcctctgtccatgagagtctccaggccagaatactgcagtgggttggcatttcctcctccagggtatcttcctgacccagggatcgaacctgagtctgttgtgtctcctgcactggagggtgtattctttaccactgcgccacttgggaaacctgtatccatcacaaaatcttcagaactttgcctgtcaatttctagaaatgaccacttaagataatagattctgttttgtggacagtgtttggagttggttctgatatcctaactttcttcgtaggtataagaccaatgaaataaaaactatgcttttgaattaaattgctaaagttttttgcttttatgactttttagtgtaattaaataaaaaaaattttagtgagaatttcatttaagaatgcattttttcacatacctggtaattaattgtttcctagagggctttgaagatatcaaaattctgaataagacttggatggctttccctaatcacagaatttcaatgatcactataacat

SEQ ID NO: 44196 - DNA, 784 bp, Bovine  19866881438750
acaaaggggaaagctcatttatttttcatgcttctttgtcgtgttgttccctctgcttctgagaaaagggcaccagcctatttagacagggacgtttcggctatttataaagtgaagcaggttaattgaaattgacagcttggtaatgtcctccgtggcttatgacgcacatggatgatgttggtgtgccgtgtggccttctagacaggaatctgccggaggaatgtgtgtgctttgagctctggttttgacgtaggtactgggtacggatatgttttaggaaacatcttatttccatataaatgaaggaagattaaaaaaagcttttttttttttctaagatggttttccctgaaattccagctgctatcacaaggatgatgaaaatatttcttttgcttttctggaaaaacaactttagttattattcatgcatagtgaagtcattataggtttattcagaaatacattttgtattcattcattggaatcttttttccagcatcagctatgtgtacatttttttgaaaaaatatgcattttttatgcatttctctaaaaaacactctaggctctcaataagttttagatagcttcacttagtatatttgtatagtttcatcaataagtatgtccattgattatcagaaaaagaagaaccaaataggtcattttctttcttacacgatggaaccctggttcttcttctgagacataataaaacatcagtttgactaaaatgagtttttgggtttttctttccatgtgtcacttaaagaagagt

SEQ ID NO: 44197 - DNA, 842 bp, Bovine  19866881518849
ccaggcaagaatactggtgtgggttgccatttccttctccaggggatcttcatgacccagggattgtacctgggacttctgcttgtcaggcagattctttacctattttatacatagtatcgacagtgtgtatgtgtcaatcccaatctcccaaattatcccagtccccttttccccttggttctctacaataagttttgaataccattaatgtacatattatatttctaaatttttacaatatttacattttaagtttactaaatcatgaatgttctctctttactaatgaacatttactctggcaagaaaatcatcttcatgatttgtgccaagtaatatggtacaaggagggcatagatcatttgtatataattaaaatatctttcacaaatgaatttcaaatttcattctgacaactcagatgttaacacagattaactcagaatttctttggtttttgctcctccttgtgctctgtaggtgtgattctaatcattgaaatgcccatggtagtttggaatcttcaaatcttataactaatctctgatattcttaagaacttttggcggctgggtggagagattttttttccccgtttttaaaaaatgtaaaaggtaaatttaagtctgtgtttatagtatgaaagtttctcaatggagagttttgggagcaattgtaagtgaaaatgagattataacgtaaattgtcttgagactgtaatgaggtaaaagtgttttgtacgacaaaagctgtaatcatattcatttgggcacggccagcatgtcaagcactttcaaggtaatgaatgcattccagaagattgtctgattttcttcaca

SEQ ID NO: 44198 - DNA, 3427 bp, Bovine  19866880658302
gttaccatccttcaaatcccacttcaatgtcatttcctgagggaagccttttcaatacagccactttccacccactgttagctgtctcccagttatgtaccgaacactcaaacgcttttcacttatttgatcaaagtctgtctctccccctaagatgcaggagcttcaggaggatcgtacccgcttttttcattgttctatcccaggcacctgaacactgactcaatcagtaacttcagtctcattacatttgcttttcactctcttaccagttgcacgtgtgtgtgcttgtgcccagtggtgtctgactgttggcaaccccgtgggctgtagcccgccaggctcctctgtccatgggattctccaggcaagaatactagggtgggttgccacttcctactccaggggatcttcccgacccagtgatcgaacaccctatgtcttgggtgtcctgcattggcaggtggattctttaccactagggccacctgggagctcctacaagttgcatataaaaatagaaattcagatttaccttttcaaaaaaatacatggcaaaattaaccactaaagtgtaccgttaaggaatagcaagtactttcagagtgtttctcaaccaatctccagaattcattttatctagcaaaactagaagtccatacccactgaaccactccccatcctcccgcccccccgtccctgctctctactgctttcgctatgattctgactacttgaggcaccacaggtaagtagaatcacgcagtatttgtcttttggggactggttcatttcacgtagaataatgccctccagattcacgcatgtcataacctgggtcagcacttccctcctcctcaggctgaaaaccattccactgtaagtgtatgcctcgtttagtttgtccacttgtccattcatggacacttgggctccttctaccttttcactattgtcaataacgcgctaagaacatgggtgcacaggatctctttgagattgcttttaattctttggggataacctagaaacagaattgctggatcatttggtaattctatttctaattttttgaaaaaccgccaacctgttgtccacagtggctgtagcattttacatttccacaaacagcacacagggctccactgtctccacgccctcactaactcttgttatttagggttttgtgttttggggttcttgatagtagccaccctaatgagtgcaggtggaagatttgcttgtcttttggctgtgctgggtcttcactgctgcacggggacttttctctagtcgcggtgagcaggggcttctcactgcagtggcctcttttcttacggagtacaggctctagggtgcaggggcttccctagttgcagctcttgggctcaggagctgtggttccaggctctaaaacacaggctcaacagtcgtggcacgcaggcttagttgctccgaggcatgtgaaatcttcccagatcagggatcgaaccagtgtctcctgcgctgtcaggtagattctttaccactgagccaccagggaagccctagatttgcttttacataaattttatgtgctttctttctcctacaaacatgtgctaaaagccctctaaaatatgctccatgaactagcaaaagacaattccaaaaggtattgaaagtaattcagttcagtcgctcagtcatgtctgactctttgtgaccccatggactgcaacacacacacagccttccctgtctttcaccacctcccggagctggctcaaactcatgtccatcgagtcagtgatgccatacaaccatctcatcctctgtcatccccttctcctcccgcgttcaatctttcccagcatcagggtcttttccaatgagtcagattttcacatcaggtggccaaagtattagagtttcagctttaccatcagtccttccaaggaatattcagaactgatttcctttagaatggactggttggatctccttgcagttcaagggactctcaagaatcttctccagcaccacagttcaaaaagcatcaactctttggcgctttctttattgaaagtagaaaagaagaaatagtcttttaaagcaagatttaagggacaataaaattgtaatgcatgtgaaatggcaaaaaaaaaaaaaaggagaaaaaataatgggaaggtattcccattcaaatgtgaaatttccaaatgccacctgcctgcatgaccttctgaattccataagctgatgttcagccttctactagaatgcttcctttcccctcctacctgctacctgtgttctggaccagtcccttcctgtgatagtcttcctttctgtctcagctccacccagctactgggtcagtgcctgccttacatatgggatgactgagtggcagggctctgttgttcccaggcggcaaggtcactgtgttccttggcattggagggtatcagtgataagcacagacggtaggagagctggggcaaaacaaatcccattacaaccctgaaaacttgaattaaatgcctaattaaatttggaaacataaaaagcttcacacaaagcaatacatcaacacatcctaaatgggaaatatatcctggtcttgggattccttgggtctaaggaatccaaagggaaccttaattaagtagtaaagaacttgcctgccaatgcaggttcaatcccttggttgaaaagatcccctggagaaggaaatggcaacccactccagtattctggcctggaaaaatccatggacagaggagcctgaacggctgcagtccgtggggtcacagaagagctggacacgactaagagactaaacaataacaaagatttcagacaatctagaagattctctggacctagaagtcactagctaagtacctcccccagagatctaaagtatagccaaaaaaaaaaaagtttcaaaacaaaggtatgcatttaatactgaatggtttgcattcaaaaataaaagatctattaagatttgtaaagacacacccagcaaacagtcaaaacttatgaaatagttgttattgcttcatcaaaatttaagtcatcgatgctggaattatttttcaaagaacaaaatgttttatacttacagttatgaaaatgaacccatgtgtaaaaactaagtgggctagtcactcactcatgtccaactctgagtaaaaactaaaagggaatattaatgaccattaatcctaaaacaatcaccattctaccatatcacacaacagatatcacatgataaagtttaagtggaggctaaatagtaaactaaaaatttctttatataagttcagggtcatggtttttaaaacggtatgataatgacaccaataaagaaagttacaaaacagaaacaggtctctaattttattgactcttgtttcaatactcagaaaaggagagt

SEQ ID NO: 44199 - DNA, 1469 bp, Bovine  19866880998656
gagcttttcgtggacagtgaaactgcggtggatcttcacggataatggaacggggttcctgcagggggttacctcatctgggtgggggaggacgatcaccgacattgtccccgtgtgaatacgctgcatccgggatgacagccccacctcggggattcgctgaacccggtgaatcccaccttcgtacttcaagtgcttatagacgttatcaccagaaattcgggccgctgcgtgatgtagcccacctatgaaaaaagatgttccagagtgataatacattctactttggaagggaccaggaccttaaatggcctccatgaaaggcctctgtgagcacagagcctgagatgagaacagaaagtagatcccaaagacacttcccagcctaagtatgtgcatatgtaatagggaacatgccaaacgattgcttatggttatctctggagaatagaacagcagcatgtttttcatcttaagtgtttttgttgtaaagtttttatatgatgaacaaatttcacttttataaaaatagtattataaaaaaaagaatactggggcattttctgcattgaatcgatgcaatcttaggctaatttggtgccatatatgagtgctcaataacacagcaatatgataatgatgaataattctgtaggttctcccaagctttcaaaatctattgaaatttaattcttgcttgtctgtgaagcgggaaaataagcacaatgcctaagctagcttcttattgaacatattgtttaaaaaaatatttttattgtaaaataatatacagacgtagaaaaccacatgaatcaaatgcatggttcaagattaagaaaaagaactttattaggcacctgcaaagccctcccataggcctgcctttcctacaatcccttccctttctcaggtaaccagtattttttatttccttctctactataattttattacctaatgtgctgccctaggcactacagtatagtcttgtccatttaaaaaagttgatatgtctttcaagcctctagtctataagttcatcacccatctcaagttatccattgaggaatcagggctgttgacatatagaaatttcccacagcttggttttgctgactgcatactcttggcatgcttcaatctcttttctgccctctgtactggctgctactgggcagctggatccagaaactagattgaactctggcaagacaacaggagacagacaatgtctggctgtctgtttttatggtgttgacaatgtttgatgcttcatgtaccacagaggttgtaaaagggtgatagtccaattctatgggcttcccttgtggctcagctggtaaagaatccacctgcagtgctggagacctgggcccaatccctgggttggaaagatcctctggagaagggaaaagctacccactccagtattcaggccggagaattccagggactgtatagtccatggg

SEQ ID NO: 44200 - DNA, 1958 bp, Bovine  19866881062951
attttttttttattgaagtatagttgatttatagtgttgtcttagtttctagcatacagtgattcagttacacctatatatatattctttttcatattttttttaatttggtttattacaggatattgaatatattcaattctagtgtgctatacagtagaacgttgttgttgatcttttatgtatatagtattatatatctgctaatcccagactcctcatttatccctcctcattccctatcctggagaaggcaatggcaacccactccagtactcttgccaggaaaatcccatggacggaggagcctggtaggctgcagtccatggagtcatgaagagtcggacatgactgagcgacttcactttcacttttcacttccatgcattgaagaaggaaacggcaacccactccagtactcttgcctggaaaatcccatggatggaggagcctggtaggctgcagtccatggggtcgctagagttagacacgactgagtgacttcactttcacttttcacttccatgcattggagaaggcaatggcaacctactccagtactcttgcctggaaaatcccatgggctgccgtctgtgcactcacacagaattggacacaactgaagcaacttagcagcagcagcatcccctatcccctttggtaaacataaatttgatgtctgtttctgtttcataagtaagttcatttgagtcatagtttagattccacatagaagtgatatcatctgatacttgtctttcttccttttctgactcacttcattttgtgagataatctccaggtccatccatattgccgcgcagatggcgttactttgttcttttccaaggctgagtagtgttccattgcacatggatgccggaccttcttaacccattcatctctcagtggacagttaggttgtttccatgtcttggctattgtaaataatgctgcagtgaacactgaggtgcatgtgtctttttgtattagagttttctccagatatatgcccaggagtaggattgctgagtcatatggcaagtctatttttagttttttagggaacctccatactgttttccatagtgactctaccagtttccattcccaccaacaatgctggagggttcctttctccccacaccttctccagcgtttgttattcatagatttttaatggtggccattctgagcagtgtgaattgatacctcctttgtagttttgatttgcgtttctctaataattagtgatgttgaacatcttttcatgtgcccattgtccatctgtatgtcttctttggaaaatgtatagtgactgaatatttttttattttcttttaggtgatatctgccaacaatttacccgagaaatatttgatatgtaccagaattattcaagctacaaacactggagatttgaacttctgaattatacaccagctgattatggtaagtgtgtttgaggattttgtccatagacgatgctgaaaattattttttctctgcttttgattagaaccatgttgtcctgttttttaaaacatatggtctgtatctactaaatattgtgacatggactcatgaattacagtggcttactatagtagaattcttgctatagaagaagagaatgggagaaagagaagcatcctctcaggaaggaatatatgaattagcaaaacttttcctgtggagggttgataaatgccttgcctgggaaatcattgttctgttatacaaagccaagatgtattaaactttttactctaaagtacttataatgtgttagatgtttatgggaatgcagaaaaagttagtcatttatctttagtttcaaaatgctcccactcaagctggactgataaaaacttagacaacataaacaataagaaactagtgcaagtctttaaagttttaaatactcagagtatgttaaattagaacagctgataatt

SEQ ID NO: 44201 - DNA, 701 bp, Bovine  19866881162298
tgaaaaacttaaataattagggaataataattacatgttttctaaatatttatgtaactgaaaattattaaagtaaaagtgaaaattagacagtcttcaccgctgctaaagtagcttcagttctgttttttgaaaaaggagagggcaagttgaatgaggtgatcttccaaagtaatgactatatttctaaaataatcatgataaaaccaatcacagtggagaaagtaaaaatgagtttcgaagtagaatttgtaatgcagtgtcacttgagaataataatgtacagctcagtatattatagaaacctctttgcttttccattgtattaatgcttttaaattataaaaaataatacattggagaaggaaatggcaacccacgccagtgttcttgcctagaaaatcctgtggggagaggagcctggtgggctgctgtccatggggtcgcaaagagtcggacacaactgaagcgacttagcagcagcagcagcagcagcatactaaaattctcaagttcagacagttcaccagcagactaatgaacagtgtcaggtacaattttagacagtttaaaagatcatcaaaagtactacttaccccctgtttctgtattataataataggtatagccatcttcacttaacccttctatccacacagtcttccctgttgcctaatgggagggaaaaaacccaacataaa

SEQ ID NO: 44202 - DNA, 1493 bp, Bovine  19866880128347
actaggcagacctttgttggcaaagtaatgtctctgcttttcaatatgctatctaggttggtcataccttcccttccaaggagtaagcgtcttttaatttcatggctgcagtcaccatctgcagtgattttggagcccagaaaaataaagtctgacactgtttccactgtttccccatctatttcccatgaagcaatgggaccagatgtcgtgatcttcgttttctgaatgttgagctttaagccaactttttcactcttcactttcactttcatcaagaggctttttaattcctcttcactttctgccataagggtggtgtcatctgcatatctgaggttattgaagaaatattagacctaaactaatattggtacattatagtgttctctcatctaaccaaaaaagtgatttccaaaaagtattaacacttattatggaaaaagttatcaggacttttgttaatagcaggtttctggaaactaaaagaacgtaaacaaacattcaagtttcatcagattcatataggaccaactaaaaataaaagatacatgtgaggctggtgaacttaaatatattcaagcactgatgtctgttagacttgatttttctaaggtgaggggtatttgggttgtaattatctagcatgcaattttcatagtgttatcataatagtatctcataaccaaaatatatacatttgctgatgaaatgagctgttattttttcttcaaaatgggataagaatcagtgatttgcctttcattgctagattacaatgaaatcaacaaaagcataaattttctattttttttggcattatgccagatgcctcagttataagatcattttcacaagactttatttgccctattaaattcacaaatgaaagacttttatagcctgtatagtatccttcccttctcctgcatctgagtttgtctttcttttcaccaagaaagatggtgctttacaactcaaagagattaaatttgagggtgacatcttcttgggcactccaatccatcacatcagagaacccaattaccttagtgatcattgactaactagtgctaagaaaatctccaaaatgttgtccttccaaaccaaggccaaagtacaaataaagctttcaactaaccaaagcgccctacagtttcagcctctatttgcaaagagatcctttaaaagtctgctgctctgttttgctgcttgctttttcaacagaagaatcaatcccagggtgtgatccttgtccactgtgaagaggtgctagttgtctgtaatcactgctgggtatcaccatgcttatatgtactgtttcaccctggcctcacagagagggaattcaggaagtcagtcagggggagataacagagtcttcctacgtctagaataaaataagggcgagtcttctttatatgtagtcttctctagacttctctatgtttacctctaagcagagatggtaggggggagatttttcctcatgg

SEQ ID NO: 44203 - DNA, 2588 bp, Bovine  19866880442706
ttccttttcttttctaaaatggcggatggaaacaggagggacaactctctacaaaatggaaggcagagcccattgccatatttgaacatctaaaatatatgttttgtttaatttgatcagagcataatgaggctgggtccctggtcagtgggagctccttgggtctattttacagccttcattctctttcccagggccataaatgaaaccctttcagccctaatgaccacaatgactttcctcgatcatgttattgctactttggcacatttattgctttcacatgcactaatggatgagtttggatatgttaacaatttatatatcatttgatcctaaaaaagaaaccccaccgaactaacttagccctcacgattgagtagcttttaaggagtataaatgaatttaatgctttagaaagagcttctgtaaattatgaacatgacacctattacattaagctgcattaagcattaatacatcttcattactggcaggttgccaaaacctccaaggttgaaaaagctgcctgaaaatgttcaatgtgacagtcacctaggctaagattgatggttcttttttgggttatgtgagggatgtctattgaccaggtgcctcttccacttccagacaaagagatgtaagtggtgtcaaccagagttcctcaaaggctgaatttaatggccaggcaagaacttctgtaccttgtgctgttattattgggagaggttcttgagtagggagatgccaggtgttccaacctttcaagctaaaagattgagtagggggcacaatattcttttctgtgagagttacatgtaatgcttattatcatctcacagtacggaattgttaacaatacttattgataataatcggggctcccctcatggctcagtggcaagtcatccacctgtaatgcagtaaccatggagacttgggtttgatccctgggtcgggaagatcccctggagaaagaggaaatggtaatctactccagtattcttgcctgggaaatcccatggacagaggagtctggtgggctacagtccgtggtgttgcaaagagtcagacacaaccgagcgactaaacaacaagcagcgattgatactaattgctaccttttcttaaatgtttactgtgtgccaccaccgctaaacgctttgtgtgctttctgtccttgaagcctcctaatgaccctgagagttagatattattatttattccccatgggtacagcattaattttctagggtggctataataaaatatcacaaactggtgacttaacagaaattaattttctcacagttctggaggctgcaagtctgaaatggcggtgttggtagggtcacgctctctctgaaggctctaggggacagtctgtcccattcctttctcttagcctctggtattgcctgcacttgttgtcttgtagatgcccccctccgacgtctgcctccgtcttcacgtagctctccctgcatgtgtctgtcttctcctcttcttgtgagcacatccgtcacattggattaagggctcaccctattccagaatgacttcacctgaactaattacagctgtaaagatccagtttccaaataaggtcatattctgaggttgagagagagtgagagagatagaggagatgtgtcctgggtgggaaaccaccttaagcagttgtgacacttgtagcgtattctgtgtggcgagggcagtgactttcgtttggaactgctggagtcttactaaatgtggacaccccatggtcttaggctctcagccccaggtgattttagttaggccataggccaaagccttcagtaactgtggatcttgtgccttgaaaagtccaggagagcaccagttagttagtctgaccccaaatgtgtagtccatgagtaaaggaatgatttcttttgatgagggcaaaaatctccagcagtagttggccaagcagaggtcaggatatttgacaaacatttattcaacatttgtcccactgatgataagagaatgggttccctgactgacaggaagagacagaggaaaactaaaggtttatgggttcactgacagaagaacatggggagcttagtggggacacagagcgggaggtgactggtgggtctgaccagactgcctggactgccctggttaaaatcttagttctaacagcttctggatgccagtttaagctaagttttatatgacatttctaagtctcaatttcttagtgcctaagtgggataatagtatcgacttcatagtgttatttcaaatattaagtgagaaatcacttgtgaattagtaatgactatttttggtcatgagcaccaagcccattccagttagttaaagcgtaaaagggaatctgtcagctgatttgacttgcatgtccacaagttcatttggctgcagccacagaacgtccaggtgtttagtaacgatgctgccaagatactgtcttcatcttctggttctgacttcttcatagacctcactatttttcccagtgtactggcaaaaaaaggcttaatggcagttctagacttttaacctaagagtgggaagtgaatactgcccta

SEQ ID NO: 44204 - DNA, 2444 bp, Bovine  19866880487370
aagtataacattgcattctagtagaggaaacaggcaatcaccttttgctccctaatgtggatacccaagtttgtaaatttaataaaaagataaaaaatgtggcagtgtttttatctgaagcaataaactctgattaaatcttgccagtttaatgctaacagtctttctcggtagcatgaaggtgagtgagagctttggacaagataatagcgacagacaaatgtgaaagaatatgaagttttaaagagcctttcagaacactaaagagtttaggaaattaaaataatcaatatggcttttcatgctcctcaatagtcttaactgcctaggttcattcacttctctgtcattgagtaaatctatctcctccactgtaatgactgttccttactctgtaatgattatctttcatgttcgtttttattaatttttaaaaataaagataggccagaagtaatctgcatattatctactgagtccaccaggatgctagtcagctaacctcgttgttcttacaacaaatgagatacgtttgggaaagaagagatgtagacaggagtttataatgacacatttaaaaaattgtttttttcattgtgttgagcagaggctatagcatatagggaaaaacaatagtagatatagggtgttacaaatgcttggctatggagatacaactatattaatgtctaacagtgatcttcaaaatcagacactttagaaataatgctttctattaatagatatttggtgaaattcagtctaattaatatatgcatatttatacataaatttagagaatggtagtgtctttagttagaacacattggaacaaatgttgagattaatttcttttatataaattttgtttgttcttttatatctatcacatatgcatgaggataacattttgataaaagaagtgagagtttgggttatcattttagagaagaggcagtggttatcataatgattttgccttaatcatttgttctgtttaatgctaatagtaatcaaggaattccaacattacataatttctgacttgaagtatagcttgcatctttatttagatactaaattgagctggcttcttttaaggtttcagagttgtagttagactaaaacatattagtttggcacagctttcaaaagtgcaccctgtgttagatcacgggggccataatggcttctggaatgatctattatttttggcatataaaaagaagttataatgctgttctttaaaatttatgtttcataataaaatgaataattcattcactcatccactgacaagcagaatacttaaattaatgtctcaaagtaaaaaatcagcaccaaaccaaaaaactaggattgaaggtagagaaagaagcctggctattagggtataatacattttcagaagataacggtaatataaaatgagtctgaaagtcatttataaagaacaggatattaaaagctataagaaaaaaaagaccatttatctatttgtgtactattttgaagacttgagccaaatgtttcatcagcgctttgggtgccttccaataaattgggcagggttgatatgtgtgtgtgtgtagggaggggtgggagacagcaatctccttttcctttaagcttggtttatttcaacctccattcattaattcaacaaatgcctattgagtaggtgatatggataaggcaagcttctaggtactataacatacatacaaagatactaatatataaggcatggagtttagactttacaagtgcagatggcatacctatgtgaacttaaggcatggttaattttacaaataattgtgaagtaaatttttaaatgaaattaatttattaatgaccagttaaggataatcaaatcaatcttaattcactttcttttttacatgttcgataacacattatcattaacataatgagaatgataagagccacagaacatgtctggcactgttctatgtgtttacatgtgttttattgttgagtgagtaagtcatgtcccactctttgcaaccccatggactgcagcatgccaggcttctctgtccttcgttgtctcccggagttggctcaaactcatgttcattgaggagaaggtaatggcaccccactccagtactcttacctggaaaatcccatggacggaggagcctggtaggctgtgtccatggggttgctaagagtcggacacgactgagcgacttcactttcccttttcactttcgtgcattggagaaggaaatggcaacccacgccggtattcttgcctggagaatcccagggacgggggatcctggtgggctgccttctctggggttgcacagagtcagaaacgactgaagcgacttagcagcagcagcagcagcagcatgttcattgagtcagtgatgccttccaaccgtcttatcctctactatcccctcctc

SEQ ID NO: 44205 - DNA, 1490 bp, Bovine  19866880492869
ctataatcataccattctggaggtcagactgaaaaagtaggttttgctgagctaacttcaaaagtgtcggcagggctacattcttacagaggctctggggagaatctgatctttgccttgtccatcttccagaggcagcccacattccttggctcaaggccctttccccatcatcaaagtcagtcatcacatcactttaacttctgcttttgtcttcccatttccttctctaactctgactcctgtgcttccctcttatgaggactttgtgattatactaggctcacccagataatccaggataatcaccccatctcaagattttaacctaatcacacattaaaagtctcttttgccatgtaatgtgatatattcacaggttttgagtctcagagtataagcatctttaggggtcagtggctgagatggtttggatggcatcaccaactcaactgacatgaacttgggcaaattctgggaggtggtgaggttcagggaggcttggcatgctacagtccctggggttgcaaagagtcagacacaacttgctgaccaaagaacaacaacaaatctttgaggggtcattttcctgcctacaacagttaagaaaaataataaaatcagaagcgccaaaacttatgggggattgagccttaactggtgttaaaaacaagttatgtcaagttttagaaagcatgtaacattgattaattcaaggtctagtgtaaatgaattctctagaaagcctttctaacatttttacattaatcaagttttcaacaaaatgattgattaaaaaaccctccttgggctaagttctcatcacttttaacgattctattataaaacaaataataaagagccaaaaaacaaaaaatagtttattgaaaaatgttttcctacattatactgtcctgtgtcaaaaggttagagagattatgtgtgccagctgagtgtgacacctacttagcaatagaaatgtgcagcatagtaaccacgcgagcaatctgaaaactgatattgctgtgtgtttttttttcccccttgtagcatcagatcaaagtttaagggtttgaaattttaactaaaataacattttccttaataaaattataaaataattaaaatctaaaagtaaaatttcagccttattcttgtattctcaaagttattctataatcatgctatttgactgatgttgaatatttaacacttggccttttagtttcaactaaaatgtagattttgtgcactcttgctcatgtgctcagtcatgtccaatctttgtggtccccatggactatagcctgtcagactcctctgcccatagaattttccaggcaagaatactggagtggggcaccatttccttcctccaggggatcttccctgacccggggattgaaccgagtctcgtgtctcctgcattggcaggtggattctttaccactaacgacatctgggaagcccctcttgttaacccttcccca

SEQ ID NO: 44206 - DNA, 1426 bp, Bovine  19866880510734
atggtatctttaattaattctgtctaccattaaaagaataaggtcactcataccaaaaattgttgaatgaagcaaaaatgtaagaaagatatactctctgatgttactcataatgaagaagggttatctgctggtcaatacaccacccattatttcttagttagaggtattacgatggaaaagaggcaatggttataggaacctaatgtgattatcacataaaatatactgtattggacagaaattattccatcataagccagaattgtttctgtggagcaaaaatgattacttcaataagacatctttagagctagagctaaaggaccacctaagagagtgcctagcctgtttatttcacctctgagcaggctaacatgtatattgctttggaatttcatatatcatctgggtctaacacatacccatttgacatatgagaaaatcaggatgcccaaggacaaagtaataaataagatctaaacccaggtcttcagttattctctgccaccaactcttgtgccctctctatagtatgttctttccaagaagagttggggatcccttttgatgaattgcatgtataagaacattgcctaagttgtagatggagatagtttgaggtgggcaagaataacctcatttcatgctctgtttgaaattgactaagaaaagataaggggcttcccaggtagctcagttggtaaagaacttgcctgaaatgcaggagatgcaggaggcttgggttcagtccctgggttgggaagatcccctaaaggagggcatggcaacccactatagtattcttgcctggagaatccccatggacagaggaggctagcaggcctctatagggtcacaaagagtcggacacaactgagcctgtacgtaagaagggatgatgacaggtgaatgcccaaagatggctgaaatgttaatgatccggatgaacactgacatgtgacgtaagacaggagagactgctgctggctcccatagctgccatagcctttctgctccccgggcttcacggctctggaaggaagtatagcccccctggtgttctgagaacaagcatgccctctggacaggttcatcatcagcattattttcaactacataaatgcactgcctcttttttccccttagtatcttcgcaggtgtctttcatgctctagtaataatctgatagattatattacaggtcgttactctaggcagctgccctactagtccattccttaatccagtgttagatttaatagaggatattcttattctgttgttgttccctaaatgaaaatgatcagtcaagaactatgtatttatgcttattgtgggcatagtacttttgggggaattcagaaaatatccttattctcaaggagtgtgtaactcaggaaaggtagaacttttatatatatat

SEQ ID NO: 44207 - DNA, 3579 bp, Bovine  19866880547620
gactgcagcacgccagacttccctgtccatcaccaactcctggagcctgctcaaactcatgtccatcaagtcggtgatgccatccaaacatctcatcctctgtcctccccgttccctcccagcttcagtctttccctgcatcaggggcttttccagtgagtcagttcttcgcatcaggtggccaaaggcactggagcttcagctttcaggcatcagtccttccgatgcatattcaggactgatctcctttaggatggactggttggatctccttgcagttcaagggactctcaagagtcttctccaaaaccagagttcaaaaacaccaattgatgaaggtcttaaatgccagcataaggttcactcacaaggtcttctaatacctggtcccactggcttttcactatatggcgccctgtacaagctgagctaggatcagttcttcccactgcttaaagtgaagagaatctctctcatgtatgtttctcttggtaggaagaagggtcactgaaataccctgtatgaacgcaggttcaagttttattgcatggactctggtatactcagccattgtttttgtagctgatgttaaagtccaaggacatagctaataaccacactcttttagaaacaaatgactggatatactccattcttataacaaccaggcagtggtaaagtaaacctcagccaaacaaaagaaaacacattttaaatgtccatagagacacagccacaaagaagttatgctcacttaacaactccagccccaagaaacctggtacctttcacagtcatggactcatttaaatgggggtttcaagaaaaaaggctaaaataaacattaatttaagtgaatccatttccctccaacccccactccccacaaaaggaggtaaaacagtcctagtgagatggaagtaaaaggatattaataaaaatacaaagataaatatgaaaaaaagaggaattttgttatttttgttaaggggtaaaggcagagaggggagaagagatctctcttggcctgaagccaggaaacttaagataaaacttttcttcccttttgcagaaaaagaaatgctctttaacaaagaaaaatgtcacccgaatctgaaataagagcagcccaaccatgtttatctttgacttgggatgctgacatcaacaatggtgttcgcctgttaacctggtgcccttatcaaaatagaggaacattttaatcactttgttcctacttttatcttggattagccccatttttagctttggtgaacttgaattaaagaaaaagcatgcagaaatttaacaagagttatgaatacctcttacaagaccaaaatccattatgtaaatcctgatttgggctccctgtcaaaaaatatctttaggaccctaaagttattccaataacatctgcataatatactttaaacactaaatgttctaagaggttattggagacttttaaaaaatctcaaaacagttcttagtttataatgttggttagtttataacaattaacaaaataaatatgcttgccagcctacccaggaaaccaaatataagacaaataaatgaacacgattagtaaattcatcttctggatttatgagtttttagggaaagcttgaaatgttttcaattttttaattcccacaaaagtgaataatgctgcaataaaacctcaaaacaattgatgttttaagaaatgaggcgttgctgctaaacttcctactactaatttaacacagatttcaagctgaaatcaagacaatatgctttcttcagctgtgtttatgtgacttcccacatccctgttaattctcttttggctttcatgtagaagtttttggaagaaagcaagcccagggcttcatccacccaccgtaaaagggtcaggtgttccagaacgcatcgaatggaataacagcacctatatttcttgtttaataaatatcatgagaggagtaaacaaatgctacataagagaacttctagtaatttgaaccggatatctctgccacataaatcttaataacttatcaaaaatctccttgtgcagaagacagtttattctttatatttcaactaagacaggatgtgtttaggtggcctaatcaaaagcctgaaggaatactgcagaaaaagagttttggtttctggattctgtctttacacaacttctttgacacaatgtctccctccagcacataaacagaaaaccctcactcctggtgacactcctggtgacagtacatcaatgcacgcgactcagcaatgggcagcagtaaacaggaattggatccgcccccgctccaccccgcccccacccccaaacgtcattgtcctgtaggggacgaagtggttatttggaagagccaggaggctgtttcaagcgtgtgtaatctcacagtgatactctcacttagtagtgaggagttgagttcggttagtcattctttttgagactgtgtgttatttcacatgttatttgttatttgtgcctcagtttccgctaggtgcaacagggctgacaaatatactcacctcatctgcattagatggatagaagagggtaaagctgagttgtcaaacgtgttcagctcaggatcgacttctgggcactctccaagatgctcagcttagggtagatgtaacacctgtgagcttgggctcacccggaaagagacggacacacacttggggtgagtattgccccacattgctggttcaccattctgaggactctttgctcttctctggctaactattgtaacttaagatggtggctcagatggtaaagcgtctgcccgcaatgcaggaaacctgggttcgatccctgggtcgggaagatcccctggagaaggaaatggcaacccactttactactcttgcctggaaaatttcgtggatggaggagcttggtaggctacagtccgtggggttgcaaagagttggacacgactgaccgacttcactttcaggactttctaactcttcacaggatagcaggggtctggcttgcaaatgccaaagccgggccctttccagagctcacattcatactgagtttcatttttttcccctctgtttgcagaggaaggtgctgtactcaggccttgacttggattggaccccaaagcaaaagaagttttgcagcttaacacatctctggcctagtttgtggctaaaatgatccaaaggtagggggaggtggcgggcagggaggttcagtaaggaaaagtatcaggaaccagtgatcaaaagagagtcgcaagcagagagccccaaatggagacccctttggcttggaggagcaggcagtcagctgtggcttgtcctccccacagacagactctcagtgctttccgaaagtgaccatgtgcagcacaaatccatccgcgttttcagtgaccgcagccagcaccttggaagcgaaggggcaacgggcagcgacagatggagggcttccgaggcgggcggcggcctttattcccagatgaaggctccctcttgtgtgagtgtcgagcggccatctccacttaaacaatccctttgcagtgaatggttgtacga

SEQ ID NO: 44208 - DNA, 1394 bp, Bovine  19866880667326
gagtatagttactttacagtgttgtgttagtttctgctgtacaacaacgtgtattggctatgtgtgtgcatatagttcctccctgttgaacctgctttccactctcctcccatcctacccatctaggtcaaaaaaagcacccagctaagctccctgagctacacttcagggtctcaccagctatctgttttacatatggtaatgtatttgaacacttactgtgtgcttgacactgcattagatgagtaaataagacagtcagactccctgctctcatagtgcataccgtctggagaaagaataccaatattatttttttttaagttgttcaagtcaaatagaacatcagatggtgcaggctctgttgttggagatctcatagaatacatcgcaccacttttagtgattcttttccttggatgctttgttcatatttgaaatgcaaaacttacttaccattttgcaaatgaatcctaggaattcatgaagtagaagtccaaaccaaacacagagtaactttgggaacagctgctcacagtttgctttccttatgacttgcagcttcccctaacccaagtccgtagcatcctgcgtagacaagcgtggttggagtgtggtctgaactacctaatcactgcttctatggctgggtttctcacaatgagtggtttgtgtttttgaagtgactgctttatagaaaagaattaaattacataaagtcatcctacaagcttatcaagaagagtgtcaggccataaatttttttttcaaattgggaaactacttaaagttatagttaaatcccactattcagtctaaagggaacttaagtcctgaaaattttcttcatgtatgccatagtctatgatcaaaccatacaagagaatcacccctgtaaggttaaaatggtgcctctcaaactgattctttttcatgttttacctaaatcttctccagcatatttgcaataaattatacaaccaaatacatttcacattcattaactggccatgcgtggaaaactcagacactgagtccaagttaataaaatactcataaattaaaatttggccgcgagatgttttttttttccctaagactgacaatttattgatagctctcttaaaattcctgactatgccagcttaaagtgtcatattgttcatgtgatcctatgctgctttatactttataacacttctccacttgaaaggattctttttccttttgcatatccagaattaggatcattaattttctaaaaaacagtttatatgaagtcacattctaatatccaccttcccaatgctgaaaatcttgttttcctccaaacacgtcactttgattttctggagatgcttgtcctggcttagttttcagctgctttcactgtt

SEQ ID NO: 44209 - DNA, 3613 bp, Bovine  19866880673917
tgtccttccccacctcacgttcctgtacttcctatcccctttctctgacctctgtttttcacacagcacgtatcatatactaaaatattttactagatcattatttactatgtttgtctgtctctttcaaccaaaatatatcaattccatcaggcaggactattgtctttattctctgatgtcttctaagcacctagaatagtgcctggcatccggtaagtattcaataaatatttgctgaataaatgaaaagagaatttggagaaaagcaattataatagggaagatagcaattgagctacacggactttttaaaatgtctgatgaatcagttaaggctggattccatatatgtggctggaaagcaaatgctacttgcttacttgactaaaggaccttggcgcttgtttagtgtaaacaaatcctagcttatttatcaattttgtccagtaaaattccacaatcattatgttttgactacttttgtgacttttgtaatgataaacaacattaaagaaaatagcaaaaacgatcttaaatagaaggcgcgaacaacatgcaaaaattctaaacttaagagttttacctgtagccttaggaatatctgtgtgaagggctccattctgacaaggtatgaagccacaatcatggctgatgaatagtgggtcccatagtggtaggctggagtttctcctggccaagaaaataaaagcacaattgaaaaggatgaactgggatatcgggactggcgtatatacactactgatactacgtacaacatagataactgctgagaatctactgcaccgcacagggcaccctactcagcgctccagtgacctaaacggaaggaaatccaaaaaaagagtgcatatatgtatacgtatagctggaagacgttgctgtacagcagaaatgatcaacactgtaaagcaactatacaccaataaaaatttaaaaaacaagaaaaatgagagtaaaaaagaaaacaaaagagtaacacaaaaataaaattagtgttaatcaatagacttgaaaatgctaatgtacatgataaccgcgacacgaagtacagtagttctggcagttgtagaataaaaactttatgataacactgaaacccctcatttatatatctggcaagtatccattttagtataattctgtgactttcccccaaattgagcacatccagcaaccccagggacgggggagcctggtgggctgtcgtctttcgggtcgcaaagagttggacacgactgaagcgacttagcagcagcagcaattcatgttttgaggctaactgtataatagataatccttactagcaagccaccttcaactaaagcaggatactgatgtaaagcaattctttattaggttctggctttgcaatagtatacatttctttgaatcgatgtctacgggtattatgcaatttctgttacacattctccttggcaggggaaaaaaaaaaagattccaaacagggaatattgttaggcttaattttttttcctcctttgtttgttttgcctatttgaaggggtaatatgataaacattgaacaataaatcatgagtatgtaaattgcattattttagaagggactcaattagtatttttttaatgcaaaagggttgtaaaaagtgctcaataaaattaaaagaacatataatggaaaacaatctgaaaaagaaaaatatgtatatatacatatacacatacacatgcacactgaatcactttttgtataactgaaacactaaattaactatacttcaataaaaaatattaaaagaatcaataaaggaaagcatagttcctggcctaaacacgattagggataaaggcgtattatgatgggaaatttctaccctagacaaagcagaaagacttagtttttgccaatacttgacaagctacccaaaaaacaccttccaagcatggccatcagttaacacgcaaaacctgattttcctactttgatagttgtgtatatgcttgcatatgtaacagacataatcatatacaagcaacttggggaaagatggaagggcgtcagaccactaaataatggcttacttttgaaacgtgggtaccaagtcctgcgacagggaaagttacttaccattaggatcttcccagtctttatatcgcttcttatactgagctaatcgttcatctgtctgtgctcccattggcttggccaggtttctaaatgtcttgggattagtaagatcgacctcctaaaatacaaaatgaaacccaattccaaaattactatccacactctattttcaccaccgtagacagaatggctatagccacgatgctttgtcaatgggctagtatccatggggtcacaccagcagagctggactccaagataacgccttgcacctactggttatccatattttacagagaggcacatggcagtttaactggttcagtatgaagatgtctgttttggaaatttattttgcacaggagaaggcactcagaacccaggtttggagataaggaataagagggaaaacccttcccagtcttgacaagggagaggcaggagactgtggacacaaaagctccatttcctctttaccctccgttacccaccaaaccggaggatcaaatctcccttctattctctccccctcctcccctctttcactccagcttcacttctgagcattttcttcctagaggtgaaagcgaagtgaaataaactagggcactcactaacttggtcacctccaaaagacaacatcataccaggccgtgattcccaaatgaggtggattcctccagtctgccagagatcattttaaaggctcatccttaggtgacttaattcatatatttaaaaggaaaccaaaatttacctcctaagcatattaaaagcagacatttgaactatgtaccaatgggatacctaatttgtgttctttttatttaaaactcaacattcaaaaaactatgatcatggcatctggtcccatcacttcaaggcacagatggggaacaagtgaacacagtgacagattttattttcttgggctccaaaatcactgcggatggtgactgtaggccataaaattaaaagacacttactccttggaaggaacgctatgataaaactagacagcatatgaaaaagcaaagacatcactttgctgacaaagatctgtctagtcaaagttatggttttttccagtattcatgtacagatatgagagatggaccatagagaaggctgcatgctaagtcgcctcagttgtgtccgactgtttgtgacccagtggactatagcccaccaggctcctctgtccatgggattctccacgcaagaatactggagtaggttgccatttccctcttcaataaagaaggctgagtgccaacgaattgatgccttcaaattgtggtgctgggagaagattcttgagaatcccttgaacatcaaggagatcaaaccagtcaatcctaaaggaaatcaaccctgaatattcgttggaaagactgatgctgaagcttcaatactctggccacctgatacaaagagtcaacccactggaaaagacactgatgctgggaaagactgaaggca

SEQ ID NO: 44210 - DNA, 1428 bp, Bovine  19866880687253
aaatattatgctcttattttgtgtcagatattgttttgctttgaattcttaatttactcatcacaacatgctatggcaaagacactattgttattattatctccattgtatatagttagtatgacctgaatccaagtgggctagctctgaattttatgattctaatcactacatgacattctctacatagtattaaaggaaaatataatgtataaattgtttagctataatagaatcaggtagtagatttattagctcactatttaaatccaatttctttattccatgaacccatagctcaaaaaactattatagattttaagcaatgcaaaacctcatttgaaaatatattaaaactgagggaactttcccccactcctactcccatcacagcattaatcaacagaaagttctactcaacagtagacatcatatttcatttggaaaattcagtttgctgtggttaattttttaatgctttagatttagcttcaattaccagtgaaaaattacagatcttgtatattaaacattaaaacattcctgtaagatcacatacagtttgtacttctattttaaaaaatagcatcacttcagtatagattgccaccatctatattttaactctttgcaccaattctttcttttgctgaaagcaaaatctttgtggttagcattgaccatagaaatcttaagaagcccaacaaatcaatatctttagacaataaatggttctgtaaattagtaatatgtcaaaagatgtaaggaaagttgtctcaaaggagaactaagaatagtacctcagagcttgcccggggttattgtctttaatgggcaaaattgcactgacagcctgaaatccttagttaatagcaaagctaaattaattcacaggaaatgactcttttgaagtggccagaaaaattaagaactggtatggtcaatttactataatagccagatatagagatgtcaccagattgacccataataatgaatgatcccctagaaggaaaataagctagaaattacctaagacttaaataaacaattttcagggccttacatgtaaggattttaaactctttgatagtactcacaagttatactttaacattctcctacagattctcacctagaagatcagtatatccaaaaataaaaattcactttgtattttaaaagttactaaagttccttgggttggatccaagatagcctgccttaatgccacattcgattatgtatcagatagttttattgcaaatttcatttttaatcaaattgttcattcatttcacaaatattttttacttactatggttcagtcagtatatttgacactgaggatatacaggggaataagaaagacaaccctgccacgtcagccaatcccatcttaaacagaaatgacatgttaaaggaaag

SEQ ID NO: 44211 - DNA, 1702 bp, Bovine  19866880754831
tgggagccaggttaggaataattgcctaatgactatctaaagccctcacactgggccgcagttctacatttatattgacactgccaatacaaggctggttttcaaaatggtctattggaaccgaaagcaaaatcttcttagcataataaagaaagtattgactgaaagttcactcaataggcagaaatatgactaagtgatcagagtcctgtctttgtccgctcaggcttctacaacaaatatcacaatctgggggccttagagagcaggaacttatttctcacagctctggagactagaaactcagaatcagggtgccagtagggtttcactgtatcctcacatgcccttttctcagtgcatgcaggtagagagagagagagaataagcaaggtctctggtgcccatgtcttataaaggcactaatccaatggtaaggtcccaccctcatgacctcatctgaacctaattacttcccaaagaccccatctccaaataacatcaagggtgagagagtttcaacataagaattttgaagagtacacaaattggctagcaccaaatttgcaaaaaatactgcagaatggtatgcctaattttgtctaattaactgtccaactctgttttcaccaaattccagtaattgtatttttcaaaagataggatgaaattaagaaataccagcatttgttaaagtagaagacaaacactagggtggtatattcttgaacactgaggaccacgccatgcttgtgtgtgtgtgtgtgtgtgtgtgtgtgtgtgtgtgtgtgtgttcgttcctctgtccatgggatttctcaggcaagaatactggagtaggttgccagtcccttctccaggggatcttcctgacccagggatcgaacccacgtctcctacattgcaggaggatgctctactgctaagccactggggaaactatctttaagctccttttttcaattccgttcataagaccatttatagacttttattaagttttcctggcaaactttgaagagaaaggtggagaaaaaaatgtattcagtatggtttgctgcagaagcttcggagttacagaagttctattcacagtgggggactgtgaaagccttttcaaaggtatgtttgtgcagccttccaaacaaaaaaatgcaagaccccatagcctgcggttctctcacactcttgaggtgaaagacatctgccctgcctctgattatagcatttaagcctggagggctggccccagaatcctatgcatcatttagaactttgatgctgaatgaattcaaagaaaaaatttgtctctgccagtctggggttgctggtgacaactgggaaaattgattggggtgatgacagagttctcctggttcaattcctcctactgggaagctctcccctagtctttctaaaatagaggttacttttatgtgctcctgatgactctgactcgatgaggtgaaataaaagagtaaaagtgcaaagtgaaaatgaaagtgttagtcgctcagtcgtgtctgactctgcgaccgcatggactgtagcccatcagggccctctctccatggaattctccaggcaagaatgctggagtaggttgccatgtccttctccattggatctttccaacacagggatcacacccaggtctcctgcactgcagaggttttcctaaaaccgcaggtgaagtgttgag

SEQ ID NO: 44212 - DNA, 886 bp, Bovine  19866880791515
tattgaattgctcacagagtccaggtattggttgatatctaaattgttagttgttcagttacaaaagtgatgccagtacagtgtataaaatcttctttctcttacagtgaagcttcaaagaatgccaagttgatgagggaatttcagctaatcccaaagctgctactgactcttcgagatatgtctctatcccagcctaccattgctgctattagtaacgtgctgagcttcttactgcagggttttcccaacagcaatgatctactcaggtagtgaaaacttctgtgttcatcggtctgttcactgaaagtaccaatgagattaagatgattgaagtgaatgtaattgcttcctatccctggataatacctgcaaagttaatactattcaggatacttgtgcatcatgagaaataggcatgtatcttgtaaaccatttgttgccactagtgactaatagaattttgggagaatgggtattagaattagttcagtgagatggattgtcctggacatcaaagtgttcagtgtaggaattcttggtccccagccctcttccaagaccaggctttgctgcttctccagggtatgtgcaggaacacatatgcacatgcatgcacacccgcagtggacatgccatgtcttttgtatttgttctttatcacccaaactgatgatagtatgttattgttgcatattctcaccttttctttaacatgagtgttattttgctgctaatgtgaaatacggcttcaggcacatttatggagtaaatgtagagcagttctaataggcacttgagaattctcatcttggccagaaaggaagaaaaaaactacctaagttattttccaaatagaaaatgcttttaactgcacttatcacct

SEQ ID NO: 44213 - DNA, 2265 bp, Bovine  19866880830129
tgttacagttcatgggcttgcaaagactgcaccataacctggggagtaaataacatgccccaagccttttagatttatttgatgtaatttctacagcaacacaaagtacatattgttgttcccacttttctggaccaatatcacccgaaatagaaggttcccaccacacagcactactgagagcatcaacagtgtgaaaaacccctggaaaatactgcttcctcccttgacacaactaccagagcctcccagatggatggcagagatccttccattatgagaaaaacaagattcgtcaaggcccttcaagtcttcaaagattctaccccaggactgaaaaccaactaaccagatttcaagagttttaagatgtgtatattttttcatattctaacatcttaaaattgagacaatcaaagaggtgctttattcttctggtaaatcagaaggtccctgatatctacgtgtagagagaaagcaatagcttgcttcatgagaactgttaattttttgccaccatttttcccatcaaggaggctataatttgcaaccaaatgaattgtctccttaatgattaaaaagcaaccataaaattgcatcagagaattttgtttccaaccaactttttattatcacttttaatttattaaacactatcaagaaaatacttcttggacttccctggtggtatggtgggtaagaatccacctgccaatgcagatggcatgggttcaaatcctggtccaggaagatcccacatgccaaagggcaactaaacccctgagccacaactgctgagccaggatactgaaaccactgaagcccttgcaccctagagctttgctatgcagcaagagaagcccacaatgagaggcccatgcactgccactaaagaaagcttgagcaaagcagtgaagacccagcacagccaaatataaattattttttaataagaaactattttcttaataagtacaaaccattcaagtgttgaacatcacttttagagaagtatggtaatgactgtgccatcaaggtgtctttttgttaattttaaattgtttgctcacagtttgctcataaaattggtgataagggagtcttccgtatttattctctccacacatcaagtaaaattaggacattatggccaaaaccaactaaaccccagaagtttcatcccaaataaagtgagaaataaatattaacaattctccattctggaaagtgtcagattgagtgaggctgagagtggaggagcgacttgacacgtctacatttcacagcacaggtagccaactcagctttttaggttttgtttcactgccagtgcttttgcttggcacgacttcaagggccttatgtgtccaatccaaggcagcccccttcaggatacatgagccaaactaactgcatgcacaccaggctgggccttggaattagtatacatgggcatgttgtcagagaaagatgtttatgtgtgtgagagtcttaaaggactgaatagaaagatcagaagcaaggttaaacagaatggagctgggaagaattccacatgtccttagaggacaggcagaggataaaagaaggtacagtagggaggcaaaaaacagaagtgcattcttcacagtctggctggcaagccccgcaacagtgccattcttcaaacaaaacctcccttggcctcagatcctgcactggtcaagccagctctattgatttacacaaaaccttcaagactttgatcagttaccaaaatgcaaacattttaaacgatgccccaaagaagcttgtttaaaaaacagttgatgtaagggtttaaaacagtccattaacaatctcatgtagaaatgtgtatacatatatgcccacccttgcatgcttccacgcaaaagaacgtttttatagtctgtgaacaatgccatgtgcttattacacatattcacttcaagtccaaggaaatgttctttatttgcaaatctagagttcaaaatataaaatcaaactcttctttcactgaaccacatgctcattcccactcaaaaagaaaaaaaggaaatcatactctacccacccattggacataaatcaggtgatttacggttggatttattcagaccataaattttttcacaaggtagaattttagggtatgaattaatcacatcatttcagagccctgaaatagccaaatgatcatttccaactttttactccttattgagtgtcctgatgcttgtcaatctgatagatacccagtccatt

SEQ ID NO: 44214 - DNA, 3900 bp, Bovine  19866880855867
tgggttgacttactgacgccttccaattgtaatgagacaattgactaggtatagaaccatagtccattacttatcaaatggaaggctttttgtgaggttgttgttgttttgttgctaagtcgtgtccaactcttttgttaccccatggactgtagccctccaggctcctctgtccatgggattttccagggcaagaatactggcatgggttgccattttcttctccaggggatcttcctgacccaaagatccagcccacatctcctgcattggcaggtggattcgttaccactgagccacatctcaggtagtgagggccaaaagatgtggactttcctggaaagtgggacatgtttccttgcagtatagaggggatgatttcattctctggcactttaacacctgcttcctggcccaaaggctgagtatctttgatcatgtctagtagggaagggttgacaggtcttagaagaactaagcagaatgacattgtacacatacttacccagggagaatacagaacctcaaatgggcacttttggacatcaatctagaaaatgcttggactgcaagatcattatctaatagtgagctagtacaacttctttgcacagatcttgtaaactgattggcaggatgtctaactattaaatcaggccagccaatcacttcatagaaaattgattaggaaagcaattccagaagactctggtcatgttgacttaagaatccacattatttttagctctgtcttcctgtgcaatttttgaaagctgatatttgaaatcagcagaagagaccagcttccttttcacaggtttcatgagctcagaatctcaaaataccagaatagccaaaacgagttgcagatagtaaagacaaagggaggagaaggaagagaaagcaaacagacagtgaagcaatgacttattgatcaatttcaataagatcccaggagtttatttttcctctgttattactaatattaaaagcaatcttataagacaggcattatgattctatttttaagcaataatttaggtgcagagatagcaataaactgatcaagcccatatagccaggaaacaatcaagatgggactccaagccaaatctcactatggactctacactctttccactacctcatgatgttcatgaaagcaaagaagtacaagaacagtcttttattgagcctctatatatacagacaattggatagtaaagaattgcctgaaatgagggagacttgggttctatccctgggtcaggaagatccactgatgaaaggaatggctatccactccagtattcttgcctggagaattccatggacagaggagcctggcggactacagtccttggagttgcaaagtgtcagacatgactgagcaactaacagtttcactttcacttatatatacagacaaaatgttttacacccattttccccattcctcccaacaattccaacaagtgtactgtaatgatatccatcttacagatgaagatatgaaggctcaaagagacaaacttcacctaacttgcatagctagtaaaaattgtaatagcttcattaaccaaattctggtccctcagaaatggcatcccactctggtggagggatcatgggagaaactgagaccaaaccctggttccaatgaatcctttactttccagaaatattcagatgatgccttccctcatgttgcccagtcttcagtttagcttctatttctggaggaccctccaagatgctccagcaattaaagtatccttgccctgcagcccttgacacaatctccaacttgatgatcagataaaataccaaggggagctggaccagaattagagttctgttccatgtatcagcagatcaactagcttgccttctctttcactattggattctgcagaatttcagccttagccactagccagttcattcagtcttataaagattccagcttaatctcagtaactttcttcttctctcatctaccacctgggtgatattcaccagtgactacccagcacaaattctctcaagatgtgttttacatcccatctatatacaagtaggagtgctggttaaaaatccagattctgggatcttatcccagatctactgaatcatctccaggagtggagctcagagacatgtgtatttaactatctctccagtttattctcattttactaagtttgaaaaacatgggttttgcagaacttggtaaactttaggatctgcaggccaagttcagtagtatgaaaatctttcatacagcctttgcagaccaggctcttcatataggacatcaggtctatctctccttgtctgagctctgatactagattttttgttgttcagttgttcatttgctcagttgtgttcaactattcatgagtccatggactgcagcacaccaggcttccctgtccttcaccatctcccagagtttgctcaaacccatgtcccttgagtcaatgatgccatccaaccatctcatcctttgccaccctcttctccttttgccttcaatgttttccagcatcagggtcttttccaaggagtcggctcttcccatcaggtggccaaattgttggaacttcaacttcagcatcagtctcttccagttaatattcaggattgatttcctttaggattgactggtttgatctctttgctgttcaagggactctcaagagtcttctccagcaccatagtttgaaagcatcaattcttcaacactcagctttctttatagtccaactttcacattcgcacatgactactacaaaagccatagctttgcctagacagaatacttgatacaacctacttgaagtgcatactgggaccctgaccagccactgccattactaactgtatagctttctccctaaagatgcttctctacacaaagtacaacaggaactgaattccatgcagtgtagggcttggcaaggatgatgcatgcttccttcacctacatgcactggatttgacggagaaccagagcatgccatctggtcctgataattccagtgtaggtgttgatgtctcgtaggtggggagaatggtggaaccaaaaggaatcagttacacacctatccaacaacctgatacccacattccactgtcatatcttctaaaatcctgtgttctgcttcgaacaaagaaagtagcaaagcctaatgataaaacaatagaaacagctaagtcacgtctttgaaataatactgtgtggaatccactagctcagggcaaaattttgatggcaggaatcaatgaatcatcttgtaagcaagcaaatacccatttttccctgttcctaagggtgcccttttgttggtgatctggggtccctgtgggtaatgattcttgggactcaatatttatgaagcaatctccttctcaaactgcttcacagctccatgatggaacttgctccctccctgtgcatgcctagttctgaccctttacaatttttacctccatccagatctcccgtcatgctggacatgtcattaatgctcattatctatattatctagaattttcttctgagtggtagaaagcactttaaatggcttcgtgtttgaacagctggattaaatggcactctaagggtctgaaagaaataatacatctccccaaactgtctccctccctcaggggaatagcttaatcaccttgtagaatgaacctattatctaatcaatctttaccaaaaccctacatttggtttaaaattcagttaaatagacacaataactcaaataacaaaaaggttaagagagctcacctatatcagtcctttctctaaaaaacaattactctcttagcatgagtggagcacttttaactctttacatatttccttgattctaccttccc

SEQ ID NO: 44215 - DNA, 1766 bp, Bovine  19866880985586
ctgtgtttcttttagttgttgtcgttcagtcctcggttgtgtccgactctttgtgacccccgggaactgcagcacgcgaggctgccctgtccttcaccacctcctggagtttgctcaaactcatgtccattgagtcagtagcgaatagaaatagcatgtttgaaatagtaaccagaaatgtgaaaaaagcccaggaacacttcctaagtcatggtcgtcactcaccttatgtttgtaaatcttatagacgcctccatggcctttctcttcaggcctgaggctattctttttgaatgtccattggcctgctgtgttcccaggggacggaagagttgtatccccctgggatgcttgaggacaagggaggctgaagaccaggttccatgggtaggtcagaaaaggacatgcagagagtctgtgtccttggtggggatgtatttatgctgaacttgcaaaatgcatgagttcagtgtcatctgttttcagtatttcctgaacaattgatttattccacattattaatgaactttgcagcagttccacttgtcagagcctactctgtaggggtcaataatgagaggaaacctgatgttagtgaatccagcttaagtgattctgtcatgctaacgattcaatatatcaggacaaatgtcagctccttccaatatgttaattcctctgatcctatttgcataaactacagtcaatgaaatacaggctccccctctaagatagttaatggaaatttgtaatgaatttttaatatatttttggggaatctttttcaacctaaattattgagttgaaaagtgatatggaacgcaagaatcacagattgggaagaggatgtaaaaatattacaggggcaaaaatataaaggaatataaaattcataggtataaatttcattgtttcttaagaatcccatgcatttgcacttactactttcaggagaagcaattactttctaaagaaacttgagaacaaagcactgatgtattctttttatagtttgagttgagttttcagtttctctagtctctggagttaaatcaccagttcattagttttcccaaagggcattaaatctgggtttcctatctctcctcctaacccacgatatttccatgggatcacccaacatgtgacagcaatgtttattttagagtcagcatttcttttgctctcaagtccaaggtgaatatatataaccatttaaaattaagattaagaagtcagattttattttatttccttttttgagatgagctacatagttatctgatttacccaacgaagtcattttctttctttctttttaaacaaactttaagatttctattcattcagagttcttaagattttatcaattgattgtcatctggggtttattatcaatagctttctgtatcgatttgcactattggcaactgtaattttcatttggactgcagacatttctcttgtctactaatttttttggctttgttttgtaatgtggctcaaacttttacttcttcgctcatgacattcaatagagagtactttattcatgtaactttggtggagatgaaaacaaacaagatagaccaagaattctcattgttaacatttgcctaagtggtttcacgcctccctggggtagttttcagtctcacttaaggtgagataacagtgatgttgctaatggcactcagtgctgtcagtcagcacagagcagcatcagcagtaggcctgtgttctccatccagctttaggcttacctg

SEQ ID NO: 44216 - DNA, 1499 bp, Bovine  19866880989155
tctgtaatgggaagccccattgggttgtctctaagggtaactatgactggaaaagtgtctgcctttgtttaccttggaattcccaagtggcaataaaacagtgcactttgttcctcaggaggacccaattgttgggatgtcgtccaaatgcttccctcctggtggcgcctgtagcccgtcatgacaggacaggaatattgatcaaggataacctaatgaaatattaacgccagtggatgtgttggggaaagagcagatctggtcttgcgagagttacattgggtaagaattagccccattagatggctcgttgagtattcaggggagacaattcttgctttataatatatgcttgggtttgccttatggaaaatttattgttcattcatttgatgcactcctttaagaggtcaactttgactttcagtgctctcagaatttattctttactccattgttccttgaaaactatctttcattggatttctttgtgcattgagttgtcaaatagccagtgcaccctctaaactgctttctacaattaacacatgtgttttgtgattggggcaggaagaaaatcggacttattggtgctagtacttatcaacatggagagggcaaattatattcatcagcctcttcttttctttttttcctccatattaatcttttatttgtctatttataataattcctccaagttaatcatatgttgcttattttatttgtaaattttgtttgggccagtcttttttaaaaattttctttatctttttattgaaggataattgctttacagaattttgttgttttctgtcaaacctcaatgtgaatcagccataggtatatgtatatcccctcccttttgatcctccctcccatctctcgccccatgccacccctctaggttgatacagagcccctgtttgagtttcctgagccatacagcaaattcccgttggctatcttatacatggtaatgtaagtttccatgttactctttgcatacatctcaccctctccccatgaacataagtctattctctatgtctgtttctccactgctgtcctgtaaataagttcttctgtaccatttttctagattccatatatatgcattagaatacaatatttatctttctctttctgactcacttcactctgtataatagattctaggttcatctacctcattagaactaactcatgtgcattcctttttatggctaatattccactgtgtatatgatcaacaacttctttatccattcatctgttgatggacatctaggttgcttccatgttctagctattttaaatagtgctgcagtgaacaatgggatacatgggtctttttcaattttggtttcctcagggtacatgcctagcagtggaattgctgggtcatatggtggttttattcctagtttcttttaaggaatctcaatactgtcttgcatagtggctgtatcaatttacattcccaccatcagtgcaag

SEQ ID NO: 44217 - DNA, 2654 bp, Bovine  19866880996727
ttttgttttgaacgagtatttgataatacaacatttcagtaagtccttttcttttgacctggtttctttcatctacagacttggacacaacacgagtattccttttgtcactgttggccagggaccacatagtttggtaattttactgcttcttactggcattttaaagaagggctttacccttctttcacctgttttcattgaccagaggcaaggatggaaagctaatgtgttcttgcttccattttaagaccaaaatcaaatgtttgtctcttgaatttcatagtatgagacaataaaaaatgtaaataaatatatttcaatggaattttgatggccatagtatttagataaagttcacacatgggatgtggttattttaaaataacttgtatcaacatagttgagtctaaaggatttattcaaatactaaatattatttaaatatataattaaatatttaatattgaaacacaaattcaaggtttctgaccgtttagacaagagacttaagagtcatatctgtaaggaaagattcctcaggaaattgaagtaaaataaatcattttttcgtgtaacccttcaagaaactggaaaattaagatgtgtttaagactttgaatatctatattaatcccagtagttggaacaaatgcatatgtaataatgaaggagaatgtttaaaaggacagctgatttatgtcactgctagactccaaacatagaatttctaaagacaaacgtttgggtctgtgatttggctcacattgtattagtttggtaaaatgtaggaaaaattgagttgatatagattctctttgcctcacacacattcatttccctcttgctatcacagtgatcatttaattcaatgtaactctggaagcattgattgagtgtctactaagtaccagattatgtgccacgtactctgggtgactcagaattaaataagatgcacttaaaagtgggtaaggggggcaagacaggtccaggacaattcaatataatattgtctttgtactagagctatgaatggagcaaggacatctctcttcattaaagagagcttcagagagaagtggattttactaatggtaaaggaggtgaagttcactccaggaggaggcctgttgaccctggtacatcttagaaggcttagcatgtaggcaggatatgaagaagatgagcctggaaggtaagatcagggcaggtgaccagaggccttacctgcttgttacagggtctagactcttctgtgagcaatggaggaagaacaatgctaattgaagagtgttaggtgcatggaaagaatgctaatggtgttgatttctgaagactttcagtcttccagagaagtgaatggcaagatttctactgagtctgagtttagcaatgtggttgtgacacttgggacagtaagtgttgaatagttgctgtaggcaaagagaaaggaagctaatcaataatgagcaagaacactggcaaactgtatccagctaaagatagaaaatctcaaatttgtcataggatgattagcacagttatacagacttcctggggcaacatgagccatcaagaggaagacaaaggggttgatattactgataattgatcacctcatagacacctggtttttgatattcctcattccaccaaatgcttgcagtcgctcatttttcatcaagatctatgatgaaggccaaaaatgtgctgggtgtgtcctgaggggtgggagtggaaatactttaccaagaacagacattacgcctttttgacaagagacaaatgtttcattcaaatgctgcatttcgcatattggaaaccgtaatgaattcttgggcacctttctgcctagttcacaatgtcaggcccaggcattgaaacacctcaggctttcctcacaaattaaatgtaatgttacaccctccagtagaatggtgcataaatcaagcgtttgatttgcatggactgtagcaagcagctccctgctggacaaatataaacccaacgccgaatattatgtcagggacaggaacaaagcaatctaagactcccaataaaagcccagtaccaagtataattcttgctggtattacactgctctgtgtcaagcctgttattaaaactcttgttttgacctccttttttcatttcaaaagaaaatgtttttcttgaccttcctgtattcagaaaaccagtgcacaaaccagtactatttataaactggtgtctactactgacagtcacgggcatagttattttttttctccatctaccctcacccaacagagagtacaggaaggggtccatatgagtaatcaagtggaaagaaacaaataaagggcatgaaataaaatacaccacgggagattaggaaacatggatattcactaatgttctacctctggccacagtcccaagagaatgctaagaacaggttcagagcagacaagtttaaaaaatggctcaatagccaaagttaatgtacatttggatgcagaacatgcattcaattcaggaaaagtgagcctaaatatgcataggttgtctcatatctggcctctagcatatgctgttatattttcttcactcatatattccccatcacagggtatctgtactatttttttttttactaaaagtaaaatcag

SEQ ID NO: 44218 - DNA, 4716 bp, Bovine  19866881079493
aaaataggaaaaaataaactttaaaaatgctgtattatgaaaagaataaaaatacaagtgagagcttttgtttgaagaaaacagttttaagggaaaatgaaatatattaacagattgaatcaaataagatgattggtttcctgtctatttgagaggcttaaggccagacataatatggccatagttgggttattctgcagatgacaatcaaagaaggggcttcctgctggcactaacagtgtgagcaacagcagagatgcatgactaactgccacgcaggactcggggaagcagggagatttcactagaaaagaagactgcattctgactgtagagagtcttcaacatcttctaaggagtctgtgagatcacaggaagactttgaagaattttatttatttttatcagcggaatgaagtgatcaaaactatggcagtatgtaatcttgagttagaaatatcaaggtgagttggcagatttcaaagccatgggtaaaatggttgaaagtggggttgacatttacacacctctatttttaaaatggataaccaacaaggccttactgtataacacagggaactcgctcagtattgggaaaaggacttgaaaaggaatagatacgtgtacatgtataaccgaatcactttgccatacacctgaatctaccactatattgttaatcaactgtaccctaatataaaataaaagcattaaaaaaaaaacctatgttttttaaaacatatgtaaactaaaagaaagtccaataaggaaattctagtaatcacttaaatttaagagaaaagcactaccagggatggactctataagccatttttgcttgaagttccaagtcatcccattaaaaaatgctggtagaaggcacaaagggccagcatgtgtgtgacaaatatggatgcatatgagagagagagagagagagaagagaggtggtggaaaactctacggctttccgtgtaatacacagtccagcgggaggcaatttcactgtcactcagtcaccctctagccaaaggtagtaatcatttacctgcccaacagcccaggtttcaataaaactgaagcatacattacttttctgatgttgaaaggaggccgacaatccatgtcaagatttgattcaaagtgcaaagtaaagctgatgagaaacacacgggccaaatcactgcattcctcttgtcactgtccaagtgacactgtctatggccactgactatggcccctgtgatcccaatcatgttgctgcaggttgtaacactaaaccaaggactgccaggttgagtggataatgggctcctcttttctagtagacgtcatcctcaaagtatagtcaagaaatggtctgctttcaactcactggaatataaactccatgacagaagggtatcaacctgcctttgttcattgctgtatgtctgctacatgatgggtgctttgtgaacactggatagataaatgattgatttaatgaatgaaatctaaataagctctcatataaatatgttatattgagtaaattttatatatatatggacttccctgctagctcagctggtaaagaagccacctgcaatgcagaagaccctagttcgattcctgggtggggaaaatctgctggaggagggataggctacccactccagtattttgaggtttccctggtggctcagatggtaaagaatctgcctgcaatgtgggagccatgggttcaatccctgggttgggaagatcccctggagatcttgcctggagaattgcatggacagaggagcctggtgggctacaatccatgggatcacaaagagctggacacaactgagcaactttcacttcacttatatatatatacacagtttaaacctacatcattcaatatatataatatagttgacccttgaatgatgtaggtttaaacagtccaggtccacttacatatagttttcttcaataagtatggcaccttcatttttattttacagatcagtaagtatggggaaaagtttatgtttgactagagatcacaggatatggaatcagaagaatcagggtttgagtcttgattctatccaaactgtttcagcttcctgcccttgggtgagtcatttatcagtttctttgtttttgaggcagagatagcagaacatggattttcaactgcatgggggcaggaatggtcagcacccctaacccttgtgttgttcacaagtcagctgtattacacatcacacatcacatcacacgcacacatgcacacacacacatatcatggtaattatcatcattaaaacttagctcaaaactttttaaaccacatattgaaaacaggtaactaattatgtgaaaataaacattgaattttggacattaggagttttgtacttctagaaaaaatgtcaagtagagtcaccttttattgctaatgttagttttttagctttgaggtcattagatttcatcagtaacctcattttccgacctggctcaaagctcctgccctggtagcatggttcactgcaaagttttaggagaaagattgaataaagaacagcctggggacaagaagggagtttggcaggaagaactgaatgtggtcacttgctcttccatgaagtcagagagcctctcaggtctgactgactcatttgacttgaacctgaaaaaatgtgaggcagagaacactgcagctgtctcacagtgatgtggaacttaaaatgaaagccatacagtatacagagtacagcagggggaagcaagttctgaaatctgaacgcagccctacctgaaggcatatctctcccgagcgtgggtgcgtgctgtgttgcttcagttgtgtccaactccttaggtccccatggactcagcccacaaggctcctctgtccatggtaattctccaggctagaacactggagtgggttgccatgcccttcttcaggggatcttcccaacccaggggttgaacctgcgtctcctgaattggcagacgagttctttacctctagcaccaccagagaagcccatctctccttagaccttccactaatagaagccaatatgtttcctttttaaaaagtttgtttaaaccaagttgagttggacttcctgtcatttgcaatagaaggagtcctgtgtgattactgtctgatacactgtgctaagtttaaatacactggtgttaatagtttgtctcatgtctgggatttgagcctgacatagatatataataagcaaacacacttcacagacaccttctaataaactgctctttatgttaggcaagcatcatctttacctccagttcttctattaagtatcttactcttctgatgtgtttccccagtggctcagtggtaaagaatctgcctgcaatgcaggagacaaagcagatgtgggttctatccctgggtcaggaagatcccctgtaaggggaaatgacccttaagtttaatttttccctctcccttttaaggaaaatttagtatttcttaaagtattttctttactaaagcaaccatcaattagttatggtttgctcttttattaacccatacttcaactttgttgtgatagataataccatcttacctaaaaagttacacttcacaacatacagcagaggtatacgtttctcatccagctgtctgagatcttctgtcctttataattgtgggaaagagtccagttagtggaaacactaattgatccttaatgagtacaaagattgcttcgtcacaccatcttggagctagacttattttaaaatagattagcttcttgctgcttttctgttctttttgagaaacaaccaagcaaatcacgtgtggcacttctgtctttgtgatctaatttcaacctcattatagtgctattaggcaaaagcaagtatatttttaaataaatgtcacttaccatagaggctttctacctagatagttcactcaccctttagcaatgaagaattaagaatatttcagtagtaattacaaaaaaattaagaataagaaaaagaaatgtgttgttttttctatgaaatgatttctgtagaaataaaaaaaaggatcatagcaagtatatttatgaaatgtaaaggtgagagtcataattctcctttgttctatgaaaaaatattaataaaaactgctttctccccaaggaggaaatatttggctacatatagacaggcaaatattttagaatgtctttaaagtataaaataaacaaaacaattttctttctcaggaaaggttatttgatatagttctgttaccccttctatgcatatcctctttaatgaggtaatactgtctggtcacttcctgtctggggactttttgcagagatggatatattctaagcatgtttatttaccagctaccattactttcttcaattcccagaaggactttttttccactcacagactataataaggagacaaattgttataaaatacaactgtgtcccttataatcatacaaaaattctttgcttatgtgtttgctttggctaacacattttcagtttatatcaaattgagtctgattttttttcctttagatttgaggaaagcaaatgaaatttcaatttccctatcacagcctctgaccatatgacaaaatttgaccaataaagtccacaggaggaaaaagacattttttaagtggaggatttttgtgtgttacctctctcagccaggagt

SEQ ID NO: 44219 - DNA, 862 bp, Bovine  19866881149105
agtatatatgtattatatcatttagggtagacccagtttgatcaattccagggataaattatattttcaagggaaaaggtacctttcgtactctgtcatcccaggatgtcggctttgttcttgactatctcttgctgaggccacaagatgatagtcaaaactccaagcacctcaggcagtcaaaaccatgtccacggtttatgtttattttttgagatgagaaactcatccccaaagcctgccccaaccccagtggccagcaaggactatggaatgtccagaagtggttttaccgaacagacttaccctgaggctttcattggcatttctgaagagtggacccctgaataaaactagattagggtttgtgaggaagcagagagaaatggctattaggcaaccagcagtgcctgctacatatgatctagtatgatacccagtgatgtagaaatatatgcgcttgtatattgtgtgaggacattcatgcaactaaattttgaaaggagagcaaatgtcctcactgagaaaaatgatagcatctgttcagtgtataattttagaaatgcagtacaagggtttctatttaaagctttcaaattttaacccaaatggagaaaatttgctagaaaacatgtaactccaccactatgagaaagaatacaatgtttttgtgttacttaactgtgtaagaggttaaccttttgctccaccccaaaacaagcaagccattaatcttcaaacagtacagatggtttcccctctccctcttttaaaatctatttaaggaaagtcttggtaggattatgctttgtgaacctattgtgtgactttaaagataagagctcttaaagatttttaaacc

SEQ ID NO: 44220 - DNA, 973 bp, Bovine  19866881157061
gttgatttttaaaatgtggtgttcattttttaaaaaaagaaaactgaaaaaacacagcaggcttccttacaatcagcttcaggcccctggtcacatggaatagctctccatcactcgccggcagggagccaaaacttgcatggaggggtaagcaataaaataaaaatcacatttccaagatttcttttccctgctacactgggtcatatttgattaatggactgcatttattttaaaggtatgattgcacacatgttacctatactgtgccactgtgcgcttggcagacagaaagctcattatgaattctgagccaaggtgggatattagcgcatcattaatatgcataggtgcagatacctgtctgttgctttataatgctatttaatttatatagtgctggtacttgatggacataagagactccatcctcagctagagagattcctaaataaaactagcaaggtattgcagaagtaatcagtccgagtgaaggagttcaggttcttgtgtctctgtatataaaagtccagttcttgagtttcatttcaaatgtctctccatgtggactagcttaacatattcctttcttctctcactgacagcaaatacacctactttgacattttttcccccttaattctgtttaatctgaaattgtagtttgctgctgtttgggttctaccagcttgaaagcagcctcaaggaaattaaaccttatgaggtatggggccaaactgcttgtacatatttcttggtatacacatgggccaccctcagtggggatggcctacaatgagcctcaggaagaaatcagacacatggagtcatatttgactatcttgaaattattatctcactactccacttcttaccatcctgaataggaaaaactcaactctttcagatggcatgcagagcacagcattcaaggccccccgcccatctctgtaagcacaatcctgtaccttca

SEQ ID NO: 44221 - DNA, 1774 bp, Bovine  19866881170799
attaatttatttttattgaaggataattgctttatagaattttgctgttttctgtcaacagacactgattgagaaccaactgaatgcccaacacagtgatgtaaacatatctaggtattgtctttgcccttaaaaagtttacagtttagggagagagagacagaggataagtctaaccaacacaggaatattcacagactgtgtaattggaaatggccagagtttaacaaataaggttagattcaaagatgaacttcttgatcatcttgatcattgaacttcttgatcattgtgaggattataacaaagctgtatggattatcaagagattgcagatgtgtgggtttttttaagaataaatctttagaatgcatgtgacttaaattacatacattgtatccatctgaagcttccagtaggattgggtctatgaacaccatgccaactaggtagctctgatctttcgctgtgaccttttgctctctggtgctgaagacacactccctagagcccattgctcagcccatctagtttctgcaaacatcaacactctcctctctctttgcagaggggcttcagccttatagacccaagtttatcttcacaccttgtgttcatcaccaatcagctcatttctcatgactataaatgattgggctcaggaatgttgagtggtaaaataaccagagaatagaatcattccttttcatctccctcctccatcagaaacttaaatgcaaaatatcttgaatcctgtcactggccttacagtttaagtggaggcaaaaaaaaaaaaaaggagcttattttaactcaccatgatatccatttatgggtactggataggtagagaaaaatgtttttcaaacaaaggtaatgaatgaccatttcagaaggttcatgcttattgcatgtttggagggatcactccaaacataagccttgaatataatgagtttttgaagtgaaacctctaacctctcaaattcagtgtatccaggattcttgtttttcttgtaaacttgtttctcttcctactctctccagcttggcatcttgtaggtattgtatgcaagagaactggggttttcctttgatttctttccttaccaagtatgtcaaactggtcaacaaaaccagtcagttctcccttctatgtctctaaaaagcttttccctcctccgtttttcccctttttatcttagttgtactagtcatgatctgtctcctggacttggcaacagccttctaaatgatctcttgcctccagctttctcttatattatcttcaccttccaccttaccagcaacattcccttgccaattatgctcagattctcagtcttgtccaactcttagcaatgccatggactgtaacccgccaggctccgtctatgggatttgtccaggcaagaatactggaatgggttgccatttccttctccaggggatcttccctacccagggatcaaacctgggtctcctgcattgcaggtggattctttaccagggagcaaccagggaagcccttcacaaaaacaccattgcttaaaaaccttatgatctaaagcagactcacagatataaagaacaaacttgtagttcccaatggggaggggaggaggaaccacactggggctgcggaggggaggtaaaagctcctgggtataagacaggctcaaggatgcattgtacaacagggggaatatagccaatcatttttaataactgaaaatggaaagtaacctttaaaaatggcataaaaattaaacgt

SEQ ID NO: 44222 - DNA, 1321 bp, Bovine  19866881221106
ttgcctgactccagaggcaatattttaaccctctccagtactgtctctctcaaataaggggtgactctggatctctctgtatttgttgttgttgttcagtcgttaagtcatgtccaaatctttgtgacaccatgaactacagcatgccaagctctgcgtccttcactatctcccagagtttgctcagattcatgtccattgagttggtgatgccatccaagcatctcatcctctgtcatcctattcttatcctttgtcaccctattctcctcctgctctcaatcttttccagcttcagggtcttttccagtgagtcagctgtttgcatcaggtagtcaaagtattggaggttcagcttcagcatcagtccttccaatgaatattcagggttgattaccttcaggattgacttgtttgatctccttgatgtcaagggattgtcaagagtcttctccaacaccacagttcaaaagcatcagttcttaggcactcagccttctttatggtccaacatacatgactactgtaaaaaccatacctttgactatgcagagctttattggcaaagtgatgtctctgctttctaatatgctgcctagatttgtcatagctttccttctatggagcaaggagtcttgcatagattactgattaaataaagttatacaacacttcacttaagtttagtggaggaacactttggatatgctaaatgagggagcagggtagtgcatgctcatgcttttctaaccacaggtagtggaattagaaggtacagaatataaggaaggagacttggagggagcttgctcagctggaaggaggagagtgaatggggagccatgtaggtgaatcaggttaggagaacctacactgacaagaggggagaccctagttgaatctttgttggtgtttcttagtctggagggtacttctcttccatgtgggtttcagagagggcttggctgattcgaaaaacagttcattcagtaaagaattgggaaaggcctgtgttatttgtagcccagagacagtctttaaaaattctcagcgtcgcttcagccctgaacttcagtgaagaacacactggacttgggatcaattagaacttaaagtcactgagatagaacagtgtttggatagaacagttttcttttgaggatgaaagaattgagattcagttgcccccttgccctgccttctcggctactgcatcattctgaattaggaaattctttgctgctgtttgactttcggctggaggcagccttagttaaagtcagtgaccaacctagtcactatcatatccgccataaaatca

SEQ ID NO: 44223 - DNA, 1429 bp, Bovine  19866881380943
attggctggtttaaactaagggattttgcatgcacgggaacagcaggtcaagatagggaagggaatacctgacctttaacatggacaggctatgattaagcaggttttcaggggctgggcaattgcaaagagcaagacaagggtgagtgagataagctccagttcctagtattataagtccccactttctgagactacgtgacctacatgctccagactttgcaaggagcaagttgagtttcagaggcagaacgagcaagaggttttgtaaaattttaacttttcctcttcaataacagatgataattctaaagctgaagtggagagagtgaccatttaaagccaggcacctacttgacagatgcttttgtggtcctgccaacacacagccccattgctgctccaggtgggcaggaaggagagcactgccctctcctaacactgctctaggacttcagtatcagcatctccaggcatcacctcaagatttccagagcaaagtcttggttaacataacccaacattcgtcttttataggtgaaaaaagttgagactagaatatttaaatgatttgctcaacattacttaatcattagggcttcccatcagttggtaaagaatcagcctgcaatgcaggagaccctggttcaattcccgggtccagaagatccactggagaagggataggctatctactccagtattcttgggcttcccttgtggctcagtgggtaaagaatctgcctgcaatgagggagacctcagttcgatcccttggttgggaaggtcccctggagagtgggaaaggctactgattacagtattctggcctgaagaattccatggactgtatagtctatggggttgcaaagagtcagacacgactgagcgactttcactttcagagctaatgaggtaaaggcaactcagaagcaagactgagctgaaagtctccagaaccttcccttctgccaaaaaagacctttttggctctcccagcgcagccttgggaaattctcaatattattaattatgaattatctcctcacaaatactactccagcatgcatggttttcttgttcttgaattatataccatttacccttaagcatttcttcaaacaaaattaccagcagattcattcaatactttcctgatgatcattttatccaggacagtcttggcaattcagttttacctgatccaattttatggttaaatccaccagtaacacacagcattttagggtgctctaataaaagatataactatctgactcgtggatatattaaaataataccattcttggaatctgggggaggaggatgtaaactgttttcctaacatatctaaggttaaatattattgtcaaagaaaaagaatcccaagaagagacacatgcatttacttcttcattcacagccattt

SEQ ID NO: 44224 - DNA, 691 bp, Bovine  19866881406974
gtttaatataaacctaaatattactactccctcacctcccccaaccaagctatccccacatggcaagaaaaaccaaaaacaatttaatgggaatgttttcatgtccatttttctctcaagaattctgttgtgcaatgtttaaaatgtctgagctcactttttaaatagtctgataaaaacaaaataaaggtaacatatacaggaatatgtcactagtttatgaatctgggtaagtcattctcatcagattatagccagtctcttacctcatagattattctcttctgttaattctcttccttttctctttccacctttcttttggttattgcactgctcattagcatttctattaagcaattctgaggctaaggaaaaaaaaaatcaatcaaggaaaagagcttcaacttgaggcttgatgtgtgagaagttgaatctattggctaaaatcagatgattttgaggttctctgtggatttcctttatccatgttatttctgccccaatagcatagagtaacagtagctgattatttgttgttgttcagtcactaagttgtgtccgactctttatgaccccatgaactgcagcgcgccagatttccctgtctttatggtataatatagaaagacacactgctaaagggtttgggagtacaggcatatttaaactaaaacctctgggtgagaaa

SEQ ID NO: 44225 - DNA, 1555 bp, Bovine  19866881731614
tcattaagtggtgttaatggtcatagagatgaggctagtggtcataatggtgtactgctgagacctgagagagcaatgaagtacagaaattaaaaaaaaaaaaaaaaaaactggaatgtgaattggaaaaacttgagctttccagaaggttattacagtataattttataatgaactcatagaacatttacttggaaaatctagaacttttaataggcttaaatgcctccaatttagggaaaatatgagcaaataagctttgatgtggttccatgccaagtcatggtgccaacaaagcatttatgtctccattgtgagctttatccaacatccatttaccagttcctggtttgcaaatccaattgctctaggatagggatttgaacaacaaaattggcaacgttgtaagcttgataaattggagctgccagcatgatagcacaattgcagaaaagagttcagcttgcacattttaagagcttgttgtagatttacctttgagcaaattgactcatctcattgccttaacatttgggagacttgaaagaatgatatcctaattaagacaagctcaattttcttagattaattataaaaatgactaacattaatcaaacaattgaatagtctttgacctttacagctatgtttcctagactatgttctatggaacatcagtgttccttgtgatgtaatatgtattcctctcaaaaaagggggagttttgttgtcgtgaatttaaggtttcacaatgtacaatagcatatgaaagactgtgagaatctctggagttaaaaaaaaaaaaaaactcttaatcacatttcccaactatgttgactctggaacatttaaaacaaacaaaattctattgctttctcacagaatacaatgtttcatgtaacagctttgaaaagtttcacaaaaagtataaatcaactagggattcacagaattacatgatttataccttgagacatggaagagattttaataatatttctgtgctatatccttgaacatcccacacattttggaaataaatttcaggtagctttcagcaacaatttccacaatgatccacaagtttacttattgataaaatggtttattcctaataaaagttctctcttcattccattccattccattgctccccttcaccccagaccgtgctctattcctcaagaatcacttttctctttggggagagtttctggctcagacatttaaacaggccctctaactcatcaataagaaaaccattttcaactcctatgatgaggttctagatctgtgttaagaggaacacaagatatataagttcaggtgtgtggactcaagggccttacaacttggcaaagtaaaagaaaaaaaaacctcacatatgtaaagcaattaaaaataactccagaggttttcaatagggaaaaatcaacatgtgctgagattactgtggaagactttgtggacctggcatatgaataagatgtagaaaattgcagagagaaacaagagaagatttcagagtaagaggaaagcatggtcaaaatcaaat

SEQ ID NO: 44226 - DNA, 4260 bp, Bovine  19866881735140
aagggacactgcacttgagtttcttttgcctgcaatgtcttttcctctcctcttcactgaattaattcttatttatgcttcacgtctcagcttaatcatcatttccttaaggaaatcgtctctgacccccctgacaaaggtcaaaagctccctctcagagaatcatgttctgcttcttggtagaaaagatcacagtcacagttttcccatttcattgatttttgcctcctctctagactctacactgcaagggggcgaggactgtatcttttttcctttcaccattgcatcgctagcacctagcactctgcctaggacagagtacatttgctgagtgagtgaataaaaccatattttctgtgctgaaattgactcactgctttctgatgtttctctagacactgattctatgtccctcctgtttctttatccataaccagctgtactgctcaagcttcccactctagtctgcagagtggctcactcctttacttttgctgttttgttgcagttctcagttatgaccaagtgatgagcatgaatgaccatgagatactgaccagagactttggcaacatagttgggtggcttttaaaggactatatagtggtttacattttctaaaaaagctttcataatttaatcttcacatcaatcctatgaagcagaaagataggaatcatacttatggtgataaaaagaaaaaaattgaatacagacacctttattgaggaaactggttgaggattctttgcttctgagcaaggaaagaaactgtttgatgagaaaattgaagcattcctgactctaccatgccatataatgaccacatgtggcttctgaacagttaaggtgtggctaaatctaattgagctgtattgtaaatataaaaatatgtacacacaaacaccagatttggaagatttagtattaaatgttgattacatattgaaatggaaatagatctattggatcaactaaaatatattatttatgatatattttaatctatttataatagattgaataatgtccccataagatatcaagtgggcttcctggtggctcagtggcagccagtgcaggagacccagacactaaaaattacaggtgtggcttgtgttctatttgggttagccaaaaagttcattctggtttttcttactgtcttacagaaaaacctgaatgatctttttggccaacccaatatttctcttggacaattctgccttagaccatttgaaggataattgtaaagacggcaatgaccagctgtctctaaattctgtagtggacagaataaaagctaatgggttttgcatgcaaaaagagtttaaatatatgaaaaaggataaactagctttaatggctattaaatattgaaactggcaaacagaggccctggctaccaatctcagaaagtcaaattggtagccacatgtcagtcaatgttgctatagaattgtctggaaagtacgagtggcatcgggggacttggaaccttgtttccaccttgaatcacatgaaattattgaaattatacggcaaagtattttcagtgctcaaatttatattcaaccattcctacttctgtctggaaatttcatccttctaatggtgctgaacaagcagatggaggataatgaagccaagagtaaactaaagctaattagaggcctaatgtaaagagtgaaaagactagggtgataaaacctggatctcctgcattgcaggcagactctttaccatctgagcactagggaagccctaagatagcactagcgtgtgccaaactaattgtaatagtggaacctttgggtgaagatcctgaccctcctgagcctcaattttatcatctatagaatggatctagtagcatctattttcatattgttctaagaattggagataatatatgtaaagtacatgacaacataacagcaacatcataaatgggaatatttgtttgttatttttatgaaaggcttttcacattgatgttagtcaatgaatagagttgatcatttcaaattggacatttcaaatgccaagatggcatcatactttcttgtgtggttaaaaaaaaagttaaggagtattgtaaatgttataaaccagcagtttggggatttttaggagactagcattaccaatagacatgcaagaagtgcaaaagtttgaaactaaatgttttatctgtggaattcagatttttgatcagccttgagtagtccatgttctacaggagtgaaggtctttgaatctgtttaggagaagaatgacagctaatggttattgagagctaccattgagacactttctaagtgcttttaatgagtagattgcttcccttgtggctctggtagagaatctggcaaagaatccatctgcaatgtgggagacctggattcgatccctgggttggaaaggtcccctggagaagggaaagactgctcactgcagtattctggcctggagaattccatggactgtatagtccatggggtcacaaagagacagacatgactgagtgactttcacttcactaattcctctaattcttatagcaactctcggtggtagatactattctcatcacttccatttaacagataaaggaattgagatacagtctggtgaaggaagttgcctaatgtaaacagttatcgaagactaatataggcatttgaactccagctgcttgactttaatactctacttctttctaataatgtactctgtgtgtatttcttttctcagaatatggatctttcaaggcagaccaagacacttgcaagtgctcattgctgatggcttcatttcatccacatattgataatacattcagaataaatttattgaacacctactacttgcaacatattgtgaaagatgctgcaggcatacaaagacaaataagacagcatctggcctcaaggaattcatgatgtaacgaggaggacagttatgttactgataagctatgagacaaagaaactcaaagggagtgtgagccagtcagtgagtgttggttgctcagtcatgttcatattatgacccaatggactgtagcccaccaggcttctctgtccatggaattctctgggcaagaatactggagtggtttgccatttcattctccaggggatccccttaacccaggaatcaaacccgggtctcctgcattgcaagcagattccttaccattgcaggggaaccagaggtataagtaactgctgttggagaagagtttctctcatgggctccgagggccatgtgcacacctttgttacttgcatcacactccaatgcattcatctgcccagttctcagtcctcctcactagacgaggtctagggactgtgtcttattcatcttaatgtctaggcatctacccttttatcttaggcatctatcaaatcccctggtatctagcaggttcttaataattggttatggaatgcatgcataaatggagaaatgagtgcagaagaaaaggagatcgaatatgactgggagcttccagcaaagcttgacagaaacattggcttttgaactcaaccttggaagacaaggtggatttccagagaagaaaagatgagacttgaggaaaggaatggtgtacgactgatgagacagaaggaaaagttatatacagttatataaagtttcataaagagaagcctgggcttccctggtggctcagatggtaaagaatttgcctgcaatgcaggacacccgagttcaatctctgaattgggaagatcccttgggaatggctatccactccagtattcttgcctggagaattcccaatgacagaggaacttggtaggctatagtccacggggttgcagagtcggacacgactgagtgactaacactcaaagaaaagcttgaagatgtggaagtggctcattggacttagtgtattgttcagaaacaaaaatctgtgacttgatcaaggtcaaggttaagggcagagctgatatagttttccaaatgtggacaaattcctaacttgatatgaaggaaaaaagcttgatggatgcttgaattattctaaataacaaacactgtatcatttattacttatcccctgcccatgatttcatggatattagctaattctcagagcaccatgtttctgcttattttacagatgaagacactgagcttcagtgcaggtaagtgaccagcccacacggctagtaagaggtggagcaggatctggaacccaagtcctctgtgtcgagggcc

SEQ ID NO: 44227 - DNA, 1407 bp, Bovine  19866881760930
tagtaaataaagacttagattaccaaaggattcccctacttttataaaggagtcccaggcaggaggaattaccgacatgtcagagtctctggggacttactgaattcagcatgcttcggagcatgcccagtaacaaaaaagcagcttctgtgcacacattgtggatagatgagaccacggttccactggaggcaggaactccaaagataaaggtccagatggaatctaaatcaaactgcagaggtgaaagcaaatcaggattaggtactgtcaatttttctcggtagagaccctcacaagttctaatgttctaaaatttctttgaaattattttctttcaaagtgagcaatgaagaagagatagagacttaatgctcttccctcctatgttttaaaactcattttcacatttacaagacaaagtgaatcttatgtatcagtgtcctagttatctatcttaaaaacatccttttcttttttttctaaggaaaataattagctaggtgatgaaattaaagaattaatggctttaagcaggatctattcaaaaagtacagtgaacttactccccacaccccactctcagcaatgttctaattcacttttagattacatatagatgaagatttgaccaaataaaaatcagtttgaggagattcattcatagtagttttatataacactttgcctatggcgtctgtaaccaaactctgctttgctcatgcatctgtagcatgatttaacgtagggtacagactcagtgttttcatttaaaaggttttgttgattactatggctgatttgaatagcaccttgggattattatggaagtgtaattcagtttaagactaaattcctacatctctgcagtgctacaaacataagctatatatagatatccacataatcttaagattagaaaatcaggtaaagccttactgttttcctaatatggacattacctatcattaagaattcagaaacacttttctaatcagaatttgcactaaaaatcctttcatatctacccaattaatttgtggaatgcacattacttcgtttttaattctacagaaattaattatatttctagataaaatcacattactcgaattcttttgatcatcattaaaataccatccaaaatcttcccatgtatataatcacacagaataatcataaagagaaaaagaacaacaggaacacagaacttctttttgggaaaattttctacagtattttcagatttctatgaccccagtcaaatcccaaatgtgagatagggatggaaccagttggtttttactgtgatgaactcaacaccctacagtgactttttggcaaatgtaattacacttacacccgactaggtaattcctacctggcaacccctgcttacatcggctg

SEQ ID NO: 44228 - DNA, 613 bp, Bovine  19866882093061
cagttaaaaactggatcctgtgtaataaactacacagttgcatatccaatatgatttagtttctgcattcttcctccatcacacttccaaatatctcaacccctgggacaaactgagttttattaccatagatttattccttagaataaagacagggtttctctcaaaaaactgccaaatgtaaatatgttaaaagatctcaaacaattagcacacatatgtacctccgtagggattaagtgatcagaatgcatgcaattcttgaaaaatgcatatttccaaaagaaatgagatggaggactggatctaatgagatggaggatgaaacatctaagaaaagcaatatctaaagagggagaatcggcaccaaggtctatatgagaagtgtgtagagacgcagggcaccaggaagtactggtttctaagggagcaaagtgtcacaaggaggaggagagtgaactcttgtctaactctcagaaatgatttgtccaaggagacacacgtgctgacaaaataagagaatttattgggaaagggcatctggttggagagcaggaaggtgagcgaacccaggagaacgtctctaccatgtggctcagcgtctcaggtttta

SEQ ID NO: 44229 - DNA, 964 bp, Bovine  19866880393704
aaaaaagacaattgcattcaccaaaatgccaatgaggaagaaacagactcaatacccatggtcattcatctattcgggaagctctgaaaatctatttgggaagccaaacataatcagaaagttgtgcagcatgcatgaaagctgtggaagggaaatgatgcaaaggaccttatagcccatgaaacaaagacagcctcaggcatccactgtgtgcaccaatgcagttctgccaaacaggtcaggacacacatgttcactcgtgacagctgacgtgaactgatttcaaagaaacattttcataaactgtttcataaagaatgaattaatttttgagcaatttgaagtaacagtataagaactgcaattagaatctttacattataagtgagtttaagaagtcaaaggaatattttactttgttgaaagttcctgtttgttaaaactattctgtgaactctttccagataatttcagattaatctgataactgttgctaattagactaggaaggaaattagtgaattaattgtggttatcttgaaacaacaatctcccagaagaaaggcggcttgcttaaaaaggcttccttcagaaatacagacaatatatcaaaattgaacagggaagtctggagagagaaacacaacattatcagaggaaaaagcaagctccttaatactgcctccctaatttatggaagaatattagactaaaaactaaaaaatagatgtttcattcagtgaaatttattcaaagtgtactattaaaattaagagcacaaaagtgtacatcaaattaaaatcttacatagtctctgcacaacctcataattctatatttgaccaagttttcaccattccaaacttgacttggaaatttagatgttttcaaacttttcatctttcttattgaaacaagcttccattttatctaatatgataaaatgataaaaatatcaaattaa

SEQ ID NO: 44230 - DNA, 3168 bp, Bovine  19866880561754
aaatataatcactgacttttgacaaaggagcaaaggcaataaaatggagaaaacttacttttttcaataaatggtgttagaaaaactagacatcgacctgcaaaaaaatgaatctaggcagacgttataaccttcaaaaaaattaaaatgaatcatagaactaactgtaaagtgcaaaactataaaacttttagaagataacaggagaaagtctagatgactttggtatggtgaagactttttagatagaaccccaaaagacacaatcacccatcagataaataattgataagctggacttcattaaaatgagaacttctgctttgcaatagacacagtcaaaagaatggaaagacaagccccagactgggagtaaatatttgcaaaagatttactggtaaataattgctatcttaactatctgaagaattcttaaaattcaacaataaaaaaaaagtaggttaaataatgggcaaaagacctgaacagactcacctcatcaaggaagataaacagatagcaaataagcatatgaaaagatgctctgtattatatgttgttagggaattgctaattacaatgacaatgagataacactgcacatctactagtggctttatatataaattacccaaacttggaagcaactaagatgtctttcagtaggttaatggataaataaactgtggtatatccaggtgggcttccctggtggctcagaaggtaaagatcctgcctgccatgcaggagacctgggtttaatccctaggttgggaagatccctggaggagggcatggcaaccccctccagtgttccttcctggagaatccccatggacagagagcctggtaggctatagtccatggggttgcaaagagttggacctgactgaatgactaagtgcagtacagcatatccagatgatagaatattatataacactagtcaaggctatggtttttccagtagtcatgtatggatgtgagagttggactgtgaagaaagctgagtgctgaagaataaatgcttttgaactgtggtgttggagaagactcttgaaagtcccttggactgcaaggagatccaaccagtccatttctgaaggagatcagccctgggatttctttggaaggaatgatgctaaagctgaaactccaagtactctggtcacctcatgcgaagagttgactcattggaaaagactctgatgctgggagggttgctgggggcatgaggagaaggggacgacagaggatgagatggctggatggcatcactgactcaatggatgtgagtttgagtgaactccaggagttggtgatggacagggaggcctggcatgctgcaattcatggagttgcaaagagtcagacacgactgagcagctgaactgaactgagaaagaaatgagctatcaagtcataaaaagacatggaggaacatgaaatgcatattactaagtgaaagaagccaatctgaaaaggctacatactattccaattatatgacgttctgggaaaggccaaactatggagactgtaaaaagatcagtagttcccatgggttgagggacagggaaaaatgaataattggagcacaaaggaattttagggcagtgaaactattctgtataatgctataatggtgggtacatatcattatacgtttgtcaaaacccacagaatgtacgggcttccctggtggctcagtggtaaagaatcttcctgccagtgaaggagatggcaagagatgtgggtttggtccctggatcaggcagatgccctggagaaggaagtggcagcccactccagtattcttgcctgggaaaccccatgaacagaggagcctggaaggctacaatccatggggtcacaaagagtcagacacaacttagtgattaaacaataacaacaacagtaacacagactgtacaccaacagtgagccctgatgtaaattgtggactttcggtgatgatctgtcagtgcaggtttattgattataagaaatgtaacactctggtgtggggtgctgatagtgggggaggctgtgagtgtgtgtggggtcagagtatatggaaactctgtactttctgattaatactgctgtgaacctaaaactgctataaaaattaaagccttaacaaaattggtaacaggaaagtagttaaagaaattccatcctctatatttagaaactacttatgaagttaaatctgattatgaaaataaaatacaaaattattttaaaagattaatattgcattatttttaagtgtatatgttaattagagaaaacatcagaaataggctgagaagcaagtgtaatatggtgcaagttagggagagggtaaaagtgttttaaaatccttattttaggtagagagactcaaaatatactgtatcatgcttgattaaaataatttgaaaaatacataaataaggttttgtaaaacttgaagaaattggctttagataggattgattaatattataacaattaagttctctctaaatcaatatataaacagtgcaattccaaattatcagcagactttctgaaagtgtgagaaaatgactaaagattttctgtaagaaggtacagtgtgagaatgaaaagaaagttttaaaactggggaaatattaataccttgccaaatattataatatgttatgataatgtgattctgggatactccaaaggtaaatttaaaaaatatgaaaatttatgtgatgaagaaggcacttcagatcaatgagatgaagatggattattaagaaaaaaatagtgttggaaaaattgtctagttatttggaaaataatgaacctggattcactgatgtaaattctagataaaccacagagttagacatatacatacaaatagaaaactaacaaaccaaataaactaaaaaagcaatagtaggaagcttgaatttttatttatttaaaaaaatatattagatagatggtcttcctaattgtagggttgacatgatgtccaaaagccacaaaggaaatttgggtaatgatagacaataagacgtgataaagagttctgcctgccaatgcaagagacgtgggttccatccctgggtcagaggatcccctggagaaagaaatgggcaacccactccagtattcttgactggagaatcccatggacag

SEQ ID NO: 44231 - DNA, 1511 bp, Bovine  19866880678855
tgagagccaatagcaatctaagcaagatatggactgtgagtgtgtttgtgtcagtgttcccttgaggagttgatgtagctcaagattaggcttttgagaaatttgacacatttcttagtttacacactaagagcatgaagcaggatgacaatcttgcataagtttatttcaggtaggatttatttagatcataggctttccaaaatgtcatatgaactactgcttctagagggactctgtttgaatcccatgcaataacttgatataagaacttgtagatctcttctgctttctttatgtcttcacacttagatgaaaatttgctggtatttttgtcttgtgctttaagctgtatattgcatatactttgttcatgattttatgaggggacttaatttgctaatattttcatttgcaattcaaggttctgatattataatttagtctttgatttgtatagaaaagcatagagttcaggcatcaaatattcctgaaataacagttccaattagttctttgatgaatttcagagcaaacaattacttattgtccttgagagaagagtgtgttgattccagtttatgctctaaatttctctggagagttggaaggggaaactctgtcatggtaatccaattacctcagttaatcaagaaaattgtcagcttcttgaagggcatcggatcagttcagttcagttgctcgtcatgtccgactgtgacccatggactgtagcacgccagggttccctgtccattacaaaatcctggagcttgctcaaactcatgtccatcgtgtcagcgatgccttccaaccattccatcttctgttgtccccttctcctcctgccttcaatcttctctgtcatcagggtcttctccaatgagtcagttttttgcatcaggtggccaaagtattggagtttcagcttcagcatcagtccttctaatgaatattcaggactgatctcctttaggatggactggttggatctccttgcagtccaagggactctcaagagtcttctccaacaccacagttcaaaagcatcaattcttcagcacttagctttctttatagtccaactctcaaatctatacaaaactactggaaaaccatagccttgactagatggacctttgttggcaaagtaatctctctgcttttgaatatgttgtcaaagttggtcatagcttttcttccaaggagcaagtgtcttaattcacggctgcattcaccatctgcagtgattttggagccaagaaaataaagtgtgtcactgtttccactgtttccccatctatttgccatgaagtgatgggatcagatgccatgatcttagttgtctgaatgttgagttttaagccaactttttcactctcctctttcactttcatcaagaggctctttagttcttcttcgcttcctgccataagggtggtgtcatctgcatatctgaggttattgatatttctcccggcgatctgattccagcttgtgcttcatcaagc

SEQ ID NO: 44232 - DNA, 1524 bp, Bovine  19866880722054
ctgctttactgaacccggcccctgcccccaaccccatggtaggcaaaataaatgggccccaaagagacctgtactctaatccctggagactgggatagtgaaaaggactctgcaggtttggggtgggagagtgtcctgtatcattcagaggagctcaatctaattacataagtccttaaaagcagagaagatttcccagcacttcttgagaggaagggaaaaggtcagagagttgttggatttgaggatggaggaagggaccaagaaccaaggaatgcaggtggcctccggaggctgcaaaggaaagaaaatagattctgtcctcacacccctggaaggactacagccctgccaatgctttgatttgggggctcccgacctctagagccaaaagataataaacttgtgttgtaagcctctaagtttgtggtaatttaaaatagtagtagagaaacaatacatgcaccactgaccagctgtatgactttctgagtcttgggtttctcatccctccccctcccaaaaaaaaaagaaaaaaaaaatatatatcataatattgatcttgtgtagtatatgcgcagacttactgggatgatgtatggaaaatccatcattaatcatttcgtaacttagtgtcaggagtccgtcctgaggagtcaaactattttctctcaggtacttagcctccgtttttggcctagctgccatcaggtggggctttcttggttggctcagtggtaaagaatctgcctgcaacgcaggaaacttgcaagagatacgggtttgatccatgggttgggaagatcccctgtgggaggaaatagcaacccactccagtattcttgcctgggaaatctcatggacagaggatcctgctgggccacagtccatgaggtcacagagagttggacacgacttagcaagtaaacagcaacagcgagccctcgggtgaatggctgcacgtggctccgtggtccacgccttctcgtcagagcgtgacgtgtggaccagcagcatcagcctcagcctgggaccttgttaggatcactgaatcttagaccgcgccccaggccgactgagtcagaatctgtgttttttaacaacatcaccagatgattcatatgcactttaaaattgaagaggcactactagactggtggttctcaaacatcatatatgctgacagaacaagtcccttggtctagcgtttaggagcatggtgtttcaatatttgtgtttttagtatattttctaagtatttctaatgcagagagctataatcactggaataaatccttagagatacacttaaatatatgagattcacaacagaattgtaaacttttcaattaatgtctttttctctaaggaaagcagctattctaggtaagtgttactaagtgctgcagtcttaaaagatccataaaggaataagcatcaaagaatagcagagatactttctcactagttcttaactgttcgattcctattcaggcttatcatatgcactgatagacttcatag

SEQ ID NO: 44233 - DNA, 2420 bp, Bovine  19866880757641
atgcctctcaccaacaagggatggggaaatggcagggtttgctcttacagttttaagttattttttaaacattatttcaaaaacttatcttttattataaaagaatatccttactgttaaaattgcaatgttcaataatgtataaatttaaaattctaggttccctatcatatactgaactccctcttcctctaatcactgctttctatacttctctacattttttctcatttacaaaaaatatgtaatgtacctacagtagttttgttcattttctccgtattttttaagtttgaagaagcagttttatttctacagcttaaatgaaattgatcttaatatatataaatacctaacatagtattatttccatgtcacttttgcaatttccgtttatattctagttcccatgtgaagtgctttacacatatatcatcttgcttaaacctcacaaaggcctacaaggtaggtatactaccattttacagttgaaaaaactgagactgaaaggtcaagtaactagcctaagatcacacagctagtaaggtcaggtacagattactgcactttaacaggttctgttacagactcacaaatcagcctccaaatttaaatactccagaatgcatcgtcagcttactttgaaataattcattctcattcttagaagttcatgagctgccagattcctttagagcttatgtgaaataaagtagaaataacaggcccttcacaaatagctttcaaaatgcctaagagtcatgctgccttttctggtaatgctgatgtatcctgaggtcctgctgttgccagactcaacatatattcatcagaatctctgcataagacaacattaagttattacttaataacgtagaagaattaatcccataaactggcatctagtgacaccagattttcaacctacttttaaagcacttatttatcaaggttttcaatgcaaattttgaactgggcaggaccagatatagaagttctgtttctgatccaatagataagtacctcattccaacaaagaggtataaaccatctaagtacagttgttcaaagggctgcaatctagaacagtgtactgctgctaagtcacttcagtcgtgtccgactctgtgcgaccccacagacggcagcccaccaggctcccccatctctgggattctccaggcaagaacactggagtgggttgccatttccttctccaatgcatgaaagtgaaaagtgaaagtgaagctgctcagtcgtgtccaactctcagtgacaccatggactgcagcctaccaagctcctcccatgggtttttccaggcaaaagtactggagtgggttgccattgccttttccttcattttatgtatgaggtaccaaaaacctccacccataaacaaatcaaaattctatcctatagttaagtagaataacattgtctattttgagagataacaacatttaagtttcaaattgccactcacagattcctctttcttctttttcccaaattatcgtatggcataggttattaaagatttaaaataacaaaaatacttatttcaagatcatgcttgttgaaagcaattccatgaatgattcaactatgtatgacttcattttgtattcttgaacataataataaaatttgattcaggcaataaaaaaataaaatttaaatacttcaaggttttttttatagactcattatttcaccaaattttttcgaaactttatttggataaagattttctttaatttaagtacataaattcttacctcttgattaaatttatgtgccatctcattaagaagtgaagaaaaaaaactagtgttttgtagcaggactcgacccataactccaagatatgttgacattactacaggatatctctgtgcaattaaaatacagcatatttaaaactgtgttatggtacaagtataaacaataataaataatcattgacaaagtaacaatcaacagggatatgaaataatattcttctttatactgcttctttagaatgaactgccaatattgttgagttctaactaacttactaaatatatatgtctcacaaggtaatatatacatattatgtacatatttttatggattatatatgtatgtatataataaagagaggaacaaagaaagaatatttatcaatggcatacttacacatttatattactttaaaagctcctaacagtagtagtatttagagtctattaaagagcttaagttagaagaaaaccagtattttcatagtatttcatacattacctagttttatgtaacaaaactagcactatttttcccgttcctatgcttaacatatttgtgtatgaacacacatgcgtatgagtgaaagacatgagatagcaaaggaaattcatactttcctatgtagagac

SEQ ID NO: 44234 - DNA, 746 bp, Bovine  19866880936968
cataagacttctggctgttttgatgctaagaattgcagatttattttccttttagactatttcttaaatctttctaatgcatacatacattcacattatattccagctaattcttctgagcaatgcattgaaagtaattgcttctttgttgtctcaccctgtgtgatatgaataaagacatagttttatcaatagctaaggtgtgctattgtgattcaaaatcaaatgaagaaaatatgagaaagaacatatccatttgtattaatttaaaacaattaaaatgatttaattccgtataaagggatacaaataaaatatcctttctgatgaaagaggatttgttaactaaagaattaacaaattaattattttgtaggatttcattgtatcctagctacttgaattcatttttacataaaacacagcaaagtgaaatgatttaaaacagctttcacaattttatgctttttttatatttaacatgataatgtatgtgaagatcatattaataggtcgtctgattttttttggaactgtccctttgaaataaattactttaaaacagatataaaagaagaaagcttttgttacagaaagtagccaagtgttatttttaacttttttttttaacttaaacgagttaacttctttcccaccgctttcttactgagctggaagaaatgaagaaacagatgactttcttaaccctagtcaaaatggctttatgtcattgtgtgaattaggta

SEQ ID NO: 44235 - DNA, 949 bp, Bovine  19866880989234
tatagcacttttttttttaaggaaacagagttttagcatgtaatattttcttctcatttacactgacatgattaaaaaataaattatctgttagtgtacagattacaaataaacacccttctaggctgttagtaggcaagcagctcagtggtctctaagacgatttctcaaagttctgacaatcctgtcaccttctccccaaactaagcatggttttcatcatgacacatctctatgcagatagacaccttgattgactttgcttttcctattgggggcaatttggaacaattaacaacatttttattcattacccatgaatttcattgtgctaggtgttgaggtcatatggatgaataaatagataagtctctgcccttgtatatcaggtgtgaggggtatggacaggcacgaagcctgcaggggaaagtcttctgtatctataaaactgagccaacctggaggtggaagggattgtcatactatgcttaacatgttctagaacatgacgtgtgtgtgtgtgtgtagtgcacactcagtcactcagaaatgtctctttgcgaccccatggactgtagcctgccaggctcctctgtccatgaaatcttccatggcaagaatacttaagtgggttgccatttcctactccaggggatctgcctgacccaggatcgaaccagcgtctcttgagtctcctgcactggcaggtggattctttaccactgcgccacctgggaagttggagaacataatccagataccttttaaaacatttgttaattagttcagttgatttgtgattgaaggaaacttaaaaagtgtcagacatagtcctttggagtcattccacccataaatattttatgatctgacagaaaattcactcatatgactttgacttcctcataaatttcaaagtttcctggaaagaaatcatttcagatgccaa

SEQ ID NO: 44236 - DNA, 1556 bp, Bovine  19866881213105
aggatgagatggctggatgtcatcactgacttgatggacgtgagtctgggtgaactccggaagttggtgatggacagggaggcctggcattctgcgattcatgaggtcacaaagagtcggacatgactgagcgactgaactgatctgaagtcaagcaaactgaaccaattaaaataagaaatgaagactgctttatgtaattaagatgatataagacatttaacagacaaagcagtggcacattggtcataattagcagggcaccaaatgccacatacttcctagaataagcttccgagaagtgcgttctgcagatgctggcgagggcaacaacctcatcttgtttgactagtgatgtatggcttataatatgtgagaacatcatgccttcagcagtatccatgatgctgatgttgaatgaccattggtggaagcatgtcaagctttgtgttaatgtggaatattgacttatgtcatgttttgcatgaattcaatgcctgctttgtgtttcagtatatgaattctcttaaagtattcaaccagttcactcttcacaaatactgagaatttagtatctattgatatatatattggtctccaatacgtttttgctgtaagtaatcattctacaatgaaatttaccatctatagaccttcatttaaattctaaagtttggtatcctattagtcactgcacattggatttgtgaaaagttaagtctaaatacctcatttttgacaatcaacatctgccacgatgtgccatctccgtatatggctgactaacaagagaagagccaagatctgtagttgaacctcttccaagtactgattgtgcttccaagtacacacttatgcctgaactgatgccaaaactgtttgcctccaaacatgtagaagcctgctgaaattaacataactggaaaatagggaagaatcaaacaattatcttagtactttccccattcgagtcagctttatctgtcttcactggtcatatatttgctattaaatattttgctattaaaatactcacagattttaaggtctgtggtgggacagcttgtatatatgttaattggatgtgtttaatttcaaaagacattaataaagctaagttaaaatcaatattttatgcctgctgatttttaagtttggctaatagtttttacatcacacaagcatgcacagttagcaagatgaagggaacaaagagttcgaaactaataaccttggaagaaattccagactaagtactctcagcttccctgatggctcagatggtaaaggatccacctgcaatgctggagacctgggttcaatccctgggttgggaagatccccaggagaagggaacggctacccactccagtgttctcgcctagagaatcccatggacagaggaacctgctgggctaaagtccatgggggtctcaaagagttggacatgacttcacttcactttggggattgccagcaaggctcttctgtgataaaatcattggattataattttagactttgccttcttgtgagtattagtataattaatttga

SEQ ID NO: 44237 - DNA, 2544 bp, Bovine  19866881257055
tgcagtcgaaattgttttaattgacacggaccagaacccaaattcttagatttaacactcagtaatactaccaaagttttaatctcaccttatcattaggtcaaatacagtcaaatgtttttaaaaggccttgaccatgcagtcatataatcatctttttagatggtcagtgtatttgaaatgcacagagaacctcaggtaaaagcaatggcccatggagaaacttagagcattttattatactggactattaagcacattcacagttcataaagtttaatggtctgtctgtaatgatttatttttaagtcagccagaggcttctgggagaacaaaatgtgacaaaatgccatcaactactctgtcaagcttaatggcagcatttaaagcctcaccacagacttgcaaattaactactgtccccccacatgaaatcaacatctccccttaaataaattaaaatgcttctagacctaccaggaatttgtctgagctgaaaacctatattctttccaggtactaggtcagaaatgttatgaaagaagtcagactcattaacactattcatatacaggactctgcaccaaatgaacagcagatataagatggcatccctgaaaattaggactgttacttttactgatgggaagaaggatttaaaaaggaatgttagcaggaactacctctctactacagaggctgagaataaggttctaaatctgatgactgctgaccagaaaaccacccttcagttctggaatcacatgcgttagtgtttccatgtaaactgctgactaagggggaaaagccatttaaactactctatccgttaataaatcatctgaacaacacatacacattctggccaaaaatgagcagctaacgtgtcaggggactcactgtaatttctttccaagaccctcatttgatcagcatgtgactgaactgatgacacttacttttgtgtctgtatcttttcacttatccacactccagaaaagactaatgagcaataaaatgatcaaaagcacaataaaacagaagagaaataaagccctcaattaaccacccatgactgaaattcctcatatttaactgtaaagcatattatccctgttcctgatattgaatctgataaagtatctgaagcaggactaggcataggagagttacttgggaaatataactggttaataataaatggaggagagaaaatcataagcatagagaaagaataaatgaaagcctggtttttacaaagacccttattttcattgaaaagtatttcttccctctgaactcaagaaatgccaagagtgaaaaccattctaattaaaaactgtcaccttatttgaatgtctttgacatgaaacttttcatttgtatcttttgatgtcttctgtctatatcccaatttttcaccctagccctttttgtctcatctcttcatttcagttgttttattaactttctggttataagagtaatgcatgctcagttccccccccccaaaaaaaaaatcagaaaatatgaacaattacaaacagaaagcaaaagtcaatgttaatcccacaacccagaattaaccactgataacatttcagtgacttctcttcagacttttccttgttcatatattcaaatgggacaaactacacatactatttaacatgctacttaatagctttgtgttttattcttcaaaaacactttgacctagtactatgaaatgatcctatgcctcccaactgattgctgtgactgaaaacacttcagctgaagtctgtgaatgtttttatttttagtttattttagatttaccatacgaatgttagtattagttcaaaactcaaattatcagtgggagtttggttaaacccacacagtgaaggggctcacgctcttgctcagtcattaagtcgtgtccaactgtgaccccatggactgtagcccaccaggctcctctgtccatgggatttgccaggcaagaatactggagtgggtacaatttcctttcttcaggggatcatccttacccaggggtagaacccacatctcctgcatcggcaggcagattctttaccactgtgccacctagaaagcctccactgaagatatggcatcataaatagccattaaaaagactagctgtcctaatattttctcagtactcaataaaagtttgatcctttgataactttagcttagaaagaggcagagttactgtgagtgattttcacctttaaagaatttttttcttcatagactcttgacaaaacaagttccagaatagtatgtatttccagaaagaagttttagtaagaattcttaccttttcatctttctatccctcactgtatacttattacttcaaatttttaaaaagctctagtaaaaatgaatcagggataatttaattaagaaaaaaaaataggtcaagaactgtggcgaccctgacattttacactacaatctaacatggtacagtttcataaatacagacagaagacacaagactcctgggtcagggataaagaactgtta

SEQ ID NO: 44238 - DNA, 1536 bp, Bovine  19866881353918
ctcaaccttagttgttgctgttggttggtaagttgtgtctgactctttgtgaccacatggactgtagccctccaggctcctctgtccatgggatttcccaggcaagaatactggagtgggttgacatttacttctacaggggatcttcctgacccagagatcaaacctgcatcttctgcattggcaggttgattctttaccactgagccaccagggaaaccctaatcttctcttaaatgcttcctaaaacttttattcctcttattgtcctatgcccatcctataaagcattgagttaagattcctcgagtttccccaaatgtttaaaaaccacatattttagaagtcatttggggacaaacaaaatgttccagagatgaaaataatgtatgagatgccaatgaaaagtataatcatagaaagcaatgtcttccttaggcaagcatgtcaggggatagcatcttctatgaatgctaaccaagcccatcggtagaaccatgctcaacaaataactctaatgaagattccaatgtctgtctctctgtctttctttcttagttcatttgaggaatcggaggttccattctaaattgcaaagaactgttgctttagcagtatctttatttttcagtaatccttcagcttatatcagaatcacaaagattagttggaccgtcttccagaatctttatgataatgacttttaatactcccaggcatctgaattcttctgaaatggaaataccttctacattctctgtatccttttccagtgttcactgatgcttgtttctggaataaatattttaactcaactagattcagttctagaatgacaagatttaaatgaatccggaatcattaaatatcaacaacaataacaacaaaacttcagagtatgggaataatatctaactgctaaagttttcaaaatctggtgttatttattgcctgtctcctcttctctgggtgatggtttagtgtgccctatgaaaagcaaaggagaaacacagacacagttcctgcctgaacatactagccttcatatctaagttttgaagtaaatgagaattttttaaaatgtagcaacattttcctcagtaaatgttctaatttaatacctagagaggtttattacacctttcttccataactttgttttattatgacttcctcccagtccaggagaggaactcaatgtcaggcaatatctaaatataacataaaaacttcttttgtctccatttcacatgagatagggagccaagctaaaagccatgcatttgctgttattataaagaaagatgttttaataaactatgcaataaattggaaaagaccctggtgttggtaaagattgaaggaaggaggagaatggtatggcagaggagagatggttcggtggcatcaccgattcaatagacgagtttgagcaaactctgggagatggtaaaggatggggaaacctggagcactgcactccatgggatcacaaagagtcagacagacgaggacgaacaacaacagcatctaata

SEQ ID NO: 44239 - DNA, 2084 bp, Bovine  19866881399517
caaattactttagatctaagattatgagataattttattactttttgttacctgatttctgctataataataattcattactgtttctaacttttacatcaaaaatattttaaactatactttatttatatgggcttccccggtggctcattctttacctccccctggtaaagaatccacctgcaacatggaagacctgtgtttgatccctaggttgggaagatcccctggagtggggcatggcaactcagtccagtattcttgcctggagaattccatggacagaggagcctggtgtactacagtccatggagttgcaaagagtcagacatgactgagtgactaagcacagcacagcacatattgatatatatatatatatgttatatatatctttaataaaaacagtttatgaccaaaaaaagacaatttttgtttgaagctgaagaactgaggcttagagtaattaatttaaagataatctaatttggggtttggcatttatatttaacgtttccaaattttttttcaacaattagaaatccctatgtagtgttaaaatttaacagatatatctactgaattcataatatgtaaagccttaaaacaactgcagtttcaaaggctttgaaattagagagactctgcatcaaatcagcagagtaattcaaaggcaacacaaacccttgaacaaccccacatttgaagaattgcactaaaatctatttaaacaatgcaattatttttaagttggtcatgggaaaaggttaaaataagaaaagtaggtcagcctgattgaaataataattgatgtcttataagagaaaaatcaaaaaccattctttggggctatattttgggaggtttcagatattatttgttttttatttgagtgccttcaccccttttagttccttacaacagatgacatcctttttttttcttttttttagtggttaagagtacacttgtcaatgcaggggacacaggtttaatccctacctgaaaacattagcattttcagtttacacaacagtgagtctacaaaattttgaaataaatctacagcacaagaaactctagaaattggtaacatgcctggattacagggaagattctggaactggcttttccttaccctcccataaataagttcttctctttgatctaatatttcatactgtcttcaaagagaaattgaactatgtcttctctatgtaatacaaccaatggcagattcattttgatatttggcaaaactaatacaattatgtaaagtttaaaaataaaataaaataaaataaaaaactttaccagcacaaaaaataaataaataaataaaattctcaaaaaaaaaaaaaacaaccaagtattaagaaatggggataactttataaaaagcttgactccttagcagtatcattacatgagtttctctcctaagctcttcttaagttgaggtcagagaatgtagcctgcaagaaactgtctttaaaatttgttgaaatattatttatggctcagaacatgttcatttttggtaaatattccttgagcaaggaagaatatatacttttaaatatttataagtatattccaaatatatttgttgtctacatttgttagaagcagtctgtgttcaaaggataactatataatgacatggatgcatggggtgcatgaatgcatgtcattatatagttatccaaaaccaccaaaatatacaatatcaagaatgagtcatgatacactataagctttgggtaaaaataatacgtcagtatagcttcaattgtgtgccattctagtagagaatgttgataatgggggaagcatgcataggtcagtttttaatctaatcccaaagaagggcaatgccaaatgatgttggcattgccaagattgtcaccctgcttatttaacttatatgcagagtacatcatgcaaaatgccaggctggaggaatcacaagctggaatcaagactgctgggagaaatatcaataacctcacatatacagatgctactactctaatggcagaaagtgaaaagcctcttgttgagggggaaaaggagagcataga

SEQ ID NO: 44240 - DNA, 866 bp, Bovine  19866881563382
tataagttttcccctcctcccttcgtggagagctgctgggtggaacgagaagggagcagggctcattagtagataacttcaaaaatcctcttaacatcctaggaataattgaaaagtgacagggattctcgactattttaaagagatactgagaaatgagatttgaatttaaagcaagtgtcattaaaaagattgaaatatttgggagcctcatggctgatttctgaggattagatttggaaaaacaaacactctttaagtgaagcatggactgaatttatgagttagagataatactttgctttgaaagataaatctcttcaaagtgatgacaaaataaaaatatgtttgcatttaattttcgtgtttatgaaagacactgtagacttacctacatagaactcaagctctcaggcctatgagttggtgattagtataatctccttccgaagccttgtcctcaaggcacctcaaacccatctgggcctctgtatgcaggggaaagagaatgacattagctttgtgtctacacaaagaccaactttgcatttagagacaggatgaaggaaccactgaatgcacaattactcaataggtttgggttccctcagtacagaaatgtgcttccttcaaggccatcagcaccattacaggggagtgtggcaggtactccacagctgcccacgctggggtgcaaagaactcatgcttggactcttcaggtccctctaattggtaaggagccaaattgaatgttttgtctatctgtttcccaacctcatacccccaaatggaaacttctcttctggattcagaaacaacacagatgttattgcttcccacattataattataagaaagcaagca

SEQ ID NO: 44241 - DNA, 710 bp, Bovine  19866880424077
tctgagatgttatccctttaaaaatttagttttatgccttcaaagggaacactattatcaagaagactgccaaaatggattgcaaacacttacctggcttttctacttttggtacctgctgtacctcatacacacagttctgtgagatacctaggtttgggggccaaattggaatagataaaattctttgtccccgtgaagactgttcctggccagatacctaaacaaaatttcaacaggtatcttaggtaaatagattttaaattatgtactgaaaagtttatttcttaaataaaaggaaatccaagaatagtaaatattatcctttattcattatatcatttgtgcttgtaaaattttgctcaaatacagttcagaaaacattattacttacataaaaatggtaatcttttcctatgcatgtttttctcaaatttggaaatctaaatgatctatagctttggactaatactgctcctcctttttttcactacctgcattatagttcctgttatataaaatactaagaaagatcaactctcataaaattgtaaactatcatccaaaactcagtggcaagggcttactttggtcaaatgtactaaagaggaaataatctgaactaagcagaacagaacaataaaaataaaaacatggggataaattatactcagctaaagaattgaaatatgtatccttatggaaaggaa

SEQ ID NO: 44242 - DNA, 1926 bp, Bovine  19866880512087
aagaacttggcttcagcttgtattagagtgtgtgtgcgtgtgtgtgtgtgtagctgagctgtatgaagacagggtcatgaatgagttgaggctgctgctaactgggggcacaattgcaaaaagttaaagacacagtccctgcccttaggtgtttataacctaagaatgcaacacacacttgcttagtgaagcagaagtatagctacctggttttcaatcacagctcttattagcttgccatgccaaatgggggaaggcaactcttagggacttcagttcctccctttttaaaacacagcgcatctcaccgccctgttcaggtgtgtaggttgtgggggaagaaatgaaataacagaagcatatatgatctggtcattcacggcctgcgtcctggggggtggggggcagcgactgtgctgttcttcatccttgtctctgcccttcagggcctcacagagtgcttgacacactctgagtactcagtgcttgcatcttgaaaaacagtactaacagccctattatgggattattaatttaaagagttccttggccgcatcagcaataacaaaagttaatcagcccatgttagggactcgagagggtaacctccagaaggacccttcacatggaagaaatggccttcactccaaaaagtcaagcatcagaagacagggaagagctgagtttttaaaatgcatgctttattattcagccttcagcagaaatgtcacctttctaaagcaagctgttatcatgcactcaccgtgccaaacaggcgcctctgaggagcaggattttatctcaacattttgagtgatttgtgtttccctttcaaggagctccatgccttaaggcagctgaaacactaacagcgcaagaaggtaaggttacgggaggagcagactccaacaacatgaaacagggatttttgcaaaacaggtctaggatcggcatcaaagctctcgtctgcagccgccctgcccaataattcatgccctcgccgcgcagctcattgttttctggtgggctccttggtcgacaccatattctcaaagaaactccgttttgtgacagggcccccattagcaagctcagccacatgacaggcctcgaagcagccagcacaactgccggcgacgcttgccaataagccagatgctgccacatattggcatctgggtcctggaatcgcaaccatgttctcagtctggctagggattctgaccccagctacggaaggagacaaaggaaggaaagaaagagatggagcgcggggagggcgcgcaggctgtggaagagtctcttggtaatttccctaccatggatttagagcctccacaacaaaagactccttggaaagctgctaccaatgctgccatgggcgggagaggtagagatggggagcattttaaacccagcgagctgctttggcacctggggagtgggggtggctgattcaaaaggagacagctgcagcaggcagccacgttctccgggctctgggcactgagagagcccacagtggagaccagccaccggatggggctttgatctgcagctgggggactgggggcaacaccaggacggctatcgctttccattttctgggtgccaagaccgacccatgacggcaaggccaaagaaacagccagggcgagattcagaccggctgtcttcaggggatcctttcgatccagaaaggtgtgatcggggtggagggggtgccggtttgagcagacgaacggggtgcaggcaaaaagaagccctttgccttcaactgatttttgatgccacagtgacaccagcccaagtgaagcttcggatcctgccagagtcctatgaggtgaaggcatggcccaggagggctgggctgcatgaggaaaggatagggtccgaaacgagaggtgagaagaaaaaggaggcaga

SEQ ID NO: 44243 - DNA, 2110 bp, Bovine  19866880536449
acaggcaccatgcgagttcctgtgagctgcaggcatcagcacttggaggagagcttgctcagcagtgctttgtaaaattctgttgaatgcatggattcctgccctcttcttccctgagcctagaggctgacttagagtcctgctcagtgcagcggttgagttctaagaagttttccaatcaaatagccatggcacacagattaaaaccttccttggtcccttcacaattagctaaatcataatgctctccctttaaatgttgcaatttgtatagaaaatataggtagattcctgggttactttgagctccataatgacatccaagttaattttatcttgttgttttcactgtggggcatgcagcttcacatatatttgtacacaacaaattctatttgaaatataaagcctatataataggtgctctcataagtcactatttatcgatgctgcttacacatatttaataattatgtttttctctaattactgtgtttggactatattttaagatctctctctctctctctttttggtaattcagatagacatcatgatgctcaaccatatttccagttctctttcctctctgaacatacaatcacattttcctaaccccaggtaatcaggtgaggtcacgtgcttgattttgacccaaaagctatcactgtatgtcactttcaggttgaagcacttagatgatgctcaattttctgtgtactcatcacttgccttggtcatcctgaaatcatgttttaatatcaaggtgccataaaatccaagcagcctggactgttgggtcatactccattgaacgacagccacctgagtgagaaagaaacctgattatgtaaaagcactaagcttttgctgctactggttgctatagcattacctgctgctgctgctaagtcacttcagttgcgtccgactctgtgtgaccccatagacggcagcccaccaggcccccctgtccctgggattctccagacaagaacactggagtgggttgccatttccttctccaatgcatgaaagtgaaaagtgaaagggaagtcgctcagtcgtgtctgactcttctgcatcctaaacatggtccaggagaggcctctgctggtcagaaaggaggtgggaaggaggttgggagcatccctgagtctgttgacatcttccctcctcatgcaaataccgtatcatcacaaattcctggagacacctgttaggaatgatctgttaaggacacagcccaggacacagcctgcacacagctctgtcctcttagggggtgtccacctccgtgatctcctctcaccttctgaacaagttcacgcagcaaggcagtcttacatccacctttcagcgcagagaaaatcaaagttcacagaaactggaggagttgtttaaactggaacaatggcctttagttagaactttctactggtttgctggcctctcaatcagctggtgataagctgatgttttgttttgttttgttttagactcacggaaagagacaaaagcaagagattacgtgctaggtgcaaagctggagctgaataaatactggttaatcaatgtagctctgttaatttgaagtctcatttctcagcctattgataaaatgcagacaggggctgtgtggagagcaagaagcacccaccagcagagggaaagaggatggcggggagagaaacccatccagttaacccaggggggcaactgactgggagcctaggatttagaaaaggcagaggaaccagagaccaaattgccaacatctgctgaatcatagaaaaaagcaagagaaaacagaaaaaacttctgcttcattgactacaataaagccgactgtacagatcacaataaactgtggaaaattcttaaagagatgggaatgccagaccaccttacctgcctccaatgaaacctgtatgcaggtcaagaaccaacagttagaactgaacatggaacagtgggctggttccaaattgggaaagaagtacgtcaaggccatgtattgtcaccctacttatttaacttacatgcagggtacatcatacgaaatgctgggctggatgaaatacaagccagaatcaagattgccaggaga

SEQ ID NO: 44244 - DNA, 736 bp, Bovine  19866880561519
aacctttccttgatctgccagagtggattagctttaacccagagtctcaatccagtccaaagcagtttcacccaggtcctccttcttgctctgtatgggcctccctgtacgaccacatgccagttcttcagcttcttggggaggtctccccacatgcctcgggagcatctctgatccacacgccttccccgctcagtccctttctggctttctttcctccactcagctgcctttgacccacttattcttctccaggctaaagtcctccctgagcaccccttgcccactgagctgtccccagcaggaaagacctggcagacagtgggtcttgcctccttttgcatttctcctccttgatgactcccctctggctctgcaaagggaaaactggccccagaaaactgcctctgtcctcctcccagctggcacacagctaacttgagtcatgcccttggaatacacataatcggatctcatttgttaaaataataaaacaaaacaaaacaaaaaccccagcagtgcaaaacacatgctgatacaggctttggtgaaagatgatacaaagtagactgactgttccttaatcaggagctcagtaaacacccctttcctgggagagcctcccagagggtattctgggaagcccggagagtttttaaccctcattagctccaactaaaaatggacccactggaatttttacaggcagctattaagcaggagtagaactcacagg

SEQ ID NO: 44245 - DNA, 1638 bp, Bovine  19866880612973
caaaaaaataatattgtttcatttgtttcattatttcataataataatgttgttatttgtgattatggtggtgagttatttctccactgcaacttgataccaaacctactggttcagttcagttcagttcagtcgctcagtcgtgtctgactcttgcgaccccatgaaacgcagcacgccaggcctccctgtccatcaccaactcccagagtccactcaaacccatgtccatcgagtcagtgatgccatccaaccatctcaccctctgtcgtccactgatctccattagcatattggacacataccgacctggggagttcctctttcagtgtcctgtctttttgccttttcatactgttcatggggttctcaaggcaagaatactgaagtggtttgctgttcccttctccagtggaccacattctgtcagacctctccaccatgacccgtccgtcttgggtggccccacagggcatggcttagtttcattgagttagacaaggctgtggtccatgtgatcagattggctagttgtaaacctactagacctctgtcttaaggaatgttaaaatttaaacgtacttttttctatttagcttaccacatttctgaaactgcaatctctatttctgcctggattagtttttgtggttaatatgccatcaagtctaaaaagttatagtcaactaattttttttagccttctattgtttatccataatgtgatcaatttaattcatacaaaccgtggtgaccatagtcacaattctaacttttaaccaaaatgtataataatgtctgtttcaggcacatggttatacatttaacatgttatgtgtttaaatgttatacatgtttaaatgtaacattagggcagtgtttctagtctgtggattctgtttagaaatataccagtcaccacacatggacattatttttgaaaaatgttttccccagttttatggaggtataattgacatatgacatcataaggatttgaatatacgcatatattgtgaaatgattactgcagtaagtttagttaacacacatcactttacagtagttatatatttttttctagtaataagaactttaaagttattcttttagcagctttcaaatatacaatatagtaacgttaactgtagtcaccatattgtatgttgtcattgttcagttgctaagtcgtgtccgactttttgtgaccccatcgactgtagccctccaggctcctctgtccgtgggacttcccaggcaagaatactggagtgggttgccattcccttctccagggaatcttcttgacccagggattgaactggagtctctgacattggcaggcgggtttttttttttttaaccactgaccccacctaggaagcccatgttgtatgttttatcccccaaatttattaatcttataagtgaaagtttgcattttttgaccaccttcaccacttgcctctggcaaccaccagtctgttctatttctttgtttggttctatttagattccacatataagtgagatcatatggtagttgtctttctctgacttaatttcacttagcatagtgccctgaagaatttattttttaggttgaatgatattctgctgtatattattcactatcta

SEQ ID NO: 44246 - DNA, 1738 bp, Bovine  19866880642339
ttattattattttttggccacaccacgtggcatgtggaattttagttccctgaccaggaattgaacttgtgctctctgcagtggaagcttgaagtcttaacccactggactgtcatggaagtccccaaaattatttaaaaggtggctaataaacaagataacctcgagaaactgttggccatctcagaaacacagggcacatggcaagagagagagagagacagagagagggaaaatgaaagaagggtcttgcatcccttatctgccttccttgcactgaccttcatcctcatgtccctggcatatttctccagctccttccttatgtcagccctcaacatttttgagacattgaggaccagctgcttccactcgatgggctggaagctatgaggctcgtgggggacatacagtccgatcttgaccttcttgactgtgtgaagatacttcttgtaggaatcttcgaagtcaaagatgaggtcactcagagtccgaaaggtcaatggcttgtccatcagctcagcccttcggctcatgcccagcgagccatagcggccattgcagtaaatccccagcacaacgtggtgaaagtaatttcctgagaagtaggttttaaagctgatggggaatcgctcgatggaaggctgtccattcgttaagtatcttaagacaatctgagtcaaggaagagaaaagaggccttgaagataccagaacttgcactcccaggaaggggaagtggaccacacggccaggggatccactcctctgcctctgagcagacccagacctcatctttccagatcaatcctcttataaaggattcactccctatctttgagatacctgctatctgctgcacatcaaaccaaattttatgggaccaagagtgaagacttcctttcttctttagtaattaaataatagaagctcaaccatcacaaggtactttttctttacctggtgctctacagggcatgacgagctattaaaagtcagcttatgccactggaatgatgttctcagtcattaattctgatttgggtatgtggggcagaccaggaatcgaaggcctctgcgacagtgcggggagaaatgatgaccagaatcaaggcaaggcagtggcgacggaaaagacacagaccaactgatggaaagggaagggacaggatggtgtcaggatgcgtcacacctgcacctcgcctgctcctctcactggccctggcacacccatgccagcagcatcgggtaccactggacagctgcctgcaacacccgacccccgggctcccctcagtccccagaccacttggtgacacagctcagccctctccacggactggctcactggggtcgagccatccagtctctgctaactcagtttgggctcagcaactccacagcacacaacttcaagtaactgccccacagactccaaacgctgcaacactggacaagaggcaccacctcctcaggtctatatccgagtctctggacggtcctggtgtggctatggtgactcacagatccagctcttctgaagagagacactaaaaatccagatacactctgttgtgtctggtgtcaccaggctttgctggtgtcaccaggctttgctgaagtaagtaacaagccaggctcttaacatggtggcttggtgcatgcatgcacgctaagtcgcttcagtcatgtctgactctttgccaccccacggaccgtagcctgcttggctcctctgt

SEQ ID NO: 44247 - DNA, 1837 bp, Bovine  19866880642412
ttgttaagaaccatcagtgtaattggccactaacctggaaggactgtgatctccagcagacagccccagcaaagaaaggagcagggatcctggggctgttcccaaccgtgctggtgactcacgggatgatacaaagcaaagcccttcttttgtgtgggggcgaaacggagaatggcacacacagctacttgcctgacagaagtgtgggttggtagcgagccattggcaggctcctggcatagcggaagcccaggggtctctgggtacacccaggttctcaatgaccgcttagcagtggctgcagggttaaccctgagctctgtctcgcttgagcaccagcctccattggagccactaagatggttgggcgggattatggcacttgcccttcgtgctgtcatcctcattggttaagaatgcaccctggttattcctaactccactttaataatgtgttatagatctgccctccaggaatttatttgaaactttctttaatctatttttatttcagcttgtacagcatgttcaggcaacaaggaggtttaccatctatgtaaaagcactaaagggcttccctggtggttcagtggtaaagaatccctttggagaaggaaatggcaacccaccccagtattcttgcctgggaaatctcatggacagaggaacctggtgagctatagtccattggggtcacaaatgagttggacatgacttagaaattaaacaacaacaacaaaaaacacaccaaaacacagaaggtgctatataaaggcttttattgtaatcataccaataatcttttattataatgttaaatgtaataaatataattggatgatgctaattcagatggtttcacaggcttatttttagtcactgtgtttgcctttgttttttgtctccacactcacacacacaaacacaccccagcaaaaagtctttattcatggagcggggcgccgtgatagatgtgagtgcatgcaaatttacataaacacgttcagtgtcctctagagactttccatctaagaccgacatataggaggtgctcagtaaatacttttgggtggttggaattaaaaaatgaaaagaaaacccgtgtggtaattcgtgagacatgttaggaatgattttgttggaggctggagggtaaacattgggctgaaggaagaagggaatatgagatggtttggccatgtgcatgtatgagctctcctcagattgccttagtgcttgttctggaggaatagctggttcccaggctgcaaaatgatgcatagcaagagagaccaaagcggcaccccctgacaggtgccatgtgggtgccagtagtgaggaggtaggtatgccgtccaggagagaaagaccagttcctgtggctatctctgtttttaatgtgaaccacgatagaatgaatggttcagtgggtaaagaatccgcctgcggtgcaggagactcaggagactcgagtttgatttttaggtcggggatgatcccgtggagaaggaaatggcaagccactgcagtattcttgcccggagaatcctacggacagaggagcctggcgggctatagtccaaagggttgcaaagagtctgagcaactaagcacgcacacatagaatgaaattttaaaagctaggtgattcggcaggtgaatggacagataaatggtagtgcttccagacaatggaatattattcagcaccaaaaataaagagagccatgaaaagacacagaggaacagtaaatgcatatcactaagtcaaacgagccaacctgcaaaggctacatactgtgtgattctaatcatatgacattctggaaaagacaaa

SEQ ID NO: 44248 - DNA, 1012 bp, Bovine  19866880645763
gctgcccccccgcattcagggagtacggtgttagggcatcttttatcccacaaaattcccagactggggtcagaacgtcaagactaggggcccatttcctcctctgtcatcattatacctcccagagccttctctctcctctgtgagaaagaaggctagtaacaatcaccctgttttcccagagaattgggcaaggcgttgacgaaagaatacctgaatatgccctggaaaaacataatgcaactaggaaatatgttattatcaggcctcccagggatctttccagcccagggctggctctgagggggtccaggtagatgggtggctggtcactctctctgatctcaaacacttaatgaatagaacactctgacctttacatcccccagtggatccaagatccacagatggaggcaagaattccaggtcaacaaccaccaccattgctgactattcaaagaaacccaggaaatgtatgaatcgaccaattctctccccaaagccatatgtcatgaatcagaactgatgctctcctatcagtttaatcctataatcttaggatgttgggaggagacttttctggcaggttctaaactctgagaagccagctttccaaagccagaaagacttaagatcctcccaggcatttgtgttttccctacctttccaactttattaaaagcccaatagttcaggaatggaattcagagctaccactgggctggcctttgtctggaggactgcacggctcgcttctacagaggcagtttgaattccactgcagttgagtgtagttccatttcatctcccaagtttattaatgagctttcagggcttggcatctgctctttgggattttttctccccatcttagtgtaaagtcagcagtcctgatgaaagaaacggaagaatgccagtggtatgcaatgtttttatgaaaagcattgtgtgggcttacttgaagatgcaaacggttgtgaaaatgtttaaaagcttttcagaaagtaaagca

SEQ ID NO: 44249 - DNA, 1277 bp, Bovine  19866880724183
tatccaccctatatatgatagcttgactctgctcatcccaaacgcctcatccttcccccctgcccttggcaaccacaagtccattctctgtgtctgtgagtctgtttctgttccatagacatgttcatttgtgtcgtattttagattccacatataagtgatatcacatgacatttgtcttcctctgaattatttcacttagtgtgcagaatcataaattcttacattgaaaggaagcttaacagaagacttctgagctacctgcttgccctgtgccccagaagatgctccatttgctaagatggggtcaagataaagaacagaggggtgggcaaccttttgggggcgtcctgactgaccacgtgcaacgtccccggagctgaaaggtgagtggcagaggggtgggaggcaggggtggtggagagaaccttggacctacactgctgtccttcccttgccttcctcttgaagcctatacatcataaagaaccctgatacatcagaaatgtctagagcccggtgaaaaacgccatctgtcaggtcgacttactgactgatttttaaaagaaataaaaaaatcaatgggaggctaggtcatatttagcgattactatatactgagcacacgctacacgccagacacaatggtaagcactttaaaaagtatccagtatcttgttttcatgccttgtactaaccccgtgaggcaggtattattatttcagctttatcgatgaggaaaccaaagctcagaaaggttgaatcttaggcacttgactcaaacacgggtctaattcccttcaaaacttctattaagttccactaccccccaaatcttagagagttttaaaatgtgctcattttcctttagacttgcctctcttgttgaagggcctccccccacccccccaccctcccaagtcttgttgaatgcctggaacattctagtgtggaccttaccgtactcctaaagtctcagaagtctcccatgtgacaaattccagatccctgtgccctcgtgatactatcctgtctgccaaatttgcaattattccataatttgctttaaccacaaatataagcccggctattgactgagtaaactgagtagggcttttcggacttttgttcagtttcccaaaatatgatgaactgaaatcatctgatgatgaacttgtacttgaaactggagtggctgagggtggagtgagtcactccggtgagttgtatacctaccagtcaatccttcagattctgtgctattgccagatcatgtg

SEQ ID NO: 44250 - DNA, 1824 bp, Bovine  19866880731501
tctctgctccaattcactttctacacggcggccagaatgatctattgaagccaaaatgcagcacatctcattcttttacttaggttttcagtgtctctcacttctccaggacttagtccaaatccctcccaaagtctaccatgattcagcccctgctcaccatcctctgtactgtctcatctcccccacacgctgacccacagctgatccgtgataacttggttttttgtggctgcacagcttgcaggatcttagttccccaaccaggaattgaaccagcgcccttggcagcgaaagcacagagtcctaacccccggaccgccagggaattcccgacccgtgacatttttgcaggatataccctgagaccataaagaatccacagatctatgcccactgccctcagcacatgtattcccccagaatatgaggtcaaatataactgaaaatcttaaatgacctttagactacatctgactcattggaaaagactcagatgcttggaaagattaaaggcaaaaggagaagtggggagcggaggatgagatgattatagtatcaccgactcaacggacatgaatttgagcaaactctgggagacagtggaggacagaggagcctggtgggctacagtccatggcgtcgcagagtcagacaggacttagtgactgaacaacaacaaacacatttcaaagctgagaccaaagtgacctacgaaactttcaaaaagaaaccactacacccactgtgcacgacctcatgtccctatttcagtataacttttttggcttcctgcaggtcagccttatagcacaagggatttaaacctggcagagatcttttgggtctcccaagaatcatgagtggtaaggatgctatggactttcttgctttcacacaggccacaccctgactggaagagcctcactgcctgggttgtgataccttccctgaccttcctcagtgtggggtgaagtccccgcatcccctgcaagagctcccagcgcacttggcgcttattcgcccagcactgtgcgtgtgtgtttgtatcttacgagggcaggagctatactttgcatcctgggcctcccacaggccgagcacacagaagtgtctagttaatgcttgctcaaggatgaaccttacgttgtgaggatacatcttacgcttaaaaggactgaactcgacagagaaagataaacactggatatcactcactcacatgtggaatccaaaaaccacaacatacctgtatacataacaaaaaagaagccagactcacaggtacagagaagaaactagtagataccagtagggggaagggacaacatagggatgggaagtggggaggaacaagctgtcgggtttaagaccggctcaagaatgtactgtacggcactgggaatggagccaatattctgtaataactgtaaatggaaagtagcctttaaaattatattaaaatttttcaaattaaagtaatttttttaaaaaaaggactgcacagggtatagggctaatccaggtacccttaaaagggaagaagtcttgtcgtctgacctcaatttaatcacagatggctcctctctataaaaatggttacctgctttctcttcactttatcacgtgaggttaactggcagtaagggagtgaaatcacatccttctgggtcctcttacataaatccttccctgctttctggggcgagttctctggggctggaacaagggcactcctcagctaagtcagtgtaacaaacactacttcctatcccagccagactgctaggtagggctgtggagtcaaggatgaagtacacagct

SEQ ID NO: 44251 - DNA, 1265 bp, Bovine  19866880750319
tgtttctgagtagcatctagattcccttagcagaggctgaagccaggaagaattctcactttcatttacagtggggcgtttcctgattcctttacttttttttctttcttcttttatgtcctttggccacctgatgcgaagagccgaatccctggaaaaaaaccctgatgctgggaaagactaggggcagggagagaaggaggtgatagcggatgagatggttggatggcatcatcgactcaatgcacatgagtttgagcaaactccgggcgatggtgcaggacagggaagccaggtgcactgcagtccacggggtcgcaaagagtcggacacgaccttcaagactgaacaacagcaaagccatagtgtagagactcagagctctccctcaccatatgttacaggtttctcacgggctctctctccatgctttacagagaaagcagtcaccgcttcagacattacccctcccgttccagactacctgctgacctttgtgttgtttattttctcctccaaattggtgcgtgaagcttattttaattcagtttcacctggatacaaatatcaatgggactaaagccctatttctggacttgaggatgtgggtctttccctccattccagatctagaacatgagggccagtagagacgcagcaggggacactttgctctgactgagctttccctagcaactctcgggtttgctccggccacctgatcaagtctggagttccagggtttcaccttgccacctatttcagcgtgagcttgataaatccgcatgaattctgagagatgaccatgtgtctcaggtattcagttactactagggtaagaggggggaataatgttcttcttctctcagggttgttaggagaatctcaagctaagatattggaaagtgcctgacacagtgcttcttaagagtttggcttttgtcagctttgctttgagctgctgaaagcactctttctcctgaaaagtgcccgaggatacaagttagagtgacacattctcttagtatcatgaggaacacgattaatgggaaatgacttcagtttactgcatcttctagtaatgctgtgatgccatcgcaaaacaaaaagcacatgactactcgtaagcccgtggtacctgaaaaagaaattggatttgactcagaaaatcaggccgtacagctaatcgctctgatccaataatgctgccctgcagaatggcatcatcagccctggggcacggggataggggaggaggacgagca

SEQ ID NO: 44252 - DNA, 1697 bp, Bovine  19866880769294
ctcatcaattgctttaggggaagtggtgttaagacctgccaggatctcccaaaggggctctttcttggccaggactctgggatgggttccccatagaatctgtactaggagactcaaagtgaaatggtaaatgggacaagagagccccagcaggacctcccaatgtctatttaccagttcctgtctctctctcccatcagtgttcctctggctggcccccagcctctctcattccagagagcacaggactttcttgggaccttctcatgttgctgtggccagcaagtcaatactgtgccagctctgagtagtaaagggctgtataatgaccatgggctagtgccaaaatttataaagaaaaaaaaaagaatttatttacaagggaaaatagtaagtgcattgtgccacatttttcttcatccttattatctatgtctatataataaatatgataagtctagggacagattttccaaaatcttttctcaactggggccatggaatattttgggtcttagttgtggcatacaggcttaagagcatgtggaatcttagttccctaaccagggatctaacccgtgtctcccacattgcaaggcagattcttaaccactggacaaacagggaagtccttgcatgaatatttagtactcataattataatacacacacataaagatttgcagtgttggtcactcagtcgtgtccgactctttgagaccccatggattgtagcctgcaagcctcttctgcccatgggattctccaggcaagaatattggagtgggttgccatttccctcaccaggggatcttcccgacctaggagttgaaccatggtctcccgcattgcaggcagattctttactttctgagccaccatggagctaggtgttaaaacaccacgcctatctgctaaatgatatttcagacccattatgggaaactttttaaagctgttttttattggggtaaggatccttttgttctctgagtattcattatctgagtccacagttgcatctggaaggaaaagccattttaacaaggaaattcttagtaataatgtgaccacttataaaatcagtcttcactcaaaccatcctccgtgtttaacactggagttttaaccttgcccattgggtcaatatctttaacatttttggctctcagttcatctcagctaatttcagggtattggaaacatctgacaaccctaatgcaaacaaaatatagactgcaaagtgaagttgcaaatcttgcaggggatcaagatttttaccaagttgttgatggcgacatggagcaaagcctttgataatggagaattggtagagctggattaattgaaaatggaagaagagacaactgaaagggatgatgacggtataggtatttgaaaagagaattctttgtgccataagaacacagacgccgtaactgagtgtttaaacaggatctgctttatattcttacctcatggtaaatgtgaagtgaaaaatgtcggagtccccaggaaatttagaaatttttagtcttgccatctgacttttgagatgaagaccctgagaggttgttcaaagtcatgcccgtggtgatggagcaggactggattgctgaccttgccggttcttccaggcactccagccagtcagtccgcctccttctcaccccccacctcccactcacaagcagtac

SEQ ID NO: 44253 - DNA, 1177 bp, Bovine  19866880811104
tctgggagacagtgaaggacagggaagcctgatatgctgcaggccatggggtcacaaagagtgggacatggctgagcaattgaacgacaacagcatatatcagaacctactggccaggcactattttgaactaagacaccattttgcaccaaaactcctttggcacaacttgaccaaaataaaaagttcagggaccatgacttcctacgttcacatccatgccagttcctgactccgtaacaccaatggagaacccaaagacataagcctttatgcaaccagagtcctgtgactaagagccgactgccactaatccatatctacagctacttaaatacattcctttatgaaaaatacagtgaaatgttcttacaaaaccagtcatatgggccctgtgaccatgactacaagtggcgtctcctctgatatttttagaccccagcatcatcacaaacagcatcaccactctctctactatcactatttacaactcctcttaaaatgcgtcagccagctcagagcagtgctgtgcctcctatcacatgcccagctgagctctgcctgaggctctgctgaaggggccaccgcaaatggtttcccaggggagcagcagttcccacacagcattccaaggacatccatactttaaaaaatgggggagaaacattttcaggaattgctcacaaccactttctaagagggggagagaacacacacgcaacaaagatagtaagcatcagagtgctcagaaacacagaaaaggacatttctctatcagtgataatgcctattatatgacattcaaacaccagaagtgccattcagctgcttgtaagtcacaaaaggtgagtgaaaacacttatgtcctttgtcgaaagggaaaaggaggtggagaatccttcacacaaagatccactttgacttaaaatacagggtaagcagtactagagatctctgtgcacaaagcccacctattaagattctgaacaaacaaggagcctcaataccacaaggctctgttgttaatatgtggttggttatgtcaaggacagtaaacaaagctgcttttcaagtgtcagtttgagctctcccagttgataaccatggggactcctgggtcacaaccccaaataggcggccgttgttgtggggaaaacagcagacgggccccagagca

SEQ ID NO: 44254 - DNA, 3207 bp, Bovine  19866880864764
aaataaataaaagcaatcagttcgctttatcaaaggacctctctaactctttactatgttgatgaatattatgaatctccaagataagattctcacatacagtgactctcagatttatctggtcatacttatgggaaataataggaacatctaccatttattaaccacatacatcaattatagtgttgtcatttatagatgtagaaattgatgcttaaagaggtcaaataagaagtttatatgacagcagactcccatgtcttaactttataagatcctagctttatatttgttccaggacattgctttgcaaattccacttgcaccagtcagtgtgtttagtcgtgtcgactcttttgcaaacccatggactgtagccctccaggctcctctgtccatgggatttcccaggcaaaaatactggaggggttgccattccctcttccagggtccacttgcataaactatgcaattaatgcacatcactccacctgtttcacatagcaccagccatgcaggcctacagatcatctctccatggaacaggaagaacaggaacctacagaggatacagagaactctcttacagcccttgggaggcttctgtttccatgacaatagagagagcatcagtatttcaacgccacaaacaaaacccttcttgaaaatctcagcaaaggggccatgatgagacaccatgtcagggaacctaatacataactttccagtgataattatgaaaaatacagtagactactgtttaatttcttatgaaagaagcttgacttattttgagtcttatatatctgttaacctggatttattcccctggagaagggaatggcaacccacccaaaattcttgcctggagaattccatggacagaggagcttggcagggtataatccatggggtcataaagagtgagatatggatgagttttataaacattaagatatttatatcctggttttataaacattaggatattccacaagaatatccacaacattaggatattccacaagaatatctgggggagttgtacatctattaaaaaattgattagaatacccaccttacatttttatgtcaaatttaagtacataatataatttaaacttaggttgttttttgggtttttgacccttttttaatggttttccaagtagaagaaatccaaagatattttagtgacttgtgtaacttaaaataacagcttcaggcacaggtggatccaggggctcaaagaaaaccaccattaaacctgaatgcatggtacctgtatttttagggaaaataaatagaatacagtgctataaacctgtcttggtcccttgttctcactgacatagagagatgctgtaaataattacatagatgtgaagagtttgggggatggactcccacctccatcactgacccttcagctactcttgttgagacttgacttttccatctgtaaaaatagacacactactctcttttcacttcggtggaagcttaggtaagtagtaaagctttagacagcttatttaccttagaggattaagtgctgtggtatttatatatacacacatatatttgctattaatgtttagggagatagcatttacactggcaaagggttttccaagtatttatttgttttacaaatttatcatttaaagctccataattagcctggcaaaaccttcaacattgcaaccacagtttaaagccaatcaaggcacagagggagagcgagatatatatatatctccgtacccgtacccgtatttaaattcccattgtgcgtgtgcacgtgtgtatgtttgcaagacacatataaatggcaaataaggaaactttgaaaaaaaaaaaaagacagagagatagatagtcccagattttaaaaccacccccaaggtagaacaggtggtgaaaatataataaaacatgttgcaaggaacttgtcatgaattttaaaaacaaaaacgcctacagaccaaataaactgctctgacactcagctaaatctgaagttcccaaactattttaaatgacaaagcagaagttccccagaggagtccaacaggaatggtttgagggcgatctctgtggaactcaaacggaacagagctggaaacggagggcagacacccagcgcgctgcccctgcctcaggggcagaccatgtgcccaggggccaaggagtgtgttgatacaaaggcctctgggagcctcctgcgcccacctccctacctggttggtggctctcagtggatctgaaggcaaacatttgggtcacttgactggaagctgggcacactcccatctgcttgccggtgccctgtttgaaggcaggctggaggctctggcttgggagcagagttggggagttggtggtgacagcagacactccccctctctgcacaccccccccccattcattcatcacaaccacctgcctgtccttttgcctctgtccacagtttatgaagagctttctcctccgctgtctccttccattatgcagaaactcccggagccacacagaggtgatagcagcagctcattccgcagtgaggaagaggtcgcgtgatccacccaaaatcacagagcgggacccacagtgtcgggtgtgacgcctggtccaatgctctgtctactagaacgtgctcacgaagaccatgcagggataagattcaggggaggggtcagcgttctggtccctcaaccctaggcccacagactcacttcatcaccccagatcacgcactaaccagaaagcccgtcatccctgggcaccaggaaactgttgtgatttgagagcagtgcgtcttctttctcaaagtgaagccatctcttgatgtaaaatgtcctgatttgtagctaccggtttggttgaaaacaacaccattgccatctgaacctaacaaatccatttgcagagggcttcgggctgcagagcacaagtttgagatccctgcctgatcacagtacccaaagcccctgctccctcactgaaggccaggatgtaatccattaaaagagggccagtctggagacacagagggagtcgccaaacctgactctccatcttggccctgactcttgctagtggcacgaccttaagcaagtgactgaagcaagtctctctgaacctcagttttctcctctgttgaatggggctaataacacctccctggtttcttcagcccttata

SEQ ID NO: 44255 - DNA, 917 bp, Bovine  19866880964332
aattaataaacaaagaaaagaatgctgtggtttatacagctaatcacaaatgaaaggaaatgttgctacagatcttttgtctgctctctgatgtcttgtcactataacctctacatcatctatcacatcatactgcttcatgctttgcttgattttcctttctaacaagaacaataataccaaagggcaagagggtacagttatgtgtactcagtttcttggcttctgaccataaaaatctagtcacatagtcatatttcctctcactcttccaaccttattttattagcaaagaatcatgattacatgaaactagatcagaaaagtaagatcataaaaacacctagggaaaagtcagagagtaaaataaagtaataaacaaaagctctatacaaattgttccctcttcaaatcctacctaattctaaatgagaaatgtttcaaaataagcaaacaaataagaactagccggttaggaagagaaactttttagcctaagcaagagaagcaaaggaaacaacactacttcttctggtgtatggagggcaattttaaaatatacgtcagatgcaaaaatgcttatatctttaatccagaaatttagcaatatataccagaaacaatcagaaatgtagggaaaaaaagactgacacgtaagaatattcatcacaaaaactagtgcaattgaaataacaaattcctaacaattggagaatatggtatatcctatgaggaggccttacaaatagctgtgaaaagaagagaagcaaaaagcaaaggacaataggaaagatacaagcatctgaatgtagagttccaagaatagcaagaagagataagaaagccttcctcaggtatcaatgcaaagaaatcgaagaaaacaacagaagggaaagactagagatctcctcaagaaa

SEQ ID NO: 44256 - DNA, 2071 bp, Bovine  19866880989239
ttcacatatggggtcaacattttcgtctcctaggatcttcgtgttttctttattatggttacatatatattcccaatgccgttgtattgtgcctgttaaaatatattagacaaaatacaaagaattaataaaaaacagatcatatattttcctgcacgtaagtattttcctgcacgtaagtattttttgccttttaaaaattcttataagtgatgaacagaatgttttcccctagaaaatggtactgtagcacctcatgactagaagtggtcatcaaactgtttacaaagaccgtggaatgatacactgcctgatccaagaggcacaaaacatgtttaagagggttcaggaagtcattctggaggctctgagcgtgtgtcaacaaagctaagactacacaggtcatggcttctcacttccccatgattatggcatggatttgccagacatgctcagcaacttcatagccaggacaatatacttgtatggcacagctggtctttcaacaagataatttcatattgtattttatcacctactagtatgacaagatcatcaaatgcttaactgtgttcctgagacaattcatctgagaaatctggtttagacgtgaatgaagggtatataatgacagtaaatggaagcagtatttacggaagactgctaatgaaataaacaaaagaaatatttttaatgcacgccaaagcaaaaattaaatgtaacatagctatacaatgctagtaaatgctaatcctgattgacaaacctagcatgcaacaatcaggaatgtgtgacagtttatattctgcaaagacaccgtgtacactgaaaaagtattgagaacaggaggaaatagcaagagattctgaaattataagcagtctttgatttagacatgattacttaaaaaaatacatacacacacacgtatgtatctatagatacataaacacagtaccatatatatgtataaacactcatacacaacacacatactccttcgatcttcctctccccatcaataaagaggatactcttactgtcatgaaagtcataaagacaaatgtggaactttttagagaatctataagcttaaaagaagggaaaacaagaaataggatgaacttgggaaacaaaaagatttgaagatggactttcaagcacaattagatgatatgagaaaatctcagccctagaatatctcccttttcctgtaaggctttcatttcactgattcagaatccctaaacttctccaattaaaaattaaataaaaaataaattgaggaagagtattctaaacatgggggggaaagactacaaggaaatataccactatttttaagagtaattatctctgatatgaaggactgtgaaagatttttccaaatcttctgtaattatatatttacagagtatcaacacattctagaggggtgggggaactagctgcaggcagtcaaaaggtacaaactttcagttataaaataaataagtaacagggatgtgatgtacaacatggtaaatttaattaacactgtagcatgttctatacgaaggttgttaagagagtaaattctaaaaggtcacattacatacaaaatatttatttcccctttcttttgtgtctctttgggattatgaagttcacaaaacttattgtggtaatccttccgtggtgtagtaaggtaaatcattatgctgttcaccttaaacttagactgtgctggtaatgtcagttatatctcaaaaaaggtgaaagaaaaaaagtatcagtacactctagaaatgtcaatgaagtaaaaattttaagtgactttaatcagatttcatccctcaaaatctaaaagctgatatctgctgcactgaaggaataggaattctgatcagaggacagaagaggaaggcaatttttatgaatagcgaggtctgagtggaacagaggagttggaattatgataccaaaggtactaggagcctgaggagaaaggtaaaaactgatgaaggaaagaaaaccaaagtaacaaaagtattcaactatcacataatttagctcagtgcttgtcctatgt

SEQ ID NO: 44257 - DNA, 1053 bp, Bovine  19866880995937
ctatgaatgtgagggcaaagggcattagggaatttgtaacttcccctcaattttgctatgaacctgaaagtgcagtaaaatgctttaattttttaaattagtttttcattttcgttttatatttctcttattatctatcatgtttatgttcatttctaaaatagttgtgtgttttttttttttaacctctaagtctttcctgagttgtcacctcatttctgagttttctacttaatgatttctgtcattctttcatgtcatataattttcttaatgtctttccattcattttgaaattgtaaattttcatctgtttcgtgagaatgtctttccggaatgctctcattgtctctaaggactttattctagcctgaattctcttttttcttataataactttgtatgggacttgattattttctgttgtgtatttttatgtgaaattagttttcctaaactatgagaatgaagcaggttaaactttcaaaggctctaacttcacagagctccttctgttgtttttgttaaggtttttttattttctttttaaagtatgtcatcttgctttctgcaatttcctcgctactcttcctttcctttaaactggacctttcttttgtccctactctgctcagttttgattccattcccagcgatttctcctcattgtagggtcctggactagaaggcggctccggcaggtcaattttgaaagttccaggaacctgcccctttaatctcttgtcttgcaagctctctgcacttaccggtgtttaagcaggcgaaacaccttctccttcagctgctgttctcaacttggtccagtgagtaccagctggctagctagcaatctcctgttctctggtcccgtcagaagctagacttttgcttccttttgtttcccacacgaatttgcttatcacacgagtcttgtggttcttggtattttgtccccagctgcttgcattctggggtaccaggtaccttgttacctagttttattgtgaatgtcacccgtgaatttttgacctcgctaatctaattgcactggta

SEQ ID NO: 44258 - DNA, 1451 bp, Bovine  19866881015327
taagtattcagtaaatacttccctttgattgaaaattttaataattcatgcaaaaattaattttgatgataacattcaaaagactagaaggatttagtatgaatgaacttgtaaattcaggaaaaatattccagcatataaattataaatatttcctttgagaaataccagttttggataataagagggattcatgtgagtaaaggtcatggttttggggactgatcaaatttggagacattgatttgatagatttataaaagaaaaaattatttcaggtttcattaggtttttagaattttagaaacctatttttaaaacaaaagcaccagaaaattcatatttgtatttttttgttttaattcaagccattttttcttctaaggtactttgtttgcaagaagttcaagaagatcattatggaacccgaggatcaggccaagtttggaatcattgggtacaaatgtaacttttattttagccagatttacttagtgagttattaaagcatagcttgctaacaaaggtgtgtggtatatttagactaaaaatcttaattttgaaaaacagcttaatactcattttaagaggtcaagaaaagattgaagtatttcaaatgggtacttttgtgttgatacatattttaatataaatggaaaagtgtgcaaaaatctcttcatagctgcctttctaggagtctctttgcctactaccagactcctaggattctgagttccatgagattggggaccattgtatctagttcatcattttataacacctatgtccacggtgcctaattgaatgaatacctttagaaacaggtcatctctttgagaaatgctgcctacgttgcattcattcattcagcacgtatttttttgagtgtttgctgtacaccatgcactgttgaaggcaatggggatacagcagtgagcaaaacaggtaacaggtctctgtgcttgcggagcatacattctagtggagaaaggccaagaatagactgaacaaacaagtaaatagtacctcaggtaatgagagttttctggagaaaaacacaggaagggggaaatgggtcagctttcagttttaaacaaaatgaccagagagagcaacttttgagtaaagacctaaaggaggtgaaggaacaagtggtggctggagcattccaggtagtggagatggctaagaaggttgtagtgccttgaggcaagagaaactgctgtgtgtggagtggatcaagcaggaaagagttagaagcaaaaaggtaaagagatcgggttgggagagaggggacaggttactataaggtcgctgtttttgccttgactctgacttttgttaggatggaaatgagagtgtgataacacgtgtatgtaacactgcagtctgccggtaaaaaaaaatctatttgacccagaagtagacttttttattccaacactttttaa

SEQ ID NO: 44259 - DNA, 1504 bp, Bovine  19866881046103
tcccgatcaatgctacacactaagaggtctggagtttgatggagttgctggatcggtaactacatttgtcactttcctcgtttcctcgccccaaagccagattacctggagaaaagcctgcttggggaaggccatgggtagaggctgggaagctgcttttctccagacacacctctaggaaccaggctgtcctggaccccagtctgttgcagtgacggaagctgggatctggagagggagggaggagcttggtgctcggtgcatctcgtggtccccacctcccacagccttcatgttactctcatctcctgcatctctcttccctctcttcttgcatgggggcccctgtcatccctcatcccgccctgcaatccggaagtcaggattaaggaggaaccgtggaagagacgctgccatccttgtaacgtctctgtgcctgtgtgctaagtcgcttcaatcatgtccgactctttgagactccatggatggtagcccgccaggttcctctgtccataggattctcctggcaagaatactggagtgggttgacgtgccctcctccaggagatcttcctgacctaaggatcgaacccgtgtctctctctcaagtctcctgcgcgggcaggcaggttctttaccaccagcactacgtgggaagcccttgtaatgccccctccactgtgaaactctagccaagacacttgccccccagatcctctcctggcctccaatccctgggagcagagaaaagcagcagcgggagcttccaccaccaagaatcaccatggtcttactggacttgctcacatcagagtgtccacaggaatccacaagccgcctgggctccctggctggtcaagcaaccaaggccacctgatcctggtgtgggccagaaccaccactccccaaattctggccctagggaagagtttatgaagacccctgggagtcagggcccggcccaggagaaggggtgccaggaggggtcatgagtctcaggggatccggggcctggttgcagcccctcttcatcattttggaaaagtctacatttacactgaaccaagagccatcacctctgtgctcctgggcctgcctggctggagctatgaccagttcagggaatgaaggggggtgatggacttgaaccgcacttccccgcaggtcttccttcctgatctctcggtgactactgccctctccccagtcttcctccccattcccaggccgactcccaagcctcgggagggcagtcaggggagggcagggggccctgacactggagggtggctgtgcactcacatccgtggcaatctaacagctgtccgctgcaggcaccggcatgctcacttgccttggctgcgtgacagagtggctggagatgagggcaggggcatggcctgggcgatgactgaggtcgggacttctctctctggcccccaggagaaggacccatcgggttcctcccagggtgacttcagtggggcccaaccacagggccatg

SEQ ID NO: 44260 - DNA, 4011 bp, Bovine  19866881057401
cttattcagcttgattgattgacttggaaacgtggctggtgtatctctgaaaaccaggctctgcactaggagctgaagatgcaacactgagcagaaaagtccctgcccaccagatgctcacattccagcaaaggatggcaccatggaaaaatgaaccgacacaaaagagaggggctgctaagacagaaaaccacaaaagggatgatatttgagaactgcaggctggaggaggtgtctctgagatggggctgcttgagctgaagcctaaattaaaaaaaaaaaaaaaaaagaatcaccaaatgaggaaagatgggagaagcccagacagagacagcaggaactaatgtacagaggccccgagtcaagaaacacctggcatgtcccataaaacaagaaaggactgtcagggctgccacatactcagcaaagggcaggaaggaatagatgaggttgaaaagacaggcacaagctacatcagttaaggctttctagtcataataagatgcctgcttgtttgtcttttaaccatatatccactataatggggcttcccgggtggcgctagtggtaaagaatcagcctgccagtgcaggaggcggaggagacttgggttcgattcctgggtcaggaagatcccctggagtaggaagcgacaacacactccagtattcgtgcctggaaaattccacggaccgaggagcctgctaggctatagtccacgggacctcaaagagtcagacacaactgagcatccattataacaatcggagtgtttggtgcatcatgaaatcaatgtattgatctaaattaacttcttctgtatttggcaagttgctctgttggaacttcagacacacaggctctttactgattaattcttaaatctgtattaaatgtagttctgttaaattctcaagtatctctgttcaggaaacctattgaaatgggtccaatgagaatctgctgtatcgcacagagaactcaactcagtgctcaatgggaaggaagtccaaaaaagaggggatatatagaaacatgcagctgactccctttgctatatggcagaaatacaacattataaaacaattatactccagtaataaagaaaagaaactggcctatttaactccttcctgcttcagcatgggtttggccgagaatgaaatgacaatgagtctgaaaatccttcatgcttttccacagcttgaagtgagtcgcaaggtgaaattaattgaggttggcaagactagaagttggacatagcctcttagttccaggggcatgaagccttcccagtttggcttcctaatttggtttgaaataaattacatcgccatattcaaaggtaagtgcatacgtatattccaaagccaaataaaaaatgtcttttggactatctgccaccttctattaccaatgatatagctcccttcgtttaatgcctgtgatcaagaattaacattccacctccagtacaaatgaatgggaaaggcaacagacaggaaagcctttcgaaatagcctgaaacagaagcaatttgtctatatctacttcgttgggtaaaaggactttcacctattaagagaacaaggtaatctagtttgaggtcttgaaagagagaccaaatggaaggttctctttcttcataattgttcacatttaatggcattacaagggcacgttagctcttccaactgaaagcaatttagtgaatacgtatgcatttcggtggcactgatacgttaatgcagggcatgaaacagaaacctttagagaaccgaatgctaaagagggcaccaaggggctttgttcaccaactcacctggagctgggctccagagaagaataacctggaatacgttctcccctcctgcaacctataggctgtgggagcagggggtacagggagatggagatgggaagaagaccagctgagatctctgtggtctgaagccgccacagaaggcggccgacctcaccacccagaatttaacccgtcttcaacctcaacctgtgacttcacagtcctgaaaaagtgtcaaatgcacagcaagccttcctgatgaaccccatccagatcggtcgctccacttgagttccatctacgtgtgcacatgttgctgtgttgcttcaaagaacacaatttaccaatacattgttccagatcatttcatatgagtatttttgtgttcatctgagaaatcaggtgcctggaacttttccctctcatttgggaattcaggtataaagtcaattttctataattgtttgtggcgttattcccagaagggggaactgttggatgacatttccatcagagatgaaaagtgaccagccattttgtttaaacattgtttggtcactggaattccaattcagttggtataatctgtattgattcctcccatatgttccttcatcagttcccagtatctccacttccttctcctgcccctttatcagtaggctctagacacacagacatctgcccggaggcaatcaattctgctgccaatatggaattttacacacagacaaaagtaaaagcaaaagtctaaaagagatgggttaaaaagaaaatagaaaaagatagattctgactcatttccttaaggctcttgggcctgctttctattacatttgtggactaatttctcccagtctgtagacaggacatgtggttatttattttcacggcagactgggcatcttttcatatgaaaccaatgacctgcctgcagagaaaaccacagccctttcaacagtcctctcttatattcttacctcttccccaaaatctcaggagaaaagatgctaagactttgaaccagaaaaacagtattgctgatgataaagatacatgagggtgatgctaggccttacctggagcagactccaagccttagaagatcatgaaaagctggctgtgattttagcgtctattcatttcaccacaggaaaaaacaggaaacgtgtgcaaccagaagaagaatagataatatcggctcgtctcctcgttttccttcccacccttctggtgccaccgtgaactccatctcctcagtaagggctcctgtggcaaccccagggctgggaagccttcactcttgaggacacctggagctgtctgtctggagcatgctcctggtgtgccaggtcttaccaccagactgtgtagttcgagggagagagtcagactctcattcagagagtcagactctcatttttactcccagagttgccaaaatagcatcagtaaattttttttttttcaataaatactgatccacctaagaactttcaaagaaccagatctttgtttctcattttgtgagatgtctcaaagaactaaatagaaatgattacataagaattaatggatactgtctctaggccagtaaacagttagaatttgggtcaagtggaggttgagagctagggagtgaaatagcaaagagaatgaagaaatccatcctggttttcccccttccaacttctggacattgtcctacactaaggctgacccccaaatccctatcaaagcaaaagctttctttctcctctaagagaatagatggtccttaggtacgacttcagtgtaggcagtggagggtgaggatggtggtggaagaagggggtagagattgaatcctgggagctgtcagagtagatggcagctaggagattcttacagtccaacttccacagttaacagatgggaaaaatgagattcagagaggaatatatgactgactctaagttatagagctgaacctgggcaaaatagggattagtatacctattttctgatcctttggtcctatattttgaactaagtcaatcaactatatccctttaattaaaatggcattaatactggaagtgaacatctagaattcatcgattaaaagctggagactcactgagtttttaaagctacctacaacctatttatgagagagaacgatacagagtgacctatcaataacctctgatatgcagatgacacca

SEQ ID NO: 44261 - DNA, 1208 bp, Bovine  19866881163560
cctgtgtttcttttagtggaaaatatattaaggggccacaatctgaatgtataaaagatttaaatccagaatcccaaatgtctacttctattattaatatatgtatttgttaatggaatataattaactatctttgatagctcaaggcatgaagctaggaggagggaagccagctaagtttgaggccattggctccttcactcttcaatggaaggaggagtgaaagaggaggaagacatctcttcattttcttcctcctcttcctcccatcctccctgctctgtcttcctcttactgcagctctccaagcatcatgagaagccaaacgtttcgtttttctaaatggaaaatcaccgttggtctgtcagatctagctgggggttgaaatggagttggatgtggagaattgattaaaggaccaccaaaagaaagactacatttttcctttttagaaacaaaacattcttccctatatttctctctctccattttttgggagattatggatagtattctcttgtgattgataccaaagagggaatgcaaaagtctagtttcacgtatgagatagcagagacttgtggagctgatgagctatagccctgggtgttctccagaccccagggaacaggagatggaagccatagtagtagttctccatttagacctggagctggagctggggtttccagtggatccagaataacctggggctctaacagccctctgctctttgagtgtgtctgcatcggagcagctgtacaacccgctggcatgtcgtcacccctcgggtcaggagcggtgtttgaaactggatggaaatagttacctctttgcgcttcctggaatcgcttttgttgttattctttcaggggaagaccgtaacagcatttctgaatgttgggtggttgtttcctttgctgttacctgatatttcttagttgatacatttttttttcccagcctgcttttccaccaaacttattgttcagggggagacacaattgaaatcaattgctaattaaatttgtgtctaaattaataaatcacaactattcaggtcatttctgtctgaataattcctattatggtgaacataattggtagattcagcatttaatgaaccatattggtagggaaaatttttatgacaattgggactaatagaatatattaaccctttattcttctcagcttgatactacatt

SEQ ID NO: 44262 - DNA, 1813 bp, Bovine  19866881173773
gaagttaggattattcttttattgtaagtggtactgaaatatcccttctgtattcattgatcttttttgcactttttattatggtgaacagatgaagttttccacatcacaagtgttcaaatatttaaaagacattttcttctgtaaatcatctcttttctaggcttaaccaatctcagttctaataattattggttatgggatagagtttcttaattcttcaccattattagcaattctggttgaccttaaatttgccagtctctcttaacatacatagtatatatttaaaaagtagcattaaagaactgtagtcttatgatgagagaaaatgacttatgttccctctctccccaagtttatctattgttttttagtctttttcttctaaattgctcttgagccttctggggcaaatataaggctgtgattgattgttggttcagttatgcatttgttacaaagttgcattatagctgtacagttctgaattgaattgttgctctggaaactgtatcagctcattaatttttcttttttaaaatcttgtttccagtgttatcatgatttatttacttgggacttttttcttgctttttctttttgatttctttcattttttattttattttttactttatattacagacaaacagaaacttcctcgtttcatctttccattctctgatttatgataaatttagttcctttggcccggcatttgcttcagcaggcagtcttccttcaagtacctccctgattgatgtgtaatctttgatatcttccattagcctccaggatcactaagttcaaggcccccttggaacctaaggagccctgccgaggagctgaaggccttcagagtccttggggtgattgacaaggtaattcttcagtgtctcttcaagagttcagtaataaatcgactgcatgctgacattatgtctttgaagctttggatcttaaggatatgaaacaaaaggagaaaatgactcaaatgcatctgcactttaaaataacaaaagcagaaaagaaaaagcttttatctaagcaattcgtgtaaggtcatgcaaaatatgttatgttaaaggagaaggtgcttatttgttggcattcagtctagtaaagagtttgattttataaacctgttatagcagtaaagatactgtgtgttagttacaaaaactagtgagtcagtagttgttcagcattaactggtatagtcagtctagtggttaaaaagaatggtgctctcctaataaatactgtttcttgagtacctactatgtatcaggactgtgtattaggcattttatgtaatataaacaacataatacaatgttttatgtacgtttacagtataaacagcataatcctttttcagccctgttatttgcatcttggtggaaaagtgatgtttagaacagtttaaataacttgccctcagagtcacatagaactatttgaggtagtactggaattcaaaccaggatcattgtaacaccaagagctgtgtttttttccctgtacactaaatccccttttacacactcatatttttatatttgaaatccaagtactgcgatagcatcagatatctcagatatgccagacaacagtgctggggcgtcagaaagcttttgagtaattgtaaaatcatacccactaagccagttttaaatatttttggtcaaccaccactattttaatacctttaaaagtgaaagaaaatgccttaatattagatataaattaatttaatctttttaatgtcagtcaatcctttatgaagcaccttagtgtttatttataa

SEQ ID NO: 44263 - DNA, 1708 bp, Bovine  19866881248275
ctttgagaagcctgagcatcacagcaaagaggagcccccactcgccacagctagagaaagccagcaacgcagcaacgaagactcagagcagccgaagacaaatagatgaatgtttttttaaataaataaaatctaaactgaattttgaagacagtatgagaagaaagactgtaaaatatctcattagcagttttatattaattatgtattacagtattttgtatatattaaattaaatattagaattctgatagcagtcctcactaatgggtctgagactgcaatttgacaggagttggataatttgagggaacaagtcagaatctgatcaaacgataagacttatcctccctgttgacaaagaagaagaatcctaagagactctaagtaattaaaaatttcctgcagggccctcatacgtcatggtcctatagctgttggttcccaattcttgataaaacccgaatttcccatccaatgcctgttaaaccacagatctgttccttttcattcctctacttcctcccatcttactgatgctctggtcaatctccttctatacctgctgactggttttactgtctgaccactttgtcctctcgtggacaaagaatgcaaggggataatgaacaattgaaaaccattgttgtgttagggtagtgagactattaagactttttttctaaggcaattatattatcttagcagtaattacatctcctaatggaaaagggtaggcatgtattactctgttcttacttcccctggtggctcagattgtaaagaatctacctgcaatgtgggagacccgggttcaatcccaaagaagggaatggctacccactccaggattcttgcctggagaattccatggacagaggagcctggtgggttacagtccatggggttaccaagagtcagacatgactgagcgactaacacactcagaattataaccactctaagaaaagatttccaagaacaatgtaagaattctgttttccccaaagttactcaaggtaagtcttgagtcatctagaatattgatttttttttaactttttctttacttaaaaaaaaaaaaaatagcctgtttcttcagtggaaacatgaatatttggtttagaaatgaccagtgtctcaaaaagctttgatttcttgccacctactcttctccaaaatgccaaattaatggcatctgatcctaaccaagtaaggcatccacagctaaaaatgtctttataatgggggtagggagagtgggggggaaagcaagggtgatttttttcccaatatgtttgtcattattataggttatatatacagaaggaaagttaattaagctttaaaaaaaaatccatcacacatcaatggctgcattttaatgagtacaaaaagttgaggtgtttactaccaattaaagtggtttttaaataagcattaattaacacagaaattcagaagaaagttataccttgtcaaagaaaggccagtgcaggctatgcccacttgtgctcccattcatattcagatagtaattaccaccaaccctatattttccataataatgaggagatgctgtcatgtctatcaaacaacaacacacacaaaagtgggagaattagaaattctcaacctgaagtaaacttttcaaattttttccttctgggtttttccctcatctgtgtcaaagttattcaaagaggag

SEQ ID NO: 44264 - DNA, 1743 bp, Bovine  19866881310769
aaaaatagcctcttcgaaggtttcgggagactgcaactctttgaggtataactaaaataactggaaaagagactcaatgccaaagagaaagagccttatgattcactccagagaagagcaggttgagggtggagtagtttgtttagttctgtggaagattctcaggcaggggagacttgccagcgctcctctgcctctggtggggagagaacaagaggaaatgagtttgaaggacagcatgtggaaccgaaaataaacatgaactgctgaccatcagcggaattaggtcctggaacactgagggtgggtagagactcttcattaaaaacaaaagaaatctatcaggtatactttgtctaaacaggaatcagaaaggatctagaacaatcttgccaaggtccttcaatgctatcagcagttcttattgagtaaagggattatgggcaaattgattacaataaattattttaattattaattaaatatataatagtttgttattgattatcagtgagtattgccattgttattttctaatattctatgataattgtttcatttttgtaatgagataagaatttttattaaaattttattaaaattctgatcttctgtgacttaaatatttatagctcaatttttaataaaaactggaattgcttggtgtgtgaaattgcacacacaggaaatataaaacttcagttacttttatgtaggtaagtgtctgaaacttgcctggaacttcctatttactaaatactatatactaaataacatagtagatactttttaaagttcttttgtattatacagtttcctgaaacttccactttgcctgaaaaagtgaaaggttttttttccttccagttttcttgaagtataattgaaatacagcactgtataagtttaaggtgtaagaagtaaatgtttgaaacttagtggagagttgtccatttccatgcataagaaaatgcatcaggattttaaaaatacacttctcagctgttttgctactgtggggatatttcatgtgtcactgatgcagaaatcactttgtagcacgagtttatcagtattctgaataattcatccttccaatcttgtgtaggagatatttctgctcaacgaattggaagtttttctaatgtaccacttttgatgaatttggttgttcaagatggaattttaacaaatgttcactatgtgagctagaatgttactgcaggagaggcacatcgcctaccagccaagacacaggcataaagaaacgaccagacagtcctggtctgaatcactaacgggagagcccgtcactcgtttcccagatgcgtgcagttcgataccaagccacccatcatctgacacgtgttagagcacgatggaagagggccatcacttccacttggaatgattaagaacgtctccacagaggatgcatttgagccacatttcatttatttatttatttatgactgtgctgggtctttgctgtgcctgggttttctctagttgcgatatgcaagttgctcattgcagtgacttcgcctgttgcagagcaccagctctaggcttgcgggcttagctgccccacagcatgtgggatcttcttggaccagggatcgaacccatatcccttacattggcgggtggactcaaccattgggtcaccaggaaagtccctgagccacactttaaatgtaagtaggatttggtgacaaagtacattccaggcagaagcaatgg

SEQ ID NO: 44265 - DNA, 1099 bp, Bovine  19866881360864
aactcaagagctcttctgcacaacgaagattagcacgatgtgagcatttccatgccaaggtgctaacgcaaataatacacgcgaggtttgccaacttttcaaattgaatgtatttgattatttgcttttaattagtgtgagttttggagtatgtacaggattgtcagggatacacgcaaagcctcctacagcccatgaagcctcccctcggtaaagacgggccgggattgttctttttgagctgtggagaatgagatttaacagctctgttaaatgttttagcccatttccattgtgcctctgtttcaacctattggcaagaccaattgaagtgagaaaataaacctcttatctgatctgaatgctgagcgcagcccctaagaagaattttccagctcaacttcggctttccacgaacatccctgttttgtgctgtgctttctttttcttcctagaattggctattaagctgactttttctcttctccctttcttgtatgaacatttcaggaaacatctatacacatggggggaaagaaagtgggcatggagaggggagacggagagaagaaatgtgtttgtataactttagaagtgtttcgagggctctttctatctgctggagacgtgagaggatcctgggtttggtgtctctccagacagcaggcgaggctcgaggccctgggaggctgcagagaggctggtctcaccaggccaggagggagggagttggatttgagcctctgagccctgtgctgccatctgcaccttgggggacagtgctctcctggctggtgtaccacctacggcatcttttattccggcgttattttacccaagatctcagctgcccccgacaaccctgacccacttcccatgggagttttgcaggcaatggtcctttacaaaaagccaaacaaatccttctttagtcaccaacttcaagaagcagaataaggtgcagaagtcagggaagcagctctttcccatctctttatatttgctaaagaggagaagaatgtgatatgaggcttgtttcatccgcagtgctttttttttctccccagccgcctcaggccaggcactcagttagcctctg

SEQ ID NO: 44266 - DNA, 1192 bp, Bovine  19866881651664
aacacggtccagttgcctgagcgagagccttcagtagccccagcagtaagggtgcccctgctgttgggcaagggcagcaccagttcagcctccagtagacaaatgaagagactggttttcaacaaggaaagcaggctttgtggtgcagtcaggccaggaagaaggagtgggaggaagggtagggagtctcactgtggcagatgtcttggctgggagagaaagttctagagactgcgatgagggttggggaacagggggcttgggctcaattcagaacagcccagcttccttccagacgggaaaccagagtagcatccagagggatcccgggagatcccggcgtgccaggccggcagccgagccacggtggggcccgggtggggagaccgcaggctggcccggtcttggaagcgcggtcggttcacctgagagggctggaaaaccctcacccctggggaggaaaaagaagatgggatttctcctggggtcggaacaggaccctgccggctggagacaatggctccaggagcctccacaactccacccctgttgcggagggaactcaacaccctggagatcggcgtgtgaaatctgcgctggggaagagagtcctcatttagcagagaaagcgctgcgctatctatgtgtgaaagcttttttaacactgttccctgctctccatatggcgaacttcacccaaattaggaagaactgatgaacaaaactccagcaacttgaaaatgagagtgagcgagttccagatgcccatcccagaggcagccacagccggtgccccgggcggggctgcagggcagagggtccctgcacccctgccacctagccccatccccaagtgtacccgagtccccggggctgtgtgtgccctctctgtggatgaatcatcgtcacccgtaactaaaatcatcaccacaatatgtgtgtgtgtgtgtgtgtgttagtctcggtggtgtctgactcttggcaatcccatggactgccaggcttctctgtccatggggattctccaggcaagaatactggagtgaattgctatgccctcctccggggaatcttccgaatccaggaatcgaacccaggtctcctgcattgcagacggattctttaccagctgagccaccagggaagctcagaaatgcccatatggtagtcactcagtcgtttccaactgttt

SEQ ID NO: 44267 - DNA, 910 bp, Bovine  19866881657673
tggaccatgagacttactggactctgcatgtagcagataggggaggggaggccatgattctagctagggaggccagcagtaggatttggaatacccaaagaaaagtgatgaatgaagattcattcaggacagacatcagaatcaaaaacatctgcttgccaaacaggtggtatttttatgcatcttggaaggttcatccagaatgaatgaggacacagccaggggctggggcacaggagacagggtccaacctccatggctaaacagggagctgggcactgcaagcaaagaagaccaaggcagaaggccaacaagaaggcatcttgtcaggaggggcataacatgcaaggttttgagcacaaaactaattccaaataccatgtactggcaagaatggggcacctattctgtattcagactcgcttctctttgaccatggatttgctgatggcagatgcttggtagggctaaagcagctgggtaggaggagttgtaagggacccactgtgaggagacttctatcatcaagtagcagatagtctcggagaaggcgatggcaccccactctagtactcttgcctggaaaatcccatggacggaggagcctggtgggctgcagtccatggggtcactaagagttggatacgactgagtgacttcactttcacttttcgctttcatgcattggagaaggaaatggcaacccactccagtgttcttgcctggagaatcccagggacgggggagcctggtgggcttccatctgtggggtcacacagagtcagacacgactgaagtgacttagcagcagtagcagcagcagcagatagtctcacagacttagattgtttattagagattattttgttcagtgcattttggactttggggtgagacccacttgtcacaa

SEQ ID NO: 44268 - DNA, 1578 bp, Bovine  19866881669116
ttacctgctttataagacctactttgtagatcgtttctttaagtgggtgtgaatctctttagctcaaaaaagtttatcaatatattttgggggtcttttatttcctctctagctcctgtagggagagaaaaagtttcaaagcaccctaaggagaatttaggatagagctcagggaggacttccttgcagaaggaggttgtagcgtgtttcctttaaaataatagcaataattttaaaaggggggtgggatggggaaggtggtcctgttctgggaggcctgagggagagttgaatgacttctcaaggtttgatccagctctaagattctttgatgtgattgcctgtcccttctagctgtctgtttttgatccaaggctttgcctgctggagccctgagctctgagtgagaaactcccagctcgataccaccctcggcagcccagggccttgcaccagctggctgacctgcgtgtgctccctaggaactccagaccagactaatgggctgctctgatttgctctgactgttgggttccagggaaggcccatggcatgtgcagctgatgagacccttccagggacctgctgcctccatgagttaactcattagaggggcttcccgggcattctctcacactgagcagagtctgcctttcacctcctcctgtttcatatttcactggttatgcatggttgaccggataactcacttctgcaaccaatcagctcgtcagagtccagcctaattactgagtcctcaggtgtgacttaggttaagtaggagtcacattaatccctcgttgaataccaagttaacggcaagtggagtcctctagatgtatttggggaatctagatatatactaaatgatttggggaataggatgattttaatttaatatctgtatatccactgcaagaaacaattggatcaagaacttctttgcagggtttgtatgttttaatgccatcgagtcctgcataggctgagacccatgtgaatccccatatacataaacatgaaaatgcttataagattcttggatttcttcttttttcccagtgtttatagcagctttgttcttaattgattcttgtctttcttctgaaccacattcctgttttgtgacttttcaccttttgtgaacagttagctcttacttgatgagatatttttataacagtacgtgtgctttccgaaaccattttacaaatagcttttctttgtgtgtgtgtgtattacatagaatatatatattataattatataaattacatatattctatgtagagaacttatcaacttattattgatatattatatattattgatatattattatgttattgatattgatattattgatattactattgatattgatatataatatataattattgatatataatatcaatattgatatataatatcaatattgatacataatacataattattatatacaataattacatttatttaaatatattatatatattctgaatatagaatatattatgtagatgatatatattataatatatgtatatatatcatctacataataattaatat

SEQ ID NO: 44269 - DNA, 833 bp, Bovine  19866881714093
attcaatgcagtgtattaattatcttcagttctcttcatgataaatatacctgactgaatcgctctcctaattaccgggtaatagagtcataagtggattcccttaggtaacccagggaaggcatcgagttgtgggcaagaggaggccctccacttttccaggtacttccccaagcttagctccagtacttcacccaccttgcaccattcctctgagtacagcaaaacccacttgttagactcaccagaactcccagcctcgggcacctcaggccctaatccatccttccctcttcttcaccaggcagaccaactgttctagaagctccgagagtgctcagacacatgagttagagatatatttcaatctattgaacgactcttctgaatactgagtgttacctgtcaaggaagggccctctggggcaattaattcattcatcatcttatcatctcaagtcactcagtcgtgtccgactctttgcgaccccgtggactgcagcccaccaggcttctccatccatgggattctccaggcaagaatactggagtgggttaccatttccttctccaggggatcttcctgacccagggatcgaacccaggtctcccgcattggaggcacctccatattaattcagtatttaattgcattcagttaaaaatagacaagaattgaaacttgtaccactgggttggccaaaaatgtttgctagggttttgctgtaaactgttaaggaaaactccaaatgaacttttggcccaccaaatataacaaccaggaaaatacatatcgaaagatctggggcagtcgcagtagactgatgcttgag

SEQ ID NO: 44270 - DNA, 958 bp, Bovine  19866881864870
ttatttaaataaacatcattcatggcaaatgggttcctttcataccatagaaacccagaacagagttcaggaaaagaaagagtgaagaaatagtccccaaagtgggaatagattttatagcatgacagtataaatatagcactatctagtgcccatctgaggagagttttagatattaagagatgtctagacagattctcctatttttttaaacttatttatttttaattgaaggatgattgccttacagtattgtgttggtttctgccatacatcagtctcctgttttttgttactagagattttaggataatctggagtattatagaaaaactggagttaactagttactcttctccagagggcttccttatagttactcattttgtttctgtttgtatatacacacctacaaacacagatttatgtaaaagattttatgtgctttatcactggagctattagcttatcataatatagaataaaatttttgttacactattttaaatatagaggaaaaataaaatgtcaaaaaagtatttttttcttttaccagtatttttttcttagtggtctcgtcttttatcataaaaaggcagctacaaaatagtccttagaatattaagcacataaaaacacaaaagactggatttgaaagtttaatatgcaattaagacaagtgagtaaaatttgtttaatgtgtcgtttttctgctaacatgatcacttaagtttcccactccagtgttagcaacttgatatggtatcctgtcagtgtgttcttcacctttattttccagcctattatgagcctttataaacgcttgagatttacattgatatttctcattgaacacttttcacacttgagaatttataggtgaatgtgtgtgtaaattgaagaagtcccgaagtgctttttaccgcagcccaatctccacgctcccagatgtcaaatg

SEQ ID NO: 44271 - DNA, 980 bp, Bovine  19866881885566
tgctgcaaggggtaggtcacaagataatttagtactctgtgtccccatgtgctcactgatttgtgattttaaccactgaaacgtcagcttcttatcactgcttccacccctctgagaagaggagcaaagcctacttgtatttttatcagcagcactgccattcagttttgaaagaaacagtaaatcacaaatttttgctccttacaaatgcaattccccttcattataagcaatgggcaggagtacacaaacttaactttgagttctgcaactctaggcttcaaatcatctgaactagaataccagcattacttttcaattaaggccattactgatctgagttttatcctattgacaaattaataggtccaaggaatgaagagacttctcacattgttcaatatatgcctcaacactataacactttggtaactcataaagcctgcagttcttttatataaataattaaaacaaagcccttcttcagacgacagcttttttcaaatgttagtgaaggacaacctagaccatgacagcaaaaatccattaatggtagactgccacctgctggtgaactttgggaactgcgatttctgggaaaaggcttaaaaattagaacttggaaactgatctgaattaaattcagtacacaaaactgtattcagctgcgtacagagcccaaagtatgtacctgctgatgaacgtcatatggctttgttccacatgtattagaattctcagggggtcaacatgctatggatgttaaacatgtctgtattttgaagaaaaataatctgctagaaagccaaagtacaacccttcagatagttttcaacaagaaagtgagaagaaaaataggaaataaagagtcagttataaacattaaactactttacaaacatctgcttttgatgtgagatttatactacacttaaggacttaacaggttttacttaaaaaagaaaaacaactcccagatt

SEQ ID NO: 44272 - DNA, 1287 bp, Bovine  19866881931480
aatgtgcatcctcggagtgaactgcctgtaaactggactttagggattatgatatgtcagtgtaggttcatctttgtaacaaatataccattctggtacatctaagttgagagtgtaggtgagggtgggtaaggggcacatgggaacaactgtactttctgctcagttttactgtaaatctataactgctctacaaaataaagtctctttttaaaaaattcaggtgaggtgatgacactcttctgtatgtagagttcagtccatcctggggacacagagacttggactggcgtctgagccccaccacgatcagctctgcaactttgggaaagtccttaacccctctgacctcagtttctctaactccacaggattgtgttgtcttcctcagagcatttggaagattaaaaaaccatatgtaaaatgtctaacagtacttagattatacaactaaatatatacaaacccctccccaattcctcatttaatgactctgattattaaacatcctgatggctactaatttcaaagtcaggccagtggaggaaagtcatctggggtgaaagtgaccttctcccaggaagtgcacctgtgtatgggactggacatgtgtgtgctcacatgctcggtcacagatgctgaccacagagtgccaggcatggacttgagccccgagaggcagcctcaagcccctcactcagctttctcctgtgaaaaggtcaggatgatggaagtctgtcatatttagctgatggctcgcagagaaggctcgatgagttagtcacctatgatacgacatcatattgccactcaatatagtaacagctgttggttgctttggggggcagggggcggagtcagctcttctctaccaaccatgcctcaaggataaattggatggcaccagaaggggagacatgtcgaggagaaatcctcctctaaacagggtgttccacagctccctaaggattttcggcacccacctcaaaatgtgagtcttgacttttctttgtctttggggccaagcaggggaaatgccatagcagaaaggtgcttggtcaggaaacctctagctagggggacatacccagcatggccaaggtcagcctcaccctggagaggagtggaaaagtgagttccatgcaccagccctgtgatacctctacgtcacccaaaggagtggtccaagggtaggtgatcagaaggcctagagtgagggtgctgaggaatccctaggttggattgggcattttacccctcataggttacataactacagggggtcaa

SEQ ID NO: 44273 - DNA, 2972 bp, Bovine  19866880183684
ttgtctctgctttttaatatgctatctgggttggtcataactttctttccagaagtaagcgtcttttaatttcattgctgcaatcaccatctgcagtgattttggagcccccaaaaataaagtctgacactgtttccactgtttccccatttatctgccataaagtgatgggactggatgccatgatcttcgttttctgaatgttgagctttaaaccaactttttcactttcctcttttactttcatcaagaggctctttagttcttcttcactttctgccatgaggatggtgtcaatctgcatatctgaggttattgatatttctcccggcaatcttgattccagcttgtgcttcttccagcccagcgtttctcatgatgtactctgcatagaagttaaataagcagggtgacaatatacagccttgacgtactccttttcctatttggaaccagtctgttgttccatgtccagttctaactgttgcttcctgacctgcgtacaggtttctcaagaggcaggtcaggtggtctggtattcccatctcttgaagaattttccacagtttattgtgatacacagagtcaaaggctttggcatagtcaataaggcagaaatagatgtttttctggaactctcttgcttcttccatgatccatcggatgttggcaatttgatctctggttcctctgccttttctaaaacctctgccttttctaacatactctcctctgtaagaataagaagacttgtgtttatatttataagtttattttttagaaggtatacaccatcagtgcaatggacatgagtttgagcaaaccccaggagagagtgaaggatgggaagcctggcatgctacagtccattgggttgcaaagaatcggacatgacttagcaactgaacaacagtacaacaaaagataacgtataaagcagaggagtgactcagaaatattcatcagagtgatctcatttggcagtaagatgttgagagaagcaaaaggccaagccagtgagaaagcatggaaagcagtaaaagtcgtgaatgaaccacatgcattgtatgcatagcagggtattcttaacaattcgatttccacacattctaagcactaacagaaagtatctagttgaagaaaggccaacccaacccaatactttgagccagagtgttctggtttttcacagttgtgacatttttttgaaataccagcacaaaatttatgtatttgcatatgtatacaagatcctcattaggtttcttgtcatgttatcatcagaagtctgtaaggaacaaagcagtcttttaatcacttttctgtaccatatagttggaatgccctcactttggggccttccatgaacctctctaagcctattcagtccttgacctgaaagtgaagctatagtggtcagcctgcatgccattctccctctttcttttacaaagctgtcatctgcccctttgacctccttttccccataccctataagtctggtgtttctttgtttgaagcagaatgaagaaggtttgatttgaatttggggaataataacaaaagaggaaaacaatcagctgccctgagtgtgttttcactgtgtgtaactgttttcacccagagtgtgttgccctccttgggcagagtcatgactatatagaactagcgctcatcacagcaaacttgacaaagcgtgtgtcactgaggccccgcagaaaagtgcttccataggactccacccttcctttcacagaagttaacagaatggagaggtttttgtaccaagaagaactgtgccatgttgcaggtgcctcagaagcgtcggaggggtccctaggggaagttgtcatggagcatgggagactgagatagcatttcagagaatcctgaagtgaagcttcattggaatctcagtgtctgtgcaggggaaggagattgctgggggcagagtaaagcctagaggcgggaaccagagctcattccggaacctaagagcaggttatggaggggctcatgatacagaggaggcccggaggaaacaggggaagacgccagaatgaactgcagagagagccattctttgagattcacctatcatcttaaggagttgtttgctttttgcttaaggcagtggggagtcatcagatttagtgtttttttaatctgtgggatggggataatgaccttggcattactgagatcttaagggtaatagtatagcaaattgtcatgccttaataaacatttcatcttttttttctgtcagataaattactggaatatattattcacagagcactatacttattatcttgtaatagcctacaatgaaaaaaatctgaaaaagaatatagatatgtatgtatatccctttactgtacacctgaaactcatacagcattgtaaatcaactatagttcatttttaaaaagagagaaatagtgccttttaaaaggaatatattctaaatctaatctaactagaaagcatattagggtatgatcataatttttaaaaatatattgtatgaatgttcaggctgtcctaattcattataggggctgtattaattctctggactttcccaagccgtagttttccacatgtaaaatttcttttccagactgataaattgaatttagtaatccatagatcaaaatgctacagcccataaagaagctttagagatggaagaaacaaaattagatttaatagaaacatttatttctaacagactccagagatagaatagtagtgagtctccagtgagcttccagattaacaatggtagagaacaattaaaggaaagaattgtactaatgtgacttcttttagaactacctaacagtaagattgagagaaggcagtggcaacccactccagtactcttgcctggaaaatcccatggacagaggagcctggtaggctgcaatccatggggtcgctaagagtcggacacgactgagcga

SEQ ID NO: 44274 - DNA, 1689 bp, Bovine  19866880367541
cgtgtccgactctgtgtgaccccatggacggcagcccaccaggctcccccgtccctgggattctccaggcaagaacactggagtgggttgccatttccttctccaatgaatgaaagtgagaagtgaaagtgaagtcgctcagtcgtgtccaactcttagcgaccccatggaccgcagcccaccaggctcctccatccatgggattttccaagcaagagtactggagtggggtgccattgcctccagtttttaaaaaaaaaaaattaagaggtggaaaaaaagttctggataatccacgaaacagaaaagtacctccaggtaaacaggtctgtttaggaaaatctggtacagtgaagggcagctctctcttttgaaggccacctgtagacagtgttctagaattatacgtattttagggtttcacatttttctaaagtgagaatgatgctaacaggttaactttttttaaaagatgaggaaaatatacttttgacttcggaatgttgttgttaccaacaatttgtacttttcggtttccaggtgctatttcttcatatatttcagaaattccaaaatatcaggtgacagctgtcttagcgctaaggcattcctcaagtgtcctacttaagtgtcgttctgtactatttctctctcggcagagctgtatcatcactcagaagccttgtttatgcatatcgctgcattgctgtcttcacttctacatccccattacttttccaaatggatactagttctcccaaaactagaggaaaaaggagagaattccagcaacatctcaaactgaatcaatgttttctccttgactagaaagttcctttgtgaacaggaaaaatacatgagttagaagaatgtctcccctctcagcccttcttctcttgacaatgttgttttaatctagtcttgtttttcctttctaatgacacatcttacaaagacatgttatatcagcaaaaagttgattcctttttcagctcaaatcttggcttagtaacttttgtctttaatagccagttatacaagtataagcacaccatttttagctcacttccacagatatttactgagtgcctgcaatataccatgcaaaactcagactgtagtaggagagacactcatcacaattataattttgatgggctgtgcattgtaatatagggcttaacataatgctgtctgagtctactcaaactgcaggtcagggaagctgcacggggcggaggtggggtggaaatatttgaaccgaacgccctgggggaggaggagtgggtttctgccaggggcagggttaagaaggagagcattctccacagaggacacagtgtgagcgcaggcaggctggcaggagagcacgcgatgggctcagcagagtcgagctgctcccaagtccggagaacaggggtgtggtgtccagccttgtcttaggtaaagtggaatctttatttgggtccaaaatgttaagagccttgatgcgttgatgccagacgttataaccacacagacagtggggaaccaccagaggcattttagcagaaaattacggtcagagaggtatagtgggaaaccttcaggatttggatccggaagagctctgtgtgggactctgggatgtttctcctgaaaagaagctcagtgctcatctaattttagcctcatgttttattcatgaaa

SEQ ID NO: 44275 - DNA, 1617 bp, Bovine  19866880393794
ctctcttgttttaaatattctgattctttctcaatgggggtgggggtgaggtggatgtgtgcattctcagtcatgtccaactctttgagtcccaggggcctctagcccaccgggctcttctgttctccccagcaagaatactggaatgggttgccatttccttctccagggtatcttcccaatccaaggatcgaacctgcatctcctgcattggcaggtggattctttaccactgagtcacctaggaagctggggtgggttgggtggcagcaaaattcttcataggtgaaggtatttgtgaaggatctttgccttcctgtagtgaaaatggacctcactattggttgtacgccctcctctggcccttccctcatctactacggtactttcaagttcgactgactgaagtgaatgtgataggggaacagcagtttttcaaagatggatgactttcccatgatctatccacattctctgagatgactaatgaagccagcctgctgctgctgctgctaagtcacttcagtcgtgtccgactctgtgcgaccccatagacagcaggccactgggctcctctgtccctgggattctccaggcaagaacactggagtgggttgccatttccttctccaaagcatgcatgcatgctaaggcacgtcagtcgaagccagcctaggcctggctaactgctgacatgatcacagtgaaaagatactctcaaaataaaacaaggaaaacttttttaatctttctttttgattttgagtatattctattcaacaacatgcctgacaacattcactgtttggcatttcggtggaagtggtaaagaaatgactcagaataaaaggcttcattcagcagcaatgcctcagccagctcttatttgcctgagacccgttaccataaatgaagaggaggaggttgacttgatcatctgtgatcagagtcttgctgaggtttgtttagcagtgatctgacgtcactagcgagtggcctttttcaaaggccatggttttgagccacactatttgagaactcctttttaaatgagtttctctctctctctctaaagtctacagccagctcctaattttaattttgttggcacagggtaaaatggtcaatggttctgacatactcaccatttcgagtgacctggtctacccgttcttcttactattgaaacaattgacttcagtttcattgatttaactagctcttcaagtgtcatgtagatacaactttttaaactagtaaagaagagtcattgtgtggccaataaaaacattggttaatctaaaaattatgtatatttaatcttgggatgtgtgtattacttacatttgaacacgggtgtgtctgatgtcctaagaattcatttcaaacaaaatattgacactctaggtttaaaaaatcttccagacttttcatttaaacccttactggttctccctttttctcatgtccaatctctgacttgggacaaagtagatcagatttttgggttagaggtttttcttttcttttctctttttttttgctttttacattaccataataattttgaaatctctgaaagaataaagaaattacatagcaaacacaactccttta

SEQ ID NO: 44276 - DNA, 1546 bp, Bovine  19866880412316
catgctgctgctgtgctgcttcagtcgtgtccaactctgtgagaccccattgatagcagccgaccaggctccctcgtccctgggattctccaggtaagacactggagtgggttgccattgccttctccgaattatctgtgttagtatctagaatttaactatgaaatagtaaattcaccctttcaagtactttatataacattcagtagccctgttaaaatttaaaataagattttgcaatttacaaaaactagtgtcaaaaataattagttgtttgacaaataaaataacacacaagctggcagcttaaaaatgagcatatgcacaggagatttaacacattaatcattcagaaaaagcaaaacaactacattcttatagtaaattaattttgcgataatcaacaaacatggaggagacattcattccttgcatttaaaagggatcatcctctaacaaacagtggggttttttaaattaccccttgaagctgatttgcttgaaggatctctgacactgagatagccaggcaaagagcctgactcagatctgcatcgtcatccttaattcccaacaaagtactgccaaacagatggtgattatcctgtgtgaagaggaacttttaaaactttatgaagaaaaaaaataaaatcaagcttccctcctaaaactattctcaacagaccagataaaaggtaaaataattatataacatctttgagtcatatgatttaacttattatatcaaatttctaggctaaaagctataaaaaggctacaaacaaaacccatgtttgagttcacacaaaatgatagcctaattaaaaaaataacacattctacacagctattttctatactatcacatacaaatagcaaatttttaaatgattactcacacttaatgctttaatattgaataaaaattaaaatatggcataaattatgtaatatgctgctaataaaacctgctctaattagcaattgctagtgcagtttatttactatgtctgaagaataaaaattattctcttaaaaggctgggaagaaaaggataaaagttctttttcatctagtatcataaccactaccttgccatctaacttagtcaacactgttgggaactgaggtaatctacataaggcaattattaaaataactgaaattagtcctgagaaacaaatttcttttataattagttttgagggaaatgttcttaaaaagtttccatcacctgcctcctggacacactatactgaacataatttaatctcatcttaatatttcagggacatgataacttccaactaacaatcatgatggtagaatgccttaaaaataaaaaaaaaacaataatgttctcatgagcacttgaggtcacaaatagtttataaatggtaattccatgctgcctccattactagctttagaaatctagagttttaggtttctagaagttcacagcacttggacttctaatctgatgtcatttctcttgaaagcacttgtctgatctgagaaaggttcaaggtctccagggagctta

SEQ ID NO: 44277 - DNA, 845 bp, Bovine  19866880564624
acatatttcatgggtgcacatccattaaccattgtaaagatgtagaactctccaagacatggatttagcaaaaccattttaccccactgggcattcattttcatacagtctaatgctttttagatgccagaaaagctgaggttcagcttattctaatataaagaaagtatactttcctggcatcatcttgcatactggtattctgaagactggaatagagaatgtttgagtcattgccatagctgatggtttttttccaatttcttctctagcatgtggtcattaatgtgctgtgataaaacatatggctctatagttcagcgtgctttcttgttattaaagacaccatggtgtttgagcatacctcaaattttacagtacgttatggtcccacccctacattccttcctggtttgctcttactatccatgtatattacattccagaaataacactaaattttccttttttccaccaaacatgcctcagtgcctttgtacccaccactctcctcctgaaaagccctttccctcctttgtgactgggcatttatgtcttattcttcaaaatttatttaaaatttatcacattatgtggaaactttcctgactctcatgggctaatttaatgaattgcttctttgggattgccctctctatatccttacagtagttttctagcttttctaactcagtagtacatcattggaacatatttaaactatcatatttccttaatgcagatacttatttaatgtgctatgtctaggaaaagcactgtatgtaacgtagacacaaattttaaatcaacaatactttattgttaaaagcaaatctacattacca

SEQ ID NO: 44278 - DNA, 1872 bp, Bovine  19866880624055
atgtgggccgagtcatgcctgaaagcacttgtatgctgttttctagtagaaagctgcacttgaatactgaagaacaaaacctgcccctggggcaattttacaaaataatacagacttggtatacaccatgctagtgaccagataattgattagttagggtttctgtggctttggatacatttccaggtaagagagatgttacagtgaatacaattatccatgtcccaagtggatggaaagctcaagattgccctgtttcaggttggaaagtagaagtgcttaagtgcagaccccctaaatgctcagagcgacagaattcaacaagattcctaccacctacaccaggttgattagtgtgtgtccccttctccctccattcatgttcactgaggacctgtaaatctgacttcatttggaaatatggtctttccagatataaataagatgaggtcatattggacacaggggggccctgatacaatcaatgactggtgttcttataagaagagggaattttggacacagacacacattgaaggaagacgaccatgtgatggcagaagcagattttggagttgccaccaccaccacccaaagaatgctaaggattgctggcaaccaggagattccacaagagtcaaggaaggattcttcccgcaagcctttgcagggaagaagcacagccctgctggcactttgatttctagcctccagaactgagagaacacattttctattgttataaaacacccagtttgtgataatgtgttatagcagccctaggaaactgaaaaattttttcaagctacttctggaatgaaaggcttgctgtggtggattatacaatgacttacaattatgccccaaactagagcaatatggagggtacaagataaaggcacaggaaacactctgccaacagagcatgaaaacccttgtttttggaaagaatggaaatgaggaataatgactagtaaccaaatagagagcaagagaacttccagttccaatggtgttatacatagcatttatcccagagttgaactaaatttaatttcatgtaagggaaactacacattacagattttaaagattctagtcatcttgtccttttccaacttagtttcctttctgtaaagaaaaaaccaagccctgaaaaataactacaagtcattttagttctttacatatctaaagaacaagattaaacactaagttatttataactttatcccacttcatatgcagaaagttttcctaatatacacttacatgattgttgaagggtggggtgcttttcatttgcctttgtaaaaattgaaagtatagttatttttaaatctggttatattagaaataaacatagtattgatttatctatgggtttgcagtgttactttttctttgcttttctatttcatgtctcagacctcttttctcatatcagctagtctaagccaagggaaaggaaggagaggcttcatttatctcacttagaggttcaattaataaaaccacaaaaataacacgaaccatgccattaaggcctatcgtccaactagatgtactcacccacattatcaccaccagctataattaccaccaccacacagatcttggaccaaaagcctctcttacaattttggtacatgtaaatgaatttcttttaaaaatgctgttcattaagaaatacccttcctaatgaacagcatttttaaaagaaatgtatcatatttgaatgatttctagactatgagtgtctgctcatgtaaaactccagggtagtacataactataacatatgtgtgccatactcagttacatatcaagaaagtttaaacacatccacctatttacatcatatgatcctgg

SEQ ID NO: 44279 - DNA, 1465 bp, Bovine  19866880633855
gctcttctcacaactttgtgacaaataccccatgattaactccctcttgaattaccaggtacagacattgggctcctgactgcaccatgaacgaggctgaaatgtaggtaaaggctacatttgctccaccatgagcaagccattagagcaagtcatttaactgactgaggatatttcctcatccatattatgagattaacagggacctcctcaaattgtcagggagcctaaagagttctatcacgactcccagcacaaatacaagcatccaataaatcttagctcttaagcctatgatttaaaaaccagggcactgcactctaaagtctccaatacagagaatccgatggaaacaaaaacatcatgattgtatgagtaaaacatccatttaaaagggtgtgtgggttgttggaaaagtcatggaatacaaattggagttgtttggacatactgtctatggagaagagcagattatctaggagaaaaagatgagactagggtgtattccagggaaagagtcaactgggagacataagttggctaaaagaccttaaggcgtgactgtggaacaagaagagtgggcagcaagtagttataaaagctgagggcacataaggatagcttctggctgtgggaaccgtccccacattaatgcagatccaaagtacgagggaagaatactcttcaagtgaaagaaaacagtgctgtttattcccttttgcaaatctacatggaacatgacatcagagctcgtctataacatatttggtgattgaaaatgggcaactacttcaaggagaaaatacttccaagcttaccctggtttataaagccaaatccaaagaaaatcttagtcatccaaagcttgctagatttagctatattcttaacctcctttcttttactgaaagtgctatatagggaagtatagtttattaaggtgacagacatgagacttgtgatataatggacccatttgtctaaggttgtgatgaaaaaacctaattttggtttttgctagttttagtaaatatgtttagagtgtgacatgagcatggaaaatagtagatgttcagttagtgcttgtcgaattaaatgtgtattaaatacaaatattggcaacatgaaagacacattttccaaaatttgacaagataatcacacagaaatagcacaccatgaaataatgaatgtgaagtataacatgtgatacaagtataagattgttattctaaaagtaccttgtgaatcatttcaggagttgttggtattaaatcatgagtcaagttttaatcttgtaatgaagacagtgtccattatttgtacctctgattttatcttactaagtcatggaacaatgtagggggcctggaaaacataaatccaaagcagacttgaatctgcttttgatgatactgtatttgggtggaatgcaaataacccaggttagtagtattgagacaga

SEQ ID NO: 44280 - DNA, 1047 bp, Bovine  19866880716141
tgatttagcagcagcagcagcagcaatgatatgttgaaagaatttatacagtaatgtttaaggggaagaatgaacactggtttcattcttgtagagctatttcaggaggtacataatgaccagaggagatatgattcaatattcattattcttactctggagtcaatagtattaataacaaaggtcaggtatcatgtgaggggaatgcattttgcagaagaagtctgatctaggatgataggtcagttggtcaccttcacatctgtgcagaagtcattcatggtctgcttttcatctgatatgcttgttgatcacctttgtggcagatcacattacctttcatgcattcatctgatttgccatatggctgttcagtttctcccattactttactaatgttcagtttactttcccaccccttgactttggaattggccatgagacttgttttggccgatattatcaggtacaaattcactgtgccagttctgagcttaggtcttaagagactttgtgtgtatccatttgctctcttgtatttctgctatattcatgagaagaacattcccagactgatgctagtctcaggagagggttgagaggcatgtggaataaaccgtccagccaagttcagtctggattagctaatccagtcaacctgcactgaatgaactaaataagtgcttattattgccactgatgttctgtagatctttgttaagcagcattattgcagtaggggcttcccttgtagctcagtcagtaaagaacctgcctgcagtgcaggagacctgggtttgattcctgggtcaggaagatccgctggagaaggaaatggcaacccattccagtattcttgcctggagaatccccatggacagaggaacctgacaggctacagtcctgcaagagtcggacatgacttagcaactaaaccaccaccaccacattattgcagtaatagttgactgacagaccttccaaatttacttgtggttttttagtgaaattcttggctttgtcagatttcattttttttttcttcgt

SEQ ID NO: 44281 - DNA, 1693 bp, Bovine  19866880758986
tttttaatgtgttgagaattatctgtctcacctatacatggaagttagaaatgtaaaacataatttttgtcattccagattatctcattttcttggcataatatttgcaattttatcaaggtaatgcatacacatggttagataatacaatatttatagtgaggcttataaagatcatcatcaattctctaacctatccctcaattatcaccaccctctgagacaatcactttcaactctttaaagaatatacttctgataattgcttccatattcctaaataattatccttatatacagttatctattttagcctttatctattgattttctcttataataaaggaagattagatctttgacatgcctgtatttttaattaaatcagcagacagtggtcataccaataaaaacaccagaatagcaataacaaaaataatgcaaatgtttccactgttcttgtacaatgtattgtgggtgcatttactttcttgtgcatctttctactgttatttgagttaattatttttatttcatgctacacagttttttgtacctattgtttctatttcttgtttgttctatcagactggtcatatacccatcagtatattttcccaaatgttgaaacattttgattaatatacagcatttttaaaaaatcttttgggacttttctccttgaggtctctgtacttctgttccattccaggctggttattcttcaagccttctgcatagctgttatgctgggttttacctccatattagtttctctgtgttcaatgtctaagtgctgcatcttgtcttttcctcttcagctggagcacatccttaagcagctttccaaagtaggctttgagaagggcaaaacttatttttcctcatccttgattgacatttcagccagatataaaattctggattgaaaataatcttcccttctggcttacttcactctgtataataggctccggtttcatccacctcattagaactgattcaaatgtattctttttaatggctgagtaatactccattgtgtatatgtaccacagctttcttatccattcatctgctgatggacatctaggttgcttccatgatatgaaatttagaaagatggtaatgataaccctgtaaaaaaaaaaaaaaaaagaaaccatttatctgctttttaccattatatattagttttgatggtaattgttatttgcaaatggaatcacacactatgtgttcttttgtgtcttactagtttggcatgtttttgagatccatctgttttcttggtatgtatcagtagttaattcctttttattgctcaatagattccattgaatgacaatatacaaaaatgttccatccatttaccgactgataaacatctggatgtttatatttgggccatcatgaataaagctggtagggatattcacgtataaaaaaaaaaaaaaaaagaaaataatcttccctcaggactttgaaggcattttctcagtgtcttttaacatctgatgttctgcttgagaatttcaatacaattctaatccttttgcatgtactacacccctgcccctctttcctctctggaaatttctgcactctttatcctggatgcttgtggatatttgtgatgatacgtgctctataggtcttctcattgtgtgagcatttagtggattttcttaat

SEQ ID NO: 44282 - DNA, 3797 bp, Bovine  19866880806659
ttctaaaacacaaaggctaaacttcgtattaaataatttaaatgaagagcaaaaaaaaatctttgaagtgctaataattttaatcctttgtcttaaataataatggtctataatttaacacttttctttcttttgctttgggggggaactaactatagtttcacagaaaactatttttcattaagtgttcctactttcactttattacccagttgagtgcataggagtctggagtaattttctttgtatcaagaaaagaacaaagctcaggttcatggtattggatgagtaatcggaaaagatgaaatggtctccccttcagggaacaatccctaaaagacaagagaagcaaagtttcttgcattaataggtcaaaactgatcatatcagtaaccagtcttcgtgcaaaaccctcctcccctccttaccccagagcatccgacttaagagcattgatagcaagcctacctgacgcaacaggggacagacctctcttgcttacacctaacatacctgacctgataggaagaaatggcacgtctacagccaactctaggaagattctttccaggtgaacccaggcagcactcaggagaaaggactacagggaccaatgaaaacagagggaccacttaggttattttgataagctttggatcccaaagggagatctggagagccctgaggaagtccagctcccttctttttctgccaaataagaaagatctcccaggaaggcttcaggatagctccatagttaacgtactcaattaagaatcccttcagcaaagctccaagtctgaaatggccacagacgaacattccaaaagagtggacccagagctgtgactggaagtggcctggataccagatgctcagagaaaatcccaggaggtgccaaacactgaccctactgagtaactataatacttcttgccttgttccctggtgtctaataaatctgtctaataaaccattaaaaatatacacagctcaaattgcaggccatcttaataaaagtcagtatttactgaggaaacaccatgtgccagacactacaatacagtttacaatgttatcttactttatctttacaagcaactctatgaaagatactattatcaccctcaatttacagatgagaaaactgaggcttagctgtggtcaagcaggtcaaccaaggtcacgtagctaagaagtgatggcattaagacttgtacacagaaactgggtattaaaccattataccaagctaccctcccatatatgcaatttaatatttgaactagtggtattttggtagatttagtctttaaaaagcaaactgtaaaaaaaaaaaacctgaaataaggtgaaagatttcatgtaaaaacattaatgaaaagcattgataaagaatgtttcaaaatgctattcaagtgggaataatgaaaactaatctctgcaaaactaagatctaaggtcaatgtcaggatttggtataaccattcatctaccatttttaatactgcagataacaggggaagttttgtagaaaaggccctaatttgctaattcagatgtccaaagatagaactggattcatactgacaagactacctcctcctctgtctgaacactttccccactctataaaggcaaaacagtagattgctaaaacaaaacacagagacacagtggtaacgaagactaggaacatacactgtaaggacaattgcctagtttgtgggtctcatcctcggaaaaagtgggacatctcagggaatcagccattgcaacagcatctattcatttaatagctgtgtactgaaagttactctccactgcaaagcagtgtgcttgacagaattctactcatgttacatctgactctctaataagatatattatagtggagttgtttgagcaacattttgtggggctgagccctatgcgggggtattaacactgactctggctggagtacagtgttacatgtggaattcatggaaacagtaactggagtaacctggcaaagtatgttacacagctcagtgcaaacctctactagtaaacctctacaatacagcctgtactagtatctaccaccaccaacatcctgtagagacaaagctggatcatcatgtcccttgctattactagttttgttacactgagaggtggtaaaaatataagcagttgagagatttagtataacacagtcgctcagttgtgtccgactcttggcagccctgtggactgcagcccgccaggctcctctgtccacaggattttcctgacaggaatactggagtgggttgccatttcctcctccatcagtataacagaatgactcccaaatgtgaattctagcctctgatttaccattagcatagccctgtattctggcatctctaggtctgctttccttacatgaagccctatcgcttcaaggtcgcacccaggttctccactctggtatgtattagaattgcctgggaatttaaaaatcgacagggctctacacagtctacttatatttgaaacatcaagggtcagtatgttttaaaagttctttggccgaacagacatttctccaaagaggacatacaaactgcatctaggcacatgaaaaaaaatgctcaaagtcattagctgtcagggaaatgcaaacaaaaaccataatgagacaccacttcacactcagtctggccataattaaaaaaaaaaaaaagttggcaagaatttagagaaactgggatctttatttactgctggtgggattgtaaaatgctgcaattattgtggaaaagtctggcaattcctcaaaaggttaaacacagatttaccgtatgatccaagaatcccactcctaggtacatatcccaaagcaatgtccacacaaatatttgtacacaaatgttcatagttgcattattcataacagtcaaaaagaatccagatgtccagcaactattacatgagtaaataaaatgtgctattttatttcattgtacatacaatgaaatgttactcagcaataaaaagaaataaagtaatggtattaatatatgctataaatacatacagatgaatctttaaaagacaatgctaagtgaacaaaggtagtcacaaaagaccatatattataaggttctatttatatgaaatacccataataggcaaatccacagagaaagatgagtaggtgcctagggctgagagtactgggggaaaaagcagttgactgctagtgagttcagggtttctttcgggggtgacagaaacattctaaaaaggattgtagctatggctgcacagttctgtgactatactaaaacccatggaattgtacatattaaaggatgaattttatattatgtgaatgatatctaaagctgtaaaagaaaaagaaaacaaaaaccaaaaaaagttgtttagttgattctaataagcaaccagggtggagaaacttgtaaggtaaagcacaagtgtccaatcaaacttaggttcaaatcctgactcagtcatacaccagaagtataacgctgaataagtcatttaacatctgtctttgcttcagtttctgtagctgtaaatcagacatatctgccttatagtggtcactgtttaagtgagaaaatacaaaaagcacccaaagctaacccagtgcttttcacacgaaaagcagggggggggaaatggcagtcatttaactatcaagctctagaatagcagtcctcttaccttaggtgcatgctgcaatcaaccaagaagctctaaatctaaacaaacctcactgcaggctggcctcctca

SEQ ID NO: 44283 - DNA, 2242 bp, Bovine  19866880815674
cccttgagcttgaggtcagaactggttagggtaaatagactgatgtaaaaaaaaaaaaaaaatttaaagaagagtgaactgatgtaaatttaagacaaattagaattttagaattgagtaggtagtcaaaagaaatgaacatttgtggttgccagcctgtcaattattcaattttttgtttaacttttcagtttgatgatattcacttgtcaaagatgataaagatggggtgaagtatgtaggctacataaaaaccagtgaaactcaagataaagatctgttacgctcagtctatgccaacatatgttgtaaatatatggggcaatgagaaccccaggctggcagctgagaaaaaagtacattagataagagctgctccccagaaataaaattttctcttgtaatttttattaggtttcaactgacaatatggctttttacatgaaaacaattaggaagagaagattcctttttactttctgtattttcctttgacttagcaatttattccagtttttgttcattcattcaacaaaagtttgcttagtactagctgtatgcaaagtaccattctaatttctggggacacagcaatagagaagatagtaaggtccttgctttataagttgctagaatttcatgtctttatctataaaaaatttatagctaattataatagtatccatcagacaagctaaaatgtggtaaaggaggcattctctgaaaaagaggggacctgacaaagaaaccatatttccttggaatttggggttccttctgtttactttgcatgtacatcaaataattccagtatctatttgaaaaatactgtctacttagttttgactttgtgcagattaatggcaattttggctacaccctcaaagcatttcctctttctggtaggctgcagtccatggggtcgctacgagtcggacacggctgagtgacttcagtttcacttttcactttcacgcattggagaaggaaatggcaacccactccagtgttcttgcctggagaatcccagggacgggggagcctggtgggctgccatctatggggttgcacagagttggacacgactgaagtgacttagcagcagcagcagcagcagcagcaatcatatacgggtgatgtcatggcactgtccccagacctttgtggccacgctcggtacgacacagctgcctcaaagttcaagactctggttctcacaaaagagccactggctcacaaaccaagcacatttcttcccttttttcactgtaacattctttcccaagggtataaatctcaggctgatatttaacattcctttgaactgaaccatggacttttaccttgtacttcttgaaagagtggagagctaagcttccattatgcatatttataaacatgtcctaaacggaaggcatgattttgtaattctctagtcatgggtctttgaaactattttataaaagaacatgtagaaacatcgcactggatcaggctgattgcctggtttaggattctatctcagagtggagtccacgtggcagtggaatgtcactgttgctaaacgtggctcaaccttgacaaggtgctgacatatcccagaacctctggaattaaaaattcctttcacttaaaaaaattaattctgaagttgaattaactaacacaagtagaggtttataagtttcggaaaattaattttaccctaggcttctctattttggaaaatgaaattaccacaagctcaaagtttaagagatgttccttttgtttgtttatttattttgcatcagaaattatgagagcctctgtagttcttttaaaatgtaatacttattttgataaatgcatagtttttaaatataagttttgaagaaagctatggttatatgacattgcatggatcacaaagaataatgttgaaaactaagtcctatttccctaaaaaaccagtatctcaaagttattagtttttaaagtctgccttacatggacagcaacaatctttcgttcctttcttctttcctcccccctttctttctttcatggtaagaacagatgacacaagatctaacctcttaagttcttaaagatatagtacagcatcattatggagtaggaaatgacaacccactccagtattcttgcctggaaaattccacggacagaggagcctgacaggcacagtcccatggtgtcgaaaagagtcggacacgactgagtggctatgcacacacacgta

SEQ ID NO: 44284 - DNA, 894 bp, Bovine  19866880823462
caaagcccttccaagcaataatattctgaaatttcactctacgactctcttgtttctttcttcttatcctagtaaggacttccacctgaacattctatgtatccaaactctgcagtctccaaaataccaactttctgcattggtagtaattatagcagtagaacaatagctaacaactataatgtaattgtttgctattataacataaggacagtacttgggagaaatggagcatatccttctgtcatcacgccttctttcaggcaacactgaaagtacgggtagaaaacagttcccactagaaaatctctgaatgttctgcccttcaaggttgtttaaaacaaaaaaaaatgcttaatgacatacttagaaaagaaattctggaattccaacaccatttttgtgtaagaaaataacaaaatcctttgttttgtgttagcggtgttgtaactaattaagggggaaattagctgccggtttacatgaaaagacaggcctgattccgctgacatatttgcatccacaagaagcaagctgatggtctgctgcctgtggtgtggtgttcagctcagcctctgcccactgggactcattagccaagggttacaaatatgtaaccagtgctttttccagatcttctaccgcaaagtaagtaccagggtgtctgtcgcctgcctcgaaggcctggatctgagccactcaggatgctcccagctgctcagcctggagccaggattttcattagatgggttcccttgcatgcaagcacatgctaccattgtataaatgttgctcttttcttcattaagaggtggaaaaggagacaaacatacaaataaatagctactttttaattttcattttttaactttcttaatgtttaataaacaactt

SEQ ID NO: 44285 - DNA, 1019 bp, Bovine  19866880828621
atatcaccttctatttctgataatatggtgggccaggtacacagtccaacccttccattgaaaactactaaaaatgctatgtaagggtacttaaaagcatctgtgaataagcaacaaaggaaggaattatcatgctaaaatcttggtaagtgaagacagagacccagagagctaagctagctctaaatttcgctttcattctgaggacagtcattgaacctagtaaccttcagcttcaatttcctcattgagttatgagacaggaaacaaaactcaggtgtggaatctaataaaggagcctcctccccaaagctgagacaagagcactgtgctctcatcataaagatgaactgtagatactacccctttacttggagagacaaatatagggaacatatgaaaaagattaagagacacgaaggagagagtgagatatcacacataaaagtattttagtttcataaagaaataataaagagaatgagaagcagtatccaaagagatgatggctgagaattttccagaattattgaaagacataaatcttcagatgcataaaccccaaagaatccaaggcagatattaaaaaagaaatcctaaccaaaacacattagcctgaaactagagaacatgaaagatgaaaaaaaaaaaaaaatctttaaaacagtcagaaggaataaactggccacctacaaaggaatagttgacagctggtttcttacagcagtaatggaagccagaagccagtatagtgatatctttagcacactaagcaaaaatagctgctaattaggaattcttaacttagtgaaaacatcctataaaatcaaaggaaaaatgacattttcaggcaagcctgaactgagtttacttccaaaatattatcataaactaatatgtaaaggacatatttctaaacagtgtatttcagaaaggatgaaaatgatcctagacgaaaaaaatctgagcttcaataagaaatgggtatcaaagataatggcaaatttaaataaaaatgg

SEQ ID NO: 44286 - DNA, 1655 bp, Bovine  19866880830575
ttgtttgttttaaatagtatctcatgtgaaatgaatcgccagtccaggtttgatgcatgagacagggggcttggggctggtgccctgggatgaccctgagggatgggatgggagggaaatgggaggggggttcaggatggggaacacatgtatgcccgtgactgattcatatcaatgtatggcaaaaaccactacaatactgtaaagtaattagcctccaattaaaataaataaatttatattaaaatgtgcaaaaactaaataaataaatagtatctcatctaattttcgcggatcttgttaagtctatgacagagcactgcgtatgagaggcaaagtcagaactttgatgtaacaagggagccgtaaaggtgtttactgattgccatgatgcacctcatcttgtgatcaaactgaacaaccaacccccagaccaggagggttgatcctcatggtgtgagactactaaaataagtgttgtctccactaatttcctgtccctctagccttcagatgcctggttccctcaagcaccagcctgatactaggcccctctctgtccatgtagaaaatagattgtcctatctagaaaacaaattccttgtagaataaatgtgtccatttatttgatctccttcattctacaataatttgaagattaatagttaaataatttacaataatatatgtgattataaagagcaaaggcccccaagagttacaagtgaatcccaacactgttgtataattgttcatttccctagagctgatggatgcaacattaagagatgcaggacgctgggtatctgaggtaatattcactctgattgtttcaacccttggttttgtttgaggtccaagcatccagttatgggaattgagggacttaaattatgataccagcctggcttctgtgtgcttttatgcaagtcccttcatgatcacatgcacttgatatccacaaagagaacataacatctgctttctctcaaaaataacatgtaagctttggagaacaatggggaaaaaaatctctggaacatggagctatcaagattacaattgtaaatttctagttctacctattgaattttaatagaaattaaaatttcataaaacaaaaattattggcagagaaactggagtgacatttataagtcctttatgtaatgttttacagttttgcacattataattcagtaataagagggggaaaaaaagaaacatcacatcttttctcataatattcagagtagcatattttcttaatagaattcttaggagaaattactggtttctatttttatgaaatgaccttagccataacccagtctataaggtaatatttaattatatgattatttccatatgattaaaattattgacaatagtgacaaataattcttgagaaaattctagcagaaaactttgaaacttcattctctttttttatatactctttagttatggctctcataattcaaaatctagactaattgctgtgattctggttaattctgtacttttcttcagtcaagatcccacacaataataattgccaaatcttttaacctggcaatatattttcaaatcctaaactgtttgcaagtgtgaaaagtgagcacttacttaatgtacagaaatatctcaaaaga

SEQ ID NO: 44287 - DNA, 1898 bp, Bovine  19866880833686
ttaaactgcaataatttctcacctgaaagtaattactttgtatatggtaacttgtactgaagagagtagatgcatgaattctcttactatactaaaacaaacttcatttatagtttttaaaatcaacaacttgaaagatcaaatgtcttcagtccacttctcagctgcaaatgcaaccaatagggggttctgatccagacgtgaaaccatgtaggatcaggaaacacagtagtagaaggttcagtaacaagaaaacaggagcctctagcttagctgctacaaaaaagaagttcagatgctttttactcatcctttccagggtaactccttttccataataaaaaaagtttcctaattccgcatgaacagtagttgtagcttttcctatccatagaatgaagaaagacataaccacaaaagcctacaacaaactcagaaaatctttaaatggcttgtatactctcaatcacaacagcctccattctggagatacatcacacttggtttctcacaatgcttttggaagatgactggaagcctccttagacaactttgaaagttcctaggggtttctgggttcataggctgagaatcactactgcaaagcatatgccacataaggaatctcaagaactttatctttccgatggctgtcactggaaatacagctatcaaccatcttcatgcacacactcacaaaagaaatacacgatttcatggtgaggtgctaagtggaggaaatgcaaacagccatgaatgagtaacatgctatgggcttcgaagtgtgtgtggcacttctgagcccaaggggttcttctgttggctctgtggcagaggtttagcatagagggtaggggctgagaaccgtgacagggaatttcttttctaaaaaatgcagggttttagttgccttctttttccttataaagccttcctgtgtcaataggctatccgcctccaaccccccagcaaaaacaagggtggcccctacatgccaaaagaataattgtctgggctttgtacgctgaaactgacttggcaagctctccatcttgcaaagaacacaaagagcttagtttagtctgtgtgttaatgctttacaatcattaccaaaatacccaaagcaacatgctcaagggagggtagtgattctttgtctcttcccccatccctccccccttaattttaagttctgacatccatttatgtacttatagctcctagcagaagctgtcctctttggtcaacacacactcttggctgccttaggcactttcaaacaaagggttatgtggaaccacacacagtgggtagaacctctgagctcagtctaccccagtcccatgtccccatgtctgaggtccaaatctattcaacaggacggggaaggggtctcccctaattaaaaagtgctggaaatgcacactttcataagattaatgtgactaggggcttgggaaggcttggtaaacccttcttggaggacacaaggagagtcctgacaccagttaaaagaacactgataatcagtccgacccaagctcatagcatgtaggccaggtcacactatctaggcccagcgcccaccctgctgcatgtggttgtctggatgcttttggatgctccctgatgcttcctgactaaagcagacttcctgctccataactcccaagctaatattcagaaaagtgaaagtgaggtcgctcagtcgtgtccgactctttgtgaccccatggaccgtagcataccaggctcctccatctatgggattttccaggcaagaatactggagagggttgccatttccttctccaggagatcttcccaactcagggattgaacccaggtcttctgccttgtaggcagatgctctgagttgaataatggagaactgtgaa

SEQ ID NO: 44288 - DNA, 1187 bp, Bovine  19866880877877
tttgtgggaggagagaaaatggcttcaattatatttttaatattttgtttctaaagagctgaaaagaggctatgtaggtgttctgtattctttatagagtctatacttggtatctaaaatgtttcataatttttaaaactatttgattaaataagctctttaatttctaagcaaaaacatgttcattctcttccccaaaggaaagataacacagagccacattattgcatccacttctaagtccaggatgtctgcatgatgatcagtcctatggggaaaatttcttttaatgtggaatgagaatctagatggcagctatcaaaaagaataaaaggcatggatctgggtcaaattaccattccaatattcaggatgtctactgggtctcttcagttgttgtcagggggttttcagaagcttttccaaaaaaaattttttttaactgtttagccagtgacatgacaaacagttgttcatcggttaaggtgatcctacccctcaactgtaattcatcttgagagtaattaagccagtgactgctttatactccatgtggtaaaaatattattccactaaaaatgtatcacttgacattttcaagcattttttttcattctgtagaagatgaaacttccaacttccattctctttaatagggccagggtcagcttcaggggcgtgtagtctgtgcaacagcacaggactccatgccatctggaaatgctttttttttccattttatttatgtattgactgattttttggctgtgctgggtcttcgttgctgtgtgggcttttctctagtggtgagtgggggctactctctggttaccatgcacaggcttctcactgcagaggcttcttgcagagcctgggctccaggacaagcaggattcagtagttgcacctccccgaccccagagcacaggtggctcatgggcttagttgctctgaggcatgtacaatctgcccggatcaggaatcaaacccatgtctcctgcattggcaggtggattctttaccactgagctgtcagggaagccctggaaattcttaataattttggaacaggaggcccctcatttttattttgcactaggcacccccacaaattatgtagccattctcaataggatcaatatgacattgatatataccccgtggggacaagatttcaatagaaatag

SEQ ID NO: 44289 - DNA, 1740 bp, Bovine  19866880989406
gctgcagtccatggggtcgctaagagtcagacacgactgagcgacttcactttcacttttccctttcatgcactggagaaggaaatggcaacccactccagtgttcttgcctggagaatcccagggacgggggagcctggtgggctgctacctatggggtcgcacagagccagacatgactgaaacaacttagcagcagcagcagcaaccaaatctcaagaatgagggtgaatgtcaggtcagtgtcagggtttaaggactgcataaccatggagatatctcaagggctaggaaatagaatgaagaagaattggaaactgaagagacagttgatagactgaactgaacctggggacaatccccgaatggccttatgagggagatggaagtttgactccaagatggcttcttctcactgatacacttggaaaacagagacggtgcccctgatagaaacaggcagtctcgcaggggagcctgctccaggcagggaaagaatagatgctcggtttatacacggacttgtgggatgtgtctgtgctccaaacatatatttgctgagaagataaagggtggagccatgagcctggagagagacctggtggcctagggtaataaaagggagagaaaagactcacttaaaatcagtggcaccatttgcagacaaaaatgattaaactgctttaaaatctcccttactcattgcaggaatgtatttgacaaatcctttcatcatatatacagcaaagggaaatgtcatcccaacccacatggaattacaatgaattccaaatacatacggccaccaaagagtgcaaatcaatcatgttttactatatttcagaaaagtttttctttttaatggtccttgtgactctaaaagtaaatatcatgctcattccatattacgaaaaagaaaaatatctatggaatacccttagagttatccttcttctggcaaagagttacacaggatttctgatgctttcattttcaaaaccaataattgtatcaggatcaattttattctcaagtaagctattctttatgatgtcaaatacctgttaatgacttttatcattagaagattattttttgctaattcctagagataagtgcactggaatttgaattttaaaagtggggcacattatcccattttaacaaattactcagaagtttcttgtgtatattactgaaacacagaaccatctaactgaattttccttcaaggcatccagaactttttcagaggtttttttcctttgctatcttaatgcaagtaaaaatggactattagattcaaaggcaccttctaaattaaagtttatgatcttgtggagacctacaattcacatgctttgttaaaaaccaccaagatctaaaaattaattctgtaatgatcatggccaagtcagttctcatctgacaagtgagtggctggcagcaacgttctcatctgctcttcatttgtgggtgacaaacacattggggaaagttgatggaatgcttaccaggctccaactgcctgctagtaagagctgcctttcctcaccaaggacaatgctgtctttgtcatttgttctgccaaaatcagagtcaccaatacagaatgtgttagggagaagtttccggggccagggtcagagaaccaatctcagctccaccagctgtgatatcttgagtcaattactttaaggtctctaaacttcagcttttacacttacaaaacagtaggtg

SEQ ID NO: 44290 - DNA, 1601 bp, Bovine  19866880991451
attcttgtgttgtcagaacatagcttaatagaagcaagagttgatttttggtgtgttttaaactgtggccctccagaggaacagcaactcaaccctgcttgtttaatgtggtttgttctgaaccatatgcgtgtgggcttttaataaatactatttgatgatgacgatgagttcctggagacagagctgtgttcggcagagtcactacattatgcttggcctaactttctgctactcaactccaggaatgctcttgtgagcagtacagaaacttctgaaatttccatttgaggtgaagtaccactgccaaaaagcctcatgaagggagtcattaaccctcacccttttttcttgtggctccttccaaactgaccctcagaagggccttctctgcaggctgcctagttctcaattgtcccctgtgttcctagcagagctatcttctgtgagctcagtgggccaactcccaaagcccaaactatggagtgcagtttgctacaatcccagaaagaagaaaaacaaaaccaactactcacaatctgtagcccctaactgatatgaaatgagctaacagctctagtgtctgaaagagggtttaaacttttttgagatgtttgcattaaaaacagtgtaatgtgttaaaatatcaagcctgaaaactgaggtcaaactcagacttttttctccataacttacattaaagtgactgggaggcaggaagggattttcttccaatagggatcaggccatgtgaaggagcataagctcgttttcataggtaactcgctacctaatctgtgagggcctttcgacttagttttgtcttggtaaattctcctcactgctataataaaactgtatttatcatttgaatttgaattaaagtctctttcatttccaatgcacccccttatttttagaagaaaaagaatttcttttagggtgagatgttcacttgcttgcctaggaagcttctacccttctgcccaagcattatggttggaaaagggtctagtgacccctggtacaaccttcccaagaaggatgcttcagacagagtgctgtaagtgaacaatgcttcctttcagacaaccctgggttctctaaacacagagatagctgtgatgctttgccagatctagagagagcccatgttgaacactgatgacctagactggcagcaacgttatgagctttgcagacagtctgtctatgcggccttggacctgattttcaaggctcattgagtccattgcctgaaatagcaggaaagagtgaaaagagatttgagagagcagaaggacatcaagtcacatgtaagggcataggggacacagggaggggcctcagacaactgggcctctccttggaaaacaacaacaagcctgtgagttcaatatcacaaaagccacagaaaggagaaatcttgcctggctcacctaagtttatgtgtttgctgttacactccaagccagtctttgatccatttaattcaatggtatggccactggatcaatcatttcatcaagtttttaaattcatccacagagactttgcaacattattccaattttttcttcttctttttttcttttttcatt

SEQ ID NO: 44291 - DNA, 882 bp, Bovine  19866881017972
atgatggtctgcaatgtatttgggtttgagcaaaacgttcatcctaatgaaatgtaactttatgaaagaagtgctcctaatcctctcaagtactgagccaggtcatcacgggtaaatgggaggtatgtgagttttcttctcttctttttcttcccttttccttttttttttgttttccctttttttttcctcccccaaaacatgttgggtacaccagctgttagcaagaacattattaaaaatcatgtcagctcagagttattgctgtttctgaagaaaagataaatgtatttatttttaaatctggacatatgaaggtttaaaaaatattgttgtagagttctcctggctacttttacttagcttttttccaagttttgggctggagaaacttaaaaatgtctccatgccaaagttaaatattaaatgaaaaccttctgtctgaggagctccaggattaataaactgtgcaaaataggtaagatctcaaatcgctagagaaagaaatttccaaagggaatggggttgcattgtaaatggtgtcagttcagagctgtgggataaaaacccacagggaaaagatggaccatgtctcattttaggctcagaggaggcaccatttctttgaagttgcaggggtactacacttatcgttgagcttaatacatatttgaaggagttaaagaaattaatgctttatgcacatgtgcaatgtgatatcataagtctccctccccaggaagacatcatctttaactgttagtagcactggtttcctaaagtcaaatccaattattatggcgaatattaattttagtagccccatattttgcctcaagatttattatcttttttctcaaggaaaatcctaggggcaagtaa

SEQ ID NO: 44292 - DNA, 1280 bp, Bovine  19866881025420
tttaagaaagagtgtctgatttttagtatttttaaattgttttttgtatattgaccatctgtatgattgtatacagctctcagattaaaaggaggtattccaaaagtttctttgtaagtcataagtcatgatctgctatagaaaacgtgttacagatcatgggtgaataggtttcaaatccctcacactgtcttttgaagattaaattattttggtttatagttctcttttttaattcatctatagtccattggtgtctttttgtttctctgtcattttttagttagattattggctaaatagacttttttatgggccgacctcaagagaaacattattgctaggcgaaggatagggaattgggtggtggagaatgaatcacttcccctcgcttcaacaaagccatagtggcagctgcccttcctggggcagaggatagtctttataatctgttatttggaaaacgcttttttgctttccggaaatgtgggtgatacctactttcctgcttcacattgtgcattcttttacacacacacacacagacacacacacacagcacacacacacacacacacacacacacacacacacacacacccctcttccctggtggttcagatggtaaagagtctgccttcaatgcaggagacccaggttctgtccctgggtgggggaagatcccctgaggaagggaatggctacccatcccagtattcttgcctggagaatcccatagacatagaaacctgatgggccacagtccataggtcgcatagagtcagacatgactgagtgactaacacttttacttttcactactttcatgtgtacacacatatgatatatatatatatgaaacatatatgaaggtccaatattaagctaataaatcctgaatagctagtgaatatgaataggtataaggaaaaatgtatttttatgtagttttattttgtcctttacatgctctaaatgcagtaagatagtatcatatattttgtaaacaagtattttgtccaatagctgagcgtctagcagccccttggtaattttgactcttattttttagatcacctttcagtgccagaagagaaggcagcacaattacttttggatattgaatctgtaattaccttttattgtaaatcccgtaacattaagtatagctcaacccttagctggatacatctcctcaaaccgttggtgcatcttcagctgccacgcagtgatttatacaactgcttttatgcaatcatgaataagtacattcccaggta

SEQ ID NO: 44293 - DNA, 1152 bp, Bovine  19866881027160
acagggtacattattcatagtatctttaattgtaatagccccaaattaggagcaatccaaatcatcaacagggaataaatcaacttttgtatatgcatataatgaagtactattcaacaataataaccagtgaatttaaaaagaaatgaactattgacacatgcaacagcatgtcaacatagacaaatctcaaaagaattatgccaagtgaaaaaaatccatacaaaaagagcatacattacatgattcttgattcaaagacggtcattaatgttccttacattttttatatcaaaatgttaaataaatatgataaaagatgctaataatcccttttatatagagccctctttcatcagcagctgtttctctgttactcacagttaaccattagtcctcgggtggtaacagtcctgatagctttcctttccaatactagtgtattgatattccaaaatcatcattactcattgaccaatactaacgacagccaactctcagttttgatagtggatttcccagaaacctggctttgtccttgcactttcctgctccttgcatgtgggtcacttcactattcgttagcacctgcaatcaagggtgttcagtcatagagcaggtaaaactcaaacccatccaatattctgctgagaatcataaaatcttaaaattgaaagtaatctccaatgttatcttttccaattcccacccagtgctggaatcttctctggcctatccctgacagatattcacccaagccagatcttctctgaacattttgaataataacagacccaatgtccagttaccccagtaacaaattttgtagtccctggcttaactctttttctgtgttagcaatgcaaggggtaattggaaacaatatttaactttggtttgggagtagtaacatgttttttatttattacacacatacacacacaaaatatttctcaagcaaaaagaattctttcaaagtgttataattacctcagccccaatattccctatgagtcatggagaaagggtaacagaaagtcaggctgggagggaagaaaatgttaaagaatgaattcattcattctatggactgaattgtgtctcctcctgcctccgccattaatgtattaaagttccaacccctcaagggga

SEQ ID NO: 44294 - DNA, 994 bp, Bovine  19866881044653
ccccttagatgaaagttattcacaaagtcttcatttgtccctgcaggatatgtgtaactatgcgtaagacctagagccaacaatgaagctgttaaatagatgatgtagatgtggcatggacatcacccaggactatgagagctatgatatttcatagaccattgtctcctgtagatgtgatttttttttttccctattgattaaataaggggcagtttctatttgagatctgatatagtctctggtcacaaaatctgtgttttaaaccaactaggacaatttcagtggaattctttttggctttagctagatgtctaaagtgtttcataatgagcaaattatagtattgcactacaaaatttgagcattttcctcatctgttcttgagtagtcattctttcttttcaaatcctggaaacaaaagaattttctggctcatcctacacacagcccagagatttcgactcttagaacctatgtaaagaatttaggatctatgtggagttcattcatggttggtttggtcattgtggaataaaagccaaatgaaatggatcgtttattttctcagtttcttaaacttctggtgctagaaaacactatgtcgcaatccttacagacatagatacactgctttttaaagtcacatacacacataagagagctatagaagaagcaccactttcctcttgccaccccggattcccttatgtctttatttactagctttgaatgaagaaggaagaaaacagagaaacacttaacgttgtttattaaattgctcattaatattcctaaggggaaatacaagaaattttttctcatgtgttaatttgaatttaatttgaggtggttgaggatgttaatctttatattttaaattgattttctgccacatagtggcaaagtatacactatagaaatgtattcccaaaatgggcaatagaattgtacattggtttagaaagaatccagaataatattttattgattt

SEQ ID NO: 44295 - DNA, 3529 bp, Bovine  19866881094922
atcatatgatcctggccagctctgtgggagttgacacctcagaccacaaggttatgcctactggtagcctaaataacatgacagataacacatatgtcatgataatattatatcatttaagggtatataggtaaactgcatgtgcttcctgtgtgatatatttgtatttattatacatttataatatacatgtataaatatataacacatttgatatttcatatcatgaaaatgtcattaaacaaaatatatatttataaatacatgatatataaaatactgggactgacagagaatgatatccattcaaatttctgatttgtggaaagggtttcagtggtttcaacaactgtcttgaaaataagtagatgtgtgacaacctaacattaaatttagggtaataacatatcacttatgtgtattctctgtgttgaaggtagacagatgactgtttggaggaaagaatcttgctgcctagaacatttaaaaatgttttgtggagggcattcctgagctgcctttggaccaaattctgactctgaatactttcacccacaaggaaccacctctatgttccaagaaataagtctcagagaggcatcttctaaggtcttatgtgataattaacaagacccagaaggacaggaggaatttacagagacttctcttaaaaaaagaaaatcatgaaaatgtacctgatctaatttggatttatccataaacaggtaaacattccattttagcattaaaacatggctaaaatcaattttaagagatttttatatttatatacagagcacttcacacaaatctaataaagatatgcctttctctgaaattgcctgagagctctgtcattataagctcctaatacattagaaggtgctcaaggaatgttcataaatgaatgaatgggtaaaacaaccactgctcctgaacattaccctgtgatgtccttaataaatttattccacgggatgactctgggtgattaaaatggtatgctccctttcacgtaggccactaggaagcttagagctaaatttgtgatttacttctaacaaaaataaaggaccagagagtatatatttcggtttcccattcttatctctggttttatattccaattactgattccctcaactacttattttattcttctgtattgcgtgttctttagaagtgaggtataaaatagactaataaaaaaagaatctttcttaaaaccataacaccttactaacctctcctacaacactcagtgatttttttttttttttgaaagagctctccccaaagtaaccattctgctttgttcttagttgctcagtcgtgactgactctgtgactccatggactgtagcccaccaggctcctctgtccatggggattctccaggcaagaatcctggagtgggttgtcatatcctccagggttcttcccaacccagggattgaacccagtctcccacattgcagggagattctttaccgtctgagccaccagggaagcctgattaaccattctatctttggtaaattctagaaaaccctagggtttaatgggaaagttagaaaagcaatggcctaagcctctgatcgttgttggatctgcttgtccctcaaaagtgaggctattcctctgaagcagtgctaaacgaaacaagagattgagctgtttgctcttgtggcttatatttgccactttcctatagtgtacagaagctatatgttcccaaaggcttaactttaaacaccagggtgagaaggtaagagaaacaaaagaggagcgagaactgtctgtgtcagaggcaactctctacagttccttcccactaaatgtagacatcaaacttaattttggcctaacaaatttatgcttagtttttcctatgctcttttattctctttaagatgcaatccatttagatttcaaaatagactattgtgtaggtggcaactttcattccaagacacaaacaaaagtgcttttcaacaattgtccatgtccatatttaagcaattagtttagacaatcatgtcaagccttacacaattctgcacaatggattttctttaaagagtaagatacaatttaagaagctgaaagtaagcttaactaggagaaaaaccccagggggctagacaggaaattctggaaacccagtctctatccacgcatgggagttaagaagcataaaacccacctggacttgaaggctgccttcagctgatatgtcaaaagagaggaatggattcctgacttgggttttgttttccctgtctaaatggtagtccaagaaagtagaccaagaaaactgctgctttggttctctgcagccggctccactctcccttccttctcttcttccctgcgcccccaccccccgccaccccaactaatgcttcaggcagctgccacactaaggtggtggccgtgcccaaggctctgaaggtgagggaaggggagaaacaagggggagctctgtgactaagacataacccagcgcagggatgggtaagtgagctaagtgtaaccctgctgctagtcttcctggtagaatcgagaccatagagaaggtatgtggtccagacttgtctgtctccttccgtgagggctgcttagcagagcttgggattccagcgtttcaaaggaggacaggacaagaatggaggaagacgacggaaacaaaagtggacatggactgtggctaggtgctccacacatcccagtctgcctgagatagttctggtactattaactgtgtctccctttcactctccacagcttttgacccagtgtttcttaggagtgcgtatttgtgctgtacggagacaattcttcctttcaggagactgctttgctcagtgtagaaaatttagcagacctacttgtatccactaaatgccaacaggcattcctcccccccaccctatcattttttgcacaccctgtcattttgacaagcataaatgtcctccctcttttcaaatgccttctggggagagtagtaaagccctggtgaagtcactgcatgctttctcagtgaagaaataagtaaggtgaggttcagcgaggtgaaatgatttaaggccattgctagaaaatgacccaagaattaactgtttcttaattttacatactgtgctccatccaggacaaaatcctactgtcccatgacacacctgtagctgaatcactgtctgcagaagcccaaactgcagggaagaatttacatgtggtaaaagcagtgttttatttgtgaccacttactggtatgtagtcagtagtcaagcttcgtaaccttgaaaaataccattattattaataacctttgaaaccaccaagggttaggaagctactgactttagattttaaaacacatgacatttggaggtaagtcacaaatgctttccagaaaaggcgtaaggttgtcattattttttaaataaatgaagcttaaagagggatttatcagttaacaacaatggcacctataaatagctttgaagaattttttctttaagga

SEQ ID NO: 44296 - DNA, 978 bp, Bovine  19866881110569
cttatatacctggctgtcttcttgaagtctttacttatttgatgaaatgttaaatggaaatgaggtccagctactgaatttttccccaaatctgctttttctccagacttccctatctcagtaaattcaatcaccaattaaccagttttgcagaggcctaggaatattctgatttattcatttactttttctacctgttacatctggtctatccagtcttgtctctctctccaaaacacatcctgaatttatttttccttttattattattttttgcgtgtttgtttacatcatctgagtatgtgctgtcattctcgcttgcctaaacctctgcagtaagctaacagggctcccagcttccgtcttgtccctctgttcttcactcagcagctgtagtgatcaatcacatcacatgcctgcttaaacctgtcagtggctcccccgctggattgcttaccatggttgctatctgctggaacctacttactctcctctaggttatgctgtaccagccacaccagcctttatactgtgccgcagctgaccaagctcattctgtcttatccatttgcagtagcttcctttctgggctgtcctgaattttgaatggttggccttttcttgatattaagacctaggttcagacatactaaataggaagcccttcctgttcagtcagtctagagtagctatccacttacattatcatgttatagtaatcctcagcagagctatggtcaccaactattattttccttattaaactattgcagtctccccacactagtacataagtacatgtgagcagagattagtttatcttgttctttgctgtatcctcagggctacttagaagacactcattaagaatttattcattaagaaattaactgttagtatttcccagccacatcttggagactttaacataggatttcgacatctaaagaaactggtccacggaagggttgtcaacat

SEQ ID NO: 44297 - DNA, 6192 bp, Bovine  19866881113731
tttccagtagtcatgtatggatgtgagagttggactgtaaagaaagctgagcgccaaataattgatgcttttgaactttggtgttgaagagtcccttggactgcaaggagatccaaccagtccatcctaaaggggatcagtcctgaatatttgttggaaggactgatgctgaagctgaaactccaatactttggccacctgatgggaagagctgactcatttgaaaataccctgattctgggaaagattgagggtgggaggagatggggacgacagaggatgagatggttggatggcatcaccgactcgatggacatgagtttgagtaggctctgggagttggtgatggacagggaggcctggcgtgcttcgattcatggggttgcaaagagtcggacacgactgagcgactgatctgatctgatctgatctgagtgactaatacacacacacacacacctgtgtgcatgtatatgcgtgtgtaggtgaatatgtacatatacacgcgcaaagttgattcttgtttttcgtggcagttatattctataaagtccctggaaacattgaactagcaaatactggaaccattgcttctaggagaaatacaagattaagttcctgtgagcctccagttcattttcatcaactgatcaatatataaccttattttatgtgtatttttgtttaaagacatacacacttttcatacacacagacacaaacacacacacacttgataactcaccttgtgcttagaaacagcagacagcacctcaacactacacttggggggcattttaaacagtgaaatcacgaataaaaagcacacaaaaaagcaaaaatgtggcactaaatgtgttgcagaaagaaatgatcacacattaacttctccgtaccccctgccatttttttaaactttttattttgtattggagtatagctgtttaacaatgttgtgataatttcaggtcacagcaaagtgattcagttatgcactttcccatttaggctgtaaacgagcatggaaactgtatgagaactgaaaagaggcagaacattgccttgtttgacctcagttggggacaggcaagtcagattagtcaaatttttgccaccctctatgaatgactgtgaaaaatgctgtgagtattaatttaggggttgctattcattttaccaagcaggagaatttgtaaatagaggatctgcaaataacgaggttgaccctgtgtgtgtgtgtgtgtgtacacataatattagaaggctgatcttgtcacattaaaataagtcttggctttttttgagggtttatttttagaagtattctttctctgactcgtctcatttttttaattcctcagtgttttttttttttttttttaatgcttctcttctttcattttatgtatacacatagactaatcagctcactctagtttgtgtctctttcccaaggtgtatatttacttttctcagtaaatgtggaatggatgggtttataaatcaggggtaatggcttgcctttgatgccctttctgccttttggtggtgggcacagtccttccccgtatctatcactggtgggcaacttaatgggcacacgccctggtctacttctcagttactagtggtttttttttaacctattgcagtgattcccaatgttagcttgagatgatgtgttcactggcctaccataagtgaagaaaaatggccagcactgcattgagaataaatttgtttaattgagacaattttttatttgagattatttttctatgttttttggaattccttttgttcttattttcttgatggtttgacttgtaaaacaaagtaaactacaacccaatatgattcccaaaattttatttggaattttattactgtatggaatccagaagtccagacacagtgtactctgtcctagcagtgttatatcttttccttcccaaacatctttcttcttgcagatagataggatagtaataataataactatatgccagggacctatccaaacactcatatgaactcctttaatctctgcaataactcagctaagtaggtcagtactgttattatccccgttttatagatggaagaattaaggcacagagagatcctcaagttcacccaattggtttgtggcggattcaagattagaacatgggcagtttaggttgaatccactctcctgagcagcctgctgagttctctacctagaccgcctgcgttcctgggctcttcctgttcccccttctgtctttagtgctttccctgtaggcaatggcatttcccagcatgcagtgctgctagcactcctacccacctctccattcctgccctgttcctaacacgttcctgctttcccggatggactaagatggccaagattgaaggtcaaaggtacacaggaaggaatataatgttgcttgactcttaatacagtgcaaaggaaagagagcccatttcctgtttgctggagatgctgagtctctcattccaaataagactatggagcagacatggccaatattccatttttagactttcttttctttttaatgctagaagcaatctgacctgtgccatgcacttaaacctggatgtgttttacttaatccatctctttgtgtcttacacgtttaatatcttttgtattttaagacattattcctcagtttcaacttttaaggctgtttggagttttgtttttgtttttttttttgtctttatgagtatattggcaaaagctatgttagtcaacatttcaaattccaagcaggttctccctaattttttttccctgtttgctttagtaacatttttcccaaaataagctcttgtcctgaaacttgactgatatgttttccttcttttattttgcagcatcttttcactgcttccattttggttctctctccgttcagtcaagtagaaagagaacacattgtacacaagactgatgttttcttataaacaggatgggtgtatccttcttggttcctctctcatctctttttcccttccttccttggcttttagaaaccttgtctcagatccttaactagagggctgactatttttctagctctctgctatgactccctgatccaggaaggtaggcacgttggctggacatccactatgggacttgtccctgtgtttgctcctgccacacccacagctctttccctctctcatccactgaaggcacatgtgctcagcctgcctcctggtttgtgccattgcccgtgaccatgggggagcatccctgtctgaatgttctccttggtagcaagcacctctgcaaacctactttggaatgcagtcagtctgtagctttagatgggccaggggtgggggggacctgtttcctccctgtgctgtaatgttgcctgactgtgtcctcagtccttttttctaatcaagagagcttctgccaaggtttcccactgtgcttggtaacttcccttgttctggctcaactaacactcttccttgagaaatctctcaaagctcgaagaatgtagccaacaactttcctgagttttcaatcgcagtgcagaatagttggtatttttattttcctttggcttggtccctgggttgggaagatcccatggaggagggcatggcaacccatgctagtattcttgcctgaagaatccccacagacagaggagactgttagtccatagggtttgcaacgcctatagtccatagggttgcaaagaatcggacatgactgaagaaacttagcatgcacaaccatatttatgggcttcccaggtggctcagatggtaaagaatctgtctgtaatgcaagagaccagggtttgatccctggactgggaagatccttgaagaagggcatggcaaggcaacccactccagtgttcttgcctggagaattccatggacagaggagactggcaggctatacagtccatggggtggcaaagaatcggacatgactgagccactaacactcattgtcgcttttggtcatatcagtgggatttgaagagggcctttcagagacctgtgctcaagccatcatcttccattgacatctttaactcttatacatattttggcagcagatggggggaattgtgccaggcatgttcactttgtgtgctcttatttaatccaccacacatccctttagagtcttttatcatcattcccatttttcaggcaagtaaactgaggttcaaagagcatgttttaagtctgtacagctagttagaagtgaacccagtaggacgcagatcccaatttttctaataaagtatgctgctttttccaccaccctgcctggcgtctgcctaaattatcatgctggggagaggcacaagtcaactccagtctttgatgatatgtgatcttgtcactttcttgctgtgtgaccttgggccagttattcagtttctgcttcggtaaaatgggaataataatatatgtgcttttagaatttggagagggagtacatgtcagggctttcaaactcagatgcctttaggaacttggcagatggcataaatatgtgaggtggcctcatgtaagattatctggagtgacgggaactatgaaccctgcagagggcctgctctgaagacatcaaaatctatttgttaaaagtcactagactgactatatgcccaccagaggggctaaatgaaaaaaaaaaatgtcaaagatggggtgaaattggaattttcatagatggctggtgggaatgtaaattgtattgtataacatctttggaaaggcattttggaaaacacacacattctgacccagcgtttcaactcttgagtgaacacagaaaccgaaggaatacagatgcccaccaaaagttctatatgttcaagaatgtgcaaaatagcagcactaatcatagccccaaacaggaaactaccatcacctgacaatagatgaatactttgtggaatgttaacacaatggaataatacagagcaatgagaacgaagaaacaattacaggcaacaatacggacacatggccatgaggttgagcaacagaagctacagaaggaagaacataacactgtatgatttcacaggctgaaaagtacgataaacgaacccatgctgtggatagaagttagaggaagggagtttgagaaggccttctggaggtgtttctgctgtttactttgtgaaaatcaccaagctccacactttggatctgttggttgtgtgaagctacatattctttaagccacttttattcttgaaagaagctttactgatataagatcagttgaagtttcaatcaaaaggtggatgtgaccaagtaaaggtataatgcaggaatgagatgcagaagacagggagaccagtaaggaagcttataatagagtaacagaaagctgaacccacacgttgaaaacctactatgtataaaatagtcatctgaaaatatcaattactctcctatcatctgtaacatctttatcaatacagttttctttaaacaactaatttttcaaataaaaggaattgtccataatagtttttatgtactagctattttttaaatatacaataaataaaggattgtttccactttagattatgacaaactagcctttatgaattaattctcctgtggaaaatgactagtagcctggataaaaaatatttcaaaattggcccttgagggttcaggatcctaaagaaaataggaacacagagacattctgtgacgattttccccttgagggacttagcgattcataggtggcaggtgtgagtgttaagaagccaataagaacttttggtagcctctcaggctgaggaaaccgagtttgaggccttgcaagcaacctggcttttcagctggaactgctgaagggcccgaggcataagaggaaaacagaaatcaatctaccctctcaatgactgaaaccagcattgaatcagcctaatgtgtgatcccgataaagcgcattcccagtagcctacttaatattagttcagagacttctttctttccttggatcccgtaagtttgctctctccagaggcagatgagtggtgaggaaataaccacaatccccaatgtttattaaacatttgttatgtgtcagattctttctactacactaaaagagattacattataatcccaattctctgctaagaaaaccgaatctca

SEQ ID NO: 44298 - DNA, 859 bp, Bovine  19866881187641
ctaagaaataacatggtttgccatgtaagtggagactaaaaaatatagcttgtttcaatgaattttttgtcatggacccttccactcattgttaaacttttcttgtcatgataccctgaagacactgaaatttagacaacaaacagcaaaaacattttttatcttggtattttctttgcataatttaatctttccatgaattgtcaacttttgttttctgatgtattataggtacatttaatatacatttcttttatcccagggattttatttataagagcctttattttaggaattccctggctattcagtggttaagacttaagagctttcactgcagagggcttgggttcaatctctggtcagaaaactaagatcccacaagctgtgtagcacagccaaaaaaaaaaagagcctttttttttttttttttttaatttcatggtggaagtataaaattgttctctccccagcctgcggggaaaatatttcaagttttgcagatgtataaaaaacacaggcttgccatattaaatttttttaattgtccagatgctccaaaatccatccgagtttgcacagtctgtaaaatctctgctggaagcacagaagcagtccattgagtctggctccatcgctggtggggagcacctctgcttcatgggcagtggcagagaggaagaagacatgtatatgaacatggtccttgcacactttttacaggtatgctgacagattactgcagtttttctttggtttttgctgtcacttttaagaaattctcctaggcaattttgggctgttgtctaccttgttaaatttctttttttttttaaacactttattggtttgtgtcttg

SEQ ID NO: 44299 - DNA, 4384 bp, Bovine  19866881191447
cagactcttgaccctgtgcccctcggaagcccagaagacagtttgcagttgtgcttgagctaaggatactgacatggggagactgtactggattatttgtgtgggcctaatgtgatcataagggtccttataaaagtgaggcaggagatcagaggagtaggggggacgtgtctatggaatcaagaggttggggtggtacaaagaaggagttgtgatccaaagaacgcaagcagcctctagaagctgaaaaaagcaagagacacaaactgctaaaagtcctactgacacctaactttgagagctcggacctctagaactgtaagaaaattaatttatgttgtttttagcacaagtatggtaagttgttacagtagtgatagaaaaccagtatattaataccatggactagcaatgctctggtcatctgaacgattgtggtttcttgagcttaggtgacctgtccaggtcagagagctagaaagaaacagcgctcacacaggaaccaaacccagcaacttcagactctgggctctcgccccttcagtccacactcctcagttatgatgttgattggaaaaagtcatgaagacatctgttacatctcagtcttgtttgtcagcttataaagtgctgtattagtcaaggttctccagagaaacagattggagatgtgtgtgagtgtgtgtgtgtgtgtgtgtgtgcagggagatttattttcaggaaatggctttcatgattatgggggcttggcaagtgcaaaatctgatggggaagactagcaggctggatatttaagaaatagtcgcagttcaagccagaagaccgtctgctagatctccaggaggaattggtgttgcaagtggagcccaaagtatgtcagctggagaattcctttgttcaggggaggttagcactctgtactacaggccttccattgactgcatgagacccactcacattatggagggcaatctactttactcagttgactgatttaaatataaatctcgtcccaaagcagccttacatgcttgccacatctactgagcctgcatgttctagagcctgtgctccacagctagagaaagcctcaacgaagatccagcacagccaaagtgtgaataaataattttaaaaaacagcctcccagaagcatccagaacaatgtttggccaaatatctgggcaccatggcccagtcaaagtgaaagtgatggtctctcagtcatgtctgactctttacgaccccatgaactgtagctcaccaggcttctctgtccatggaactctccaggaaagaatactggagtgtgttgccatttaccactaaagggatcttcctgacccagggaccaaacctgagtccctgcattgcgggttaattcttcaccttctgagccaccagggaggcccaagtaaactggagtaggtagcctatcccttctccaggggatactcccaacccagggatcgaacctgagtctcccacattgcaggcagagtcttcactgtcagagccaccagggaataaaagtgtagagttaacctttattggaaatttaaccaattacacccctgccttatgtgacaaatccacgatgccaaggataccaaaacgagccagctggggccatggtctcaagggactgttctcccatgggtctctctgtccttccaatcccatttgcccaactgagcgtggatcccacactcgcctaatgtgggtttcacgcagcttgctaagatgtcaatctggcctcaggactgaagagagactatgccccactcaggacagcatcagcctcccacccccgcagtgtgatcccagaaccccaaagtccacactaggcacacagaggcgttcttaaattgataaaaaacgtaatccttcccagcctgcactaaagtctttgttgcaaagcctgggttttcagctggtttctttcatgtagaggctttattaaccaagtgttaataaaggaaaaccagcttcagacagctgctggtggttttccttcacaggaccacgcggcagcctgcagttgtcaacatttcagcctttggatattcctaagtggtaggacagaagagcagatttcttgcggcttctctactgggtgcaacacagggaagcccatgcccctttcttgctgccacaagtcactcacgcgctcagcccagggtcccactcctcagcactggctcgtgactctgtagctaaatcagccttaatttggcaaataagcgcagcaccttgaagtctttatctctactaaccaggtttcacagagaaggcaatggcaccccactccagtactcctgcctggaaaatcccatggatggaggagcctggtaggctgcagtccatggggtcgctaagagttggacacgactgagagacttcactttcacttttcactttcacgcattggagaaggaaatggaagcccactccagtgttcttgcctggagaatcccagggacgggggagcctggtgggctgccatctatggggtcgcatagaatcggacatgactgaagcaacttagcagcagcagcagcagcaggagcaaccaggtttcaaaagccttcattctgctttcacctgtttacagtgtccgtatctttgacacttcttagataaatgcattataggatgagccatgttttatctacactcctccctgcccggccccccaccagttcccttaaaatagctagctatctggtaaatgattagaagaaagaaggtcaaattatgagatttggattgcaatgactcagtagcaagcaaaacttctttaggtgggggtaaaacttttcctccaaagggtcaggcttgtgcaatgtccccattgtaatcctgtagcaatcagcaagatgactcagagccactctgacaaacgtagaaactcttcaaagtctggggagtgaaatattgtcttaccctgaatcttccttttctgattagagtggagcctgtctcctgcttccagagacaggatccagttttcttattcattctcaccacagttagaatggaaaaactgaagtcattgctctgatggtaaggaacatcttgcggcacccacagagccagcagtctgcacagacaggcgtgggggtgcttttctgtatggaaagagcttcactccactgaaacaaatgatttttagtgcaggctaacatggcagaaataacttagagtctgtcaatttttttttcttttttgtttataaagatttctctgtttctttcttataatcaacatccatgggttgaccataaaaatatattcctgagtttgaggtcaggaactttcttgagaggtcggggagattccaaatggtttgtggaaactagagccacaaaactccacaaagtaggttggggtggacaagacaagcagtacctcggtttagggaagatgagcaaatcttttggatttccatctttcttctaaagctgaaaaataagctctcccctgatgggggagaaagaggggaaatgaaacaaagaattgaggatgtatctggtccaattagaagtcgctacctacattactgcatttcatcttcacaacaaagggatgagacaaatctgttaccgtcccatgaatcacttcccttacccttcttccctcctgtcaaagcccaccagatatattctttgcctttgggtaggaatggccaagggacccagttctgactatggggcataagagaaagactcttggtggaactgggaaagggagagctctcttgtcacttacctgccacctacttcctttatataaatgcggttgtacaaggacatgaggggcttccctggtggctcagaggttaaagcgtctgcctgcaacgcgggagacctgggtccgatccctgggtcaggaagattccctggagaaggaaatggcaacccactcctgtattcttgcctggagaatcccatggacggaggagcctggtgggctacagtccatggggtcgcaaagagttggacacaactgagcgacttcactttcactttcacaaggacatgatccctggaactgtggcaaaaggtaaaagatttgagggctctaagttttcatactgaggatggtggaatgaaggatggaaagagcttgattcttttttataaattatttttatttgaagaatagttgatttacaagattgtatttgtttcagatgtacagcaacatgattattatatatacatctatatttttagattattttccattataggttattacaagacattgaatactgttccctgtgcttcacagtaaatcctgttggttatctgttttatgtatattaatttgtgttaatccctacgcctagtttataatctttataaccattcattatctt

SEQ ID NO: 44300 - DNA, 698 bp, Bovine  19866881223250
ggatgtagtaggcaagagaagaaaacagacaaatcatagacgtgggaatataagatatgtgtgtgtgtggtgtatgtcagggggagggtatttcttggaagagtaatcaagaaaggttggatttataaagcagggccaaactatgattaactttcagggacattttgcaaagttaggattgcaagcatttgcagagagggtatttccaattttgcagtgtgcagtagattttgtaactaaaactttttcctgctgatttcaagataagtttgaaattattctgtttcattttacactgcagtgttgaggggctatgccgtttgtggagttctgtgaggatatgttcagtgatcattaatttgcatttgttaaatttgtgctaaatgctgtttcgcagtcactgtgttgggagcttggatacagttttaacactattgacttgaatgagggttcggcttctcttgtttaaattttggattaaagctcaatcaacagactttgggtggtctcatcttcacccctcagagaagcagatccatatgaccaaactccttaacaatttggcaagatggtaggcttctctcatgagacacccaagacaagaatagcaggggacattagaggtcatttctgaggtaggttgccagaccatggggggaaatttgtccaaaacttgctttcactctcttcagccttag

SEQ ID NO: 44301 - DNA, 947 bp, Bovine  19866881239861
tggccaagatccacattaaatgttttatgtggatcatctcacttaaccctcacaaaaactctttgcaattggtattattatcatctcaattttacagatgataaaacatggttgattggggcctggaatctggggcttctgagtccaagtccagtgttctttccacattgttttaataatagagtttaaaaagaacaaagagaatgctaaagtttccagttcatttcgtatcagttactttcagacaaaaataaagtaagaaagggaccatgaaaagaaagttaaatttgcagcctcttcccaaaataaatacttacaaaaatgcagcaggcaaaaatatttgccaaactcttgagccttcgtaaatttcaatatgttgcaatcccactatactagcagctaaatgcaaaattctacttttaaacctgctactgaccaaaaaacaaacaaaaaagttttttaaaaagaaaataaagaagactgttgaaaggcctgacagtgtggggtggcctacgtgactgataaagctcttcagtttccaaaccaccctagttgcagcttggttggtcactggctacatcagagttgatttctactcagcaagcacttaatgagtgcctactgcatgttagatgttgagtgatacagtgaagaggacatttattgttcctaccttttaggagattatgaactgaaggcaaaggcagataaaagagattaattctagtgtagtcagttccacaacagaggatttatcctggtcttgggaatcatcagaagcttccctgaaaaaaataataacatttagatgaatctcaatggaatgtcaaagatcatctgatgaagaagtggcatgaggactcagggaagagagaacctaggcaccagaaatggagtcactcagaaacttggaagtatctgcatgagatgaaggtttccacaatcta

SEQ ID NO: 44302 - DNA, 1654 bp, Bovine  19866881267023
attatcaccatcattttattaaagaaaggcattttaacactaaaaatgggaaaaggtcaccgtctcagaaaaataaaaacgtttctcaaagaacagtaagtaagcaagcttgaggggaaggccagaaggagcaggcttgttagaaaacagcccttcctgtttgtctggtacagagaaccttcttagaagccagagcagcccacccatcacagcttccctcacatctcaaggttattggagtgagtcccccatgctgcctaagctgaggagacatgcttgccacccttctgtcttagaggatgccttccatgagagctggccataggccacactgggcatgtcctgcaaaatgaagcttgcccacacctggagtttgttgctcctcatccaaaggtaccacacagattcttctttatgttccatagcctggggtactgtaagctccccttgaaaagagtctggttgagttcttgtcatgcagaaaggctatggaggtgtggggaaaagcctgagcaggagaacgtgggtgaaactagaaagtggtatacacactttgtatcatgtgcaggaatctgtccatggaaaggtttttaggtcaatcaccggtatgtgctccagtgtaatgctctaaaatcccaaaactagatattatgtgaacataattcttgaaatgtaagtcatttcttatacttattaaattcattttaacattcaccttgattgctcatgacaaattcattgtaaaatcaaagcctgagtggttaaatgaacttaaaaaaaaaaaaaaaaaaaactattttgatctaaattgctatccgtagaagtatcctaactctctcagtcctaagagtgcccaatcccatagtttttaccagaaagtggtaaaggaagtacaaggaatggatttagctccacagccaaagctttggttatgagaactggtcaattttaatccatacaagatcatccagaaaaggcagattgcatagctgcccagatccctgtgtaccaatgacatattgatgatcagtttctacagtaatatggtttatttaatctggtaacatttggtagctgacatattgcctttcaggcttcccttgtagctcagtgataaagaatccacctgcaagtacaggagacataggttcaatccctgggtcaagaagatcccctgaagaaagaaatggcaacccactcaaatatttttcttgtctaggaaatcccatggacagagaagcttggcgggctacagtccgtggggtcacaaaagagttgggtcacaaaagagttggacacaacttagcagctaaacaacaatattgcctttcacctagatttattgctaaataacacaccagctagagggaaatgtaacaagaaagttgggaatgtgaaatgtggtgaggtcaggacacacacacccacatgtccacaattcacatgatgttgcagtttcttctgtcacagtgaccatgattgccatttctatcaccaccactagttagaataaaaattctcaaaatttggtgcaccattcagctatagagctaagtaggattattctaagctttcggcccaagttttctaaaacctagctgattaaaaggcattaatatttatatattgccaacactgattatacttgttgctg

SEQ ID NO: 44303 - DNA, 950 bp, Bovine  19866881278980
catttgaattgggtctttcatcttttcctgttatccattgcctctagctttttcaatttttttggtatttgtgctcaaaacttatcattaaaaaaaaaaaaaaaaaatgtcctgacagctttgaaatggaaaggtccaaatctcagcatgagacttttctctcagaaacttctaggtgaaagccatacacactgggtctcaagtacctatagtttcagttgttacatcaagcaattgtgcttcttgattcaagtgttcctggttcagattttgtttcatgaaacttcattcacagcacttggcatgattaggagaaaggatcaatagtgtaccgggagaaaaggatccttctctcacagatcacgtagaaatagcctaagagaggtgctattcctctgaaagagggatacaatttttccaaaaaggaagttttaatttaagaagataattttcctttaacattttttgtttgaaatctgatttacttgctcaatgtgctttcagatttctaggttcctttctggccgagttccttaacagccactgctagaaatatgctttgaattttgtgttttgagaaatggatcatttgtttagaactgccatattattttgttagcaacataactaaggacagtgtgaaaactatgtttcaaatatcagcaaatatcaaagggcccaagatctggaaattcctggacatcacaaatttggggagtcccttccttcttggtctcctgggtggtcactgaatgagtcagatgtccttttctcatatctaatgcattcttctttttgtcagtgactattgccatgaaatataattatcatttctttttcctttattcttgttgcacactcatacattgcaatgccaattgacgtttcaagggtaagttgtttgttttgctttgctctctggtctggaaatagaaaatgtaagatagatg

SEQ ID NO: 44304 - DNA, 1854 bp, Bovine  19866881348738
aaatttacttcttagataataaatgaaagtttctttagtatgttgtttctactttaaattctaagcagcagagttaacagtcaatctccatctctcctcttctggtttcagttactaccatagtaataataaccaacaaaaagataatgttttgcattgaagtcctaaattcaattagcaactctacaactttttatatttgttgactcctttgatgaagacatgctctatgttctccaaagggacagttattcaggattaagatgagtctaacagctagagtgtaaaccaccttaagaacaaaatagaatatttttgggaagtagtcagtcatcattataagaaagaattcactatgtgtacatttatggaacaaatatatatatatgatgacaaataggggactgaaaattaatgtcctaagaaagttctgctttggcaagttttctaattcaatttagtatcatgagttcttgaaatatcacctaagattcttcaagcctatctttgccgacaaggtatcgtctttcaaccagcagtctgaagcaagatgtctaatagcctgaaatatcctttccatttttgaaagcttcaaatgtctccacactacagaatttatgactatccatgatatattccatcatttcccctgtattttttcctggcattaatgttgaaagggtgatttaaacattaagatttatgtgtcatttagagtaaaggcagtcagtttgtcatcagagagatgtgatctggctgccatctgactgaagtagtgagtttcctttttagtgacaaggcaaaaagaaaaaagtgaagaggaccatagaacagcattattgaatcaactctgaacaacagatatgcggagtcacttaggaacagaaaagctttggttttggtgtcagacagacctcagttctggtcctgagtctctttaccactgcataaactttgactgagtccataactactctgagcttcagcttcctcatcagtaaaatggaaagaataatagtgctgttgtaagatttaatgtggtaatacacatatagcagtaagtaagcacagaagctgacatatggcagacaagtccataaaattgtatgtttcattatcaaaatattttataagaaataagtaaaagtcactttttaaaccttctaaccactaaacaactctttctcaaaatgtggcataaggaaaatttacatcaacatcagagtgtgaggtgcttattaataatgtgcattctgcctcccacacagatctccttaattttcttaattcatttatctactgaatgaattaacaagtatttctacacccataatacatgcctgtcactgtctgccattgggagagcaatgatatgacagataatttccctgccattatagaacttacattctagtggggaaggccgcaaataaataaataagcaacaagtgttataaactaaatagattgataatatagggcataatctgggaaggtcaccttagatagggtggtctgtcaaaacctgttcagaggaggtggcatctgaactgagacttgaaggaggaaattgagaccaccatggaaaaagataggggaaaagcattataggcagaaagaataaaaaaattcaatggcctacaagtctgaagtcttggcatgttgataaaggagacagatgtaattggaatctagtgagagagaagaatggtaggaaacaatattggggatgttagagaagaaagaaattattccccattatgccattcatatccattttcttcctactgcaaattcttcccatctgggaatatcttttccagaattaaagcggtctctttttctatacaagaa

SEQ ID NO: 44305 - DNA, 1529 bp, Bovine  19866881479001
aaggaaccggttcctccaggaaatttggaaactgtagattggttaacttgtggcagcacacagagacagcacacactacaaacggttaagaagagttcagctaaatagttaagaaattgctaaagaacaagtataggttagactgagagtatagggcttttgggagctccaatcaccagggcattcaaacccactttccaccaggtgctcatgagaaagatgggggaagggtgggaaagaataggagagaagaagaagaaaacagtcaaaatcctccccctccaccatataattaaagacataaaaccacaggtccaagaaacttggagaaccctgagtaggataaataacaacaactacaaaatcatatattcaaatttcccaaaattaaaaataaaaaggaaattttgaaggcagccaaaaaaaggaaagatagtatatagagaggaacaagcataataattgtaccaaacttcttgccacaaattatgcaagccagaagacaatcaagtgacatctttaatgtgctgaaagaaaatcactaggctaagactttttcttgggagtctagcttagatcctggagaagggaatggcaactcattctggtattctttcgtgggaaatcccattgacagaggaacctggctggctacagtccatggcgtcacagagagttggacatgactgagtgtccacacacagcttagatccaacaagagtcctactagtaatctggctgcacttctcatgaggagttacttttcccaggttcattgtgtctatatatttgctttatatatttgctttgggcatggcttaataatttacctaaaatatccaataaatagacaacaccatagtgttgatgttgtttagtcactaaattgtatcagactctttgtgaccccatggaagacagcctaccagattcctccatccatgagatttctcagacaagaatactggagtgggttaccatttccttttccaggggatcttcccaatccagggatcaaacccatgcttcctgcattggcaggtgggttctttactgctgagccaccagggaattcatattaccatgttaccattcaattgtattctatatgtatggtttcttatgattgctttttagttataaacagagatgagtagtgtatataggttacagtatctttgtactatcctcagatagattaaaaacagcacatactgacagagcctcaccatgttctacttctaagtgtttcatatttaataagagacactatagtattactgttcacatgctagcccaaagaaaatatacattaatatatgttgttgatttttctaacctttctttctacaactcactgcatatttgatttctacatctgagtaagaatgttacttttggaatgactctgatactcagattgctgaaatgtctctttccctagactatactatccaaaatagaactttcttcgtcttccatgtctcccgatattacagtcactttctatctgattactctattttatt

SEQ ID NO: 44306 - DNA, 788 bp, Bovine  19866881569578
aatcgtatctattggtaagcagattcttatggcccccacccattggttactacatactgtgggttaattggttttataagtagttaagttcttattttcttacagtttcagaaactgaggcttccctgggacttgggagttagagttgattttcctagcacaaccttgccctatatacagggtgttgcccttctcatccactaacctagcataatattttccaccttcctaatctttgtactaacataattgcaataaattgctgctgctcttgaagataatctctcttctcacatctgggtttaagtctttctttaagtaaagctacttaagcaatggggaggaaagagcttttccataaagttaaggtctttcctgataaaggtaactactccacccctccttcccagttagatcccctgccagcaatagcatagacttgagttagtgccaaatgttttaatgccataaggactcacttgataaaggctatgcatggcagaggaaaaaacaaaattcccaaactttattttcaagatttccatatgagatgcagttagggcacccttcatctaatagttaccctgtgtttgccatagtcattggtaccctgcaattctcattcttcagctcttctagagattagaaattataggaagtgctagccatgtcaaaatgcatgtctactctagctacagagaatttgacagaaaggcaaagaaggaacagctgtgagattaatacctgggatcactccaaataattgtctgttagacagcagcactcaa

SEQ ID NO: 44307 - DNA, 1591 bp, Bovine  19866881593469
aggggaaagaatgctattaaaataacttcgggtatctcgggactcctaccaggaatcctacaggtcttttgattcaggtacagaagcagtaacattaagggaggtcaaggtgctgttctgttccgaagaggagactttccgtaggtccgcgcatccctcgtcagcccatggtgaaccagtgccaagtccactaccagccactgggcttcaccgggcctgtgcgttctttcttgttcctcaggctctgcctgcacgctggtaggcctggctctgccagaatgttcattctgttgctgtggaaaggcctgcagtttcaacagttgcaaatcctgttacaggaatagcactgagcctaactgggggaagggggagcctcctgtgcctcttacgttgagcctgagtattcaagagtccttcaaaacatcattctccatttattattccgttggcttcatgggtgcttctgtaggacagacataggtgaggaacatggagaaactgccaaaacccagggggaaggaaagtgagagagattccatgctgcctgagtcagctgtaatgggtagaaagcctaaagatcttttttcttcagtgatcatcatttgttttcatttgttcccatggttatcttcccctgtccaattgttatttttctactactttttaaaaaagcatcagtgagtgagccttaagaagcaaagaagattgaggtgctctaccagactctgagaaaattcaaagtttgcgactaaggtcccacctctgagctcatgtttttgttttgtttctcacctgtatttggctgatgatctgacaccagatgcattgtaaccattggaaaggcagtacaatctcttgcttcctagattgccactggcatttttgcctgttgttagagtaaccactggagaagcaatggcaccgaactccagcactcttgcctggaaaatcccatggatggaggagcctggcaggctatagttcatggggtcgctacaagtcagatacaactgagtgacttcactttcacttttcactctcatgccattggagaaggaaatggcaaccccactccagtgttcttgcccggagaatcccagggacgggggagcctggtgggctgccacctatggggtcgcacagagtcggacacgactgacgcgacttaccagcataccagcagagtaaccacacttttccttgagtttctggtgttttatccattttgaaataagaggagaagggacaagaaggaattgatgataaagagatgatgcctgaaaatggaaagttcacagatgaaagtgcagtacgtgtgaccttctggctcaagccaggtggttgggtgtggatgtcctgtgtatcccccatgcagttagcactgcagtggtaattctcccaacgcagccactctggagtactgttccttgtttttctatagtgcttgtcagaatgctatgacaactggctggttttatgcaaacagagcctggctctcaagagacagtgtgtctgaaagtcaaacatggatggcagccattggcacgcaaaggagtcagaagccacagatgttttctcgtggagaacagct

SEQ ID NO: 44308 - DNA, 926 bp, Bovine  19866881644481
ctcttttgcatacccagcatctaggctaatacttggcacaaacacatttgataacactttgacatatgaatgatcaaacaccaaaagataagtgtatgttccttgactattactttagactatgagctccttgacaaaaacatttaattataggacaaggctgcccggtggtgatgctttcctccaagtgtctccttttggattacccaaaattatttttccttcataaacttagaaaattttcaatctgttacctaaactttcataaatagtaggttggtgatcctgtaccaccaggaagatagattagatgacttattggaattttccagcttcacagcacaatttcaggagcattaataagtaaatattatactaactggcaattcagacagcagttataattttagtcctctttgtcatcactgccttcatttcattcttatgaaaatatcaatgtgttttgggaggtcttagggaaatgaaccaaacctatttagctagaacaactcaatcctcctttcttttaagtccatatccttttcatctgtggaccaatgtagaaaccatttccctcctgcaaaggagcctgcctttgccaagccaaacagcaggcacaaaggcaaatggagcgggtgccctggctcagcctctaggccctacctttgaggactggcaacaggcgtcttctcccttcttccaacaccttccacatgatgctcgctgacctccagtggcagttccaagttctttcacaagtactcatggaggccagttggatttctcttgaacagtttaaattgctccacctacctagtcaagaagaaattcagaagttacgaaagttctggaatcaatggcttcttttttatacagtcgccgactaaaatagcaaaaacgttaagcagaaggaatttcaacattca

SEQ ID NO: 44309 - DNA, 1523 bp, Bovine  19866881667781
aagtttaaataaaacaaagtaatccaacccaaagccagcattccaacccaggggacaagcctggagaggggcaaagccaggtcccctggggcgttctccacaccacctccctcatcctggaggaggcaatttaactttacaactttcgagaaacttcccattagaagtggttttaactttagatttattgcattttccaaggttacgtcatttgggctgtgcacaatccagagtgactccaggggctacactgtaaactgttacaataaatattaacgaagagtaggcctgataaaacctgtaatctgcacacacgcacccacacaaaaagggacttttcaccttatatggttactttaaaaaatcgacgctttttccgttccactttgttggtctgccaaacacgcagagtacatctactttaaaaacaccaattaaaaatattaacaacacaaaaatacataaaccgtggttcagagccaagggcacataaattgacatggattcggatggtaagtaaacataaaatgagtaacagaaactactacatcattcaaaaggaagcaggaacaatagccctacatgtcgagcccattccttcccgccccccacccccaccctcagtactccaactctcccactccagagggcaaggtaatgattaggaggcaggcaaaatgattgaatgagggagggaacgaggaaagacctgtaggaggtggggagaaaagcagacgcaacctcatttcacactgtaaccttggacagccccatgggcttttttactccttactagaaacactgcatctcaagtgctcaaaccctcaaacactagggtggtgtaactgagaagcagccgtggagagaaagctgggttgggagttatagtctttggattggcaccactattagcatctagttcctgtcacttaacttttctaagccttatcgttgttgttcagttgctcaatcatgtccaactctttgcgagctcatagtctgtagcatgccaggcttccctgttctttgctattcctcatcttaaaaatggggatcctaaaacccacctcattacaaccttgataggaataactaaaaccagatatgcaaaagtgaagaatctagctagaaaaatacaaatccctcaatgattccatttgtctgttcaaacagaaaagaactgtttccttctctggtacctgacaggctgagctatcactattttttcaaaactgaactcagcccaggacagagtgaagctcatcagtataatacgagaggcatgatgctatacacaccgcagacaattaatgtgtgatgataggagacagccagaagatgaaaggtgaaggaaagaactaggcataatcccaacatttctttctgcaagaggaacagacatgagccctcaaggccttttccctgcacttcctaggggtggtctgagccttactactaccacagtgaatgagcttgaggtctcagccagagaaccacgttcaatgttcataatcttactgctg

SEQ ID NO: 44310 - DNA, 1141 bp, Bovine  19866881832947
tatgtaaaaccaattttatatagctcctagatttctaaattgaaaactgttcaaagaaattatctgttcacatatatactagtattccctctgttacaaattcaggatttttaaaaagaaaatgatccataaggatcatagaatcataaacatgataagctaaaggttttggagaccacctattacttataaaattccccaatagaaaaggaaactgggttaataagccaaatgctaaccttcaacatgacggactcaaatagaaaataaacctatcagcaatttgcttatgaccttttaaaacatgttgcagaatcttgctcttccattgaagtttcatttcccactaactacaaaaaagaaatcagatttgacatcttataacttgcacatttaatgtaagaagccatgtgtacactcagagattttttgctaattctgattctcatatatttttattactattttctcatccctaaagatctttttcaaagttgtatatgggaaatgtcgagggtgataagaacatcatgagcacaaaggaaatccaagtagatgcctctatgtgcccattggaagaaagcaaggactagtgtttgtggctgcatgtaaagaattttcactgttgaaatcactgtgatatttgaaggggaaaaagtctctaaatacctaagtagttttagtgaatgtatcataaattacaccaaccggttttgccctcttcctatagagataatgtattaaataagtaagcatgaacatacattagaatgtgccagcttatggagttcctttcacccaaagaagagactccatttggtaactgctctgcaccaaataaatccagatatgaaaagcatatctttcagtaaagttgaagggcagatacaaaacagcatggaagcttatctgtcaaggaactgcagaatcctaaagctcaaggccatcttattcaaaatcctctcttcaaaggtgagaagcctagagaagtgaagtgccttgctcaatggcacagacagtaaagtgtggtttataaccagaactctgaaggtcaatctactggagttctctactgattcttttattctgtgagaggacataggtgagggattgttcttccgaaatcagaatggaatcccag

SEQ ID NO: 44311 - DNA, 1589 bp, Bovine  19866881835633
atgaggaaaagtgttctgcttttagagacctatcttatcctggactcaagcagataatccaaaatgatctccccatcccagctttcttaactgcatcacatctgtaaactacattttgccacataaagtaacatgttcacaggatctggggattgggatgtggccacatttggaagcccacaattctgcctaccacagtacccacctattaagaatatggaagagtcaaagtatcaagaaacaagagtgtgggactgtcaggagaataacctcattttaatacactctgcactatagcagcccaatcctgtgttcagtggctcttgctctgagacccctaaagggcaggctcagtggtctaaataaaaaatgatagacctgtactttgcttgaggcagagaatggtatagacagtagtgcccatgatgacctgagattaaccctttccatgtacaaggtagaggcttgagtgaacaggtgaatgaatggaggtaaatgaaatattgaccaaataaacagaacttgaccaaagtccggatacaaaaggtgattaaagagagagaagaatgaaaaaagctgacaatcaaggaagcagctagaagttcaagatcggacagtgaagaaagcatggaggaggattgcatgggatatcttccccactgtgctctgaaatttcattgtttttcagaatttctgttacagagctgtagggttaaacatactggcaaacagaaagcgagagatgtttgagaaaatatattaattatatgtttagaaaaagactattgggcagatgtttttcagggaaccaaaaactagacataacatttgtgggaaagaattgggggaacttctaattaggagcataggatcatttttaaaggagattttatcttcaaataaatctgaagagatagaaccatgttttaattatgaaatgatggctttgagcatgtgtaccctagatctccccagccagaggtttgctgcatctgggtccactgacttagtaagatgtggtggaaactgaaaactatactaaataacaacccctgtgggcaacacccgattaaatttctttctggcttttgcacaatggtggcaatggctataatccagaacataaacaaaaagtcatatggaagcaacaaacacattaacaaaaaaacttttttattattcaccagtccaaagaactttttgtctaagactttgtctgtgacttatttatattaatgagtaactctacccatgaacataaagcacagatgactacaaagaggcagcatttacgtagtctaatgattcccatgtatggatgatagatgtgcatgccaagtttggcattccatttcagaaattgatttaataggatggtgacaagtgaagtgtgtacatgggcagtcccatgataacccagacatttctattctcatctctggaaaatcaagtcattcattctccattaccaacgtgtttcagagcaacatgtaaataagtggcaaactgccacacactgaatttgctaaaatcagtcccatggtataaatagaaaccagagctataaccactactaatgcattatgcta

SEQ ID NO: 44312 - DNA, 515 bp, Bovine  19866882182272
actgaatgaaaaatatgttgggtttaagcccctgtgggctttccaagtaaataaatgtgacaggcattggaagagactctggactagaaatacagatttggaagtcaccccttatcaatgatatttaaaatcaagagctaaagaaattatacaagtagagtatgtagaatgagcagagtaaagtaccagtggagaagccttgacaaatgcattcaagggcaaacaaaagaagaggaaccagacttccctggaggatcagtggtaaagaacccgcctgccaatgcaggggtcatgggttcgatccctgatccaagaagatcccacatgtcatggagcaactaatccaatgtgccacaactattgatcctgtgctctagagcccaggagccacaactactgagcccacatactgagcccacataccacagctactgaagcccgagcgccctagagccagtgctctgcaacaagagaagcccccgcaggtgagaagccaagcaccacaactgggagaa

SEQ ID NO: 44313 - DNA, 1484 bp, Bovine  19866880417721
attgactgatttgatctcctcgcagtccaggaactctcaggagtcttctccataccatagttcaaaagcatcagttctttggcactcagccttctttatggcccaactctcacatctgtacatgattactggaaaaaccatagctttgactagatggacctttgttggcaaactgatgtctctacttttcaatatgctacctaggtttgtcatggcttttcttccaaggagcaggggtcttttaattttaaaaacagatgatacttgaattggatcatgaaggatcaacaggaatttgacaagcagaaaatgctgatctctgagagaggtgcatgtgccagaacgaagagtgtcagcctttgggagccacagacctaacaagacacagtggggagctggtcagttcccctcctcaggacccaaggagaggggcaaatggggaaggggcccacgagccgtgtggggcagagtgaccctccaggaacagacaaaaaagcagatccaagctgaaggtcgacaagcatttctgtgtgacctggtcctgagacaccagcttggctctcacaggagatcagctgcgtgtgggatttcctctgagagtctcctaattgctttgcgggtctaaacatcccccatggtgctgtcgggatcgctgtggacagccaactccattctgctaaacaaaaccagcaatttggaaaaattacagccctggatgctctcgctggcaccacaaggacaccctccctgctaatggctaaaaaagagaaaaaattggctggcgcagcagagcaggaaggcctccttgtcaatgcagaatgtggtgctctactggaaagcaagtgagacagagcaccatgaacttgcacgagctaaccagatggtggcatcttacaaggcggtggctctttctttttgaacaaaattgggaccttccgtcctgcagtgccaatgaaccacatgtaagtgctgatgagcactgtgtctggtatggccatgccctctgaagagctggacctcatcagactgggggctcctcctcccagggactctcagaaacacaggcctgtgagtacccgaattgtcagatctgaagctggatgctgagcgttactcggatttttgtctccctgcctgaaactggcctgtgatttcagtttctgaaaatttcagtttcacatcttgactcaaaagttcttccatttgatcctttcttaacattctaaacatatatcatagctcatgcttcttctccctcacacgtacccactcccgtgagtcttggtcacatatgtggatacagacaggtgctcaggcttcccatctgagacaggagcgagcggaagaataatctgacagacactgcatttctttcgtaacaagtgtaataatgctaacagcagagtaagcagcattctcttgttctctgattccctaaggggcatggctgtgagcaggtctcagtattatctcaacttctcaaa

SEQ ID NO: 44314 - DNA, 1661 bp, Bovine  19866880539978
atggtcctatgttatctatgttctgactaaagcactatttctgctaaagagagaaagaaaccaggccccttttccatgactgggtgctgtcagaatcattggcaaagttctcttaggaattccttacatgaaacaattagataagaaagattcagtttatgaaaaatacttgaggagatggttaattttttaagatttcatataaaacatcatgtgtttcaaaatcgttttcttcacatgtccatgaactattaggagctctttgagcaggcaatgttccttctcattcatccatgatgttacccctggaaatcggaaatgacttctactaacttcctcattattttcacacctgtgtatgggacccgagagtttcaccttctttcagactgagtaccatgtggctaaactgctggttttcattacactgcctgcatcgtgtatcccaggcttaacagcctggatataccacacagaagatggctattctgaccccagaaccaaggttcctttcctatcgggattgccttgttaaatagcacagatctatgtgctcatgcttagtttctcagttgtgtccaactctttgtgaccccatgggctataacccaccaggccacagaatttcccacataagaacactggagcaggttgccatttccttctccagggtatcttctcaacccagggatcaaacccacgtctgctttggcaggtggattctttactgctgagccaatggaaaagccccaacactcaaactcaagaacagagcatgagtctaatgttgtttgacacctgaattccaaggttgttgatttttactggtctttgatgggatctggaccatattcgagattgagaacaaaccaaaacttccaagtcatttcaagtcactactaaaaaataacatgaataggagtcatttactactatttatttgatgaactctcatactgcttcctggaaaaagttgacagtcacataatgatgacatgccctacgcttgggaattagctgtacttagtagagtgagttaaacccaattgcaacgcttaaagttatttatccattgccatgaatgccttgacttattggaacctactggcaaagcccatgctattctgctagaatgagatattttcaccatggtcaggcagaatagtgctgcaagggatgagaactgaatattcagaagtcttatttctcatgattgaggctaaggggactcagaggaccaaatcaattttctgacctggtaaatgacttaatatcccttcagaaattgaagacattataaatgtaatccattttaaacttttttacagtaggaataaagtaagaaatataattcctttattgggagttcttacaaaagaatcattatattttcaattattaagttaaaaattagcatattttaaatgaaaatactagttataacaaataaaggtgactggttgtaataatccactctcctattcataaaatcaaatttgttttaatacatttatgatgcttttgatgagaaataatgtcaaactgtggtgaggaaaagagatcaagattactgtttagaataaacactgttgtaagaattttagcatctatttagagaaagacatgccctagcacttttacaaaaatttaaggccagaatt

SEQ ID NO: 44315 - DNA, 1191 bp, Bovine  19866880649794
tagtgtcttgtaattttcagtgtatagattctttcacttcctcacttacatttcttttttataaaaataactaggaacaaatattaacctgctaattctagcaacagaaatataaatatttgaatttgtttgtatatttttcaaatttaacaaaatgttttccatataattatgaagattatttaaatttttctaaggatcaaaaataaatcttactttatgcttttttatatttgtgttttttggttcacatttgaaactaagctgatgatatgttatgtgagtttcctaatgaattttctcttcattgaattaatgaagtgataaagtaaaacctagtgagaccttatgtatttaagcatatttccattaacagacattgaattgttacagagaaggaagaacctatcaaggttctaaggcatatgcatgttggcttaagtggtaatgaatttattatagaagcaaggtttgataatctgtcctaatacatgtcctaatacagtcctaagaagctgtctttacaaaggcatgtggtcatacagacctcttttctggtttaggagtgtattttctaggcagggagagttgatacctacatggagagagaccatcatcctcttttgcccaggtatctatcagtctgagtcaaataaatagattgagaatcaggtgactttagatttagagcatttgcgttgttgaagccatactgtggagactctaaacttccaaagttcctgactttctttctggaaatgccctgagatggaactggggtccttctgtgtgacaatgtgtgtcaccggccttgtaaattaaattcctgagcattatcacctcccagctctatcccgcccacttggaaagattgaaacacaagtttgatactgcaaacaaaaagttccatcttggggcagagatgtcagcagatgtatttaaattcacaagacataaatatcatatcacattttcaaaagagccgtttgggggcctattcttctgtttcatttcataaattcccaaagacagtgaaagacaaagcagatgagcttaattattatcttctgcttgagcatgctgtgagaggagattagggggaggggagaaggaggaagaaatgaaaaatccctgacacaaatgagtatttagcttacattttgaaaccatgctgtttctgccagcttcagt

SEQ ID NO: 44316 - DNA, 1194 bp, Bovine  19866880989738
gagaggtaagttaaaagactgaaatttttttatgttttaggggtcttctaaagcatcagtgcacatatctgtaatgtttggagaaacatgggaaacacttgtctgtcctgatatatgacactgtcataatatggtaatgccatctgccccatactctttccctgaaattttatgttttatttagttcctgtacctgaatgcttaacaagtactctcctctagctgtatttagagattacagatagacatgcaatccacaccaggattccattgcaatctgcactgtctcgtgccctccacatgcagctgccggagagaagagctgcccgtgcttagatttatgctccctcctctgcaagagactacatgggcaccgctgcacccaccttagactaactgtacaattagcactgtgatagaaagtccctgagtgaacacacgctccctcgtgacatgattaactccagggactctagacaacaggagccagtcacaaagtgcaaactaattaactttggaggacaggaatgaggacaagggaggtcaagcagttggcatgctggccacagagcccagagcagcagaaatgaaagttcagctgaagcagtaggaatagaaactgcttcaaatttaattttgtgatttttctctctggttcttttgtcattttttctggactttatatatatatgcatatggagtggtaagagtacaggagtacgggatattgccgggagaaatatcaatcacctcagatatgcagatgacaccacccttatggcagaaagtgaagaggaactcaaaagcctcttgatgaaaatgaaagaggagagtgaaaaagttggcttaaagctcaacattcagaaaacaaagattacggtatctggtcccattacttcataggaaatagatggggaaacagtggaaacagtgtcagactttatttttttgggctccaaaatcactgcagatggtgactgtagccatggaattaaagacgcttactccttggaagaaaagttatgaccaaccttgacagcatattgaaaagcagagacattactttgccaacaaaggtctgtctagtcaaggctatggtttttccagtggtcatgtatggatgtgagagttggactgtgaagaaggctgagtgccgaagaattgatgcttttgaactgtggtgtggagaagact

SEQ ID NO: 44317 - DNA, 1418 bp, Bovine  19866881037311
aaatttttattaaattactctctcgcacaaataatcaacttggttattcaggctatatagattttttcagtaccttaaagggctaaatgaatgcttctcttatcactatgctgtctctgacgcatcagctggaagactacattctatccagaattattttggccgtgcagcaacgatataatgatcaagctgagggttaattcaatccatatatcctgtgggactggcagtaggagaaacaggcaaaatggactttgacaaccaaagcacaatttcaaaaattactaactacatgtataattttattaaacaacagtgtcaagcagctggattaggaagagctaataggttattgtttgtaaaaagtcaattaggaatcagtggcatttaataaagctgatttttcaggatgtctatcaacatcatattttttataatttgggaaggtcacattttactcaccttattaaaaagattctaagtatatgaattatgatgaaggtattcactgtacaaatgagtcatcagtgtgaagaccaatcattaatatttcatgctccctaatattgaggaaggtgtaagttgtatgctggccttcacacaccaccttattttcattttatttatactgcatttatactgcctgattaaattattttgttatctctctaaacatggcaactttatgcaatttaattttgactaccacatccacaatgtatttccttgatgatgtggtctaagaatctgaatatattcatcgaatcctaaaatgttgaacatttaagttctccttggtatcagtagctcccaatgcaagtatctttaatttgctaaatgctttgcttgtgtttcctaacagtcccaaaccacagaaccagagcattcacccaactgtaattacaattcacaaatcatcttttgtagaacctgatcaagagacattgcaaaataattttcagaaatgcaatttttatcaccttctttactatctatcaatataattcataactgtcattttaaagctttaatttcctggtggatattgcattattgcacacccaggataaaggattaggaaaagccacatcccttagcgtgcacgttccagcagacaggcgtctgcttttcagagctttgcccactaagctgatctttctcaatcccatgccatcctaaagctaatttccacaccctctttctcatgcccatccggaaagaggtgcaagagcttaaaactaggaaatcatcttaagtgaatttccatataatttaactcttgactgctctgctgttcttacaggttttcataaaaattgacaggtcaagaatttaaataaaataaaggtatatatgtgaagcacacagtatcagtcagcgttttgagttttttatagcctgattttcctgaccagtgc
